United States Patent 11,078,247 (RNA ENCODING A THERAPEUTIC PROTEIN) - sequence listing, part 14

SEQ ID NO: 26202 - RNA, 1065 nt, Artificial Sequence
  derived and/or modified sequence opt1 from ABO__Homo_sapiens__NP_065202
auggccgaggugcugcgcacccucgccggcaagcccaagugccacgcgcugcggccgaugauccuguuccucaucaugcugguccuggugcuguucggguacggcgugcugagcccccgcucccugaugcccgggagccucgagcggggcuucugcauggccguccgcgagcccgaccaccuccagcgggugucccugccgcgcaugguguacccccagcccaagguccucacccccugccggaaggacgugcugguggucacgccguggcuggcccccaucgugugggaggggaccuucaacaucgacauccucaacgagcaguuccgccugcagaacaccaccaucggccugacgguguucgccaucaagaaguacgucgccuuccucaagcuguuccuggagaccgcggagaagcacuucauggugggccaccgggugcacuacuacgucuucaccgaccagcccgccgccgugccccgcgugacccucgggacgggccggcagcugagcguccuggaggugcgcgccuacaagcgguggcaggacguguccaugcgccggauggagaugaucagcgacuucugcgagcgccgguuccucuccgaggucgacuaccuggugugcguggacgucgacauggaguuccgcgaccacgugggggucgagauccugaccccgcuguucggcacccugcaccccggguucuacggcagcucccgggaggcguucaccuacgagcgccggccccagagccaggccuacauccccaaggacgagggcgacuucuacuaccucgggggcuucuucgggggcuccgugcaggaggugcagcgccucacgcgcgccugccaccaggccaugauggucgaccaggccaacggcaucgaggcgguguggcacgacgagagccaccugaacaaguaccugcuccggcacaagccgaccaaggugcugucccccgaguaccugugggaccagcagcuccugggguggcccgccguccugcgcaagcuccgguucaccgccgugcccaagaaccaccaggccgugcgcaacccguga

SEQ ID NO: 26203 - RNA, 1146 nt, Artificial Sequence
  derived and/or modified sequence opt1 from ABRA__Homo_sapiens__NP_631905
auggcccccggcgagaaggagagcggggagggcccggccaaguccgcgcugcgcaagauccggaccgccacccucgugaucagccuggcccgcggguggcagcagugggccaacgagaacuccauccggcaggcccaggagcccacgggcuggcugcccgggggcacccaggacagcccccaggcgccgaagcccaucaccccgcccaccucccaccagaaggcccagagcgcccccaaguccccgccccgccuccccgagggccacggggacggccagagcuccgagaaggcccccgaggucagccacaucaagaagaaggagguguccaagacgguggucagcaagaccuacgagcgcgggggcgacgugucccaccugagccaccgguacgagcgggacgcgggggugcuggagcccggccagcccgagaacgacaucgaccgcauccuccacucccacggcagccccacccggcgccggaagugcgccaaccuggucuccgagcugaccaagggguggcgcgugauggagcaggaggagccgacguggcggagcgacuccguggacaccgaggacagcggcuacgggggcgaggccgaggagcgccccgagcaggacggcguccagguggccgugguccggaucaagcgcccccuccccagccaggugaaccgguucaccgagaagcugaacugcaaggcccagcagaaguacuccccgguggggaaccugaagggccgcuggcagcagugggcggacgagcacauccagagccagaagcucaaccccuucuccgaggaguucgacuacgagcuggccaugagcacccggcugcacaagggggacgagggcuacgggcgccccaaggagggcacgaagaccgccgagcgggccaagcgcgccgaggagcacaucuaccgcgagaugauggacaugugcuucaucaucugcaccauggcgcggcaccgccgggacggcaagauccaggucaccuucggggaccucuucgaccgcuacgugcggaucuccgacaagguggucggcauccugaugcgcgcccggaagcacgggcugguggacuucgagggcgagaugcucuggcaggggcgcgacgaccacguggucaucacgcugcugaaguga

SEQ ID NO: 26204 - RNA, 2442 nt, Artificial Sequence
  derived and/or modified sequence opt1 from ABR__Homo_sapiens__NP_001153218
augcccuacaucgacgagagccccaccaugagcccccagcuguccgcccgcucccagggcgggggcgacggggugagccccacgcccccggagggccucgcccccggggucgaggcgggcaagggccuggagaugcggaagcuggugcucuccggguuccuggccagcgaggagaucuacaucaaccagcuggaggcccuccugcugcccaugaagccccucaaggccaccgccaccaccucccagccggugcugaccauccagcagaucgagacgaucuucuacaagauccaggacaucuacgagauccacaaggaguucuacgacaaccugugccccaagguccagcagugggacagccaggugaccaugggccaccucuuccagaagcuggcgucccagcuggggguguacaaggccuucgucgacaacuacaagguggcccucgagaccgccgagaagugcagccaguccaacaaccaguuccagaagaucagcgaggagcugaaggugaagggccccaaggacuccaaggacagccacaccuccgucacgauggaggcgcugcucuacaagcccaucgaccgcgugacccggagcacccuggugcugcacgaccuccugaagcacaccccggucgaccaccccgacuacccccugcuccaggacgcccugcgcaucucccagaacuuccugagcuccaucaacgaggacaucgacccccggcgcacggccgugaccaccccgaagggggagacccggcagcucgugaaggacggcuuccuggucgaggugagcgagagcucccgcaagcugcggcacguguuccucuucacggacguccugcugugcgccaagcucaagaagaccagcgccggcaagcaccagcaguacgacugcaagugguacaucccccuggcggaccugguguuccccucccccgaggagagcgaggccuccccgcagguccaccccuuccccgaccacgagcucgaggacaugaagaugaagaucagcgcccugaaguccgagauccagaaggagaaggccaacaaggggcagagccgcgccaucgagcggcugaagaagaagauguucgagaacgaguuccuccugcugcucaacucccccaccaucccguuccgcauccacaaccggaacggcaagagcuaccuguuccugcucuccagcgacuacgagcgcuccgaguggcgggaggcgauccagaagcugcagaagaaggaccugcaggccuucgugcucagcuccguggagcuccaggugcugaccgggagcugcuucaagcugcgcacgguccacaacauccccgugaccuccaacaaggacgacgacgagagccccggccuguacggcuuccugcacgucaucgugcacuccgccaagggguucaagcagagcgccaaccuguacugcacccucgagguggacagcuucggcuacuucgucuccaaggccaagacccggguguuccgcgacacggcggagcccaagugggacgaggaguucgagaucgagcuggaggggagccagucccugcggauccucugcuacgagaagugcuacgacaagaccaaggugaacaaggacaacaacgagaucgucgacaagaucaugggcaaggggcagauccagcuggacccgcagaccguggagaccaagaacuggcacacggacgugaucgagaugaacggcaucaaggucgaguucagcaugaaguucaccucccgcgacaugagccugaagcggacccccuccaagaagcagaccggcguguucggggugaagaucagcgucgugacgaagcgcgagcgcuccaaggugcccuacaucguccggcagugcguggaggagguggagaagcgcggcaucgaggaggucgggaucuaccggaucagcggcguggccaccgacauccaggcccucaaggccguguucgacgccaacaacaaggacauccugcugaugcucuccgacauggacaucaacgcgaucgccgggacccugaagcuguacuuccgcgagcucccggagccccugcugaccgaccggcucuaccccgccuucauggagggcaucgcccugagcgaccccgcggccaaggagaacugcaugaugcaccuccugcgcucccugccggaccccaaccugaucacguuccucuuccugcuggagcaccucaagcgggucgccgagaaggagcccaucaacaagaugagccugcacaaccuggccaccguguucggccccacccuccugcgcccguccgagguggagagcaaggcccaccugaccuccgcggccgacaucuggagccacgacgucauggcccagguccaggugcuccuguacuaccugcagcacccgcccaucagcuucgccgagcucaagcggaacacccuguacuucuccacggacguguga

SEQ ID NO: 26205 - RNA, 819 nt, Artificial Sequence
  derived and/or modified sequence opt1 from ABT1__Homo_sapiens__NP_037507
auggaggccgaggagagcgagaaggccgcgaccgagcaggagccccuggagggcaccgagcagacgcucgacgccgaggaggagcaggaggaguccgaggaggccgccugcgggagcaagaagcgcgugguccccggcaucguguaccuggggcacaucccgccccgguuccgcccccugcacgugcggaaccuccuguccgccuacggcgaggucgggcgcguguucuuccaggcggaggaccgguucgugcgccggaagaagaaggccgccgccgcggccggcggcaagaagcgcagcuacaccaaggacuacaccgaggggugggucgaguuccgggacaagcgcaucgccaagcggguggccgccucccugcacaacacccccaugggcgcgcgccggcgcagccccuuccgguacgaccucuggaaccugaaguaccugcaccgcuucacguggucccaccucagcgagcaccuggccuucgagcgccaggugcggcggcagcgccugcgggccgaggucgcccaggccaagcgcgagaccgacuucuaccuccaguccguggagcgcgggcagcgguuccuggcggccgacggcgaccccgcccgccccgacgggagcuggaccuucgcccagcggccgaccgagcaggagcugcgcgcccggaaggcggcccgccccggcggccgggagcgcgcccggcucgccacggcccaggacaaggcgcgcuccaacaaggggcugcuggcccggaucuucggcgccccgccgcccagcgaguccauggaggggcccagccucgugcgcgacuccuga

SEQ ID NO: 26206 - RNA, 996 nt, Artificial Sequence
  derived and/or modified sequence opt1 from ACAA1__Homo_sapiens__NP_001123882
augcagcgccuccaggugguccugggccaccuccgggggcccgccgacagcggcuggaugccgcaggccgcgcccugccuguccggggcgccccaggccagcgccgccgacgugguggucgugcacggccgccggaccgccaucugccgcgccgggcggggcggcuucaaggacaccacgcccgacgagcugcuguccgccgugaugaccgccguccugaaggacgugaaccuccgcccggagcagcugggggacaucugcgugggcaacguccugcagcccggggcgggcgccaucauggcccggaucgcccaguuccucagcgacauccccgagaccgugccccuguccaccgugaaccgccagugcagcuccgggcugcaggccgucgcgagcaucgccggcggcauccggaacggguccuacgacaucggcauggccugcgggaucacgagcgagaacguggccgagcgcuucggcaucucccgggagaagcaggacaccuucgcccucgcgagccagcagaaggccgcccgcgcccaguccaagggcugcuuccaggccgagaucgugccggucaccaccacggugcacgacgacaaggggaccaagcggagcaucaccgugacccaggacgagggcauccgccccuccacgaccauggaggggcuggcgaagcugaagcccgccuucaagaaggacggcagcaccaccgccgggcucacggucuccgacguggacaucuucgagaucaacgaggccuucgccagccaggcggccuacugcguggagaagcugcggcugcccccggagaaggucaacccccucggcggcgccguggcccuggggcacccccugggcugcaccggggcgcgccaggugaucacccuccugaacgagcugaagcggcgcggcaagcgggccuacggggucguguccaugugcaucggcaccggcaugggggccgccgccgucuucgaguaccccggcaacuga

SEQ ID NO: 26207 - RNA, 1194 nt, Artificial Sequence
  derived and/or modified sequence opt1 from ACAA2__Homo_sapiens__NP_006102
auggcccugcuccggggcguguucgucguggccgcgaagcggacccccuucggggccuacggcgggcugcugaaggacuucaccgccacggaccucagcgaguucgccgccaaggcggcccuguccgccggcaaggugagcccggagaccgucgacuccgugaucauggggaacgugcugcagagcuccagcgacgccaucuaccucgcgcgccacgucggccugcgggugggcauccccaaggagacccccgcccugaccaucaaccgccucugcggguccggcuuccagagcaucgugaacgggugccaggagaucugcgucaaggaggccgagguggugcugugcggcgggacggaguccaugagccaggcccccuacugcguccggaacgugcgcuucggcaccaagcugggcuccgacaucaagcucgaggacagccugugggugucccugaccgaccagcacguccagcucccgauggccaugaccgcggagaaccuggccgugaagcacaagaucagccgggaggagugcgacaaguacgcccugcagucccagcagcgcuggaaggccgccaacgacgcgggguacuucaacgacgagauggcccccaucgaggugaagacgaagaagggcaagcagaccaugcaggucgacgagcacgcccggccccagaccacccucgagcagcugcagaagcugcccccgguguucaagaaggacgggacggugaccgccggcaacgccagcggcgucgcggacggggccggcgccgugaucaucgccuccgaggacgccgugaagaagcacaacuucacgccccucgcgcgcaucgucggguacuucgugagcggcugcgaccccuccaucauggggaucggccccgucccggccaucagcggcgcccugaagaaggccgggcugagccucaaggacauggaccugguggaggugaacgaggcguucgcgccccaguaccuggccgucgagcggucccucgaccuggacaucagcaagaccaacgugaacggcggggccaucgcccugggccacccccucgggggcuccggcagccgcaucaccgcccaccuggugcacgagcugcggcgccgcgggggcaaguacgccgucggguccgccugcaucggcgggggccagggcaucgccgugaucauccagagcaccgccuga

SEQ ID NO: 26208 - RNA, 7152 nt, Artificial Sequence
  derived and/or modified sequence opt1 from ACACA__Homo_sapiens__NP_942131
augugguggagcacccugauguccauccugcgggcccggagcuucuggaaguggaucuccacccagacggugcggaucauccgggccgugcgcgcgcacuucggcgggaucauggacgagcccagcccccuggcccagccccuggagcucaaccagcacucccgguucaucaucggcagcguguccgaggacaacagcgaggacgagaucuccaaccuggugaagcuggaccuccuggaggagaaggaggggagccugucccccgccagcgucggcuccgacacccucagcgaccuggggaucuccagccugcaggacggccucgcccugcacauccgcuccagcauguccggccugcaccucgugaagcaggggcgggaccgcaagaagaucgacagccagcgggacuucaccguggccagccccgcggaguucgucacccgcuucggcgggaacaaggugaucgagaaggugcugaucgccaacaacggcaucgccgccgucaagugcaugcgguccauccgccgguggagcuacgagauguuccgcaacgagcgggcgauccgcuucguggugauggucacgccggaggaccugaaggccaacgccgaguacaucaagauggccgaccacuacgugcccgugcccgggggccccaacaacaacaacuacgccaacgucgagcucauccuggacaucgcgaagcggaucccggugcaggccgugugggccggcugggggcacgccuccgagaaccccaagcugcccgagcuccugcugaagaacggcaucgccuucauggggcccccgagccaggcgaugugggcccucggcgacaagaucgccuccagcaucgucgcccagaccgccggcauccccacccugcccugguccgggagcggccugcgcguggacuggcaggagaacgacuucuccaagcggauccucaacgugccccaggagcuguacgagaagggguacgucaaggacguggacgacggccugcaggcggccgaggaggugggguacccggucaugaucaaggccagcgagggcggcgggggcaaggggauccgcaaggugaacaacgccgacgacuuccccaaccucuuccggcagguccaggccgaggugcccggcucccccaucuucgugaugcgccuggcgaagcagagccgccaccuggagguccagauccucgccgaccaguacgggaacgccaucucccuguucggccgggacugcagcgugcagcgccggcaccagaagaucaucgaggaggccccggcgaccaucgccacgcccgccguguucgagcacauggagcagugcgccgucaagcuggccaagauggugggcuacguguccgcggggaccgucgaguaccucuacagccaggacggcuccuucuacuuccuggagcugaacccccgccuccagguggagcaccccugcaccgagaugguggccgacgucaaccugccggccgcccagcugcagaucgccauggggaucccccucuaccggaucaaggacauccgcaugauguacggcgugagccccuggggcgacucccccaucgacuucgaggacagcgcgcacgugccgugcccccggggccacgucaucgccgcccgcaucaccagcgagaaccccgacgagggcuucaagccguccagcgggacggugcaggagcugaacuuccgguccaacaagaacguguggggcuacuucagcgucgccgccgcgggcgggcugcacgaguucgccgacucccaguucgggcacugcuucagcuggggcgagaaccgcgaggaggccaucuccaacauggugguggcccucaaggagcugagcauccggggcgacuuccgcaccaccgucgaguaccugaucaagcuccuggagaccgaguccuuccagaugaaccggaucgacacgggguggcuggaccgccugaucgcggagaaggugcaggccgagcggcccgacaccaugcucggcguggucugcggggcccugcacguggccgacgugagccugcgcaacuccgucagcaacuuccuccacucccuggagcggggccaggugcugcccgcccacacccuccugaacaccguggacgucgagcugaucuacgagggcgugaaguacgugcucaaggucacgcgccagagccccaacuccuacguggugaucaugaacgggagcugcgucgagguggacgugcaccggcuguccgacggcgggcugcuccugagcuacgacggcagcuccuacaccaccuacaugaaggaggaggucgaccgcuaccgcaucaccaucgggaacaagacgugcguguucgagaaggagaacgacccgagcgugaugcggucccccagcgcgggcaagcugauccaguacaucgucgaggacggcgggcacguguucgccggccagugcuacgccgagaucgaggugaugaagauggucaugacccucaccgccguggaguccgggugcauccacuacgugaagcgccccggcgccgcgcuggaccccgggugcguccuggccaagaugcagcucgacaacccgagcaaggugcagcaggccgagcugcacaccggcucccugccccggauccagagcacggcccuccgcggcgagaagcugcaccggguguuccacuacguccuggacaaccucgugaacgucaugaacggguacugccugcccgaccccuucuucuccagcaaggugaaggacuggguggagcgccugaugaagacccuccgggacccgucccugccccugcucgagcugcaggacaucaugaccagcgucuccggccgcaucccgcccaacguggagaaguccaucaagaaggagauggcccaguacgcguccaacaucaccagcgugcugugccaguucccgucccagcagaucgccaacauccucgacagccacgccgccacgcugaaccggaaguccgagcgcgaggucuucuucaugaacacccagagcaucgugcagcuggugcagcgguaccgcagcgggauccggggccacaugaaggcggucgugauggaccuccugcgccaguaccugcggguggagacccaguuccagaacgggcacuacgacaagugcgucuucgcccuccgcgaggagaacaaguccgacaugaacaccgugcugaacuacaucuucagccacgcccaggugacgaagaagaaccugcucgucaccaugcugaucgaccagcugugcggccgggaccccacccucaccgacgagcugcugaacauccucaccgagcugacgcagcuguccaagaccaccaacgccaagguggcccuccgcgcgcgccaggugcugaucgccagccaccuccccuccuacgagcuccgccacaaccaggucgagagcaucuuccuguccgccaucgacauguacggccaccaguucugcaucgagaaccugcagaagcucauccugagcgagaccuccaucuucgacgugcugcccaacuucuucuaccacagcaaccaggugguccggauggccgcccucgagguguacgugcgccgcgcguacaucgccuacgagcugaacuccguccagcaccggcagcugaaggacaacacgugcgugguggaguuccaguucaugcucccgaccagccaccccaaccgcgggaacauccccacccugaaccggauguccuucagcuccaaccugaaccacuacggcaugacccacgucgccagcguguccgacgugcuccuggacaacagcuucacgcccccgugccagcgcaugggcgggauggucuccuuccggaccuucgaggacuucgugcgcaucuucgacgaggugauggggugcuucagcgacuccccgccccaguccccgaccuuccccgaggccgggcacaccagccuguacgacgaggacaaggucccccgggacgagcccauccacauccucaacguggccaucaagacggacugcgacaucgaggacgaccgccuggcggccauguuccgggaguucacccagcagaacaaggccacccugguggaccacggcauccgccggcucaccuuccuggucgcccagaaggacuuccgcaagcaggucaacuacgagguggaccggcgcuuccaccgggaguucccgaaguucuucacguuccgcgcccgggacaaguucgaggaggaccgcaucuaccggcaccuggagcccgcgcucgccuuccagcuggagcugaaccgcaugcgcaacuucgaccucaccgccauccccugcgccaaccacaagaugcaccuguaccugggggcggccaaggucgaggugggcaccgaggugaccgacuaccgguucuucguccgcgccaucauccggcacuccgaccucgugacgaaggaggccagcuucgaguaccugcagaacgagggggagcgccugcuccuggaggccauggacgagcuggagguggcguucaacaacaccaacguccggaccgacugcaaccacaucuuccucaacuucgugcccaccgugaucauggacccguccaagaucgaggagagcguccgcuccauggugaugcgguacggcagccgccuguggaagcugcgggugcuccaggccgagcugaagaucaacauccgccugacgcccaccggcaaggccauccccauccgccucuuccugaccaacgaguccggguacuaccuggacaucagccuguacaaggaggucaccgacucccggacggcccagaucauguuccaggccuacggcgacaagcaggggccccuccacggcaugcugaucaacaccccguacgugaccaaggaccugcuccagagcaagcgguuccaggcgcagucccuggggaccacguacaucuacgacauccccgagauguuccgccagagccugaucaagcucugggaguccaugagcacccaggccuuccugcccagcccgccccugcccagcgacaugcucaccuacaccgagcugguccuggacgaccagggccagcucgugcacaugaaccggcugcccggcgggaacgagaucggcaugguggccuggaagaugacguucaagucccccgaguacccggaggggcgcgacaucaucgucaucggcaacgacaucaccuaccggaucgggagcuucggcccccaggaggaccugcuguuccugcgcgccagcgagcuggcccgggcggagggcaucccccgcaucuacguguccgccaacagcggggcccggaucggccucgccgaggagauccgccacauguuccacguggcgugggucgaccccgaggacccguacaagggguaccgcuaccuguaccugacgccccaggacuacaagcggguguccgcccucaacagcgugcacugcgagcacgucgaggacgagggcgagucccgcuacaagaucaccgacaucaucggcaaggaggaggggaucggccccgagaaccugcgggggagcggcaugaucgccggggaguccagccuggccuacaacgagaucaucaccaucucccucgugaccugccgcgccaucggcaucggcgcguaccuggugcggcuggggcagcgcaccauccaggucgagaacagccaccucauccugaccggcgccggggcccugaacaaggugcucggccgggagguguacaccuccaacaaccagcucgggggcauccagaucaugcacaacaacggcgucacgcacugcaccgugugcgacgacuucgaggggguguucaccguccugcacuggcucagcuacaugcccaaguccgugcacagcuccgugccgcugcugaacagcaaggaccccaucgaccgcaucaucgaguucguccccaccaagacgccguacgacccccgguggaugcucgccggccgcccccaccccacccagaaggggcaguggcuguccggcuucuucgacuacgggagcuucuccgagaucaugcagccgugggcccagaccgugguggucggccgggcgcgccugggcgggauccccgugggcguggucgccguggagacccggacgguggagcucagcauccccgccgaccccgccaaccuggacagcgaggccaagaucauccagcaggcggggcaggucugguucccggacuccgccuucaagaccuaccaggccaucaaggacuucaaccgcgagggccugccccucaugguguucgccaacuggcggggguucagcggcggcaugaaggacauguacgaccaggugcugaaguucggggcguacaucgucgacggccugcgcgagugcugccagcccgugcucguguacaucccgccccaggccgagcugcgcgggggcuccugggucgugaucgacagcuccaucaacccccgccacauggagauguacgccgaccgggagagccgcggcuccgugcuggagcccgaggggaccgucgagaucaaguuccgccggaaggaccucgugaagaccaugcgccggguggaccccgucuacauccaccuggccgagcgccugggcacgcccgagcucagcaccgccgagcggaaggagcuggagaacaagcugaaggagcgcgaggaguuccucauccccaucuaccaccagguggcggugcaguucgccgaccugcacgacacccccgggcggaugcaggagaagggcgucaucuccgacauccuggacuggaagaccagccgcacguucuucuacuggcggcuccgccggcugcugcucgaggaccuggugaagaagaagauccacaacgccaaccccgagcugaccgacgggcagauccaggccaugcuccgccggugguucguggaggucgagggcaccgugaaggccuacgugugggacaacaacaaggaccuggcggaguggcuggagaagcagcucaccgaggaggacggcguccacuccgugaucgaggagaacaucaagugcaucagccgcgacuacguccugaagcagauccggucccuggugcaggccaacccggagguggccauggacagcaucauccacaugacgcagcacaucucccccacccagcgcgccgaggucauccggauccucagcaccauggacucccccagcaccuga

SEQ ID NO: 26209 - RNA, 7377 nt, Artificial Sequence
  derived and/or modified sequence opt1 from ACACB__Homo_sapiens__XP_011536564
auggugcugcuccugugccugagcugccucaucuucagcugccugaccuucagcuggcugaagaucuggggcaagaugaccgacuccaagcccaucaccaaguccaaguccgaggccaaccucaucccgagccaggagcccuuccccgccuccgacaacagcggggagacgccccagcggaacggcgaggggcacacccugcccaagacccccucccaggccgagcccgccagccacaagggccccaaggacgccgggcggcgccggaacucccugccgcccagccaccagaagccgccccgcaacccccucuccagcuccgacgccgcccccagccccgagcugcaggcgaacggcacgggcacccaggggcuggaggccaccgacaccaacggccucuccagcuccgcccggccccaggggcagcaggccggcagcccgagcaaggaggacaagaagcaggcgaacaucaagcggcagcugaugacgaacuucauccugggguccuucgacgacuacagcuccgacgaggacagcgucgccggcuccagccgggaguccacccgcaagggcagccgggccucccucggggcccugagccuggaggccuaccucaccaccggcgaggcggagacgcgcgugcccaccaugcggcccuccaugagcgggcugcaccuggugaagcgcggccgggagcacaagaagcucgaccugcaccgcgacuucaccgucgccucccccgccgaguucgugacccgguucggcggggaccgcgugaucgagaagguccugaucgccaacaacggcaucgccgcggugaagugcaugcggagcauccgccggugggccuacgagauguuccgcaacgagcgggccauccgcuucguggucauggugacgccggaggaccucaaggccaacgccgaguacaucaagauggcggaccacuacgugcccguccccgggggccccaacaacaacaacuacgccaacguggagcugaucguggacaucgccaagcgcaucccgguccaggccgugugggccggguggggccacgcguccgagaaccccaagcugcccgagcuccugugcaagaacggcguggccuuccuggggcccccgagcgaggccaugugggcccucggcgacaagaucgcguccaccgucguggcccagacccuccaggugcccacccugcccuggagcggguccggccucacggucgaguggaccgaggacgaccugcagcaggggaagcggaucagcgugccggaggacguguacgacaagggcugcgucaaggacguggacgagggccuggaggccgccgagcgcaucggguucccccucaugaucaaggccagcgagggcgggggcgggaagggcauccggaaggcggaguccgccgaggacuuccccauccuguuccgccagguccagagcgagauccccggcuccccgaucuuccugaugaagcucgcccagcacgcccggcaccuggaggugcagauccuggccgaccaguacgggaacgcggugagccucuucggccgcgacugcuccauccagcggcgccaccagaagaucgucgaggaggcccccgccaccaucgcgccccuggccaucuucgaguucauggagcagugcgcgauccggcuggccaagaccgugggguacgugagcgccggcacggucgaguaccucuacucccaggacggcagcuuccacuuccuggagcugaacccccgccuccagguggagcacccgugcaccgagaugaucgccgacgugaaccugcccgcggcccagcugcagaucgccaugggggucccccugcaccggcucaaggacauccgccugcuguacggcgagucccccuggggcgugaccccgaucagcuucgagacccccuccaacccgccccuggcccggggccacgugaucgccgcgcgcaucacgagcgagaacccggacgagggguucaagcccuccagcggcaccguccaggagcugaacuuccgguccagcaagaacguguggggcuacuucuccguggccgccaccgggggccugcacgaguucgccgacagccaguucgggcacugcuucagcuggggcgagaaccgcgaggaggccaucuccaacauggucguggcgcucaaggagcugagcauccgcggggacuuccgcaccacgguggaguaccugaucaaccuccuggagaccgaguccuuccagaacaacgacaucgacaccggcuggcuggacuaccucaucgccgagaagguccaggccgagaagcccgacaucaugcugggcguggugugcggggcccugaacgucgccgacgcgauguuccggaccugcaugacggacuuccuccacagccuggagcgcggccaggugcugcccgccgacucccuccugaaccugguggacgucgagcucaucuacgggggcgugaaguacauccugaagguggcccgccagagccugaccauguucguccucaucaugaacgggugccacaucgagaucgacgcccaccggcugaacgacggcggccugcuccuguccuacaacgggaacagcuacaccaccuacaugaaggaggagguggacuccuaccgcaucaccaucggcaacaagacgugcguguucgagaaggagaacgacccgaccguccugcggagccccuccgcggggaagcucacccaguacaccguggaggacggcgggcacguggaggccggcagcuccuacgccgagauggaggucaugaagaugaucaugacgcugaacgugcaggagcgcggccgggugaaguacaucaagcgccccggggccguccuggaggccggcugcgugguggcgcggcucgagcuggacgaccccagcaagguccacccggccgagcccuucaccggggagcugcccgcccagcagacccucccgauccugggcgagaagcugcaccagguguuccacuccgugcucgagaaccugaccaacgucaugagcggcuucugccugcccgagcccguguucuccaucaagcucaaggagugggugcagaagcugaugaugacgcugcgccaccccagccucccgcugcuggagcuccaggagaucaugaccuccgucgccgggcggauccccgcccccguggagaaguccgugcgccgggucauggcgcaguacgccagcaacaucaccuccgugcugugccaguuccccagccagcagaucgccaccauccuggacugccacgccgccacgcuccagcgcaaggcggaccgggagguguucuucaucaacacccaguccaucguccagcuggugcagcgcuaccggagcggcauccgcggguacaugaagaccgucgugcuggaccuccugcggcgcuaccugcggguggagcaccacuuccagcaggcccacuacgacaagugcgucaucaaccuccgcgagcaguucaagccggacaugucccaggugcuggacugcaucuucagccacgcccagguggccaagaagaaccagcuggucaucaugcucaucgacgagcugugcggccccgaccccucccugagcgacgagcucaucuccauccugaacgagcugacccagcucagcaaguccgagcacugcaagguggcccugcgggcgcgccagauccugaucgccagccaccuccccuccuacgagcugcgccacaaccagguggagagcaucuuccuguccgccaucgacauguacgggcaccaguucugcccggagaaccucaagaagcugauccugagcgagacgaccaucuucgacguccuccccaccuucuucuaccacgccaacaagguggugugcauggcgucccuggaggucuacgugcggcgcggcuacaucgccuacgagcugaacagccuccagcaccggcagcugcccgacgggaccugcguggucgaguuccaguucaugcugcccuccagccacccgaaccgcaugacggugcccaucagcaucaccaaccccgaccuccugcggcacuccaccgagcuguucauggacagcggguucagcccccugugccagcgcaugggcgccaugguggccuuccggcgcuucgaggacuucacccggaacuucgacgaggucaucagcugcuucgccaacgugccgaaggacacgccccuguucuccgaggcgcgcaccagccuguacuccgaggacgacugcaagagccuccgggaggagcccauccacauccugaacguguccauccagugcgccgaccaccuggaggacgaggcccucguccccauccugcgcaccuucgugcagagcaagaagaacauccugguggacuacgggcuccggcgcaucaccuuccugaucgcccaggagaaggaguucccgaaguucuucacguuccgggcccgcgacgaguucgcggaggaccggaucuaccgccaccuggagcccgcccuggccuuccagcucgagcugaaccggaugcgcaacuucgaccugaccgccguccccugcgccaaccacaagaugcaccucuaccugggcgcggccaaggugaaggaggggguggaggucaccgaccaccgcuucuucauccgggccaucauccgccacuccgaccugaucaccaaggaggccagcuucgaguaccuccagaacgagggcgagcggcugcugcucgaggcgauggacgagcuggagguggccuucaacaacacguccgugcgcaccgacugcaaccacaucuuccugaacuucguccccaccgugaucauggacccguucaagaucgaggagagcgugcgguacauggucaugcgcuacggcucccggcucuggaagcugcgcgugcugcaggccgaggugaagaucaacauccggcagaccacgaccgggagcgccguccccauccgccucuucaucaccaacgaguccggcuacuaccuggacaucagccuguacaaggaggugaccgacucccggagcgggaacaucauguuccacagcuucggcaacaagcaggggccccagcacggcaugcucaucaacaccccguacgugacgaaggaccugcugcaggccaagcgcuuccaggcgcagacccucggcaccaccuacaucuacgacuuccccgagauguuccggcaggcccuguucaagcugugggggucccccgacaaguaccccaaggacauccucacguacaccgagcugguccuggacagccagggccagcucguggagaugaaccgccugcccgggggcaacgaggugggcauggucgccuucaagaugcgguucaagacccaggaguaccccgaggggcgcgacgugaucgugaucggcaacgacaucaccuuccggaucggguccuucggccccggggaggaccugcucuaccugcgcgccagcgagauggcccgggcggagggcauccccaagaucuacgucgccgccaacuccggcgcccgcaucgggauggccgaggagaucaagcacauguuccacguggcguggguggacccggaggacccccacaagggcuucaaguaccuguaccucacgccccaggacuacacccggaucagcucccugaacagcguccacugcaagcacaucgaggagggcggggagucccgcuacaugaucaccgacaucaucgggaaggacgacggccugggcguggagaaccuccgcgggagcggcaugaucgccggggaguccagccuggccuacgaggagaucgugaccaucucccuggucacgugccgggccaucggcaucggggcguaccucgugcgccugggccagcgggucauccagguggagaacagccacaucauccugaccggcgccuccgcccucaacaaggugcuggggcgcgaggucuacaccagcaacaaccagcugggcggggugcagaucaugcacuacaacggcgugucccacaucaccguccccgacgacuucgaggggguguacacgauccucgaguggcugagcuacaugccgaaggacaaccacucccccgugcccaucaucacccccaccgacccgaucgaccgggagaucgaguuccugcccagccgcgcccccuacgacccccgguggaugcucgccggccgcccgcaccccacccugaagggcacguggcagagcggguucuucgaccacggcuccuucaaggagaucauggcgcccugggcccagaccgucgugaccgggcgggcccgccugggcggcauccccgugggggucaucgccguggagacccggacgguggaggucgccgugccggcggaccccgccaaccucgacagcgaggccaagaucauccagcaggccggccaggugugguuccccgacuccgccuacaagaccgcgcaggccgucaaggacuucaaccgcgagaagcugccccugaugaucuucgccaacuggcggggguucagcggcgggaugaaggacauguacgaccaggugcucaaguucggcgccuacaucguggacggccugcgccaguacaagcagccgauccugaucuacaucccgcccuacgccgagcuccgcgggggcuccugggucgugaucgacgcgaccaucaacccgcugugcaucgagauguacgccgacaaggagagccgcgggggcgugcuggagcccgaggggaccgucgagaucaaguuccggaagaaggaccucaucaaguccaugcgccggaucgaccccgccuacaagaagcugauggagcagcugggcgagcccgaccucagcgacaaggaccgcaaggaccuggagggccgccugaaggcccgggaggaccuccugcugccgaucuaccaccagguggcggugcaguucgccgacuuccacgacacgcccgggcgcaugcucgagaagggcgucaucuccgacauccuggaguggaagaccgcccggaccuuccuguacuggcgccuccggcgccugcugcucgaggaccaggugaagcaggagauccugcaggccagcggggagcugucccacgugcacauccagagcaugcuccggcgcugguucgucgagaccgagggcgccgugaaggcguaccugugggacaacaaccagguggucgugcaguggcuggagcagcacuggcaggccggggacggcccccgguccacgauccgcgagaacaucaccuaccucaagcacgacagcgugcugaagaccauccggggccuggucgaggagaaccccgagguggccguggacugcgucaucuaccucucccagcacaucagcccggccgagcgcgcccagguggugcaccuccuguccaccauggacagccccgcguccacguga

SEQ ID NO: 26210 - RNA, 3273 nt, Artificial Sequence
  derived and/or modified sequence opt1 from ACAD10__Homo_sapiens__NP_001130010
augugcgugcgcagcugcuuccagagcccccggcugcagugggucuggcgcaccgccuuccucaagcacacccagcggcgccaccagggcagccaccgguggacgcaccucgggggcuccaccuaccgcgccgugaucuucgacaugggcggggugcugaucccgagccccgggcgggucgcggccgagugggaggugcagaaccgcauccccuccggcaccauccugaaggcccugauggagggcggggagaacggccccuggaugcgguucaugcgcgccgagaucaccgccgagggguuccugcgggaguucggccgccucugcagcgagaugcugaagacguccgugccggucgacagcuucuucucccugcucaccagcgagcggguggcgaagcaguuccccgugaugaccgaggccaucacccagauccgcgccaaggggcugcagacggccguccuguccaacaacuucuaccuccccaaccagaaguccuuccugccccuggaccggaagcaguucgacgugaucguggaguccugcauggagggcaucugcaagccggacccccgcaucuacaagcucugccuggagcagcugggccuccagcccagcgaguccaucuuccuggacgaccuggggaccaaccucaaggaggcggcccggcugggcauccacaccaucaagcgccagggguucgccguccugcccaagcucgugagcaacuccugggcccaggccaucuacccgcccuacccgcccaaggugguccggcuccaggugaacgacccggagaccgcggugaaggagcuggaggcccugcugggcuucacgcugcgcgucggcgugcccaacacccggcccgugaagaagaccauggagauccccaaggacagccuccagaaguaccugaaggaccugcucgggauccagaccacgggcccgcuggagcugcuccaguucgaccacgggcaguccaaccccaccuacuacauccgccuggccaaccgcgaccugguccuccggaagaagccgcccggcacccugcugcccagcgcccacgccaucgagcgcgaguuccggaucaugaaggcgcucgccaacgccggggugcccgugcccaacguccuggaccugugcgaggacagcuccgugaucggcacccccuucuacgucauggaguacugcccgggccucaucuacaaggaccccagccugcccgggcuggagccgucccaccgccgggccaucuacacggccaugaacaccgugcucugcaagauccacagcguggaccugcaggcggucggccuggaggacuacgggaagcagggcgacuacaucccccgccaggugcggaccugggugaagcaguaccgcgccuccgagaccagcacgauccccgccauggagcggcugaucgaguggcucccccugcaccucccgcgccagcagcggaccaccgucgugcacggggacuuccgccuggacaaccugguguuccaccccgaggagcccgagguccuggccgugcucgacugggagcuguccacccugggcgacccccucgccgacguggcguacagcugccuggcccacuaccugccguccagcuuccccguccuccggggcaucaacgacugcgaccugacgcagcuggggauccccgccgccgaggaguacuuccgcauguacugccuccagaugggccugcccccgaccgagaacuggaacuucuacauggcguucuccuucuuccggguggccgccauccugcaggggguguacaagcgcagccucaccggccaggccuccagcaccuacgccgagcagacggggaagcugaccgaguucgucuccaaccuggcgugggacuucgccgugaaggagggcuuccggguguucaaggagaugcccuucaccaacccccucacccgcagcuaccacacgugggcccggccccagucccaguggugcccgaccggcagccgcuccuacagcagcguccccgaggccucccccgcccacaccagccgcgggggccuggugaucucccccgagagccuguccccgcccgugcgggagcucuaccaccgccugaagcacuucauggagcagcgggucuaccccgcggagcccgagcugcagagccaccaggccuccgccgcccgcuggagcccgagcccccucaucgaggaccugaaggagaaggccaaggcggaggggcuguggaaccucuuccugccccuggaggccgacccggagaagaaguacggcgccggccucaccaacguggaguacgcccaccugugcgagcugauggggaccagccucuacgcgcccgaggugugcaacugcuccgcccccgacacgggcaacauggagcugcugguccgguacgggaccgaggcccagaaggcccgcuggcucaucccccugcuggagggcaaggcccggagcugcuucgcgaugaccgagccccagguggccuccagcgacgccaccaacaucgaggccuccauccgcgaggaggacagcuucuacgugaucaacgggcacaagugguggaucacgggcauccucgacccccggugccagcugugcgucuucaugggcaagaccgacccccacgcgccccgccaccggcagcaguccgugcugcucgugccgauggacacccccgggaucaagaucauccgcccccugaccgucuacggccuggaggacgcccccgggggccacggggaggugcgguucgagcacgugcgcgucccgaaggagaacauggugcucggccccggccggggguucgagaucgcccagggccgccuggggcccggccggauccaccacugcaugcgccugaucggguucagcgagcgggcccucgcccugaugaaggcccgcgugaagucccggcuggcguucggcaagccccucgucgagcagggcacggugcuggccgacaucgcccagucccgcguggagaucgagcaggcccgccugcucguccugcgggcggcccaccugauggaccucgccgggaacaaggccgccgcgcuggacaucgccaugaucaagaugguggccccgagcauggccucccgcgugaucgaccgggccauccaggcguucggcgccgccgggcugagcuccgacuacccccucgcccaguucuucaccugggcccgcgcgcugcgguucgccgacggccccgacgagguccaccgcgccaccguggccaagcuggagcucaagcaccggaucuga

SEQ ID NO: 26211 - RNA, 1248 nt, Artificial Sequence
  derived and/or modified sequence opt1 from ACAD8__Homo_sapiens__NP_055199
augcuguggagcggcugccgccgguucggggcccgccucggcugccugcccgggggccugcgggugcucguccagaccgggcaccgcucccugaccagcugcaucgacccguccaugggccugaacgaggagcagaaggaguuccagaagguggccuucgacuucgcggcccgggagauggcccccaacauggccgagugggaccagaaggagcuguuccccguggacgucaugcgcaaggccgcgcagcucggcuucgggggcguguacauccagacggacgucgggggcagcgggcugucccggcucgacaccagcgugaucuucgaggcccuggccaccggcugcaccuccacgaccgccuacaucagcauccacaacaugugcgcguggaugaucgacuccuucggcaacgaggagcagcgccacaaguucugcccgccccugugcaccauggagaaguucgccagcuacugccucaccgagcccggguccggcagcgacgccgccucccugcugacgagcgccaagaagcagggggaccacuacauccucaacggcuccaaggcguucaucagcggcgccggggaguccgacaucuacguggugaugugccggaccggcgggcccggccccaaggggaucagcugcaucgucguggagaagggcaccccgggccuguccuucgggaagaaggagaagaaggugggcuggaacagccagcccacccgcgccgucaucuucgaggacugcgccgugcccguggccaaccggaucgggagcgagggccagggguuccugaucgcgguccgcggccucaacggcgggcggaucaacaucgccuccugcagccugggcgccgcccacgccuccgugauccugacgcgcgaccaccucaacgugcggaagcaguucggggagccccuggcgagcaaccaguaccugcaguucacccucgccgacauggccacccgccuggucgccgcccggcugauggugcgcaacgcggccguggcccuccaggaggagcggaaggacgccgucgcgcugugcuccauggccaagcuguucgccaccgacgagugcuucgccaucugcaaccaggcccuccagaugcacggcggguacggcuaccugaaggacuacgcggugcagcaguacgugcgcgacagccggguccaccagauccuggagggcuccaacgaggugaugcgcauccucaucagccgcucccugcugcaggaguga

SEQ ID NO: 26212 - RNA, 1866 nt, Artificial Sequence
  derived and/or modified sequence opt1 from ACAD9__Homo_sapiens__NP_054768
augagcggcugcgggcuguuccuccgcaccaccgccgccgcgcgggccugccgcggccugguggucuccacggccaaccggcgccugcuccggaccagcccgcccgugcgcgccuucgccaaggagcuguuccuggggaagaucaagaagaaggagguguuccccuuccccgaggucucccaggacgagcucaacgagaucaaccaguuccugggccccguggagaaguucuucaccgaggagguggacagccggaagaucgaccaggaggggaagaucccggacgagacccuggagaagcucaagucccugggccuguucggccuccagguccccgaggaguacgggggccugggguucagcaacacgauguacucccgccugggcgagaucaucagcauggacggguccaucaccgugacccucgcggcccaccaggccaucggccugaagggcaucauccuggccgggaccgaggagcagaaggcgaaguaccuccccaagcuggccagcggcgagcacaucgccgccuucugccugacggagcccgccuccgggagcgacgcggccuccauccggagccgcgccacccucuccgaggacaagaagcacuacauccugaacggcagcaagguguggaucaccaacggcgggcuggccaacaucuucaccgucuucgccaagacggaggugguggacuccgacggcagcgucaaggacaagaucaccgcguucaucguggagcgggacuucgggggcgugaccaacgggaagccggaggacaagcucggcauccgcggcuccaacacgugcgagguccacuucgagaacaccaagauccccguggagaacauccugggggaggugggcgacggguucaaggucgccaugaacauccugaacagcggccgguucagcaugggguccgugguggccggccuccugaagcgccugaucgagaugaccgccgaguacgccugcacccggaagcaguucaacaagcgccucagcgaguucggccugauccaggagaaguucgcgcugauggcccagaaggccuacgucauggaguccaugaccuaccucacggccgggaugcuggaccagcccggcuuccccgacugcagcaucgaggccgcgauggugaagguguucuccagcgaggccgccuggcagugcgucuccgaggcccugcagauccucgggggccugggguacacccgggacuacccguacgagcgcauccugcgggacacccgcauccuccugaucuucgagggcaccaacgagauccugcggauguacaucgcgcucacgggccugcagcacgccgggcgcauccugaccacccgcauccacgagcucaagcaggccaaggugagcaccgucauggacacggugggccggcgccugcgggacucccuggggcgcaccguggaccucggccugaccggcaaccacggggucgugcaccccagccuggccgacuccgccaacaaguucgaggagaacaccuacugcuucggccggacgguggagacccugcuccugcgcuucgggaagaccaucauggaggagcagcugguccucaagcggguggcgaacauccugaucaaccuguacggcaugaccgccgugcucagccgcgccucccggagcauccgcaucgggcugcggaaccacgaccacgagguccugcucgccaacacguucugcguggaggccuaccugcagaaccuguucucccucagccagcuggacaaguacgcgcccgagaaccuggacgagcagaucaagaaggugucccagcagauccucgagaagcgcgccuacaucugcgcccacccccuggaccggaccugcuga

SEQ ID NO: 26213 - RNA, 1293 nt, Artificial Sequence
  derived and/or modified sequence opt1 from ACADL__Homo_sapiens__NP_001599
auggccgcccgccugcuccggggcagccugcgcgugcucgggggccaccgggcgccccgccagcugccggccgcccggugcucccacagcgggggcgaggagcgccuggagacccccuccgccaagaagcugaccgacaucgggauccggcgcaucuucagccccgagcacgacaucuuccggaaguccguccgcaaguucuuccaggaggaggugaucccccaccacagcgagugggagaaggccggcgaggugucccgggaggucugggagaaggcgggcaagcaggggcuccugggcgugaacaucgccgagcaccucgggggcaucgggggcgaccuguacagcgccgccaucgugugggaggagcaggcguacuccaacugcagcggcccgggguucuccauccacagcggcaucgucauguccuacaucacgaaccacgggagcgaggagcagaucaagcacuucaucccccagaugaccgccggcaagugcaucggcgccaucgccaugaccgagcccggggccggcuccgaccugcaggggaucaagaccaacgcgaagaaggacggcagcgacuggauccugaacggguccaagguguucaucagcaacggcucccucagcgacguggucaucgugguggccgucacgaaccacgaggcccccagcccggcccacggcaucucccuguuccugguggagaacgggaugaagggcuucaucaaggggcgcaagcuccacaagaugggccugaaggcccaggacaccgcggagcuguucuucgaggacauccggcuccccgccagcgcccugcugggggaggagaacaagggcuucuacuacaucaugaaggagcucccccaggagcgccugcugaucgccgacguggccaucuccgcgagcgaguucauguucgaggagacccggaacuacgucaagcagcgcaaggccuucggcaagaccguggcccaccuccagacggugcagcacaagcuggccgagcugaagacccacaucugcgucacccgggccuucguggacaacugccuccagcugcacgaggcgaagcgccuggacuccgccaccgccugcauggccaaguacugggcgagcgagcuccagaacuccguggccuacgacugcguccagcugcacgggggcuggggguacaugugggaguaccccaucgccaaggccuacguggacgcccgggugcagccgaucuacggcgggacgaacgagaucaugaaggagcugaucgcgcgcgagaucgucuucgacaaguga

SEQ ID NO: 26214 - RNA, 1299 nt, Artificial Sequence
  derived and/or modified sequence opt1 from ACADSB__Homo_sapiens__NP_001600
auggagggccuggccgugcgccuccugcgggggagccgccugcuccggcgcaacuuccugaccugccuguccagcuggaagaucccgccccacgucuccaagagcucccagagcgaggcccuccugaacaucaccaacaacggcauccacuucgcgccccugcagacguucaccgacgaggagaugaugaucaaguccagcgugaagaaguucgcccaggagcagaucgcgccccucguguccaccauggacgagaacagcaagauggagaaguccgucauccaggggcuguuccagcagggccugauggggaucgagguggaccccgaguacggcggcaccggggccagcuuccucuccacggugcuggucaucgaggagcuggccaagguggacgccagcguggccgucuucugcgagauccagaacacccucaucaacacccugauccggaagcacggcaccgaggagcagaaggccacguaccugccgcagcucaccaccgagaaggugggguccuucugccugagcgaggccggcgcgggguccgacagcuucgcccugaagacccgcgccgacaaggagggcgacuacuacgugcucaacggcuccaagauguggaucagcagcgccgagcacgccgggcuguuccuggucauggcgaacguggaccccacgaucggcuacaaggggaucaccuccuuccucguggaccgggacacccccggccugcacaucggcaagcccgagaacaagcuggggcuccgcgccagcuccacgugcccgcugaccuucgagaacgucaaggugcccgaggccaacauccugggccagaucgggcacggcuacaaguacgccaucgggagccucaacgagggccggaucggcaucgccgcgcagaugcuggggcuggcccagggcugcuucgacuacaccauccccuacaucaaggagcgcauccaguucgggaagcgccucuucgacuuccagggccugcagcaccagguggcccacgucgccacccagcuggaggccgcgcggcuccugaccuacaacgccgcccggcugcucgaggccgggaagcccuucaucaaggaggccuccauggcgaaguacuacgccagcgagaucgccggccagacgaccuccaagugcaucgaguggaugggcggggugggcuacaccaaggacuacccgguggagaaguacuuccgcgacgccaagaucgggaccaucuacgagggcgcgagcaacauccagcugaacacgaucgccaagcacaucgacgccgaguacuga

SEQ ID NO: 26215 - RNA, 1239 nt, Artificial Sequence
  derived and/or modified sequence opt1 from ACADS__Homo_sapiens__NP_000008
auggccgccgcgcugcucgcccgcgccagcggccccgcccggcgcgcccugugcccgcgggcguggcgccagcugcacaccaucuaccaguccguggagcuccccgagacccaccagaugcugcugcagacgugccgggacuucgccgagaaggagcuguuccccaucgccgcccaggucgacaaggagcaccuguuccccgcggcccaggugaagaagaugggcgggcuggggcuccuggccauggacgugccggaggagcugggcggggccggccucgacuaccuggccuacgcgaucgccauggaggagaucagccgcggcugcgccuccaccggggucaucaugagcgugaacaacucccuguaccucggccccauccugaaguucgggagcaaggagcagaagcaggccugggugacccccuucaccuccggcgacaagaucgggugcuucgcccugagcgagcccggcaacggcuccgacgcgggggccgccagcacgaccgcccgggccgagggcgacuccuggguccucaacgggaccaaggcguggaucaccaacgccugggaggccagcgccgccgugguguucgcguccacggaccgcgcccugcagaacaagggcaucagcgccuuccuggucccgaugcccacccccggccucacccuggggaagaaggaggacaagcugggcauccggggguccagcaccgccaaccucaucuucgaggacugccgcauccccaaggacuccauccugggcgagccggggaugggcuucaagaucgcgaugcagacgcuggacaugggccggaucgggaucgccagccaggcccucggcaucgcccagaccgcccuggacugcgcggugaacuacgccgagaaccgcauggccuucggggcgccccugaccaagcuccaggugauccaguucaagcuggccgacauggcccuggcccucgaguccgcccggcugcugaccuggcgcgccgccaugcucaaggacaacaagaagcccuucaucaaggaggcggccauggccaagcuggccgcgagcgaggccgccacggccaucagccaccaggccauccagauccugggcgggaugggcuacgucaccgagaugcccgcggagcggcacuaccgcgacgcccggaucaccgagaucuacgagggcaccuccgagauccagcgccucgugaucgccgggcaccuccugcggagcuaccgcuccuga

SEQ ID NO: 26216 - RNA, 1968 nt, Artificial Sequence
  derived and/or modified sequence opt1 from ACADVL__Homo_sapiens__NP_000009
augcaggccgcccgcauggcggccagccugggccggcagcuccugcgccucgggggcggguccagccggcucaccgcccugcugggccagccccgcccggggcccgcccggcgccccuacgccggcggcgcggcccagcucgcccuggacaaguccgacagccaccccuccgacgcccugacccggaagaagccggcgaaggccgagagcaaguccuucgccguggggauguucaagggccagcucacgaccgaccaggucuuccccuaccccagcgugcugaacgaggagcagacccaguuccugaaggagcucguggagcccgucucccgcuucuucgaggaggugaacgacccggccaagaacgacgcccuggagaugguggaggagaccacguggcaggggcugaaggagcucggcgcguucgggcugcagguccccagcgagcugggcggcguggggcucugcaacacccaguacgcccggcugguggagaucgucggcaugcacgaccugggggugggcaucacccucggcgcccaccaguccaucggguucaagggcauccugcuguucgggaccaaggcccagaaggagaaguaccuccccaagcuggccagcggcgagacgguggcggccuucugccugaccgagcccuccagcggguccgacgccgccagcauccgcaccuccgccgucccgagccccugcggcaaguacuacacccucaacggcuccaagcuguggaucagcaacgggggccuggcggacaucuucacgguguucgccaagacccccgugaccgaccccgccaccggggccgucaaggagaagaucacggccuucgugguggagcggggcuucgggggcaucacccacggcccgcccgagaagaagauggggaucaaggcgagcaacaccgccgaggucuucuucgacggcgugcgcgugcccuccgagaacguccucggggaggugggcagcggguucaagguggccaugcacauccugaacaacggccgguucggcauggccgcggcccuggccgggaccaugcgcggcaucaucgccaaggccgucgaccacgcgacgaaccggacccaguucggggagaagauccacaacuucggccucauccaggagaagcuggcccgcauggugaugcugcaguacgucaccgaguccauggccuacauggugagcgccaacauggaccagggcgccaccgacuuccagaucgaggcggccaucuccaagaucuucgggagcgaggccgccuggaaggugacggacgagugcauccagaucaugggcgggaugggcuucaugaaggagcccggggucgagcgggugcuccgcgaccugcggaucuuccgcaucuucgagggcaccaacgacauccugcggcuguucguggcccugcagggcugcauggacaaggggaaggagcuguccggccucgggagcgcgcugaagaacccguucggcaacgccgggcugcuccugggcgaggccggcaagcagcugcgccgccgggccgggcucggcuccgggcugagccuguccggccugguccaccccgagcucagccgcuccggggagcuggcggugcgggcccuggagcaguucgccaccguggucgaggccaagcucaucaagcacaagaagggcaucgugaacgagcaguuccugcugcagcgccucgccgacggcgcgaucgaccuguacgccaugguggucgugcugagccgggccucccgcagccucuccgaggggcaccccaccgcccagcacgagaagaugcugugcgacacguggugcaucgaggccgcggcccggauccgcgagggcauggccgcccugcagagcgaccccuggcagcaggagcucuaccggaacuucaaguccaucagcaaggcccugguggagcgcgggggcgucgugaccagcaacccgcugggguucuga

SEQ ID NO: 26217 - RNA, 7296 nt, Artificial Sequence
  derived and/or modified sequence opt1 from ACAN__Homo_sapiens__NP_001126
augaccacccugcuguggguguucgucacccugcgcgugaucaccgccgccgugaccgucgagaccuccgaccacgacaacucccugagcguguccaucccccagcccagcccccuccgggugcugcugggcaccucccucaccauccccugcuacuucaucgaccccaugcacccggucaccaccgcccccagcacggcgccccucgcgccccgcaucaaguggucccgggugagcaaggagaaggaggugguccugcucguggccaccgaggggcgcgugcgggucaacuccgccuaccaggacaaggugagccugccgaacuaccccgccauccccuccgacgccacccuggaggugcagagccuccgcuccaacgacagcggcgucuaccggugcgaggugaugcacgggaucgaggacuccgaggccacccuggagguggucgugaagggcaucguguuccacuaccgcgccaucagcacgcgguacacccuggacuucgaccgcgcgcagcgggccugccuccagaacuccgccaucaucgccacccccgagcagcugcaggccgcguacgaggacggguuccaccagugcgacgccggcuggcuggccgaccagaccguccgcuacccgauccacacgccccgggagggcugcuacggggacaaggacgaguuccccggcgugcgcaccuacgggauccgggacaccaacgagaccuacgacguguacugcuucgccgaggagauggagggcgaggucuucuacgccacgagccccgagaaguucaccuuccaggaggcggccaacgagugccgccggcucggggcccgccuggccaccaccggccagcuguaccucgccuggcaggcgggcauggacaugugcuccgccggguggcuggccgaccggagcgugcgcuacccgaucagcaaggcccggcccaacugcggcgggaaccugcucggcguccgcacgguguacgugcacgccaaccagaccggcuaccccgaccccuccagccgcuacgacgcgaucugcuacaccggggaggacuucgucgacaucccggagaacuucuucggcgugggcggcgaggaggacaucaccgugcagacggucaccuggcccgacauggagcugccccugccccggaacaucaccgagggggaggcccgcggcuccgugauccucaccgugaagccgaucuucgaggucagccccagcccccuggagcccgaggagccguucacguucgcccccgagaucggcgccaccgcguucgccgagguggagaacgagaccggggaggccacccggcccuggggcuucccgacgcccgggcugggccccgccaccgccuucaccagcgaggaccucgugguccaggugaccgcggugcccgggcagccgcaccuccccggcggcgucguguuccacuaccgccccgggcccacccgguacucccugacguucgaggaggcccagcaggccugccuccgcaccggcgccgugaucgccagcccggagcagcugcaggcggccuacgaggccggguacgagcagugcgacgccggcuggcugcgggaccagaccguccgcuaccccaucgugagcccccggacccccugcgugggggacaaggacagcuccccgggcguccgcacguacggcgugcggcccagcaccgagaccuacgacguguacugcuucgucgaccgccucgagggggagguguucuucgccacccggcuggagcaguucacguuccaggaggcgcuggaguucugcgagucccacaacgccacccucgccaccaccggccagcuguacgccgcguggagccgcgggcuggacaagugcuacgccggcuggcucgccgacggcucccugcgguaccccaucgugacgccccgcccggccugcgggggcgacaagcccgggguccggaccguguaccuguaccccaaccagaccggccuccccgacccgcugagccgccaccacgccuucugcuuccgggggaucuccgcggugcccagccccggcgaggaggagggcgggacccccacguccccgagcggcgucgaggaguggaucgugacccaggugguccccgggguggccgccgugcccgucgaggaggagaccaccgccgugccgagcggcgagacgaccgccauccuggaguucaccaccgagcccgagaaccagacggagugggagcccgcguacacccccguggggaccuccccgcuccccggcauccugcccaccuggcccccgacgggcgccgccaccgaggagagcaccgaggggcccuccgccaccgagguccccagcgccuccgaggagcccagcccguccgaggugcccuuccccagcgaggagcccuccccgagcgaggagcccuuccccuccgugcgccccuucccgagcgucgagcuguuccccuccgaggagcccuuccccagcaaggagccgucccccagcgaggagcccuccgcgagcgaggagcccuacacgccguccccgcccgugccguccuggaccgagcugcccagcuccggcgaggagagcggggcccccgacguguccggcgacuucaccgggagcggcgacgucuccggccaccucgacuucagcgggcagcuguccggcgaccgcgccagcgggcugcccuccggcgaccucgacagcuccgggcugaccagcacggugggcuccggccugccgguggagagcgggcuccccuccggcgacgaggagcggaucgaguggcccagcacccccaccgucggggagcugccguccggcgccgagauccuggagggcagcgcgagcggggugggcgaccucuccgggcugcccagcggcgaggugcuggagaccuccgccagcggggucggcgaccucuccggccugcccagcggggaggugcuggagaccacggcccccggcgucgaggacaucuccgggcucccgagcggcgaggugcuggagaccaccgcccccgggguggaggacaucuccggccugcccagcggcgagguccucgagaccacggcccccgggguggaggacaucuccggccugccgagcggggaggugcuggagaccaccgcgcccggcgucgaggacaucuccgggcuccccagcggcgaggugcuggagaccacggcccccggcguggaggacaucuccgggcugccgagcggcgagguccucgagaccaccgcccccgggguggaggacaucuccggccugcccagcggcgaggugcuggagaccgccgcccccggggucgaggacaucuccggccucccgagcggggaggugcuggagacggcggcccccggcguggaggacaucagcgggcugcccuccggcgagguccucgagaccgccgcccccggcguggaggacaucagcgggcugccguccggcgaggugcuggagaccgccgcgcccggggucgaggacaucagcggccuccccuccggggaggugcuggagaccgccgccccgggcguggaggacaucagcggccugcccuccggggagguccucgagacggccgcccccggcguggaggacaucagcgggcugcccuccggcgaggugcuggagaccgcggccccgggggucgaggacaucagcggccuccccuccggcgaggugcuggagaccgccgcccccgggguggaggacaucagcggccugcccuccggggagguccucgagaccgcggccccgggcguggaggacaucagcgggcugcccuccggcgaggugcuggagacggccgcccccggcgucgaggacaucagcgggcuccccuccggcgaggugcuggagaccgccgcgccggggguggaggacaucagcggccugcccuccggcgagguccucgagaccgccgcccccgggguggaggacaucagcggccugcccagcggggaggugcuggagaccgccgccccgggcgucgaggacaucuccgggcuccccagcggcgaggugcuggagacggcggcccccggcguggaggacaucuccgggcugcccagcggcgagguccucgagaccgccgccccggggguggaggacaucuccggccugcccagcggggaggugcuggagaccgccgcgcccggcgucgaggacaucuccggccuccccagcggggaggugcuggagaccacggccccgggcguggaggagaucuccgggcugcccagcggcgagguccucgagaccaccgcccccgggguggacgagaucuccggccugccgagcggcgaggugcuggagaccacggcccccggggucgaggagaucuccggccuccccagcggggaggugcuggagaccuccaccagcgcggugggcgaccuguccgggcuccccagcggcggcgagguccuggagaucuccgugagcggggucgaggacaucagcggccugccguccggggaggugguggagaccagcgccuccggcaucgaggacgucagcgagcuccccuccggcgaggggcuggagacgagcgccuccggcguggaggaccugagccgccuccccuccggggaggaggugcuggagaucagcgccuccggcuucggggaccugagcggccuccccuccggcggggagggccuggagaccagcgccuccgaggucgggaccgaccugagcggccucccguccgggcgggagggccuggagaccagcgcguccggcgccgaggaccugagcgggcuccccagcggcaaggaggaccuggugggguccgccagcggcgaccuggaccucgggaagcugcccuccggcacccugggcagcgggcaggcccccgagacguccggccucccgagcggguucuccggcgaguacagcggcguggaccugggguccgggccgcccagcgggcugcccgacuucuccggccucccgagcggguuccccaccgucucccugguggacagcacccugguggaggucgugaccgccuccacggcgagcgagcucgagggccgcggcaccaucgggaucuccggcgccggggagaucagcggccugcccagcuccgagcuggacaucagcgggcgggccuccggccugcccagcggcaccgagcucuccgggcaggccagcggcuccccggacgugagcggggagauccccggccuguucggggucuccggccagcccagcggcuuccccgacaccuccggggagacgagcggcgugaccgagcuguccgggcucagcuccggccagccggggaucagcggcgaggccuccggcgugcuguacgggaccagccagcccuucggcaucaccgaccuguccggggagacgagcggcguccccgaccucagcggccagcccuccgggcugccgggcuucagcggggcgaccuccggcgugcccgaccuggugagcgggaccaccuccggcagcggcgaguccagcgggaucacguucgucgacaccucccucguggagguggcccccaccaccuucaaggaggaggagggccuggggagcgucgagcuguccggccucccgagcggggaggccgaccuguccggcaagagcggcaugguggacguguccgggcaguucagcggcacggucgacuccagcggguucaccucccagacccccgaguucagcggccugcccagcgggaucgccgagguguccggcgagagcucccgcgcggagaucggcagcucccuccccagcggggccuacuacggcuccgggaccccgagcuccuuccccacggugagccuggucgaccggacccugguggaguccgugacccaggcccccaccgcccaggaggccggcgagggccccagcgggauccucgagcuguccggcgcgcacagcggggccccggacauguccggcgagcacagcggguuccuggaccucuccggccugcagagcggccugaucgagcccuccggggagccgcccggcacgccguacuucagcggggacuucgccagcaccaccaacgucuccggcgagagcuccguggccauggggaccagcggcgaggccuccggccuccccgaggugacgcugaucaccagcgaguucgucgagggggugaccgagcccaccaucucccaggagcugggccagcgcccgcccgugacgcacacgccccagcuguucgagagcuccgggaaggucagcaccgcgggcgacaucuccggggccacccccgugcugcccggcagcggcguggaggucuccagcgugcccgaguccagcuccgagacgagcgccuaccccgaggccggguucggcgccuccgcggcccccgaggccagccgggaggacagcgggucccccgaccugagcgagaccaccuccgccuuccacgaggccaaccucgagcgcagcuccggccugggggugagcggcuccacccugaccuuccaggagggcgaggcgagcgccgccccggaggucuccggggagagcacgaccaccuccgacgugggcaccgaggcccccgggcuccccagcgcgacgcccaccgccuccggcgaccggaccgagaucagcggcgaccuguccgggcacaccagccagcugggcguggucaucuccacgagcaucccggaguccgaguggacccagcagacccagcgccccgccgagacccaccucgagaucgagagcagcucccugcuguacagcggggaggagacgcacaccguggagaccgccaccucccccacggacgccagcaucccggcgucccccgaguggaagcgggagagcgaguccaccgccgccgaccaggaggugugcgaggagggcuggaacaaguaccaggggcacugcuaccgccacuuccccgaccgggagaccugggucgacgccgagcgccggugccgcgagcagcagagccaccucuccagcaucgugacccccgaggagcaggaguucgucaacaacaacgcccaggacuaccaguggaucggccugaacgaccggacgaucgagggcgacuuccgcugguccgacgggcacccgaugcaguucgagaacuggcggcccaaccagcccgacaacuucuucgcggccggcgaggacugcguggugaugaucuggcacgagaagggggaguggaacgacguccccugcaacuaccaccuccccuucacgugcaagaagggcaccgccaccacguacaagcgccgccugcagaagcggagcucccgccacccccggcgcagccggcccuccaccgcccacuga

SEQ ID NO: 26218 - RNA, 1284 nt, Artificial Sequence
  derived and/or modified sequence opt1 from ACAT1__Homo_sapiens__NP_000010
auggccgugcuggccgcgcuccugcgcagcggcgcccggucccgcagcccccugcuccggcgccugguccaggagauccgguacguggagcgcuccuacgugagcaagccgacccugaaggaggucgugaucguguccgccacccggacgcccaucgggagcuuccucggcucccugagccugcuccccgccaccaagcugggguccaucgccauccagggcgcgaucgagaaggccgggauccccaaggaggaggucaaggaggccuacaugggcaacgugcugcagggcggggagggccaggccccgacccgccaggcggugcucggggccggccugcccaucagcacccccugcacgaccaucaacaaggucugcgccuccgggaugaaggccaucaugauggccagccagucccugaugugcggccaccaggacgugaugguggcgggcgggauggagagcauguccaacguccccuacgugaugaaccggggcagcaccccguacgggggcgugaagcucgaggaccugaucgucaaggacggccugaccgacguguacaacaagauccacaugggguccugcgccgagaacacggccaagaagcucaacaucgcccgcaacgagcaggacgccuacgcgaucaacagcuacacccgguccaaggccgccugggaggccggcaaguucgggaacgaggugauccccgucaccgugaccgugaagggccagcccgacgucguggugaaggaggacgaggaguacaagcgcgucgacuucagcaaggugcccaagcugaagacggucuuccagaaggagaacgggaccgugaccgccgcgaacgccagcacccugaacgacggcgccgccgcccucgugcugaugacggcggacgccgccaagcggcugaacgucaccccgcucgcccgcaucguggcguucgccgacgccgccguggagcccaucgacuuccccaucgcccccgucuacgcggccuccauggugcugaaggacgugggccugaagaaggaggacaucgccaugugggaggucaacgaggccuucagccucguggugcuggccaacaucaagaugcuggagaucgacccgcagaaggucaacaucaacgggggcgcggugucccucgggcaccccaucggcaugagcggggcccggaucgugggccaccugacccacgcccugaagcagggcgaguacgggcucgccuccaucugcaacggcgggggcggggccagcgcgaugcugauccagaagcuguga

SEQ ID NO: 26219 - RNA, 1281 nt, Artificial Sequence
  derived and/or modified sequence opt1 from ACAT2__Homo_sapiens__NP_001290182
augggcagccaccccgugcugcgcaucugggggaaccggcgcgccaccgccgcgucccucggccggagcgggggccgccuguccagcccgcggcugcuccgcgucguggcccccacccugacguucgcccagaccucccggugcagcuucaacggggcccuggccgcggugcccguccaggaccucggcuccaccgugaucaaggaggugcugaagcgcgccaccgucgcccccgaggacgugagcgaggugaucuucggccacguccuggccgcggggugcggccagaacccggugcggcaggccuccgugggggccggcauccccuacagcguccccgccugguccugccagaugaucugcgggagcggccucaaggccgugugccuggcggugcaguccaucggcaucggggacagcuccaucgucguggccggcgggauggagaacaugagcaaggcgccccaccuggccuaccuccgcacgggcgugaagaucggcgagaugccgcugaccgacuccauccugugcgacgggcucaccgacgccuuccacaacugccacaugggcaucaccgccgagaacgucgccaagaaguggcaggucagccgggaggaccaggacaagguggccgugcugucccagaaccgcacggagaacgcccagaaggccgggcacuucgacaaggagaucgugcccgugcuggucagcacccggaagggccucaucgaggugaagaccgacgaguucccccgccacgggagcaacaucgaggcgauguccaagcugaagcccuacuuccugaccgacggcacgggcaccgucaccccggccaacgccagcgggaucaacgacggcgccgccgcgguggugcucaugaagaaguccgaggccgacaagcgggggcugacgccccuggcccgcaucgucagcuggucccaggugggcguggagcccagcaucauggggaucggccccaucccggccaucaagcaggcggucaccaaggccggcuggucccucgaggacguggacaucuucgagaucaacgaggccuucgccgccgugagcgcggccaucgucaaggagcuggggcugaaccccgagaaggugaacaucgagggcggggccaucgcccucggccacccccugggggccuccggcugccggauccuggugacccuccugcacacccuggagcgcaugggccggagccgcggggucgcggcccucugcaucggcgggggcaugggcaucgccaugugcgugcagcgggaguga

SEQ ID NO: 26220 - RNA, 1587 nt, Artificial Sequence
  derived and/or modified sequence opt1 from ACBD3__Homo_sapiens__NP_073572
auggccgccgugcugaacgcggagcgccucgaggucagcguggacggccugacccugucccccgacccggaggagcggcccggggccgagggcgcgccccuccugcccccgccccugcccccgcccagcccgcccggguccggccgcgggcccggcgccagcggcgagcagcccgagcccggggaggccgccgccggcggggccgccgaggaggcgcggcgccucgagcagcgguggggcuucgggcuggaggagcuguacggccucgcccugcgcuucuucaaggagaaggacggcaaggccuuccaccccaccuacgaggagaagcugaagcucguggcccugcacaagcagguccugauggggcccuacaacccggacacgugccccgaggugggcuucuucgacgugcucgggaacgaccggcgccgggagugggccgcgcugggcaacauguccaaggaggacgccauggucgaguucgugaagcugcucaaccgcugcugccaccuguucagcaccuacguggccucccacaagaucgagaaggaggagcaggagaagaagcggaaggaggaggaggagcgccggcgccgggaggaggaggagcgcgagcggcugcagaaggaggaggagaagcgccggcgcgaggaggaggagcggcuccgccgcgaggaggaggagcggcgccggaucgaggaggagcgccugcggcuggagcagcagaagcagcagaucauggccgcccucaacagccagaccgcgguccaguuccagcaguacgccgcccagcaguaccccggcaacuacgagcagcagcagauccugauccgccagcugcaggagcagcacuaccagcaguacaugcagcagcucuaccaggugcagcuggcccagcagcaggccgcgcugcagaagcagcaggagguggucguggccggguccagccuccccaccuccagcaaggugaacgccacggucccguccaacaugaugagcgugaacggccaggccaagacccacaccgacuccagcgagaaggagcuggagcccgaggccgcggaggaggcccuggagaacgggcccaaggagucccuccccgugaucgccgccccgagcauguggacccggccccagaucaaggacuucaaggagaagauccagcaggacgcggacuccgucaucacggugggccgcggggagguggucaccgugcgggugcccacccacgaggagggcagcuaccuguucugggaguucgccaccgacaacuacgacaucggcuucggggucuacuucgaguggacggacagccccaacaccgccguguccguccacgugagcgaguccagcgacgacgacgaggaggaggaggagaacaucggcugcgaggagaaggccaagaagaacgccaacaagccgcugcucgacgagaucgugcccgucuaccgccgggacugccacgaggagguguacgcggggucccaccaguaccccggccgcgggguguaccugcugaaguucgacaacagcuacucccucuggcggagcaaguccgucuacuaccgcguguacuacacccgguga

SEQ ID NO: 26221 - RNA, 1026 nt, Artificial Sequence
  derived and/or modified sequence opt1 from ACBD4__Homo_sapiens__NP_001129176
augggcaccgagaaggagagccccgagccggacugccagaagcaguuccaggccgccguguccgucauccagaaccugcccaagaacgggagcuaccgccccuccuacgaggagaugcuccgguucuacagcuacuacaagcaggcgaccaugggccccugccuggugccgcgccccggguucugggaccccaucggccgguacaagugggacgccuggaacucccuggggaagaugagccgcgaggaggccauguccgccuacaucacggagaugaagcucguggcccagaaggucaucgacaccgugccccugggcgagguggcggaggacauguucggcuacuucgagccgcuguaccaggucauccccgacaugccccggcccccggagaccuuccuccgccgggugaccggguggaaggagcaggucgugaacggcgacgugggggccgugagcgagccgcccugccugcccaaggagcccgccccgcccucccccgccagccugugggcggucacgcuccccaccccgccccagucccccauccaccccggcaccuggacgccccgcuucagcgugauccccugguccagcuggucccugagcugguucgggcaguccagcggccagcaccuggaggaguccgugauccccggcaccgccccgugcccgccccagcggaagcgcgggugcggcgccgcccggcgcgggccccggagcuggaccugcggcugcuggggccaguucgagcacuaccgccgggccugccgccggugccgccgggggugccgcgcguggcgggccugccccggcccccucagccgcgggcgcucccccggcccgguccuggggcacggcccccugggcagccgggggccccgcugcuccagcuccagcugcggccccuccagcuccagcggguccagcgagugcuucggcccgaagcgcggggacugccaguggcggggccucugcucccagcugcggcugagcugcugcgcccucucccugccccgcguguga

SEQ ID NO: 26222 - RNA, 1473 nt, Artificial Sequence
  derived and/or modified sequence opt1 from ACBD5__Homo_sapiens__NP_001035938
auggccgacacccgcagcgugcacgagacccgguucgaggccgcggucaaggugauccagucccugcccaagaacggcagcuuccagccgacgaacgagaugaugcucaaguucuacuccuucuacaagcaggccaccgaggggcccugcaagcugagccgccccggcuucugggaccccaucgggcgguacaagugggacgccugguccagccugggcgacaugaccaaggaggaggccaugaucgccuacguggaggagaugaagaagaucaucgagaccaugccgaugacggagaaggucgaggagcuccugcgcgugaucgggcccuucuacgagaucguggaggacaagaaguccggccggagcuccgacaucaccagcgaccugggcaacguccucaccuccacccccaacgcgaagacggugaacgggaaggccgagagcuccgacagcggcgccgaguccgaggaggaggaggcccaggaggaggugaagggggcggagcagagcgacaacgacaagaagaugaugaagaaguccgccgaccacaagaaccuggaggucaucgugaccaacggcuacgacaaggacggguucgugcaggacauccagaacgacauccacgccagcuccagccugaacggccgcagcaccgaggaggucaagcccaucgacgagaaccucggccagaccgggaaguccgccgugugcauccaccaggacaucaacgacgaccacguggaggacgucacgggcauccagcaccugaccagcgacuccgacagcgagguguacugcgacuccauggagcaguucgggcaggaggagagccuggacuccuucaccagcaacaacggcccguuccaguacuaccucggcgggcacuccagccagcccauggagaacuccggcuuccgggaggacauccaggugccgcccgggaacggcaacaucgggaacaugcaggucguggccguggagggcaagggcgaggucaagcacgggggcgaggacgggcgcaacaacagcggcgcgccccaccgggagaagcgcgggggcgagaccgacgaguucuccaacgugcggcgcggccgggggcaccgcaugcagcaccugagcgagggcacgaaggggcgccaggugggcuccgggggcgacggcgagcggugggggagcgaccggggcucccgcgggagccugaacgagcagaucgcccucguccugaugcggcugcaggaggacaugcagaacgugcuccagcgccugcagaagcuggagacccucaccgcccugcaggccaaguccagcaccagcacgcugcagaccgcgccccagcccaccucccagcggcccagcugguggccguucgagaugucccccggcguccucaccuucgccaucaucuggcccuucaucgcccaguggcugguguaccuguacuaccagcgccgccggcgcaagcucaacuga

SEQ ID NO: 26223 - RNA, 849 nt, Artificial Sequence
  derived and/or modified sequence opt1 from ACBD6__Homo_sapiens__NP_115736
auggccagcuccuuccugcccgccggcgcgaucaccggggacagcggcggggagcucuccagcggcgacgacuccggggagguggaguucccgcacagccccgagaucgaggagaccuccugccuggccgagcuguucgagaaggccgccgcccaccuccagggccugauccaggucgcgagccgcgagcagcugcucuaccuguacgcccgguacaagcaggucaaggugggcaacugcaacacgcccaagcccuccuucuucgacuucgaggggaagcagaagugggaggccuggaaggcccugggcgacagcuccccgagccaggcgaugcaggaguacaucgccguggugaagaagcucgaccccggguggaacccccagauccccgagaagaagggcaaggaggccaacaccggguucggcggcccggugaucuccagccuguaccacgaggagaccauccgcgaggaggacaagaacaucuucgacuacugccgggagaacaacaucgaccacaucaccaaggccaucaaguccaagaacgucgacgugaacgugaaggacgaggaggggcgcgcccugcuccacugggcgugcgaccggggccacaaggagcuggucacggugcugcuccagcaccgcgccgacaucaacugccaggacaacgaggggcagaccgcccugcacuacgccagcgccugcgaguuccuggacaucguggagcuccugcugcaguccggcgcggaccccacccuccgggaccaggacggcugccugcccgaggaggucaccgggugcaagacggugagccuggugcuccagcgccacaccaccggcaaggccuga

SEQ ID NO: 26224 - RNA, 1506 nt, Artificial Sequence
  derived and/or modified sequence opt1 from ACCS__Homo_sapiens__NP_115981
auguucacccugccccagaaggacuuccgcgccccgaccacgugccucggcccgaccugcaugcaggaccuggggagcucccacggcgaggaccuggagggggagugcagccggaagcucgaccagaagcugcccgagcugcgcggcgugggggaccccgccaugaucuccagcgacaccuccuaccucagcucccggggccgcaugaucaagugguucugggacagcgcggaggagggcuaccggaccuaccacauggacgaguacgacgaggacaagaaccccuccgggaucaucaaccugggcacgagcgagaacaagcugugcuucgaccuccuguccuggcgccugagccagcgggacaugcagcgcgucgagcccucccuccugcaguacgccgacuggcgggggcaccuguuccuccgcgaggagguggccaaguuccugagcuucuacugcaagucccccgugccccugcggccggagaacgucguggugcucaacggcggggccagccuguucuccgcccuggcgaccguccucugcgaggccggcgaggccuuccugauccccacccccuacuacggcgccaucacccagcacgugugccuguacgggaacauccgccucgcguacguguaccuggacagcgaggucacgggccuggacacccggcccuuccagcucaccguggagaagcuggagauggcccugcgcgaggcccacuccgagggggugaaggucaagggccucauccugaucagcccgcagaacccccugggcgacguguacagccccgaggagcuccaggaguaccugguguucgccaagcggcaccgccugcacgucaucguggacgagguguacaugcucuccgucuucgagaaguccgugggguaccggagcgugcugagccuggagcgccuccccgacccgcagcggacccacgucaugugggccacguccaaggacuucggcaugagcgggcugcgcuucggcacccuguacaccgagaaccaggacguggcgaccgccguggccucccucugccgguaccacgggcugagcggccugguccaguaccagauggcccagcuccugcgcgaccgcgacuggaucaaccagguguaccugcccgagaaccacgcccggcucaaggcggcccacacguacgucuccgaggagcugcgcgcccugggcauccccuuccugagccgcggggccggcuucuucaucuggguggaccuccggaaguaccugcccaaggggaccuucgaggaggagaugcugcucuggcggcgcuuccuggacaacaaggugcugcucuccuucggcaaggccuucgagugcaaggagccggggugguuccgguucgucuucagcgaccaggugcaccgccugugccugggcaugcagcgggugcagcagguccucgcgggcaagucccagguggccgaggacccccgccccagccagucccaggagcccagcgaccagcggcgcuga

SEQ ID NO: 26225 - RNA, 1635 nt, Artificial Sequence
  derived and/or modified sequence opt1 from ACD__Homo_sapiens__NP_001075955
augcccggccgcugccagagcgacgccgccaugcgggugaacgggcccgcgucccgcgcccccgccggcuggaccagcgggucccugcacaccggcccccgggccgggcgcccccgggcccaggcgcgcggcguccggggccgcgggcuccugcugcggccgcgccccgccaaggagcucccccugccccggaagggcggggccugggccccggcgggcaaccccgggccccugcacccccucggcguggccgugggcauggccgggagcggccgccugguccugcggccguggauccgcgagcucauccugggguccgagacgcccagcagcccccgggccggccagcugcucgaggugcugcaggacgccgaggcggccguggccggccccucccacgccccggacaccuccgacgucggggccacccugcucgugagcgacggcacccacuccgugcgcugccuggucacgcgggaggcgcuggacaccagcgacugggaggagaaggaguucggguuccgcggcaccgaggggcggcuccugcugcuccaggacugcggcgugcacgugcaggucgccgagggcggggcccccgccgaguucuaccuccagguggaccgcuucucccugcuccccaccgagcagccccggcugcgcgugccgggcugcaaccaggaccuggacguccagaagaagcucuacgacugccuggaggagcaccugagcgaguccacgagcuccaacgccgggcucagccugucccagcugcucgacgagaugcgcgaggaccaggagcaccagggcgcgcuggugugccuggccgagagcugccucacccuggaggggcccugcaccgccccgcccgugacccacugggccgccagccggugcaaggcgacgggcgaggccgucuacaccgugcccuccagcaugcugugcaucuccgagaacgaccagcucauccugagcucccugggccccugccagcgcacccaggggcccgagcugcccccgcccgaccccgcccugcaggaccugagccucacccugaucgccuccccgcccagcucccccagcuccagcggcacgcccgcgcugccggggcacauguccagcgaggaguccggcaccagcaucucccuccugcccgcccugagccuggccgcccccgaccccgggcagcgguccagcagccagccgucccccgccaucugcagcgcgcccgccacccucacgccccgcuccccgcacgccagccggacccccuccagcccccugcaguccugcacccccagccuguccccgcgcagccacgugcccagcccccaccaggcccucgucacccggccccagaagccgucccuggaguucaaggaguucgugggccugcccugcaagaaccgcccgcccuucccccggaccggcgccacgcgcggggcgcaggagcccugcuccgugugggagcccccgaagcggcaccgcgacggcagcgccuuccaguacgaguacgagccgcccugcaccucccucugcgcccggguccaggccgugcgccugccgccccagcugauggccugggcgcuccacuuccugauggacgcccagcccgggagcgagcccacccccauguga

SEQ ID NO: 26226 - RNA, 2418 nt, Artificial Sequence
  derived and/or modified sequence opt1 from ACE2__Homo_sapiens__NP_068576
augagcuccagcuccuggcugcuccugagccugguggccgucaccgccgcgcaguccaccaucgaggagcaggccaagacguuccucgacaaguucaaccacgaggccgaggaccuguucuaccagagcucccuggccagcuggaacuacaacaccaacaucaccgaggagaacgugcagaacaugaacaacgccggcgacaagugguccgcguuccucaaggagcagagcacccuggcccagauguacccccugcaggagauccagaaccucacggugaagcugcagcugcaggcccuccagcagaacggguccagcguccuguccgaggacaagagcaagcgccugaacaccauccucaacaccauguccaccaucuacagcacgggcaaggugugcaacccggacaacccccaggagugccugcugcucgagcccgggcugaacgagaucauggccaacucccuggacuacaacgagcggcucugggcgugggagagcuggcgcuccgaggugggcaagcagcugcggccccuguacgaggaguacgucgugcucaagaacgagauggcccgcgccaaccacuacgaggacuacggggacuacuggcggggcgacuacgaggugaacggcgucgacggguacgacuacagccgcggccagcugaucgaggacguggagcacaccuucgaggagaucaagccgcuguacgagcaccuccacgccuacgugcgggccaagcugaugaacgcguaccccagcuacaucucccccaucgggugccugcccgcccaccuccugggcgacaugugggggcgcuucuggaccaaccuguacagccucaccgucccguucggccagaagcccaacaucgacgugacggacgccaugguggaccaggccugggacgcccagcggaucuucaaggaggcggagaaguucuucgucuccgugggccugcccaacaugacccagggguucugggagaacagcaugcugaccgaccccggcaacgugcagaaggccgucugccacccgaccgccugggaccucgggaagggcgacuuccgcauccugaugugcacgaaggugaccauggacgacuuccugaccgcccaccacgagaugggccacauccaguacgacauggccuacgcggcccagcccuuccuccugcggaacggggccaacgagggcuuccacgaggccgugggggagaucaugucccugagcgccgcgacccccaagcaccucaaguccaucggccugcugagccccgacuuccaggaggacaacgagacggagaucaacuuccuccugaagcaggcccugaccaucgucgggacccucccguucaccuacaugcuggagaaguggcgcuggaugguguucaagggcgagauccccaaggaccaguggaugaagaaguggugggagaugaagcgggagaucgugggcgucguggagcccgucccccacgacgagacguacugcgacccggccucccuguuccacgugagcaacgacuacuccuucauccgcuacuacacccggacccuguaccaguuccaguuccaggaggcccucugccaggcggccaagcacgaggggccccugcacaagugcgacaucagcaacuccaccgaggccggccagaagcuguucaacaugcuccgccugggcaagagcgagcccuggacgcuggcccucgagaacguggucggcgccaagaacaugaacgugcggccccugcugaacuacuucgagccccucuucaccuggcugaaggaccagaacaagaacuccuucgugggguggagcaccgacuggucccccuacgcggaccagagcaucaagguccgcaucucccucaagagcgcccugggcgacaaggccuacgaguggaacgacaacgagauguaccuguuccggagcuccguggccuacgccaugcgccaguacuuccugaaggugaagaaccagaugauccucuucggcgaggaggacguccggguggcgaaccugaagccccgcaucagcuucaacuucuucgugaccgcccccaagaacgucuccgacaucaucccgcgcacggagguggagaaggccauccggaugagccgcucccggaucaacgacgccuuccgccugaacgacaacagccucgaguuccuggggauccagcccacccuggggcccccgaaccagccgcccguguccaucuggcucaucgucuucgggguggugaugggcgucaucgugguggggaucgucauccugaucuucaccggcauccgggaccgcaagaagaagaacaaggcccggagcggcgagaaccccuacgcguccaucgacaucagcaagggggagaacaacccgggcuuccagaacaccgacgacgugcagacguccuucuga

SEQ ID NO: 26227 - RNA, 3921 nt, Artificial Sequence
  derived and/or modified sequence opt1 from ACE__Homo_sapiens__NP_000780
augggcgccgccagcgggcgccggggccccgggcugcuccugccgcugccccuccugcugcuccugccgccccagcccgcgcuggcccucgaccccggccugcagcccgggaacuucuccgccgacgaggccggcgcccagcuguucgcgcagagcuacaacuccagcgccgagcagguccucuuccaguccguggccgccagcugggcgcacgacaccaacaucaccgccgagaacgcccgccggcaggaggaggccgcccugcugucccaggaguucgcggaggccuggggccagaaggccaaggagcucuacgagcccaucuggcagaacuucacggacccgcagcugcgccggaucaucggggccgugcgcacccugggcagcgccaaccucccccuggcgaagcggcagcaguacaacgcccugcucuccaacaugagccgcaucuacuccaccgccaaggugugccugcccaacaagaccgccacgugcuggagccuggaccccgaccucaccaacauccuggccuccagccgguccuacgcgaugcuccuguucgccugggagggguggcacaacgccgccggcaucccgcugaagccccuguacgaggacuucaccgcccucagcaacgaggcguacaagcaggacggguucaccgacacgggcgccuacuggcgcuccugguacaacagccccaccuucgaggacgaccuggagcaccuguaccagcagcucgagccccuguaccugaaccuccacgccuucguccggcgcgcccugcaccggcgcuacggcgaccgguacaucaaccugcgcgggccgauccccgcgcaccuccugggcgacaugugggcccaguccugggagaacaucuacgacaugguggugcccuuccccgacaagccgaaccuggacgucaccagcaccaugcuccagcagggguggaacgccacgcacauguuccggguggccgaggaguucuucaccagccuggagcugucccccaugccgcccgaguucugggagggcagcaugcucgagaagcccgccgacggccgcgagguggucugccacgcguccgccugggacuucuacaaccggaaggacuuccgcaucaagcagugcacccgggugaccauggaccagcugagcacggugcaccacgagauggggcacauccaguacuaccugcaguacaaggaccuccccgucucccugcgccgcggcgccaaccccggguuccacgaggccaucggcgacgugcuggcccugagcguguccacccccgagcaccuccacaagaucgggcugcuggaccgggucaccaacgacaccgagagcgacaucaacuaccuccugaagauggcgcuggagaagaucgccuuccucccguucggcuaccugguggaccaguggcgcuggggcguguucuccgggcggacgccgcccagccgcuacaacuucgacuggugguaccugcggaccaaguaccagggcaucugcccgcccgucacccgcaacgagacccacuucgacgccggggccaaguuccacgugcccaacgugacgcccuacauccgguacuucgucuccuucgugcuccaguuccaguuccacgaggcccugugcaaggaggcgggcuacgaggggccccugcaccagugcgacaucuaccgcagcaccaaggccggcgccaagcuccggaaggugcugcaggccggcuccagccgccccuggcaggagguccugaaggacaugguggggcucgacgcgcuggacgcccagccccugcucaaguacuuccagcccgucacccaguggcugcaggagcagaaccagcagaacggcgaggugcugggguggccggaguaccaguggcacccgccccuccccgacaacuaccccgagggcaucgaccuggugaccgacgaggccgaggccuccaaguucgucgaggaguacgaccggacgagccaggugguguggaacgaguacgccgaggcgaacuggaacuacaacaccaacaucaccaccgagacguccaagauccugcuccagaagaacaugcagaucgccaaccacacccugaaguacgggacccaggcccgcaaguucgacgucaaccagcugcagaacaccacgaucaagcggaucaucaagaaggugcaggaccucgagcgcgccgcccugcccgcgcaggagcuggaggaguacaacaagauccuccuggacauggagaccaccuacagcguggccaccgucugccaccccaacggcuccugccugcagcucgagcccgaccugaccaacgugauggccacgagccggaaguacgaggaccugcucugggccugggagggcuggcgcgacaaggccgggcgggcgauccugcaguucuacccgaaguacguggagcugaucaaccaggccgcccgccucaacggcuacgucgacgccggggacagcuggcgguccauguacgagacccccagccuggagcaggaccuggagcgccucuuccaggagcugcagccccuguaccucaaccugcacgcguacgugcgccgggcccugcaccgccacuacggcgcccagcacaucaaccucgagggccccaucccggcccaccuccuggggaacaugugggcccagaccugguccaacaucuacgaccuggugguccccuuccccagcgcgcccuccauggacaccacggaggccaugcugaagcagggcuggaccccgcggcgcauguucaaggaggccgacgacuucuucaccagccuggggcuccugcccgugcccccggaguucuggaacaaguccaugcuggagaagcccaccgacggccgggagguggucugccacgccagcgccugggacuucuacaacgggaaggacuuccgcaucaagcagugcacgaccgugaaccucgaggaccugguggucgcgcaccacgagaugggccacauccaguacuucaugcaguacaaggaccugcccguggcccuccgggagggcgccaaccccggguuccacgaggccaucggcgacgugcuggcccuguccgucagcaccccgaagcaccuccacucccugaaccugcucagcuccgagggcgggagcgacgagcacgacaucaacuuccugaugaagauggcgcuggacaagaucgccuucauccccuucuccuaccucguggaccaguggcgcuggcggguguucgacgggagcaucaccaaggagaacuacaaccaggagugguggucccugcgccugaaguaccagggccucugcccgcccgucccccggacgcagggcgacuucgaccccggggccaaguuccacauccccagcagcgugcccuacauccgcuacuucguguccuucaucauccaguuccaguuccacgaggcccugugccaggccgcgggccacaccgggccgcugcacaagugcgacaucuaccagagcaaggaggccggccagcggcucgccaccgccaugaagcugggguucucccgccccuggcccgaggcgaugcagcugaucaccggccagcccaacaugagcgccuccgccaugcucagcuacuucaagccgcugcuggacuggcuccggacggagaacgagcugcacggcgagaagcugggguggccccaguacaacuggacccccaacuccgcccgcagcgagggcccccucccggacuccgggcgggucagcuuccugggccuggaccucgacgcccagcaggcgcgcguggggcaguggcugcuccuguuccugggcaucgcccugcucguggccacccugggccugucccagcggcuguucagcauccgccaccggucccuccaccgccacagccacgggccccaguucggcuccgaggucgagcugcgccacagcuga

SEQ ID NO: 26228 - RNA, 828 nt, Artificial Sequence
  derived and/or modified sequence opt1 from ACER2__Homo_sapiens__NP_001010887
augggcgcgccccacuggugggaccagcugcaggccgggagcuccgagguggacuggugcgaggacaacuacaccaucgucccggccaucgccgaguucuacaacaccaucagcaacguccucuucuucauccugccgcccaucugcaugugccuguuccgccaguacgccacgugcuucaacuccggcaucuaccucaucuggacccugcugguggugguggggaucggcagcguguacuuccacgccacccucuccuuccuggggcagaugcuggacgagcucgccguccugugggugcugaugugcgcgcucgccaugugguucccccggcgcuaccugcccaagaucuuccggaacgaccgcggccgguucaagguggucgugagcgugcuguccgccgucaccacgugccucgccuucgugaagcccgcgaucaacaacaucagccugaugacccugggcgugcccugcaccgcccuccugaucgccgagcugaagcgcugcgacaacaugcgggucuucaagcucgggcuguucuccggccugugguggacccucgcccuguucugcuggaucagcgaccgcgccuucugcgagcugcucuccagcuucaacuuccccuaccugcacugcauguggcacauccugaucugccucgcggccuaccuggggugcgugugcuucgccuacuucgacgccgccuccgagaucccggagcagggccccgugaucaaguucuggcccaacgagaagugggcguucaucgggguccccuacgugagccugcucugcgccaacaagaaguccagcgugaagaucacguga

SEQ ID NO: 26229 - RNA, 693 nt, Artificial Sequence
  derived and/or modified sequence opt1 from ACER3__Homo_sapiens__NP_001287882
auggcccccgccgcggaccgcgagggcuacugggggccgaccaccagcacgcuggacuggugcgaggagaacuacuccgugaccugguacaucgccgaguuccucgucggcauggggagcuggugcuuccacaugacccugaaguacgagaugcagcugcucgacgagcugcccaugaucuacuccugcugcaucuucguguacugcauguucgagugcuucaagaucaagaacagcgugaacuaccaccuccuguucacccugguccuguucucccucaucgugacgaccguguaccugaaggucaaggagcccaucuuccaccaggugauguacggcaugcugguguucacccucguccugcggagcaucuacaucgugaccuggguguaccccuggcugcgcgggcucggcuacacgucccugggcaucuuccugcucggguuccuguucuggaacaucgacaacaucuucugcgagagccugcggaacuuccgcaagaaggucccgcccaucaucggcaucaccacccaguuccacgccugguggcacauccucaccgggcugggcuccuaccugcacauccucuucagccuguacacgcggacccuguaccuccgcuaccggcccaaggugaaguuccuguucgggaucuggcccgugauccuguucgagccgcuccgcaagcacuga

SEQ ID NO: 26230 - RNA, 1581 nt, Artificial Sequence
  derived and/or modified sequence opt1 from ACHE__Homo_sapiens__NP_001269378
augcggcccccgcagugccugcuccacacccccagccuggccagcccccugcuccugcugcuccuguggcugcucggcgggggcgugggggccgagggccgcgaggacgcggagcugcuggucaccgugcgcgggggccggcuccgcggcauccggcugaagacgcccgggggcccgguguccgccuuccuggggauccccuucgccgagccgcccaugggcccgcgccgguuccucccgcccgagcccaagcagcccugguccggggucguggacgccaccaccuuccagagcgugugcuaccaguacgucgacacccuguaccccggcuucgagggcacggagauguggaaccccaaccgcgagcuguccgaggacugccucuaccugaacguguggacccccuacccgcggcccaccagccccacccccgugcuggucuggaucuacgggggcggguucuacuccggcgccagcucccucgacguguacgacggccgcuuccuggugcaggcggagcggacgguccuggugagcaugaacuaccgcgugggggccuucggcuuccucgcccugccggggucccgggaggcccccggcaacgucgggcugcucgaccagcgccuggcgcugcagugggugcaggagaacguggccgccuucggcggcgaccccaccagcgucacccucuucggggaguccgccggcgccgcgagcguggggaugcaccuccuguccccgcccagccggggccuguuccaccgcgccgugcugcaguccggggcccccaacggccccugggccaccgucggcaugggggaggcccggcgccgggcgacgcagcuggcccaccucgugggcugcccgcccgggggcaccgggggcaacgacaccgagcugguggccugccugcgcacccggcccgcccagguccucgugaaccacgaguggcacguccugccccaggagagcguguuccgcuucuccuucgugcccgucguggacggcgacuuccugagcgacacgcccgaggcccucaucaacgcgggggacuuccacggccugcagcuggccgggcgccucgccgcccagggcgcccggguguacgcguacgucuucgagcaccgcgccagcacccuguccuggccccuguggaugggcgugccccacggguacgagaucgaguucaucuucggcaucccgcucgaccccagccggaacuacaccgccgaggagaagaucuucgcccagcgccugaugcgguacugggcgaacuucgcccgcaccggggaccccaacgagccccgggacccgaaggcgccccaguggccgcccuacacggccggcgcccagcaguacgugucccuggaccugcgcccccucgagguccggcgcgggcugcgggcccaggccugcgccuucuggaaccgcuuccugcccaagcuccugagcgccaccgacacccuggacgaggccgagcggcaguggaaggcggaguuccaccgcugguccagcuacauggugcacuggaagaaccaguucgaccacuacuccaagcaggaccggugcagcgaccucuga

SEQ ID NO: 26231 - RNA, 3987 nt, Artificial Sequence
  derived and/or modified sequence opt1 from ACIN1__Homo_sapiens__NP_001158286
auguggcgccggaagcacccccgcaccagcggcgggacccggggcgugcuguccgggaaccgcggcgucgaguacgggagcggccggggccaccucgggacguucgagggccgcuggcggaagcugccgaagaugcccgaggccguggggaccgaccccuccaccagccgcaagauggccgagcuggaggaggugacccucgacggcaagccccugcaggcgcugcgggucacggaccucaaggccgcccuggagcagcgcgggcuggccaaguccggccagaagagcgcccucgugaagcggcugaagggcgcgcugaugcucgagaaccugcagaagcacuccaccccgcacgccgccuuccagcccaacagccagaucggggaggagaugucccagaacagcuucaucaagcaguaccuggagaagcagcaggagcuccugcgccagcggcuggagcgcgaggcccgggaggcggccgagcucgaggaggccuccgccgagagcgaggacgagaugauccaccccgagggcguggccucccugcugcccccggacuuccagagcucccucgagcgccccgagcuggagcugagccggcacuccccccgcaagagcuccagcaucagcgaggagaagggggacuccgacgacgagaagccccggaagggcgagcgccggagcucccgcguccgccaggcgcgggccgccaagcucagcgagggcucccagccggccgaggaggaggaggaccaggagacccccagccgcaaccugcgggugcgcgccgaccggaaccugaagaccgaggaggaggaggaggaggaggaggaggaggaggaggacgacgaggaggaggagggggacgacgagggccagaagucccgcgaggcgcccauccucaaggaguucaaggaggagggggaggagaucccccgggugaagccggaggagaugauggacgagcgccccaagacgcggagccaggagcaggagguccuggagcgcggcgggcgguucacccgcucccaggaggaggcccggaagagccaccuggcccgccagcagcaggagaaggagaugaagaccaccuccccccucgaggaggaggagcgggagaucaagagcucccagggccugaaggagaagagcaagucccccagcccgccccgccugacggaggaccggaagaaggccucccucguggcccugcccgagcagaccgcgagcgaggaggagacccccccgccccugcucaccaaggaggccuccagcccccccccgcacccccagcugcacagcgaggaggagaucgagcccauggagggcccggccccccccgugcugauccagcucucccccccgaacacggacgccgacacccgcgagcugcuggucagccagcacaccgugcagcucguggggggccuguccccccugagcucccccagcgacaccaaggccgagucccccgcggagaaggucccggaggagagcgugcucccccuggugcagaaguccacgcuggccgacuacagcgcccagaaggaccucgagcccgaguccgaccggagcgcccagccccugccgcugaagaucgaggagcuggcgcucgccaaggggaucaccgaggagugccugaagcagcccucccuggagcagaaggagggccgccgcgccagccacacccuccugcccucccaccggcugaagcagagcgccgacuccagcagcucccgcagcuccagcuccagcuccagcuccagccggucccgcagccggucccccgacagcuccgggagccgcucccacagcccgcuccgguccaagcagcgcgacgucgcccaggcgcggacccacgccaacccccgcggccggcccaagaugggcagccgcagcacguccgagagccggucccgcagccggucccgcagccgguccgccagcuccaacagccgcaagucccugagccccggggugucccgggacagcuccaccagcuacaccgagaccaaggacccguccagcggccaggagguggccacgccccccgucccccagcugcaggugugcgagccgaaggagcgcaccuccaccagcagcuccagcgugcaggcccggcgccucucccagcccgagagcgcggagaagcacgucacccagcgccugcagcccgagcggggguccccgaagaagugcgaggccgaggaggccgagccccccgccgccacgcagccccagaccagcgagacccagaccucccaccugccggagagcgagcgcauccaccacacgguggaggagaaggaggaggucaccauggacaccuccgagaaccggcccgagaacgacgugcccgagcccccgaugcccaucgcggaccaggugagcaacgacgaccgccccgagggcuccgucgaggacgaggagaagaaggagagcucccuccccaagagcuucaagcggaagaucuccguggugagcaccaagggggucccggccggcaacuccgacaccgagggcgggcagcccggccgcaagcggcgcuggggggccagcacggccaccacccagaagaagcccuccaucagcaucaccacggagagccugaaggaggcggugguggaccugcacgccgacgacucccggaucagcgaggacgagaccgagcgcaacggcgacgacggcacccacgacaaggggcucaagaucugccggaccgucacgcagguggugcccgccgagggccaggagaacgggcagcgcgaggaggaggaggaggagaaggagccggaggccgagccccccguccccccgcagguguccguggaggucgcccugcccccccccgcggagcacgaggugaagaaggugacccugggcgacacccucacccggcgcagcaucucccagcagaagagcggggucuccaucacgaucgacgacccggugcggaccgcccaggugcccagccccccccgcggcaagaucuccaacaucguccacaucagcaaccuggugcggccguucacccugggccagcucaaggagcugcuggggcgcaccggcacgcucguggaggaggccuucuggaucgacaagaucaagucccacugcuucgucaccuacagcaccguggaggaggccguggccacccggacggcgcugcacggggucaaguggccccaguccaaccccaaguuccugugcgccgacuacgccgagcaggacgagcucgacuaccaccgcggccugcugguggaccgcccgagcgagaccaagaccgaggagcaggggaucccccggccccuccaccccccgcccccccccccggugcagcccccccagcacccccgcgccgagcagcgggagcaggagcgcgccguccgggagcagugggcggagcgcgagcgggagauggagcgccgggagcgcacccgguccgagcgcgagugggaccgggacaaggugcgcgagggcccgcggagccgcucccggagccgcgaccggcgccggaaggagcgcgccaaguccaaggagaagaagagcgagaagaaggagaaggcccaggaggagccccccgccaagcugcuggacgaccucuuccgcaagacgaaggcggcccccugcaucuacuggcugccgcugaccgacagccagaucgugcagaaggaggccgagcgggccgagcgcgccaaggagcgggagaagcgccggaaggagcaggaggaggaggagcagaaggagcgcgagaaggaggcggagcgggagcgcaaccggcagcucgagcgcgagaagcggcgcgagcacucccgggagcgcgaccgggagcgcgagcgggagcgcgagcgggaccgcggcgaccgcgaccgggaccgcgagcgggaccgcgagcgggggcgcgagcgggaccgccgggacaccaagcgccacagccggucccgcagccgguccacccccguccgcgaccggggcgggcgccgguga

SEQ ID NO: 26232 - RNA, 1017 nt, Artificial Sequence
  derived and/or modified sequence opt1 from ACKR1__Homo_sapiens__NP_001116423
auggccagcuccggcuacgugcugcaggccgagcucagccccuccaccgagaacagcucccagcuggacuucgaggacgucuggaacagcuccuacggggugaacgacagcuucccggacggcgacuacggggcgaaccuggaggccgccgcccccugccacuccugcaaccuccuggacgacagcgcccugcccuucuucauccucaccuccgugcugggcauccuggcgagcuccaccguccucuucaugcuguuccgcccccuguuccgguggcagcucugcccgggguggcccgugcuggcccagcuggccgugggcagcgcccucuucuccaucgucgugcccgugcuggcgcccggccuggggagcacccgcuccagcgcccucugcucccugggcuacugcgucugguacgggagcgccuucgcccaggcccugcuccugggcugccacgcgagccuggggcaccggcucggcgccggccaggugccggggcugacccugggccucaccguggggaucuggggcgucgccgcccugcugacgcuccccgugacccuggccuccggcgcgagcgggggccugugcacccucaucuacuccaccgagcugaaggcccugcaggccacgcacaccguggccugccucgccaucuucguccugcugccccucgggcuguucggcgcgaaggggcugaagaaggcccucggcaugggccccgggccguggaugaacauccugugggccugguucaucuucugguggccccacggcguggugcuggggcucgacuuccugguccgcagcaagcugcuccugcuguccacgugccuggcccagcaggcccucgaccugcugcucaaccuggcggaggcccuggccauccuccacugcguggccacgccccugcugcucgcgcuguucugccaccaggccacccggacccugcuccccagccugccgcugcccgagggcugguccagccaccucgacacccugggguccaagagcuga

SEQ ID NO: 26233 - RNA, 1155 nt, Artificial Sequence
  derived and/or modified sequence opt1 from ACKR2__Homo_sapiens__NP_001287
auggccgccaccgcgagcccccagccgcuggccaccgaggacgccgacuccgagaacagcuccuucuacuacuacgacuaccucgacgagguggccuucaugcugugccgcaaggacgccgucgugagcuucggcaagguguuccugcccgucuucuacucccucaucuucgugcuggggcugagcggcaaccuccugcugcucauggugcugcugcgguacgucccccgccggcgcaugguggagaucuaccuccugaaccuggcgaucuccaaccuccuguuccuggugacgcuccccuucugggggaucagcgucgccuggcacuggguguucggcuccuuccugugcaagauggugagcacccuguacaccaucaacuucuacuccgggaucuucuucaucagcugcaugucccucgacaaguaccuggagaucguccacgcccagccguaccaccggcugcgcacccgggccaagagccuccugcuggcgacgaucgugugggccgugucccucgccgucagcauccccgacaugguguucgugcagacccacgagaaccccaagggcgucuggaacugccacgccgacuucggcgggcacggcaccaucuggaagcuguuccugcgcuuccagcagaaccuccugggguuccugcucccccugcuggccaugaucuucuucuacucccggaucggcugcgugcucgugcgccugcggccggcggggcagggccgcgcccugaagaucgccgccgcccucgucguggcguucuucgugcugugguuccccuacaaccugacccucuuccugcacacgcugcucgaccugcaggucuucggcaacugcgaggugagccagcaccuggacuacgcccuccaggucaccgaguccaucgccuuccugcacugcugcuucagccccauccuguacgccuucagcucccaccgguuccgccaguaccugaaggccuuccucgcggccgugcugggguggcaccuggcccccggcaccgcccaggccagccucuccagcugcuccgagagcuccauccugaccgcgcaggaggagaugacggggaugaacgaccugggcgagcggcagagcgagaacuacccgaacaaggaggacgugggcaacaaguccgccuga

SEQ ID NO: 26234 - RNA, 1089 nt, Artificial Sequence
  derived and/or modified sequence opt1 from ACKR3__Homo_sapiens__XP_005246155
auggaccugcaccucuucgacuacagcgagcccggcaacuucuccgacaucagcuggccgugcaacuccagcgacugcaucguggucgacaccgugaugugccccaacaugcccaacaaguccgugcugcuguacacccucagcuucaucuacaucuucaucuucgucaucgggaugaucgccaacuccgugguggucugggugaacauccaggccaagacgaccggcuacgacacccacugcuacauccugaaccuggcgaucgccgaccucugggugguccugaccauccccguguggguggucagccuggugcagcacaaccaguggccgaugggggagcucacgugcaaggugacccaccugaucuucuccaucaaccuguucggcagcaucuucuuccugaccugcauguccgucgaccgcuaccucagcaucaccuacuucacgaacacccccuccagccggaagaagauggugcgccggguggucugcauccugguguggcuccuggccuucugcgugucccugcccgacaccuacuaccucaagaccgucacgagcgccuccaacaacgagaccuacugccgcagcuucuaccccgagcacuccaucaaggaguggcugaucgggauggagcuggugagcgugguccucggcuucgccgugccguucagcaucaucgcggucuucuacuuccugcuggcccgggccaucuccgccagcuccgaccaggagaagcacagcucccgcaagaucaucuucagcuacgugguggucuuccucgugugcuggcugcccuaccacguggcgguccugcucgacaucuucuccauccugcacuacauccccuucacgugccggcuggagcacgcccucuucaccgcccugcacgugacccagugccugagccucgugcacugcugcgucaaccccgugcuguacuccuucaucaaccgcaacuaccgguacgagcugaugaaggccuucaucuucaaguacagcgccaagaccggccucaccaagcugaucgacgcgucccgcgugagcgagaccgaguacuccgcccuggagcagagcacgaaguga

SEQ ID NO: 26235 - RNA, 1053 nt, Artificial Sequence
  derived and/or modified sequence opt1 from ACKR4__Homo_sapiens__NP_848540
auggcccuggagcagaaccagagcaccgacuacuacuacgaggagaacgagaugaacggcaccuacgacuacucccaguacgagcucaucugcaucaaggaggacgugcgcgaguucgccaaggucuuccugcccguguuccugacgaucguguucgucaucgggcucgcgggcaacagcauggugguggccaucuacgccuacuacaagaagcagcggaccaagaccgacgucuacauccugaaccuggccguggccgaccuccugcuccuguucacccugccguucugggcggugaacgccguccacgggugggugcugggcaagaucaugugcaagaucacguccgcccucuacacccugaacuucgugagcgggaugcaguuccuggccugcaucuccaucgaccgcuacgucgcggugaccaaggugcccagccaguccggcgucggcaagcccugcuggaucaucugcuucugcguguggauggccgccauccuccugagcaucccccagcugguguucuacaccgucaacgacaacgcccggugcaucccgaucuucccccgcuaccucgggacguccaugaaggcccugauccagaugcuggagaucugcaucggcuucguggugcccuuccucaucaugggggucugcuacuucaucaccgcgcggacccugaugaagaugcccaacaucaagaucagccgcccgcugaaggugcuccugaccguggucaucguguucaucgucacgcagcugcccuacaacaucgugaaguucugccgggccaucgacaucaucuacucccucaucaccagcugcaacauguccaagcgcauggacaucgccauccaggugaccgagagcaucgcccuguuccacuccugccugaaccccauccucuacgucuucaugggcgccagcuucaagaacuacgugaugaagguggcgaagaaguacggguccuggcggcgccagcggcagagcgucgaggaguuccccuucgacuccgagggcccgaccgagcccacgagcaccuucagcaucuga

SEQ ID NO: 26236 - RNA, 3468 nt, Artificial Sequence
  derived and/or modified sequence opt1 from ACLY__Homo_sapiens__NP_001290203
augggcgccggcaagagccccgccgggccggggcagaagcccgaccccggcaagcugcccgcggccggggugcuccgcauccugcggggcuccagcggccuguggaagaagcgccgggcccgcaccuccgccgagaccgggcgggccggccucagcgcggccauguccgccaaggccaucagcgagcagacggggaaggagcugcuguacaaguucaucugcaccaccuccgcgauccagaaccgcuucaaguacgcccgggucaccccggacacggacugggcccgccuccugcaggaccaccccuggcugcucagccagaaccugguggugaagcccgaccagcugaucaagcggcgcggcaagcucgggcuggucggcgugaaccugacccucgacggcgugaaguccuggcugaagccccggcuggggcaggaggccaccgucggcaaggccaccggguuccucaagaacuuccugaucgagccguucgugccccacagccaggcggaggaguucuacgugugcaucuacgccacgcgcgagggcgacuacguccuguuccaccacgagggcgggguggacgugggcgacgucgacgccaaggcccagaagcuccugguggggguggacgagaagcugaaccccgaggacaucaagaagcaccuccugguccacgcccccgaggacaagaaggagauccuggcguccuucaucagcggccucuucaacuucuacgaggaccuguacuucaccuaccuggagaucaacccgcucguggugaccaaggacggggucuacgugcuggaccuggccgccaagguggacgccaccgccgacuacaucugcaaggucaaguggggcgacaucgaguucccgccgcccuucggccgggaggcguaccccgaggaggccuacaucgccgaccucgacgccaaguccggggccagccugaagcugacgcuccugaaccccaagggccgcaucuggaccaugguggccgggggcggggcguccguggucuacagcgacaccaucugcgaccugggcggcgugaacgagcucgccaacuacggggaguacuccggcgcccccagcgagcagcagaccuacgacuacgcgaagacgauccugucccugaugacccgggagaagcaccccgacgggaagauccucaucaucggcgggagcaucgccaacuucaccaacgucgccgccaccuucaagggcaucgugcgcgccauccgggacuaccagggcccccugaaggagcacgaggugacgaucuucguccgccgcgggggccccaacuaccaggaggggcugcgggugaugggcgaggugggcaagaccaccgggauccccauccacgucuucggcaccgagacgcacaugaccgcgaucguggggauggcccucggccaccggcccaucccgaaccagccgcccaccgccgcccacaccgccaacuuccugcugaacgcgagcggguccacgagcacccccgcccccucccgcaccgccagcuucuccgagagccgcgccgacgagguggcccccgcgaagaaggccaagcccgccaugccgcaggacuccguccccagcccccggucccuccagggcaagagcaccacgcuguucucccgccacaccaaggccaucguguggggcaugcagacccgggcggugcaggggaugcuggacuucgacuacgucugcagccgcgacgagcccuccguggccgccaugguguacccguucaccggcgaccacaagcagaaguucuacugggggcacaaggagauccugauccccgucuucaagaacauggccgacgccaugcggaagcaccccgagguggacgugcucaucaacuucgcgagccugcgcuccgccuacgacagcacgauggagaccaugaacuacgcccagauccggaccaucgccaucaucgccgagggcauccccgaggcgcugacccgcaagcucaucaagaaggccgaccagaagggggucaccaucaucggcccggccacggugggcgggaucaagcccggcugcuucaagaucgggaacaccggcgggaugcuggacaacauccuggccuccaagcucuaccggcccggcagcguggccuacgucucccgcagcggcgggaugagcaacgagcugaacaacaucaucucccggaccaccgacggcguguacgaggggguggcgaucggcggggaccgcuaccccggcagcacguucauggaccacguccugcgguaccaggacaccccgggcgugaagaugaucgugguccucggggagaucggcgggaccgaggaguacaagaucugccgcggcaucaaggagggccggcugaccaagcccaucgugugcuggugcaucgggacgugcgccaccauguucuccagcgaggugcaguucggccacgccggggccugcgcgaaccaggccuccgagaccgccgucgccaagaaccaggcccugaaggaggcgggcguguucgugccccgcagcuucgacgagcucggggagaucauccaguccgucuacgaggaccugguggccaacggcgugaucguccccgcccaggaggugccgccgcccaccgugcccauggacuacagcugggcccgggagcugggccucauccgcaagcccgccuccuucaugacgagcaucugcgacgagcgggggcaggagcugaucuacgcgggcaugcccaucaccgaggucuucaaggaggagauggggaucggcggggugcugggccuccugugguuccagaagcgccugcccaaguacuccugccaguucaucgagaugugccucauggugaccgccgaccacggccccgccgucagcggggcccacaacaccaucaucugcgcccgcgcgggcaaggaccugguguccagccugacguccgggcuccugaccaucggcgaccgguucgggggcgcccuggacgccgccgccaagauguucagcaaggcguucgacuccggcaucaucccgauggaguucgugaacaagaugaagaaggaggggaagcucaucaugggcaucgggcaccgcgucaagagcaucaacaaccccgacaugcgggugcagauccugaaggacuacgugcgccagcacuuccccgccaccccgcugcucgacuacgcccuggaggucgagaagaucaccacgagcaagaagcccaaccugauccucaacguggacggccugaucggcguggccuucgucgacaugcugcggaacugcggguccuucacccgcgaggaggcggacgaguacaucgacaucggcgcccucaacgggaucuucgugcugggccggagcaugggguucaucggccacuaccuggaccagaagcgccucaagcagggccuguaccggcaccccugggacgacaucuccuacguccugcccgagcacaugagcauguga

SEQ ID NO: 26237 - RNA, 1011 nt, Artificial Sequence
  derived and/or modified sequence opt1 from ACMSD__Homo_sapiens__NP_612199
augaagaucgacauccacagccacauccugcccaaggaguggccggaccucaagaagcgcuucggcuacgggggcugggugcagcugcagcaccacuccaagggggaggccaagcugcucaaggacggcaaggucuuccggguggugcgcgagaacugcugggaccccgagguccggauccgcgagauggaccagaagggggugaccgugcaggcccugagcaccguccccgugauguucuccuacugggcgaagcccgaggacacgcugaaccucugccagcugcugaacaacgaccucgccagcaccguggucuccuacccgcggcgcuucgugggccugggcacccugcccaugcaggcccccgagcucgccgugaaggagauggagcggugcgucaaggagcugggguuccccggcgugcagaucgggacccacgugaacgagugggaccugaacgcccaggagcuguucccggucuacgcggccgccgagcgccucaagugcagccuguucgugcaccccugggacaugcagauggacggccggauggccaaguacuggcuccccuggcugguggggaugcccgcggagacgaccaucgccaucugcuccaugaucaugggcggcgucuucgagaaguucccgaagcugaaggugugcuucgcccacgggggcggggccuuccccuucaccgugggccgcaucagccacggcuucuccaugcggcccgaccucugcgcccaggacaaccccaugaacccgaagaaguaccuggggagcuucuacaccgacgcgcugguccacgacccccucucccugaagcugcucacggacgugaucggcaaggacaaggugauccuggggaccgacuaccccuucccccugggcgagcucgagccggggaagcugaucgagagcauggaggaguucgacgaggagaccaagaacaagcugaaggccggcaacgcccucgccuuccugggccuggagcgcaagcaguucgaguga

SEQ ID NO: 26238 - RNA, 2670 nt, Artificial Sequence
  derived and/or modified sequence opt1 from ACO1__Homo_sapiens__NP_002188
augagcaaccccuucgcccaccuggccgagccgcucgaccccgugcagcccggcaagaaguucuucaaccugaacaagcuggaggacucccgcuacgggcggcuccccuucagcauccgcguccugcuggaggcggccauccggaacugcgacgaguuccucgugaagaagcaggacaucgagaacauccugcacuggaacgugacccagcacaagaacaucgaggucccguucaagcccgcccgcgugauccugcaggacuucaccggcgugcccgccgucguggacuucgccgcgaugcgggacgccgugaagaagcucgggggcgaccccgagaagaucaacccggucugccccgccgaccuggugaucgaccacuccauccagguggacuucaaccgccgggccgacagccugcagaagaaccaggaccucgaguucgagcgcaaccgggagcgcuucgaguuccugaagugggggucccaggcguuccacaacaugcggaucaucccgcccggcagcggcaucauccaccaggucaaccuggaguaccucgcccgcgugguguucgaccaggacggguacuacuaccccgacucccuggucggcacggacagccacaccaccaugaucgacgggcugggcauccucggguggggcgugggcgggaucgaggccgaggccgugaugcugggccagcccaucuccaugguccugccccaggugaucggguaccggcucaugggcaagccccacccgcuggugaccagcacggacaucguccugaccaucaccaagcaccuccgccaggugggcguggucgggaaguucguggaguucuucggccccggggucgcccagcuguccaucgcggaccgggccaccaucgccaacaugugccccgaguacggcgccacggccgcguucuuccccguggacgaggugagcaucaccuaccugguccagaccgggcgcgacgaggagaagcucaaguacaucaagaaguaccugcaggccgugggcauguuccgggacuucaacgacccgucccaggaccccgacuucacccagguggucgagcuggaccucaagacgguggugcccugcugcagcggccccaagcgcccgcaggacaaggucgccguguccgacaugaagaaggacuucgagagcugccugggggccaagcagggcuucaagggguuccagguggcccccgagcaccacaacgaccacaagaccuucaucuacgacaacaccgaguucacccuggcgcacggcuccgucgugaucgccgccaucacgagcugcaccaacaccuccaaccccagcgugaugcucggggccggccugcuggccaagaaggcggucgacgccggccucaacgugaugcccuacaucaagaccagccuguccccggggagcggcguggucacguacuaccugcaggaguccggggugaugcccuaccucagccagcugggcuucgacguggucggguacggcugcaugaccugcaucggcaacuccgggccccugccggagcccgugguggaggccaucacccagggcgaccucgucgccgugggggugcugagcggcaaccggaacuucgagggccgcguccaccccaacacccgggcgaacuaccuggccagcccgccccucgugaucgccuacgccaucgccgggacgauccgcaucgacuucgagaaggagccccugggcgugaacgcgaaggggcagcaggucuuccugaaggacaucuggcccacccgcgacgagauccaggccguggagcggcaguacgugauccccggcauguucaaggaggucuaccagaagaucgagaccgugaacgaguccuggaacgcccucgccaccccguccgacaagcuguucuucuggaacagcaaguccacguacaucaagagcccgcccuucuucgagaaccugacccuggaccuccagccgcccaaguccaucguggacgccuacguccugcugaaccucggggacagcgugaccaccgaccacaucucccccgcgggcaacaucgcccgcaacagccccgccgcccgguaccugacgaaccgcggccugacgccccgggaguucaacuccuacgggagccgccggggcaacgacgccgugauggcgcgcgggaccuucgccaacauccggcuccugaaccgcuuccugaacaagcaggcgccccagaccauccaccuccccuccggcgagauccuggacgucuucgacgccgccgagcgguaccagcaggccgggcugccccucaucgugcuggccggcaaggaguacggcgccgggagcagccgcgacugggccgcgaagggccccuuccugcucgggaucaaggccgugcuggccgaguccuacgagcggauccaccgcagcaaccuggucggcaugggggugaucccgcucgaguaccugcccggcgagaacgccgacgcccugggccucaccgggcaggagcgguacaccaucaucauccccgagaaccugaagccccagaugaaggugcaggucaagcuggacaccggcaagaccuuccaggcggugaugcgcuucgacaccgacguggagcucacguacuuccugaacgggggcauccugaacuacaugauccggaagauggccaaguga

SEQ ID NO: 26239 - RNA, 2343 nt, Artificial Sequence
  derived and/or modified sequence opt1 from ACO2__Homo_sapiens__NP_001089
auggcccccuacagccugcucgugacccgccugcagaaggcccugggcguccggcaguaccacguggcguccgugcucugccagcgcgccaaggucgccaugagccacuucgagccgaacgaguacauccacuacgaccugcuggagaagaacaucaacaucgugcggaagcgccucaaccggccccugacccuguccgagaagaucguguacgggcaccucgacgaccccgccagccaggagaucgagcgcggcaaguccuaccugcggcugcgccccgaccgggucgccaugcaggacgcgacggcccagauggccaugcuccaguucaucagcuccgggcugagcaagguggccgugccguccaccauccacugcgaccaccugaucgaggcgcaggucggcggggagaaggaccuccgccgggccaaggacaucaaccaggagguguacaacuuccuggccaccgccggcgccaaguacggcgugggguucuggaagcccggcagcgggaucauccaccagaucauccuggagaacuacgcguaccccggcguccuccugaucgggaccgacucccacacgcccaacggcggcgggcugggcgggaucugcaucggcgugggcggggccgacgccguggacgucauggccggcaucccgugggagcucaagugccccaaggugaucggggugaagcugaccggcagccuguccggguggagcucccccaaggacgucauccucaagguggccggcauccugaccgugaagggcgggaccggcgcgaucgucgaguaccacgggcccggcguggacagcaucuccugcacggggauggccaccaucugcaacaugggcgccgagaucggcgccaccaccagcguguucccguacaaccaccgcaugaagaaguaccuguccaagacggggcgggaggacaucgccaaccucgcggacgaguucaaggaccaccugguccccgaccccggcugccacuacgaccagcugaucgagaucaaccucagcgagcugaagccccacaucaacgggccguucacccccgaccuggcccaccccguggccgaggucggcaagguggccgagaaggagggguggccccucgacauccgcgugggccugaucggcagcugcaccaacuccagcuacgaggacauggggcgguccgccgcggucgccaagcaggcccuggcccacggccucaagugcaagagccaguucaccaucacgccgggguccgagcagauccgcgcgaccaucgagcgggacggcuacgcccagauccugcgcgaccugggcgggaucgugcucgccaacgccugcggccccugcaucgggcagugggaccggaaggacaucaagaagggcgagaagaacaccaucgugaccagcuacaaccgcaacuucacggggcggaacgacgccaaccccgagacccacgcguucgucaccucccccgagaucgugaccgcccuggccaucgccggcacgcugaaguucaacccggagaccgacuaccucaccggcaccgacgggaagaaguuccgccuggaggcccccgacgcggacgagcugcccaagggcgaguucgaccccgggcaggacacguaccagcacccgcccaaggacagcuccggccagcacguggacgucagccccaccucccagcgccuccagcugcuggagccguucgacaagugggacgggaaggaccucgaggaccugcagauccugaucaaggugaagggcaagugcaccaccgaccacaucagcgccgccggccccuggcugaaguuccgggggcaccucgacaacaucuccaacaaccugcugaucggcgccaucaacaucgagaacgggaaggccaacagcgugcgcaacgcggucacgcaggaguucggccccgugcccgacaccgcccgguacuacaagaagcacgggauccgcuggguggucaucggcgacgagaacuacggcgagggguccagccgggagcacgccgcccucgagccgcgccaccugggcgggcgggcgaucaucaccaaguccuucgcccgcauccacgagaccaaccugaagaagcagggccuccugccccugacguucgccgaccccgccgacuacaacaagauccaccccguggacaagcucaccauccaggggcugaaggacuucaccccgggcaagccccugaagugcaucaucaagcaccccaacggcacccaggagaccauccuccugaaccacacguucaacgagacccagaucgagugguuccgggccgggagcgcgcugaaccgcaugaaggagcuccagcaguga

SEQ ID NO: 26240 - RNA, 354 nt, Artificial Sequence
  derived and/or modified sequence opt1 from ACOT13__Homo_sapiens__NP_001153566
auggugcgcaagaucacccuggucagcgccgcccccggcaaggugaucugcgagaugaagguggaggaggagcacaccaacgcgaucgggacgcuccacggcgggcugaccgccacccuggucgacaacaucuccaccauggcccuccugugcacggagcggggcgccccgggggugagcguggacaugaacaucaccuacaugucccccgccaagcugggcgaggacaucgucaucaccgcgcacgugcucaagcagggcaagacccuggccuucacgagcguggaccugaccaacaaggccaccgggaagcucaucgcccagggccgccacaccaagcaccuggggaacuga

SEQ ID NO: 26241 - RNA, 1266 nt, Artificial Sequence
  derived and/or modified sequence opt1 from ACOT1__Homo_sapiens__NP_001032238
auggccgccacccugauccuggagcccgcgggccgcugcugcugggacgagccggugcggaucgccguccgcgggcuggcccccgagcagcccgugacccugcgggccagccuccgcgacgagaagggcgcccuguuccaggcgcacgcccgguaccgcgccgacacgcugggggagcucgaccuggagcgggcccccgcgcugggcggguccuucgccggccucgagccgaugggccugcugugggcccucgagcccgagaagccccuggugcgccuggucaagcgggacgugcgcacgccccucgccguggagcuggagguccuggacgggcacgacccggaccccggccggcuccugugccgcgugcggcacgagcgcuacuuccugccgcccggggugcggcgcgagcccguccgggccggccgcgugcgggggacccucuuccugccgcccgagcccggccccuuccccggcaucguggacauguucgggaccggcgggggccugcucgaguaccgcgcgagccugcuggccggcaagggguucgccgucauggcccucgccuacuacaacuacgaggaccugcccaagaccauggagacccugcaccucgaguacuucgaggaggcggugaacuaccugcugucccaccccgaggugaagggcccgggggucggccuccuggggaucagcaagggcggcgagcugugccucuccauggccagcuuccugaaggggaucaccgccgccguggugaucaacggcuccgucgccaacgucgggggcacccugcgguacaagggggagacgcucccgcccgugggcgugaaccgcaaccgcaucaaggugaccaaggacggcuacgcggacaucguggacguccugaacagcccccuggaggggcccgaccagaaguccuucauccccguggagcgggccgagagcaccuuccucuuccuggucggccaggacgaccacaacuggaaguccgaguucuacgccaacgaggccugcaagcgccugcaggcccacgggcggcgcaagccccagaucaucugcuaccccgagaccggccacuacaucgagccgcccuacuucccccucugccgggcgagccugcacgcccuggugggguccccgaucaucuggggcggcgagccccgcgcccacgccauggcccagguggacgcguggaagcagcuccagacguucuuccacaagcaccucgggggccacgaggggaccauccccagcaaggucuga

SEQ ID NO: 26242 - RNA, 1452 nt, Artificial Sequence
  derived and/or modified sequence opt1 from ACOT2__Homo_sapiens__NP_006812
augagcaacaagcugcugagcccccacccgcacagcgugguccugcgcuccgaguucaagauggccagcucccccgccgugcugcgggcgagccgccucuaccaguggucccucaagagcuccgcccaguuccugggcagcccccagcugcgccagguggggcagaucauccggguccccgcccggauggccgccacccugauccuggagccggcgggccgcugcugcugggacgagcccgugcggaucgccgugcgcgggcucgcccccgagcagcccgucacccugcgggccucccugcgcgacgagaagggcgcccucuuccaggcgcacgcccgguaccgcgccgacacgcugggggagcuggaccucgagcgggccccggcgcugggcggcagcuucgccgggcuggagcccaugggccuccugugggcccuggagcccgagaagccccucgugcgccuggugaagcgggacguccgcaccccgcuggccguggagcucgaggugcuggacgggcacgaccccgaccccggccggcugcucugccagacccgccacgagcgguacuuccugcccccggggguccgccgggagcccgugcgcgugggccgcguccggggcacccuguuccucccgcccgagcccgggcccuuccccggcaucguggacauguucgggacgggcggcgggcugcuggaguaccgcgccucccuccuggcgggcaagggguucgccgugauggcccuggccuacuacaacuacgaggaccuccccaagaccauggagacccugcaccuggaguacuucgaggaggccaugaacuaccuccugagccacccggaggucaagggccccggggugggccugcucggcaucuccaagggcggggagcugugccugagcauggcguccuuccucaaggggaucaccgccgccguggucaucaacggcagcguggccaacgucgggggcacgcugcacuacaagggcgagacccugccgcccgugggggugaaccggaaccgcaucaaggucaccaaggacggcuacgccgacaucguggacgugcucaacagcccccuggaggggcccgaccagaaguccuucauccccgucgagcgggcggaguccaccuuccuguuccuggugggccaggacgaccacaacuggaaguccgaguucuacgccaacgaggccugcaagcgccuccaggcccacgggcggcgcaagccgcagaucaucugcuaccccgagacgggccacuacaucgagccgcccuacuucccccugugccgggcgagccugcacgcccucgugggcucccccaucaucuggggcggggagccccgcgcccacgccauggcccaggucgacgcguggaagcagcugcagaccuucuuccacaagcaccucgggggccacgagggcaccauccccagcaagguguga

SEQ ID NO: 26243 - RNA, 1320 nt, Artificial Sequence
  derived and/or modified sequence opt1 from ACOT9__Homo_sapiens__NP_001028755
augcgccgggccgcccugcgccucugcgcgcugggcaaggggcagcugacccccggccgggggcucacccagggcccgcagaaccccaagaagcaggggaucuuccacauccacgaggugcgcgacaagcugcgggagaucgucggcgccagcacgaacuggcgcgaccacgugaaggccauggaggagcggaagcugcuccacuccuuccuggccaagagccaggacggccugccgccccgccggaugaaggacuccuacaucgaggugcuccugccccuggggagcgagcccgagcuccgcgagaaguaccugaccguccagaacaccgugcgguucggccgcauccuggaggaccucgacucccugggggugcugaucugcuacaugcacaacaagauccacagcgccaagaugagcccccucagcaucgucaccgcgcugguggacaagaucgacaugugcaagaagucccugagccccgagcaggacaucaaguucuccggccacgugagcugggucgggaagacguccauggaggugaagaugcagauguuccagcuccacggcgacgaguucugcccggugcuggacgccaccuucgucaugguggcccgggacagcgagaacaagggccccgccuucgugaacccccugauccccgaguccccggaggaggaggagcuguuccgccagggggagcugaacaagggccggcgcaucgcguucagcuccaccagccugcucaagauggcccccuccgccgaggagcggaccacgauccacgagauguuccugagcacccuggaccccaagaccaucagcuuccgcucccggguccuccccagcaacgccguguggauggagaacuccaagcugaagucccuggagaucugccacccgcaggagcgcaacaucuucaaccggaucuucgggggcuuccucaugcgcaaggccuacgagcuggcgugggccaccgccugcuccuucggcgggagccgccccuucguggucgccguggacgacaucauguuccagaagcccguggaggucggcucccuccucuuccugagcucccaggugugcuucacgcagaacaacuacauccaggugcggguccacagcgagguggccucccugcaggagaagcagcacaccaccaccaacgucuuccacuucacguucaugagcgagaaggaggugccccucguguucccgaagaccuacggggaguccaugcuguaccuggacggccagcgccacuucaacagcauguccgggcccgcgacccuccggaaggacuaccuggucgagcccuga

SEQ ID NO: 26244 - RNA, 1869 nt, Artificial Sequence
  derived and/or modified sequence opt1 from ACOX1__Homo_sapiens__NP_001171968
augauccugaacgaccccgacuuccagcacgaggaccucaacuuccugacccgcagccagcgguacgagguggccguccgcaaguccgccaucauggugaagaagaugcgggaguucggcaucgcggacccggacgagaucaugugguucaagaacuucgugcaccgcgggcggcccgagccccuggaccuccaccugggcauguuccugcccacccuccugcaccaggccacggccgagcagcaggagcgcuucuucaugccggccuggaaccuggagaucaucgggaccuacgcccagaccgagaugggccacgggacccaccuccggggccuggagacgaccgcgaccuacgaccccgagacccaggaguucauccugaacagccccacggucaccuccaucaagugguggcccggcgggcucggcaagaccagcaaccacgccaucgugcuggcccagcugaucaccaaggggaagugcuacggccuccacgccuucaucgugccgauccgcgagaucgggacgcacaagccccugcccggcaucaccgucggcgacaucgggcccaaguucggcuacgacgagaucgacaacggguaccugaagauggacaaccaccggaucccgcgcgagaacaugcucaugaaguacgcccaggugaagcccgacggcaccuacgugaagccccuguccaacaagcugaccuacggcacgauggucuucgugcggagcuuccucgugggggaggcggcccgcgcccuguccaaggccugcaccaucgcgauccgguacagcgccguccgccaccaguccgagaucaagcccggcgagccggagccccagauccuggacuuccagacccagcaguacaagcuguucccccuccuggccaccgccuacgccuuccaguucgugggggcguacaugaaggagacguaccaccggaucaacgagggcaucgggcagggcgaccucagcgagcugcccgagcugcacgcccucaccgccggccugaaggccuucaccuccuggaccgccaacacggggaucgaggcgugccgcauggccugcggcgggcacggcuacagccacugcuccgggcugccgaacaucuacgugaacuucacccccagcugcaccuucgagggcgagaacaccgucaugaugcuccagacggcccgguuccugaugaaguccuacgaccaggugcacagcggcaagcuggugugcgggauggucuccuaccucaacgaccugcccagccagcgcauccagccccagcaggucgccguguggccgaccaugguggacaucaacucccccgagagccugaccgaggccuacaagcuccgggcggcccgccugguggagaucgccgccaagaaccugcagaaggaggugauccaccgcaagagcaaggaggucgcguggaaccucaccuccguggaccugguccgggccagcgaggcccacugccacuacgugguggucaagcuguucuccgagaagcuccugaagauccaggacaaggccauccaggccgugcugcgcagccucugccugcuguacucccuguacggcaucagccagaacgcgggggacuuccuccagggcuccaucaugacggagccccagaucacccaggugaaccagcgggucaaggagcugcugacccucauccgcagcgacgccguggcccugguggacgccuucgacuuccaggacgucacccugggguccgugcucggccgguacgacggcaacguguacgagaaccuguucgagugggccaagaacagcccccugaacaaggcggagguccacgaguccuacaagcaccucaagagccugcaguccaagcuguga

SEQ ID NO: 26245 - RNA, 2046 nt, Artificial Sequence
  derived and/or modified sequence opt1 from ACOX2__Homo_sapiens__NP_003491
augggcagccccgugcaccgcgucucccugggggacaccuggagccggcagaugcacccggacaucgaguccgagcgcuacaugcagagcuucgacguggagcggcucaccaacauccuggacggcggggcccagaacacggcccugcgccggaagguggaguccaucauccacagcuaccccgaguucuccugcaaggacaacuacuucaugacccagaacgagcgcuacaaggcggccaugcggcgcgccuuccacauccggcucaucgcccgccggcugggcuggcuggaggacgggcgcgagcucggcuacgccuaccgggcgcugagcggcgacgucgcccugaacauccaccgcguguucgugcgggcccuccgcucccuggggagcgaggagcagaucgccaagugggacccccugugcaagaacauccagaucaucgcgaccuacgcccagaccgagcucggccacgggacguaccugcagggccuggagaccgaggccaccuacgacgccgccacccaggaguucgucauccacucccccacgcucaccgcgaccaagugguggccgggggaccugggccggagcgccacccacgcccuggugcaggcccagcucaucugcuccggcgcccgccgggggaugcacgcguucaucgugcccauccgcagccugcaggaccacacgccccugcccggcaucaucaucggggacaucggcccgaagauggacuucgaccagaccgacaacggcuuccuccagcugaaccacguccgggugccccgcgagaacaugcugucccgcuucgcccaggugcuccccgacgggaccuacgucaagcugggcaccgcccagagcaacuaccugcccaugguggugguccggguggagcuccuguccggggagauccugccgauccuccagaaggccugcgugaucgccaugcgcuacagcgucauccggcgccagucccggcugcgccccagcgaccccgaggcgaaggugcuggacuaccagacgcagcagcagaagcuguucccccagcuggccaucagcuacgccuuccacuuccuggccgugucccuccuggaguucuuccagcacagcuacaccgccauccugaaccaggacuucuccuuccucccggagcugcacgcgcugagcaccggcaugaaggccaugauguccgaguucugcacccagggggccgagaugugccggcgcgccugcggcggccacggguacagcaagcucuccggccugcccagccuggucacgaagcucuccgcgagcugcaccuacgagggggagaacaccgugcuguaccugcaggucgcccgguuccucgugaaguccuaccugcagacccagaugagccccggcuccacgccccagcgcagccuguccccgagcguggccuaccugaccgcccccgaccucgcccggugccccgcgcagcgcgccgccgacuuccugugccccgagcuguacaccaccgccugggcccacgucgcggugcggcucaucaaggacuccgugcagcaccuccagacgcugacccagagcggggccgaccagcacgaggccuggaaccagaccaccgucauccaccuccaggccgccaaggugcacugcuacuacgugacggucaagggcuucaccgaggcgcuggagaagcuggagaacgagccggccauccagcagguccucaagcgccugugcgaccugcacgccauccacggcauccucaccaacuccggggacuuccugcacgacgccuuccugagcggcgcccagguggacauggcgcggaccgccuaccucgaccugcugcgccucauccggaaggacgccauccugcugacggacgccuucgacuucaccgaccagugccucaacagcgcgcuggggugcuacgacggcaacguguacgagcgccuguuccagugggcccagaagucccccaccaacacccaggagaaccccgccuacgaggaguacauccggccccuccugcagagcuggcgcuccaagcuguga

SEQ ID NO: 26246 - RNA, 1875 nt, Artificial Sequence
  derived and/or modified sequence opt1 from ACOX3__Homo_sapiens__NP_001095137
auggccagcaccguggagggcggggacaccgcccugcuccccgaguucccgcgcggcccccuggacgcguaccgggcccgcgccuccuucagcuggaaggagcuggcccucuucacggagggggagggcaugcugcgguucaagaagaccaucuucuccgcccuggagaacgacccccucuucgcgcgcagccccggggccgaccugucccuggagaaguaccgggagcucaacuuccugcgcugcaagcggaucuucgaguacgacuuccugagcgucgaggacauguucaaguccccgcucaaggugcccgcccugauccagugccugggcauguacgacagcucccucgccgcgaaguaccugcugcacagccucguguucggcuccgccgucuacagcuccgggagcgagcgccaccugaccuacauccagaagaucuuccggauggagaucuucggcugcuucgcccugaccgagcucucccacgggagcaacacgaaggccauccgcaccaccgcccacuacgaccccgcgaccgaggaguucaucauccacucccccgacuucgaggccgccaaguucugggugggcaacauggggaagacggccacccacgccguggucuucgcgaagcugugcgugccgggcgaccagugccacggccugcaccccuucaucgugcagauccgggaccccaagacccuccugcccaugccgggggucauggugggcgacaucgggaagaagcugggccagaacggccucgacaacggguucgccauguuccacaaggugcgcgucccccggcagagccugcugaaccgcaugggcgacgugacccccgaggggacguacgugucccccuucaaggacguccggcagcgcuucggcgccagccucgggagccuguccagcggccggguguccaucgugagccuggccauccucaaccugaagcuggccgucgcgaucgcccuccgcuucuccgccacccggcgccaguucggcccgaccgaggaggaggagauccccgugcuggaguaccccaugcagcaguggcggcugcuccccuaccuggccgccguguacgcgcuggaccacuucagcaagucccucuuccuggaccuggucgagcuccagcgcgggcuggccagcggcgaccgcuccgcccggcaggccgagcuggggcgcgagauccacgcgcucgccagcgccuccaagccgcuggccagcuggaccacgcagcagggcauccaggagugccgggaggccugcgggggccacggcuaccuggcgaugaaccgccugggggugcuccgggacgacaacgaccccaacugcaccuacgagggcgacaacaacauccugcugcagcagaccuccaacuaccuccuggggcugcucgcccaccaggugcacgacggcgccugcuuccgcagcccccugaaguccgucgacuuccuggacgccuaccccgggauccucgaccagaaguucgaggugagcuccgucgccgacugccuggacagcgcgguggcccuggccgccuacaaguggcucgugugcuaccugcugcgggagaccuaccagaagcucaaccaggagaagcgcuccggcagcagcgacuucgaggcccggaacaagugccaggucucccacggccgcccgcuggcgcuggccuucguggagcucacggugguccagcgguuccacgagcacgugcaccagcccagcgugccgcccucccugcgcgccguccuggggcggcucagcgcccuguacgcgcuguggucccucagccgccacgccgcccugcuguaccgggccgagcgccggugcuccugccccggccgccgggaccgcagcuccuga

SEQ ID NO: 26247 - RNA, 1743 nt, Artificial Sequence
  derived and/or modified sequence opt1 from ACOXL__Homo_sapiens__NP_001136279
augcgcgcccugaccgugcagcgggucaaguucgccauggaccucccccugcugaagcgcgcgggccaggaccucgccgagaagaccaagaacuucgugagccggucccuggugaucggggagguccugagcauggccgacauggccacgggcgugaagugcgggaucaucuacuggcuguucggcggggccauccgcaaccucggcuccccggagcacgugaccaagugguuccagccccugcaggagcagaaguacaccggcauguucgcgaugaccgagcgggggcacggcagcaacgcccgcgggauccagacggaggccaccuucgaccucuccgcccaggaguucgucaucgacacccccugcgagaacgcggagaagauguacaucggcaacgccauguacgggaacuacgccgccguguucgcccagcugaucaucgacggccggagccagggcccccacugcuucaucgugccgguccgcgacgagaacgggucccuguaccccggcgugaccgcgaucgacaugauguacaaggaggggcuccacggcguggacaacggcauccugaucuucgacaagguccggaucccccgcgagaaccugcucgacaaguucgggagcguggcccccgacggccaguaccacuccccgauccggaacaagagcgcccgcuucaacgccaugcuggccgcgcugacgcccucccggcucgccguggccuuccaggccaugggggccaugaagcugggccugaccaucgcgauccgcuacagccacucccggcgccaguucgggcccaagaccaaggaggaggucaagaucaucgagcaccagacccagacgcuccggcugaugccccaccuggccaccgcccucgcccugaccuucgugagccgcuacgccggcgcgcugcucgacgaggacguguuccagggcaaggagcuggucaacucccggagccugcaggcccucguggccgggcugaaggccuacuccaccugggagaacauccgcugccugcaggacugccgggagugcacgggcgggaugguggucggccgcgagcuccuggcgcaguacaccaagcaguacgaggagaagccgcuguucgggcuccugcagaacugggccgagagcgugggcgacaagcugcgcaccuccuuccucgccuucaacauggacaccguggacgaccuggccuuccugcucaaggccgucaaguuccgggagcgcgugcugcagcggggccuggucgcgcgcaucuacuacaaggugaagacgaagaaggaggacuucuuccacgccuggaacagcugccuccaccacguggccagccugucccuggcccacacccaccgggucacccucgagcaguucagccuggccgugaaguccugccccgaccaggaggaccagacccugcugaugaaguucugccuccuguacgggacgaagcugguguuccaggagcgcgcgugguaccucgagcacaaguaccugacccccauggccagcacccggauccgcaaccagcugcucgaccugugcgacuccgucaaggacgacgcccggcgcgugaucagcaccuucaacaucccccacacguaccugcacgccccgaucgccggcaucuccaacccccgggcggccugggccuucuaccccgcgccccuccagccgcgcccccgggaggaggcccgcagccggcgccccaagcugggggccaagcuguga

SEQ ID NO: 26248 - RNA, 339 nt, Artificial Sequence
  derived and/or modified sequence opt1 from ACP1__Homo_sapiens__NP_001035739
auggccgagcaggccaccaagagcgugcuguucgucugccucggcaacaucugccggucccccaucgcggaggccguguuccggaagcuggugaccgaccagaacaucagcgagaacuggcgcgucgacuccgccgccacgagcggguacgagaucggcaacccgcccgacuaccgggggcaguccugcaugaagcgccacggcauccccaugagccacguggcccgccaggugcccucccuggaccucaagcugugcguccugugcuucagcgggucccucaccgcggugcuguuccugaccggcaccugggccggcccgcagacgcaggagcucuga

SEQ ID NO: 26249 - RNA, 1176 nt, Artificial Sequence
  derived and/or modified sequence opt1 from ACP2__Homo_sapiens__NP_001289419
auggccggcaagcgcagcggguggucccgggccgcgcugcuccagcugcugcucggcgugaaccuggucgugaugcccccgacccgcgcccggagccugcgcuucgugacccucgaggggaugcugcagcacugggagcugggccaggcccuccggcagcgcuaccacggguuccugaacacguccuaccaccggcaggaggucuacgugcgcagcaccgacuucgaccggacccugauguccgccgaggccaaccucgcgggccuguucccgcccaacggcaugcagcgcuucaaccccaacaucagcuggcagcccauccccgugcacaccguccccaucacggaggaccggcugcucaaguucccccuggggccgugcccccgcuacgagcagcugcagaacgagacccggcagacccccgaguaccagaacgaguccagccgcaacgcccaguuccucgacaugguggccaacgagaccggccugacggaccugacccucgagaccguguggaacgucuacgacacccuguucugcgagcagacgcacgggcugcggcugcccccgugggccagcccccagaccaugcagcgccucucccggcugaaggacuucuccuuccgcuuccucuucggcaucuaccagcaggcggagaaggcccggcugcagggcggggugcugcucgcccagauccgcaagaaccugacccugauggccaccacgagccagcuccccaagcugcugguguacuccgcccacgacaccacccucgucgcgcugcagauggcccuggacguguacaacggcgagcaggcccccuacgccagcugccacaucuucgagcucuaccaggaggacuccgggaacuucagcguggagauguacuuccggaacgaguccgacaaggccccguggccccugagccugcccggcugcccccaccgcugcccgcuccaggacuuccugcgccugaccgagcccgucgugcccaaggacuggcagcaggagugccagcucgcguccgggcccgccgacacggaggugaucgucgcccuggccgugugcggcagcauccuguuccuccugaucgugcugcugcucaccguccuguuccggaugcaggcccagccgcccggcuaccgccacguggcggacggggaggaccacgccuga

SEQ ID NO: 26250 - RNA, 978 nt, Artificial Sequence
  derived and/or modified sequence opt1 from ACP5__Homo_sapiens__NP_001104506
auggacauguggaccgcccugcucauccugcaggcccugcuccugcccagccuggcggacggcgccaccccggcccuccgcuucguggccgucggggacuggggcggggugcccaacgcccccuuccacacggcgcgggagauggccaacgccaaggagaucgcccgcaccgugcagauccugggcgcggacuucauccugucccucggggacaacuucuacuucaccggcguccaggacaucaacgacaagcgguuccaggagaccuucgaggacguguucagcgaccgcucccugcggaaggugcccugguacguccuggccggcaaccacgaccaccucgggaacgugagcgcccagaucgccuacuccaagaucagcaagcgcuggaacuucccgucccccuucuaccggcugcacuucaagaucccccagacgaacgugagcgucgccaucuucaugcuggacaccgugacccucugcggcaacuccgacgacuuccugagccagcagcccgagcgcccgcgggacgugaagcuggcgcgcacccagcucuccuggcugaagaagcagcuggccgccgcccgggaggacuacguccucguggccgggcacuaccccguguggagcaucgcggagcacggccccacgcacugccuggucaagcagcugcgcccccuccuggccaccuacggggugaccgccuaccugugcggccacgaccacaaccuccaguaccugcaggacgagaacggcgugggguacguccuguccggcgccgggaacuucauggacccgagcaagcggcaccagcgcaaggugcccaacggcuaccuccgguuccacuacggcaccgaggacucccucgggggcuucgccuacguggagaucagcuccaaggagaugacggucaccuacaucgaggcgagcgggaagucccuguucaagacccgccugccccggcgcgcccggcccuga

SEQ ID NO: 26251 - RNA, 1206 nt, Artificial Sequence
  derived and/or modified sequence opt1 from ACP6__Homo_sapiens__XP_011507903
augaucaccggcguguucagcaugcgccuguggacccccgucggggugcucacgucccuggccuacugccugcaccagcggcgcguggcccucgcggagcugcaggaggccgacggccagugcccggucgaccggagccugcucaagcugaagaugguccaggugguguuccgccacggggcccggagcccccugaagccccucccccuggaggagcaggucgaguggaacccgcagcugcucgaggugccgccccagacccaguucgacuacaccgugaccaaccuggccggcgggcccaagcccuacucccccuacgacucccaguaccacgagacgacccugaagggcggcauguucgccgggcagcucaccaaggugggcaugcagcagauguucgcgcugggggagcgccugcggaagaacuacguggaggacauccccuuccucagccccaccuucaacccgcaggaggucuucauccgcuccacgaacaucuuccggaaccuggagagcacccgcugccugcucgccggccuguuccagugccagaaggaggggcccaucaucauccacaccgacgaggccgacuccgaggugcuguaccccaacuaccagagcugcuggucccuccggcagcgcacccggggccgccggcagacggccagccugcagcccggcaucuccgaggaccugaagaaggugaaggaccgcauggggaucgacagcuccgacaaggucgacuucuucauccuccuggacaacguggcggccgagcaggcccacaaccugccgagcugccccaugcucaagcgguucgcccgcaugaucgagcagcgggccguggacaccucccuguacauccugcccaaggaggaccgcgagagccuccagauggcggucggccccuuccugcacauccuggaguccaaccuccugaaggccauggacagcgccaccgccccggacaagauccggaagcuguaccucuacgccgcgcacgacgugaccuucaucccccugcugaugacgcucgggaucuucgaccacaaguggccgcccuucgccguggaccugaccauggagcuguaccagcaccucgagagcaaggagugguucguccagcuguacuaccacggcaaggaccuccagguggccuccaucaccggcaugaagaagauccuggggcuguuccagccccacuga

SEQ ID NO: 26252 - RNA, 1161 nt, Artificial Sequence
  derived and/or modified sequence opt1 from ACPP__Homo_sapiens__NP_001090
augcgcgccgcgccccugcuccuggcccgggccgccagccugucccucggcuuccuguuccugcuguucuucuggcuggaccgcagcgugcuggccaaggagcucaaguucgucacccugguguuccggcacggggaccgcuccccgaucgacaccuuccccacggaccccaucaaggagagcuccuggccccagggcuucgggcagcugacccagcucggcauggagcagcacuacgagcugggggaguacauccggaagcgcuaccggaaguuccugaacgagagcuacaagcacgagcaggucuacauccgcuccaccgacguggaccggacccucaugagcgccaugacgaaccuggcggcccuguucccgcccgagggcguguccaucuggaaccccauccuccuguggcagcccaucccggugcacaccgucccccugagcgaggaccagcuccuguaccugcccuuccgcaacugcccccgguuccaggagcucgaguccgagacccucaagagcgaggaguuccagaagcgccugcacccguacaaggacuucaucgccacccucggcaagcuguccgggcugcacggccaggaccucuucgggaucuggagcaagguguacgacccccuguacugcgaguccgugcacaacuucacgcugcccagcugggccaccgaggacaccaugaccaagcuccgggagcuguccgagcugagccuccugucccuguacggcauccacaagcagaaggagaagucccgccuccagggcgggguccuggugaacgagauccugaaccacaugaagcgggcgacgcagauccccagcuacaagaagcucaucauguacagcgcccacgacaccaccgugagcggccugcagauggcccuggacgucuacaacgggcuccugccgcccuacgccuccugccaccugaccgagcucuacuucgagaagggcgaguacuucguggagauguacuaccgcaacgagacgcagcacgagcccuacccccugaugcugccggggugcagccccuccugcccccuggagcgguucgccgagcucgugggccccgucaucccgcaggacuggagcaccgagugcaugaccaccaacucccaccagggcacggaggacagcaccgacuga

SEQ ID NO: 26253 - RNA, 1632 nt, Artificial Sequence
  derived and/or modified sequence opt1 from ACRBP__Homo_sapiens__NP_115878
augcgcaagcccgccgccggcuuccugccgagccuccugaaggugcugcuccugccccuggcgcccgccgccgcccaggacuccacccaggccagcacccccggguccccgcucagccccacggaguacgagcgguucuucgcgcugcugacccccaccuggaaggccgagaccacgugccgccuccgggccacccacggcugccgcaaccccacccugguccagcuggaccaguacgagaaccacgggcucgugccggacggcgccgugugcuccaaccugcccuacgcgagcugguucgaguccuucugccaguucacccacuaccggugcagcaaccacgucuacuacgccaagcgcgugcugugcucccagcccgugagcauccucucccccaacacgcugaaggagaucgaggccagcgccgaggucuccccgaccaccaugaccagccccaucagcccccacuucacggugaccgagcggcagaccuuccagcccuggccggagcgccugagcaacaacguggaggagcuccugcaguccagccugucccucgggggccaggagcaggcccccgagcacaagcaggagcagggcgucgagcaccggcaggagcccacccaggagcacaagcaggaggaggggcagaagcaggaggagcaggaggaggagcaggaggaggagggcaagcaggaggaggggcagggcacgaaggaggggcgcgaggcggugagccagcugcagaccgacagcgagcccaaguuccacuccgagagccuguccagcaacccguccagcuucgcgccccgggugcgcgaggucgaguccacccccaugaucauggagaacauccaggagcucauccggagcgcccaggagaucgacgagaugaacgagaucuacgacgagaacuccuacuggcgcaaccagaaccccggcagccugcugcagcucccgcacaccgaggcccugcuggugcucugcuacuccaucguggagaacacgugcaucaucacccccaccgccaaggccuggaaguacauggaggaggagauccugggcuucgggaaguccgucugcgacucccugggccggcgccacaugagcacgugcgcccucugcgacuucugcucccugaagcuggagcagugccacagcgaggccucccuccagcggcagcagugcgacaccagccacaagacccccuucgugagcccccugcuggccucccagagccucuccaucgggaaccaggugggcagcccggaguccggccgcuucuacgggcuggaccuguacggcgggcuccacauggacuucuggugcgcccggcuggcgaccaagggcugcgaggacguccgcgugagcggguggcugcagaccgaguuccucuccuuccaggacggcgacuuccccacgaagaucugcgacaccgacuacauccaguaccccaacuacugcagcuucaagucccagcagugccugaugcggaaccgcaaccgcaaggugagccggaugcgcugccugcagaacgagaccuacuccgcccucagcccgggcaaguccgaggacgucgugcugcgguggagccaggaguucuccacccugacgcuggggcaguucggcuga

SEQ ID NO: 26254 - RNA, 2076 nt, Artificial Sequence
  derived and/or modified sequence opt1 from ACRC__Homo_sapiens__XP_011529367
auggacggcugcaagaaggagcugccccgccuccaggagccggaggaggacgaggacugcuacauccugaacgugcagagcuccagcgacgacaccuccgggagcuccgucgcccggcgcgcccccaagcggcaggcgagcugcauccugaacgugcagucccgcagcggcgacaccuccgggagcuccguggcccggcgcgcccccaagcggcaggccagcuccgucguggugaucgacagcgacuccgacgaggagugccacacgcacgaggagaagaaggccaagcuccuggagaucaacagcgacgacgagucccccgagugcugccacgucaagccggcgauccaggagccgcccaucgugaucagcgacgacgacaacgacgacgacaacggcaacgaccuggaggugcccgacgacaacuccgacgacagcgaggcccccgacgacaacagcgacgacuccgaggcccccgacgacaacagcgacgacuccgaggcccccgacgacaacagcgacgacuccgaggcgcccgacgacaacagcgacgacuccgacgucccggacgacaacagcgacgacuccagcgacgacaacuccgacgacagcuccgacgacaacagcgacgacuccgacgugcccgacgacaagagcgacgacuccgacgugcccgacgacagcuccgacgacagcgacguccccgacgacagcuccgacgacagcgaggccccggacgacuccagcgacgacuccgaggcccccgacgacagcuccgacgacagcgaggcccccgacgacuccagcgacgacuccgaggcccccgacgacagcuccgacgacagcgaggcguccgacgacagcuccgacgacagcgaggccagcgacgacuccagcgacgacuccgaggccccggacgacaagagcgacgacuccgacgugcccgaggacaagagcgacgacuccgacgugcccgacgacaacagcgacgaccucgagguccccgugccggccgaggaccugugcaacgaggggcagaucgccuccgacgaggaggagcugguggaggcggccgccgccgucagccagcacgacuccagcgacgacgccggcgagcaggaccucggcgagaaccuguccaagccgcccagcgaccccgaggcgaaccccgagguguccgagcgcaagcugcccaccgaggaggagcccgccccgguggucgagcagagcgggaagcggaaguccaagaccaagaccaucguggagccgccccgcaagcggcagacgaagaccaagaacaucguggagccgccccgcaagcggcagaccaagaccaagaacaucgucgagccccuccgcaagcggaaggccaagacgaagaacgugagcgucacccccggccacaagaagcgcgggcccuccaagaagaagcccggcgccgccaagguggagaagcggaagacccgcacccccaagugcaaggugcccgggugcuuccugcaggaccuggagaaguccaagaaguacagcggcaagaaccucaagcggaacaaggacgagcugguccagcgcaucuacgaccuguucaaccggagcgugugcgacaagaagcuccccgagaagcugcgcaucggcuggaacaacaagauggugaagacggcggggcugugcagcaccggcgagaugugguacccgaaguggcgccgguucgccaagauccagaucgggcucaaggucugcgacuccgccgaccgcauccgggacacccugauccacgagaugugccacgccgcgagcuggcugaucgacggcauccacgacucccacggcgacgccuggaaguacuacgcccgcaagagcaaccggauccaccccgagcucccccgcgugacccggugccacaacuacaagaucaacuacaaggugcacuacgagugcacggggugcaagacccgcaucggcugcuacaccaagucccuggacaccagccgguucaucugcgccaagugcaaggggucccuggucauggugccccucacgcagaaggacggcacccgcaucgugccgcacgucuga

SEQ ID NO: 26255 - RNA, 1266 nt, Artificial Sequence
  derived and/or modified sequence opt1 from ACR__Homo_sapiens__NP_001088
augguggagaugcugcccaccgccauccuccugguccuggccgugagcguggucgcgaaggacaacgccaccugcgacggcccgugcgggcuccgcuuccggcagaacccccagggcggggugcgcaucgugggcgggaaggccgcccagcacggcgccuggcccuggauggucucccugcagaucuucacguacaacagccaccgguaccacaccugcggcgggucccugcucaacagccgcugggugcugaccgcggcccacugcuucgugggcaagaacaacguccacgacuggcggcugguguucggggccaaggagaucaccuacggcaacaacaagcccgugaaggccccgcuccaggagcgcuacgucgagaagaucaucauccacgagaaguacaacuccgcgacggaggggaacgacaucgcccugguggagaucaccccccccaucagcugcggccgguucaucggccccgggugccugccgcacuucaaggccggccucccccgcgggucccagagcugcuggguggccggcuggggcuacaucgaggagaaggccccccggcccuccagcauccugauggaggcgcgcgucgaccugaucgaccucgaccugugcaacuccacccagugguacaacgggcgggugcagccgaccaacgugugcgccggcuaccccgucgggaagaucgacacgugccagggcgacagcgggggcccccugaugugcaaggacuccaaggagagcgccuacgugguggucggcaucaccuccuggggggugggcugcgcccgcgccaagcggcccgggaucuacaccgcgaccuggccguaccucaacuggaucgccagcaagaucggcuccaacgcccugcgcaugauccagagcgccacgcccccccccccgaccacccggcccccccccauccgcccgcccuucucccaccccaucagcgcccaccugcccugguacuuccagccgcccccccggccgcuccccccccgccccccggcggcccagccccggccccccccgagccccccccccccgcccccccccccggccuccccccugccccccccgcccccccccccgccccccaccccgagcuccacgaccaagcugccccaggggcucagcuucgccaagcgccugcagcagcugaucgaggugcucaagggcaagaccuacuccgacggcaagaaccacuacgacauggagaccacggagcugcccgagcugaccagcaccuccuga

SEQ ID NO: 26256 - RNA, 798 nt, Artificial Sequence
  derived and/or modified sequence opt1 from ACRV1__Homo_sapiens__NP_001603
augaaccgcuuccugcuccugaugagccuguaccuccugggcuccgcccgggggaccagcucccagcccaacgagcugagcggcuccaucgaccaccagaccagcgugcagcagcucccgggggaguucuucucccuggagaaccccagcgacgccgaggcgcuguacgagacguccagcggccucaacacccuguccgagcacgggagcuccgagcacggcagcuccaagcacaccgucgccgagcacaccagcggcgagcacgccgaguccgagcacgccagcggggagcccgccgcgacggagcacgccgagggcgagcacaccgugggggagcagcccuccggcgagcagccgagcggggagcaccugagcggcgagcagccccucuccgagcuggagagcggcgagcagcccuccgacgagcagcccagcggggagcacggcuccggggagcagccgagcggcgagcaggccuccggcgagcagcccagcggggagcacgccuccggcgagcaggcgagcggggcccccaucuccagcaccuccaccggcacgauccugaacugcuacacgugcgccuacaugaacgaccaggggaagugccuccgcggcgaggggaccugcaucacccagaacagccagcagugcaugcugaagaagaucuucgagggcggcaagcugcaguucauggugcaggggugcgagaacaugugccccuccaugaaccucuucagccacggcacccggaugcagaucaucugcugccgcaaccaguccuucugcaacaagaucuga

SEQ ID NO: 26257 - RNA, 2175 nt, Artificial Sequence
  derived and/or modified sequence opt1 from ACSBG1__Homo_sapiens__NP_055977
augccccgcaacagcggcgccggguacggcugcccgcacggggaccccuccaugcuggacagccgggagacgccccaggagucccgccaggacaugaucgugcggaccacccaggagaagcucaagaccagcucccugaccgaccgccagccccugagcaaggagucccucaaccacgcccuggagcugagcgucccggagaaggugaacaacgcgcagugggacgcccccgaggaggcccucuggaccacgcgggccgacggccgcgugcggcugcgcaucgaccccuccugcccccagcugccguacaccguccaccggauguucuacgaggcccucgacaaguacggggaccugaucgcgcugggcuucaagcgccaggacaagugggagcacaucagcuacucccaguacuaccuccuggcccggcgcgccgccaagggcuuccugaagcucgggcugaagcaggcgcacagcguggccauccugggcuucaacucccccgagugguucuucagcgccguggggaccgucuucgccggcgggaucgugaccggcaucuacacgaccuccagccccgaggccugccaguacaucgcguacgacugcugcgccaacgugaucauggucgacacccagaagcagcucgagaagauccugaagaucuggaagcagcugccccaccucaaggccguggugaucuacaaggagccgccgcccaacaagauggccaacgucuacaccauggaggaguucauggagcugggcaacgaggugcccgaggaggcccuggacgcgaucaucgacacgcagcagcccaaccagugcugcgugcucgucuacaccuccgggaccaccggcaaccccaagggggugaugcugagccaggacaacaucacguggaccgcccgguacggcucccaggccggcgacauccgccccgccgaggugcagcaggaggucguggugagcuaccugccccucagccacaucgccgcgcagaucuacgaccuguggaccgggauccaguggggcgcccaggucugcuucgccgagccggacgcccugaaggggucccucgugaacacccugcgggagguggagcccacgagccacaugggcgucccccgcgugugggagaagaucauggagcggauccaggaggucgccgcgcaguccggguucauccgccggaagaugcugcucugggccaugagcgugacccuggagcagaaccugaccugccccggcuccgaccucaagccguucaccacgcgccuggccgacuaccuggugcucgccaagguccggcaggcgcugggcuucgccaagugccagaagaacuucuacggggccgcccccaugauggccgagacccagcacuucuuccugggccucaacauccgccuguacgcgggguacggccugagcgagaccuccgggccccacuucaugagcucccccuacaacuaccgccucuacagcuccggcaagcuggugccgggcugccgggugaagcuggucaaccaggacgccgaggggaucggcgagaucugccucugggggcgcaccaucuucaugggcuaccugaacauggaggacaagacgugcgaggccaucgacgaggagggguggcugcacaccggcgacgccggccggcuggacgccgacggguuccucuacaucaccggccgccugaaggagcugaucaucaccgccgggggcgagaacgugccgcccgugcccaucgaggaggcggucaagauggagcuccccaucaucagcaacgccaugcugaucggcgaccagcggaaguuccuguccaugcuccugacgcugaagugcacccucgaccccgacaccagcgaccagaccgacaaccugacggagcaggccauggaguucugccagcgcguggggucccgggccaccaccgugagcgagaucaucgagaagaaggacgaggcggucuaccaggccaucgaggagggcauccgccgggugaacaugaacgccgccgcgcgccccuaccacauccagaagugggccauccuggagcgggacuucuccaucagcgggggcgagcucgggccgaccaugaagcugaagcgccugaccgugcucgagaaguacaagggcaucaucgacuccuucuaccaggagcagaagauguga

SEQ ID NO: 26258 - RNA, 2001 nt, Artificial Sequence
  derived and/or modified sequence opt1 from ACSBG2__Homo_sapiens__NP_001276107
augaccggcacccccaagacgcaggagggggccaaggaccuggagguggacaugaacaagaccgaggucaccccgcgccucuggaccacgugccgggacggcgaggugcugcugcgccucagcaagcacgggcccggccacgagacccccaugaccauccccgaguucuuccgggaguccgugaaccgcuucgggaccuacccggcccuggcgagcaagaacggcaagaagugggagauccugaacuucaaccaguacuacgaggccugccggaaggccgccaagucccucaucaagcugggccuggagcgcuuccacggggucggcauccucggguucaacagcgccgagugguucaucacggcggugggcgccauccuggccgggggccugugcgugggcaucuacgccaccaacuccgcggaggucugccaguacgugaucacccacgccaaggugaacauccuccuggucgagaacgaccagcagcugcagaagauccucagcaucccccaguccagccuggagccccugaaggccaucauccaguaccggcuccccaugaagaagaacaacaaccuguacuccugggacgacuucauggagcuggggcgcagcaucccggacacccagcucgagcaggucaucgagucccagaaggccaaccagugcgccgugcugaucuacacgagcggcaccaccgggauccccaagggcgugaugcugucccacgacaacaucaccuggaucgcgggcgccgugacgaaggacuucaagcucaccgacaagcacgagaccguggucagcuaccugccccugucccacaucgccgcccagaugauggacaucugggugcccaucaagaucggggcccucaccuacuucgcgcaggccgacgcccugaagggcacgcuggugagcacccucaaggaggucaagccgaccguguucaucggggugccccagaucugggagaagauccacgagauggucaagaagaacuccgccaagagcaugggccugaagaagaaggccuucgugugggcgcggaacaucggguucaaggugaacuccaagaagaugcugggcaaguacaacacccccgucagcuaccgcauggccaagacgcucguguucagcaaggucaagaccucccugggccuggaccacugccacagcuucaucuccgggaccgcgccccucaaccaggagaccgccgaguucuuccugagccuggacaucccgaucggcgagcucuacgggcuguccgagagcuccggcccccacacgaucagcaaccagaacaacuaccggcugcucuccugcgggaagauccugaccggcugcaagaacaugcuguuccagcagaacaaggacggcaucggggagaucugccucuggggccgccacaucuucaugggguaccuggagagcgagaccgagaccacggaggccaucgacgacgagggcuggcugcacuccggggaccucggccagcuggacggccugggguuccuguacgugaccggccacaucaaggagauccucaucaccgccgggggcgagaacgugccgcccauccccgucgagacccuggugaagaagaagauccccaucaucagcaacgccaugcuggugggcgacaagcucaaguuccuguccaugcugcucacgcugaagugcgagaugaaccagaugagcggggagccccuggacaagcucaacuucgaggccaucaacuucugccggggccuggggucccaggccagcaccgucaccgagaucgugaagcagcaggacccccugguguacaaggcgauccagcagggcaucaacgccgucaaccaggaggccaugaacaacgcccagcgcaucgagaagugggugauccucgagaaggacuucuccaucuacgggggcgagcugggcccgaugaugaagcugaagcggcacuucguggcccagaaguacaagaagcagaucgaccacauguaccacuga

SEQ ID NO: 26259 - RNA, 1731 nt, Artificial Sequence
  derived and/or modified sequence opt1 from ACSF3__Homo_sapiens__NP_777577
augcugccccacgugguccucaccuuccgccggcugggcugcgcccuggccagcugccgccucgcgccggcccggcaccgcggguccggccugcugcacaccgcccccguggcccggagcgaccgcuccgcccccguguucacgcgggcgcucgccuucggggaccgcaucgcccuggucgaccagcacggccggcacaccuaccgcgagcuguacagccggucccuccgccugagccaggagaucugccggcugugcgggugcgugggcggcgaccuccgcgaggagcggguguccuuccugugcgccaacgacgcgagcuacgucguggcccagugggccuccuggaugagcgggggcguggccgucccccuguaccgcaagcacccggccgcgcagcucgaguacgugaucugcgacucccagagcuccgugguccuggccagccaggaguaccuggagcuccugucccccguggugcggaagcugggggucccccuccugccccugaccccggccaucuacaccggcgccguggaggagcccgccgaggugcccguccccgagcagggguggcgcaacaagggcgcgaugaucaucuacacgagcggcaccaccgggcggccgaagggcgugcucuccacccaccagaacauccgcgccguggucacggggcuggugcacaagugggccuggaccaaggacgacgugauccugcacguccucccccugcaccacgugcacggcgucgugaacgcccugcucugcccccugugggugggcgcgaccugcgucaugaugcccgaguucagcccgcagcaggucugggagaaguuccuguccagcgagacgccccggaucaacguguucauggccgugcccaccaucuacaccaagcucauggaguacuacgaccgccacuucacccagccccacgcccaggacuuccugcgcgccgugugcgaggagaagauccggcugauggugagcggguccgccgcccucccgcugcccguccuggagaaguggaagaacaucaccggccacacgcuccuggagcgcuacgggaugaccgagaucggcauggcgcugagcgggccccucaccaccgccgugcggcugcccggcuccgugggcacgccgcugcccgggguccaggugcgcaucgugagcgagaacccccagcgggaggccugcuccuacaccauccacgccgagggcgacgagcgcgggaccaaggucacccccggcuucgaggagaaggagggggagcuccuggugcggggcccgagcguguuccgcgaguacuggaacaagcccgaggagacgaaguccgcguucacccuggacggcugguucaagaccggggacaccgucguguucaaggacggccaguacuggauccgggggcgcacgagcguggacaucaucaagaccggcggguacaaggucuccgcccucgagguggaguggcaccuccuggcccaccccagcaucaccgacguggccgucaucggcgugccggacaugaccuggggccagcgggugacggccgucgugacccugcgcgaggggcacucccugagccaccgggagcugaaggagugggcgcgcaacgugcuggcccccuacgccguccccuccgagcucgugcugguggaggagaucccccggaaccagaugggcaagaucgacaagaaggcccugauccgccacuuccacccgagcuga

SEQ ID NO: 26260 - RNA, 1995 nt, Artificial Sequence
  derived and/or modified sequence opt1 from ACSL1__Homo_sapiens__NP_001273640
augcaggcccacgagcuguuccgcuacuuccggaugcccgagcucguggacuuccgccaguacguccggacccugccgaccaacacgcugaugggcuucggggccuucgcggcccucaccaccuucugguacgccacccgccccaagccccugaagcccccgugcgaccugagcaugcaguccguggagguggccggcagcgggggcgcccggcgcuccgcgcuccuggacagcgacgagccccuggucuacuucuacgacgacgugacgacccucuacgagggguuccagcggggcauccagguguccaacaacggccccugccuggggagccgcaagcccgaccagccguacgaguggcuguccuacaagcagugggucaucaucgagcagggcugcuucgccuacagcauggugaucgugccccucuacgacacccuggggaacgaggccaucaccuacaucgucaacaaggccgagcugucccucguguucguggacaagcccgagaaggcgaagcugcugcucgagggcgucgagaacaagcugauccccgggcugaagaucaucguggugauggacgccuacggcagcgagcucgucgagcggggccagcgcugcgggguggaggugacguccaugaaggccauggaggaccugggccgggccaaccgccggaagccgaagccgcccgcccccgaggaccuggcggucaucugcuucaccagcgggaccaccggcaaccccaagggcgccauggugacgcaccgcaacaucguguccgacugcagcgccuucgucaaggccaccgagaacaccgugaaccccugccccgacgacacccucaucuccuuccugccccuggcccacauguucgagcggguggucgagugcgugaugcucugccacggggcgaagaucggcuucuuccagggggacauccgccugcugauggacgaccucaagguccugcagccgacgguguuccccguggucccccggcugcucaaccgcauguucgaccggaucuucggccaggccaacaccacccugaagcgcuggcugcucgacuucgccagcaagcggaaggaggccgagcugcgcuccgggaucauccgcaacaacagccugugggaccggcucaucuuccacaaggugcaguccagccugggcggccgcgugcggcugauggucaccggggccgcgcccgugagcgccacggugcucaccuuccugcgcgccgcccugggcugccaguucuacgagggguacggccagaccgagugcaccgccgggugcugccucacgaugccgggcgacuggaccgcgggccacgucggggcccccaugcccugcaaccugaucaagcugguggacguggaggagaugaacuacauggccgccgagggcgagggggaggucugcgugaagggccccaacguguuccagggguaccucaaggacccggcgaagaccgccgaggcccuggacaaggacggcuggcugcacaccggcgacaucgggaaguggcugcccaacggcacgcucaagaucaucgaccggaagaagcacaucuucaagcuggcccagggggaguacaucgcccccgagaagaucgagaacaucuacaugcgcuccgagccggucgcccagguguucgugcacggcgagagccugcaggcguuccucaucgccaucgucgugcccgacguggagacccugugcuccugggcccagaagcggggcuucgaggggagcuucgaggagcugugccgcaacaaggacgucaagaaggccauccucgaggacauggugcggcugggcaaggacuccgggcugaagcccuucgagcaggucaagggcaucacccuccaccccgagcuguucagcaucgacaacgggcugcucaccccgacgaugaaggcgaagcgccccgagcugcggaacuacuuccgcucccagaucgacgaccuguacagcaccaucaagguguga

SEQ ID NO: 26261 - RNA, 2163 nt, Artificial Sequence
  derived and/or modified sequence opt1 from ACSL3__Homo_sapiens__NP_976251
augaacaaccacgugagcuccaagcccagcaccaugaagcugaagcacaccaucaacccgauccuccuguacuucauccacuuccugaucucccucuacacgauccugaccuacauccccuucuacuucuucagcgagucccgccaggagaaguccaaccggaucaaggccaagcccgucaacuccaagcccgacagcgccuaccgcuccgugaacagccuggacggccucgcguccgugcuguacccggggugcgacacccuggacaaggucuucaccuacgccaagaacaaguucaagaacaagcggcuccugggcacgcgcgaggugcugaacgaggaggacgaggugcagcccaacgggaagaucuucaagaaggucauccucggccaguacaacuggcugagcuacgaggacguguucgugcgggccuucaacuucgggaacggccugcagaugcucggccagaagcccaagaccaacaucgccaucuucugcgagacccgcgccgaguggaugaucgcggcccaggccugcuucauguacaacuuccagcuggucacccuguacgccacgcucgggggccccgcgaucgugcacgcccugaacgagaccgaggugaccaacaucaucaccuccaaggagcugcuccagacgaagcugaaggacaucgucagccuggugccgcggcuccgccacaucaucaccguggacgggaagccgcccaccugguccgaguuccccaagggcaucaucguccacaccauggccgccguggaggcccugggggcgaaggccagcauggagaaccagccccacuccaagccccugcccagcgacaucgccgugaucauguacacguccggcagcaccggccuccccaagggggucaugaucagccacuccaacaucaucgccggcaucaccgggauggccgagcggaucccggagcugggcgaggaggacguguacaucggcuaccugccccucgcgcacgugcuggagcugagcgccgagcucgucugccugucccacgggugccgcaucggcuacagcagcccccagacccuggccgaccagagcuccaagaucaagaaggggagcaagggcgacacguccaugcucaagcccacccugauggccgccgugccggagaucauggaccggaucuacaagaacgugaugaacaaggucagcgagauguccagcuuccagcgcaaccuguucauccucgcguacaacuacaagauggagcagaucuccaaggggcggaacacgccccugugcgacagcuucguguuccgcaagguccggucccugcucggcggcaacauccgccugcugcucugcgggggcgcgccccugagcgccaccacccagcgguucaugaacaucugcuucugcugccccguggggcagggcuacgggcugaccgaguccgccggcgccggcaccaucagcgaggugugggacuacaacaccgggcgcgucggcgccccgcucgugugcugcgagaucaagcugaagaacugggaggagggcggguacuucaacacggacaagccccacccccgcggggagauccugaucggcggccaguccgugaccaugggguacuacaagaacgaggccaagaccaaggccgacuucuucgaggacgagaacggccagcgguggcugugcaccggggacaucggcgaguucgagcccgacggcugccucaagaucaucgaccggaagaaggaccuggucaagcugcaggccggggaguacgugagccucggcaagguggaggcggcccugaagaaccugccgcucgucgacaacaucugcgccuacgccaacagcuaccacuccuacgugaucggguucgugguccccaaccagaaggagcugacggagcuggcccgcaagaagggccucaaggggaccugggaggagcugugcaacagcugcgagauggagaacgaggugcugaaggugcucuccgaggcggccaucagcgccucccuggagaaguucgagauccccgucaagauccgccugagcccggagcccuggacccccgagaccggccucgugacggacgccuucaagcugaagcggaaggagcugaagacccacuaccaggccgacaucgagcgcauguacggccggaaguga

SEQ ID NO: 26262 - RNA, 2220 nt, Artificial Sequence
  derived and/or modified sequence opt1 from ACSL5__Homo_sapiens__NP_057318
auggacgcccugaagcccccgugccucuggcgcaaccacgagcggggcaagaaggaccgcgacagcugcgggcggaagaacuccgagcccggcagcccccacucccuggaggcccugcgcgacgcggcccccagccaggggcucaacuuccugcuccuguucaccaagaugcuguucaucuucaacuuccuguucuccccgcuccccacccccgcccugaucugcauccugacguucggcgccgccaucuuccucuggcugaucacccggccccagccggugcugccccuccuggaccugaacaaccagagcguggggaucgagggcggcgcgcgcaagggggugucccagaagaacaacgaccucaccagcugcugcuucuccgacgccaagaccauguacgagguguuccagcggggccuggccgucagcgacaacgggcccugccugggcuaccgcaagcccaaccagccguaccgguggcucuccuacaagcaggucagcgaccgcgccgaguaccugggguccugccugcuccacaagggcuacaagagcucccccgaccaguucgugggcaucuucgcgcagaaccggcccgaguggaucaucagcgagcuggccugcuacacguacuccaugguggccgugccccuguacgacacccucgggccggaggccaucgugcacaucgucaacaaggccgacaucgcgauggugaucugcgacacgccccagaaggcccuggugcugaucggcaacgucgagaagggguucacccccagccucaaggugaucauccugauggaccccuucgacgacgaccugaagcagcgcggcgagaaguccggcaucgagauccucagccuguacgacgccgagaaccuggggaaggagcacuuccggaagccggugccgcccagccccgaggaccucuccgucaucugcuucaccagcggcaccaccggggaccccaagggcgccaugaucacccaccagaacaucguguccaacgccgcggccuuccugaagugcguggagcacgccuacgagcccacgcccgacgacgucgccaucagcuaccugccccucgcccacauguucgagcgcaucgugcaggcgguggucuacuccugcggggcccgggugggcuucuuccagggcgacauccgccugcuggccgacgacaugaagacccucaagccgacccuguuccccgccgugccccggcugcucaaccgcaucuacgacaagguccagaacgaggccaagaccccgcugaagaaguuccugcucaagcuggcggugagcuccaaguucaaggagcugcagaaggggaucauccggcacgacagcuucugggacaagcugaucuucgccaagauccaggacucccucggcgggcgcguccgggugaucgugacgggcgccgcccccaugagcaccuccgucaugaccuucuuccgcgcggccauggggugccagguguacgaggccuacggccagaccgagugcacgggcgggugcaccuucacccugcccggcgacuggaccagcgggcacgugggcgucccccuggccugcaacuacgugaagcucgaggacguggccgacaugaacuacuucacggucaacaacgagggggaggugugcaucaagggcaccaacguguucaagggcuaccugaaggacccggagaagacccaggaggcgcuggacuccgacggguggcuccacaccggcgacaucgggcgcuggcugcccaacggcacgcugaagaucaucgaccggaagaagaacaucuucaagcucgcccagggcgaguacaucgcccccgagaagaucgagaacaucuacaaccgcagccagcccguccugcagaucuucgugcacggggagucccugcggagcucccucgugggcgucguggugccggacaccgacguccugcccagcuucgccgccaagcugggggugaagggcuccuucgaggagcucugccagaaccaggugguccgcgaggcgauccuggaggaccugcagaagaucgggaaggagagcggccucaagaccuucgagcaggucaaggccaucuuccugcaccccgagcccuucagcaucgagaacggccugcucaccccgacgcugaaggccaagcgcggggagcuguccaaguacuuccggacccagaucgacagccucuacgagcacauccaggacuga

SEQ ID NO: 26263 - RNA, 2169 nt, Artificial Sequence
  derived and/or modified sequence opt1 from ACSL6__Homo_sapiens__NP_001009185
augcugaccuucuuccucgugagcggcgggucccuguggcuguucgucgaguucgugcucagccugcuggagaagaugcagacccaggagauccuccgcauccugcggcugcccgagcucggcgaccuggggcaguucuuccgcucccugagcgccacgacccucguguccaugggcgcccuggcggccauccuggccuacugguucacccaccggccgaaggcccuccagccgcccugcaaccugcugaugcagagcgaggaggucgaggacuccgggggcgcccgccggagcgugaucggcuccgggccccagcuccugacccacuacuacgacgacgcgcgcacgauguaccagguguuccggcgcggccugagcaucuccgggaacggccccugccucggguuccggaagcccaagcagcccuaccaguggcugagcuaccaggaggucgccgaccgcgccgaguuccugggcuccggccuccugcagcacaacugcaaggccugcaccgaccaguucaucgggguguucgcgcagaaccggcccgaguggaucaucguggagcuggccugcuacaccuacagcauggucguggugccgcucuacgacacccugggccccggggccauccgcuacaucaucaacacggccgacaucuccaccgucaucguggacaagccccagaaggccgugcugcuccuggagcacgucgagcggaaggagacccccggccugaagcucaucauccugauggacccguucgaggaggcgcugaaggagcgcggccagaagugcgggguggugaucaagagcaugcaggccgucgaggacugcggccaggagaaccaccaggcccccgugccgccccagcccgacgaccucuccaucgugugcuucaccagcgggacgaccggcaaccccaagggggccaugcugacccacggcaacgucguggccgacuucuccggcuuccugaaggugaccgagaaggucaucuucccccggcaggacgacgugcucaucagcuuccugccccuggcgcacauguucgagcgcgucauccagagcgugguguacugccacgggggccgggucggguucuuccagggcgacauccgccuccuguccgacgacaugaaggcccugugcccgacgaucuuccccguggugccccggcuccugaaccgcauguacgacaagaucuucagccaggccaacacgccccugaagcgguggcuccuggaguucgccgccaagcgcaagcaggcggagguccgcuccgggaucauccggaacgacagcaucugggacgagcuguucuucaacaagauccaggccucccugggcggcugcgugcgcaugaucgugaccggggccgccccggccagccccaccguccucggcuuccugcgggcggcccuggggugccagguguacgagggcuacgggcagaccgagugcaccgccggcugcaccuucaccacgcccggcgacuggaccuccgggcacgugggcgcgccccucccgugcaaccacaucaagcuggucgacguggaggagcugaacuacugggccugcaagggggagggcgagaucugcgugcgcggccccaacgucuucaagggguaccucaaggaccccgaccggaccaaggaggcccuggacagcgacggcuggcugcacaccggggacaucggcaaguggcucccggccgggacgcugaagaucaucgaccgcaagaagcacaucuucaagcuggcccagggcgaguacguggcccccgagaagaucgagaacaucuacauccggucccagcccguggcgcagaucuacguccacggcgacagccucaaggccuuccugguggggaucgugguccccgacccggaggugaugcccuccugggcccagaagcgcggcaucgaggggaccuacgccgaccugugcaccaacaaggaccucaagaaggccauccuggaggacauggugcggcugggcaaggagagcgggcuccacuccuucgagcaggucaaggcgauccacauccacagcgacauguucuccgugcagaacggccugcugacccccacgcucaaggccaagcgccccgagcugcgggaguacuucaagaagcagaucgaggagcuguacagcaucuccauguga

SEQ ID NO: 26264 - RNA, 1734 nt, Artificial Sequence
  derived and/or modified sequence opt1 from ACSM1__Homo_sapiens__NP_001305819
augcaguggcugaugcgcuuccggacccucuggggcauccacaagagcuuccacaacauccaccccgccccgucccagcugcgcugccggagccuguccgaguucggggcgccccgcuggaacgacuacgaggugcccgaggaguucaacuucgccagcuacguccucgacuacugggcccagaaggagaaggagggcaagcgggggcccaacccggccuucuggugggugaacggccagggggacgaggugaagugguccuuccgcgagaugggcgaccugacccggcgcgucgccaacguguucacgcagaccugcggccugcagcagggggaccaccucgcccugaugcugccccgggugcccgagugguggcucgucgcggugggcugcaugcgcaccgggaucaucuucauccccgccaccauccugcugaaggccaaggacauccucuaccggcugcagcugagcaaggccaagggcaucgugacgaucgacgcgcucgccuccgaggucgacagcaucgccucccagugcccgagccugaagaccaagcugcucguguccgaccacagccgcgagggguggcuggacuuccggucccuggugaaguccgccagccccgagcacacgugcgucaagagcaagacccucgaccccauggugaucuucuucaccuccggcaccaccggcuuccccaagauggccaagcacagccacgggcuggcgcugcagccguccuuccccggcagccgcaagcuccggagccugaagaccuccgacgugagcuggugccuguccgacagcggguggaucgucgccacgaucuggacccucguggagcccuggaccgccggcugcaccguguucauccaccaccucccccaguucgacacgaaggucaucauccagacccugcugaaguacccgaucaaccacuucuggggcguguccagcaucuaccgcaugauccugcagcaggacuucaccuccauccgguuccccgcccuggagcacugcuacaccgggggcgaggugguccuccccaaggaccaggaggaguggaagcgccggacggggcugcugcucuacgagaacuacggccagagcgagaccgggcugaucugcgccaccuacuggggcaugaagaucaagcccggcuucauggggaaggcgaccccgcccuacgacguccaggugaucgacgacaagggcuccauccugccgcccaacacggaggggaacaucggcauccgcaucaagcccgugcggcccgugagccucuucaugugcuacgagggggaccccgagaagaccgccaaggucgagugcggcgacuucuacaacaccggcgaccgcgggaagauggacgaggagggcuacaucugcuuccuggggcgcuccgacgacaucaucaacgccagcggcuaccggaucgggcccgccgagguggaguccgcccugguggagcacccggcggucgccgagagcgccguggugggcucccccgaccccauccgcggcgaggucgugaaggccuucaucgugcucaccccgcaguuccugagccacgacaaggaccagcugacgaaggagcuccagcagcacgucaaguccgugaccgcccccuacaaguacccccggaagguggaguucgucagcgagcugcccaagaccaucaccgggaagaucgagcgcaaggagcugcggaagaaggagacgggccagauguga

SEQ ID NO: 26265 - RNA, 1734 nt, Artificial Sequence
  derived and/or modified sequence opt1 from ACSM2B__Homo_sapiens__NP_001098539
augcacuggcugcgcaaggugcagggccucugcacccugugggggacccagaugagcucccggacgcuguacaucaacagccgccagcucgucucccugcaguggggccaccaggaggugcccgccaaguucaacuucgccagcgacgugcuggaccacugggcggacauggagaaggccgggaagcggcucccgucccccgcccuguggugggucaacggcaaggggaaggagcugauguggaacuuccgcgagcucagcgagaacucccagcaggccgccaacauccugagcggcgcgugcggccugcagcgcggggaccggguggccgugaugcucccccggguccccgagugguggcuggugauccugggcugcauccgcgccgggcucaucuucaugccgggcaccauccagaugaaguccaccgacauccuguaccggcugcagaugagcaaggccaaggcgaucguggccggggacgaggucauccaggagguggacaccguggccuccgagugccccagccuccgcaucaagcugcuggucuccgagaaguccugcgacggcuggcucaacuucaagaagcugcugaacgaggccagcacgacccaccacugcguggagaccggcagccaggaggccuccgcgaucuacuucaccagcgggacguccggccuccccaagauggccgagcacagcuacagcucccuggggcugaaggccaagauggacgccggcuggaccggccuccaggccagcgacaucauguggaccaucuccgacaccggguggauccugaacauccugggcagccuccuggaguccuggacgcugggggcgugcaccuucgugcaccuccugcccaaguucgacccgcuggucauccucaagacccugagcuccuaccccaucaagagcaugaugggcgcccccaucguguaccggaugcugcuccagcaggaccuguccagcuacaaguucccccaccuccagaacugccuggccgggggcgagucccugcugccggagacccucgagaacuggcgcgcccagacgggccuggacauccgggaguucuacgggcagaccgagaccggccugaccugcauggugagcaagacgaugaagaucaagcccggguacaugggcaccgccgcguccugcuacgacguccaggugaucgacgacaaggggaacgugcucccgcccggcaccgagggcgacaucgggauccgcgucaagcccauccggcccaucggcaucuucagcggguacguggagaaccccgacaagaccgccgccaacauccgcggcgacuucuggcugcugggggaccggggcaucaaggacgaggacggcuacuuccaguucauggggcgcgccgacgacaucaucaacuccagcggcuaccggaucgggcccuccgagguggagaacgcccugaugaagcacccggcggucguggagacggccgucaucagcucccccgaccccgugcgcggcgagguggucaaggccuucgugauccucgccagccaguuccugagccacgaccccgagcagcugaccaaggagcuccagcagcacgugaaguccgucaccgcgccguacaaguacccccggaagaucgaguucgugcugaaccugcccaagaccgugacgggcaagauccagcgcaccaagcuccgcgacaaggaguggaagaugagcgggaaggcccgggcccaguga

SEQ ID NO: 26266 - RNA, 1761 nt, Artificial Sequence
  derived and/or modified sequence opt1 from ACSM3__Homo_sapiens__NP_005613
augcuggcccgcgugacccggaagaugcuccgccacgccaagugcuuccagcggcuggcgaucuucggcagcguccgcgcccugcacaaggacaaccggaccgccacgccccagaacuucuccaacuacgagagcaugaagcaggacuucaagcucgggaucccggaguacuucaacuucgccaaggacgugcuggaccaguggaccgacaaggagaaggccggcaagaagcccuccaaccccgcguucugguggaucaaccgcaacggggaggagaugcgguggagcuucgaggagcugggcucccucagccgcaaguucgccaacauccuguccgaggccugcagccugcagcgcggggaccgggugauccucauccugccccgggucccggagugguggcuggccaacguggcgugccuccgcaccggcaccgugcugauccccggcacgacccagcugacccagaaggacauccucuaccggcugcaguccagcaaggccaacugcaucaucaccaacgacguccuggcccccgccguggacgccguggcguccaagugcgagaaccuccacagcaagcugaucgucuccgagaacagccgcgagggguggggcaaccugaaggagcucaugaagcacgccuccgacagccacacgugcgugaagaccaagcacaacgagaucauggccaucuucuucaccuccgggaccagcggcuaccccaagaugacggcccacacccacuccagcuucgggcugggccugagcgugaacggccgguucuggcucgaccugaccccguccgacgucauguggaacaccagcgacacggggugggccaaguccgcguggagcuccguguucagccccuggauccagggcgccugcguguucacccaccaccucccccgcuucgagcccaccuccauccuccagacccugagcaaguacccgaucacggucuucugcuccgcccccaccguguaccggaugcuggugcagaacgacaucaccagcuacaaguucaagucccucaagcacugcgucagcgccggggagcccaucacccccgacgugacggagaaguggcgcaacaagaccggccuggacaucuacgagggcuacgggcagaccgagaccgugcugaucugcggcaacuucaaggggaugaagaucaagccgggcuccauggggaagcccagccccgccuucgacgucaagaucguggacgugaacggcaacguccugcccccgggccaggagggggacaucggcauccaggugcugcccaaccggcccuucgggcuguucacgcacuacgucgacaaccccuccaagaccgcgagcacccuccgcggcaacuucuacaucaccggggaccggggcuacauggacaaggacggcuacuucugguucguggcccgcgccgacgacgugauccuguccagcggguaccgcaucggcccguucgaggucgagaacgcccugaacgagcaccccuccguggccgagagcgcgguggucagcucccccgaccccauccgcggggagguggugaaggccuucgucgugcucaacccggacuacaagagccacgaccaggagcagcugaucaaggagauccaggagcacgugaagaagacgaccgcccccuacaaguacccccggaaggucgaguucauccaggagcugccgaagaccaucuccggcaagaccaagcggaacgagcuccgcaagaaggaguggaagacgaucuga

SEQ ID NO: 26267 - RNA, 1707 nt, Artificial Sequence
  derived and/or modified sequence opt1 from ACSS1__Homo_sapiens__NP_001239605
augcgccggcgcaaggagcggcagcccugggaccgcuuccacuuccugcacuucgccccgcacggccgggagcuccuggagacgaccugccgccuggccaacacccucaagcggcacggggugcaccgcggcgaccgggucgcgaucuacaugcccgugagcccccuggccguggccgccaugcuggccugcgcgcgcaucggggccguccacaccgugaucuucgccggcuucuccgccgagagccucgcggggcggaucaacgacgccaagugcaagguggucaucaccuucaaccagggccugcgcggcgggcgggugguggagcugaagaagaucgucgacgaggccgugaagcacugccccaccgugcagcacguccucguggcccaccgcacggacaacaaggugcacaugggcgaccuggacgucccgcuggagcaggagauggccaaggaggaccccgugugcgcgcccgaguccauggggagcgaggacaugcuguucaugcuguacaccuccggcagcaccgggaugcccaagggcaucgugcacacccaggccggcuaccugcucuacgccgcccugacgcacaagcuggucuucgaccaccagccgggggacaucuucggcugcguggccgacaucggguggaucaccggccacuccuacguggucuacggcccccucugcaacggggcgaccagcgugcuguucgaguccacccccguguaccccaacgccggccgguacugggagacggucgagcgccugaagaucaaccaguucuacggggccccgaccgccgugcggcuccugcugaaguacggcgacgccugggucaagaaguacgaccgcagcucccuccggacccuggggagcgugggcgagcccaucaacugcgaggcgugggaguggcugcaccgcguggucggcgacucccggugcacccucguggacacgugguggcagaccgagaccgggggcaucugcaucgcgccccgccccagcgaggagggggccgagauccugccggccauggccaugcgccccuucuucggcaucgugcccguccugauggacgagaagggguccgugguggagggcagcaacgucuccggcgcccucugcaucagccaggccuggcccgggauggcccggaccaucuacggcgaccaccagcgcuucguggacgccuacuucaaggcguacccgggguacuacuucacgggcgacggggccuaccggaccgagggcggcuacuaccagaucaccgggcgcauggacgacgugaucaacaucuccggccaccggcuggggaccgccgagaucgaggacgccaucgccgaccaccccgcgguccccgagagcgccgugaucggcuacccccacgacaucaagggcgaggccgccuucgccuucaucguggucaaggacagcgcgggggacuccgacguggugguccaggagcucaagagcaugguggccacgaagaucgccaaguacgccgugccggacgagauccucgucgugaagcgccugcccaagacccgguccggcaaggugaugcgccggcugcuccgcaagaucaucaccagcgaggcccaggagcugggggacaccacgacccuggaggaccccuccaucaucgcggagauccucagcgucuaccagaagugcaaggacaagcaggccgccgccaaguga

SEQ ID NO: 26268 - RNA, 2145 nt, Artificial Sequence
  derived and/or modified sequence opt1 from ACSS2__Homo_sapiens__NP_001070020
augggccugcccgaggagcgcgugcggagcggguccggcagccgcgggcaggaggaggccggcgccgggggccgggcgcgcuccuggagcccgccgcccgaggucucccggagcgcccacgugcccucccuccagcgcuaccgggagcugcaccgccggagcguggaggagccccgcgaguucuggggcgacaucgccaaggaguucuacuggaagacccccugccccgggcccuuccugcgguacaacuucgacgucaccaagggcaagaucuucaucgaguggaugaagggggccacgaccaacaucugcuacaacgugcucgaccgcaacgugcacgagaagaagcugggcgacaaggucgccuucuacugggaggggaacgagccgggcgagaccacccagaucacguaccaccagcugcucguccaggugugccaguucuccaacgugcugcggaagcagggcauccagaagggggaccgcguggcgaucuacaugcccaugauccccgagcugguggucgccaugcucgccugcgcccggaucggcgcgcugcacagcaucguguucgccggguucuccagcgagucccugugcgagcgcauccucgacagcuccugcagccugcugaucaccaccgacgccuucuaccggggcgagaagcucgugaaccugaaggagcuggccgacgaggcccuccagaagugccaggagaagggcuuccccguccgcugcugcaucguggugaagcaccuggggcgggcggagcugggcaugggggacuccaccagccaguccccgcccaucaagcgcagcugccccgacguccagggcaagcucaaggagaaguccaagcgggugcagccccagaucagcuggaaccaggggaucgaccugugguggcacgagcugaugcaggaggccggcgacgagugcgagccggaguggugcgacgccgaggacccccucuucauccuguacacgagcggcuccaccgggaagcccaagggcgugguccacaccgucgggggcuacaugcuguacguggccaccacguucaaguacguguucgacuuccacgccgaggacguguucuggugcaccgcggacaucggguggaucaccggccacagcuacgucaccuacggcccccucgccaacggggccacguccgugcuguucgagggcaucccgaccuaccccgacgugaaccgccuguggagcaucgucgacaaguacaaggugaccaaguucuacaccgcccccacggccauccgccuccugaugaaguucggggacgagcccgugaccaagcacucccgggcgagccugcagguccucggcaccgugggggagccgaucaaccccgaggccuggcugugguaccaccgcguggucggcgcccagcggugccccaucguggacaccuucuggcagacggagaccggcgggcacaugcugacgccccucccgggcgccacccccaugaagcccggguccgccaccuucccguucuucggcguggcgcccgccauccugaacgagagcggcgaggagcuggagggggaggccgagggcuaccucgucuucaagcagcccuggcccgggaucaugcgcaccguguacggcaaccacgagcgguucgagaccaccuacuucaagaaguucccgggguacuacgugacgggcgacggcugccagcgcgaccaggacggguacuacuggaucaccggccggaucgacgacaugcugaacgucuccgggcaccuccugagcaccgccgagguggaguccgcgcugguggagcacgaggccgucgccgaggccgccguggugggccacccccaccccgucaagggggagugccuguacugcuucgugacccucugcgacggccacacguucagccccaagcugaccgaggagcugaagaagcagauccgcgagaagaucggcccgaucgcgacccccgacuacauccagaacgcccccgggcuccccaagacccgguccggcaagaucaugcgccgggugcugcgcaagaucgcccagaacgaccacgaccugggggacaugagcaccgucgccgacccguccgugaucagccaccuguucucccaccggugccucacgauccaguga

SEQ ID NO: 26269 - RNA, 2061 nt, Artificial Sequence
  derived and/or modified sequence opt1 from ACSS3__Homo_sapiens__NP_078836
augaagcccagcuggcugcagugccgcaaggugaccuccgccggcgggcucggcgggccgcugcccggcagcucccccgcccgcggggcgggcgccgcccugcgggcccucgucgugcccggcccgcgcgggggccucgggggccgggggugccgggcccugagcuccggcagcggcuccgaguacaagacccacuucgcggccagcgugacggaccccgagcgcuucugggggaaggccgccgagcagaucuccugguacaagcccuggaccaagacccuggagaacaagcacagccccuccacccggugguucgucgagggcaugcugaacaucugcuacaacgcgguggaccgccacaucgagaacgggaagggcgacaagaucgccaucaucuacgacagcccggugacgaacaccaaggccaccuucaccuacaaggagguccuggagcaggucuccaagcucgccggcgugcuggugaagcacgggaucaagaagggcgacacgguggugaucuacaugcccaugaucccccaggccauguacaccaugcuggcgugcgcccggaucggggccauccacagccucaucuucggcggguucgccuccaaggagcugagcucccgcaucgaccacgucaagcccaaggugguggucaccgccagcuucggcaucgagccgggccggcgcguggaguacgugccccuggucgaggaggcgcucaagaucgggcagcacaagcccgacaagauccugaucuacaaccggcccaacauggaggccgugccgcuggcccccggccgcgaccucgacugggacgaggagauggccaaggcccagucccacgacugcgugcccguccugagcgagcacccccuguacauccucuacaccagcgggacgaccggccugccgaagggggugauccggcccaccggcggcuacgcggugaugcugcacugguccaugagcuccaucuacgggcuccagcccggcgaggucuggugggccgccagcgaccugggguggguggucggccacuccuacaucugcuacgggccccugcuccacggcaacaccacggugcuguacgagggcaagccgguggggacccccgacgccggcgccuacuuccgcguccuggcggagcacgggguggccgcccucuucaccgcccccaccgcgauccgggccauccgccagcaggaccccggcgccgcccugggcaagcaguacagccugacgcgguucaagacccucuucguggccggggagcgcugcgacgucgagacccuggagugguccaagaacguguuccgggugccgguccuggaccacugguggcagaccgagacgggcagccccaucaccgcguccugcguggggcucggcaacagcaagacgcccccgcccgggcaggccggcaaguccgugcccggcuacaacgucaugauccuggacgacaacaugcagaagcugaaggcccgcugccucgggaacaucguggugaagcugccccugccgcccggcgccuucagcgggcucuggaagaaccaggaggccuucaagcaccuguacuucgagaaguuccccggcuacuacgacaccauggacgcgggguacauggacgaggagggcuaccuguacgucaugucccgcguggacgacgugaucaacgucgccggccaccggaucagcgccggggccaucgaggaguccauccucagccacggcaccguggccgacugcgcgguggucgggaaggaggacccccugaagggccacgugccgcuggcccucugcgugcugcgcaaggacaucaacgccaccgaggagcagguccuggaggagaucgugaagcacgugcggcagaacaucgggcccgucgccgcguuccgcaacgccguguucgugaagcagcugcccaagacccgguccggcaagaucccccgcagcgcccucuccgccaucgucaacggcaagccguacaagaucaccagcacgaucgaggaccccagcaucuucgggcacguggaggagaugcugaagcaggccuga

SEQ ID NO: 26270 - RNA, 1134 nt, Artificial Sequence
  derived and/or modified sequence opt1 from ACTA1__Homo_sapiens__NP_001091
augugcgacgaggacgagaccaccgcccuggugugcgacaacggcagcgggcucgucaaggccggcuucgcgggggacgacgccccgcgcgccguguuccccuccaucgugggccggccccgccaccagggggucauggugggcaugggccagaaggacagcuacgugggggacgaggcccaguccaagcggggcauccugacgcugaaguaccccaucgagcacgggaucaucaccaacugggacgacauggagaagaucuggcaccacaccuucuacaacgagcuccgcgucgcccccgaggagcacccgacccugcugacggaggcgccccucaaccccaaggccaaccgggagaagaugacccagaucauguucgagaccuucaacgugcccgccauguacguggccauccaggcgguccugagccuguacgccuccggccgcaccacggggaucgugcucgacagcggcgacggcgugacccacaacgucccgaucuacgagggguacgcccugccccacgccaucaugcggcuggaccucgccggccgcgaccugaccgacuaccugaugaagauccucaccgagcggggguacuccuucgugacgaccgcggagcgcgagaucgugcgggacaucaaggagaagcugugcuacgucgcccuggacuucgagaacgagauggccaccgccgccagcuccagcucccucgagaaguccuacgagcugcccgacggccaggugaucaccaucggcaacgagcgcuuccggugccccgagacgcuguuccagccgagcuucaucgggauggagagcgcgggcauccacgagaccaccuacaacuccaucaugaagugcgacaucgacauccgcaaggaccucuacgccaacaacgugaugagcgggggcaccacgauguaccccgggaucgccgaccggaugcagaaggagaucaccgcccuggcccccuccaccaugaagaucaagaucaucgcgcccccggagcgcaaguacagcgucuggaucggcggcuccauccuggccagccucagcaccuuccagcagauguggaucacgaagcaggaguacgacgaggccgggcccuccaucgugcaccggaagugcuucuga

SEQ ID NO: 26271 - RNA, 1134 nt, Artificial Sequence
  derived and/or modified sequence opt1 from ACTA2__Homo_sapiens__XP_011538318
augugcgaggaggaggacagcaccgcccuggugugcgacaacggcuccgggcucugcaaggccggcuucgcgggggacgacgccccgcgcgccgucuuccccagcaucgugggccggccccgccaccagggggugauggucggcaugggccagaaggacuccuacgugggggacgaggcccagagcaagcggggcauccugacccugaaguaccccaucgagcacgggaucaucacgaacugggacgacauggagaagaucuggcaccacuccuucuacaacgagcuccgcguggcccccgaggagcacccgacccugcugaccgaggcgccccucaaccccaaggccaaccgggagaagaugacccagaucauguucgagacguucaacguccccgccauguacguggccauccaggcggugcugagccuguacgccuccggccgcaccaccgggaucguccucgacagcggcgacggcgugacccacaacgugccgaucuacgagggguacgcccugccccacgccaucaugcggcuggaccucgccggccgcgaccugacggacuaccugaugaagauccucaccgagcggggguacuccuucgucaccaccgcggagcgcgagaucgugcgggacaucaaggagaagcugugcuacguggcccuggacuucgagaacgagauggccacggccgccagcuccagcucccucgagaaguccuacgagcugcccgacggccaggucaucaccaucggcaacgagcgcuuccggugccccgagacccuguuccagccgagcuucaucgggauggagagcgcgggcauccacgagaccacguacaacuccaucaugaagugcgacaucgacauccgcaaggaccucuacgccaacaacgugcugagcgggggcaccaccauguaccccgggaucgccgaccggaugcagaaggagaucaccgcccuggcccccuccacgaugaagaucaagaucaucgcgcccccggagcgcaaguacagcguguggaucggcggcagcauccucgccucccugagcaccuuccagcagauguggaucuccaagcaggaguacgacgaggccgggcccagcaucguccaccggaagugcuucuga

SEQ ID NO: 26272 - RNA, 1128 nt, Artificial Sequence
  derived and/or modified sequence opt1 from ACTB__Homo_sapiens__NP_001092
auggacgacgacaucgccgcccugguggucgacaacggcagcgggaugugcaaggccggcuucgccggggacgacgcgccccgcgccguguucccguccaucgugggccggccccgccaccagggggucauggugggcaugggccagaaggacagcuacgugggggacgaggcccaguccaagcggggcauccucacccugaaguaccccaucgagcacgggaucgucaccaacugggacgacauggagaagaucuggcaccacacguucuacaacgagcugcgcguggcccccgaggagcacccggugcuccugaccgaggcgccccugaaccccaaggccaaccgggagaagaugacccagaucauguucgagaccuucaacacgcccgccauguacgucgccauccaggccgugcucagccuguacgccuccggccgcaccaccgggaucgugauggacagcggcgacggcgucacccacacggugccgaucuacgagggguacgcccugccccacgccauccuccggcuggaccuggcgggccgcgaccucaccgacuaccugaugaagauccugaccgagcggggguacuccuucaccacgaccgccgagcgcgagaucgugcgggacaucaaggagaagcucugcuacgucgcccuggacuucgagcaggagauggccaccgccgcgagcuccagcucccuggagaaguccuacgagcuccccgacggccaggugaucaccaucggcaacgagcgcuuccggugccccgaggcccuguuccagccgagcuuccuggggauggagagcugcggcauccacgagacgaccuucaacuccaucaugaagugcgacguggacauccgcaaggaccucuacgccaacaccguccugagcgggggcaccacgauguaccccgggaucgccgaccggaugcagaaggagaucaccgcccuggcgcccuccaccaugaagaucaagaucaucgcgcccccggagcgcaaguacagcguguggaucggcggcuccauccucgccagccugagcaccuuccagcagauguggaucuccaagcaggaguacgacgagagcgggcccuccaucgugcaccggaagugcuucuga

SEQ ID NO: 26273 - RNA, 1131 nt, Artificial Sequence
  derived and/or modified sequence opt1 from ACTBL2__Homo_sapiens__NP_001017992
augaccgacaacgagcugagcgcccucguggucgacaacggcuccgggaugugcaaggccggcuucgggggcgacgacgcgccccgcgccguguuccccagcaugaucgggcggccccgccaccagggcgugauggucggcauggggcagaaggacugcuacgugggcgacgaggcccaguccaagcgcggggugcugacccugaaguaccccaucgagcacggcgucgugacgaacugggacgacauggagaagaucugguaccacaccuucuacaacgagcuccggguggcccccgacgagcacccgauccugcugaccgaggcgccccucaaccccaagaucaaccgggagaagaugacccagaucauguucgaggccuucaacacgcccgccauguacgucgccauccaggccgugcugagccuguacgcguccgggcgcaccaccggcaucgugauggacagcggcgacggggucacccacaucgugccgaucuacgagggcuacgcccucccccacgccauccugcggcuggaccucgccgggcgcgaccugacggacuaccugaugaagauccucaccgagcggggcuacaacuucaccaccacggccgagcgcgagaucgugcgggacgucaaggagaagcugugcuacguggcgcuggacuucgagcaggagauggugcgcgccgccgccuccagcucccccgagcggagcuacgagcuccccgacggccaggucaucaccaucgggaacgagcgcuuccggugcccggaggccaucuuccagcccuccuuccugggcaucgagagcuccgggauccacgagaccaccuucaacagcaucaugaagugcgacguggacauccgcaaggaccuguacgcgaacacggugcucuccggcgggagcaccauguaccccggcaucgccgaccggaugcagaaggagaucaucacccuggcccccuccaccaugaagaucaagaucaucgccccgcccgagcgcaaguacagcgucuggaucggcggguccauccuggccagccucagcacguuccagcagauguggaucuccaagcaggaguacgacgaggcgggcccgcccaucgugcaccggaagugcuucuga

SEQ ID NO: 26274 - RNA, 1134 nt, Artificial Sequence
  derived and/or modified sequence opt1 from ACTC1__Homo_sapiens__NP_005150
augugcgacgacgaggagaccaccgcccuggugugcgacaacggcagcgggcucgucaaggccggcuucgcgggggacgacgccccgcgcgccguguuccccuccaucgugggccggccccgccaccagggggucauggugggcaugggccagaaggacagcuacgugggggacgaggcccaguccaagcggggcauccugacgcugaaguaccccaucgagcacgggaucaucaccaacugggacgacauggagaagaucuggcaccacaccuucuacaacgagcuccgcgucgcccccgaggagcacccgacccugcugacggaggcgccccucaaccccaaggccaaccgggagaagaugacccagaucauguucgagaccuucaacgugcccgccauguacguggccauccaggcgguccugagccuguacgccuccggccgcaccacggggaucgugcucgacagcggcgacggcgugacccacaacgucccgaucuacgagggguacgcccugccccacgccaucaugcggcuggaccucgccggccgcgaccugaccgacuaccugaugaagauccucaccgagcggggguacuccuucgugacgaccgcggagcgcgagaucgugcgggacaucaaggagaagcugugcuacgucgcccuggacuucgagaacgagauggccaccgccgccagcuccagcucccucgagaaguccuacgagcugcccgacggccaggugaucaccaucggcaacgagcgcuuccggugccccgagacgcuguuccagccgagcuucaucgggauggagagcgcgggcauccacgagaccaccuacaacuccaucaugaagugcgacaucgacauccgcaaggaccucuacgccaacaacgugcugagcgggggcaccacgauguaccccgggaucgccgaccggaugcagaaggagaucaccgcccuggcccccuccaccaugaagaucaagaucaucgcgcccccggagcgcaaguacagcgucuggaucggcggcuccauccucgccagccugagcaccuuccagcagauguggaucuccaagcaggaguacgacgaggccgggcccagcaucgugcaccggaagugcuucuga

SEQ ID NO: 26275 - RNA, 1128 nt, Artificial Sequence
  derived and/or modified sequence opt1 from ACTG1__Homo_sapiens__NP_001605
auggaggaggagaucgccgcccuggugaucgacaacggcagcgggaugugcaaggccggcuucgccggggacgacgcgccccgcgccgucuucccguccaucgugggccggccccgccaccagggggugauggucggcaugggccagaaggacagcuacgugggggacgaggcccaguccaagcggggcauccucacccugaaguaccccaucgagcacgggaucgugaccaacugggacgacauggagaagaucuggcaccacacguucuacaacgagcugcgcgucgcccccgaggagcacccggugcuccugaccgaggcgccccugaaccccaaggccaaccgggagaagaugacccagaucauguucgagaccuucaacacgcccgccauguacguggccauccaggccguccucagccuguacgccuccggccgcaccaccgggaucgugauggacagcggcgacggcgugacccacacggucccgaucuacgagggguacgcccugccccacgccauccuccggcuggaccuggcgggccgcgaccucaccgacuaccugaugaagauccugaccgagcggggguacuccuucaccacgaccgccgagcgcgagaucgugcgggacaucaaggagaagcucugcuacguggcccuggacuucgagcaggagauggccaccgccgcgagcuccagcucccuggagaaguccuacgagcuccccgacggccaggucaucaccaucggcaacgagcgcuuccggugccccgaggcccuguuccagccgagcuuccuggggauggagagcugcggcauccacgagacgaccuucaacuccaucaugaagugcgacguggacauccgcaaggaccucuacgccaacaccgugcugagcgggggcaccacgauguaccccgggaucgccgaccggaugcagaaggagaucaccgcccuggcgcccuccaccaugaagaucaagaucaucgcgcccccggagcgcaaguacagcgucuggaucggcggcuccauccucgccagccugagcaccuuccagcagauguggaucuccaagcaggaguacgacgagagcgggcccuccaucgugcaccggaagugcuucuga

SEQ ID NO: 26276 - RNA, 1002 nt, Artificial Sequence
  derived and/or modified sequence opt1 from ACTG2__Homo_sapiens__NP_001186822
augugcgaggaggagaccaccgcccuggugugcgacaacggcagcgggcucugcaaggccggcuucgcgggggacgacgcgccccgcgccgucuucccguccaucgugggccggccccgccaccagaucuggcaccacagcuucuacaacgagcugcggguggcccccgaggagcaccccacgcugcucaccgaggccccgcugaaccccaaggccaaccgcgagaagaugacccagaucauguucgagaccuucaacguccccgccauguacguggccauccaggccgugcugucccucuacgcgagcgggcggacgaccggcaucguccuggacuccggcgacggggugacccacaacgugcccaucuacgagggcuacgcccugccgcacgccaucaugcgccucgaccuggccgggcgggaccugaccgacuaccucaugaagauccugacggagcgcggcuacagcuucgucaccaccgccgagcgggagaucgugcgcgacaucaaggagaagcugugcuacguggcgcucgacuucgagaacgagauggccaccgccgccuccagcuccagccuggagaaguccuacgagcugcccgacgggcaggucaucacgaucggcaacgagcgguuccgcugccccgagacccucuuccagcccagcuucaucggcauggaguccgccgggauccacgagaccaccuacaacagcaucaugaagugcgacaucgacauccggaaggaccuguacgcgaacaacgugcuguccggcgggacgaccauguacccgggcaucgccgaccgcaugcagaaggagaucaccgcccucgcccccagcaccaugaagaucaagaucaucgccccgcccgagcggaaguacuccguguggaucggcgggagcauccuggcgucccugagcacguuccagcagauguggaucagcaagcccgaguacgacgaggccggccccuccaucguccaccgcaagugcuucuga

SEQ ID NO: 26277 - RNA, 1290 nt, Artificial Sequence
  derived and/or modified sequence opt1 from ACTL6A__Homo_sapiens__NP_004292
augagcggcgggguguacggcggggacgaggucggcgcccugguguucgacaucggguccuacaccgugcgcgccggcuacgcgggcgaggacugccccaaggucgacuucccgaccgccaucgggauggugguggagcgggacgacggcagcacgcucauggagaucgacggggacaagggcaagcagggcgggcccaccuacuacaucgacaccaacgcccugcgcgucccccgggagaacauggaggccaucagcccccugaagaacggcaugguggaggacugggacagcuuccaggccauccucgaccacaccuacaagaugcacgugaaguccgaggcgagccugcacccgguccugauguccgaggcccccuggaacacgcgcgccaagcgggagaagcucaccgagcugauguucgagcacuacaacauccccgccuucuuccugugcaagaccgcggugcucaccgccuucgccaacgggcgcagcacgggccugauccuggacuccggggccacccacaccaccgccauccccgugcacgacggcuacguccuccagcagggcaucgugaaguccccgcuggcgggggacuucaucacgaugcagugccgggagcuguuccaggagaugaacaucgagcucgugccgcccuacaugaucgccuccaaggaggccguccgcgagggcagccccgccaacuggaagcggaaggagaagcugccccaggugacccgcuccuggcacaacuacaugugcaacugcgugauccaggacuuccaggccagcguccuccagguguccgacagcaccuacgacgagcaggucgcggcccagaugcccaccgugcacuacgaguuccccaacggguacaacugcgacuucggcgccgagcggcugaagauccccgaggggcuguucgacccguccaacgugaagggccugagcggcaacacgaugcucggggugucccacgucgugaccaccagcgucggcaugugcgacaucgacauccgccccgggcuguacggcagcgugaucguggccgggggcaacacccugauccaguccuucacggaccggcucaaccgcgagcugagccagaagaccccgcccuccaugcggcugaagcucaucgccaacaacaccaccgucgagcgccgguucagcuccuggaucggcgggagcauccuggcgucccugggcacguuccagcagauguggaucagcaagcaggaguacgaggagggcgggaagcagugcguggagcgcaagugccccuga

SEQ ID NO: 26278 - RNA, 1281 nt, Artificial Sequence
  derived and/or modified sequence opt1 from ACTL6B__Homo_sapiens__NP_057272
augagcggcgggguguacggcggggacgaggucggcgcccugguguucgacaucggguccuucagcgugcgcgccggcuacgcgggcgaggacugccccaaggccgacuucccgaccaccgucgggcuccuggccgccgaggagggcgggggccuggagcucgagggggacaaggagaagaagggcaagaucuuccacaucgacacgaacgcccugcacgugccccgggacggcgcggaggugaugagcccccugaagaacgggaugaucgaggacugggagugcuuccgcgccauccucgaccacaccuacuccaagcacgucaaguccgagcccaaccugcacccggugcugaugagcgaggcccccuggaacacccgggccaagcgcgagaagcucaccgagcugauguucgagcaguacaacauccccgcguucuuccugugcaagacggccgugcucaccgccuucgccaacggccgguccaccgggcugguccuggacagcggcgccacccacacgaccgcgauccccgugcacgacggcuacgugcuccagcaggggaucgucaaguccccgcuggccggcgacuucaucagcaugcagugccgcgagcuguuccaggagauggccaucgacaucaucccgcccuacaugaucgccgccaaggagcccgugcgggagggggcgccgcccaacuggaagaagaaggagaagcucccccagguguccaagagcuggcacaacuacaugugcaacgaggucauccaggacuuccaggccuccgugcuccaggugagcgacucccccuacgacgagcaggucgccgcccagaugcccaccgugcacuacgagaugcccaacggcuacaacaccgacuacggggccgagcgccugcggauccccgagggccuguucgaccccagcaacgugaagggccuguccgggaacacgaugcugggcgucgggcacguggugaccaccagcaucggcaugugcgacaucgacauccgcccggggcucuacggcuccgucaucgugaccggcgggaacacgcugcugcagggcuucaccgaccggcucaaccgcgagcugagccagaagaccccgcccagcaugcggcugaagcucaucgcguccaacagcaccauggagcgcaaguucucccccuggaucgggggcagcauccuggccucccuggggacguuccagcagauguggaucagcaagcaggaguacgaggagggcggcaagcagugcgucgagcggaagugccccuga

SEQ ID NO: 26279 - RNA, 1176 nt, Artificial Sequence
  derived and/or modified sequence opt1 from ACTL8__Homo_sapiens__XP_011540513
augagccugcugcccccgcgcgagucccccgccgccagcuccagcaccuccgugccgcccaccagcgcguccgccauggccgcccggacggucaucaucgaccacggcagcggguuccucaaggccggcaccgcgggguggaacgagccccagaugguguuccccaacaucgugaacuaccugcccugcaaggagaaccccggcccguccuacgcccgccggcgcgucagccucgggaucgacaucugccaccccgacaccuucuccuaccccaucgagcggggccgcauccugaacugggagggcgugcaguaccuguggagcuucgugcucgagaaccaccggcgcgagcaggaggugcccccggucaucaucaccgagacgccccugcgggagcccgccgaccgcaagaagaugcuggagauccucuucgagcugcugcacgugcccuccguccuccuggccgaccagcugcagaugagccucuacgcguccgggcugcugaccggcgugguggucgacagcggguacggccucacccgggugcagccguuccaccaggggcgcccccugcccgccuccggcaagacccuggaguucgccggccaggaccucagcgccuaccugcugaagucccucuucaaggaggacugcgaccggcgcugccuguuccagcuggagacgguggccgucacccagaugaacaagugcuacgugccccagaaccucggggaggcgcuggacuuccgggagcgccagcagagcgcccuggacgagagcaacaccuaccagcucccggacggcucccggguggagcugacccccaugcagcgcgucgcccccgagauguucuucagcccccagguguucgagcagccggggcccuccaucccccgggccaucguggagagcgucgaguccugcgagaucagccugcgcccccuccuggugucccacgugauggccugcggcggcaacacgcuguacccgggguucaccaagcgccucuuccgggagcugaugggcgaccacgucagcuccaccaaggcgaccgugugggaggggagcaaccgcaacuucuccgucuggcugggcgccagcgugguggcccaccucuccacguaccagagcgaguggaugucccgggaggaguacggggagcacaugcgcauguga

SEQ ID NO: 26280 - RNA, 1251 nt, Artificial Sequence
  derived and/or modified sequence opt1 from ACTL9__Homo_sapiens__NP_848620
auggacgccagccgccccaaguccagcgagucccagagcucccuggaggccccgcggcccggccccaaccccagcccgaacguggucaacaagccccuccagcgcgacucccccgggaugguggcggaccggcugcccccgaagaccggcgccguggucaucgacauggggaccggcacgugcaaggugggguucgccggccaggccagccccaccuacaccguggccaccauccugggcugccagcccaagaagcccgcgacguccgggcagagcggccuccagaccuucaucggggaggccgcccgcguccugccggagcugacccucgugcagccccugcgguccggcaucguggucgacugggacgccgcggagcugaucuggcgccaccuccuggagcacgaccugcggguggccacccacgaccacccccuccuguucagcgacccgcccuucucccccgccacgaaccgcgagaagcugguggaggucgccuucgagagccuccggucccccgccauguacguggcgagccaguccgugcugagcgucuacgcccacgggcgcguguccggccugguggucgacaccggccacggggugaccuacaccgugcccgucuuccagggcuacaaccuccugcacgccacggagcggcuggaccucgccgggaacaaccugaccgccuuccuggcggagaugcuccugcaggccggccugccgcucggccagcaggaccuggaccugguggagaacaucaagcaccacuacugcuacguggccagcgacuuccagaaggagcaggcccgccccgagcaggaguacaagcggacccucaagcugcccgacgggcgcaccgucacgcugggcaaggagcuguuccagugccccgagcuccuguucaacccgcccgaggugcccgggcucagccccgucggccuguccaccauggccaagcagagccugcggaagcucucccuggagaugcgcgcggaccuggcccagaacgugcuccugugcgggggcagcucccuguucaccggcuucgaggggcgguuccgcgccgagcuccugcgggcccugccggccgagacccacguggucguggcggcccagcccacgcgcaacuucagcguguggaucggcggguccauccucgccagccugcgggccuuccaguccugcuggguccugcgcgagcaguacgaggagcagggccccuacaucguguaccgcaagugcuacuga

SEQ ID NO: 26281 - RNA, 2679 nt, Artificial Sequence
  derived and/or modified sequence opt1 from ACTN1__Homo_sapiens__NP_001093
auggaccacuacgacagccagcagaccaacgacuacaugcagcccgaggaggacugggaccgcgaccugcuccuggacccggccugggagaagcagcagcggaagaccuucacggccuggugcaacucccaccuccgcaaggcgggcacccagaucgagaacaucgaggaggacuuccgggacgggcugaagcugaugcugcuccuggaggugaucagcggcgagcgccuggccaagcccgagcgggggaagaugcgcguccacaagaucuccaacgugaacaaggcccucgacuucaucgccagcaagggcgugaagcuggucuccaucggggccgaggagaucguggacggcaacgugaagaugacccugggcaugaucuggaccaucauccuccgguucgcgauccaggacaucagcgucgaggagacguccgccaaggaggggcugcugcucuggugccagcgcaagaccgcccccuacaagaacgugaacauccagaacuuccacaucagcuggaaggacggccugggguucugcgcccugauccaccggcaccgccccgagcucaucgacuacggcaagcugcggaaggacgacccgcugaccaaccucaacaccgcguucgacguggccgagaaguaccuggacauccccaagaugcuggacgccgaggacaucgucgggacggcccgccccgacgagaaggccaucaugaccuacguguccagcuucuaccacgcguucuccggcgcccagaaggccgagaccgccgccaaccggaucugcaaggugcucgcggucaaccaggagaacgagcagcugauggaggacuacgagaagcuggccagcgaccuccuggaguggauccgccggaccauccccuggcuggagaaccgcgugccggagaacacgaugcacgccaugcagcagaagcucgaggacuuccgggacuaccgccggcugcacaagccgcccaaggugcaggagaagugccagcuggagaucaacuucaacacccuccagaccaagcugcgccuguccaaccggcccgccuucaugcccagcgagggccgcauggucuccgacaucaacaacgccugggggugccucgagcaggucgagaagggcuacgaggaguggcugcugaacgagauccgccggcucgagcgccuggaccaccuggcggagaaguuccggcagaaggccagcauccacgaggccuggaccgacgggaaggaggccaugcuccgccagaaggacuacgagacggccacccuguccgagaucaaggcgcugcucaagaagcacgaggccuucgagagcgaccuggccgcccaccaggaccggguggagcagaucgcggccaucgcccaggagcugaacgagcucgacuacuacgacucccccagcgugaacgcccgcugccagaagaucugcgaccagugggacaaccugggcgcccugacccagaagcggcgcgaggcgcuggagcggaccgagaagcuccuggagacgaucgaccagcuguaccucgaguacgccaagcgcgccgcccccuucaacaacuggauggagggcgccauggaggaccugcaggacaccuucaucgugcacaccaucgaggagauccaggggcugaccacggcgcacgagcaguucaaggccacccuccccgacgccgacaaggagcggcuggccauccugggcauccacaacgaggugagcaagaucguccagaccuaccacgugaacauggccgggaccaacccguacacgaccaucacgccccaggagaucaacggcaagugggaccacgugcgccagcucgucccccggcgcgaccaggcgcugaccgaggagcacgcccggcagcagcacaacgagcgccugcggaagcaguucggggcccaggccaacgugaucggccccuggauccagaccaagauggaggagaucggccgcaucuccaucgagaugcacgggacccucgaggaccagcugagccaccuccggcaguacgagaaguccaucgucaacuacaagccgaagaucgaccagcuggagggcgaccaccagcugauccaggaggcgcugaucuucgacaacaagcacaccaacuacaccauggagcacauccgcguggggugggagcagcuccugacgaccaucgcccgcaccaucaacgagguggagaaccagauccugacccgggacgccaagggcaucagccaggagcagaugaacgaguuccgcgccuccuucaaccacuucgaccgggaccacagcgggacccucggccccgaggaguucaaggccugccugaucucccugggcuacgacaucgggaacgacccccagggcgaggcggaguucgcccgcaucaugagcaucgucgaccccaaccggcucgggguggugacguuccaggccuucaucgacuucaugucccgcgagaccgccgacaccgacaccgccgaccaggucauggcgagcuucaagauccuggccggcgacaagaacuacaucacgauggacgagcugcggcgcgagcucccgcccgaccaggccgaguacugcaucgcccggauggcccccuacaccgggcccgacuccgugccgggcgcgcuggacuacaugagcuucuccaccgcccuguacggcgagagcgaccucuga

SEQ ID NO: 26282 - RNA, 2685 nt, Artificial Sequence
  derived and/or modified sequence opt1 from ACTN2__Homo_sapiens__NP_001094
augaaccagaucgagcccggcgugcaguacaacuacguguacgacgaggacgaguacaugauccaggaggaggagugggaccgcgaccugcuccuggacccggccugggagaagcagcagcggaagaccuucaccgccuggugcaacagccaccuccgcaaggcggggacgcagaucgagaacaucgaggaggacuuccggaacggccugaagcugaugcugcuccuggaggugaucuccggggagcgccugcccaagcccgaccggggcaagaugcgcuuccacaagaucgccaacgugaacaaggcccucgacuacaucgccagcaagggggucaagcugguguccaucggcgccgaggagaucguggacggcaacgucaagaugacccuggggaugaucuggaccaucauccuccgguucgcgauccaggacaucagcguggaggagaccuccgccaaggagggccugcugcucuggugccagcgcaagacggcccccuaccggaacgugaacauccagaacuuccacaccagcuggaaggacgggcugggccugugcgcccucauccaccgccaccggccggaccugaucgacuacuccaagcugaacaaggacgaccccaucgggaacaucaaccucgcgauggagaucgccgagaagcaccuggacauccccaagaugcuggacgccgaggacaucgucaacacccccaagccggacgagcgcgccaucaugaccuacgugagcugcuucuaccacgccuucgcgggcgccgagcaggccgagacggccgccaaccggaucugcaaggugcucgcggucaaccaggagaacgagcgccugauggaggaguacgagcggcuggccuccgagcuccuggaguggauccgccggaccauccccuggcuggagaaccgcacccccgagaagaccaugcaggccaugcagaagaagcucgaggacuuccgggacuaccgccggaagcacaagcccccgaaggugcaggagaagugccagcuggagaucaacuucaacacgcugcagaccaagcuccgcaucagcaaccgccccgccuucaugcccuccgagggcaagauggugagcgacaucgccggggcguggcagcggcuggagcaggccgagaagggcuacgaggaguggcugcucaacgagauccgccggcuggagcgccuggagcaccucgccgagaaguuccggcagaaggccuccacccacgagaccugggccuacgggaaggagcagauccugcugcagaaggacuacgagagcgcgucccucacggagguccgcgcccugcugcggaagcacgaggccuucgagagcgaccucgccgcgcaccaggaccgcguggagcagaucgccgccaucgcccaggagcugaacgagcuggacuaccacgacgccgugaacgucaacgaccggugccagaagaucugcgaccagugggaccgccucggcacccugacccagaagcggcgcgaggcgcuggagcggauggagaagcugcucgagaccaucgaccagcugcaccuggaguucgccaagcgcgccgcccccuucaacaacuggauggagggcgccauggaggaccuccaggacauguucaucgugcacuccaucgaggagauccagagccugaucacggcgcacgagcaguucaaggccacccugccggaggccgacggggagcggcaguccaucauggccauccagaacgagguggagaaggucauccagagcuacaacauccgcaucagcuccagcaaccccuacuccaccgugaccauggacgagcuccggacgaagugggacaaggugaagcagcugguccccauccgcgaccagagccugcaggaggagcucgcccggcagcacgcgaacgagcgccugcgccggcaguucgccgcccaggccaacgcgaucggccccuggauccagaacaagauggaggagaucgcccgcuccagcauccagaucaccggggcccuggaggaccagaugaaccagcucaagcaguacgagcacaacaucaucaacuacaagaacaacaucgacaagcuggagggcgaccaccagcugauccaggaggcccucguguucgacaacaagcacaccaacuacaccauggagcacauccgggucgggugggagcugcugcucacgaccaucgcccgcaccaucaacgagguggagacccagauccugacgcgggacgcgaagggcaucacccaggagcagaugaacgaguuccgcgccuccuucaaccacuucgaccggcgcaagaacggccugauggaccacgaggacuuccgggccugccucaucagcaugggguacgaccugggcgaggccgaguucgcccgcaucaugacccugguggacccgaacgggcagggcaccgucacguuccaguccuucaucgacuucaugacccgggagaccgcggacaccgacaccgccgagcaggucaucgccagcuuccgcauccucgccuccgacaagcccuacauccuggccgaggagcugcggcgcgagcucccgcccgaccaggcgcaguacugcaucaagcggaugcccgccuacagcgggcccggcuccgugcccggcgcccuggacuacgccgcguucagcuccgcccuguacggggagagcgaccucuga

SEQ ID NO: 26283 - RNA, 2706 nt, Artificial Sequence
  derived and/or modified sequence opt1 from ACTN3__Homo_sapiens__NP_001095
augaugauggugaugcagcccgagggccugggggccggcgaggggcgcuucgccggcgggggcggcgggggcgaguacauggagcaggaggaggacugggaccgggaccuccugcuggacccggcgugggagaagcagcagcgcaagaccuucaccgccuggugcaacagccaccuccggaaggccgggacgcagaucgagaacaucgaggaggacuuccgcaacggccugaagcugaugcuccugcuggaggucaucuccggggagcggcucccccgccccgacaagggcaagaugcgguuccacaagaucgccaacgugaacaaggcccuggacuucaucgcgagcaagggcgugaagcuggucuccaucggggccgaggagaucguggacggcaaccucaagaugacccuggggaugaucuggaccaucauccugcgcuucgccauccaggacaucagcguggaggagaccuccgccaaggagggccuccugcuguggugccagcggaagacggcgcccuaccgcaacgucaacgugcagaacuuccacaccagcuggaaggacggccucgcccugugcgcccugauccaccggcaccgcccggaccucaucgacuacgccaagcugcggaaggacgaccccaucgggaaccugaacaccgccuucgagguggcggagaaguaccucgacauccccaagaugcuggacgccgaggacaucgucaacacccccaagccggacgagaaggccaucaugacguacguguccugcuucuaccacgccuucgccggcgcggagcaggccgagaccgccgccaaccgcaucugcaaggugcuggccgucaaccaggagaacgagaagcucauggaggaguacgagaagcuggcgagcgagcugcucgaguggauccggcgcaccgugcccuggcuggagaaccgggugggggagcccuccaugagcgccaugcagcgcaagcuggaggacuuccgggacuaccgccggcuccacaagcccccgcgcauccaggagaagugccagcuggagaucaacuucaacacccugcagacgaagcuccgccugucccaccggcccgccuucaugcccagcgagggcaagcuggucuccgacaucgccaacgccuggcgcgggcucgagcaggucgagaagggcuacgaggacuggcugcugagcgagauccggcgccuccagcggcugcagcaccuggcggagaaguuccgccagaaggccucccuccacgaggccuggacccggggcaaggaggagaugcugagccagcgcgacuacgacuccgcccugcuccaggaggugcgggcgcugcugcgccggcacgaggccuucgagagcgaccuggccgcccaccaggaccgcguggagcacaucgccgcgcucgcccaggagcugaacgagcuggacuaccacgaggccgccuccgugaacagccggugccaggccaucugcgaccagugggacaaccucgggacccugacccagaagcgccgggacgcgcuggagcgcauggagaagcuccuggagacgaucgaccggcugcagcucgaguucgcccgccgggccgcccccuucaacaacuggcuggacggcgccguggaggaccugcaggacgucuggcucgugcacagcguggaggagacccagucccugcugaccgcgcacgaccaguucaaggccacccucccggaggccgaccgcgagcgcggggccaucaugggcauccagggggagauccagaagaucugccagacguacggccugcggcccugcagcaccaaccccuacaucacccugagcccccaggacaucaacaccaagugggacaugguccgcaagcucgugccguccugcgaccagacgcugcaggaggagcuggcgcggcagcaggucaacgagcgccuccggcgccaguucgccgcccaggccaacgccaucggccccuggauccaggcgaagguggaggagguggggcggcuggccgccggccuggccgggucccucgaggagcagauggccggccugcgccagcaggagcagaacaucaucaacuacaagaccaacaucgaccggcuggagggggaccaccagcuccugcaggagagccuggucuucgacaacaagcacaccguguacuccauggagcacauccgcgugggcugggagcagcuccugaccagcaucgcgcggacgaucaacgaggucgagaaccaggugcugacccgcgacgccaagggccucucccaggagcagcugaacgaguuccgggccagcuucaaccacuucgaccgcaagcagaacgggaugauggagcccgacgacuuccgggccugccugaucuccaugggcuacgaccucggggagguggaguucgcccgcaucaugaccauggucgaccccaacgcggccggcguggugaccuuccaggccuucaucgacuucaugacgcgggagaccgccgagaccgacaccacggagcaggucguggcgagcuucaagauccuggccggcgacaagaacuacaucaccccggaggagcugcgccgggagcuccccgccaagcaggccgaguacugcauccgccggauggugcccuacaagggguccggcgcccccgcgggggcccuggacuacgucgccuucagcuccgcccuguacggcgagagcgaccucuga

SEQ ID NO: 26284 - RNA, 2736 nt, Artificial Sequence
  derived and/or modified sequence opt1 from ACTN4__Homo_sapiens__NP_004915
augguggacuaccacgccgccaaccagagcuaccaguacggccccuccagcgcggggaacggcgccgggggcgggggcuccaugggcgacuacauggcccaggaggacgacugggaccgcgaccugcuccuggacccggccugggagaagcagcagcggaagaccuucaccgccuggugcaacagccaccuccgcaaggcggggacgcagaucgagaacaucgacgaggacuuccgggacggccucaagcugaugcugcuccuggaggucaucuccggggagcgccugcccaagcccgagcggggcaagaugcgcgugcacaagaucaacaacgugaacaaggcccucgacuucaucgccagcaagggggucaagcugguguccaucggcgccgaggagaucguggacggcaacgcgaagaugacccuggggaugaucuggaccaucauccuccgguucgccauccaggacaucagcgucgaggagaccuccgccaaggagggccugcugcucuggugccagcgcaagacggcccccuacaagaacgugaacgugcagaacuuccacaucagcuggaaggacgggcuggccuucaacgcgcugauccaccggcaccgcccggagcucaucgaguacgacaagcugcggaaggacgaccccgucaccaaccugaacaacgccuucgagguggccgagaaguaccucgacauccccaagaugcuggacgccgaggacaucgugaacaccgcccgccccgacgagaaggcgaucaugaccuacgucuccagcuucuaccacgccuucuccggcgcccagaaggccgagacggccgcgaaccggaucugcaaggugcuggccgugaaccaggagaacgagcaccucauggaggacuacgagaagcuggccagcgaccugcucgaguggauccgccggaccaucccguggcuggaggaccgcgucccccagaagaccauccaggagaugcagcagaagcuggaggacuuccgggacuaccgccgggugcacaagccgcccaaggugcaggagaagugccagcucgagaucaacuucaacacccugcagacgaagcugcgccucuccaaccggcccgccuucaugcccagcgagggcaagauggucuccgacaucaacaacggguggcagcaccuggagcaggccgagaagggcuacgaggaguggcugcucaacgagauccgccgccuggagcggcuggaccaccucgcggagaaguuccgccagaaggccagcauccacgaggccuggaccgacgggaaggaggccaugcugaagcaccgggacuacgagaccgcgacccuguccgacaucaaggcccucauccgcaagcacgaggccuucgagagcgaccuggccgcccaccaggaccggguggagcagaucgcggccaucgcccaggagcugaacgagcucgacuacuacgacagccacaacgugaacacgcgcugccagaagaucugcgaccagugggacgcccugggcucccugacccacagccggcgcgaggcccucgagaagaccgagaagcagcuggaggcgaucgaccagcugcaccuggaguacgccaagcgggccgcccccuucaacaacuggauggaguccgccauggaggaccuccaggacauguucaucguccacaccaucgaggagaucgaggggcugaucagcgcgcacgaccaguucaaguccacgcugcccgacgccgaccgcgagcgggaggccauccucgccauccacaaggaggcgcagcgcaucgccgagagcaaccacaucaagcuguccggcagcaacccguacaccaccgugacgccccagaucaucaacuccaagugggagaaggugcagcagcugguccccaagcgggaccacgcccuccuggaggagcagagcaagcagcaguccaacgagcaccuccgccggcaguucgccagccaggccaacguggucggccccuggauccagaccaagauggaggagaucgggcgcaucuccaucgagaugaacggcacccuggaggaccagcugagccaccugaagcaguacgagcgguccaucguggacuacaagccgaaccucgaccugcuggagcagcagcaccagcucauccaggaggcgcugaucuucgacaacaagcacaccaacuacaccauggagcacauccgcguggggugggagcagcugcucacgaccaucgcccggaccaucaacgaggucgagaaccagauccugacccgcgacgccaagggcaucagccaggagcagaugcaggaguuccgcgccuccuucaaccacuucgacaaggaccacgggggcgcccugggccccgaggaguucaaggcgugccucaucagccugggguacgacguggagaacgaccggcagggcgaggccgaguucaaccgcaucaugucccugguggaccccaaccacagcgggcucgucacguuccaggccuucaucgacuucaugagccgggagaccaccgacaccgacacggccgaccaggugaucgccuccuucaaggugcuggcgggcgacaagaacuucaucaccgccgaggagcugcgccgggagcugcccccggaccaggccgaguacugcaucgcccgcauggcgcccuaccaggggcccgacgccguccccggcgcccuggacuacaagagcuucuccaccgcccuguacggcgagagcgaccucuga

SEQ ID NO: 26285 - RNA, 1131 nt, Artificial Sequence
  derived and/or modified sequence opt1 from ACTR1A__Homo_sapiens__NP_005727
auggagagcuacgacgugaucgccaaccagcccgucgugaucgacaacggcuccggggugaucaaggccggcuucgcgggggaccagaucccgaaguacugcuuccccaacuacgucggccgccccaagcacgugcgggugauggccggggcccuggagggcgacaucuucaucggccccaaggccgaggagcaccgcgggcuccugagcauccgguacccgauggagcacggcaucgucaaggacuggaacgacauggagcgcaucuggcaguacguguacuccaaggaccagcugcagaccuucagcgaggagcaccccgugcuccugaccgaggcgccccugaacccccggaagaaccgcgagcgggccgccgaggucuucuucgagacguucaacgugccggcccucuucaucuccaugcaggccgugcugagccuguacgcgaccgggcgcaccaccggcgucgugcucgacuccggggacggcgugacgcacgccguccccaucuacgagggcuucgccaugccccacagcaucaugcggaucgacaucgccgggcgcgacgugucccgguuccugcgccuguaccuccggaaggagggcuacgacuuccacagcuccagcgaguucgagaucgugaaggccaucaaggagcgcgcgugcuaccuguccaucaacccccagaaggacgagacccuggagaccgagaaggcccaguacuaccucccggacgggagcaccaucgagaucggccccucccgguuccgcgcccccgagcugcuguuccggcccgaccucaucggcgaggagagcgaggggauccacgagguccugguguucgccauccagaaguccgacauggaccugcgccggacccucuucagcaacaucgugcuguccggcgggagcacgcuguucaagggcuucggggaccgccuccugagcgaggucaagaagcuggccccgaaggacgugaagauccggaucuccgcgccccaggagcgccucuacagcaccuggaucggcggcuccauccuggccagccuggacaccuucaagaagauguggguguccaagaaggaguacgaggaggacggggcccgcagcauccaccggaagacguucuga

SEQ ID NO: 26286 - RNA, 1131 nt, Artificial Sequence
  derived and/or modified sequence opt1 from ACTR1B__Homo_sapiens__NP_005726
auggagagcuacgacaucaucgccaaccagcccguggucaucgacaacggcuccggggugaucaaggccggcuucgcgggggaccagaucccgaaguacugcuuccccaacuacgugggccgccccaagcacaugcgggucauggccggggcccuggagggcgaccucuucaucggccccaaggccgaggagcaccgcgggcugcugaccauccgguacccgauggagcacggcguggugcgcgacuggaacgacauggagcggaucuggcaguacgucuacagcaaggaccagcuccagaccuucuccgaggagcaccccgugcugcugacggaggcgccccucaaccccagcaagaaccgcgagaaggccgccgagguguucuucgagaccuucaacgucccggcccuguucaucuccaugcaggccgugcugagccucuacgcgaccgggcggaccacgggcgugguccuggacuccggggacggcgugacccacgccgugcccaucuacgagggcuucgccaugccccacagcaucaugcgcgucgacaucgccgggcgggacgugucccgcuaccugcggcuccugcugcgcaaggagggcguggacuuccacaccagcgccgaguucgaggucgugcggaccaucaaggagcgcgcgugcuaccucuccaucaacccccagaaggacgaggcccuggagacggagaaggugcaguacacccugccggacgggagcacccucgacgucggccccgcccgguuccgcgcccccgagcugcuguuccagcccgaccucgugggcgacgaguccgaggggcugcacgagguggucgccuucgcgauccacaagagcgacauggaccugcggcgcacccucuucgccaacaucgugcuguccggcgggagcacgcuguucaagggcuucggggaccggcuccuguccgaggucaagaagcuggccccgaaggacaucaagaucaagaucagcgcgccccaggagcgccucuacuccaccuggaucggcggcagcauccuggccagccuggacaccuucaagaagauguggguguccaagaaggaguacgaggaggacgggagccgggccauccaccgcaagaccuucuga

SEQ ID NO: 26287 - RNA, 1200 nt, Artificial Sequence
  derived and/or modified sequence opt1 from ACTR2__Homo_sapiens__NP_001005386
auggacagccagggccgcaagguggucgugugcgacaacgggaccggcuucgugaagugcggguacgccggcuccaacuuccccgagcacaucuuccccgcccuggucgggcggcccaucauccgcagcaccacgaaggugggcaacaucgagaucaagaacaacaagaagauggaccucauggugggcgacgaggcguccgagcugcggagcaugcuggaggucaacuaccccauggagaacgggaucgugcgcaacugggacgacaugaagcaccucugggacuacaccuucggccccgagaagcugaacaucgacacccggaacugcaagauccugcucaccgagccgcccaugaaccccacgaagaaccgcgagaagaucguggaggucauguucgagaccuaccaguucuccgggguguacguggccauccaggccguccugacccuguacgcccagggccuccugaccggggugguggucgacagcggcgacggcgugacgcacaucugccccguguacgagggguucucccugccgcaccucacccggcgccuggacaucgccggccgggacaucacccgcuaccugaucaagcuccugcugcuccggggguacgcguucaaccacagcgccgacuucgagaccguccgcaugaucaaggagaagcugugcuacgugggcuacaacaucgagcaggagcagaagcuggcccucgagacgaccgugcuggucgaguccuacacccugcccgacggccggaucaucaaggucgggggcgagcgcuucgaggcccccgaggcgcuguuccagccccaccugaucaacguggagggggugggcguggccgagcuccucuucaacaccauccaggccgccgacaucgacacgcggagcgaguucuacaagcacaucguccuguccgggggcagcaccauguacccgggccugcccucccgccucgagcgggagcugaagcagcuguaccucgagcgcgugcugaagggggacguggagaagcugagcaaguucaagauccggaucgaggacccgccccgccggaagcacauggucuuccucggcggggccgugcuggcggacaucaugaaggacaaggacaacuucuggaugacccgccaggaguaccaggagaagggcgugcgcguccuggagaagcucggggugaccgugcgguga

SEQ ID NO: 26288 - RNA, 1047 nt, Artificial Sequence
  derived and/or modified sequence opt1 from ACTR3B__Homo_sapiens__NP_001035225
auggccggcagccugcccccgugcguggucgacugcgggaccggcuacaccaagcucggguacgccggcaacacggagccccaguucaucauccccuccugcaucgcgauccgcgagagcgccaaggugguggaccaggcccagcggcgcguccugcgcgggguggacgaccuggacuucuucaucggcgacgaggccaucgacaagcccaccuacgccaccaaguggccgauccggcacggcaucaucgaggacugggaccucauggagcgguucauggagcaggucguguucaaguaccugcgcgcggagcccgaggaccacuacuuccugaugaccgagccgccccucaacacgcccgagaaccgggaguaccuggccgagaucauguucgaguccuucaacgugcccgggcuguacaucgccgugcaggccguccucgcgcuggccgccagcuggaccucccgccaggugggcgagcggacccugaccgggaucgugaucgacagcggcgacggggucacgcacgugauccccguggccgagggcuacgucaucggcuccugcaucaagcacauccccaucgccgggcgcgacaucaccuacuucauccagcagcuccugcgggagcgcgaggugggcaucccgcccgagcagagccuggagaccgcgaaggccaucaaggagaaguacugcuacaucugccccgacaucgugaaggaguucgccaaguacgacgucgacccccggaaguggaucaagcaguacaccgggaucaacgccaucaaccagaagaaguucgugaucgacgugggcuacgagcgcuuccucggcccggagaucuucuuccaccccgaguucgccaaccccgacuucauggaguccaucagcgacgucguggacgaggugauccagaacugccccaucgacguccggcgcccgcuguacaagcccgaguucuuccaggugugccacacgaagaaggacuacgaggaguacgggcccuccaucugccggcacaaccccgucuucggcgugaugagcuga

SEQ ID NO: 26289 - RNA, 1104 nt, Artificial Sequence
  derived and/or modified sequence opt1 from ACTR3__Homo_sapiens__NP_001264069
augaagggcguggacgaccuggacuucuucaucggggacgaggccaucgagaagcccaccuacgccaccaaguggccgauccgccacggcaucgucgaggacugggaccucauggagcgguucauggagcaggucaucuucaaguaccugcgcgcggagcccgaggaccacuacuuccugcucacggagccgccccugaacacccccgagaaccgggaguacaccgccgagaucauguucgagagcuucaacgugcccgggcuguacaucgccgugcaggccgugcucgcccuggcggccuccuggaccagccgccaggugggcgagcggacgcugaccgggaccgucaucgacuccggcgacggcgugacccacgugauccccgucgccgagggguacgugaucggcagcugcaucaagcacauccccaucgccgggcgcgacaucacguacuucauccagcagcuccugcgggaccgcgaggugggcaucccgcccgagcagucccuggagaccgcgaaggccgucaaggagcgguacagcuacgugugccccgaccucgugaaggaguucaacaaguacgacaccgacggguccaaguggaucaagcaguacaccggcaucaacgccaucagcaagaaggaguucuccaucgacgucggcuacgagcgcuuccuggggcccgagaucuucuuccacccggaguucgccaaccccgacuucacgcagcccaucagcgaggugguggacgaggucauccagaacugccccaucgacgugcggcgcccgcuguacaagaacaucgugcucuccggcgggagcaccauguuccgggacuucggccgccggcugcagcgcgaccugaagcggaccgucgacgcccgccucaagcuguccgaggagcugagcggcgggcggcucaagcccaagcccaucgacguccaggugaucacccaccacaugcagcgcuacgcggugugguucggcggguccaugcuggccagcacgcccgaguucuaccaggugugccacaccaagaaggacuacgaggagaucggcccguccaucugccggcacaaccccgucuucggggugaugagcuga

SEQ ID NO: 26290 - RNA, 1824 nt, Artificial Sequence
  derived and/or modified sequence opt1 from ACTR5__Homo_sapiens__NP_079131
auggccgccaacguguuccccuuccgcgacgcgcgggccgccccggaccccguccuggaggccggccccguggcccacgggccccucccggugccccugguccuggacaacggcagcuuccaggugcgcgcggggugggccugccccggccaggaccccgggccggagccccggcuccaguuccgcgccgugugcgcccggggccgcggcggggcgcggggcgccuccgggccccaggucggcaacgcccuggggagccuggagccccuccgcuggaugcugcgguccccguucgaccgcaacgugcccgugaaccuggagcuccaggagcugcugcucgacuacagcuuccagcaccugggcgucuccagccagggcugcguggaccaccccaucgugcugaccgaggccgucugcaacccccucuacucccggcagaugaugagcgagcugcuguucgagugcuacgggaucccgaagguggccuacggcaucgacucccucuucagcuucuaccacaacaagcccaagaacuccaugugcagcgggcugaucaucuccagcggcuaccagugcacccacgugcugcccauccucgagggccgccuggacgcgaagaacugcaagcggaucaaccucgggggcucccaggccgccggguaccugcagcgccugcugcagcucaaguaccccggccaccuggccgccaucacgcugagccggauggaggagauccuccacgagcacuccuacaucgcggaggacuacgucgaggagcugcacaaguggcgcugcccggacuacuacgagaacaacgugcacaagaugcagcugcccuucagcuccaagcuccuggggagcacccugaccagcgaggagaagcaggagcggcgccagcagcagcuccggcgccugcaggagcugaacgcccggcgccgcgaggagaagcuccagcuggaccaggagcggcuggaccgccuccuguacgugcaggagcugcucgaggacggccagauggaccaguuccacaaggcccugaucgagcugaacauggacucccccgaggagcuccagagcuacauccagaagcuguccaucgccgucgagcaggccaagcagaagauccugcaggcggaggugaaccuggagguggacgucguggacagcaagcccgagaccccggaccucgagcagcuggagcccucccuggaggacguggagagcaugaacgacuucgacccccucuucuccgaggagacgcccggcgucgagaagccggugaccaccguccagcccguguucaaccuggccgccuaccaccagcuguucguggggaccgagcggauccgcgcccccgagaucaucuuccagccgagccucaucggcgaggagcaggccgggaucgcggagacgcugcaguacauccuggaccgguaccccaaggacauccaggagaugcucguccagaacguguuccugaccggcgggaacaccauguaccccggcaugaaggcccgcauggagaaggagcugcucgagaugcggcccuuccgcuccagcuuccaggugcagcuggccuccaacccgguccuggacgccugguacggcgcgcgggacugggcccucaaccaccuggacgacaacgagguguggaucacccgcaaggaguacgaggagaagggcggggaguaccugaaggagcacugcgccagcaacaucuacgugcccauccggcuccccaagcaggccucccgcagcuccgacgcccaggcgagcuccaaggggagcgccgccggcgggggcggcgccggggagcaggccuga

SEQ ID NO: 26291 - RNA, 1131 nt, Artificial Sequence
  derived and/or modified sequence opt1 from ACTRT1__Homo_sapiens__NP_612146
auguucaacccccacgcccuggacgugccggccgucaucuucgacaacggcagcgggcucugcaaggcgggccuguccggggagaucggcccccgccacgugaucagcuccgugcuggggcacugcaaguucaacgucccccucgcccggcugaaccagaaguacuucgugggccaggaggcccuguacaaguacgaggcccuccaccuccacuaccccaucgagcgcggccuggugaccgggugggacgacauggagaagcuguggaagcaccuguucgagcgggagcugggcgucaagccgagccagcagcccgugcucaugaccgagcccucccugaacccccgcgagauccgggagaagcuggccgagaugauguucgagacguucagcgugccgggguucuaccucuccaaccacgcggucgccgcccuguacgccagcgcgugcgugaccggccugguggucgacuccggggacggcgugaccugcaccgugcccaucuucgagggcuacagccucccccacgccgucacgaagcugugcauggccgggcgcgacaucaccgagcaccugacccggcuccuguucgccuccggcuucaacuuccccugcauccugaacaaggccguggugaacaacaucaaggagaagcucugcuacaucgcgcuggagccggagaaggagcugcgcaagagccgcggggagguccucggcgccuaccggcugcccgacggccacgugauccacuucggggacgagcuguaccaggugcccgagguccucuucgcccccgaccagcugggcauccacuccccggggcugagcaagaugguguccagcuccaucaugaagugcgacaccgacauccagaacaagcucuacgccgacaucgugcugagcggcgggacgacccugcuccccggccuggaggagcggcugaugaaggaggucgagcagcucgccuccaagggcacccccaucaagaucaccgcgagccccgaccgcugcuucagcgccuggaucggggccuccaucaugacgagcauguccagcuucaagcagaugugggugaccuccgccgacuucaaggaguacggcaccagcgucgugcagcggcgcugcuucuga

SEQ ID NO: 26292 - RNA, 1518 nt, Artificial Sequence
  derived and/or modified sequence opt1 from ACVR1B__Homo_sapiens__NP_004293
auggccgagagcgccggcgcguccagcuucuucccccuggugguccuccugcuggccggguccggcgggagcggcccgcgcggggugcaggcccuccugugcgccugcaccuccugccugcaggccaacuacacgugcgagaccgacggcgcgugcauggugagcaucuucaaccucgacggcauggagcaccacguccggaccugcauccccaagguggagcuggugcccgccgggaagcccuucuacugccuguccagcgaggaccuccgcaacacccacugcugcuacaccgacuacugcaaccggaucgaccugcgcgucccguccggccaccugaaggagcccgagcaccccagcaugugggggcccguggagcucgugggcaucaucgccgggccggucuuccugcuguuccucaucaucaucaucguguuccuggugaucaacuaccaccagcgggucuaccacaaccgccagcggcuggacauggaggaccccuccugcgagaugugccucagcaaggacaagacgcugcaggaccugguguacgaccucuccaccagcggcuccggcagcgggcugccccuguucgugcagcgcaccgucgcccggaccaucgugcuccaggagaucaucggcaaggggcgcuucggcgagguguggcggggccgcuggcgcgggggcgacgucgcggugaagaucuucuccagccgggaggagcgguccugguuccgcgaggccgagaucuaccagacggugaugcugcggcacgagaacauccugggguucaucgccgccgacaacaaggacaacggcaccuggacccagcucuggcuggucagcgacuaccacgagcacgggagccuguucgacuaccucaaccgcuacaccgugacgaucgagggcaugaucaagcuggcccuguccgcggccagcggccucgcccaccuccacauggagaucguggggacccagggcaagcccgggaucgcccaccgggaccugaaguccaagaacauccuggucaagaagaacggcaugugcgccaucgcggaccuggggcuggccgugcgccacgacgccgucaccgacaccaucgacaucgccccgaaccagcgggugggcacgaagcgcuacauggcccccgaggugcucgacgagaccaucaacaugaagcacuucgacagcuucaagugcgcggacaucuacgcccugggccuggucuacugggagaucgcccgccggugcaacuccgggggcgugcacgaggaguaccagcuccccuacuacgaccuggugcccagcgacccguccaucgaggagaugcgcaaggucgugugcgaccagaagcugcggcccaacauccccaacugguggcagagcuacgaggcccuccgcgugauggggaagaugaugcgggagugcugguacgccaacggcgcggcccgccugaccgcccugcggaucaagaagacccucucccagcugagcguccaggaggacgugaagaucuga

SEQ ID NO: 26293 - RNA, 1332 nt, Artificial Sequence
  derived and/or modified sequence opt1 from ACVR1C__Homo_sapiens__NP_001104501
augcugaccaacggcaaggagcaggucaucaagagcugcgugucccuccccgagcugaacgcccagguguucugccacagcuccaacaacgugaccaagacggagugcugcuucaccgacuucugcaacaacaucacccugcaccucccgaccgccagccccaacgcgcccaagcuggggcccauggagcuggccaucaucaucacggucccggugugccuccuguccaucgccgccaugcugaccgugugggccugccagggccgccagugcagcuaccggaagaagaagcgccccaacgucgaggagccccucuccgagugcaaccuggugaacgcggggaagacccugaaggaccucaucuacgacgugaccgccagcggcuccgggagcggccugccccugcucguccagcggacgaucgcccgcaccaucgugcugcaggagaucgugggcaaggggcgguucggcgaggucuggcacgggcgcuggugcggcgaggacguggccgugaagaucuucuccagccgggacgagcgcuccugguuccgggaggcggagaucuaccagaccgucaugcugcgccacgagaacauccucggguucaucgccgccgacaacaaggacaacggcaccuggacgcagcuguggcuggugagcgaguaccacgagcagggcucccucuacgacuaccugaaccggaacaucgugaccgucgccgggaugaucaagcuggcccucagcaucgcguccggccuggcccaccuccacauggagaucguggggacccagggcaagccggccaucgcccaccgcgacaucaagagcaagaacauccuggugaagaagugcgagaccugcgccaucgcggaccugggccuggccgucaagcacgacuccauccucaacacgaucgacaucccccagaaccccaagguggggaccaagcgguacauggcccccgagaugcuggacgacaccaugaacgugaacaucuucgagagcuucaagcgcgccgacaucuacagcgucggccugguguacugggagaucgcccggcgcugcuccgucgggggcaucguggaggaguaccagcucccguacuacgacauggugcccagcgaccccuccaucgaggagaugcggaaggucgugugcgaccagaaguuccgccccagcaucccgaaccaguggcaguccugcgaggcgcugcgggugauggggcgcaucaugcgggagugcugguacgccaacggcgccgcccgccugaccgcccuccgcaucaagaagacgaucagccagcugugcgucaaggaggacugcaaggcguga

SEQ ID NO: 26294 - RNA, 1530 nt, Artificial Sequence
  derived and/or modified sequence opt1 from ACVR1__Homo_sapiens__NP_001096
augguggacggcgucaugauccugcccgugcucaucaugaucgcccugccgagccccuccauggaggacgagaagcccaaggugaaccccaagcuguacaugugcgucugcgaggggcucagcugcggcaacgaggaccacugcgaggggcagcagugcuucuccagccuguccaucaacgacggcuuccacguguaccagaaggggugcuuccagguguacgagcagggcaagaugaccugcaagaccccgcccagccccggccaggccgucgagugcugccagggggacuggugcaaccgcaacaucacggcgcagcugcccaccaagggcaaguccuucccggggacccagaacuuccaccucgaggugggccugaucauccugagcguggucuucgccgugugccuccuggccugccugcucgggguggcccugcggaaguucaagcgccggaaccaggagcgccugaacccccgggacgucgaguacggcaccaucgagggccucaucacgaccaacgugggggacuccacccuggccgaccugcucgaccacagcugcaccuccggcagcggguccggccugcccuuccuggugcagcgcacggucgcgcggcagaucacccuccuggagugcgugggcaaggggcgcuacggcgagguguggcgggggagcuggcagggcgagaacgucgccgugaagaucuucuccagccgcgacgagaaguccugguuccgggagaccgagcuguacaacaccgugaugcuccgccacgagaacauccugggguucaucgccagcgacaugacgucccggcacagcagcacccagcuguggcucaucacccacuaccacgagaugggcucccuguacgacuaccugcagcucaccacgcuggacaccgucagcugccugcgcaucgugcucuccaucgccagcggccuggcgcaccuccacaucgagaucuucgggacccagggcaagcccgccaucgcccaccgggaccugaaguccaagaacauccuggugaagaagaacgggcagugcugcaucgccgaccugggccucgccgucaugcacagccaguccaccaaccagcuggacguggggaacaacccgcgcgucggcacgaagcgguacauggcgcccgaggugcuggacgagaccauccagguggacugcuucgacagcuacaagcgcgucgacaucugggccuucggccucgugcugugggagguggcccggcgcauggucuccaacgggaucguggaggacuacaagccgcccuucuacgacgugguccccaacgaccccagcuucgaggacaugcggaagguggugugcgucgaccagcagcgccccaacauccccaaccgcugguucuccgacccgacccugaccagccucgccaagcugaugaaggagugcugguaccagaaccccuccgcccggcugacggcgcuccgcaucaagaagacccugaccaagaucgacaacagccuggacaagcugaagaccgacugcuga

SEQ ID NO: 26295 - RNA, 1542 nt, Artificial Sequence
  derived and/or modified sequence opt1 from ACVR2A__Homo_sapiens__NP_001265508
augggcgccgccgcgaagcuggccuucgccguguuccucaucagcugcuccagcggggccauccugggccgcuccgagacccaggagugccuguucuucaacgccaacugggagaaggaccggaccaaccagacgggggucgagcccugcuacggcgacaaggacaagcgccggcacugcuucgcgaccuggaagaacaucagcggguccaucgagaucgugaagcagggcugcuggcucgacgacaucaacugcuacgaccgcaccgacugcguggagaagaaggacagcccggaggucuacuucugcugcugcgagggcaacaugugcaacgagaaguucuccuacuuccccgagauggaggugacccagcccacgagcaaccccgugaccccgaagccgcccuacuacaacauccugcuguacucccucgucccccugaugcugaucgccgggaucgugaucugcgccuucuggguguaccggcaccacaagauggccuacccgcccguccucgugcccacccaggaccccggcccgccgccgcccagcccccugcuggggcucaagccccugcagcugcucgaggugaaggcgcgcggccgguucgggugcgucuggaaggcccagcugcugaacgaguacguggccgugaagaucuuccccauccaggacaagcaguccuggcagaacgaguacgaggucuacagccuccccggcaugaagcacgagaacauccugcaguucaucggcgccgagaagcgcgggaccuccguggacguggaccuguggcucaucacggccuuccacgagaagggcagccuguccgacuuccugaaggcgaacgucgugagcuggaacgagcucugccacaucgccgagaccauggcccgggggcuggccuaccugcacgaggacauccccggccucaaggacggccacaagcccgccaucucccaccgcgacaucaagagcaagaacgugcugcugaagaacaaccucaccgcgugcaucgccgacuucgggcuggcccugaaguucgaggccggcaaguccgccggggacacccacggccaggucgggacgcggcgcuacauggcgcccgaggugcucgagggcgccaucaacuuccagcgggacgccuuccugcgcaucgacauguacgccaugggccuggugcucugggagcuggccagccggugcaccgcggccgacgggcccgucgacgaguacaugcugcccuucgaggaggagaucggccagcaccccagccucgaggacaugcaggagguggucgugcacaagaagaagcgccccgugcugcgggacuacuggcagaagcacgccgggauggccaugcugugcgagaccaucgaggagugcugggaccacgacgcggaggcccgccucuccgccggcugcgucggggagcggaucacccagaugcagcgccugacgaacaucaucaccaccgaggacaucgugaccguggucacgauggugaccaacguggacuucccgcccaaggagagcucccuguga

SEQ ID NO: 26296 - RNA, 1539 nt, Artificial Sequence
  derived and/or modified sequence opt1 from ACVR2B__Homo_sapiens__NP_001097
augaccgcccccuggguggcccuggcgcuccuguggggcagccugugcgccggguccggccgcggggaggccgagacccgggagugcaucuacuacaacgccaacugggagcucgagcgcacgaaccagagcggccuggagcggugcgagggggagcaggacaagcgccugcacugcuacgccuccuggcggaacagcuccggcaccaucgagcucgucaagaagggcugcuggcuggacgacuucaacugcuacgaccgccaggagugcguggcgaccgaggagaacccccagguguacuucugcugcugcgaggggaacuucugcaacgagcgguucacccaccuccccgaggccggcgggcccgaggucacguacgagcccccgcccaccgcccccacccuccugaccgugcuggccuacagccuccugcccaucggcgggcugucccucaucgugcugcuggcguucuggauguaccgccaccggaagccgcccuacggccacgucgacauccacgaggaccccgggcccccgccgcccagcccccucgugggccugaagccgcugcagcuccuggagaucaaggcccgcggccgguucgggugcguguggaaggcccagcugaugaacgacuucgucgccgugaagaucuucccccuccaggacaagcaguccuggcagagcgagcgcgagaucuucuccacgcccggcaugaagcacgagaaccugcugcaguucaucgccgcggagaagcggggcagcaaccucgagguggagcuguggcugaucaccgccuuccacgacaaggggucccucaccgacuaccugaagggcaacaucaucaccuggaacgagcugugccacgucgccgagacgaugagccgcgggcucuccuaccugcacgaggacgugcccuggugccggggcgaggggcacaagccgagcaucgcccaccgcgacuucaaguccaagaacgugcugcucaagagcgaccugaccgccguccuggcggacuucggccucgccgugcgguucgagcccggcaagccgcccggggacacccacggccagguggggacccgccgguacauggcccccgagguccuggagggcgccaucaacuuccagcgcgacgccuuccugcggaucgacauguacgcgauggggcucgugcugugggagcuggugucccgcugcaaggccgccgacggccccgucgacgaguacaugcuccccuucgaggaggagaucggccagcaccccagccuggaggagcugcaggagguggugguccacaagaagaugcgcccgacgaucaaggaccacuggcucaagcaccccgggcuggcccagcugugcgugaccaucgaggagugcugggaccacgacgccgaggcgcggcugagcgccggcugcgucgaggagcgcgugucccucauccggcgcagcgugaacgggaccaccuccgacugccuggucagccuggugacguccgugaccaacgucgaccugcccccgaaggagagcuccaucuga

SEQ ID NO: 26297 - RNA, 1512 nt, Artificial Sequence
  derived and/or modified sequence opt1 from ACVRL1__Homo_sapiens__NP_001070869
augacccugggcagcccccgcaaggggcuccugaugcugcucauggcccuggugacccagggcgacccggucaagcccucccgggggccccuggugacgugcacgugcgagagcccccacugcaagggcccgaccugccgcggggccuggugcaccgugguccucgugcgggaggagggccgccacccccaggagcaccggggcugcgggaaccugcaccgcgagcugugccggggccgccccaccgaguucgugaaccacuacugcugcgacucccaccucugcaaccacaacgucagccuggugcuggaggcgacccagcccccguccgagcagcccgggaccgacggccagcucgcccugauccuggggcccgugcucgcccugcuggcccucgucgcccugggcgugcugggccucuggcacgugcggcgccggcaggagaagcagcgcgggcugcacagcgagcugggcgaguccagccucauccugaaggcguccgagcagggggacagcaugcugggcgaccuccuggacuccgacugcaccacgggcagcggguccggccugcccuuccucguccagcggaccguggcccgccagguggcccuggucgagugcguggggaagggccgguacggggagguguggcgcggccuguggcacggcgagagcgucgccgugaagaucuucuccagccgggacgagcaguccugguuccgcgagaccgagaucuacaacaccgugcuccugcggcacgacaacauccugggguucaucgcgagcgacaugacgucccgcaacagcagcacccagcucuggcugaucacccacuaccacgagcacggcucccuguacgacuuccuccagcggcagacccuggagccgcaccuggcccuccgccuggccgucagcgccgccugcgggcuggcgcaccuccacguggagaucuucggcacgcaggggaagcccgccaucgcccaccgcgacuucaagucccggaacgugcuggucaagagcaaccugcagugcugcaucgccgaccucggccuggccgugaugcacucccagggcagcgacuaccuggacaucgggaacaacccccgcgucggcaccaagcgguacauggcgcccgaggugcuggacgagcagauccgcaccgacugcuucgaguccuacaaguggaccgacaucugggccuucgggcucgugcugugggagaucgcccggcgcacgaucgucaacggcaucguggaggacuaccggccgcccuucuacgacgugguccccaacgaccccagcuucgaggacaugaagaagguggugugcgucgaccagcagaccccgaccauccccaaccgccuggccgccgaccccgugcucuccgggcuggcgcagaugaugcgggagugcugguaccccaacccgagcgcccgccugaccgcccuccggaucaagaagacgcugcagaagaucuccaacagccccgagaagcccaaggugauccaguga

SEQ ID NO: 26298 - RNA, 1227 nt, Artificial Sequence
  derived and/or modified sequence opt1 from ACY1__Homo_sapiens__NP_001185824
augaccagcaagggccccgaggaggagcacccguccgugacccuguuccgccaguaccuccggauccgcacgguccagcccaagcccgacuacggggccgccguggcguucuucgaggagaccgcccggcagcugggccuggggugccagaagguggaggucgcccccggcuacguggugaccguccucaccuggccggggacgaaccccacccugagcuccauccugcucaacagccacaccgacguggugcccgucuucaaggagcacuggucccacgaccccuucgaggccuucaaggacagcgagggcuacaucuacgcccgcggcgcgcaggacaugaagugcguguccauccaguaccuggaggccgugcggcgccugaaggucgaggggcaccgguucccgcgcaccauccacaugacguucgugcccgacgaggaggugggcgggcaccagggcauggagcuguucguccagcggcccgaguuccacgcccuccgcgccggguucgcgcuggacgagggcaucgccaaccccaccgacgccuucaccguguucuacagcgagcgguccccguggugggugcgcgucaccagcacgggccggcccgggcacgccucccgcuucauggaggacaccgccgcggagaagcuccacaagguggugaacagcauccuggccuuccgggagaaggaguggcagcgccugcaguccaacccccaccucaaggagggcagcgucaccuccgugaaccugaccaagcuggagggcgggguggccuacaacgucauccccgccacgaugagcgccuccuucgacuuccggguggcgccggacgucgacuucaaggccuucgaggagcagcuccagagcuggugccaggccgccggcgagggggugacccuggaguucgcccagaaguggaugcacccccaggugacccccaccgacgacuccaaccccuggugggcggccuucagccgcgucugcaaggacaugaaccugacgcucgagccggagaucaugcccgccgccaccgacaaccgguacauccgcgccgugggcgugcccgcgcugggguucagccccaugaaccggaccccgguccugcuccacgaccacgacgagcgccugcacgaggccguguuccugcgcggcguggacaucuacacccggcuccugcccgcccuggccuccguccccgcgcuccccagcgacuccuga

SEQ ID NO: 26299 - RNA, 960 nt, Artificial Sequence
  derived and/or modified sequence opt1 from ACY3__Homo_sapiens__NP_542389
augugcagccugcccgugccgcgcgagccccuccggcgcgucgccgugaccggcgggacccacggcaacgagauguccgggguguaccuggcccggcacuggcugcacgcgcccgccgagcuccagcgcgccagcuucuccgccguccccgugcuggccaacccggcggccacgagcggcugccggcgcuacguggaccacgaccugaaccggaccuucaccuccagcuuccucaacucccgccccacccccgacgaccccuacgaggucacgcgggcccgcgagcugaaccagcugcucgggccgaaggccagcggccaggcguucgacuucgugcuggaccugcacaacaccaccgccaacauggggaccugccucaucgccaaguccagccacgagguguucgccaugcaccugugccggcaccuccagcugcaguaccccgagcuguccugccaggucuuccuguaccagcgcagcggcgaggaguccuacaaccucgacagcguggccaagaacggccuggggcuggagcucggcccccagccccagggggugcugcgggcggacaucuucucccgcaugcggacgcuggucgccaccgugcucgacuucaucgagcuguucaaccagggcaccgccuucccggccuucgagauggaggccuaccgccccgugggcgucguggacuucccccggaccgaggcggggcaccuggccggcacggugcacccccagcuccaggaccgcgacuuccagccgcugcagcccggggcccccaucuuccagauguucagcggcgaggaccugcucuacgagggcgaguccaccgucuaccccguguucaucaacgaggccgccuacuacgagaaggggguggcguucguccagaccgagaaguucaccuucacggugccggccaugcccgcccugacccccgcccccagcccggccuccuga

SEQ ID NO: 26300 - RNA, 300 nt, Artificial Sequence
  derived and/or modified sequence opt1 from ACYP2__Homo_sapiens__NP_612457
augagcaccgcccagucccucaagagcguggacuacgaggucuucggccgcgugcagggggugugcuuccggauguacaccgaggacgaggcccgcaagaucggcgucguggggugggugaagaacacguccaagggcaccgucaccggccaggugcaggggcccgaggacaaggugaacagcaugaaguccuggcugagcaaggucggcuccccgagcucccggaucgaccgcaccaacuucagcaacgagaagacgaucuccaagcuggaguacagcaacuucuccauccgguacuga

SEQ ID NO: 26301 - RNA, 1698 nt, Artificial Sequence
  derived and/or modified sequence opt1 from ADAD1__Homo_sapiens__NP_001152757
auggccagcaacaaccacugguuccaguccagccaggugcccuccuucgcccagaugcugaagaagaaccucccgguccagcccgcgaccaagaccaucacgacccccaccggcuggagcuccgagagcuacgggcuguccaagauggccagcaaggugacccaggugacgggcaacuuccccgagccgcugcucuccaagaaccugagcuccaucagcaaccccguccugccgcccaagaagauccccaaggaguucaucaugaaguacaagcgcggggagaucaaccccguguccgcccuccaccaguucgcccagaugcagcgggugcagcuggaccugaaggagaccgucaccaccggcaacgugauggggcccuacuucgccuucugcgcgguggucgacggcauccaguacaagacgggccucgggcagaacaagaaggagagccgcuccaacgccgccaagcuggcccuggacgagcuccugcagcuggacgagcccgagccgcggauccucgagaccagcggcccgccgcccuuccccgcggagcccguggugcuguccgagcuggccuacgucagcaaggugcacuacgaggggcgccacauccaguacgccaagaucucccagaucgugaaggagcgguucaaccagcucaucagcaaccgcagcgaguaccugaaguacuccagcucccuggccgccuucaucaucgagcgggcgggccagcacgaggucguggccaucgggaccggcgaguacaacuacagccaggacaucaagcccgacggccgcgugcuccacgacacccacgccgucgugacggcccggcgcucccugcugagcaagaaccccgccaugauggagaaguccaucuucugcaccgagcccaccagcaaccuccugacccugaagcagaacaucaacaucugccucuacaugaaccagcugcccaagggguccgcgcagaucaagagccagcugcggcucaacccccacuccaucagcgccuucgaggccaacgaggagcugugccugcacguggccgucgagggcaagaucuaccucacgguguacugccccaaggacggggugaaccgcaucuccagcauguccagcuccgacaagcugacccggugggagguccugggcgugcagggcgcccuccugagccacuucauccagccggucuacaucuccagcauccugaucggggacggcaacugcagcgacacccgcgggcucgagaucgcgaucaagcagcggguggacgacgcccugaccuccaagcugcccauguucuaccucgugaaccgcccccacaucagccugguccccuccgccuacccgcugcagaugaaccucgaguacaaguuccugagccugaacugggcccagggcgacgugucccucgagaucguggacgggcugagcggcaagaucacggaguccagccccuucaaguccggcaugagcauggccucccggcugugcaaggcggccaugcugagccgcuucaaccuccuggccaaggaggccaagaaggagcugcucgaggcggggaccuaccacgccgccaagugcauguccgccagcuaccaggaggccaagugcaagcugaaguccuaccugcagcagcacggcuacgggagcuggaucgucaagucccccugcaucgagcaguucaacauguga

SEQ ID NO: 26302 - RNA, 1092 nt, Artificial Sequence
  derived and/or modified sequence opt1 from ADA__Homo_sapiens__NP_000013
auggcccagacccccgccuucgacaagcccaagguggagcugcacguccaccucgacggcagcaucaagcccgagaccauccuguacuacgggcgccggcgcggcaucgcgcugcccgccaacacggccgaggggcuccugaacgugaucggcauggacaagccccugacccucccggacuuccuggccaaguucgacuacuacaugcccgccaucgcggggugccgggaggccaucaagcgcaucgccuacgaguucguggagaugaaggccaaggagggcgucguguacguggagguccgguacagcccccaccuccuggcgaacuccaagguggagcccaucccguggaaccaggccgagggcgaccugacccccgacgagguggucgcccugguggggcagggccuccaggagggggagcgcgacuucggcgugaaggcccgguccauccugugcugcaugcgccaccagcccaacuggagccccaaggucguggagcugugcaagaaguaccagcagcagaccguggucgccaucgaccucgcgggggacgagacgaucccgggcuccagccugcugcccggccacgugcaggccuaccaggaggccgugaaguccgggauccaccggaccguccacgccggcgagguggggagcgccgagguggucaaggaggcgguggacauccucaagaccgagcgccugggccacggcuaccacacccuggaggaccaggcccucuacaaccggcugcgccaggagaacaugcacuucgagaucugccccugguccagcuaccugacgggggccuggaagcccgacaccgagcacgccgugauccggcucaagaacgaccaggccaacuacucccugaacaccgacgacccgcugaucuucaagagcacccucgacacggacuaccagaugaccaagcgcgacaugggcuucaccgaggaggaguucaagcggcugaacaucaacgcggccaaguccagcuuccugcccgaggacgagaagcgcgagcuccuggaccugcucuacaaggccuacgggaugccgcccuccgccagcgccggccagaaccuguga

SEQ ID NO: 26303 - RNA, 2247 nt, Artificial Sequence
  derived and/or modified sequence opt1 from ADAM10__Homo_sapiens__NP_001101
auggugcugcuccgcguccugauccugcuccugagcugggccgccggcaugggcgggcaguacgggaacccccugaacaaguacauccggcacuacgagggccucuccuacaacguggacagccugcaccagaagcaccagcgcgcgaagcgggccgugucccacgaggaccaguuccugcgccucgacuuccacgcccacgggcggcacuucaaccugcgcaugaagcgggacaccagccuguucuccgacgaguucaaggucgagaccagcaacaaggugcucgacuacgacaccucccacaucuacaccggccacaucuacggcgaggaggggagcuucucccacggcagcgugaucgacgggcgcuucgagggcuucauccagacccgcgggggcaccuucuacgucgagccggccgagcgcuacaucaaggaccggacgcugcccuuccacuccgugaucuaccacgaggacgacaucaacuacccccacaaguacggcccccagggcgggugcgccgaccacagcguguucgagcgcaugcggaaguaccagaugaccggggucgaggaggugacccagaucccgcaggaggagcacgcggccaacggccccgagcugcuccgcaagaagcggaccacguccgccgagaagaacacgugccagcuguacauccagaccgaccaccuguucuucaaguacuacggcacccgcgaggccgugaucgcgcagaucagcucccacgucaaggccaucgacacgaucuaccagaccaccgacuucagcgggauccggaacaucuccuucauggugaagcgcauccggaucaacaccacggccgacgagaaggaccccaccaaccccuuccgcuucccgaacaucggcguggagaaguuccucgagcugaacagcgagcagaaccacgacgacuacugccuggccuacgucuucaccgaccgggacuucgacgacggggugcucggccuggccugggugggggcgcccuccggcagcagcggcgggaucugcgagaaguccaagcuguacagcgacggcaagaagaagucccucaacaccgggaucaucacgguccagaacuacggcagccacgugccgcccaaggugucccacaucaccuucgcccacgaggucgggcacaacuucggcagcccccacgacuccggcaccgagugcacccccggggagagcaagaaccugggccagaaggagaacgggaacuacaucauguacgcccgcgccacguccggcgacaagcugaacaacaacaaguucagccucugcuccauccgcaacaucagccaggugcuggagaagaagcggaacaacugcuucguggaguccgggcagcccaucugcggcaacggcauggucgagcagggggaggagugcgacugcggcuacagcgaccagugcaaggacgagugcugcuucgacgccaaccagcccgaggggcgcaagugcaagcugaagccgggcaagcagugcucccccagccagggccccugcugcaccgcgcagugcgccuucaaguccaagagcgagaagugccgggacgacuccgacugcgcccgcgaggggaucugcaacggcuucaccgcccucugccccgccagcgacccgaagcccaacuucaccgacugcaaccggcacacccaggugugcaucaacgggcagugcgcgggcagcaucugcgagaaguacgggcuggaggagugcacgugcgccuccagcgacggcaaggacgacaaggagcugugccacgucugcugcaugaagaagauggaccccuccacgugcgccagcaccggcuccgugcaguggagccgccacuucuccgggcggaccaucacccuccagcccggcagcccgugcaacgacuuccgcggguacugcgacguguucaugcggugccgccuggucgacgccgacggcccccuggcccggcucaagaaggcgaucuucucccccgagcuguacgagaacaucgccgaguggaucguggcccacuggugggccgugcugcucauggggaucgcgcugaucaugcugauggccggcuucaucaagaucugcagcguccacacccccuccagcaacccgaagcugcccccgcccaagccccuccccggcacccugaagcgccggcggcccccgcagcccauccagcagccccagcggcagcgcccccgggaguccuaccagauggggcacaugcgccgguga

SEQ ID NO: 26304 - RNA, 2310 nt, Artificial Sequence
  derived and/or modified sequence opt1 from ADAM11__Homo_sapiens__NP_002381
augcgccugcuccggcgcugggccuucgccgcgcugcugcucagccugcugcccaccccgggccucgggacccagggccccgccggggcccugcgguggggcgggcugccccagcucggcggccccggggccccggaggugacggagcccucccgccugguccgggagagcuccggcggggaggugcgcaagcagcagcuggacacccgggugcgccaggagccccccggcgggccgcccguccaccucgcccaggugagcuucgugauccccgcguucaacuccaacuucacccuggaccuggagcucaaccaccaccugcugagcucccaguacgucgagcggcacuucagccgcgagggcaccacgcagcacuccaccggcgccggggaccacugcuacuaccagggcaagcuccgggggaacccccacagcuucgccgcccuguccaccugccagggccugcacggcguguucagcgacgggaaccucaccuacaucguggagccgcaggaggucgcgggccccuggggggccccccagggcccccugccgcaccugaucuaccgcacgccccuccugcccgacccccuggggugccgggagccgggcugccucuucgccgugcccgcccaguccgccccccccaaccgcccgcggcugcgccggaagcgccaggugcggcgcggccaccccaccguccacagcgagaccaaguacguggagcugaucgugaucaacgaccaccagcucuucgagcagaugcggcaguccgucgugcugaccagcaacuucgcgaaguccguggucaaccuggccgacgugaucuacaaggagcagcucaacacgcgcaucgugcuggucgccauggagaccugggccgacggggacaagauccaggugcaggacgaccugcucgagacccuggcccgccugaugguguaccggcgcgagggccuccccgagcccagcgacgcgacccaccuguucuccgggcggacguuccagagcaccagcuccggcgccgccuacgucgggggcaucugcagccugucccacggcgggggcgugaacgaguacgggaacaugggcgccauggccgucacccucgcgcagacccuggggcagaaccugggcaugauguggaacaagcaccgcagcuccgccggcgacugcaagugcccggacaucuggcucgggugcaucauggaggacacgggcuucuaccugccccggaaguucagccgcugcuccaucgacgaguacaaccaguuccugcaggaggggggcggcagcugccucuucaacaagccccugaagcugcuggacccgcccgagugcgggaacggcuucguggaggccggggaggagugcgacugcggcuccgugcaggagugcagccgggccgggggcaacugcugcaagaagugcacccucacccacgacgccaugugcuccgacggccugugcugccgccggugcaaguacgagccccgcggggucagcugccgggaggcggugaacgagugcgacaucgccgagaccugcacgggcgacuccagccagugccccccgaaccugcacaagcucgacggguacuacugcgaccacgagcagggccgcugcuacgggggccggugcaagacccgcgaccggcagugccaggugcuguggggccacgccgccgcggaccgcuucugcuacgagaagcugaacgucgaggggaccgagcggggcuccugcgggcgcaagggcagcgggugggugcagugcuccaagcaggacgugcucugcggcuuccugcugugcgucaacaucagcggcgccccccggcucggggaccuggugggcgacaucuccagcgugaccuucuaccaccaggggaaggagcuggacugccgcggcgggcacguccagcucgccgacggcagcgaccuguccuacguggaggacggcacggccugcgggcccaacaugcugugccucgaccaccgcugccugcccgccagcgcguucaacuucuccaccugcccgggcagcggggagcggcgcaucugcucccaccacggcgugugcagcaacgagggcaagugcaucugccagcccgacuggaccgggaaggacugcuccauccacaacccccugcccaccagcccgcccacgggcgagaccgagcgguacaaggggcccuccggcaccaacaucaucaucgggagcaucgccggcgccguccucguggccgccaucgugcugggcgggaccggcuggggguucaagaacauccgccggggccgcuccgggggcgcguga

SEQ ID NO: 26305 - RNA, 2208 nt, Artificial Sequence
  derived and/or modified sequence opt1 from ADAM12__Homo_sapiens__NP_001275904
auggccgcccgcccccugccggugagccccgcgcgggcccuccugcuggcccucgccggcgcccugcuggcgcccugcgaggcccgcggggucucccucuggaaccagggccgggccgacgagguggugagcgccuccgucgggagcggcgaccuguggauccccgugaaguccuucgacagcaagaaccacccggaggugcugaacauccgccuccagcgggaguccaaggagcugaucaucaaccuggagcgcaacgaggggcucaucgcgagcuccuucaccgagacccacuaccugcaggacggcacggacgucagccuggcccggaacuacaccggccacugcuacuaccacgggcacgugcgcggcuacuccgacagcgccgugucccucagcacgugcuccgggcugcggggccugaucgucuucgagaacgagagcuacgugcucgagcccaugaaguccgccaccaaccgcuacaagcuguuccccgccaagaagcugaaguccgugcggggguccugcggcagccaccacaacacccccaaccucgcggccaagaacgucuucccgccgcccagccagaccugggcccgccggcacaagcgcgagacccugaaggccaccaaguacguggagcuggugaucgucgccgacaaccgggaguuccagcgccagggcaaggaccucgagaaggugaagcagcggcugaucgagaucgcgaaccacguggacaaguucuaccgcccccugaacauccggaucguccucguggggguggaggucuggaacgacauggacaagugcuccgugagccaggaccccuucacgucccugcacgaguuccuggacuggcgcaagaugaagcuccugccccgcaagagccacgacaacgcccagcugguguccggcgucuacuuccaggggaccaccaucggcauggcccccaucaugagcaugugcaccgccgaccaguccggcgggaucgugauggaccacagcgacaacccccucggcgccgcggucacgcuggcccacgagcuggggcacaacuucggcaugaaccacgacacccucgaccgggggugcuccugccagauggccguggagaagggcggcugcaucaugaacgccagcaccggguacccguuccccaugguguucuccagcugcucccgcaaggaccuggagaccagccuggagaagggcaugggggucugccucuucaaccugcccgaggugcgggaguccuucggcgggcagaagugcggcaaccgcuucguggaggagggcgaggagugcgacugcggggagcccgaggagugcaugaaccggugcugcaacgccacgaccugcacccugaagccggacgcggucugcgcccacggccucugcugcgaggacugccagcugaagcccgccgggaccgccugccgcgacagcuccaacagcugcgaccugcccgaguucugcacgggcgcgagcccccacugcccggccaacguguaccuccacgacgggcacagcugccaggacguggacggcuacugcuacaacggcaucugccagacccacgagcagcagugcgucacccugugggggcccggcgccaagcccgcccccgggaucugcuucgagcgggugaacagcgccggcgacccguacggcaacugcgggaagguguccaagagcuccuucgcgaagugcgagaugcgcgacgccaagugcggcaagauccagugccagggcggggccagccggcccgucaucgggaccaacgccguguccaucgagacgaacaucccccugcagcagggcggccgcauccucugccgggggacccacguguaccugggcgacgacaugccggaccccgggcugguccuggccggcaccaagugcgcggacgggaagaucugccucaaccgccagugccagaacaucagcguguucggcgugcacgagugcgccaugcagugccacggccgcggggucugcaacaaccggaagaacugccacugcgaggcccacugggccccgcccuucugcgacaaguucggcuucgggggcuccaccgacagcgggcccauccggcaggccgaggcgcgccaggaggccgccgaguccaaccgggagcgcggccagggccaggagcccguggggagccaggagcacgccuccacggcgagccugacccugaucuga

SEQ ID NO: 26306 - RNA, 2475 nt, Artificial Sequence
  derived and/or modified sequence opt1 from ADAM15__Homo_sapiens__NP_001248393
augcgccuggcccuccugugggcccugggccuccugggggcgggcagcccccugccguccuggccccuccccaacaucgugcugagcugggggguccugggccccgccgggggcaccgaggagcagcaggccgaguccgagaaggccccgcgggagccccucgagccccaggugcugcaggacgaccugcccaucagccucaagaaggugcugcagaccucccugccggagccccuccgcaucaagcuggagcuggacggcgacagccacauccucgagcugcugcagaaccgggagcucguccccgggcgccccacgcuggugugguaccagccggacggcacccggguggucuccgaggggcacacccuggagaacugcugcuaccagggccgcgugcggggguacgccggcagcuggguguccaucugcaccugcagcggccuccgcgggcuggucgugcugacgcccgagcgguccuacacccucgagcagggccccggggaccugcagggccccccgaucaucagccgcauccaggaccugcaccuccccggccacaccugcgcgcuguccuggcgggagagcgugcacacccagaagccccccgagcacccgcuggggcagcgccacauccggcgccggcgcgacgucgugacggagaccaagaccguggagcucgucaucguggccgaccacuccgaggcccagaaguaccgggacuuccagcaccugcugaaccgcacccucgagguggcccugcugcucgacacguucuuccggccccugaacguccgcguggcgcuggugggccucgaggccuggacccagcgggaccuggucgagaucagccccaaccccgccgugacccuggagaacuuccuccacuggcgccgcgcccaccugcugccgcggcucccccacgacuccgcccagcuggugaccgggacgagcuucuccggccccaccgucgggauggcgauccagaacagcaucugcagccccgacuucuccggcggcgugaacauggaccacagcaccuccauccugggggucgccagcuccaucgcccacgagcugggccacagccucgggcuggaccacgaccugccgggcaacuccugccccugccccgggccggcccccgccaagaccugcaucauggaggcgagcacggacuuccuccccggccugaacuucuccaacugcagccgccgggcccuggagaaggcccuccuggacggcaugggguccugccuguucgagcgccuccccagccugccgcccauggccgccuucugcggcaacauguucguggagcccggggagcagugcgacugcggcuuccuggacgacugcguggaccccugcugcgacucccucaccugccagcugcggccgggggcgcagugcgccagcgacggccccugcugccagaacugccagcugcgccccuccggcuggcagugccggcccacccgcggggacugcgaccucccggaguucugccccggcgacagcucccagugcccccccgacgucagccugggggacggcgagccgugcgccggcgggcaggccgugugcaugcacggccggugcgccuccuacgcgcagcagugccagagccugugggggcccggcgcccagcccgccgccccccucugccugcagaccgcgaacacgcgcgggaacgccuucggcagcugcggccggaacccguccgggagcuacguguccugcaccccccgcgacgccaucugcggccagcugcagugccagaccgggcggacccagccccuccugggcagcauccgcgaccugcucugggagacgaucgacgucaacgggaccgagcugaacugcuccugggugcaccuggaccucggcagcgacguggcccagccccugcugacccucccgggcaccgccugcgggcccggccuggucugcaucgaccaccggugccagcgcguggaccugcucggggcgcaggagugccgguccaagugccacggccacggggugugcgacagcaaccgccacugcuacugcgaggagggcugggcccccccggacugcacgacccagcugaaggccaccuccagccugaccacgggccuccugcugucccuccugguccugcucgugcuggugaugcugggggccagcuacugguaccgggcccgccuccaccagcgccugugccagcugaagggccccaccugccaguaccgggcggcccaguccgggcccagcgagcgccccggcccgccccagcgggcccuccuggcccgcgggaccaagucccagggccccgccaagcccccgcccccccggaagccccugccggcggacccccagggccgcugccccagcggggaccuccccggcccgggggccggcauccccccccuggucgugcccucccggccggcccccccccccccgaccgugagcagccuguaccucuga

SEQ ID NO: 26307 - RNA, 2475 nt, Artificial Sequence
  derived and/or modified sequence opt1 from ADAM17__Homo_sapiens__NP_003174
augcgccagagccuccuguuccugaccuccgugguccccuucgugcuggccccgcggccgcccgacgaccccggcuucgggccccaccagcgccucgagaagcuggacagccugcucuccgacuacgacauccugagccuguccaacauccagcagcacagcgugcggaagcgcgaccuccagaccuccacgcacgucgagacccugcugaccuucagcgcccucaagcggcacuucaagcuguaccugaccuccagcacggagcgcuucucccagaacuucaaggugguggucguggacggcaagaacgagagcgaguacaccgugaaguggcaggacuucuucaccgggcacgucgugggcgagcccgacucccgggugcucgcgcacauccgcgacgacgacgucaucauccggaucaacaccgacggggccgaguacaacaucgagccccuguggcgcuucgugaacgacacgaaggacaagcggaugcugguguacaagagcgaggacaucaagaacgucucccgccuccagagccccaaggugugcggcuaccugaagguggacaacgaggagcugcucccgaagggccuggucgaccgggagccgcccgaggagcuggugcaccgcgugaagcggcgcgccgaccccgaccccaugaagaacacgugcaagcuccuggucguggccgaccaccgguucuaccgcuacauggggcggggcgaggaguccaccaccaccaacuaccugaucgagcucaucgaccgcguggacgacaucuaccggaacaccagcugggacaacgccggguucaagggcuacgggauccagaucgagcagauccgcauccugaaguccccgcaggaggucaagcccggcgagaagcacuacaacauggccaagagcuaccccaacgaggagaaggacgccugggacgugaagaugcugcucgagcaguucagcuucgacaucgccgaggaggccuccaaggucugccuggcgcaccuguucaccuaccaggacuucgacaugggcacccucgggcuggccuacgugggcagcccccgcgccaacucccacgggggcgugugccccaaggccuacuacagccccgucggcaagaagaacaucuaccugaacuccgggcucacgagcaccaagaacuacggcaagaccauccugaccaaggaggccgaccuggugacgacccacgagcucgggcacaacuucggcgcggagcacgaccccgacgggcuggccgagugcgccccgaacgaggaccagggcggcaaguacgugauguaccccaucgccgucuccggggaccacgagaacaacaagauguucagcaacugcuccaagcagagcaucuacaagaccaucgaguccaaggcccaggagugcuuccaggagcggagcaacaaggugugcggcaacucccgcguggacgagggggaggagugcgaccccggcaucauguaccugaacaacgacacgugcugcaacagcgacugcacccucaaggaggggguccagugcuccgaccggaacagccccugcugcaagaacugccaguucgagaccgcgcagaagaagugccaggaggccaucaacgcgaccugcaagggcguguccuacugcaccggcaacagcuccgagugcccgccgcccgggaacgccgaggacgacacggugugccuggaccugggcaagugcaaggacgggaagugcauccccuucugcgagcgcgagcagcagcucgagagcugcgccugcaacgagaccgacaacagcugcaaggucugcugccgggaccuguccggccgcugcgugcccuacguggacgcggagcagaagaaccuguuccuccggaaggggaagcccugcaccgucggcuucugcgacaugaacggcaagugcgagaagcgcgugcaggacgugaucgagcgguucugggacuucaucgaccagcugagcaucaacaccuucgggaaguuccuggccgacaacaucgucggcuccgugcugguguucagccucaucuucuggauccccuucuccauccugguccacugcguggacaagaagcuggacaagcaguacgagagccucucccuguuccacccgagcaacguggagaugcuguccagcauggacuccgccagcguccgcaucaucaagcccuuccccgcgccccagacgccggggcggcuccagcccgcccccgugauccccuccgcgccggccgcccccaagcuggaccaccagcgcauggacaccauccaggaggaccccagcaccgacucccacauggacgaggacggcuucgagaaggaccccuucccgaacagcuccaccgccgccaagagcuucgaggaccugacggaccaccccgugacccggagcgagaaggccgccuccuucaagcuccagcgccagaaccgggucgacagcaaggagaccgagugcuga

SEQ ID NO: 26308 - RNA, 2757 nt, Artificial Sequence
  derived and/or modified sequence opt1 from ADAM19__Homo_sapiens__NP_150377
augcccggcggggccggcgccgcgcgccugugccuccuggccuucgcccugcagccgcuccggccccgcgccgcccgggagcccggguggacccgcggcagcgaggaggggucccccaagcugcagcacgagcugaucaucccgcaguggaagaccagcgagucccccgugcgggagaagcacccccucaaggcggagcugcgcgucauggccgagggccgggagcugauccucgaccuggagaagaacgagcagcuguucgcccccagcuacacggagacccacuacaccuccagcggcaacccgcagaccacgacccgcaagcucgaggaccacugcuucuaccacgggaccgugcgggagaccgagcuguccagcgugacgcuguccacgugccgcggcauccgggggcucaucaccgucagcuccaaccugagcuacgugaucgagccccugcccgacuccaagggccagcaccucaucuaccgcagcgagcaccugaagcccccgcccgggaacugcggcuucgagcacuccaagcccaccacccgggacugggcccugcaguucacccagcagaccaagaagcgcccccggcgcaugaagcgggaggaccucaacagcaugaaguacguggagcuguaccuggucgcggacuaccucgaguuccagaagaaccgccgggaccaggacgccaccaagcacaagcugaucgagaucgccaacuacguggacaaguucuaccgcucccugaacauccggaucgcccucgugggccuggaggucuggacgcacgggaacaugugcgaggugagcgagaacccguacuccacccuguggagcuuccucagcuggcgccgcaagcugcuggcccagaaguaccacgacaacgcgcagcucaucaccggcauguccuuccacgggaccacgaucggccuggcgccccugauggccaugugcagcguguaccaguccggcggggucaacauggaccacagcgagaacgccaucggcguggccgccaccauggcccacgagauggggcacaacuucggcaugacccacgacuccgccgacugcugcagcgccuccgccgcggacgggggcugcaucauggccgccgccaccggccaccccuuccccaagguguucaacgggugcaaccggcgcgagcucgaccgguaccugcagagcggcgggggcaugugccuguccaacaugccggacacgcgcaugcucuacgggggccggcgcugcggcaacggguaccuggaggacggcgaggagugcgacugcggggaggaggaggagugcaacaaccccugcugcaacgccagcaacugcacccugcggcccggcgcggagugcgcccacggguccugcugccaccagugcaagcuccuggcccccggcacccugugccgcgagcaggcccggcagugcgaccucccggaguucugcaccggcaagagcccccacugccccacgaacuucuaccagauggacgggacccccugcgagggcgggcaggcguacugcuacaacggcaugugccugaccuaccaggagcagugccagcagcuguggggcccgggggcccgccccgcccccgaccucugcuucgagaaggucaacguggccggcgacaccuucgggaacugcggcaaggacaugaacggggagcaccggaagugcaacaugcgcgacgccaagugcggcaagauccagugccaguccagcgaggcgcggccgcuggaguccaacgccgugcccaucgacacgaccaucaucaugaacggccgccagauccagugccgggggacccacgucuaccgcggccccgaggaggagggggacaugcuggaccccggccuggugaugaccgggacgaagugcggcuacaaccacaucugcuucgagggccagugccggaacaccagcuucuucgagaccgaggggugcggcaagaagugcaacgggcacggcgugugcaacaacaaccagaacugccacugccucccggggugggccccgcccuucugcaacacccccggccacggcggguccaucgacagcggccccaugccgcccgaguccgucgggcccgugguggccggcguccugguggccauccugguccucgcggugcugaugcugauguacuacugcugccgccagaacaacaagcucgggcagcugaagcccagcgcccugcccagcaagcuccggcagcaguucuccugccccuuccgcgugagccagaacuccggcaccggccacgccaaccccacguucaagcugcagaccccgcaggggaagcgcaaggucaucaacacccccgagauccugcggaagcccagccagcccccgccccggcccccgcccgacuaccuccgcggcggguccccgcccgcgccccugcccgcccaccugagccgcgccgcccggaacucccccggccccggcagccagaucgagcgcaccgaguccagccggcgcccgccgcccucccggcccaucccgcccgcccccaacugcaucgugagccaggacuucucccgcccccggccgccccagaaggcccuccccgcgaaccccgugcccgggcgccggagccugccccgccccggcggggccagcccccugcggccgcccggcgccgggccccagcagucccgcccccucgccgcccuggcgccgaaguuccccgaguaccggucccagcgcgccggcggcaugaucagcagcaagaucuga

SEQ ID NO: 26309 - RNA, 2331 nt, Artificial Sequence
  derived and/or modified sequence opt1 from ADAM20__Homo_sapiens__XP_005268209
auggugcagcugcaccaggacaccgacccccagauccccaagggccagcccugcacccucaacagcuccgagggcggggcccgccccgccgucccccacacgcuguucagcuccgcgcuggaccgguggcuccacaacgacagcuucaucauggccgugggggagccgcuggugcacauccgcgucacccugcuccugcugugguucggcauguuccucuccaucagcgggcacucccaggcccggcccagccaguacuucaccucccccgagguggugaucccccugaaggucaucagccgcggccggggcgccaaggccccgggguggcuguccuacagccuccgcuucggcgggcagcgguacaucgugcacaugcgcgugaacaagcugcuguucgcggcccaccuccccgucuucaccuacacggagcagcacgcccugcugcaggaccagcccuucauccaggacgacugcuacuaccacggcuacguggagggggugcccgagucccucgucgcccugagcacgugcuccggcggcuuccuggggaugcuccagaucaacgaccugguguacgagaucaagccgaucagcguguccgcgaccuucgagcaccuggucuacaagaucgacagcgacgacacccaguucccgcccaugcggugcggccucaccgaggagaagaucgcccaccagauggagcugcagcuguccuacaacuucacccucaagcagagcagcuucguggggugguggacccaccagcgcuucguggagcuggucgugguggucgacaacauccgguaccuguucucccagagcaacgccaccacggugcagcacgagguguucaacgucgugaacaucgucgacuccuucuaccacccccucgagguggacgugauccugaccggcaucgacaucuggaccgccagcaacccccugcccaccuccggcgaccucgacaacguccuggaggacuucagcaucuggaagaacuacaaccugaacaaccgccuccagcacgacguggcccaccuguucaucaaggacacgcaggggaugaagcugggcguggcguacgucaaggggaucugccagaaccccuucaacaccggcguggacguguucgaggacaaccggcucgucguguucgccaucacccuggggcacgagcugggccacaaccucggcaugcagcacgacacccaguggugcgugugcgagcugcaguggugcaucaugcacgccuaccgcaaggucacgaccaaguucuccaacugcagcuacgcccaguacugggacuccaccaucagcuccgggcugugcauccagcccccgcccuaccccggcaacaucuuccggcucaaguacugcgggaaccuggugguggaggagggcgaggagugcgacugcgggaccauccgccagugcgccaaggaccccugcugccugcucaacugcacgcugcacccgggcgcggccugcgccuucggcaucugcugcaaggacugcaaguuccugcccagcgggacccugugccggcagcaggucggcgagugcgaccuccccgaguggugcaacgggaccucccaccagugccccgacgacguguacgugcaggacggcaucagcugcaacgucaacgccuucugcuacgagaagaccugcaacaaccacgacauccagugcaaggagaucuucgggcaggacgcccgcuccgcgagccaguccugcuaccaggagaucaacacgcagggcaaccgguucggccacugcgggaucgugggcaccaccuacgugaagugcuggaccccggacaucaugugcgggcgcguccagugcgagaacgugggcgugauccccaaccugaucgagcacagcacgguccagcaguuccaccugaacgacacgaccugcuggggcaccgacuaccaccucgggauggccauccccgacaucggcgaggugaaggacgggaccgugugcggcccggagaagaucugcauccggaagaagugcgccuccaugguccaccugagccaggccugccagcccaagaccugcaacaugcgcgggaucugcaacaacaagcagcacugccacugcaaccacgagugggccccgcccuacugcaaggacaagggcuacggcgggagcgcggacuccgggcccccgcccaagaacaacauggagggccugaacgugaugggcaagcuccgcuaccugagccugcucugccugcugccccucguggccuuccugcuguucugccuccacguccuguucaagaagcggaccaaguccaaggaggacgaggagggguga

SEQ ID NO: 26310 - RNA, 2169 nt, Artificial Sequence
  derived and/or modified sequence opt1 from ADAM21__Homo_sapiens__NP_003804
auggccguggacggcacccuggucuacauccgcgugacccuccugcugcucuggcuggggguguuccugagcaucuccggcuacugccaggccgggcccagccagcacuucacguccccggaggucgugaucccccucaaggugaucagccggggccgcuccgcgaaggcccccggguggcugagcuacucccugcgguucggcggccagaagcacgucgugcacaugcgcgugaagaagcuccuggucagccggcaccuccccguguucaccuacaccgacgaccgcgcccugcuggaggaccagcuguucaucccggacgacugcuacuaccacggguacguggaggccgcccccgagucccucgucguguucagcgcgugcuucggcggguuccggggcgugcugaagaucuccgggcugaccuacgagaucgagcccauccgccacagcgccacguucgagcaccucgucuacaagaucaacuccaacgagacccaguuccccgccaugcggugcggccugaccgagaaggagguggcccgccagcagcuggaguucgaggaggcggagaacagcgcccucgagccgaaguccgccggcgacugguggacccacgccugguuccuggagcugguggucguggugaaccacgacuucuucaucuacagccaguccaacaucagcaagguccaggaggacguguuccucguggucaacaucguggacuccauguacaagcagcuggggacguacaucauccugaucggcaucgagaucuggaaccaggggaacgucuuccccaugaccagcaucgagcagguccucaacgacuucagccaguggaagcagaucucccugagccagcugcagcacgacgccgcgcacauguucaucaagaacucccucaucagcauccugggccuggccuacguggccggcaucugccggccgcccaucgacugcgggguggacaacuuccagggcgacaccuggucccucuucgccaacaccguggcccacgagcuggggcacacgcugggcaugcagcacgacgaggaguucugcuucugcggggagcgcggcugcaucaugaacaccuuccgggugcccgcggagaaguucaccaacugcagcuacgccgacuucaugaagaccacgcucaaccagggcuccugccugcacaacccgccccgccugggggagaucuucaugcucaagcggugcggcaacggggucguggagcgcgaggagcagugcgacugcggcagcgugcagcagugcgagcaggacgccugcugccugcugaacugcacccuccggcccggggccgccugcgcguucggccugugcugcaaggacugcaaguucaugcccuccggcgagcugugccgccaggaggucaacgagugcgaccuccccgaguggugcaacgggaccagccaccagugccccgaggaccgguacgugcaggacggcauccccugcuccgacagcgccuacugcuaccagaagcgcugcaacaaccacgaccagcacugccgggagaucuucgggaaggacgccaaguccgccagccagaacugcuacaaggagaucaacucccagggcaaccgcuucgggcacugcggcaucaacggcaccacguaccugaagugccacaucagcgacguguucugcgggcgcguccagugcgagaacgugcgggacaucccgcugcuccaggaccacuucacccugcagcacacccacaucaacggcgugaccugcugggggaucgacuaccaccuccgcaugaacaucuccgacaucggcgaggucaaggacggcacggugugcgggcccggcaagaucugcauccacaagaagugcgugagccuguccguccugagccacgugugccugcccgagaccugcaacaugaaggggaucugcaacaacaagcaccacugccacugcggcuacggguggagcccgcccuacugccagcaccggggcuacggcggguccaucgacagcggccccgccuccgcgaagcgcgggguguuccugccccucaucgucauccccagccuguccgugcugaccuuccucuucaccgugggccugcugauguaccuccggcagugcagcgggccgaaggagacgaaggcccacuccagcggcuga

SEQ ID NO: 26311 - RNA, 2613 nt, Artificial Sequence
  derived and/or modified sequence opt1 from ADAM22__Homo_sapiens__NP_057435
augcaggccgccguggcggucagcgugcccuuccugcuccugugcgugcuggggaccugcccgcccgcccgcugcgggcaggccggcgacgccucccucauggagcuggagaagcggaaggagaaccgcuucgucgagcggcagagcaucgugccccugcgccucaucuaccgguccgggggcgaggacgagagccgccacgacgcccuggacacccgggugcgcggggaccugggcggcccccagcucacgcacgucgaccaggcguccuuccagguggacgccuucgggaccagcuucauccuggacgugguccugaaccacgaccuccuguccagcgaguacaucgagcggcacaucgagcacggcgggaagaccguggaggugaagggcggggagcacugcuacuaccagggccacauccgcggcaacccggacuccuucgucgcccugagcacgugccacgggcuccacggcauguucuacgacgggaaccacaccuaccugaucgagcccgaggagaacgacaccacccaggaggacuuccacuuccacuccguguacaagagccggcuguucgaguucucccucgacgaccugcccagcgaguuccagcaggucaacaucacccccuccaaguucauccugaagccgcgccccaagcggagcaagcgccagcuccggcgcuacccccggaacguggaggaggagacgaaguacaucgagcugaugaucgugaacgaccaccugauguucaagaagcaccgccucuccgugguccacaccaacaccuacgccaagagcguggugaacauggcggaccugaucuacaaggaccagcugaagacccggaucguccucguggccauggagacgugggccaccgacaacaaguucgccaucuccgagaacccccugaucacccugcgcgaguucaugaaguaccggcgcgacuucaucaaggagaaguccgacgccgugcaccucuucagcggcagccaguucgagagcucccgcagcggcgcggccuacaucgggggcaucugcucccugcugaagggcggcggggucaacgaguucggcaagaccgaccucauggccgugacgcuggcccagagccuggcccacaacaucggcaucaucuccgacaagcggaagcucgcgagcggggagugcaagugcgaggacaccugguccggcugcaucaugggggacaccggcuacuaccugccgaagaaguucacccagugcaacaucgaggaguaccacgacuuccugaacagcgggggcggcgccugccucuucaacaagcccuccaagcugcuggacccgcccgagugcgggaacggcuucaucgagacgggggaggagugcgacugcggcacccccgccgagugcguccucgagggggccgagugcugcaagaagugcacccugacccaggacagccagugcuccgacggccugugcugcaagaagugcaaguuccagcccaugggcacggugugccgcgaggccgugaacgacugcgacauccgggagaccugcagcgggaacuccagccagugcgcgcccaacauccacaagauggacggcuacuccugcgacgggguccagggcaucugcuucggcgggcgcugcaagacccgggaccgccagugcaaguacaucuggggccagaaggugaccgccagcgacaaguacugcuacgagaagcucaacaucgaggggacggagaagggcaacugcgggaaggacaaggacaccuggauccagugcaacaagcgggacgugcugugcggcuaccugcucugcaccaacaucggcaacaucccccgccugggggagcuggacggcgagaucaccuccacgcuggucgugcagcaggggcggacccucaacugcagcggcgggcacgugaagcuggaggaggacgucgaccugggcuacguggaggacggcaccccgugcgggccccagaugaugugccucgagcaccgcugccugcccguggccagcuucaacuucuccacgugccugagcuccaaggagggcaccaucugcagcgggaacggcgucugcuccaacgagcucaagugcgugugcaaccggcacuggaucgggagcgacugcaacaccuacuucccccacaacgacgacgccaagaccggcaucacccuguccggcaacgggguggccggcaccaacaucaucaucgggaucaucgcgggcacgauccugguccucgcccugauccuggggaucaccgccuggggcuacaagaacuaccgcgagcagcggagcaacggccucucccacagcugguccgagcgcaucccggacaccaagcacaucagcgacaucugcgagaacgggcggccccgcuccaacagcuggcagggcaaccucgggggcaacaagaagaagauccggggcaagcgcuuccggccccgcuccaacagcaccgagacgcugucccccgccaagagcccgagcuccagcaccggguccaucgcgagcucccgcaaguaccccuaccccaugccgccccugcccgacgaggacaagaaggugaaccggcagagcgcccgccugugggagaccuccaucuga

SEQ ID NO: 26312 - RNA, 2499 nt, Artificial Sequence
  derived and/or modified sequence opt1 from ADAM23__Homo_sapiens__NP_003803
augaagcccccgggcagcuccagccgccagccgccccuggccgggugcucccucgccggcgcgagcugcgggccccagcggggccccgccggguccgugcccgccagcgcccccgcccgcacgcccccgugccggcugcugcucguccugcugcuccugccgccccuggcggccuccagccgcccccgggccuggggcgccgcggcccccuccgcgccccacuggaacgagaccgccgagaagaaccucggcgugcuggccgacgaggacaacacccugcagcagaacagcuccagcaacaucuccuacagcaacgcgaugcagaaggagaucacccuccccucccgccugaucuacuacaucaaccaggacagcgagucccccuaccacgugcuggacaccaaggcccggcaccagcagaagcacaacaaggccguccaccucgcccaggccagcuuccagaucgaggcguucggguccaaguucauccuggaccugauccucaacaacggccugcugagcagcgacuacguggagauccacuacgagaacgggaagccgcaguacuccaagggcggggagcacugcuacuaccacggcagcauccgcggcgugaaggacuccaaggucgcccucagcacgugcaacgggcugcacggcauguucgaggacgacaccuucguguacaugaucgagccccuggagcucgugcacgacgagaaguccaccgggcggccccacaucauccagaagacccuggccggccaguacagcaagcagaugaagaaccugaccauggagcgcggcgaccaguggcccuuccucuccgagcugcaguggcugaagcggcgcaagcgggccgucaacccgagccgcgggaucuucgaggagaugaaguaccucgagcugaugaucgugaacgaccacaagacguacaagaagcaccgguccagccacgcccacaccaacaacuucgcgaaguccguggucaaccugguggacagcaucuacaaggagcagcucaacacccgcgugguccugguggccguggagaccuggacggagaaggaccagaucgacaucaccaccaaccccguccagaugcugcacgaguucuccaaguaccggcagcgcaucaagcagcacgccgacgccgugcaccucaucagccgggugaccuuccacuacaagcgcuccagccuguccuacuucggcggggucugcagccggacgcgcggcgugggggugaacgaguacggccugcccauggccgucgcccaggugcucucccagagccuggcccagaaccugggcauccagugggagcccagcucccgcaagccgaagugcgacugcaccgagagcuggggcgggugcaucauggaggagaccggggucucccacagccggaaguucuccaagugcagcauccucgaguaccgcgacuuccugcagcggggcgggggcgccugccuguucaaccgccccaccaagcuguucgagcccacggagugcggcaacggguacguggaggccggcgaggagugcgacugcggguuccacguggagugcuacggccucugcugcaagaagugcucccugagcaacggggcgcacugcuccgacggccccugcugcaacaacaccagcugccucuuccagccgcggggcuacgagugccgcgacgccgucaacgagugcgacaucaccgaguacugcaccggggacuccggccagugcccgcccaaccugcacaagcaggacggguacgccugcaaccagaaccagggccggugcuacaacggcgagugcaagacgcgcgacaaccagugccaguacaucugggggaccaaggccgccggcagcgacaaguucugcuacgagaagcugaacaccgaggggaccgagaagggcaacugcgggaaggacggcgaccgguggauccagugcuccaagcacgacguguucugcggcuuccugcucugcacgaaccugacccgcgcgccccggaucgggcagcugcagggcgagaucauccccaccagcuucuaccaccaggggcgcgugaucgacugcuccggcgcccacgucgugcucgacgacgacaccgacgugggguacgucgaggacggcacgcccugcggccccagcaugaugugccuggaccggaagugccugcagauccaggcccucaacauguccagcugcccgcuggacagcaaggggaaggugugcuccggccacggggugugcagcaacgaggcgaccugcaucugcgacuucaccugggccggcaccgacugcuccauccgcgaccccguccggaaccugcacccgcccaaggacgaggggcccaagggccccagcgccacgaaccucaucaucggcuccaucgccggggccauccugguggccgccaucgugcugggcgggaccggcuggggguucaagaacgucaagaagcgccgguucgaccccacccagcagggccccaucuga

SEQ ID NO: 26313 - RNA, 2328 nt, Artificial Sequence
  derived and/or modified sequence opt1 from ADAM28__Homo_sapiens__NP_055080
augcugcagggccuccugcccgugagccugcuccuguccgucgccgugagcgccaucaaggagcugccgggggugaagaaguacgaggucguguaccccauccgccuccacccccugcacaagcgggaggcgaaggagcccgagcagcaggagcaguucgagaccgagcugaaguacaagaugaccaucaacggcaagaucgccgugcucuaccugaagaagaacaagaaccugcucgccccgggguacacggagaccuacuacaacuccaccggcaaggagaucaccacgagcccccagaucauggacgacugcuacuaccaggggcacauccugaacgagaaggucuccgacgccagcaucuccacgugccgcggccugcggggcuacuucagccagggggaccagcgcuacuucaucgagccccucucccccauccaccgggacggccaggagcacgcccuguucaaguacaacccggacgagaagaacuacgacagcacgugcgggauggacggcgugcugugggcgcacgaccuccagcagaacaucgcccugcccgccaccaagcuggugaagcucaaggaccgcaagguccaggagcacgagaaguacaucgaguacuaccuggugcuggacaacggggaguucaagcgguacaacgagaaccaggacgagauccgcaagcggguguucgagauggccaacuacgucaacaugcucuacaagaagcugaacacccacguggcgcuggugggcauggagaucuggaccgacaaggacaagaucaagaucacccccaacgccuccuucacccucgagaacuucagcaaguggcgcggcuccguccugagccggcgcaagcggcacgacaucgcccagcugaucaccgccaccgagcucgccgggaccaccgugggccuggcguucauguccacgaugugcagccccuacuccgugggggucgugcaggaccacagcgacaaccugcuccgcguggccggcaccauggcccacgagaugggccacaacuucgggauguuccacgacgacuacuccugcaagugcccgagcaccaucugcgucauggacaaggcccugagcuucuacauccccaccgacuucuccagcugcucccggcugagcuacgacaaguucuucgaggacaagcucuccaacugccuguucaacgcgccccugcccacggacaucaucagcaccccgaucugcggcaaccagcucguggagaugggggaggacugcgacugcggcaccuccgaggagugcaccaacaucugcugcgacgccaagacgugcaagaucaaggccaccuuccagugcgcccugggggagugcugcgagaagugccaguucaagaaggccggcauggugugccgccccgccaaggacgagugcgaccugcccgagaugugcaacggcaagagcgggaacugccccgacgaccgguuccaggucaacggcuucccgugccaccacgggaagggccacugccucauggggaccugccccacccugcaggagcagugcacggagcuguggggccccggcaccgagguggcggacaaguccugcuacaaccgcaacgagggcgggagcaaguacggguacugccggcgcgucgacgacacccucauccccugcaaggccaacgacaccaugugcggcaagcuguucugccagggcggguccgacaaccugccguggaagggccggaucgugacguuccugaccugcaagaccuucgaccccgaggacaccagccaggagaucgggaugguggccaacggcacgaagugcggggacaacaaggucugcaucaacgccgagugcguggacaucgagaaggccuacaaguccaccaacugcagcuccaagugcaagggccacgcggugugcgaccacgagcuccagugccagugcgaggagggcuggaucccgcccgacugcgacgacagcuccgucguguuccacuucagcaucguggucggggugcuguuccccauggccgugaucuucgucgugguggccauggucauccgccaccaguccagccgcgagaagcagaagaaggaccagcggccccugagcaccaccggcacccgcccccacaagcagaagcggaagccgcagauggugaaggccgugcagccccaggagaugucccagaugaagccccacgucuacgaccuccccguggaggggaacgagccgcccgcgagcuuccacaaggacacgaacgcccugccgcccaccguguucaaggacaaccccgucuccacccccaaggacagcaaccccaaggccuga

SEQ ID NO: 26314 - RNA, 2463 nt, Artificial Sequence
  derived and/or modified sequence opt1 from ADAM29__Homo_sapiens__NP_001265056
augaagaugcugcuccugcugcacugccucggcguguuccugagcugcuccgggcacauccaggacgagcacccccaguaccacagcccgcccgacgucgugauccccgugcgcaucaccggcaccacgcgggggaugaccccgcccggcuggcuguccuacauccuccccuucgggggccagaagcacaucauccacaucaaggucaagaagcugcuguucagcaagcaccuccccguguucaccuacaccgaccagggcgccauccuggaggaccagcccuucgugcagaacaacugcuacuaccacggguacgucgagggcgacccggagucccuggugagccucuccacgugcuucgggggcuuccaggggauccugcagaucaacgacuucgccuacgagaucaagccccuggcguucagcaccaccuucgagcaccucguguacaagauggacuccgaggagaagcaguucagcaccaugcgcuccggcuucaugcagaacgagaucacgugccggauggaguucgaggagaucgacaacagcacccagaagcaguccagcuacgucggcugguggauccacuuccgcaucguggagaucguggucgugaucgacaacuaccuguacauccgguacgagcgcaacgacuccaagcugcucgaggaccuguacgugaucgucaacaucguggacagcauccuggacgugaucggggucaaggugcuccuguucggccuggagaucuggaccaacaagaaccucaucguggucgacgacgugcggaaguccgugcaccuguacugcaaguggaaguccgagaacaucacgccccgcaugcagcacgacaccagccaccuguucaccacccucgggcugcggggccugagcggcaucggggccuuccgcggcaugugcacgccccaccggagcugcgccaucgucaccuucaugaacaagacccucgggaccuucuccaucgccguggcccaccaccugggccacaaccuggggaugaaccacgacgaggacacgugccgcugcagccagccgcggugcaucaugcacgagggcaacccgcccaucaccaaguucuccaacugcagcuacggcgacuucugggaguacaccgucgagcgcaccaagugccuccuggagaccgugcacacgaaggacaucuucaacgugaagcggugcgggaacggcgucguggaggagggggaggagugcgacugcggcccccugaagcacugcgcgaaggaccccugcugccucuccaacugcacccugaccgacggguccacgugcgccuucggccugugcugcaaggacugcaaguuccuccccagcggcaaggugugccgcaaggaggucaacgagugcgaccugcccgaguggugcaacgggaccagccacaagugccccgacgacuucuacguggaggacggcaucccgugcaaggagcggggguacugcuacgagaaguccugccacgaccgcaacgagcagugccggcgcaucuucggcgccggggccaacaccgcgagcgagaccugcuacaaggagcugaacacccucggcgaccgggugggccacugcgggaucaagaacgccacguacaucaagugcaacaucuccgacguccagugcggccgcauccagugcgagaacgugaccgagauccccaacaugagcgaccacaccaccgugcacugggcccgcuucaacgacaucaugugcugguccacggacuaccaccuggggaugaagggccccgacaucggcgaggucaaggacgggaccgagugcggcaucgaccacaucugcauccaccggcacugcgugcacaucaccauccugaacagcaacugcucccccgccuucugcaacaagcgcgggaucugcaacaacaagcaccacugccacugcaacuaccucugggacccgcccaacugccugaucaagggcuacgggggcagcguggacuccggcccgccgcccaagcggaagaagaagaagaaguucugcuaccugugcauccuccugcugaucguccuguucauccuccugugcugccuguaccgccucugcaagaaguccaagcccaucaagaagcagcaggacgugcagacccccagcgccaaggaggaggagaagauccagcggcgcccccacgagcugccgccccagagccagcccugggugaugcccagccagucccagccgcccgucacccccagccagucccacccccaggugaugcccagccagucccagccgcccgugacgcccagccagucccagccccgggucaugcccagccagucccagcccccggugaugcccagccagucccacccccagcugacccccagccagucccagccgcccgugacccccagccagcgccagccccagcucaugccgucccagagccagccgcccgucacccccuccuga

SEQ ID NO: 26315 - RNA, 2151 nt, Artificial Sequence
  derived and/or modified sequence opt1 from ADAM2__Homo_sapiens__NP_001265042
auguggcgcgugcuguuccuccugagcggccucgggggccugcggauggacuccaacuucgacagccugcccguccagaucaccgugccggagaagauccgcuccaucaucaaggaggggaucgagagccaggccuccuacaagaucgugaucgagggcaagcccuacaccgucaaccugaugcagaagaacuuccucccccacaacuuccggguguacagcuacuccgggacgggcaucaugaagccccuggaccaggacuuccagaacuucugccacuaccagggcuacaucgagggguaccccaagagcguggucaugguguccacgugcaccggccugcgcggggugcuccaguucgagaacgucagcuacggcaucgagccccuggaguccagcgugggguucgagcacgugaucuaccaggucaagcacaagaaggccgacgugucccuguacaacgagaaggacaucgagagccgggaccucuccuucaagcugcagagcguggaguacaaccacaugggcuccgacaccaccgucguggcgcagaagguguuccagcugaucggccucaccaacgccaucuucgucagcuucaacaucaccaucauccuguccagccuggagcucuggaucgacgagaacaagaucgccaccacgggggaggccaacgagcugcugcacaccuuccuccgcuggaagaccagcuaccuggugcugcggccccacgacguggccuuccuccuggucuaccgcgagaaguccaacuacgugggcgcgaccuuccaggggaagaugugcgacgccaacuacgccggcggcgugguccugcacccccggacgaucagccucgagucccuggccgugauccuggcgcagcuccugagccuguccauggggaucaccuacgacgacaucaacaagugccagugcagcggcgccgucugcaucaugaacccggaggccauccacuucuccggggugaagaucuucagcaacugcuccuucgaggacuucgcccacuucaucagcaagcagaagucccagugccuccacaaccagccccgccuggaccccuucuucaagcagcaggccgugugcggcaacgcgaagcuggaggccggggaggagugcgacugcggcaccgagcaggacugcgcccucaucggcgagaccugcugcgacaucgccacgugccgguucaaggccgggagcaacugcgcggagggccccugcugcgagaacugccuguucauguccaaggagcgcaugugccggccgagcuucgaggagugcgaccugcccgaguacugcaacggguccagcgccuccugccccgagaaccacuacguccagaccggccaccccugcgggcucaaccaguggaucugcaucgacggcgugugcaugagcggcgacaagcagugcaccgacaccuucgggaaggagguggaguucggcccguccgagugcuacagccaccugaacagcaagacggacgucuccgggaacugcggcaucagcgacuccggguacacccagugcgaggccgacaaccugcagugcggcaagcucaucugcaaguacgugggcaaguuccugcugcagaucccccgcgccaccaucaucuacgccaacaucagcgggcaccucugcaucgcgguggaguucgccuccgaccacgccgacagccagaagauguggaucaaggacggcaccuccugcgggagcaacaaggucugccggaaccagcgcugcguguccagcuccuaccugggcuacgacugcacgaccgacaagugcaacgaccggggcgugugcaacaacaagaagcacugccacugcagcgccuccuaccugccgcccgacugcagcguccaguccgaccucuggcccgggggcagcaucgacuccgggaacuucccgcccguggccauccccgcgcgccugccggagcggcgcuacaucgagaacaucuaccacagcaagcccaugcgguggcccuucuuccuguucauccccuucuucaucaucuucugcgugcugaucgccaucauggucaaggugaacuuccagcgcaagaaguggcgcaccgaggacuacagcuccgacgagcagccggagagcgaguccgagcccaagggcuga

SEQ ID NO: 26316 - RNA, 2439 nt, Artificial Sequence
  derived and/or modified sequence opt1 from ADAM33__Homo_sapiens__NP_001269376
augggcuggcgcccccggcgcgcccgggggaccccgcugcuccugcugcuccugcugcuccugcuguggcccgugcccggcgccgggguccuccagggccacauccccgggcagccggugacgccccacugggugcuggacggccagcccuggcgcaccgucagccuggaggagcccguguccaagccggacaugggccucguggcgcuggaggccgaggggcaggagcugcuccuggagcuggagaagaaccaccggcuccuggcccccggcuacaucgagacccacuacgggcccgacggccagcccgucgugcuggccccgaaccacaccgaccacugccacuaccaggggcgcgugcggggcuuccccgacagcugggucgugcucugcacgugcuccggcaugagcgggcugaucacccugucccgcaacgccagcuacuaccuccggcccuggcccccgcgcggcuccaaggacuucagcacccacgagaucuuccggauggagcagcugcugaccuggaaggggaccugcggccaccgcgaccccggcaacaaggcggggaugacgucccuccccggcgggccccagagccggggccgccgggaggcccgccggacccgcaaguaccuggagcuguacaucguggccgaccacacccucuuccugacccggcaccgcaaccugaaccacacgaagcagcggcuccuggaggucgccaacuacguggaccagcugcuccgcacccuggacauccagguggcgcugaccgggcucgaggucuggaccgagcgcgaccggucccgcgugacgcaggacgccaacgccacccugugggccuuccugcaguggcggcgcggccucugggcccagcggccgcacgacagcgcgcagcugcugaccggccgcgccuuccagggggccaccgugggccucgcccccgucgaggggaugugccgggccgaguccagcggcgggguguccacggaccacagcgagcugcccaucggcgcggccgccaccauggcccacgagaucggccacucccuggggcucagccacgaccccgacggcugcugcguggaggccgcggccgaguccgggggcugcgucauggccgccgccaccgggcacccguucccccgcguguucagcgcgugcagccggcgccagcugcgggccuucuuccgcaagggcggcggggccugccuguccaacgcccccgaccccggccugccggugccgcccgcgcucugcgggaacggcuucgucgaggccggcgaggagugcgacugcgggcccggccaggagugccgggaccugugcugcuucgcccacaacugcagccugcgccccggggcccagugcgcccacggcgacugcugcgugcggugccuccugaagcccgcgggggcccugugccgccaggccaugggcgacugcgaccuccccgaguucugcaccggcacguccagccacugcccgcccgacgucuaccugcuggacgggucccccugcgcccggggcagcggguacugcugggacggcgccugccccacccucgagcagcagugccagcagcugugggggccgggcucccaccccgcgcccgaggccugcuuccagguggugaacagcgccggcgacgcccacgggaacugcggccaggacuccgaggggcacuuccugcccugcgccggccgcgacgcgcucugcgggaagcugcagugccagggcggcaagccgagccugcucgcgccccacaugguccccguggacuccaccgugcaccuggacgggcaggaggugaccugccggggcgcccuggcccuccccagcgcccagcuggaccugcucgggcugggccuggucgagccggggacgcagugcggcccccgcauggugugccagucccgccggugccgcaagaacgccuuccaggagcuccagcggugccugaccgccugccacagccacggcgucugcaacuccaaccacaacugccacugcgcccccgggugggcgcccccguucugcgacaagcccggcuucgggggcagcauggacuccggccccgugcaggccgagaaccacgacaccuuccugcucgccaugcugcugagcgugcuccugccccugcucccgggggccggccuggccuggugcugcuaccgccugcccggggcccaccuccagcggugcuccuggggcugccgccgggaccccgcgugcagcgggccgaaggacggcccccaccgcgaccacccccugggcgggguccaccccauggagcugggcccgaccgccacggggcagcccuggccccucgaccccgagaacagccacgagccguccagccaccccgagaagccccugcccgccguguccccggacccccaggaccaggugcagaugccccggagcugccugugguga

SEQ ID NO: 26317 - RNA, 2265 nt, Artificial Sequence
  derived and/or modified sequence opt1 from ADAM7__Homo_sapiens__NP_003808
augcugcccggcugcaucuuccucaugauccugcugaucccccaggugaaggagaaguucauccucggggucgagggccagcagcuggugcgccccaagaagcugccccucauccagaagcgggacaccgggcacacccacgacgacgacauccugaagacguacgaggaggagcugcucuacgagaucaagcugaaccgcaagacccuggugcuccaccuccugcggagccgcgaguuccucggcuccaacuacagcgagaccuucuacuccaugaagggggaggccuucacccggcacccccagaucauggaccacugcuucuaccagggcagcaucguccacgaguacgacuccgccgcgagcaucuccacgugcaacggccugcgcggguucuuccggaucaacgaccagcgcuaccugaucgagccggugaaguacagcgacgagggcgagcaccucguguucaaguacaaccugcggguccccuacggggccaacuacuccugcaccgagcugaacuucacccgcaagaccgugcccggcgacaacgagagcgaggaggacuccaagaucaaggggauccacgacgagaaguacguggagcuguucaucgucgccgacgacacgguguaccggcgcaacggccacccccacaacaagcugcggaaccgcaucuggggcauggugaacuucgucaacaugaucuacaagacccugaacauccacgugacccucguggggaucgagaucuggacccacgaggacaagaucgagcuguacagcaacaucgagacgacccugcuccgguucuccuucuggcaggagaagauccugaagacccgcaaggacuucgaccacgucgugcugcucagcggcaaguggcuguacucccacgugcaggggaucagcuacccgggcggcaugugccugcccuacuacuccaccagcaucaucaaggaccuccugcccgacacgaacaucaucgccaaccggauggcccaccagcuggggcacaaccucggcaugcagcacgacgaguuccccugcacgugcccguccgggaagugcgucauggacagcgacggcagcauccccgcgcugaaguucuccaagugcagccagaaccaguaccaccaguaccugaaggacuacaagccgaccugcaugcucaacauccccuucccguacaacuuccacgacuuccaguucugcgggaacaagaagcuggacgagggcgaggagugcgacugcggccccgcccaggagugcaccaaccccugcugcgacgcccacacgugcgugcugaagcccggguucacgugcgccgagggcgagugcugcgaguccugccagaucaagaaggcggggagcaucugccgcccggccaaggacgagugcgacuuccccgagaugugcaccggccacucccccgccugccccaaggaccaguuccgggugaacggguucccgugcaagaacagcgagggcuacugcuucaugggcaagugccccacccgcgaggaccagugcuccgagcuguucgacgacgaggccaucgagagccacgacaucugcuacaagaugaacaccaaggggaacaaguucggcuacugcaagaacaaggagaaccgguuccuccccugcgaggagaaggacguccgcugcgggaagaucuacugcaccggcggggagcuguccagccuccugggcgaggacaagaccuaccaccugaaggacccccagaagaacgccaccgugaagugcaagaccaucuuccucuaccacgacuccaccgacaucggccugguggcgagcgggaccaagugcggcgaggggauggucugcaacaacggcgagugccugaacauggagaagguguacaucuccaccaacugcccgagccagugcaacgagaaccccgucgacggccacgggcugcagugccacugcgaggagggccaggcccccguggccugcgaggagacgcuccacgugaccaacaucaccauccuggucguggugcugguccucgugaucguggggaucggcguccugauccugcucgugcgcuaccggaagugcaucaagcugaagcagguccaguccccgcccaccgagacgcuggggguggagaacaagggcuacuucggcgacgagcagcagauccgcaccgagcccauccuccccgagauccacuuccugaacaagccggccagcaaggacucccgggggaucgccgaccccaaccagagcgcgaaguga

SEQ ID NO: 26318 - RNA, 2475 nt, Artificial Sequence
  derived and/or modified sequence opt1 from ADAM8__Homo_sapiens__NP_001100
augcgcggccuggggcucuggcugcugggcgccaugaugcuccccgccaucgcgcccagccggcccugggcccugauggagcaguacgaggugguccugcccuggcgccuccccgggccgcgggugcgccgggcccugcccucccaccugggccuccaccccgagcgcgugagcuacguccugggggccaccggccacaacuucacccugcaccuccggaagaaccgcgaccugcugggcuccggguacacggagaccuacaccgccgcgaacggcagcgaggugaccgagcagccccgggggcaggaccacugcuucuaccagggccacguggagggguacccggacuccgccgccagccucuccacgugcgccggccugcgcggcuucuuccaggucgggagcgaccugcaccucaucgagccccuggacgagggcggggagggcggccggcacgcgguguaccaggccgagcaccuccuccagaccgccgggaccugcggcguguccgacgacagccuggggucccugcucggcccccgcaccgccgccgucuuccggccccgcccgggggacagccugcccucccgggagacgcgcuacguggagcuguacguggucguggacaacgcggaguuccagaugcucggcagcgaggccgccgugcggcaccgcguccuggagguggugaaccacgucgacaagcuguaccagaagcucaacuuccggguggugcuggucggccuggagaucuggaacucccaggaccgcuuccacgugagccccgaccccuccgugacccucgagaaccugcugaccuggcaggcccggcagcgcacccgccggcaccuccacgacaacguccagcugaucacggggguggacuucaccggcaccaccgucggguucgcccgcgugagcgcgaugugcucccacagcagcggcgccgugaaccaggaccacuccaagaacccggucgggguggccugcacgauggcccacgagaugggccacaaccugggcauggaccacgacgagaacgugcaggggugccggugccaggagcgcuucgaggccggccggugcaucauggcggggagcaucggcuccagcuucccccgcauguucuccgacugcagccaggccuaccuggaguccuuccuggagcggccccagagcgucugccuggccaacgcccccgaccucucccaccuggucgggggcccggugugcggcaaccuguucguggagcgcggggagcagugcgacugcggcccgcccgaggacugccggaaccgcugcugcaacagcacgaccugccagcucgccgagggggcgcagugcgcccacgggaccugcugccaggagugcaaggugaagcccgccggcgagcugugccggcccaagaaggacaugugcgaccuggaggaguucugcgacggccgccaccccgagugccccgaggacgccuuccaggagaacggcacccccugcuccgggggcuacugcuacaacggggcgugcccgacccucgcccagcagugccaggccuucuggggccccggcgggcaggccgccgaggagagcugcuucuccuacgacauccugcccggcugcaaggcgagccgguaccgcgccgacaugugcggggugcugcagugcaagggcgggcagcagccgcugggccgggccaucugcaucgucgacgugugccacgcccucaccaccgaggacggcacggccuacgagcccgugcccgaggggacccgcugcggccccgagaaggucugcuggaaggggcggugccaggaccugcacguguaccgcuccagcaacugcuccgcgcagugccacaaccacggcgugugcaaccacaagcaggagugccacugccacgccgggugggccccgccccacugcgccaagcugcucaccgagguccacgccgcgagcggcucccugcccguguucguggucguggugcugguccuccuggccguggugcuggucacccucgccggcaucaucguguaccggaaggcccgcagccgcauccugagccggaacguggcgcccaagacgaccauggggcgcuccaacccgcuguuccaccaggccgccagccggguccccgccaagggcggggcccccgcgcccucccgcggcccgcaggagcucgugcccaccacccaccccgggcagcccgcccggcacccggccagcuccguggcccugaagcgcccgccgcccgccccgcccgucacggugagcuccccgcccuuccccgugcccgucuacacccggcaggcgcccaagcaggucaucaagcccaccuucgccccgcccgugccgcccgugaagcccggcgccggcgccgccaaccccgggcccgcggagggcgccguggggcccaagguggcccugaagccgcccauccagcgcaagcagggcgccggcgcgcccaccgcccccuga

SEQ ID NO: 26319 - RNA, 2460 nt, Artificial Sequence
  derived and/or modified sequence opt1 from ADAM9__Homo_sapiens__NP_003807
augggcagcggggcccgcuuccccuccggcacccugcgggugcgcuggcuccugcugcucgggcuggucggccccgugcugggggccgcgcggcccggcuuccagcagaccagccaccucuccagcuacgagaucaucacgcccuggcgccugacccgggagcgccgggaggcgccccgccccuacuccaagcaggucagcuacgucauccaggccgagggcaaggagcacaucauccaccuggagcggaacaaggaccuccugcccgaggacuucgugguguacaccuacaacaaggaggggacccugaucacggaccaccccaacauccagaaccacugccacuaccgcggcuacgucgagggggugcacaacuccagcaucgcccucuccgacugcuucggccugcgggggcugcuccaccuggagaacgccagcuacggcaucgagccccugcagaacuccagccacuucgagcacaucaucuaccgcauggacgacguguacaaggagccgcucaagugcggcgucuccaacaaggacaucgagaaggagaccgccaaggacgaggaggaggagccgcccagcaugacccagcugcugcggcgccggcgcgccgugcucccccagacccgguacguggagcuguucaucgucguggacaaggagcgcuacgacaugauggggcggaaccagacggccgugcgcgaggagaugauccugcucgccaacuaccuggacuccauguacaucaugcugaacauccggaucguccucgugggccuggagaucuggaccaacgggaaccugaucaacaucgugggcggcgcgggggacgugcucggcaacuucgugcaguggcgcgagaaguuccugaucacccgccggcgccacgacagcgcccagcuggugcucaagaagggguucggcgggaccgccggcauggccuucgucggcacggugugcucccggagccacgccgggggcaucaacguguucgggcagaucaccgucgagaccuucgcguccaucguggcccacgagcugggccacaaccuggggaugaaccacgacgacggccgcgacugcagcugcggcgccaagagcugcaucaugaacuccggggccagcggcucccggaacuucagcuccugcagcgccgaggacuucgagaagcucacccugaacaagggcgggaacugccugcucaacauccccaagcccgacgaggcguacuccgcccccagcugcgggaacaagcuggucgacgccggcgaggagugcgacugcggcacgcccaaggagugcgagcuggacccgugcugcgaggggagcacgugcaagcucaaguccuucgccgagugcgccuacggcgacugcugcaaggacugccgcuuccugcccgggggcacccugugccggggcaagaccuccgagugcgacgugcccgaguacugcaacgggagcucccaguucugccagcccgacguguucauccagaacggcuacccgugccagaacaacaaggcguacugcuacaacgggaugugccaguacuacgacgcccagugccaggucaucuucggcagcaaggccaaggccgcccccaaggacugcuucaucgaggugaacuccaagggggaccgcuucggcaacugcggcuucagcgggaacgaguacaagaagugcgcgaccggcaacgcccucugcgggaagcugcagugcgagaacgugcaggagauccccgucuucggcaucgugcccgccaucauccagaccccgucccgggggaccaagugcuggggcguggacuuccagcugggcagcgacguccccgaccccgggauggugaacgagggcaccaagugcggggccggcaagaucugccgcaacuuccagugcguggacgcguccguccucaacuacgacugcgacgugcagaagaagugccacgggcacggcgugugcaacagcaacaagaacugccacugcgagaacggcugggcgcccccgaacugcgagacgaagggguacggcgggagcgucgacuccggccccaccuacaacgagaugaacaccgcccugcgggacgggcugcugguguucuucuuccucaucgugccccugaucgucugcgccaucuucaucuucaucaagcgcgaccagcuguggcggagcuacuuccgcaagaagcggucccagaccuacgagagcgacggcaagaaccaggccaacccgucccgccagcccggcagcgugccccggcacgugucccccgucacgccgccccgcgaggugcccaucuacgccaaccgguucgccgugcccaccuacgccgccaagcagccgcagcaguuccccagccgcccgccgccgccccagcccaaggucuccagccaggggaaccucauccccgcccgccccgcgcccgccccgccccuguacuccagccugaccuga

SEQ ID NO: 26320 - RNA, 1176 nt, Artificial Sequence
  derived and/or modified sequence opt1 from ADAMDEC1__Homo_sapiens__NP_001138743
augauccugaacggcgaggagaucauccucagccugcagaagaccaagcaccuccuggggcccgacuacaccgagacgcuguacuccccgcgcggcgaggagaucaccaccaagcccgagaacauggagcacugcuacuacaaggggaacauccugaacgagaagaacagcguggccuccaucagcacgugcgacggccuccggggguacuucacccaccaccaccagcgcuaccagaucaagccccugaaguccaccgacgagaaggagcacgccgucuucaccagcaaccaggaggagcaggaccccgcgaaccacacgugcggcgugaaguccaccgacggcaagcaggggccgauccggaucagccgcucccucaagagccccgagaaggaggacuuccugcgggcccagaaguacaucgaccuguaccuggugcucgacaacgccuucuacaagaacuacaacgagaaccugacccugauccgcuccuucgucuucgacgugaugaaccuccugaacgugaucuacaacaccaucgacguccagguggcccuggugggcauggagaucuggagcgacggggacaagaucaaggucgugcccuccgccagcaccacguucgacaacuuccuccgguggcacuccagcaaccugggcaagaagauccacgaccacgcgcagcugcucuccgggaucagcuucaacaaccgccgggugggccuggccgccuccaacagccugugcagccccuccagcgucgccgugaucgaggcgaagaagaagaacaacguggcccucgucggcgugaugucccacgagcuggggcacgugcugggcaugccggacguccccuucaacaccaagugccccagcggguccugcgugaugaaccaguaccucagcuccaaguuccccaaggacuucagcaccuccugccgcgcccacuucgagcgguaccugcugagccagaagccgaagugccuccugcaggcccccauccccaccaacaucaugacgacccccgugugcggcaaccaccuccuggaggucggcgaggacugcgacugcggguccccgaaggagugcaccaaccugugcugcgaggcccugaccugcaagcucaagcccggcacggacugcgggggcgacgcgcccaaccacaccaccgaguga

SEQ ID NO: 26321 - RNA, 3312 nt, Artificial Sequence
  derived and/or modified sequence opt1 from ADAMTS10__Homo_sapiens__NP_112219
auggcccccgccugccagauccugcgcugggcgcucgcccugggccuggggcucauguucgaggugacccacgccuuccggagccaggacgaguuccuguccagccuggaguccuacgagaucgccuucccgacccgcgucgaccacaacggcgcccuccuggcguucagccccccccccccgcggcgccagcggcgcgggacgggcgccaccgccgagucccggcuguucuacaagguggccagccccuccacccacuuccuccugaaccugacccgcagcucccggcuccuggcggggcacgugagcgucgaguacuggacgcgcgagggccuggccuggcagcgggccgcccgcccccacugccucuacgccggccaccugcaggggcaggcguccagcucccacguggccaucagcaccugcggcgggcugcacggccucaucguggccgacgaggaggaguaccugaucgagccccugcacgggggcccgaagggcucccggagccccgaggaguccgggccccacgucguguacaagcgcagcucccuccggcacccccaccuggacaccgccugcggcgugcgcgacgagaagccguggaaggggcggcccugguggcugcgcacccucaagccccccccggcccggccccugggcaacgagacggagcgcggccagcccgggcugaagcggagcgucagccgcgagcgcuacguggagacccucguggucgcggacaagaugaugguggccuaccacggccggcgcgacguggagcaguacguccuggccaucaugaacaucguggccaagcuguuccaggacuccagccucggguccaccgugaacauccuggucacccggcugauccuccugacggaggaccagcccacccuggagaucacccaccacgccggcaagagccucgacuccuucugcaaguggcagaagagcaucgugaaccacuccgggcacggcaacgcgaucccggagaacggcguggccaaccacgacaccgccguccugaucacgcgcuacgacaucugcaucuacaagaacaagcccugcgggacccugggccucgcccccguggggggcaugugcgagcgggagcgcagcugcuccgugaacgaggacaucgggcuggccaccgcguucaccaucgcccacgagaucggccacacguucggcaugaaccacgacggggucggcaacagcugcggggcccggggccaggaccccgccaagcugauggcggcccacaucaccaugaagaccaacccguucgugugguccagcugcucccgcgacuacaucaccagcuuccucgacuccgggcugggccugugccucaacaaccggcccccccgccaggacuucgucuaccccacgguggccccgggccaggccuacgacgccgacgagcagugccgguuccagcacggggugaagagccgccagugcaaguacggcgaggucugcuccgagcuguggugccugagcaaguccaaccggugcaucaccaacagcauccccgcggccgaggggacccucugccagacccacacgaucgacaagggcuggugcuacaagcgcgugugcgugcccuucggcagccggccggagggggucgacggcgccugggggcccuggacccccuggggcgacugcucccgcaccugcgggggcggcgugagcuccagcucccggcacugcgacagcccccgcccgaccaucgggggcaaguacugccugggggagcggcgccgccaccgguccugcaacacggacgacugcccccccggcagccaggacuuccgcgaggugcagugcuccgaguucgacagcauccccuuccgggggaaguucuacaaguggaagaccuaccgcggcggcggggucaaggccugcucccugaccugccuggccgagggcuucaacuucuacaccgagcgggcggccgccgugguggacgggacgccgugccgccccgacaccgucgacaucugcgugagcggcgagugcaagcacguggggugcgaccggguccucggcuccgaccugcgcgaggacaagugccgggugugcggcggggacggcagcgccugcgagaccaucgaggggguguucucccccgccagccccggcgcgggguacgaggacgucguguggaucccgaagggcuccgugcacaucuucauccaggaccugaaccucagccugagccaccuggcccucaagggcgaccaggagucccugcugcucgaggggcugcccggcaccccccagccccaccgccugccgcucgccgggaccacguuccagcugcggcagggccccgaccagguccagagccuggaggcccucggccccaucaacgcgucccugaucgugauggugcuggcccgcaccgagcuccccgcccugcgguaccgcuucaacgccccgaucgcccgggacagccugccccccuacuccuggcacuacgcgcccuggaccaagugcagcgcccagugcgccgggggcucccagguccaggccguggagugccgcaaccagcucgacagcuccgccguggcgccgcacuacugcagcgcccacuccaagcugcccaagcggcagcgcgccugcaacaccgagcccugcccgcccgacugggucguggggaacuggagccugugcucccggagcugcgacgccggcgugcgcucccggagcgucgugugccagcgccgcguguccgccgcggaggagaaggcccucgacgacagcgccugcccccagccccggccgcccguccuggaggccugccacgggcccacgugccccccggagugggcggcccuggacugguccgagugcacccccagcugcggccccggccuccgccaccggguggugcugugcaagagcgccgaccaccgcgccacccugcccccggcccacugcucccccgcggccaagccccccgccaccaugcggugcaaccuccgccggugcccgcccgcccgcugggucgccggggaguggggcgagugcagcgcgcagugcggggugggccagcggcagcgcuccgugcggugcacgagccacaccgggcaggccucccacgagugcaccgaggcccugcgcccccccaccacgcagcagugcgaggccaagugcgacagcccgacccccggcgacggccccgaggagugcaaggacgucaacaagguggccuacugcccccuggugcucaaguuccaguucugcucccgggcguacuuccgccagaugugcugcaagaccugccacgggcacuga

SEQ ID NO: 26322 - RNA, 4785 nt, Artificial Sequence
  derived and/or modified sequence opt1 from ADAMTS12__Homo_sapiens__NP_112217
augcccugcgcccagcgcagcuggcuggccaaccucuccguggucgcgcagcugcugaacuucggcgcccucugcuacgggcggcagccgcagcccggccccgugcgcuuccccgaccggcgccaggagcacuucaucaaggggcugccggaguaccacguggucggccccgugcggguggacgccagcgggcacuuccuguccuacggccuccacuaccccaucaccagcucccgccggaagcgcgaccuggacggcagcgaggacugggucuacuaccggaucucccacgaggagaaggaccuguucuucaaccucaccgugaaccagggguuccugagcaacuccuacaucauggagaagcgcuacggcaaccugagccacgugaagaugauggccuccagcgccccccucugccaccuguccgggacgguccugcagcagggcacccggguggggaccgcggcccucagcgccugccacggccugaccggcuucuuccagcugccgcacggggacuucuucaucgagcccgugaagaagcacccccucgucgagggcggguaccacccccacaucguguaccgccggcagaaggugccggagacgaaggagcccaccugcggccugaaggacuccgucaacaucagccagaagcaggagcuguggcgcgagaagugggagcggcacaaccuccccucccgcagccugucccggcgcagcaucagcaaggagcgguggguggagacccugguggucgccgacaccaagaugaucgaguaccacggcuccgagaacguggagagcuacauccucacgaucaugaacauggugaccgggcuguuccacaaccccuccaucggcaacgcgauccacaucgucguggugcgccugauccuccuggaggaggaggagcaggggcugaagaucguccaccacgccgagaagacccucagcuccuucugcaaguggcagaagagcaucaacccgaaguccgaccugaaccccgugcaccacgacgucgccgugcugcucacccggaaggacaucugcgccggcuucaaccgccccugcgagacgcuggggcugagccaccucuccggcaugugccagccccaccgcagcugcaacaucaacgaggacuccggccugccgcuggccuucaccaucgcgcacgagcucgggcacagcuucggcauccagcacgacgggaaggagaacgacugcgagcccgugggccggcaccccuacaucaugucccgccagcugcaguacgaccccaccccgcugaccuggagcaagugcuccgaggaguacaucacgcgguuccucgaccgcggguggggcuucugccuggacgacauccccaagaagaagggccugaagagcaaggucaucgcccccggggugaucuacgacgugcaccaccagugccagcuccaguacggccccaacgccaccuucugccaggaggucgagaacgugugccagacccuguggugcuccgugaagggguucugccggagcaagcuggacgccgccgcggacggcacccagugcggggagaagaaguggugcauggccggcaagugcaucacggucggcaagaagccggaguccauccccgggggcugggggcgcuggagccccuggagccacugcucccggaccugcggcgccggcgugcagagcgccgagcgccucugcaacaacccggagcccaaguucgggggcaaguacugcaccggggagcggaagcgcuaccggcugugcaacgugcaccccugccgcuccgaggcccccaccuuccggcagaugcagugcagcgaguucgacacggucccguacaagaacgagcuguaccacugguuccccaucuucaaccccgcgcaccccugcgagcuguacugccgcccgaucgacggccaguucuccgagaagaugcucgacgccgugaucgacgggacccccugcuucgagggcggcaacagccggaacgugugcaucaacgggaucugcaagauggucggcugcgacuacgagaucgacuccaacgccaccgaggaccgcugcggggugugccugggcgacgggagcuccugccagaccgugcggaagauguucaagcagaaggagggcagcggcuacgucgacaucgggcugauccccaagggcgcccgcgacauccgggugauggagaucgagggggccggcaacuuccucgcgauccgcuccgaggaccccgagaaguacuaccugaacgggggcuucaucauccaguggaacggcaacuacaagcuggccgggacgguguuccaguacgaccgcaagggcgaccucgagaagcugauggccaccgggccgaccaacgagagcgucuggauccagcugcucuuccaggugaccaaccccggcaucaaguacgaguacacgauccagaaggacgggcuggacaacgacguggagcagcagauguacuucuggcaguacggccacuggaccgagugcuccgucaccugcggcaccgggauccggcgccagacggcccacugcaucaagaagggccgggggauggugaaggcgaccuucugcgaccccgagacccagcccaacggccgccagaagaagugccacgagaaggccugcccgccccgguggugggccggcgagugggaggccugcagcgccaccugcgggccccacggcgagaagaagcgcaccgugcugugcauccagacgauggucuccgacgagcaggcgcuccccccgaccgacugccagcaccugcugaagcccaagacccuccugagcugcaaccgggacauccugugccccuccgacuggaccguggggaacuggagcgagugcagcguguccugcggcgggggcguccgcauccggagcgugacgugcgccaagaaccacgacgagcccugcgacgugacccgcaagccgaacucccgggcccucugcggccugcagcagugccccagcucccgccggguccugaagcccaacaaggggaccaucagcaacggcaagaacccgcccacccucaagcccgugcccccgcccacgucccgcccccggaugcugaccacccccaccgggccggagagcauguccacgagcacccccgccaucuccagccccucccccaccaccgccagcaaggagggcgaccuggggggcaagcaguggcaggacuccagcacgcagccggagcucuccagccgcuaccugaucuccaccggcagcaccagccagcccauccugaccucccagagccucuccauccagcccagcgaggagaacguguccagcuccgacacggggcccaccagcgagggcgggcuggucgcgaccaccacguccggcagcgggcuguccagcucccggaacccgaucaccuggcccgugacccccuucuacaacacccucacgaagggccccgagauggagauccacagcggcuccggggaggagcgcgagcagccggaggacaaggacgagagcaaccccgugaucuggaccaagauccggguccccggcaacgacgcccccguggaguccaccgagaugccgcuggcccccccccugacccccgaccucagccgcgaguccugguggccgcccuucagcacggugauggaggggcugcugcccagccagcggccgaccaccuccgagaccggcacgccccgcgucgagggcauggugaccgagaagcccgccaacacccuccugccccuggggggcgaccaccagccggagcccagcgggaagaccgccaaccgcaaccaccucaagcugcccaacaacaugaaccagaccaaguccagcgagcccgugcugacggaggaggacgcgaccucccucaucaccgagggcuuccugcugaacgccagcaacuacaagcagcucaccaacgggcacggcuccgcccacuggaucgucggcaacuggagcgagugcuccacgaccugcgggcugggcgccuacuggcggcgcguggagugcagcacccagauggacuccgacugcgcggccauccagcggccggaccccgccaagcgcugccaccugcggcccugcgccggguggaaggugggcaacuggagcaagugcucccgcaacugcagcgggggcuucaagauccgggagauccagugcgucgacucccgcgaccaccggaaccuccgccccuuccacugccaguuccuggccggcaucccgcccccccugagcauguccugcaaccccgagccgugcgaggcguggcagguggagcccuggagccagugcucccggagcugcgggggcggggugcaggagcgcggcgucuucugccccgggggccucugcgacuggaccaagcggcccacgagcaccauguccugcaacgagcaccugugcugccacugggccaccggcaacugggaccugugcagcaccuccugcgggggcggguuccagaagcgcacggugcagugcgucccgagcgagggcaacaagaccgaggaccaggaccagugccucugcgaccacaagccccggccccccgaguucaagaagugcaaccagcaggccugcaagaaguccgccgaccugcugugcaccaaggacaagcucagcgccuccuucugccagacccugaaggcgaugaagaagugcagcgugccgacggugcgcgccgagugcugcuucuccugcccccagacccacaucacccacacccagcggcagcgccggcagcgccugcuccagaagagcaaggagcuguga

SEQ ID NO: 26323 - RNA, 4284 nt, Artificial Sequence
  derived and/or modified sequence opt1 from ADAMTS13__Homo_sapiens__NP_620594
augcaccagcgccacccccgggcccgcugcccgccccugugcguggccggcauccucgcgugcggguuccugcugggcugcugggggcccagccacuuccagcaguccugccuccaggcccuggagccccaggccgucagcuccuaccugagcccgggcgcgccccucaaggggcggccgcccucccccggcuuccagcgccagcggcagcgccagcggcgcgccgcgggcgggauccugcaccuggagcuccugguggccgugggccccgacgucuuccaggcccaccaggaggacaccgagcgguacgugcugaccaaccucaacaucggggccgagcugcugcgcgaccccagccucggcgcgcaguuccgggugcaccuggucaagauggugauccugacggagcccgagggggccccgaacaucaccgccaaccucaccuccagccugcuguccgugugcggcuggagccagaccaucaaccccgaggacgacacggaccccggccacgccgaccucguccuguacaucacccgcuucgaccuggagcuccccgacgggaaccgccaggugcgcggcgugacccagcucgggggcgccugcuccccgaccuggagcugccugaucacggaggacaccggcuucgaccugggggucaccaucgcgcacgagaucggccacuccuucgggcuggagcacgacggcgcccccgggagcggcugcggccccuccgggcacgugauggccagcgacggcgccgcgccccgggccgggcuggccugguccccgugcagccgccggcagcuccugucccugcucagcgccggccgcgcccggugcgugugggacccgccccgcccccagcccgggagcgccggccacccgcccgacgcgcagcccggccuguacuacuccgccaacgagcagugccgggucgccuucgggcccaaggccguggccugcaccuucgcgcgcgagcaccuggacaugugccaggcccucagcugccacacggacccccuggaccaguccagcugcucccgccugcucgugccccugcuggacggcaccgagugcggggucgagaaguggugcagcaagggccggugccgcucccucguggagcugaccccgaucgccgccgugcacgggcgguggagcuccuggggcccccgcagccccugcucccggagcugcggcgggggcgucgugacccgccggcgccagugcaacaacccccggccggcguucgggggccgcgccugcgugggcgccgaccugcaggccgagaugugcaacacgcaggccugcgagaagacccagcucgaguucaugucccagcagugcgcgcggaccgacgggcagccccugcgcagcucccccggcggggccagcuucuaccacuggggcgccgccgucccccacucccagggggacgcccugugccggcacaugugccgggcgaucggcgagagcuucaucaugaagcggggcgacuccuuccucgacgggacccgcugcaugccgagcggcccccgggaggacgggacgcugagccugugcguguccggcagcugccgcaccuucgggugcgacggccggauggacucccagcaggucugggaccgcugccaggugugcggcggggacaacuccacgugcagcccccgcaagggcagcuucaccgccgggcgggcccgcgaguacgugaccuuccugaccgugacccccaaccucaccuccguguacaucgccaaccaccggccgcuguucacgcaccuggccgugcgcaucggcgggcgguacgucguggcgggcaagaugagcaucucccccaacaccaccuaccccagccuccuggaggacggccgcguggaguaccgggucgcccugaccgaggaccgccucccccggcuggaggagauccgcaucugggggccgcugcaggaggacgccgacauccagguguaccggcgcuacggcgaggaguacgggaaccucacgcggcccgacaucaccuucaccuacuuccagcccaagccccgccaggccugggugugggcggccguccggggcccgugcuccgugagcugcggggccggccugcgcugggugaacuacuccugccuggaccaggcccggaaggagcucgucgagaccgugcagugccagggcagccagcagccgcccgccuggcccgaggcgugcgugcuggagcccugcccgcccuacugggccgucggggacuucggccccugcuccgccagcugcgggggcggccugcgcgagcggcccgugcgcugcguggaggcccaggggucccuccugaagacgcugccgcccgcccggugccgcgcgggcgcccagcagcccgccgucgcccucgagaccugcaacccccagcccugccccgcccgcugggaggugagcgagccgagcuccugcaccagcgccgggggcgccgggcuggcccuggagaacgagaccugcgugcccggcgccgacggccucgaggcgcccgucaccgaggggcccggcuccguggacgagaagcugccggcccccgagcccugcguggggaugagcugcccgcccggcugggggcaccuggacgccacguccgccggcgagaaggcccccagccccuggggcuccauccggaccggggcgcaggccgcccacgucuggacccccgccgccggcagcugcuccgugagcugcgggcgcggccucauggagcugcgguuccugugcauggacuccgcgcuccgcgugccgguccaggaggagcugugcgggcuggccagcaagcccggcucccggcgcgaggugugccaggccgugcccugccccgcccgguggcaguacaagcucgccgcgugcagcgucuccugcggccgcgggguggugcggcgcauccuguacugcgcccgggcccacggcgaggacgacggggaggagauccugcucgacacccagugccagggccugccgcgccccgagccccaggaggccugcagccuggagcccugcccgccccgguggaaggucaugucccucggccccugcagcgccuccugcgggcugggcacggcgcgccggagcguggccugcgugcagcuggaccaggggcaggacgucgagguggacgaggccgccugcgcggcccucgugcgcccggaggccagcguccccugccugaucgccgacugcaccuaccgguggcacgugggcaccuggauggagugcuccgugagcugcggggacggcauccagcgccggcgcgacacgugccugggcccccaggcccaggcgcccgucccggccgacuucugccagcaccuccccaagcccgugaccgugcgcgggugcugggccggccccugcgucgggcagggcaccccgucccuggugccccacgaggaggccgccgcgcccgggcggaccaccgccacgcccgccggcgccagccuggaguggucccaggcccgcggccuccuguucagcccggcgccccagccccggcgccugcuccccgggccgcaggagaacuccgugcagagcuccgccugcggccggcagcaccuggagcccaccgggaccaucgacaugcgcggccccgggcaggccgacugcgccgucgcgaucggccggccccugggcgagguggucacccuccgcgugcuggagagcucccugaacugcagcgccggggacaugcuccugcuguggggccggcucacguggcgcaagaugugccggaagcugcuggacaugaccuucuccagcaagaccaacacccucgugguccgccagcggugcgggcgcccgggcgggggcgugcugcugcgguacggcucccagcucgcccccgagacguucuaccgcgagugcgacaugcagcuguucgggcccuggggcgagaucgugagccccucccugagcccggccaccuccaacgccgggggcugccgccucuucaucaacgucgcgccccacgcccggaucgccauccacgcccuggccaccaacaugggcgcggggaccgagggcgccaacgccagcuacauccugauccgggacacgcacagccuccgcaccaccgccuuccacgggcagcagguccuguacugggaguccgagagcucccaggccgagauggaguucagcgagggcuuccugaaggcgcaggccucccuccgggggcaguacuggacccugcagagcugggugcccgagaugcaggacccccaguccuggaagggcaaggagggcacguga

SEQ ID NO: 26324 - RNA, 3672 nt, Artificial Sequence
  derived and/or modified sequence opt1 from ADAMTS14__Homo_sapiens__NP_542453
auggcgccccugcgcgcccuccugagcuaccugcucccgcugcacugcgcccugugcgccgccgccggcucccggacccccgagcuccaccugagcgggaagcuguccgacuacggcgugaccguccccugcagcacggacuuccgcgggcgguuccucucccacguggugagcggccccgccgcggccuccgccgggagcauggucguggacaccccgcccacccugccccgccacuccagccaccuccggguggcccgcagcccccugcacccgggcggcacccuguggcccgggcgggucggccgccacagccuguacuucaacgugacgguguucgggaaggagcuccaccuccggcugcgccccaaccggcgccuggucgugcccggcuccagcguggaguggcaggaggacuuccgggagcuguuccgccagccgcugcggcaggagugcgucuacaccgggggcgugaccggcaugcccggggcggccguggccaucuccaacugcgacggccucgccgggcugauccgcaccgacagcacggacuucuucaucgagccccuggagcggggccagcaggagaaggaggccuccggccgcacccacgucguguaccggcgcgaggcggugcagcaggagugggccgagcccgacggggaccuccacaacgaggccuucggccugggggaccugccgaaccuccugggccuggucggggaccagcucggcgacaccgagcggaagcgccgccacgccaagcccggcagcuacuccaucgaggugcugcugguggucgacgacagcguggugcgguuccacgggaaggagcacguccagaacuacgugcucacccugaugaacaucgucgacgagaucuaccacgacgagagccugggcgugcacaucaacaucgcccucgugcgccugaucauggucggguaccggcagucccugagccucaucgagcgcggcaaccccucccggagccuggagcaggucugccgcugggcgcacucccagcagcggcaggaccccagccacgccgagcaccacgaccacgugguguuccugacgcgccaggacuucgggccguccggcuacgcccccgugaccggcaugugccacccccuccggagcugcgcccugaaccacgaggacggguucuccagcgccuucgugaucgcgcacgagaccggccacguccuggggauggagcacgacggccaggggaacggcugcgccgacgagaccucccucggcagcgugauggcgccccuggugcaggccgccuuccaccgcuuccacuggucccggugcagcaagcuggagcucucccgcuaccugccgagcuacgacugccugcuggacgaccccuucgaccccgccuggccccagccgcccgagcuccccgggaucaacuacuccauggacgagcagugccgguucgacuucggcagcggguaccagacgugccuggccuuccgcaccuucgagccgugcaagcagcuguggugcucccaccccgacaaccccuacuucugcaagaccaagaaggggcccccgcucgacggcaccgagugcgcccccggcaaguggugcuucaagggccacugcaucuggaagucccccgagcagacguacgggcaggacggcggguggagcuccuggaccaaguucggcagcugcucccggagcugcggcgggggcguccgcucccggagccgcuccugcaacaaccccagcccggccuacgggggccggcugugccuggggcccauguucgaguaccaggugugcaacuccgaggagugccccggcaccuacgaggacuuccgcgcgcagcagugcgccaagcgcaacagcuacuacgugcaccagaacgccaagcacuccuggguccccuacgagccggacgacgacgcccagaagugcgagcucaucugccagagcgccgacaccggcgacgugguguucaugaaccaggucgugcacgacgggacgcggugcuccuaccgcgaccccuacagcgugugcgcgcggggcgagugcguccccguggggugcgacaaggaggugggcuccaugaaggccgacgacaagugcggggucugcggcggcgacaacagccacugccgcaccgugaaggggacccugggcaaggccuccaagcaggccggggcccugaagcucgugcagauccccgcgggcgcccggcacauccagaucgaggcccuggagaaguccccgcaccgcaucgucgugaagaaccaggugaccgggagcuucauccugaaccccaagggcaaggaggccacgagccggaccuucaccgccaugggccucgagugggaggacgcggucgaggacgccaaggagagccugaagaccuccgggccccugcccgaggccaucgccauccucgcgcugccgcccacggagggcgggccccgcagcucccuggccuacaaguacgugauccacgaggaccuccugccccugaucggcagcaacaacgugcuccuggaggagauggacaccuacgagugggcccugaaguccugggccccgugcagcaaggccugcggcgggggcauccaguucaccaaguacgggugccggcgccggcgcgaccaccacaugguccagcggcaccucugcgaccacaagaagcgccccaagcccauccggcgccggugcaaccagcacccgugcucccagcccgugugggugaccgaggaguggggcgcgugcagccgcuccugcgggaagcugggcguccagacgcggggcauccagugccugcucccccugagcaacgggacccacaaggugaugcccgccaaggccugcgccggcgaccgcccggaggcccggcgccccugccugcgcgugcccugccccgcgcaguggcggcucggggccuggucccagugcagcgcgaccugcggcgaggggauccagcagcgccaggucgugugccggaccaacgccaacucccugggccacugcgagggcgaccgcccggacaccgugcaggucugcagccugcccgccugcgggggcaaccaccagaacuccacggugcgggccgacgugugggagcucgggacccccgagggccagugggucccccagagcgagccgcugcaccccaucaacaagaucuccagcaccgagcccugcaccggggaccgcagcguguucugccagauggaggugcuggaccgguacugcuccauccccggcuaccaccgccucugcugcgucagcugcaucaagaaggccuccggcccgaaccccgggcccgaccccggcccgacgagccugccgcccuucuccacccccgggagcccccugcccggcccccaggaccccgccgacgccgcggagccgcccggcaagcccaccggguccgaggaccaccagcacggccgggccacccagcucccgggggcccuggacacgagcucccccggcacccagcaccccuucgcccccgagaccccgauccccggggccagcugguccaucagccccaccacgcccggcggccugccguggggguggacccagacccccacccccgugcccgaggacaagggccagccgggggaggaccuccgccaccccggcacgucccugcccgcggccagccccgugaccuga

SEQ ID NO: 26325 - RNA, 2853 nt, Artificial Sequence
  derived and/or modified sequence opt1 from ADAMTS15__Homo_sapiens__NP_620686
augcugcuccugggcauccugacccucgccuucgccgggcgcaccgcgggcgggagcgagcccgagcgggagguggucgugccgauccgccuggaccccgacaucaacggccggcgcuacuacuggcgggggcccgaggacuccggcgaccagggccugaucuuccagaucacggccuuccaggaggacuucuaccuccaccugacccccgacgcccaguuccuggccccggccuucagcaccgagcaccucggggugccccugcagggccugaccgggggcuccagcgaccuccgccggugcuucuacuccggggacgucaacgcggagcccgacagcuucgccgccgugucccugugcggcggccugcgcggggccuucggcuaccgcggggcggaguacgugaucagcccccucccgaacgccuccgcccccgccgcccagcggaacagccagggcgcgcaccuccugcagcggcgcggcguccccgggggccccuccggggacccgacgagccggugcggcguggccuccggguggaaccccgccauccugcgcgcccuggaccccuacaagccccggcgcgccggcuucggcgagagccggucccgccggcgcagcgggcgggcgaagcgcuucguguccaucccgcgcuacgucgagacccuggugguggccgacgagagcauggucaaguuccacggcgccgaccucgagcacuaccugcugacccuccuggccaccgccgcgcggcuguaccgccaccccuccauccucaaccccaucaacaucgugguggucaaggugcugcugcuccgggaccgcgacagcgggcccaaggugacgggcaacgccgcccugacccugcggaacuucugcgccuggcagaagaagcucaacaaggucagcgacaagcacccggaguacugggacaccgccauccuguucacccgccaggaccugugcggggcgacgaccugcgacacccucggcauggccgacgugggcaccaugugcgaccccaagcgguccugcagcgugaucgaggacgacgggcugcccuccgccuucacgaccgcccacgagcugggccacgucuucaacaugccccacgacaacgugaaggugugcgaggaggucuucgggaagcuccgcgcgaaccacaugaugagcccgacccugauccagaucgaccgggccaaccccugguccgccugcagcgccgccaucaucaccgacuuccuggacuccggccacggggacugccuccuggaccagcccagcaagcccaucucccugccggaggaccuccccggcgcgagcuacacgcugucccagcagugcgagcuggccuucggcguggggagcaagcccugcccguacaugcaguacugcaccaagcucuggugcaccggcaaggccaaggggcagauggucugccagacccgccacuuccccugggccgacggcacguccugcggcgaggggaagcugugccugaagggcgccugcguggagcggcacaaccugaacaagcaccgcguggacgggagcugggcgaagugggaccccuacggccccugcucccggaccugcgggggcggcguccagcucgcccgccggcagugcaccaacccgacccccgccaacgggggcaaguacugcgagggggugcgcgugaaguaccggagcugcaaccuggagcccugccccuccagcgccuccggcaagagcuuccgcgaggagcagugcgaggccuucaacggguacaaccacagcacgaaccggcugacccucgcggucgccugggugccgaaguacuccggcgugagcccccgcgacaagugcaagcugaucugccgcgccaacggcaccggguacuucuacguccuggcccccaaggugguggacggcacccucugcucccccgacagcacguccgucugcgugcaggggaagugcaucaaggcgggcugcgacgggaaccugggcagcaagaagcgguucgacaagugcggcgugugcgggggcgacaacaaguccugcaagaaggucaccgggcuguucaccaagccgaugcacggcuacaacuucgugguggccauccccgccggggccagcuccaucgacauccgccagcggggcuacaagggccucaucggggacgacaacuaccuggcccugaagaacagccagggcaaguaccuccugaacgggcacuucgucguguccgcgguggagcgcgaccuggucgugaagggcagccuccugcgguacuccggcaccgggacggccguggagagccugcaggccucccgccccauccucgagccccugaccgucgaggugcugagcgugggcaagaugaccccgccccggguccgcuacuccuucuaccuccccaaggagccccgggaggacaagagcagccacccgaaggacccccgcgggcccuccgugcugcacaacagcgugcugucccucagcaaccaggucgagcagcccgacgaccggccgcccgcccgcuggguggccggcuccugggggcccugcagcgcguccugcggcagcggccugcagaagcgggccguggacugccgcggguccgccggccagcggaccgucccggccugcgacgccgcgcaccgccccguggagacccaggccugcggggagcccugccccacgugggagcugagcgccugguccccgugcagcaaguccugcggccggggguuccagcgccggagccucaagugcgugggccacggcgggcgccugcuggcccgggaccagugcaaccuccaccgcaagccccaggagcuggacuucugcguccugcgccccugcuga

SEQ ID NO: 26326 - RNA, 3675 nt, Artificial Sequence
  derived and/or modified sequence opt1 from ADAMTS16__Homo_sapiens__NP_620687
augaagccccgcgcccggggcuggcgcgggcuggccgcgcucuggaugcugcuggcccagguggccgagcaggccccggccugcgcgaugggccccgccgccgccgcgcccgggagccccuccgucccgcggcccccgccgcccgccgagcgccccggcuggauggagaagggggaguacgaccucgugagcgccuacgagguggaccaccggggcgacuacgucucccacgagaucaugcaccaccagcgccggcgccgggccgugcccgugagcgaggucgagucccugcaccuccgccugaagggcagccggcacgacuuccacauggaccugcgcaccuccagcucccugguggcccccggguucaucgugcagacccucggcaagacggggaccaagagcguccagacccugccgcccgaggacuucugcuucuaccagggcucccugcggagccaccgcaacuccagcguggcgcucuccacgugccaggggcugagcggcaugauccggaccgaggaggccgacuacuuccugcgcccccuccccucccaccugagcuggaagcugggccgggccgcccagggguccagcccgagccacgugcucuacaagcgcuccaccgagccccacgcccccggcgcgagcgagguccuggugaccucccggaccugggagcuggcccaccagccccuccacagcuccgaccugcgccuggggcucccgcagaagcagcacuucugcggccggcgcaagaaguacaugccccagccgcccaaggaggaccuguucauccugcccgacgaguacaagagcugccuccgccacaagcggucccugcugcgcagccaccggaacgaggagcucaacguggagacgcuggucgugguggacaagaagaugaugcagaaccacggccacgagaacaucaccaccuacguccugaccauccucaacaugguguccgcccuguucaaggacgggacgaucggcgggaacaucaacaucgccaucgugggccugauccuccuggaggacgagcagcccgggcuggucaucagccaccacgccgaccacacccucuccagcuucugccaguggcaguccggccugaugggcaaggacgggacccgccacgaccacgcgauccugcucaccggccuggacaucugcagcuggaagaacgagcccugcgacacgcugggguucgcccccaucuccggcaugugcagcaaguaccgguccugcaccaucaacgaggacaccgggcucggccuggccuucaccaucgcccacgagagcggccacaacuucgggaugauccacgacggcgaggggaacaugugcaagaaguccgagggcaacaucaugagccccacgcuggccgggcgcaacggcguguucagcuggucccccugcagccggcaguaccuccacaaguuccuguccaccgcgcaggccaucugccuggccgaccagcccaagccggugaaggaguacaaguaccccgagaagcugcccggcgagcucuacgacgccaacacccagugcaaguggcaguucggggagaaggcgaagcugugcaugcuggacuucaagaaggacaucugcaaggcccucuggugccaccgcaucggccggaagugcgagaccaaguucaugcccgccgccgaggggacgaucugcggccacgacauguggugccgcggcgggcagugcgucaaguacggcgacgaggggccgaagcccacccacggccacuggagcgacugguccagcuggucccccugcagccggaccugcgggggcggcgugucccaccgcagccggcugugcaccaaccccaagccgucccacgggggcaaguucugcgaggggagcacgcgcacccugaagcucugcaacucccagaagugcccccgggacagcgucgacuuccgcgccgcgcagugcgccgagcacaacucccggcgcuuccggggccgccacuacaaguggaagcccuacacccagguggaggaccaggaccugugcaagcuguacugcaucgccgagggguucgacuucuucuucagccucuccaacaaggugaaggacggcacccccugcagcgaggacagccgcaacgucugcaucgacggcaucugcgagcggguggggugcgacaacgugcugggcuccgacgccgucgaggacgugugcggggugugcaacggcaacaacagcgccugcacgauccaccgcgggcuguacaccaagcaccaccacaccaaccaguacuaccacauggucaccaucccguccggcgcgcggagcauccgcaucuacgagaugaacguguccacgagcuacaucuccgugcggaacgcccuccgccgguacuaccugaacggccacuggaccgucgacuggcccgggcgcuacaaguucagcggcaccaccuucgacuaccggcgcuccuacaacgagcccgagaaccugaucgccaccgggcccacgaacgagacccucaucguggagcugcuguuccagggccggaacccggggguggccugggaguacagcaugccccgccucggcaccgagaagcagccgcccgcccagcccuccuacaccugggcgaucguccggagcgagugcuccgugagcugcggcgggggccagaugacggugcgcgaggggugcuaccgggaccugaaguuccaggucaacauguccuucugcaaccccaagacccgccccgugaccggccuggugcccugcaaggucagcgccugcccgcccuccuggagcgugggcaacugguccgccugcagccggaccugcgggggcggggcccagagccgccccgugcagugcacgcggcgcguccacuacgacuccgagccggugcccgcgagccucugcccccagcccgccccguccagccggcaggccugcaacucccagagcugcccgcccgccugguccgccggccccugggcggagugcagccacacgugcgggaagggcuggcgcaagcgcgccguggccugcaaguccaccaaccccagcgcccgggcccagcugcugcccgacgcggucugcaccuccgagcccaagccccgcaugcacgaggccugccuccugcagcggugccacaagccgaagaagcugcaguggcucgugagcgccuggucccagugcagcgugaccugcgagcgcggcacccagaagcgguuccugaagugcgccgagaaguacgucuccgggaaguaccgcgagcuggccagcaagaagugcucccaccuccccaagcccagccuggagcuggagcgggcgugcgcgccccucccgugcccccgccacccgcccuucgccgccgccggccccucccgggggagcugguucgccagccccuggucccagugcaccgccagcugcggcgggggcgugcagacccgcuccgugcagugccuggccggcgggcggcccgccagcggcugccugcuccaccagaagcccuccgcgagccuggccugcaacacgcacuucugcccgaucgccgagaagaaggacgccuucugcaaggacuacuuccacuggugcuaccuggucccccagcacgggaugugcucccacaaguucuacggcaagcagugcugcaagaccugcagcaaguccaaccucuga

SEQ ID NO: 26327 - RNA, 3288 nt, Artificial Sequence
  derived and/or modified sequence opt1 from ADAMTS17__Homo_sapiens__NP_620688
augugcgacggcgcccugcucccgccccuggugcugcccguccuccugcugcucgugugggggcuggaccccggcaccgccgugggggacgcggccgccgacgucgagguggugcugcccuggcgcguccggcccgacgacgugcaccucccgccccugcccgccgcccccggcccccgccggcgccggcgcccccggacgcccccggcggcgccccgcgcccggcccggggagcgcgcccugcuccugcaccuccccgccuucggccgggaccucuaccugcagcugcgccgggaccuccgcuuccugagccggggcuucgagguggaggaggccggggccgcccgccggcgcggccggccggccgagcugugcuucuacuccgggcgcguccucggccaccccgggagccuggugucccugagcgcgugcggcgccgccggcgggcucgugggccugauccagcuggggcaggagcagguccucauccagccccugaacaacucccagggccccuucagcggccgggagcaccugauccgccgcaaguggucccucaccccgagccccuccgccgaggcccagcggcccgagcagcugugcaaggugcugaccgagaagaagaagcccaccugggggcgcccgagccgggacuggcgcgagcggcgcaacgcgauccggcucaccuccgagcacacgguggagacccuggucguggccgacgccgacauggugcaguaccacggcgccgaggccgcgcagcgcuucauccugaccgucaugaacaugguguacaacauguuccagcaccagagccucgggaucaagaucaacauccaggugaccaagcugguccugcuccggcagcgccccgccaagcuguccaucggccaccacggggagcggagccuggaguccuucugccacuggcagaacgaggaguacggcggcgcccgcuaccucgggaacaaccaggugcccggcgggaaggacgacccgccccugguggacgccgccgucuucgugacgcggaccgacuucugcguccacaaggacgagcccugcgacaccgugggcaucgcguaccucgggggcgugugcagcgccaagcgcaagugcguccuggccgaggacaacggccugaaccuggccuucaccaucgcgcacgagcuggggcacaaccugggcaugaaccacgacgacgaccacuccagcugcgccgggcggucccacaucaugagcggcgagugggugaaggggcgcaaccccagcgaccuguccuggagcuccugcagccgggacgaccuggagaacuuccucaaguccaaggugagcacgugccugcuggucaccgacccgcgcucccagcacaccgugcggcucccccacaagcugcccggcaugcacuacagcgccaacgagcagugccagauccuguucggcaugaacgccaccuucugccgcaacauggagcaccucaugugcgccgggcuguggugccugguggagggcgacacguccugcaagaccaagcucgacccgccccuggacgggaccgagugcggcgcggacaaguggugccgcgccggcgagugcgucagcaagacccccauccccgagcacguggacggggacuggucccccuggggcgccuggagcaugugcucccggacgugcgggaccggcgcccgcuuccggcagcgcaagugcgacaacccgccgcccgggcccggcggcacccacugccccggggccagcguggagcacgcggucugcgagaaccugcccugccccaagggccuccccuccuuccgggaccagcagugccaggcccacgaccgccugagcccgaagaagaaggggcugcucaccgccgugguggucgacgacaagcccugcgagcuguacugcagcccccugggcaaggagagcccccuccugguggccgaccgggugcuggacgggacgccgugcggccccuacgagaccgaccucugcguccacggcaagugccagaagaucgggugcgacggcaucaucggguccgccgcgaaggaggaccgcugcggcgugugcagcggggacggcaagaccugccaccuggugaagggcgacuucagccacgcccgggggaccgcccugaaggacuccggcaaggggagcaucaacuccgacuggaagaucgagcuccccggcgaguuccagaucgccgggacgaccguccgcuacgugcggcgcggccugugggagaagaucagcgcgaagggccccaccaagcugccgcuccaccugauggugcuccuguuccacgaccaggacuacgggauccacuacgaguacaccguccccgugaaccggacggccgagaaccaguccgagcccgagaagccgcaggacagccuguucaucuggacccacuccggcugggaggggugcagcgugcagugcggcggcggggagcgccggaccaucgucuccugcacccgcaucgugaacaagacgaccacccuggugaacgacagcgacugcccccaggccucccggcccgagccccagguccgccggugcaaccuccacccgugccagagccgcuggguggccggccccuggucccccugcagcgcgaccugcgagaagggguuccagcaccgggaggugaccugcgucuaccagcugcagaacggcacgcacguggccacccgcccccuguacugcccggggccccgccccgccgccgugcaguccugcgagggccaggacugccucagcaucugggaggccuccgaguggagccagugcagcgccuccugcggcaagggggucuggaagcggaccguggcgugcaccaacagccagggcaagugcgacgccuccacgcgcccccgggccgaggaggccugcgaggacuacagcgggugcuacgaguggaagaccggcgacuggagcacgugcuccuccacgugcgggaagggccugcagucccgcgugguccagugcaugcacaaggugaccggccggcacggguccgagugcccggcccugagcaagcccgcgcccuaccgccagugcuaccaggaggugugcaacgaccggaucaacgccaacaccaucaccagcccccgccucgccgcccugaccuacaagugcacccgggaccaguggaccgucuacugccgcgugauccgggagaagaaccugugccaggacaugcgcugguaccagcggugcugccagaccugccgcgacuucuacgcgaacaagaugcggcagccgccgcccaacuccuga

SEQ ID NO: 26328 - RNA, 3666 nt, Artificial Sequence
  derived and/or modified sequence opt1 from ADAMTS18__Homo_sapiens__NP_955387
auggagugcgcccugcuccuggccugcgcguuccccgccgccggcagcgggccgccccgcggccuggccgggcucggccggguggccaaggcgcugcagcugugcugccucugcugcgccuccgucgccgccgcgcuggccagcgacuccagcuccggggccagcggccugaacgacgacuacguguucgugacccccgucgagguggacuccgccggcagcuacaucucccacgacauccuccacaacgggcgcaagaagcggagcgcccagaacgcgcgcuccagccugcacuaccgguucuccgccuucggccaggagcugcaccucgagcugaagcccagcgccauccuguccagccacuucaucgugcagguccucgggaaggacggcgccuccgagacccagaagccggaggugcagcagugcuucuaccagggguucauccgcaacgacagcuccagcagcguggccgucuccacgugcgcgggccugagcggccugauccggacccgcaagaacgaguuccucaucagcccccugccccagcugcucgcccaggagcacaacuacuccucccccgccgggcaccacccgcacgugcuguacaagcggaccgccgaggagaagauccagcgcuaccggggcuaccccgggagcggccgcaacuaccccggcuacucccccagccacaucccgcacgccucccagagccgggagaccgaguaccaccaccgccggcugcagaagcagcacuucugcgggcgccggaagaaguacgcgcccaagccgcccacggaggacaccuaccuccgcuucgacgaguacggcuccagcgggcggccccgccgguccgccggcaagagccagaaggggcugaacguggagacccuggucguggccgacaagaagaugguggagaagcacggcaagggcaacgucaccacguacauccucaccgugaugaacaugguguccgggcuguucaaggacggcaccaucgggagcgacaucaacgucgugguggucucccugauccuccuggagcaggagcccggcgggcugcucaucaaccaccacgccgaccagagccugaacuccuucugccaguggcagagcgcccugaucggcaagaacggcaagcgccacgaccacgcgauccuccugaccggguucgacaucugcagcuggaagaacgagcccugcgacacgcugggcuucgcccccaucuccgggaugugcagcaaguaccgcuccugcaccaucaacgaggacaccggccucgggcuggccuucaccaucgcccacgagagcggccacaacuucggcaugauccacgacggggagggcaacccgugccggaaggcggaggggaacaucaugucccccacgcugaccggcaacaacggcguguucagcugguccagcugcucccgccaguaccucaagaaguuccugagcacgccccaggccgggugccugguggacgagcccaagcaggccggccaguacaaguacccggacaagcuccccgggcagaucuacgacgccgacacccagugcaaguggcaguucggcgccaaggcgaagcugugcucccugggguucgucaaggacaucugcaagagccucuggugccaccgggugggccaccgcugcgagaccaaguucaugcccgccgccgagggcaccgucugcgggcuguccauguggugccggcagggccagugcgugaaguucggggagcugggcccccgcccgauccacgggcaguggagcgccugguccaaguggagcgagugcucccggaccugcggcggcggggugaaguuccaggagcgccacugcaacaaccccaagccccaguacggcgggcuguucugcccgggcagcagccggaucuaccagcucugcaacaucaaccccugcaacgagaacucccuggacuuccgcgcccagcagugcgcggaguacaacagcaagcccuuccgggggugguucuaccaguggaagcccuacaccaaggucgaggaggaggaccgcugcaagcuguacugcaaggccgagaacuucgaguucuucuucgccauguccggcaaggugaaggacggcacgccgugcagccccaacaagaacgacgugugcaucgacggggucugcgagcucgugggcugcgaccacgagcugggguccaaggccgugagcgacgccugcggcgucugcaagggggacaacuccacgugcaaguucuacaagggccuguaccucaaccagcacaaggcgaacgaguacuaccccguggugcugauccccgccggcgcccggagcaucgagauccaggagcugcaggucuccagcuccuaccucgccgugcgcagccugucccagaaguacuaccugaccgggggcuggagcaucgacuggccgggggaguuccccuucgcgggcaccaccuucgaguaccagcgguccuucaaccgccccgagcggcucuacgcccccggcccgaccaacgagacccugguguucgagauccugaugcaggggaagaaccccggcaucgccuggaaguacgcccuccccaaggucaugaacgggacgcccccggccaccaagcgccccgcguacaccuggagcaucgugcaguccgagugcagcguguccugcggcgggggcuacaucaacgucaaggccaucugccugcgggaccagaacacccaggugaacagcagcuucugcuccgccaagaccaagcccgugacggagcccaagaucugcaacgccuucagcugcccggccuacuggaugcccggcgagugguccacgugcagcaaggcgugcgccgggggccagcagucccgcaagauccagugcguccagaagaagcccuuccagaaggaggaggccgugcugcacagccucugccccguguccaccccgacccagguccaggccugcaacagccacgccugcccgccccaguggucccuggggcccuggagccagugcuccaagaccugcggccgcggggugcggaagcgcgagcugcucugcaagggcagcgcggccgagacccugcccgagucccagugcaccagccugccccggcccgagcuccaggagggcugcgugcuggggcgcugcccgaagaacucccggcugcagugggucgccagcuccuggagcgagugcuccgcgaccugcggccucggggugcgcaagcgggagaugaagugcagcgagaagggcuuccaggggaagcugaucaccuuccccgagcgccggugccgcaacaucaagaagcccaaccuggaccucgaggagacgugcaaccggcgcgccugccccgcccacccgguguacaacauggucgccggcugguacagccugcccuggcagcagugcaccgugaccugcggcgggggcgugcagacccgguccguccacugcgugcagcaggggcgccccagcuccagcugccugcuccaccagaagcccccggugcugcgggccugcaacacgaacuucugccccgcccccgagaagcgcgaggaccccuccugcgucgacuucuucaacuggugccaccuggugccgcagcacggcgugugcaaccacaaguucuacggcaagcagugcugcaagagcugcacccggaagaucuga

SEQ ID NO: 26329 - RNA, 3624 nt, Artificial Sequence
  derived and/or modified sequence opt1 from ADAMTS19__Homo_sapiens__NP_598377
augcgccugacccacaucugcugcugcugccuccuguaccagcugggcuuccucagcaacgggaucguguccgagcugcaguucgcccccgaccgggaggagugggaggucguguucccggcccuguggcgccgggagcccguggaccccgcgggcgggagcggcggguccgccgaccccggcuggguccgcggcgucgggggcgggggcagcgcccgggcccaggccgcgggguccagccgcgaggugcgguccguggccccggugccccucgaggagcccguggagggccgcagcgagucccggcugcggcccccgccgcccagcgagggcgaggaggacgaggagcuggagucccaggagcucccccgcgggagcuccggcgccgccgcgcugagcccgggggcccccgccuccuggcagcccccgcccccgccccagcccccgcccagcccgccgcccgcccagcacgccgagcccgacggcgacgagguccugcuccgcauccccgcguucucccgggaccuguaccugcuccugcgccgggacggccgcuuccuggccccgcgguucgccguggagcagcgccccaaccccgggcccggccccaccggggccgccagcgcgccccagccgcccgccccgcccgacgccggcugcuucuacacgggggccgugcuccggcaccccggcucccuggccagcuucagcacgugcggcgggggccugaugggguucauccagcucaacgaggacuucaucuucaucgagccccugaacgacaccauggcgaucaccggccacccccaccgcgucuaccggcagaagcgcuccauggaggagaaggugacggagaaguccgcccugcacucccacuacugcgggaucaucagcgacaagggccgcccccggucccgcaagaucgccgagagcggccgggggaagcgcuacuccuacaagcucccccaggaguacaacaucgagaccguggucguggccgaccccgccauggugagcuaccacggcgcggacgccgcccggcgcuucauccugaccauccugaacauggucuucaaccucuuccagcacaagucccugagcguccaggugaaccugcgggucaucaagcucauccugcugcacgagaccccgcccgagcucuacaucgggcaccacggcgagaagaugcuggaguccuucugcaaguggcagcacgaggaguucgggaagaagaacgacauccaccuggagaugagcaccaacuggggcgaggacaugaccagcguggacgccgcgauccucaucacccgcaaggacuucugcgugcacaaggacgagcccugcgacaccgugggcaucgccuaccugagcgggaugugcuccgagaagcggaagugcaucaucgccgaggacaacggccugaaccucgccuucacgaucgcccacgagauggggcacaacaugggcaucaaccacgacaacgaccaccccagcugcgcggacggccugcacaucauguccggggaguggaucaagggccagaaccugggggacgugagcuggucccgcugcagcaaggaggaccucgagcgguuccugcgcagcaaggccuccaacugccugcuccagaccaacccccagagcgucaacuccgugauggugcccagcaagcugcccggcaugaccuacaccgccgacgagcagugccagauccuguucgggccccucgccuccuucugccaggagaugcagcacgucaucugcacgggccuguggugcaagguggagggcgagaaggagugccggaccaagcuggacccgcccauggacgggaccgacugcgaccugggcaaguggugcaaggccggggagugcaccagccgcacguccgcgcccgagcaccucgccggcgaguggagccuguggucccccugcagccggaccugcuccgccgggaucagcucccgcgagcggaagugcccgggccuggacagcgaggcccgcgacugcaacggcccccggaagcaguaccgcaucugcgagaacccgcccugccccgccgggcuccccggcuuccgcgacuggcagugccaggcguacuccgugcggaccagcucccccaagcacauccugcaguggcaggccguccuggacgaggagaagcccugcgcccucuucugcagccccguggggaaggagcagcccauccugcugagcgagaaggugauggacggcaccuccugcggguaccagggccucgacaucugcgccaacggccgcugccagaaggucgggugcgacggccugcuggggagccucgcgcgggaggaccacugcggcgugugcaacgggaacggcaaguccugcaagaucaucaagggcgacuucaaccacacgcgcggggccggcuacguggagguccuggugauccccgccggggcccggcgcaucaagguggucgaggagaagccggcccacagcuaccuggcgcuccgggacgccggcaagcaguccaucaacagcgacuggaagaucgagcacuccggcgccuucaaccuggccgggaccaccgugcacuacgugcgccggggccugugggagaagaucagcgccaaggggcccaccacggcgccccuccaccuccugguccugcuguuccaggaccagaacuacggccugcacuacgaguacaccauccccuccgacccgcuccccgagaaccagagcuccaaggcccccgagccccuguucauguggacccacaccagcugggaggacugcgacgccacgugcgggggcggcgagcgcaagaccaccguguccugcaccaagaucaugagcaagaacaucuccaucguggacaacgagaagugcaaguaccugacgaagccggagccccagauccggaagugcaacgagcagcccugccagacccgcuggaugaugaccgaguggacccccugcagccggaccugcgggaagggcaugcagucccgccaggucgccugcacgcagcagcucagcaacgggacccugauccgggcccgcgagcgggacugcaucggcccgaagcccgcguccgcccagcgcugcgaggggcaggacugcaugaccgugugggaggccggcguguggagcgagugcagcgucaagugcggcaaggggauccggcaccgcaccgugcggugcacgaacccccgcaagaagugcgugcuguccacccgcccccgggaggccgaggacugcgaggacuacagcaagugcuacgucuggcgcaugggcgacugguccaagugcagcaucacgugcgggaagggcaugcagucccgggugauccagugcaugcacaagaucaccgggcgccacggcaacgagugcuucagcuccgagaagccggcggccuaccggcccugccaccuccagcccugcaacgagaagaucaacgugaacaccaucaccagcccccgccuggccgcccugaccuucaagugccucggcgaccaguggccggucuacugccgggugauccgcgagaagaaccugugccaggacaugcggugguaccagcgcugcugcgagaccugccgggacuucuacgcccagaagcugcagcagaaguccuga

SEQ ID NO: 26330 - RNA, 2904 nt, Artificial Sequence
  derived and/or modified sequence opt1 from ADAMTS1__Homo_sapiens__NP_008919
augcagcgcgccgugcccgagggcuucgggcggcgcaagcugggcagcgacauggggaacgccgagcgggcgccgggcucccgcagcuucgggcccguccccacccuccugcugcucgccgccgcccugcuggccguguccgacgcgcucggccggcccagcgaggaggacgaggagcugguggucccggagcuggagcgcgcccccggccacgggaccacgcggcuccgccugcacgccuucgaccagcagcuggaccucgagcugcggcccgacuccagcuuccuggcccccggcuucacccuccagaacguggggcgcaaguccggcagcgagaccccgcugcccgagaccgaccuggcgcacugcuucuacuccgggacggugaacggcgaccccagcuccgccgccgcccucagccugugcgagggcguccgcggggccuucuaccugcucggcgaggcguacuucauccagccccugccggccgccuccgagcggcuggccaccgccgcgcccggggagaagccgcccgcgccccuccaguuccaccuccugcggcgcaaccggcagggcgacgugggcgggaccugcggcguggucgacgacgagccccgccccaccgggaaggccgagacggaggacgaggacgagggcaccgagggggaggacgagggcgcccaguggagcccccaggacccggcccugcagggcguggggcagcccaccggcaccggguccauccggaagaagcgcuucgugagcucccaccgguacgucgagacgaugcugguggccgaccagagcauggccgaguuccacggcuccgggcugaagcacuaccuccugacccuguucagcguggccgcccgccucuacaagcaccccagcauccggaacuccgucagccuggugguggucaagauccuggugauccacgacgagcagaagggccccgaggugaccuccaacgccgcgcucacccugcgcaacuucugcaacuggcagaagcagcacaacccgcccagcgaccgcgacgccgagcacuacgacacggccauccuguucacccggcaggaccucugcggcucccagaccugcgacacccuggggauggccgacgucggcacggugugcgaccccagccgcuccugcagcgugaucgaggacgacgggcugcaggcggccuucaccaccgcccacgagcucggccacgucuucaacaugccccacgacgacgccaagcagugcgccucccugaacggggugaaccaggacagccacaugauggcguccaugcugagcaaccucgaccacucccagccguggagccccugcuccgccuacaugaucaccagcuuccuggacaacggccacggcgagugccugauggacaagccccagaacccgauccagcuccccggggaccugcccggcacguccuacgacgccaaccggcagugccaguucaccuucggggaggacagcaagcacugccccgacgccgccuccacgugcagcacccuguggugcaccggcaccagcggcgggguccuggugugccagaccaagcacuucccgugggcggacggcaccuccugcggggagggcaaguggugcaucaacgggaagugcgugaacaagacggaccgcaagcacuucgacacccccuuccacggcagcuggggcaugugggggcccuggggcgacugcucccggaccugcgggggcgggguccaguacaccaugcgcgagugcgacaaccccgugccgaagaacggcggcaaguacugcgaggggaagcgggugcgcuaccggagcugcaaccucgaggacugccccgacaacaacggcaagacguuccgcgaggagcagugcgaggcccacaacgaguucuccaaggccagcuucggguccggccccgccgucgaguggauccccaaguacgccggggugagcccgaaggaccggugcaagcugaucugccaggcgaagggcaucggcuacuucuucgugcugcagcccaaggucguggacgggacccccugcucccccgacagcaccuccgugugcguccagggccagugcgugaaggccgggugcgaccgcaucaucgacagcaagaagaaguucgacaagugcggcgugugcgggggcaacggcuccacgugcaagaagaucagcggguccgucaccagcgccaagccgggcuaccacgacaucaucaccauccccaccggggccaccaacaucgaggugaagcagcggaaccagcgcggcucccggaacaacggcagcuuccucgcgaucaaggccgccgacgggaccuacauccugaacggcgacuacacgcugagcacccucgagcaggacaucauguacaagggggugguccugcgcuacuccggcagcuccgccgcccuggagcggauccgcagcuucagcccccucaaggagccccugaccauccaggugcugaccguggggaacgcgcuccggccgaagaucaaguacacguacuucgucaagaagaagaaggaguccuucaacgccauccccaccuucuccgccugggugaucgaggaguggggcgagugcagcaaguccugcgagcugggcuggcagcgccgccugguggagugccgggacaucaacgggcagcccgccagcgagugcgccaaggaggucaagcccgcguccacccgcccgugcgccgaccaccccugcccccaguggcagcucggcgaguggagcuccugcagcaagaccugcgggaagggcuacaagaagcggucccugaagugccugagccacgacgggggcgugcucucccacgagagcugcgacccgcugaagaagcccaagcacuucaucgacuucugcacgauggccgagugcuccuga

SEQ ID NO: 26331 - RNA, 5733 nt, Artificial Sequence
  derived and/or modified sequence opt1 from ADAMTS20__Homo_sapiens__NP_079279
auguggguggccaaguggcugaccgggcuccuguaccaccugagccucuucaucacccgguccugggagguggacuuccacccccggcaggaggcccuggugcgcacccugaccagcuacgagguggucauccccgagcgggugaacgaguucggggagguguucccccagucccaccacuucagccgccagaagcgguccagcgaggcgcucgagcccaugcccuuccgcacccacuaccgguucaccgccuacgggcagcuguuccagcugaaccucaccgccgacgccuccuuccuggccgcgggguacaccgagguccaccugggcaccccggagcgcggggccugggagagcgacgccggccccuccgaccuccggcacugcuucuaccgcggccaggugaacagccaggaggacuacaaggccguggucucccugugcgggggccugaccgggacguucaagggccagaacggggaguacuuccucgagcccaucaugaaggcggacggcaacgaguacgaggacggccacaacaagccccaccugaucuaccggcaggaccugaacaacagcuuccuccagacccugaaguacugcuccgugagcgagucccagaucaaggagaccagccugcccuuccacaccuacuccaacaugaacgaggaccucaacgugaugaaggagcgcguccuggggcacacgagcaagaacgugccccugaaggacgagcggcgccacucccggaagaagcgccucaucagcuacccccgguacaucgagaucauggugaccgccgacgccaaggucgugagcgcccacggcuccaaccugcagaacuacauccugacccucaugagcaucguggccaccaucuacaaggaccccuccaucgggaaccugauccacaucgucguggugaagcuggucaugauccaccgcgaggaggagggcccggugaucaacuucgacggcgcgacgacccucaagaacuucugcagcuggcagcagacccagaacgaccuggacgacgugcaccccucccaccacgacaccgccguccugaucacgcgggaggacaucugcagcuccaaggagaagugcaacaugcucgggcugagcuaccugggcaccaucugcgacccccuccaguccugcuucaucaacgaggagaaggggcugaucagcgccuucaccaucgcccacgagcugggccacacccucggggugcagcacgacgacaacccccgcugcaaggagaugaaggucacgaaguaccacgugauggccccggcgcuguccuuccacaugagccccugguccuggagcaacugcucccggaaguacgugaccgaguuccuggacaccggcuacggcgagugccuccuggacaagcccgacgaggagaucuacaaccugcccagcgagcucccggggucccgcuacgacggcaacaagcagugcgagcuggccuucgggcccggcagccagaugugcccccacaucaacaucugcaugcaccuguggugcaccuccacggagaagcuccacaaggggugcuucacccagcacgugccgcccgccgacggcaccgacugcggccccgggaugcacugccgccacggccugugcgugaacaaggagaccgagacgcggcccgugaacggggaguggggccccugggagcccuacagcagcugcucccggaccugcgggggcggcaucgagagcgccacccggcgcugcaaccggcccgagccccgcaacgggggcaacuacugcgucgggcggcgcaugaaguuccgguccugcaacaccgacagcugcccgaagggcacgcaggacuuccgcgagaagcagugcuccgacuucaacggcaagcaccuggacaucagcgggauccccuccaacgugcgguggcugccccgcuacagcggcaucgggaccaaggaccggugcaagcucuacugccagguggccggcaccaacuacuucuaccugcugaaggacauggucgaggacgggacccccugcggcaccgagacgcacgacaucugcgugcagggccagugcauggcggccgggugcgaccacgugcucaacuccagcgccaagaucgacaagugcggcgucugcgggggcgacaacuccagcugcaagaccaucaccgggguguucaacuccagccacuacggcuacaacguggucgugaagaucccggccggcgccaccaacguggacauccgccaguacuccuacagcgggcagcccgacgacuccuaccuggcgcugagcgacgccgagggcaacuuccucuucaacgggaacuuccugcugagcacguccaagaaggagaucaacguccagggcacccggaccgugaucgaguacagcggguccaacaacgccguggagcgcaucaacagcaccaaccggcaggagaaggagcucauccugcagguccugugcgugggcaaccucuacaaccccgacgugcacuacuccuucaacaucccccuggaggagcgcagcgacauguucacgugggacccguacggccccugggaggggugcaccaagaugugccagggccugcagcggcgcaacaucacgugcauccacaaguccgaccacagcgucguguccgacaaggagugcgaccaccucccccugcccagcuucgugacccaguccugcaacacggacugcgagcugcgcuggcacgucaucggcaagagcgagugcuccagccagugcggccagggguaccggacccucgacauccacugcaugaaguacuccauccacgagggccagaccguccaggucgacgaccacuacugcggcgaccagcugaagccgcccacccaggagcugugccacgggaacugcgucuucacgcgcuggcacuacagcgaguggucccagugcagccgguccugcggcgggggcgagcgcagccgggagagcuacugcaugaacaacuucggccaccgccucgccgacaacgagugccaggagcugucccgggugacccgcgagaacugcaacgaguucagcugccccuccugggcggccagcgagugguccgagugccuggugaccugcgggaagggcaccaagcagcggcaggucuggugccagcucaacguggaccaccugagcgacggguucugcaacuccagcacgaagcccgagucccugagcccgugcgagcuccacacgugcgccuccuggcaggucggccccugggggcccugcaccaccacgugcggccacggcuaccagaugcgcgacgucaagugcgugaacgagcuggccagcgccgugcuggaggacaccgagugccacgaggcgucccggcccagcgaccgccaguccugcguccucaccccgugcagcuucaucuccaagcuggagaccgcccugcuccccacggugcugaucaagaagauggcccaguggcggcacgggagcuggacccccugcuccgugagcugcggccgcgggacccaggcccgguacgucagcugccgcgacgcccuggaccggaucgcggacgaguccuacugcgcccaccucccccgcccggccgagaucugggacugcuucacccccugcggcgaguggcaggccggggacuggagccccugcuccgccagcugcggccacggcaagacgacccgccaggugcugugcaugaacuaccaccagccgaucgacgagaacuacugcgaccccgaggugcgcccccugauggagcaggagugcucccucgcggccugcccgcccgcccacagccacuuccccuccagccccguccagcccuccuacuaccugagcaccaaccugccgcucacccagaagcuggaggacaacgagaaccagguggugcaccccuccguccgggggaaccaguggcgcacgggccccugggggagcugcuccagcuccugcagcggcgggcugcagcaccgcgccguggugugccaggacgagaacggccaguccgcgagcuacugcgacgccgccuccaagcccccggagcuccagcagugcggccccgggcccugcccccaguggaacuacggcaacuggggcgagugcagccagaccugcggcggcgggaucaagagccggcuggucaucugccaguucccgaacggccagauccuggaggaccacaacugcgagaucgugaacaagccgcccuccgucauccagugccacaugcacgccugccccgccgacgugagcuggcaccaggagccguggaccuccugcagcgcguccugcgggaagggccgcaaguaccgggagguguucugcaucgaccaguuccagcgcaagcucgaggacaccaacugcagccagguccagaagccgcccacccacaaggccugccgguccgugcgcugccccagcuggaaggccaacuccuggaacgagugcagcgugacgugcggguccggcguccagcagcgggacguguacugccgccugaagggcguggggcaggucguggaggagaugugcgaccagagcacccggccgugcucccagcgccggugcuggagccaggacugcgugcagcacaagggcauggagcgcgggcggcugaacugcuccaccagcugcgagcgcaaggacucccaccagcggauggagugcaccgacaaccagauccgccaggucaacgagaucguguacaacagcuccacgaucagccucaccagcaagaacugccggaacccgcccugcaacuacaucguggucaccgccgacuccagccagugcgccaacaacugcggcuucuccuaccgccagcggaucaccuacugcacggagauccccagcaccaagaagcacaagcugcaccgccugcgcccgaucguguaccaggagugccccgugguccccuccagccagguguaccagugcaucaacuccugccuccaccuggcgaccuggaagguggggaaguggagcaagugcuccgugaccugcggcaucggcaucaugaagcgccaggugaagugcaucacgaagcacgggcugagcuccgaccucugccugaaccaccugaagccgggcgcccagaagaagugcuacgccaacgacugcaagagcuucacgaccugcaaggagauccaggugaagaaccacauccgcaaggacggggacuacuaccucaacaucaagggccggaucaucaagaucuacugcgccgacauguaccuggagaaccccaaggaguaccugacccucguccagggggaggagaacuucuccgagguguacggcuuccgccugaagaaccccuaccagugccccuucaacggcagccggcgcgaggacugcgagugcgacaacgggcaccuggccgcgggcuacaccguguucuccaagauccggaucgaccucaccagcaugcagaucaagaccaccgaccugcuguucuccaagacgaucuucgggaacgccgucccguucgccaccgccggcgacugcuacagcgcguuccgcugcccccaggggcaguucuccaucaaccucagcggcaccggcaugaagaucagcuccaccgccaaguggcugacgcaggggagcuacaccuccgugagcauccggcgcuccgaggacggcacccgguucuucgggaagugcggcggcuacugcgggaagugccugccccacaugaccacgggccuccccauccaggugaucuga

SEQ ID NO: 26332 - RNA, 3636 nt, Artificial Sequence
  derived and/or modified sequence opt1 from ADAMTS2__Homo_sapiens__NP_055059
auggaccccccggccggcgccgcgcgccggcugcucugccccgcccugcugcuccugcugcuccugcugccccccccgcuccugcccccccccccgccccccgccaacgcccgccuggccgcggccgccgaccccccggggggcccccucgggcacggcgccgagcggauccuggcggugcccguccgcaccgacgcccaggggcggcuggugagccacguggucuccgccgccaccagccgcgccggcgugcgggcgcgccgggccgcccccgugcgcacgccguccuuccccggcgggaacgaggaggagcccggcagccaccucuucuacaacgucaccguguucgggcgggaccugcaccugcgccuccggcccaacgcccgccugguggccccgggcgcgaccauggaguggcagggggagaagggcaccacgcgggucgagccccugcucggcuccugccuguacgugggggacguggccggccuggccgaggccagcuccgucgcccucagcaacugcgacgggcuggcgggccugauccgcauggaggaggaggaguucuucaucgagccccucgagaagggccuggccgcccaggaggccgagcaggggcgggugcacguggucuaccgccggcccccgaccucccccccccugggcgggccccaggcccucgacaccggcgcgagccuggacucccuggacagccucucccgcgcccugggggugcuggaggagcacgccaacagcucccggcgccgcgcccggcgccacgcggccgacgacgacuacaacaucgaggugcuccugggcgucgacgacagcguggugcaguuccacggcaaggagcacguccagaaguaccugcucacccugaugaacaucgugaacgagaucuaccacgacgagucccugggggcccacaucaacgugguccucgugcggaucauccugcugagcuacggcaaguccaugagccucaucgagaucgggaacccgagccagucccuggagaacgucugccgcugggccuaccugcagcagaagcccgacacgggccacgacgaguaccacgaccacgccaucuuccucacccggcaggacuucgggcccagcggcaugcagggcuacgcgccggugaccgggaugugccaccccgugcgcuccugcacccugaaccacgaggacggcuucagcuccgccuucgucguggcccacgagacggggcacgugcugggcauggagcacgacgggcagggcaaccggugcggcgacgagguccgccuggggagcaucauggccccccucgugcaggccgcguuccaccgguuccacuggucccgcugcagccagcaggagcugucccgguaccugcacagcuacgacugccuccuggacgaccccuucgcccacgacuggccggcccugccccagcuccccggccugcacuacuccaugaacgagcagugccgcuucgacuucgggcugggcuacaugaugugcaccgccuuccggaccuucgaccccugcaagcagcucuggugcagccacccggacaaccccuacuucugcaagaccaagaagggccccccccuggacgggacgaugugcgccccgggcaagcacugcuucaaggggcacugcaucuggcugacccccgacauccucaagcgcgacggcuccuggggggcguggagccccuucggcuccugcagccggaccugcggcaccggggugaaguuccgcacgcggcagugcgacaacccccacccggccaacggcgggcgcaccugcuccggccuggccuacgacuuccagcugugcagccggcaggacugccccgacucccucgccgacuuccgcgaggagcagugccgccagugggaccuguacuucgagcacggggacgcgcagcaccacuggcugccccacgagcaccgggacgccaaggagcgcugccaccucuacugcgagagccgggagaccggcgaggucgugagcaugaagcgcauggugcacgacggcacccggugcuccuacaaggacgccuucagccugugcguccgcggggacugccggaaggugggcugcgacggggugaucggcuccagcaagcaggaggacaagugcggggucugcggcggcgacaacucccacugcaagguggugaaggggacguucacccgcagccccaagaagcacggcuacaucaagauguucgagaucccggccggggcccggcaccugcucauccaggaggucgacgcgaccucccaccaccuggccgugaagaaccuggagaccggcaaguucauccucaacgaggagaacgacguggacgccagcuccaagacguucaucgccaugggggucgagugggaguaccgcgacgaggacggccgggagacccugcagaccaugggcccccugcacgggaccaucacggugcucgugauccccgucggcgacacccgcgugagccugaccuacaaguacaugauccacgaggacucccugaacguggacgacaacaacguccucgaggaggacagcgugguguacgagugggcccugaagaaguggucccccugcagcaagccgugcgggggcggcucccaguucaccaaguacgggugccggcgccggcuggaccacaagaugguccaccgcggcuucugcgcggcccucagcaagcccaaggccauccggcgcgccugcaacccccaggagugcucccagccggugugggugacgggggagugggagcccugcagccagaccugcggccggaccgggaugcagguccgcagcgugcggugcauccagccccugcacgacaacaccacccgcuccgugcacgccaagcacugcaacgacgcgcgccccgagagccggcgcgccugcucccgggagcugugcccgggccgcuggcgggccggccccuggagccagugcuccgucacgugcgggaacggcacccaggagcgccccgugcucugccggaccgccgacgacagcuucgggaucugccaggaggagcgccccgagaccgcgcggacgugccgccugggcccgugcccccggaacaucuccgaccccagcaagaaguccuacgugguccaguggcugagccgccccgacccggacucccccauccggaagaucagcuccaaggggcacugccagggcgacaagagcaucuucugccgcauggaggugcucucccgguacugcagcauccccggcuacaacaagcugugcugcaaguccugcaaccuguacaacaaccucaccaacguggaggggcgcaucgagcccccgcccggcaagcacaacgacaucgacgucuucaugcccacccugcccgugccgaccguggccauggagguccggcccagccccuccacgccccuggaggugccgcucaacgccagcagcaccaacgccaccgaggaccaccccgagaccaacgccguggacgagcccuacaagauccacgggcuggaggacgagguccagcccccgaaccugaucccccgccggcccuccccguacgagaagacgcgcaaccagcgcauccaggagcucaucgacgagaugcggaagaaggagaugcugggcaaguucuga

SEQ ID NO: 26333 - RNA, 3618 nt, Artificial Sequence
  derived and/or modified sequence opt1 from ADAMTS3__Homo_sapiens__NP_055058
auggugcugcucagccuguggcugaucgccgccgcgcucgucgaggugcgcaccuccgccgacggccaggccgggaacgaggagauggugcagaucgaccugcccaucaagcgguaccgcgaguacgagcuggucacccccgugagcacgaaccucgagggccgguaccugucccacacccugagcgccucccacaagaagcgcagcgcccgggacguguccagcaaccccgagcagcuguucuucaacaucaccgcguucgggaaggacuuccaccuccgccugaagcccaacacccagcucgucgcccccggcgccgugguggaguggcacgagacgucccuggucccggggaacaucaccgaccccaucaacaaccaccagcccggcagcgccaccuaccggauccgccggaccgagccccugcagacgaacugcgcguacgugggcgacaucguggacaucccggggaccuccgucgccaucagcaacugcgacggccucgccgggaugaucaaguccgacaacgaggaguacuucaucgagccccuggagcgcggcaagcagauggaggaggagaaggggcggauccacgugguguacaagcgcagcgccgucgagcaggcccccaucgacauguccaaggacuuccacuaccgggagagcgaccuggagggccucgacgaccugggcaccguguacgggaacauccaccagcagcugaacgagaccaugcgccggcgccggcacgcgggcgagaacgacuacaacaucgaggugcuccugggggucgacgacuccguggugcgcuuccacggcaaggagcacguccagaacuaccugcucacgcugaugaacaucgugaacgagaucuaccacgacgagagccugggcgugcacaucaacgucgugcucguccggaugaucaugcugggguacgccaaguccaucagccugaucgagcgcggcaaccccagccggucccucgagaacgugugccgcugggccagccagcagcagcgcuccgaccugaaccacagcgagcaccacgaccacgccaucuuccugacccggcaggacuucgggccggccggcaugcagggguacgcgcccgugaccggcaugugccaccccguccgcuccugcacccucaaccacgaggacggcuucagcuccgccuucgugguggcccacgagacggggcacguccugggcauggagcacgacgggcagggcaaccggugcggggacgagaccgccaugggcagcgugauggcgccccuggugcaggccgccuuccaccgcuaccacuggucccggugcagcggccaggagcucaagcgcuacauccacuccuacgacugccugcuggacgacccguucgaccacgacuggcccaagcuccccgagcugcccgggaucaacuacagcauggacgagcagugccgguucgacuucggcgucggguacaagaugugcaccgccuuccgcaccuucgacccgugcaagcagcuguggugcucccaccccgacaaccccuacuucugcaagacgaagaaggggcccccgcucgacggcaccgagugcgccgccggcaaguggugcuacaagggccacugcauguggaagaacgcgaaccagcagaagcaggacgggaacuggggcagcuggaccaaguucggguccugcagccggaccugcggcacgggcgugcgcuuccggacccgccagugcaacaaccccaugcccaucaacgggggccaggacugccccggggugaacuucgaguaccagcugugcaacaccgaggagugccagaagcacuucgaggacuuccgggcccagcagugccagcagcgcaacucccacuucgaguaccagaacaccaagcaccacuggcugccguacgagcaccccgaccccaagaagcggugccaccucuacugccagagcaaggagacgggcgacgucgccuacaugaagcagcuggugcacgacgggacccacugcuccuacaaggacccguacagcaucugcgugcgcggcgagugcgucaaggugggcugcgacaaggagaucgggagcaacaagguggaggacaagugcggcgucugcgggggcgacaacucccacugccggaccgugaaggggaccuucacgcgcacgccccggaagcugggcuaccucaagauguucgacaucccgcccggcgcccgccacgugcugauccaggaggacgaggcgagcccccacauccuggccaucaagaaccaggccaccgggcacuacauccugaacggcaagggggaggaggccaagucccgcaccuucaucgaccucggcgucgagugggacuacaacaucgaggacgacaucgagagccugcacaccgacgggccccugcacgaccccgugaucgugcucaucaucccccaggagaacgacacccgguccagccugaccuacaaguacaucauccacgaggacuccgucccgaccaucaacagcaacaacgugauccaggaggagcuggacaccuucgagugggcccucaaguccuggagccagugcuccaagcccugcggcggcggguuccaguacacgaaguacggcugccgccgcaagagcgacaacaagauggugcaccgguccuucugcgaggcgaacaagaagcccaagcccauccggcgcaugugcaacauccaggagugcacccacccgcugugggucgccgaggagugggagcacugcaccaagaccugcgggagcuccggcuaccagcugcggacggugcgcugccuccagccccugcuggacgggaccaaccggagcgugcacuccaaguacugcaugggcgaccgccccgagagccggcgccccugcaaccgggucccgugccccgcccaguggaagaccggccccuggagcgagugcuccgugaccugcggggagggcacggaggugcgccagguccucugccgggccggggaccacugcgacggcgagaagcccgagagcgugcgcgccugccagcugccgcccugcaacgacgagcccugccugggcgacaaguccaucuucugccagauggaggugcucgcgcgguacugcagcauccccggguacaacaagcugugcugcgaguccugcagcaagcgcuccagcacccugccgccgcccuaccuccuggaggccgccgagacccacgacgacgucaucuccaaccccagcgaccugccccggucccucgugaugcccaccagccuggugcccuaccacuccgagacgccggccaagaagaugagccuguccagcaucuccagcgucggcgggcccaacgccuacgcggccuuccgccccaacuccaagcccgacggcgccaaccuccggcagcgcagcgcccagcaggcggggagcaagaccgugcgccuggugaccgucccguccagcccgcccaccaagcgggugcaccuguccagcgccucccagauggccgccgccagcuucuucgcggccuccgacagcaucggcgccuccagccaggcccgcacguccaagaaggacggcaagaucaucgacaaccggcgccccacccggagcuccacccucgagcgcuga

SEQ ID NO: 26334 - RNA, 2514 nt, Artificial Sequence
  derived and/or modified sequence opt1 from ADAMTS4__Homo_sapiens__NP_005090
augagccagaccggcucccaccccgggcgcggccuggccgggcgguggcucuggggcgcccagccgugccugcugcuccccaucgugccccugagcuggcuggucuggcuccugcugcuccugcuggcgucccuccugcccagcgcccgccuggccuccccgcucccccgggaggaggagaucguguuccccgagaagcugaacgggagcgugcugcccggcuccggcgccccggcccgccuccugugccggcugcaggcguucggggagacccuccugcuggagcucgagcaggacagcggcguccagguggaggggcugaccgugcaguaccugggccaggcccccgagcuccucgggggcgccgagcccggcaccuaccugaccgggaccaucaacggcgaccccgaguccgucgccagccuccacugggacgggggcgcgcugcugggcgugcuccaguaccgcggggccgagcugcaccuccagccgcuggagggcgggacgcccaacuccgccggcgggcccggcgcccacauccugcggcgcaagagccccgccuccggccaggggccgaugugcaacgugaaggcgccccugggcagccccagcccccggccgcgccgggccaagcgcuucgccucccucucccgguucgucgagacccuggugguggccgacgacaagauggccgcguuccacggggccggccugaagcgcuaccuccugaccgucauggccgccgccgcgaaggccuucaagcaccccagcauccggaaccccgugucccugguggucacccgccucgugauccuggggagcggcgaggagggcccccagguggggccgagcgccgcccagacgcugcgguccuucugcgccuggcagcgcggccucaacacccccgaggacagcgaccccgaccacuucgacaccgcgauccuguucacccggcaggaccugugcggggucuccacgugcgacacccugggcauggccgacguggggaccgugugcgaccccgcccgcagcugcgccaucgucgaggacgacggccuccaguccgcguucaccgccgcccacgagcugggccacguguucaacaugcugcacgacaacagcaagccgugcaucucccucaacgggccccugagcacgucccggcacgugauggcccccgucauggcccacguggacccggaggagcccuggagccccugcuccgcgcgcuucaucaccgacuuccuggacaacggcuacgggcacugccuccuggacaagcccgaggccccgcugcaccuccccgucaccuuccccggcaaggacuacgacgccgaccgccagugccagcugaccuucggccccgacagccggcacugcccgcagcugcccccgcccugcgccgcccucuggugcuccgggcaccugaacggccacgcgaugugccagacgaagcacagccccugggccgacgggacccccugcggccccgcccaggccugcaugggcgggcgcugccugcacauggaccagcuccaggacuucaacaucccccaggccggcggguggggcccgugggggcccuggggcgacugcucccggaccugcgggggcggcgugcaguucagcucccgcgacugcacccggcccgugccccgcaacgggggcaaguacugcgaggggcggcgcacgcgguuccgcagcugcaacaccgaggacugcccgaccggcuccgcgcugaccuuccgggaggagcagugcgccgccuacaaccaccgcacggaccuguucaagagcuuccccgggcccauggacugggucccccgguacaccggcguggccccgcaggaccagugcaagcugaccugccaggcgcaggcccugggcuacuacuacgugcuggagccccgcgucguggacgggacccccugcagcccggacuccagcuccgugugcguccagggccggugcauccacgccgggugcgaccgcaucaucggcagcaagaagaaguucgacaagugcauggugugcgggggcgacggcuccgggugcagcaagcaguccggcagcuuccggaaguuccgcuacggguacaacaacguggucacgauccccgccggcgccacccacauccucgugcggcagcagggcaaccccgggcaccgcuccaucuaccuggcgcugaagcuccccgacggcagcuacgcccugaacggggaguacacccugaugccgucccccaccgacgugguccuccccggcgccgugagccugcgcuacuccggggccacggccgcgagcgagacccuguccggccacggcccccucgcccagccgcugacccuccaggugcuggucgccgggaacccccaggacacccggcugcgcuacagcuucuucgugccccggcccaccccguccacgccccgccccacgccccaggacuggcugcaccggcgcgcccagauccucgagauccugcggcgccggccgugggccggccgcaaguga

SEQ ID NO: 26335 - RNA, 2793 nt, Artificial Sequence
  derived and/or modified sequence opt1 from ADAMTS5__Homo_sapiens__NP_008969
augcugcucggcugggccagccugcugcucugcgccuuccgccugccccuggcggccguggggccggccgccacccccgcccaggacaaggcgggccagccgcccaccgccgccgccgcggcccagccccggcgccggcagggggaggagguccaggagcgcgccgagccgcccggccacccccacccccucgcccagcggcgccgguccaaggggcuggugcagaacaucgaccagcuguacagcggcggcgggaaggugggcuaccucgucuacgccgggggccgccgguuccugcuggaccucgagcgcgacggguccgugggcaucgcgggcuucgugcccgccgggggcgggacgagcgcccccuggcggcaccgcucccacugcuucuaccggggcaccgucgacggcagcccccgcucccuggccguguucgaccugugcgggggccucgacggguucuucgccgugaagcacgcgcgguacacccugaagccgcugcuccgcggccccugggccgaggaggagaaggggcgggucuacggcgacggcagcgcccgcauccugcacguguacacccgggagggguucuccuucgaggcccugccgccccgcgccagcugcgagacgcccgcguccacccccgaggcccacgagcacgcccccgcccacagcaaccccuccggccgggccgcgcucgccagccagcugcuggaccaguccgcccucagcccggccgggggcuccgggccccagaccugguggcgccgccggcgccggagcaucucccgcgcgcgccagguggagcugcugcucgucgccgacgccagcauggcccgccuguacggccggggccugcagcacuaccuccugacccuggccagcaucgcgaaccgccucuacucccacgccagcaucgagaaccacauccggcuggccguggugaaggucguggugcugggggacaaggacaagucccucgaggucagcaagaacgccgccacgacccugaagaacuucugcaaguggcagcaccagcacaaccagcugggcgacgaccacgaggagcacuacgacgcggccauccucuucacccgcgaggaccugugcgggcaccacuccugcgacacccugggcauggccgacguggggacgaucugcagccccgagcgguccugcgccgugaucgaggacgacggccuccacgccgcguucaccgucgcccacgagaucggccaccuccuggggcucagccacgacgacuccaaguucugcgaggagaccuucggcagcaccgaggacaagcgccugauguccagcauccugacguccaucgacgccagcaagcccugguccaagugcaccagcgccaccaucaccgaguuccucgacgacgggcacggcaacugccugcuggaccugccgcggaagcagauccucggccccgaggagcugcccgggcagacguacgacgcgacccagcagugcaaccugaccuucggccccgaguacuccgugugcccggggauggacgugugcgcccgccucuggugcgccgucgugcggcagggccagauggucugccugaccaagaagcugcccgccguggaggggacgcccugcggcaagggccgcaucugccuccaggggaagugcguggacaagaccaagaagaaguacuacagcaccuccagccacggcaacugggggagcuggggcuccugggggcagugcagccgguccugcggcggcgggguccaguucgccuaccgccacugcaacaacccggcgccccggaacaacggccgcuacugcaccgggaagcgcgccaucuaccggagcugcucccugaugcccugcccgcccaacggcaagagcuuccgccacgagcagugcgaggccaagaacggguaccaguccgacgccaagggcgugaagacguucguggaguggguccccaaguacgccggcgugcugcccgcggacgugugcaagcugaccugccgggccaaggggaccggcuacuacgucguguucagccccaaggugaccgacgggacggagugccgccuguacuccaacagcgucugcgugcggggcaagugcgugcgcaccgggugcgacggcaucaucggcuccaagcugcaguacgacaagugcggggucugcggcggggacaacagcuccugcaccaagaucgugggcaccuucaacaagaaguccaagggcuacacggacgugguccggaucccggagggggccacccacaucaaggugcgccaguucaaggccaaggaccagacccgguucaccgccuaccucgcgcugaagaagaagaacggcgaguaccugaucaacgggaaguacaugaucagcaccagcgagacgaucaucgacaucaacggcaccgugaugaacuacuccggguggagccaccgcgacgacuuccuccacggcaugggcuacagcgccaccaaggagauccugaucguccagauccuggccaccgaccccacgaagccccucgacgugcgguacuccuucuucgugcccaagaaguccaccccgaaggucaacagcgugaccagccacggguccaacaaggugggcagccacaccucccagccccagugggucacggggcccuggcuggccugcagccggaccugcgacaccggcuggcacacccggacggugcagugccaggacgggaaccgcaagcuggcgaagggcugcccccucucccagcggccgagcgccuucaagcagugccugcugaagaagugcuga

SEQ ID NO: 26336 - RNA, 3354 nt, Artificial Sequence
  derived and/or modified sequence opt1 from ADAMTS6__Homo_sapiens__NP_922932
auggagauccuguggaagacccucaccuggauccugagccugaucauggccuccagcgaguuccacuccgaccaccgccucagcuacuccagccaggaggaguuccugacguaccuggagcacuaccagcucaccauccccauccggguggaccagaacggcgccuuccuguccuucaccgucaagaacgacaagcacagccgccggcgccgguccauggaccccaucgacccccagcaggcggugagcaagcuguucuucaagcucuccgccuacgggaagcacuuccaccugaaccugacccucaacacggacuucgugagcaagcacuucaccgucgaguacuggggcaaggacgggccccaguggaagcacgacuuccuggacaacugccacuacaccggcuaccugcaggaccagcgcuccaccacgaagguggcccucagcaacugcguggggcugcacggcgucaucgccaccgaggacgaggaguacuucaucgagccccugaagaacaccaccgaggacuccaagcacuucagcuacgagaacggccacccgcacgugaucuacaagaaguccgcccuccagcagcggcaccuguacgaccacagccacugcgggguguccgacuucacgcgcagcggcaagcccugguggcugaacgacaccagcaccgucuccuacagccuccccaucaacaacacccacauccaccaccggcagaagcgcuccgugagcaucgagcgguucguggagacgcuggucguggcggacaagaugauggugggguaccacggccgcaaggacaucgagcacuacauccuguccgucaugaacaucguggccaagcucuaccgggacagcucccuggggaacguggucaacaucaucguggcccgccugaucgugcucaccgaggaccagcccaaccuggagaucaaccaccacgccgacaagagccuggacuccuucugcaaguggcagaaguccauccucagccaccagagcgacggcaacaccaucccggagaacggcaucgcgcaccacgacaacgccguccugaucacccgguacgacaucugcacguacaagaacaagcccugcgggacccugggccucgccuccguggccgggaugugcgagcccgagcgcagcugcuccaucaacgaggacaucggccugggcagcgccuucaccaucgcgcacgagaucgggcacaacuucggcaugaaccacgacgggaucggcaacuccugcgggaccaagggccacgaggccgccaagcugauggccgcccacaucacggcgaacaccaaccccuucagcugguccgccugcagccgggacuacaucaccagcuuccucgacuccggccgcgggaccugccuggacaacgagccgcccaagcgggacuuccuguaccccgccguggcccccggccaggucuacgacgccgacgagcagugccgcuuccaguacggggcgacgagccggcagugcaaguacggcgaggugugccgcgagcucuggugccuguccaagagcaaccgcugcgucaccaacuccaucccggccgccgaggggacccugugccagaccggcaacaucgagaagggcuggugcuaccagggggacugcgugcccuucggcacguggccccagagcaucgacgggggcugggggcccuggucccucuggggcgagugcagccggaccugcggcgggggcguguccagcucccugcgccacugcgacagcccggcccccuccgggggcggcaaguacugccugggggagcggaagcgcuaccggagcugcaacaccgaccccugcccccucggcucccgcgacuuccgggagaagcagugcgccgacuucgacaacaugccguuccgcgggaaguacuacaacuggaagcccuacaccggcgggggcgucaagcccugcgcgcugaacugccuggccgagggcuacaacuucuacacggagcgggcccccgccgugaucgacgggacccagugcaacgcggacagccucgacaucugcaucaacggcgagugcaagcacguggggugcgacaacauccugggcuccgacgcccgcgaggaccggugccgcgucugcgggggcgacggcagcacgugcgacgccaucgagggguucuucaacgacagccugccgcggggcggguacauggagguggugcagaucccccgcggcuccguccacaucgaggugcgggagguggccaugagcaagaacuacaucgcccugaaguccgagggggacgacuacuacaucaacggcgcguggaccaucgacuggccccgcaaguucgacgucgccggcaccgccuuccacuacaagcggccgaccgacgagcccgagagccucgaggcccuggggcccaccuccgagaaccugaucgugauggugcuccugcaggagcagaaccugggcauccgcuacaaguucaacguccccaucacccggaccgggagcggcgacaacgaggugggguucacguggaaccaccagccgugguccgagugcagcgcgaccugcgccggcggcgugcagcgccaggaggucgugugcaagcgccucgacgacaacuccaucgugcagaacaacuacugcgaccccgacagcaagccgcccgagaaccagcgggccugcaacaccgagcccugcccgcccgagugguucaucggggacuggcuggagugcuccaagaccugcgacggcgggaugcgcacgcgggccguccugugcauccgcaagaucggccccagcgaggaggagacccucgacuacuccggcugccugacccaccggcccguggagaaggagcccugcaacaaccagagcugcccgccccaguggguggcccuggacugguccgagugcacccccaagugcgggcccggcuucaagcaccgcaucguccucugcaagagcuccgaccugagcaagacguuccccgccgcgcagugccccgaggaguccaagccgcccgugcggauccgcugcagccuggggcggugcccgccgccccgcugggugaccggcgacugggggcagugcagcgcccagugcggccucggccagcagaugcggaccguccagugccuguccuacaccgggcaggccagcuccgacugccuggagacggugcgcccgcccagcaugcagcagugcgaguccaagugcgacagcacccccaucuccaacaccgaggagugcaaggacgugaacaaggucgccuacugcccccucgugcugaaguucaaguucugcagccgggcguacuuccgccagaugugcugcaagaccugccagggccacuga

SEQ ID NO: 26337 - RNA, 5061 nt, Artificial Sequence
  derived and/or modified sequence opt1 from ADAMTS7__Homo_sapiens__NP_055087
augcccggcgggcccagcccccggucccccgcgccccugcugcggccccugcugcuccugcugugcgcccucgcgcccggcgcccccgggcccgcccccggccgcgccaccgaggggcgggccgcccuggacaucguccaccccguccgcgucgacgccggcggcuccuuccuguccuacgagcucuggccccgggcccugcgcaagcgggacguguccguccgccgggacgcccccgccuucuacgagcugcaguaccgcgggcgggagcuccgcuucaaccugaccgccaaccagcaccuccuggcccccggcuucguguccgagacccggcgccgcggcgggcuggggcgcgcccacauccgggcccacacccccgccugccaccuccugggggaggugcaggaccccgagcuggagggcgggcuggccgccaucuccgccugcgacggccugaagggggucuuccagcuguccaacgaggacuacuucaucgagccccuggacuccgcccccgcccgccccggccacgcccagccccacgugguguacaagcggcaggcccccgagcgccucgcccagcggggcgacuccagcgcccccagcacgugcgggguccagguguaccccgagcuggagagccgccgcgagcggugggagcagcgccagcaguggcggcgcccccggcugcgccggcuccaccagcgcuccgugagcaaggagaagugggucgagacccuggugguggcggacgccaagauggucgaguaccacggccagccccagguggaguccuacgugcugaccaucaugaacauggucgccggccuguuccacgaccccagcaucggcaaccccauccacaucaccaucgugcggcuggugcugcucgaggacgaggaggaggaccugaagaucacccaccacgccgacaacacccugaaguccuucugcaaguggcagaaguccaucaacaugaagggggacgcccacccccuccaccacgacacggcgauccugcugacccgcaaggaccucugcgccgccaugaaccggcccugcgagacccugggccugucccacgucgccggcaugugccagccgcaccgcagcugcagcaucaacgaggacaccgggcucccccuggcguucacgguggcccacgagcugggccacuccuucgggauccagcacgacggcagcgggaacgacugcgagcccgugggcaagcggccguucaucaugagcccccagcuccuguacgacgccgcgccccugaccuggagccgcugcucccggcaguacaucacccgcuuccucgaccggggcugggggcugugccuggacgacccgcccgccaaggacaucaucgacuuccccagcgugccgcccggcgugcuguacgacgucucccaccagugccgccuccaguacggggcguacagcgccuucugcgaggacauggacaacgugugccacacccuguggugcuccgugggcacgaccugccacagcaagcuggacgccgccgucgacgggacccggugcggcgagaacaaguggugccucuccggcgagugcgugccggugggguuccgccccgaggccgucgacggcggguggagcggcugguccgcguggagcaucugcucccgcagcugcggcaugggggugcaguccgccgagcggcagugcacccagcccacgcccaaguacaagggccgcuacugcgugggggagcggaagcgcuuccggcugugcaaccugcaggccugcccggccggccgccccagcuuccggcacguccagugcucccacuucgacgccaugcucuacaaggggcagcugcacaccugggugcccguggucaacgacgugaaccccugcgagcugcacugccgcccggcgaacgaguacuucgccgagaagcuccgggacgccguggucgacggcacccccugcuaccaggugcgcgccagccgggaccugugcaucaacggcaucugcaagaacguggggugcgacuucgagaucgacagcggcgcgauggaggaccgcugcggggucugccacggcaacgggagcacgugccacaccgugagcggcaccuucgaggaggccgagggccugggguacguggacgucggccucauccccgccggggcccgggagauccgcauccaggagguggccgaggcggccaacuuccuggcccugcgguccgaggaccccgagaaguacuuccucaacggcggguggaccauccaguggaacggcgacuaccagguggccggcaccacguucaccuacgcccgccgggggaacugggagaaccugaccagcccgggccccaccaaggagcccgucuggauccagcuccuguuccaggaguccaaccccggggugcacuacgaguacacgauccaccgcgaggcgggcgggcacgacgaggugccgccgcccgucuucagcuggcacuacggcccguggaccaagugcaccgugaccugcggccgcgggguccagcggcagaacgucuacugccuggagcggcaggccggccccguggacgaggagcacugcgacccccuggggcgccccgacgaccagcagcgcaagugcuccgagcagccgugccccgcccgguggugggccggcgaguggcagcucugcagcuccagcugcggccccgggggccugucccgccgggccgugcugugcauccgcagcgucgggcucgacgagcaguccgcgcuggagcccccggccugcgagcaccucccccggccgcccacggagaccccgugcaaccgccacgugcccugccccgccaccugggccgugggcaacuggagccagugcuccgugaccugcggggagggcacccagcggcgcaacguccucugcacgaacgacaccggcgugcccugcgacgaggcgcagcagccggccagcgaggugaccugcucccugccccugugccgguggccccucgggacccugggccccgaggggagcggcagcggguccagcucccacgagcuguucaacgaggccgacuucaucccgcaccaccucgcgccccgccccagccccgccuccagcccgaagcccggcacgaugggcaacgcgaucgaggaggaggcccccgagcuggaccugcccgggccgguguucguggacgacuucuacuacgacuacaacuucaucaacuuccacgaggaccucuccuacggccccagcgaggagcccgaccuggaccuggccgggaccggcgaccggaccccgccgccccacucccaccccgccgccccgagcaccgggucccccguccccgcgacggagcccccggccgccaaggaggagggcgugcucggccccuggagccccucccccuggccgagccaggccgggcgcagcccgccgccgcccagcgagcagacccccggcaacccccugaucaacuuccugcccgaggaggacacccccaucggggcccccgaccucggccugcccucccugagcuggccccggguguccaccgacggccuccagacgccggcgacccccgagagccagaacgacuuccccgucgggaaggacagccagucccagcugcccccgcccuggcgcgaccggaccaacgagguguucaaggacgacgaggagcccaagggccgcggggccccgcaccucccgccccggcccagcuccacccucccgccccugagccccgugggcuccacgcacagcucccccagcccggacgucgccgagcuguggaccgggggcaccguggccugggagcccgcccucgagggcgggcugggccccguggacuccgagcuguggcccaccgucgggguggcgagccuccugccgccgcccaucgcgccccugccggagaugaagguccgcgacuccagccucgagcccggcacgcccuccuuccccaccccggggcccggcagcugggaccugcagaccguggccguguggggcaccuuccugcccacgacccucaccgggcugggccacaugcccgagccggcccugaaccccgggcccaagggccagccggagucccucagccccgaggucccccuguccagccggcugcucuccacccccgcgugggacagcccggccaacagccaccgcgugcccgagacgcagccccuggcccccucccuggccgaggccgggccgcccgcggacccccucgugguccgcaacgccggcuggcaggccggcaacuggagcgagugcuccacgaccugcgggcugggcgccguguggcggcccgugcgcugcagcuccgggcgggacgaggacugcgccccggcgggccgcccccagcccgcccggcgcugccaccuccggcccugcgccaccuggcacagcgggaacugguccaagugcagccgcuccugcggcggcgggagcuccguccgggacgugcagugcguggacacgcgcgaccuccggccgcugcgccccuuccacugccagcccggccccgccaagccgcccgcccaccggcccugcggggcgcagcccugccugagcugguacaccuccagcuggcgcgagugcuccgaggccugcggcggcggggagcagcagcggcucgugaccugcccggagcccggccugugcgaggaggcccugcgccccaacaccacgcggcccugcaacacccacccgugcacccagugggugguggggcccuggggccagugcagcgggcccugcggcggcgggguccagcgccggcucgugaagugcgugaacacccagaccggccugccggaggaggacuccgaccagugcgggcacgaggccuggcccgagagcucccgccccugcggcacggaggacugcgagcccgucgagccgccccggugcgagcgcgaccgccugagcuucggguucugcgagacccuccggcugcugggccgcugccagcuccccaccauccggacccagugcugccgcagcugcagcccgcccagccacggcgcgcccucccgggggcaccagcgcguggcccggcgcuga

SEQ ID NO: 26338 - RNA, 2670 nt, Artificial Sequence
  derived and/or modified sequence opt1 from ADAMTS8__Homo_sapiens__NP_008968
augcugcccgccccggccgcgccccgcuggccgccccuccugcugcuccugcugcuccugcugccccucgcccggggcgcccccgcccgccccgccgccgggggccaggccagcgagcuggugguccccacccggcugccgggguccgccggcgagcucgcccugcaccugagcgcguucgggaagggcuucgugcuccgccuggcccccgacgacuccuuccuggcccccgaguucaagaucgagcggcucggcgggagcggccgcgccaccgggggcgagcgggggcugcgcggcugcuucuucuccggcaccgugaacggggagcccgagagccuggccgcggucucccucugccggggccugagcggguccuuccugcucgacggcgaggaguucaccauccagccgcagggcgccgggggcagccuggcccagccccaccgccugcagcggugggggcccgccggcgcccgcccccucccgcgggggcccgagugggagguggagaccggcgagggccagcgccaggagcgcggggaccaccaggaggacuccgaggaggagagccaggaggaggaggcggagggcgccuccgagccgccgccgccccugggggccaccagccggacgaagcgguucguguccgaggcccgcuucgucgagacccugcucguggccgacgcgagcauggccgccuucuacggcgccgaccugcagaaccacauccugacccucauguccguggccgcgcggaucuacaagcaccccagcaucaagaacuccaucaaccugauggucgugaaggugcugaucgucgaggacgagaagugggggcccgaggugagcgacaacggcggccucacccugcgcaacuucugcaacuggcagcggcgcuucaaccagcccagcgaccgccaccccgagcacuacgacacggccauccugcucacccggcagaacuucugcgggcaggagggccugugcgacacccuggggguggccgacaucggcaccaucugcgaccccaacaaguccugcagcgucaucgaggacgaggggcuccaggccgcgcacacgcuggcccacgagcugggccacgugcucuccaugccccacgacgacagcaagcccugcacccgccuguucggccccauggggaagcaccacgugauggcgccccuguucguccaccucaaccagacccugccguggucccccugcagcgccauguaccugaccgagcugcucgacggcgggcacggcgacugccugcuggacgcccccgcggccgcccucccccugccgacgggccugcccgggcggauggcccucuaccagcuggaccagcagugccgccagaucuucggccccgacuuccggcacugccccaacaccuccgcccaggacgugugcgcgcagcuguggugccacaccgacggggccgagccgcucugccacaccaagaacggcagccugcccugggccgacgggacgcccugcggccccggccaccugugcuccgaggggagcugccucccggaggaggagguggagcgccccaagcccgucgccgacggcgggugggcccccuggggcccguggggcgagugcucccggaccugcgggggcggggugcaguucagccaccgcgagugcaaggaccccgagccccagaacggcgggcgguacugccugggccgccgggcgaaguaccaguccugccacaccgaggagugcccgcccgacggcaagagcuuccgcgagcagcagugcgagaaguacaacgccuacaacuacaccgacauggacgggaaccugcuccagugggugcccaaguacgccggcgucagcccccgggaccgcugcaagcuguucugccgggcccgcgggcgguccgaguucaagguguucgaggcgaaggucaucgacggcacgcugugcgggcccgagacccucgccaucugcgugcgcggccagugcgugaaggccgggugcgaccacgucguggacuccccgcggaagcuggacaagugcggcgugugcggcgggaagggcaacagcugccgcaaggucuccgggagccugacccccaccaacuacggcuacaacgacaucgugacgauccccgccggcgccaccaacaucgacgugaagcagcgcagccacccggggguccagaacgacggcaacuaccucgcgcugaagaccgccgacgggcaguaccugcucaacggcaaccuggccaucuccgccaucgagcaggacauccuggugaaggggaccauccucaaguacagcggcuccaucgccacgcuggagcggcugcagagcuuccgcccccuccccgagccccugaccgugcagcugcucaccgucccgggcgagguguucccgcccaaggugaaguacaccuucuucguccccaacgacguggacuucuccaugcagagcuccaaggagcgggcgacgaccaacaucauccagccccugcugcacgcccagugggugcucggggacuggagcgagugcuccagcacgugcggcgccggguggcagcgccggaccgucgagugccgcgaccccuccggccaggccagcgcgaccugcaacaaggcccugaagcccgaggacgccaagcccugcgagucccagcugugcccgcucuga

SEQ ID NO: 26339 - RNA, 5808 nt, Artificial Sequence
  derived and/or modified sequence opt1 from ADAMTS9__Homo_sapiens__NP_891550
augcaguucgugagcugggccacccugcucacccugcugguccgcgaccucgccgagaugggcagccccgacgccgccgccgccgugcggaaggaccgccugcacccccgccaggugaagcugcucgagacgcugagcgaguacgagaucgucagccccauccgcgugaacgcccugggggagcccuuccccaccaacgugcacuucaagcggacccgccggagcaucaacuccgccaccgaccccuggcccgccuucgccagcuccagcuccagcuccacgagcucccaggcccacuaccgccucagcgcguucggccagcaguuccuguucaaccugaccgccaacgccggguucaucgcgccccucuucaccgucacccugcugggcacgcccggggugaaccagaccaaguucuacuccgaggaggaggccgagcucaagcacugcuucuacaagggcuacgugaacaccaacagcgagcacaccgccgucaucucccugugcagcggcaugcuggggacguuccggucccacgacggcgacuacuucaucgagccgcuccagagcauggacgagcaggaggacgaggaggagcagaacaagccccacaucaucuaccgccggagcgcgccccagcgcgagcccuccaccgggcggcacgccugcgacaccagcgagcacaagaaccgccacuccaaggacaagaagaagacccgggcccgcaaguggggcgagcggaucaaccuggccggggacguggcggcccugaacagcggccucgccacggaggccuucuccgccuacggcaacaagaccgacaacacccgcgagaagcggacccaccgccggacgaagcgcuuccugagcuacccgcgcuucguggagguccuggugguggcggacaaccggauggucuccuaccacggggagaaccuccagcacuacauccugacccugaugagcaucguggccuccaucuacaaggaccccagcaucggcaaccucaucaacaucgugaucgucaaccugaucgugauccacaacgagcaggacgggcccuccaucagcuucaacgcccagaccacccugaagaacuucugccaguggcagcacuccaagaacagccccggcggcauccaccacgacacggccgugcuccugacccgccaggacaucugccgggcccacgacaagugcgacacccuggggcucgcggagcugggcaccaucugcgacccguaccgcuccugcagcaucuccgaggacagcgggcuguccacggccuucaccaucgcccacgagcucggccacgucuucaacaugccccacgacgacaacaacaagugcaaggaggagggggucaagagcccccagcacgugauggcccccacccugaacuucuacaccaacccguggauguggagcaagugcucccggaaguacaucacggaguuccuggacaccggcuacggcgagugccuccugaacgagcccgagagccgccccuacccccugccgguccagcuccccgggauccuguacaacgugaacaagcagugcgagcugaucuucggccccgggucccaggucugccccuacaugaugcagugccggcgccucuggugcaacaacgugaacggcgugcacaaggggugccggacccagcacaccccgugggcggacggcacggagugcgagcccggcaagcacugcaaguacggguucugcguccccaaggagauggacgugccggugaccgacggcagcuggggguccuggagccccuucgggaccugcucccggaccugcgggggcggcaucaagaccgccauccgggagugcaaccgccccgagcccaagaacgggggcaaguacugcgucgggcggcgcaugaaguucaagagcugcaacacggagccgugccugaagcagaagcgggacuuccgcgacgagcagugcgcccacuucgacggcaagcacuucaacaucaacggccugcuccccaacgugcggugggugcccaaguacuccgggauccugaugaaggaccgcugcaagcuguucugccgggucgccggcaacaccgccuacuaccagcugcgcgaccgcgugaucgacgggacccccugcggccaggacaccaacgacaucugcgugcaggggcucugccggcaggcgggcugcgaccacguccugaacagcaaggcccgccgggacaagugcggcgugugcgggggcgacaacuccagcugcaagacgguggccgggaccuucaacaccguccacuacggcuacaacaccguggugcgcaucccggccggggccacgaacaucgacguccggcagcacuccuucagcggcgagaccgacgacgacaacuaccuggcgcucuccagcuccaagggcgaguuccugcugaacgggaacuucguggugaccauggccaagcgcgagauccggaucggcaacgccgucguggaguacagcgggagcgagaccgccguggagcgcaucaacuccacggaccggaucgagcaggagcuccugcugcagguccucagcgugggcaagcuguacaaccccgacgugcgcuacuccuucaacauccccaucgaggacaagccccagcaguucuacuggaacagccacgggccguggcaggccugcuccaagcccugccagggcgagcggaagcgcaagcuggucugcacccgggagagcgaccagcucaccguguccgaccagcgcugcgaccggcugccccagcccggccacaucaccgagccgugcgggacggacugcgaccugcgcuggcacguggcgagccgguccgagugcagcgcccagugcggccucggguaccgcacccuggacaucuacugcgccaaguacucccggcuggacggcaagaccgagaaggucgacgacggguucugcagcucccaccccaagcccagcaaccgcgagaagugcuccggcgagugcaacaccggcggguggcgguacagcgccuggacggagugcuccaagagcugcgacggcgggacccagcgccgccgggcgaucugcgugaacacccgcaacgacgugcucgacgacuccaagugcacccaccaggagaaggucacgauccagcggugcagcgaguuccccugcccgcaguggaaguccggcgacugguccgagugccuggugaccugcggcaaggggcacaagcaccgccagguguggugccaguucggcgaggaccggcugaacgaccgcaugugcgaccccgagaccaagcccaccagcaugcagacgugccagcagcccgagugcgccuccuggcaggccgggccguggggccagugcagcgugaccugcgggcagggcuaccagcuccgggccgugaagugcaucaucggcaccuacauguccguggucgacgacaacgacugcaacgccgcgacccgccccacggacacccaggacugcgagcugcccagcugccacccgccgcccgccgcccccgagacccggcgcuccaccuacagcgccccgcggacgcaguggcgcuucggguccuggacccccugcagcgcgaccugcggcaaggggacccggaugcgcuacguguccugccgggacgagaacggcagcguggcggacgaguccgccugcgccacccugccccgccccgucgccaaggaggagugcagcgugacgccgugcgggcaguggaaggcccucgacugguccagcugcuccgugaccugcggccagggccgggcgacccgccaggucaugugcgugaacuacagcgaccacgugaucgaccgguccgagugcgaccaggacuacauccccgagaccgaccaggacugcagcaugagccccugcccccagcgcacgccggacuccgggcuggcccagcaccccuuccagaacgaggacuaccgcccccggagcgccucccccagccgcacccacguccugggcgggaaccaguggcggaccggcccguggggcgccugcuccuccacgugcgcgggcggcucccagcgccgggugguggucugccaggacgagaacggguacaccgccaacgacugcguggagcgcaucaagcccgacgagcagcgggccugcgagagcggccccugcccccagugggccuacgggaacuggggcgagugcaccaagcucugcggcgggggcauccgcacccggcuggucgugugccagcgcuccaacggggagcgguucccggaccugagcugcgagauccucgacaagccgcccgaccgcgagcagugcaacacccacgccugcccccacgacgcggccugguccacgggcccguggagcuccugcagcguguccugcgggcggggccacaagcagcgcaacgucuacugcauggccaaggacggcagccaccuggaguccgacuacugcaagcaccuggccaagccccacgggcaccggaagugccgcggcgggcggugccccaaguggaaggccggcgcguggagccagugcuccgugagcugcgggcgcggcgugcagcagcggcacgucggcugccagaucgggacccacaagaucgcccgcgagaccgagugcaaccccuacacccggccggagagcgagcgcgacugccagggcccccgcugcccccucuacacguggcgggccgaggaguggcaggagugcaccaagaccugcggggagggcucccgcuaccggaagguggugugcgucgacgacaacaagaacgaggugcacggggcccgcugcgacgugagcaagcggccggucgaccgcgaguccugcagccugcagcccugcgaguacguguggaucaccggcgagugguccgagugcagcgugacgugcggcaagggguacaagcagcggcuggucuccugcagcgagaucuacaccggcaaggagaacuacgaguacuccuaccagaccaccaucaacugccccgggacgcagcccccgagcgugcaccccugcuaccuccgcgacugccccguguccgccaccuggcgggucggcaacugggggagcugcuccgugagcugcggcgugggcgucaugcagcgcuccgugcagugccugaccaacgaggaccagcccagccaccugugccacaccgaccucaagccggaggagcggaagacgugccgcaacguguacaacugcgagcugccccagaacugcaaggaggucaagcggcugaagggggcguccgaggacggcgaguacuuccucaugauccgcgggaagcugcugaagaucuucugcgccggcaugcacagcgaccaccccaaggaguacgugacccucgugcacggcgacuccgagaacuucagcgaggucuacgggcaccggcugcacaaccccaccgagugcccguacaacggcagccgccgggacgacugccagugccgcaaggacuacaccgccgccggguucuccagcuuccagaagauccggaucgaccugacguccaugcagaucaucaccaccgaccuccaguucgcccgcaccagcgagggccaccccgugcccuucgcgacggccggggacugcuacuccgccgccaagugcccccagggccgcuucagcaucaaccuguacggcaccgggcugucccucaccgagagcgcgcgguggaucucccagggcaacuacgccgugagcgacaucaagaaguccccggacgggacccgcgucgugggcaagugcgggggcuacugcggcaagugcacccccagcuccgggacgggccuggaggugcggguccuguga

SEQ ID NO: 26340 - RNA, 5289 nt, Artificial Sequence
  derived and/or modified sequence opt1 from ADAMTSL1__Homo_sapiens__NP_001035362
auggagugcugccgccgggccacccccggcacccugcugcuguuccuggccuuccugcugcugagcucccgcacggcccggagcgaggaggaccgcgacgggcugugggacgccuggggcccgugguccgagugcagccggaccugcgggggcggggccuccuacagccugcgccggugccuguccagcaaguccugcgagggccgcaacauccgguaccggacgugcagcaacguggacugcccgcccgaggccggcgacuuccgggcccagcagugcuccgcccacaacgacgugaagcaccacgggcaguucuacgaguggcuccccgugagcaacgacccggacaaccccugcucccugaagugccaggccaagggcaccacgcuggugguggagcucgcccccaaggugcuggacgggacccgcugcuacaccgagagccuggacaugugcaucuccggccucugccagaucguggggugcgaccaccagcugggcagcaccgucaaggaggacaacugcggcgugugcaacggggacggcuccacgugccggcuggugcgcgggcaguacaagagccagcucuccgccaccaagagcgacgacaccgucguggccauccccuacggcagccggcacauccgccuggugcugaagggcccggaccaccucuaccuggagaccaagacgcugcaggggaccaagggcgagaacucccucagcuccaccgggaccuuccuggucgacaacagcuccguggacuuccagaaguuccccgacaaggagauccugcggauggccggcccccucacggccgacuucaucgugaagauccgcaacagcggguccgccgacagcaccguccaguucaucuucuaccagcccaucauccaccgguggcgcgagaccgacuucuucccgugcuccgcgacgugcggcggcggguaccagcugacgagcgccgagugcuacgaccugcgguccaaccgcgugguggccgaccaguacugccacuacuaccccgagaacaucaagcccaagcccaagcuccaggagugcaaccuggacccgugccccgccagcgacggcuacaagcagaucaugcccuacgaccuguaccacccccucccgcgcugggaggccacccccuggaccgccugcuccagcuccugcgggggcgggauccagagccgggcggucuccugcguggaggaggacauccagggccacgugaccagcgucgaggaguggaagugcauguacacgcccaagaugcccaucgcccagccgugcaacaucuucgacugccccaaguggcuggcccaggaguggucccccugcaccgugaccugcggccaggggcugcgcuaccgggugguccucugcaucgaccaccgcggcaugcacaccgggggcugcagccccaagacgaagccgcacaucaaggaggagugcaucgugcccacccccugcuacaagccgaaggagaagcugcccgucgaggccaagcugcccugguucaagcaggcccaggagcucgaggagggggcggccgugagcgaggagcccuccuucaucccggaggccuggagcgccugcaccgugaccugcggcgucggcacccaggugcggaucgugcgcugccagguccugcuguccuucagccaguccguggccgaccuccccaucgacgagugcgaggggcccaagcccgcgagccagcgggccugcuacgccggcccgugcuccggggagauccccgaguucaaccccgacgagaccgacggccuguucggcgggcugcaggacuucgacgagcucuacgacugggaguacgagggcuucaccaagugcagcgaguccugcgggggcggggugcaggaggccgucgugagcugccugaacaagcagacccgcgagcccgcggaggagaaccugugcgugacgucccggcgcccgccccagcuccugaaguccugcaaccuggaccccugccccgcccggugggagaucggcaagugguccccgugcagccugaccugcggcgucgggcuccagacccgcgacguguucugcucccaccuccugagccgggagaugaacgagaccgugauccucgccgacgagcugugccgccagcccaagcccuccaccguccaggccugcaaccgguucaacugcccgcccgccugguaccccgcgcaguggcagcccugcagccgcacgugcggcgggggcgugcagaagcgggaggugcugugcaagcagcgcauggccgacgggagcuuccucgagcugcccgagaccuucugcuccgccagcaagcccgccugccagcaggccugcaagaaggacgacugccccuccgaguggcugcucagcgacuggaccgagugcuccaccagcugcggcgagggcacgcagacccgguccgcgaucugccgcaagaugcugaagaccgggcugagcaccgucgugaacuccacgcucugcccgccccugcccuucagcuccagcauccgccccugcaugcuggcgaccugcgcccggcccggccgccccuccaccaagcacagcccccacaucgccgccgcgcggaagguguacauccagacccgccggcagcgcaagcuccacuucgucgucggcggguucgccuaccugcugcccaagacggccgugguccuccggugccccgcccgccgggugcgcaagccgcugaucaccugggagaaggacgggcagcaccugaucuccagcacccacgugaccgucgcgcccuucggguaccucaagauccaccggcugaagcccuccgacgccggcguguacacgugcagcgccgggcccgcccgcgagcacuucgugaucaagcugaucggcgggaaccggaagcucgucgcccgcccgcugagcccccgcagcgaggaggaggugcuggcgggccgcaagggcggccccaaggaggcccuccagacccacaagcaccagaacggcaucuucagcaacggguccaaggccgagaagcggggccuggccgccaaccccgggagccgcuacgacgaccuggugucccggcuccuggagcagggcggcuggccgggggagcugcucgcgagcugggaggcccaggacuccgccgagcgcaacaccaccagcgaggaggaccccggcgccgagcagguccugcugcaccuccccuucacgauggugaccgagcagcggcgccuggacgacauccuggggaaccucucccagcagcccgaggagcugcgcgaccuguacagcaagcaccucguggcccagcuggcgcaggagaucuuccggucccaccuggagcaccaggacacccuccugaagccgagcgagcgccggaccucccccgucacgcugagcccccacaagcacguguccggcuucagcuccagccuccgcaccuccagcaccggggacgccggcggcgggucccggcgcccccaccggaagccgaccauccugcgcaagaucagcgccgcccagcagcugagcgcguccgagguggucacgcaccucggccagaccguggcccuggccagcgggacccuguccgugcuccugcacugcgaggccaucggccacccccggcccaccaucagcugggcccgcaacggggaggagguccaguucuccgaccggauccugcuccagcccgacgacagccugcagauccuggcgccgguggaggccgacgugggcuucuacacgugcaacgccaccaacgcccucggcuacgacuccgucagcaucgccgugacccuggcggggaagccccuggugaagaccucccgcaugacggucaucaacaccgagaagcccgccgugaccguggacaucggcagcaccaucaagaccguccagggggugaacgucacgaucaacugccagguggccggcgugccggaggccgaggucaccugguuccggaacaaguccaagcucgggagcccccaccaccuccacgagggcucccugcuccugaccaacgugagcuccagcgaccagggccuguacuccugccgcgccgcgaaccuccacggggagcugaccgagagcacgcagcugcucauccuggacccgccccaggugccgacccagcuggaggacauccgggcccuccuggccgccaccggccccaaccugcccuccguccucaccagcccccuggggacgcagcuggugcucgacccgggcaacagcgcccugcugggcugccccaucaaggggcaccccgugcccaacaucaccugguuccacggcgggcagccgaucgucaccgcgaccggccucacgcaccacauccuggccgccgggcagauccuccagguggccaaccucuccggcggcagccagggggaguucuccugccuggcgcagaacgaggccggcgugcugaugcagaaggccagccucgucauccaggacuacuggugguccguggaccgccuggcgaccugcagcgccuccugcgggaaccggggcgugcagcagccccgccugcggugccuccugaacagcaccgaggucaaccccgcgcacugcgccgggaaggugcgccccgccgugcagccgaucgccugcaaccgccgggacugccccucccgcuggauggucaccagcugguccgccugcacgcggagcugcggcggcggggugcagacccgccgggugaccugccagaagcugaaggcguccggcaucagcacccccgucuccaacgacaugugcacccagguggccaagcgccccguggacacccaggccugcaaccagcagcugugcgucgagugggccuucagcuccugggggcagugcaacggcccgugcaucgggccccaccucgccgugcagcaccggcaggucuucugccagacccgcgacggcaucacccugcccagcgagcagugcuccgcgcugccccggccggucagcacgcagaacugcuggagcgaggccugcuccgugcacuggcgcgugagccucuggacccugugcaccgcgaccugcggcaacuacggguuccagucccggcgcgucgagugcgugcacgcccggacgaacaaggcggugcccgagcaccugugcagcuggggcccccgccccgccaacuggcagcggugcaacaucaccccgugcgagaacauggagugccgcgacaccacccgguacugcgagaaggucaagcagcucaagcugugccagcugucccaguucaagagccgcugcugcgggacgugcggcaaggccuga

SEQ ID NO: 26341 - RNA, 2856 nt, Artificial Sequence
  derived and/or modified sequence opt1 from ADAMTSL2__Homo_sapiens__NP_001138792
auggacggccgcuggcagugcagcugcugggccugguuccugcucgugcuggccgucguggcgggggacaccguguccaccggcagcacggacaacucccccaccagcaacucccuggagggcgggaccgacgccaccgccuucugguggggcgaguggacgaaguggaccgccugcagccgguccugcgggggcggggucaccagccaggagcgccacugccuccagcagcggcgcaaguccgugcccggccccgggaaccggaccugcacgggcaccagcaagcgcuaccagcugugccgggugcaggagugcccgcccgacgggcgcuccuuccgggaggagcagugcgucagcuucaacucccacguguacaacggccgcacccaccaguggaagccccuguaccccgacgacuacgugcacaucagcuccaagcccugcgaccuccacugcaccacggucgacggccagcggcagcugauggugcccgcccgcgacgggaccagcugcaagcugaccgaccuccggggcgugugcgucuccgggaagugcgagccgaucggcugcgacggcgugcuguucagcacccacacgcuggacaagugcgggaucugccagggcgacggguccagcugcacccacgugaccggcaacuaccgcaaggggaacgcgcaccucggcuacagccuggucacccacauccccgccggcgcccgggacauccagaucguggagcgcaagaaguccgccgacgugcuggcgcucgccgacgaggccggguacuacuucuucaacggcaacuacaaggucgacagccccaagaacuucaacaucgccgggacgguggugaaguaccggcgccccauggacgucuacgagaccggcaucgaguacaucguggcccaggggccgaccaaccagggccugaacgugauggucuggaaccagaacggcaagucccccagcaucaccuucgaguacacgcugcuccagccgccccacgagucccggccccagcccaucuacuacggguucagcgaguccgcggagagccagggccuggacggggccggccugaugggguucgugccccacaacggcucccucuacggccaggccagcuccgagcgccuggggcuggacaaccgccucuucggccaccccgggcuggacauggagcugggcccgagccagggccaggagaccaacgaggucugcgagcaggccgggggcggggccugcgagggcccgccccgggggaagggcuuccgcgaccggaacgugaccggcacgccccucaccggggacaaggacgacgaggagguggacacccacuucgcgucccaggaguucuucagcgccaacgccaucuccgaccagcugcugggcgccgggagcgaccucaaggacuucacccugaacgagaccgucaacuccaucuucgcccagggcgcgccccgcagcucccuggccgagagcuucuucguggacuacgaggagaacgagggggccggccccuaccuccugaacggcagcuaccuggagcucuccagcgaccggguggccaacuccagcuccgaggcccccuuccccaacgucagcacgucccugcugaccagcgcggggaaccgcacccacaaggcccggacccgcccgaaggcccggaagcagggcgugucccccgccgacauguaccgcuggaagcucagcucccacgagcccugcagcgcgacgugcaccaccggggugauguccgccuacgccaugugcguccgguacgacggcguggagguggacgacagcuacugcgacgcccugacccgcccggagcccguccacgaguucugcgccgggcgggagugccagccccgcugggagaccuccagcugguccgagugcagccggacgugcggcgagggcuaccaguuccgcguggugcggugcuggaagaugcugagccccggguucgacuccagcgucuacuccgaccucugcgaggcggccgaggccgugcgcccggaggagcggaagaccugccgcaaccccgccugcggcccccagugggagaugagcgagugguccgagugcaccgccaagugcggggagcggagcguggucacccgcgacauccgcugcuccgaggacgagaagcugugcgaccccaacacgcggccggugggcgagaagaacugcaccgggccgcccugcgaccgccaguggaccgugagcgacuggggccccugcuccggcagcugcgggcagggccggaccauccgccacgucuacugcaagacguccgacgggcggguggugcccgagagccagugccagauggagaccaagccccuggcgauccaccccugcggcgacaagaacugccccgcccacuggcucgcccaggacugggagcgcugcaacacgaccugcggccgcggggucaagaagcggcuggugcugugcauggagcucgccaacggcaagccgcagacccgguccgggcccgagugcggccuggccaagaagccgcccgaggaguccacgugcuucgagcgccccugcuucaagugguacaccagccccuggagcgagugcaccaagaccugcggggugggcguccggaugcgcgacgugaagugcuaccagggcaccgacaucgugcgggggugcgacccccuggucaagcccgugggccgccaggcgugcgaccugcagccgugccccaccgagcccccggacgacuccugccaggaccagcccgggaccaacugcgcccucgccaucaaggugaaccugugcggccacugguacuacagcaaggccugcugccgguccugccgcccgccccacagcuga

SEQ ID NO: 26342 - RNA, 5076 nt, Artificial Sequence
  derived and/or modified sequence opt1 from ADAMTSL3__Homo_sapiens__NP_997400
auggccagcuggaccagccccuggugggugcugaucgggauggucuucaugcacagcccccucccccagaccaccgccgagaagucccccggggccuacuuccugcccgaguucgcccugagcccccagggcuccuuccucgaggacaccaccggggagcaguuccugaccuaccgcuacgacgaccagaccagccggaacacccgcuccgacgaggacaaggacggcaacugggacgccuggggcgacuggagcgacugcucccggaccugcggcggcggggccagcuacucccugcgccggugccucaccggccgcaacugcgaggggcagaacauccgguacaagacgugcagcaaccacgacugcccgcccgacgccgaggacuuccgcgcccagcagugcuccgccuacaacgacgugcaguaccagggccacuacuacgaguggcugccccgguacaacgacccggccgcccccugcgcccugaagugccacgcccaggggcagaaccucguggucgagcuggcccccaaggugcuggacggcacccgcugcaacaccgacagccucgacaugugcaucuccggcaucugccaggccguggggugcgaccggcagcugggcagcaacgccaaggaggacaacugcggggucugcgcgggcgacggcagcacgugccgccuggugcgggggcagagcaagucccacgugagccccgagaagcgcgaggagaacgucaucgccgugccccucggcagccgguccgugcgcaucaccgucaaggggcccgcccaccuguucaucgagagcaagacccugcagggcuccaagggggagcacagcuucaacucccccggcguguuccucguggagaacaccaccgucgaguuccagcggggcagcgagcgccagacguucaagauccccgggccgcugauggccgacuucaucuucaagacccgguacaccgccgcgaaggacuccguggugcaguucuucuucuaccagcccaucagccaccaguggcgccagaccgacuucuuccccugcacggugaccugcggcgggggcuaccagcugaacuccgccgagugcguggacauccggcucaagcgcgugguccccgaccacuacugccacuacuacccggagaacgugaagcccaagcccaagcugaaggagugcagcauggaccccugcccguccagcgacggguucaaggagaucaugcccuacgaccacuuccagccccugccccgcugggagcacaacccguggaccgccugcuccgugagcugcggcggcgggauccagcggcgcuccuucgucugcguggaggagagcaugcacggcgagauccuccaggucgaggaguggaagugcauguacgcccccaagcccaaggugaugcagaccugcaaccuguucgacugcccgaaguggaucgccauggaguggucccagugcacggugaccugcgggcggggccugcgcuaccgggucgugcucugcaucaaccaccgcggggagcacgugggcggcugcaacccccagcugaagcugcacaucaaggaggagugcgucauccccauccccugcuacaagccgaaggagaagucccccguggaggcgaagcuccccuggcugaagcaggcccaggagcuggaggagacccggaucgccaccgaggagcccacguucaucccggagcccugguccgccugcagcacgaccugcgggcccggcgugcagguccgcgaggugaagugccgggugcuccugaccuucacgcagaccgagaccgagcugcccgaggaggagugcgaggggccgaagcuccccaccgagcgccccugccugcuggaggccugcgacgagagccccgcgucccgggagcucgacaucccgcugcccgaggacagcgagacgaccuacgacugggaguacgccggcuucacccccugcaccgcgaccugcgucggcgggcaccaggaggccaucgcggugugccugcacauccagacgcagcagaccgugaacgacucccucugcgacaugguccaccggccgcccgccaugagccaggccugcaacaccgagcccugcccgccccgcuggcacgugggcuccugggggcccugcagcgcgaccugcggcguggggauccagacgcgcgacgucuacugccugcaccccggcgagacccccgccccgcccgaggagugccgggacgagaagccccacgcgcugcaggccugcaaccaguucgacugcccgcccggcuggcacaucgaggaguggcagcagugcucccggaccugcgggggcgggacccagaaccggcgcgugacgugccggcagcuccugaccgacggcagcuuccugaaccucuccgacgagcugugccaggggcccaaggccagcucccacaagagcugcgcccgcaccgacugcccgccccaccuggccgugggcgacugguccaagugcagcgucuccugcggcguggggauccagcgccggaagcaggucugccagcgccuggcggccaagggccggcgcaucccccucagcgagaugaugugccgggaccugcccgggcugccccucguccgcuccugccagaugcccgagugcagcaagaucaagagcgagaugaagaccaagcugggcgagcaggggccgcagauccuguccgugcagcggguguacauccagacgcgcgaggagaagcggaucaaccucaccaucggcagccgcgccuaccugcugcccaacaccuccgucaucaucaagugccccgugcggcgcuuccagaagucccucauccagugggagaaggacggccggugccugcagaacuccaagcgccuggggaucaccaagagcggcucccucaagauccacgggcuggccgcccccgacaucggcguguaccggugcaucgcggggagcgcccaggagacggucgugcugaagcucaucggcaccgacaaccgccugaucgcccggccggcccugcgcgagcccaugcgggaguaccccggcauggaccacuccgaggcgaacagccucggggugaccuggcacaagaugcgccagauguggaacaacaagaacgaccuguaccuggacgacgaccacaucuccaaccagcccuuccuccgggcccugcugggccacugcagcaacuccgccgggagcaccaacuccugggagcucaagaacaagcaguucgaggccgccgucaagcagggcgcguacagcauggacacggcccaguucgacgagcugauccgcaacaugucccagcugauggagaccggcgaggugagcgacgaccucgccucccagcugaucuaccagcugguggccgagcucgccaaggcgcagccgacccacaugcaguggcgcgggauccaggaggagacgccgcccgccgcccagcugcggggcgagacggggagcgucagccaguccagccacgccaagaacuccggcaagcugaccuucaagcccaaggggccggugcucaugcgccagagccagccgcccuccaucagcuucaacaagaccaucaacucccggaucggcaacaccguguacaucacgaagcgcaccgaggucaucaacauccugugcgaccugaucacccccagcgaggccaccuacacguggaccaaggacggcacccuccugcagccguccgugaagaucauccuggacgggaccggcaagauccagauccagaaccccacgcggaaggagcaggggaucuacgagugcagcguggcgaaccaccucggcuccgacgucgagagcuccagcgugcuguacgccgaggcccccgugauccuguccgucgagcgcaacaucaccaagccggagcacaaccaccucagcgugguggucgggggcaucguggaggccgcgcugggcgccaacgugaccauccggugccccgucaagggggugccccagcccaacaucaccuggcugaagcgcggcgggucccucagcggcaacgucucccugcuguucaacgggagccuccugcugcagaacgugagccucgagaacgagggcaccuacgugugcaucgccacgaacgcccugggcaaggccgucgcgaccuccgugcugcaccuccuggagcggcgcuggccggagagccggaucguguuccugcaggggcacaagaaguacauccuccaggccaccaacacccgcacgaacuccaacgaccccaccggcgagccgccgccccaggagcccuucugggagcccgggaacuggagccacugcuccgcgaccugcggccaccugggcgcccggauccagcgcccccagugcgucauggccaacgggcaggaggugagcgaggcgcugugcgaccaccuccagaagccccuggccggcuucgagcccugcaacauccgggacugccccgcccgcugguucaccuccguguggagccagugcuccgucagcugcggggagggcuaccacucccgccaggugacgugcaagcgcaccaaggccaacgggaccgugcaggucgugagcccccgggccugcgcgccgaaggaccgcccccugggccgcaagcccugcuucggccaccccugcgugcagugggagccggggaaccggugccccggccgcugcauggggcgggccguccgcaugcagcagcggcacaccgccugccagcacaacuccagcgacuccaacugcgacgaccgcaagcggcccacgcuccgccggaacugcaccagcggcgccugcgacgugugcuggcacaccgggcccuggaagccgugcaccgccgcgugcggccgcggcuuccagucccggaagguggacugcauccacacgcgcagcugcaagcccgucgccaagcggcacugcgugcagaagaagaagcccaucuccuggcgccacugccuggggcccagcugcgaccgggacugcaccgacaccacccacuacugcauguucgugaagcaccugaaccucugcagccuggaccgcuacaagcagcggugcugccaguccugccaggagggcuga

SEQ ID NO: 26343 - RNA, 3393 nt, Artificial Sequence
  derived and/or modified sequence opt1 from ADAMTSL4__Homo_sapiens__XP_011507946
augcuggcgccccgccgggccccgagcacgccccgcugccuccgcuccuucugcgaccagagcgcccccgccucccccuggggcagccgcgggggcgccauggagaacuggaccgggcggcccuggcuguaccugcuccugcugcucucccugccccagcugugccucgaccaggaggugcugagcggccacucccugcagacccccaccgaggaggggcagggccccgagggcgucugggggcccugggugcagugggccagcugcucccagcccugcggcguggggguccagcgccggagccggaccugccagcuccccaccgugcagcugcaccccucccugccccugccgccccgcccgccccgccaccccgaggcccugcugccccggggccaggggccccgcccccagacgagccccgagacccucccccuguaccggacccagucccgcggccggggcgggccccugcgcggccccgccagccaccucgggcgggaggagacccaggagauccgcgccgcccggcgcucccggcugcgcgaccccaucaagcccggcauguucggcuacgggcgcgugcccuucgcccugccccuccaccggaaccgccggcacccccgcagcccgccccgguccgagcugagccugaucuccagccgcggcgaggaggccauccccagccccacgccccgggccgagcccuucuccgccaacgggagcccccagaccgagcugccgcccaccgagcuguccguccacacccccagcccccaggccgagccccugucccccgagacggcccagaccgagguggcgccccgcacccggcccgcgccccugcgccaccacccccgggcccaggccagcggcaccgagccgcccucccccacgcacagccugggggagggcggcuucuuccgcgccagcccccagccccggcgccccuccucccaggggugggccagcccccagguggccggccggcgccccgacccguuccccuccgucccccgggggcgcggccagcaggggcagggcccguggggcaccgggggcacgccccacgggccccggcuggagcccgacccgcagcaccccggcgccuggcucccccugcugagcaacgggccccacgccuccagccucuggucccuguucgccccgagcucccccaucccccgcugcagcggcgagagcgagcagcugcgcgcgugcucccaggcccccugcccgcccgagcagcccgacccccgggcccuccagugcgccgccuucaacagccaggaguucaugggccagcuguaccagugggagccguucaccgaggcgccccugcucccccugcgccacgccuucuuccugcuccccggggccggcuccggggacagcaccggcgugcagggcucccagcggugcgagcugaacugccgcccgcggggguuccgcuucuacgugcggcacaccgagaagguccaggacggcacccugugccagcccggggcccccgacaucugcguggcgggccgcugccucagccccgggugcgacggcauccugggcuccgggcggcgcccggacggcugcggggugugcggcggggacgacagcacgugccggcuggucuccggcaaccugaccgaccgcggcgggccccucggcuaccagaagauccuguggauccccgccggggcccugcggcuccagaucgcccagcugcgccccuccuccaacuaccuggcccuccggggccccggcgggcgcagcaucaucaacggcaacugggcgguggacccgcccggguccuaccgggccggcgggaccguguuccgcuacaaccggccgccccgcgaggagggcaagggggagagccuguccgccgagggccccaccacccagcccgucgacguguacaugaucuuccaggaggagaacccgggcguguucuaccaguacgucaucagcagcccgccgcccauccuggagaacccgacgcccgagccgcccgugccgcagcuccagcccgagauccugcggguggagccgccccucgccccggcgccccgccccgcgcgcacccccgggacccuccagcggcagguccgcaucccgcagaugcccgcgccgccccacccgcggacgccccucggcagccccgccgccuacuggaagcgcguggggcacagcgccugcuccgcgagcugcggcaagggcgucuggcggcccaucuuccugugcaucucccgcgagagcggggaggagcucgacgagcgguccugcgccgccggcgcccgcccgcccgcgagccccgagccgugccacgggacccccugcccgcccuacugggaggccggcgaguggaccuccugcagccgguccugcgggccgggcacccagcaccgccagcugcagugccggcaggaguucggcgggggcgggagcuccgugccgcccgagcgcugcggccaccucccccggccgaacaucacccagagcugccagcuccgccugugcgggcacugggaggugggcucccccuggagccagugcuccguccggugcggccgcgggcagcggagccgccaggugcggugcgugggcaacaacggggacgaggucuccgagcaggagugcgccagcgggccgccccagccgcccucccgcgaggccugcgacauggggcccugcacgaccgccugguuccacagcgacuggagcuccaagugcagcgcggagugcggcaccggcauccagcgccgguccguggugugccuggggagcggcgccgcccucgggcccggccagggcgaggccggggccggcaccgggcaguccugcccgaccggcagccggccgcccgacaugcgggcgugcucccuggggcccugcgagcgcacguggcggugguacaccggcccguggggcgagugcagcuccgagugcgggagcggcacccagcgccgggacaucaucugcgucuccaagcuggggaccgaguucaacgugacgagccccuccaacugcagccaccucccccgcccgcccgcccugcagcccugccagggccaggccugccaggaccggugguucuccacccccuggagccccugcucccgcagcugccagggcggcacccagacccgggaggugcagugccuguccacgaaccagacccucagcacccgcugcccgccccagcugcggcccagccgcaagcggcccugcaacucccagcccugcagccagcgccccgacgaccagugcaaggacuccagcccccacugcccgcuggucgugcaggcccggcucugcguguaccccuacuacaccgccacgugcugccgcuccugcgcgcacguccuggagcggagcccccaggaccccuccuga

SEQ ID NO: 26344 - RNA, 1416 nt, Artificial Sequence
  derived and/or modified sequence opt1 from ADAMTSL5__Homo_sapiens__NP_998769
auggacagcgcgccccuguucccgcgcccccaccucuuccagaaccugcuccuguuccugugggcccugcucaacugcggccuggggguguccgcccagggccccggggaguggacccccugggucagcuggacccggugcuccagcuccugcggccgcggggugagcgugcggucccgccggugccugcgccucccgggcgaggagcccugcuggggcgacagccacgaguaccggcugugccagcugcccgacugcccgcccggggccguccccuuccgcgaccuccagugcgcccuguacaacggccggcccgugcuggggacgcagaagaccuaccagugggugcccuuccacggcgccccgaaccagugcgaccucaacugccuggccgaggggcacgcguucuaccacuccuucggccgcguccuggacggcaccgccugcagccccggggcccagggcgugugcguggccgggcggugccucuccgcgggcugcgacggccugcuggggagcggcgcccucgaggaccgcugcgggcggugcggcggggccaacgacuccugccuguucguccagcgcguguuccgggacgccggcgccuucgcgggcuacuggaacgugacccugauccccgagggggcccgccacauccgggucgagcaccgcagccggaaccaccucgcccugaugggcggggacggccgcuacgugcugaacgggcacuggguggucuccccgcccggcacguacgaggccgccggcacccacgugguguacacccgggacaccgggccccaggagacgcuccaggcggccggccccaccagccacgaccugcugcuccagguccugcugcaggagcccaacccggggaucgaguucgaguucuggcucccccgcgagcgcuacucccccuuccaggcccgggugcaggcccugggcuggccccugcgccagccgcagccccgcgggguggagccccagcccccggccgcgcccgccgucacccccgcccagaccccgacgcucgcccccgaccccugcccgcccugccccgacacccggggccgggcccaccgccugcugcacuacugcggcagcgacuucguguuccaggcgcgggugcucgggcaccaccaccaggcccaggagacccgcuacgagguccggauccagcugguguacaagaaccgcagcccccugcgggcccgcgaguacgucugggcccccggccacugcccgugccccaugcucgcgccccaccgggacuaccugauggccgugcagcgccuggugucccccgacgggacccaggaccagcuccugcugccgcacgccggcuacgcccggcccuggagccccgccgaggacucccgcauccggcucacggcgcgccggugccccggcuga

SEQ ID NO: 26345 - RNA, 1158 nt, Artificial Sequence
  derived and/or modified sequence opt1 from ADAP1__Homo_sapiens__NP_001271237
auguuccaguucguguucagccgcgucuacugcaucaaccccgcccggcgcaaguggaaggaguucgagaagaugcugggcugcgccgaggaggggcacgcgucccucggccgggacccggacugggccagcuacacccuggggguguucaucugccuguccugcagcggcauccaccgcaacaucccccagguguccaaggucaagagcgugcggcucgacgccugggaggaggcccagguggaguucauggccucccacgggaacgacgcggcccgcgcccgguucgagagcaagguccccuccuucuacuaccgccccaccccgagcgacugccagcugcugcgggagcaguggauccgcgccaaguacgagcggcaggaguucaucuaccccgagaagcaggagcccuacuccgcgggcuaccgcgagggcuuccucuggaagcgggggcgcgacaacggccaguuccugagccggaaguucgugcugacggagcgcgagggggcccucaaguacuucaaccggaacgacgccaaggagcccaaggccgugaugaagaucgagcaccugaacgccaccuuccagccggcgaagaucggccacccccacgggcugcaggucaccuaccucaaggacaacuccacccgcaacaucuucaucuaccacgaggacggcaaggagaucguggacugguucaacgcccugcgggccgcccgcuuccacuaccuccagguggccuuccccggcgcgagcgacgccgaccugguccccaagcugucccggaacuaccugaaggagggguacauggagaagacgggcccgaagcagaccgagggguuccgcaagcgcugguucaccauggacgaccggcgccucauguacuucaaggacccccuggacgccuucgcccggggcgagguguucaucggcagcaaggaguccggguacaccgugcugcacggcuucccgcccagcacgcaggggcaccacuggccccacggcaucaccaucgucacccccgaccgcaaguuccucuucgccugcgagaccgaguccgaccagcgggaguggguggcggccuuccagaaggccguggaccgccccaugcugccccaggaguacgccgucgaggcccacuucaagcacaagccguga

SEQ ID NO: 26346 - RNA, 1146 nt, Artificial Sequence
  derived and/or modified sequence opt1 from ADAP2__Homo_sapiens__NP_060874
augggcgaccgcgagcggaacaagaagcgccugcucgagcugcugcgggcccccgacaccgggaacgcccacugcgcggacugcggcgccgccgacccggacugggccagcuacaagcucgggaucuucaucugccugaacugcugcggcgugcaccgcaacuuccccgacaucucccgggucaagagcgugcgccuggacuucugggacgacuccaucguggaguucaugauccacaacgggaaccuccgggucaaggccaaguucgaggcgcgcgugcccgccuucuacuacaucccccaggccaacgacugccuggugcugaaggagcaguggauccgggccaaguacgagcgccgggaguucauggcggacggcgagaccaucagccucccgggcaaccgcgagggguuccuguggaagcggggccgcgacaacucccaguuccugcggcgcaaguucguccuccuggcccgggaggggcugcucaaguacuucacgaaggagcagggcaagagccccaaggccgugaucuccaucaaggaccugaacgccaccuuccagaccgagaagaucgggcacccccacggccugcagaucaccuaccgccgggacggccacacgcgcaaccucuucguguaccacgagagcgggaaggagaucgucgacugguucaacgcccugcgggcggcccgccugcaguaccucaagauggccuuccccgagcugccggaguccgagcuggugcccuuccucacccgcaacuaccugaagcagggcuucauggagaagaccgggcccaagcagaaggagcccuucaagaagcggugguucgcccuggacugccacgagcgccggcuccuguacuacaagaacccgcuggacgccuucgagcagggccagguguuccucggcaacaaggagcagggguacgaggcguacgaggaccugcccaagggcauccgcgggaaccgguggaaggccggccugaccaucgucacgcccgagcgccgguucgugcugaccugccccagcgagaaggagcagcaggaguggcucgagucccugcgcggggugcucagcuccccgcugacgccccugaaccggcucaccgccagcaccgaguccggccgcagcucccgguga

SEQ ID NO: 26347 - RNA, 2145 nt, Artificial Sequence
  derived and/or modified sequence opt1 from ADARB1__Homo_sapiens__NP_056649
auggacaucgaggacgaggagaacaugagcuccagcuccaccgacgugaaggagaaccgcaaccuggacaacgucagccccaaggacggcuccaccccggggcccggcgaggggagccagcucuccaacggcgggggcggcgggcccggccggaagcgcccccuggaggaggggagcaacggccacuccaaguaccggcugaagaagcgccggaagacgccggggcccgugcuccccaagaacgcccugaugcagcugaacgagaucaagcccggccuccaguacacccugcugagccagaccggcccggugcacgcgccccucuucgucauguccguggaggugaacgggcaggucuucgagggcagcgggcccaccaagaagaaggccaagcugcacgccgccgagaaggcccugcgcuccuucgugcaguuccccaacgccagcgaggcgcaccucgccaugggccggacgcuguccgugaacaccgacuucaccagcgaccaggccgacuucccggacacccuguucaacggcuucgagacgcccgacaaggccgagccgcccuucuacgucggguccaacggcgacgacagcuucuccagcagcggggaccucucccugagcgcguccccggugcccgccagccuggcccagccgccccuccccgugcugccgcccuucccgccgcccuccggcaagaaccccgucaugauccugaacgagcuccgccccgggcugaaguacgacuuccugagcgaguccggcgagagccacgccaaguccuucgugaugagcguggucguggacggccaguucuucgagggguccggccggaacaagaagcucgccaaggcgcgcgccgcccagagcgcccuggccgcgaucuucaaccugcaccucgaccagacccccucccggcagcccauccccagcgaggggcugcagcugcaccucccccaggugcuggccgacgccgucucccgccuggugcucggcaaguucggggaccugaccgacaacuucagcagcccccacgcccggcgcaaggugcuggccggcgucgugaugaccacgggcaccgacgugaaggacgcgaaggucaucuccguguccaccgggaccaagugcaucaacggcgaguacaugagcgaccgggggcucgcccugaacgacugccacgccgagaucaucagccgccggucccugcuccgcuuccuguacacgcagcuggagcucuaccugaacaacaaggacgaccagaagcggagcaucuuccagaaguccgagcgcggcggguuccggcugaaggagaacguccaguuccaccucuacaucagcaccucccccugcggcgacgcccgcaucuucagcccccacgagcccauccuggagggcucccgcagcuacacccaggccggggugcaguggugcaaccacggcucccugcagccccggccgcccgggcuccugagcgaccccuccaccagcacguuccagggcgcgggcaccaccgagcccgccgaccgccaccccaaccggaaggcccgcgggcagcugcggaccaagaucgaguccggcgaggggacgauccccgugcgcagcaacgccuccauccagaccugggacggcguccugcagggggagcggcuccugaccaugagcugcuccgacaagaucgcgcgcuggaacguggugggcauccagggcagccugcucagcaucuucgucgagccgaucuacuucuccagcaucauccuggggucccuguaccacggcgaccaccucagccgggccauguaccagcgcaucuccaacaucgaggaccugccgccccuguacacccucaacaagccccugcugagcgggaucuccaacgccgaggcccggcagcccggcaaggcccccaacuucagcgugaacuggacggugggggacuccgcgaucgaggucaucaacgccaccaccggcaaggacgagcucggccgcgccagccggcugugcaagcacgcccuguacugccgcuggaugcgggugcacgggaaggugcccucccaccuccugcgcagcaagaucaccaagcccaacgucuaccacgaguccaagcuggccgcgaaggaguaccaggccgccaaggugcacuga

SEQ ID NO: 26348 - RNA, 2220 nt, Artificial Sequence
  derived and/or modified sequence opt1 from ADARB2__Homo_sapiens__NP_061172
auggccagcgugcugggcuccgggcgcggcagcgggggccucuccagccagcugaagugcaaguccaagcggcgccggcgccggcgcagcaagcggaaggacaaggucuccauccugagcaccuuccucgcccccuucaagcaccugucccccgggaucaccaacacggaggacgacgacacccugagcaccuccagcgcggaggugaaggagaaccgcaacgugggcaaccucgccgcccggcccccgcccuccggcgaccgcgcccgcgggggcgcccccggggcgaagcggaagcggccccuggaggagggcaacgggggccaccugugcaagcuccagcuggucuggaagaagcugagcugguccguggcccccaagaacgcccucgugcagcugcacgagcugcgccccggccuccaguaccggaccgucagccagacggggccggugcacgcccccguguucgcggucgccguggaggugaacggccugaccuucgaggggaccggccccaccaagaagaaggccaagaugcgcgccgccgagcuggcgcuccgguccuucguccaguuccccaacgccugccaggcccaccuggccaugggcgggggcccggggcccggcacggacuucaccagcgaccaggccgacuuccccgacacccuguuccaggaguucgagcccccggcgccccgccccgggcucgccggcggccggcccggggacgccgcccugcuguccgccgcguacggccgccggcgccuccugugccgcgcccuggaccucguggggccgacccccgccacgcccgccgcccccggcgagcggaacccggugguccugcugaaccgccuccgggcggggcugcgcuacgugugccuggccgagcccgccgagcggcgcgcccggagcuucgugauggcggucagcguggacggccgcaccuucgagggcuccgggcggagcaagaagcucgcccgcggccaggccgcccaggccgcgcugcaggagcuguucgacauccagaugcccgggcacgcccccggccgggcccgccggaccccgaugccccaggaguucgccgacuccaucagccagcucgugacccagaaguuccgcgaggucacgaccgaccugacccccaugcacgcccggcacaaggcgcuggccgggaucgugaugaccaagggccucgacgcccgccaggcccagguggucgcccuguccagcggcacgaagugcaucuccggggagcaccugagcgaccagggccucguggucaacgacugccacgcggaggugguggcccggcgcgccuuccugcacuuccuguacacccagcucgagcugcaccuguccaagcggcgcgaggacagcgagcgcuccaucuucguccggcucaaggagggcggguaccgccugcgggagaacauccuguuccaccuguacgugagcaccuccccgugcggcgacgcccgccuccacagccccuacgagaucaccacggaccugcacuccagcaagcaccuggugcggaaguuccgcgggcaccuccggaccaagaucgaguccggcgaggggaccguccccgugcgcggccccagcgcggugcagaccugggacgggguccugcugggcgagcagcucaucacgauguccugcaccgacaagaucgcccgguggaacgugcugggccugcagggggcccuccugagccacuucguggagccggucuaccugcagagcaucguggugggcucccuccaccacaccgggcaccuggcccgcgucaugagccaccggauggagggcguggggcagcugcccgccuccuaccgccacaaccggccccuccugagcggcguguccgacgcggaggcccgccagcccggcaagagcccgcccuucuccaugaacugggucguggggagcgccgaccuggagaucaucaacgccaccacgggccggcgcuccugcgggggccccagccggcucugcaagcacgugcuguccgcccgcugggcgcggcuguacgggcgccucagcacccggacccccuccccgggcgacacccccagcauguacugcgaggccaagcugggcgcccacacguaccaguccgucaagcagcagcuguucaaggccuuccagaaggccgggcucggcaccugggugcgcaagccgcccgagcagcagcaguuccugcugacccucuga

SEQ ID NO: 26349 - RNA, 2796 nt, Artificial Sequence
  derived and/or modified sequence opt1 from ADAR__Homo_sapiens__NP_001020278
auggccgagaucaaggagaagaucugcgacuaccuguucaacgugagcgacuccagcgcccucaaccuggcgaagaacaucggccugaccaaggcccgcgacaucaacgccguccucaucgacauggagcggcagggggacguguaccgccagggcaccacgcccccgaucuggcaccugaccgacaagaagcgggagcgcaugcagaucaagcggaacaccaacuccgugcccgagaccgcccccgccgcgauccccgagacgaagcgcaacgccgaguuccugaccugcaacaucccgaccagcaacgccuccaacaacauggucaccacggagaagguggagaacgggcaggagcccgugaucaagcucgagaaccggcaggaggcccgccccgagcccgcgcggcugaagccgcccguccacuacaacggccccagcaaggccggguacguggacuucgagaacggccagugggccaccgacgacauccccgacgaccugaacuccauccgcgccgccccgggcgaguuccgggcgaucauggagaugcccagcuucuacucccacgggcucccccgcugcagccccuacaagaagcugaccgagugccagcugaagaacccgaucuccggccuccuggaguacgcccaguucgccagccagaccugcgaguucaacaugaucgagcaguccgggccgccccacgagccccgguucaaguuccagguggucaucaacggccgcgaguucccgcccgccgaggccgggagcaagaagguggcgaagcaggacgccgccaugaaggccaugacgauccugcucgaggaggccaaggcgaaggacuccggcaagagcgaggaguccagccacuacuccaccgagaaggagagcgagaagaccgccgagagccagacccccacgcccuccgccaccagcuucuucuccggcaagagccccgugaccacccugcuggagugcaugcacaagcucgggaacuccugcgaguuccggcugcugagcaaggagggccccgcccacgagcccaaguuccaguacugcgucgccgugggggcgcagacguuccccuccgugagcgccccguccaagaaggucgccaagcagauggccgcggaggaggccaugaaggcccuccacggcgaggccaccaacagcauggccuccgacaaccagcccgagggcaugaucagcgagucccuggacaaccuggagagcaugaugcccaacaaggugcgcaagaucggggagcucgugcgguaccugaacaccaacccggucggcgggcugcucgaguacgcgcgcucccacggcuucgccgccgaguucaagcugguggaccagagcgggccgccccacgagcccaaguucguguaccaggccaaggucggcggccggugguuccccgccgugugcgcgcacuccaagaagcaggggaagcaggaggccgccgacgccgcccugcgcgugcucaucggcgagaacgagaaggcggagcggaugggguucaccgaggucacgcccgugaccggcgccagccugcgccgcaccaugcugcuccugucccggagccccgaggcccagcccaagacccugccgcucacggggagcaccuuccacgaccagaucgccaugcugucccaccgcugcuucaacacccugaccaacagcuuccagcccucccuccugggccggaagauccuggcggccaucaucaugaagaaggacagcgaggacaugggcgucguggugucccucgggacgggcaaccgcugcgucaagggggacagccugucccugaagggcgagaccgugaacgacugccacgccgagaucaucagccggcgcggguucauccgguuccucuacuccgagcugaugaaguacaacagccagaccgccaaggacuccaucuucgagcccgccaagggcggcgagaagcugcagaucaagaagaccgugagcuuccaccucuacaucuccacggcgcccugcggggacggcgcccuguucgacaagagcugcuccgaccgcgccauggagagcaccgagucccggcacuacccggucuucgagaaccccaagcaggggaagcugcgcaccaagguggagaacggcgagggcaccauccccguggagagcagcgacaucguccccaccugggacgggauccggcugggcgagcgccuccggacgauguccugcagcgacaagauccugcgcuggaacgugcuggggcuccagggcgcccugcugacccacuuccuccagccgaucuaccugaaguccgugacccugggguaccucuucagccagggccaccugacccgggccaucugcugccgcgucacgcgggacggcuccgcguucgaggacgggcugcgccaccccuucaucgugaaccaccccaaggugggccgggucagcaucuacgacuccaagcgccagagcgggaagaccaaggagaccuccgugaacuggugccucgccgacggcuacgaccuggagauccuggacgggacccgcggcacgguggacggcccccggaacgagcucagccgcgucuccaagaagaacaucuuccugcuguucaagaagcucugcagcuuccgguaccgccgggaccugcugcgccucuccuacggggaggccaagaaggccgcccgggacuacgagaccgcgaagaacuacuucaagaagggccugaaggacaugggguacggcaacuggaucagcaagccgcaggaggagaagaacuucuaccugugccccguguga

SEQ ID NO: 26350 - RNA, 435 nt, Artificial Sequence
  derived and/or modified sequence opt1 from ADAT2__Homo_sapiens__NP_001273188
augguguacaacaacgaggucgugggcaaggggcgcaacgaggugaaccagaccaagaacgccacccggcacgccgagauggucgcgaucgaccaggugcuggacuggugccgccagagcggcaagagccccagcgagguguucgagcacacgguccucuacgugaccguggagccgugcaucaugugcgccgccgcccugcggcugaugaagaucccccucgucguguacgggugccagaacgagcgcuucggcgggugcggcuccgugcugaacaucgccagcgcggaccugcccaacaccggccggcccuuccagugcaucccgggguaccgcgccgaggaggccgucgagaugcucaagaccuucuacaagcaggagaaccccaacgcccccaaguccaaggugcggaagaaggagugccagaaguccuga

SEQ ID NO: 26351 - RNA, 1104 nt, Artificial Sequence
  derived and/or modified sequence opt1 from ADAT3__Homo_sapiens__NP_612431
augauccugugcagccgccucugccugccccaguccgccagccugcggauggagccggcccccggccucguggagcagcccaagugccuggaggcggggucccccgagccggagcccgcccccuggcaggcccugcccguccucagcgagaagcaguccggcgacguggagcuggugcuggccuacgccgcgccgguccucgacaagcgccagaccagccggcugcugaaggagguguccgcccuccacccccugcccgcccagccccaccugaagcgcgugcggccgagccgcgacgccgggagcccccacgcgcucgagaugcugcugugccucgccggccccgccuccgggccccggucccuggccgagcugcucccgcgccccgccgucgacccccggggccugggccagcccuuccuggugccggugcccgcgcgcccgccccucacccgggggcaguucgaggaggcccgcgcccacuggcccacgagcuuccacgaggacaagcaggucaccuccgcccuggccggccggcuguucagcacccaggagcgcgcggccaugcagucccacauggagcgggccgugugggccgcccgccgggcggccgcccgcgggcuccgggccgugggcgccgucgugguggaccccgcgagcgaccgcguccuggccaccgggcacgacugcuccugcgccgacaacccccugcuccacgccgugauggugugcgucgaccugguggcgcggggccagggccgcgggacguacgacuuccgccccuucccggccugcagcuucgcccccgccgccgcgccccaggccgugcgggccggcgccguccgcaagcuggacgccgacgaggacgggcucccguaccugugcaccggcuacgaccuguacgugacccgggagcccugcgcgaugugcgccauggcccucgugcacgcccgcauccugcgggucuucuacggcgcccccucccccgacggggcgcugggcacccgcuuccggauccacgcccgcccggaccucaaccaccgguuccagguguuccgcgggguccuggaggagcagugccgguggcuggaccccgacacguga

SEQ ID NO: 26352 - RNA, 1944 nt, Artificial Sequence
  derived and/or modified sequence opt1 from ADCK3__Homo_sapiens__NP_064632
auggccgccauccugggcgacaccaucaugguggcgaaggggcucgucaagcugacccaggccgccguggagacgcaccuccagcaccucggcaucgggggcgagcugaucauggccgcccgcgcgcugcagagcaccgccguggagcagaucgggauguuccucggcaagguccagggccaggacaagcacgaggaguacuucgccgagaacuucgggggccccgagggggaguuccacuucuccgugccgcacgccgcgggcgccagcaccgacuucuccagcgccuccgcccccgaccagagcgccccgcccucccuggggcacgcgcacagcgagggccccgcccccgccuacguggccuccggccccuuccgggaggccggguuccccggccaggcgagcuccccgcuggggcgcgccaacggccggcuguucgccaacccccgcgacagcuucuccgccaugggcuuccagcggcgcuucuuccaccaggaccagagccccgucgggggccugaccgccgaggacaucgagaaggcgcggcaggccaaggcccgccccgagaacaagcagcacaagcagacgcuguccgagcacgcccgggagcgcaaggugccggugacccggaucgggcgccucgccaacuucggcgggcuggcggucggccugggcuucggggcccucgccgagguggccaagaagucccugcggagcgaggaccccagcggcaagaaggcggugcugggguccagccccuuccucagcgaggccaacgccgagcgcaucguccggacccugugcaaggugcgcggcgccgcccugaagcucgggcagaugcuguccauccaggacgacgcguucaucaacccccaccuggccaagaucuucgagcgggugcgccagagcgccgacuucaugccgcucaagcagaugaugaagacccugaacaacgaccugggccccaacuggcgggacaagcucgaguacuucgaggagcgccccuucgccgccgcguccaucggccagguccaccuggcccggaugaagggcgggcgcgagguggccaugaagauccaguaccccgggguggcccagagcaucaacuccgacgucaacaaccugauggccgugcucaacaugagcaacaugcugccggagggccuguuccccgagcaccucaucgacgugcugcgccgggagcuggcgcucgagugcgacuaccagcgcgaggccgccugcgcccggaaguuccgcgaccugcugaaggggcaccccuucuucuacguccccgagaucguggacgagcucugcuccccgcacgugcugacgaccgagcuggucagcggcuucccccucgaccaggcggagggccugucccaggagauccggaacgagaucugcuacaacauccuggugcucugccugcgcgagcuguucgaguuccacuucaugcagaccgaccccaacuggagcaacuucuucuacgacccccagcagcacaaggucgcccuccuggacuucggggccacccgggaguacgaccgcuccuucacggaccuguacauccagaucauccgggccgccgcggaccgcgaccgggagaccgugcgcgccaagagcaucgagaugaaguuccugaccggcuacgaggugaaggucauggaggacgcccaccucgacgccauccugauccugggggaggccuucgcguccgacgagccguucgacuucggcacccagagcacgaccgagaagauccacaaccucauccccgugaugcugcggcaccgccuggugcccccgcccgaggagaccuacucccuccaccggaagaugggcgggagcuuccugaucugcuccaagcugaaggcccgcuuccccugcaaggccauguucgaggaggccuacagcaacuacugcaagcggcaggcccagcaguga

SEQ ID NO: 26353 - RNA, 1512 nt, Artificial Sequence
  derived and/or modified sequence opt1 from ADCK4__Homo_sapiens__NP_001136027
auguggcugaaggugggcgggcuccugcgcggcaccgggggccagcuggggcagaccgucggcuggcccugcggcgcccucgggccgggcccccaccggugggggcccugcggcgggagcugggcccagaaguucuaccaggacggccccggccgcgggcugggcgaggaggacauccggcgcgcgcgggaggcccgcccgcggaagacgccccgcccccagcuguccgaccggagccgcgagcggaaggugcccgccucccgcaucagccggcucgccaacuucgggggccuggccgugggccuggggcucggcguccuggcggagauggccaagaaguccaugcccgggggccgccugcagagcgacaacuccuucaucagcccccagcuccagcacaucuucgagcgggugcgccaguccgccgacuucaugccccgguggcagaugcugcgcgugcuggaggaggagcucgggcgggacuggcaggccaaggucgcgagccuggaggaggugcccuucgccgccgccuccaucggccaggugcaccagggccugcuccgcgacgggaccgaggucgccgugaagauccaguacccgggcaucgcgcagagcauccaguccgacgugcagaaccugcuggccguccucaagaugagcgccgcccugcccgccgggcuguucgcggagcagucccuccaggcccugcagcaggagcuggccugggagugcgacuaccggcgcgaggccgccugcgcgcagaacuuccgccagcuccuggccaacgaccccuucuuccgggugcccgccguggucaaggagcugugcaccacccgcgugcucggcauggagcuggccgggggcgugccgcuggaccagugccagggccucagccaggaccugcggaaccagaucugcuuccagcugcucacgcugugccugcgcgagcuguucgaguuccgguucaugcagaccgaccccaacugggccaacuuccuguacgacgcguccagccaccaggucacccugcucgacuucggggccucccgcgaguucggcaccgaguucacggaccacuacaucgagguggugaaggccgccgcggacggggaccgggacugcguccugcagaagucccgcgaccugaaguuccucaccggcuucgagaccaaggccuucagcgacgcccacguggaggccgugaugauccugggggagcccuucgccacccagggccccuacgacuucggcagcggggagacggcgcggcgcauccaggaccugaucccgguccuccugcggcaccgccugugcccgccgcccgaggagaccuacgcccugcaccggaagcucgccggcgccuuccuggccugcgcgcaccuccgcgcccacaucgccugccgggaccucuuccaggacaccuaccaccgcuacugggccagccggcagcccgacgccgcgaccgccgggucccugcccacgaagggcgacagcuggguggaccccuccuga

SEQ ID NO: 26354 - RNA, 4374 nt, Artificial Sequence
  derived and/or modified sequence opt1 from ADCY10__Homo_sapiens__NP_001161221
augcugguguucggcgacgagacccacagccacuuccucgucaucgggcaggccguggacgacgugcgccuggcccagaacauggcgcagaugaacgacgucauccugucccccaacugcuggcagcucugcgaccggagcaugaucgagaucgaguccgugccggaccagcgcgccgugaaggucaacuuccugaagcccccgcccaacuucaacuucgacgaguucuucaccaagugcacgaccuucaugcacuacuaccccagcggcgagcacaagaaccugcuccggcuggccugcacccugaagcccgaccccgagcucgagaugucccugcagaaguacgugauggagagcauccugaagcagaucgacaacaagcagcuccagggguaccuguccgagcugcgccccgugaccaucgucuucgugaaccucauguucgaggaccaggacaaggccgaggagaucggcccggccauccaggacgcguacaugcacaucacgagcgugcugaagaucuuccaggggcagaucaacaaggucuucauguucgacaagggcugcuccuuccugugcguguucggcuuccccggggagaaggugcccgacgagcucacccacgcccuggagugcgccauggacaucuucgacuucugcagccagguccacaagauccagaccguguccaucggcguggccagcgggaucgucuucugcggcaucguggggcacaccgugcggcacgaguacacggucaucggccagaaggugaaccuggcggcccgcaugaugauguacuaccccggcaucgugaccugcgacuccgucaccuacaacgggagcaaccucccggccuacuucuucaaggagcugcccaagaaggugaugaagggcgucgccgacuccgggccccuguaccaguacuggggccggaccgagaaggugauguucggcauggccugccucaucugcaaccgcaaggaggacuacccccugcuggggcggaacaaggagaucaacuacuucauguacacgaugaagaaguuccucaucagcaacuccagccaggugcugauguacgagggccugccgggguacggcaagucccagauccucaugaagaucgaguaccuggcgcaggggaagaaccaccgcaucaucgccaucagccugaacaagaucagcuuccaccagaccuucuacaccauccagauguucauggccaacguccucggccuggacacgugcaagcacuacaaggagcggcagaccaaccugcgcaacaaggugaugacccuccuggacgagaaguucuacugccugcucaacgacaucuuccacgugcaguuccccaucucccgggagaucagccgcauguccacccugaagaagcagaagcagcuggagauccucuucaugaagauccugaagcugaucgucaaggaggagcggaucaucuucaucaucgacgaggcccaguucguggacagcaccuccuggcgcuucauggagaagcucauccggacgcugcccaucuucaucaucaugagccugugccccuucgugaacaucccgugcgccgcggcccgcgccgucaucaagaaccggaacaccaccuacaucgugaucggcgccgugcagcccaacgacaucuccaacaagaucugccucgaccugaacgucagcugcaucuccaaggagcuggacagcuaccugggggagggcuccugcgggauccccuucuacugcgaggagcuccugaagaaccuggagcaccacgaggugcucguguuccagcagaccgagagcgaggagaagacgaaccgcaccuggaacaaccuguucaaguacuccaucaagcugaccgagaagcucaacauggucacccugcacagcgacaaggaguccgaggaggugugccaccugacgagcggcgugcggcucaagaaccuguccccgcccaccagccugaaggagaucucccucauccagcuggacagcaugcgccugagccaccagaugcucguccgcugcgccgcgaucaucgggcugaccuucaccacggagcugcuguucgagauccugcccugcuggaacaugaagaugaugaucaagacccuggccacccucguggaguccaacaucuucuacugcuuccggaacggcaaggagcugcagaaggcccugaagcagaacgaccccagcuucgaggugcacuaccgcucccucagccugaagcccuccgagggcauggaccacggggaggaggagcagcugcgggagcucgagaacgaggucaucgagugccaccgcauccgguucugcaacccgaugaugcagaagaccgccuacgagcuguggcugaaggaccagcgcaaggccaugcaccucaagugcgcgcgguuccuggaggaggacgcccaccgcugcgaccacugccggggccgcgacuucauccccuaccaccacuucacggugaacauccggcugaacgcccucgacauggacgccaucaagaagauggcgaugagccacggguucaagaccgaggagaagcugauccuguccaacagcgagauccccgagaccuccgccuucuucccggagaaccgcagccccgaggagauccgggagaagauccucaacuucuucgaccacgugcugaccaagaugaagaccuccgacgaggacaucaucccccuggagagcugccagugcgaggagauccucgagaucgucauccugccccuggcccaccacuuccucgcccugggcgagaacgacaaggcccuguacuacuuccucgagaucgcguccgccuaccugaucuucugcgacaacuacauggccuacauguaccugaacgaggggcagaagcuccugaagacgcugaagaaggacaagagcuggucccagaccuucgagagcgccaccuucuacucccucaagggcgaggugugcuucaacaugggccagaucgugcuggccaagaagaugcugcgcaaggcgcucaagcugcugaaccggaucuucccguacaaccucaucagccuguuccugcacauccacgucgagaagaaccgccacuuccacuacgugaaccggcaggcccaggagagcccgccgcccgggaagaagcgccucgcccagcuguaccggcagaccgugugccugucccuccuguggcgcaucuacagcuacuccuaccuguuccacugcaaguacuacgcccaccucgccgucaugaugcagaugaacacggcgcuggagacccagaacugcuuccagaucaucaaggccuaccuggacuacagccucuaccaccaccuggccggcuacaagggggugugguucaaguacgaggugauggccauggagcacaucuucaaccugccccucaagggcgagggcaucgagaucgucgcguacguggccgagacccugguguucaacaagcugaucauggggcaccucgaccuggccaucgagcugggcucccgcgcccuccagaugugggcccugcugcagaaccccaaccggcacuaccagagccucugccgccugucccggugccugcuccugaacagccgcuacccccagcugauccagguccucgggcggcugugggagcuguccgugacccaggagcacaucuucagcaaggcguucuucuacuucgugugccucgacauccugcuguacuccggcuucgucuaccgcacguucgaggagugccucgaguucauccaccaguacgagaacaaccggauccugaaguuccacagcgggcugcugcucggccuguacuccagcguggccaucugguacgcccgccugcaggagugggacaacuucuacaaguucuccaaccgggccaagaaccuccugccccgccggaccaugacccugaccuacuacgacggcaucagccgcuacauggagggccaggugcuccaccuccagaagcagaucaaggagcaguccgagaacgcccaggcgagcggggaggagcugcucaagaaccuggagaaccuggucgcccagaacacgaccgggcccguguucugcccccggcucuaccaccugauggccuacgugugcauccugaugggcgacgggcagaagugcggccucuuccugaacaccgcccugcgccucuccgagacccagggcaacauccuggagaagugcuggcugaacaugaacaaggagagcugguacagcacguccgagcucaaggaggaccaguggcugcagaccauccugagccuccccuccugggagaagaucgucgccgggcgggugaacauccaggaccugcagaagaacaaguuccugaugcgcgcgaacaccguggacaaccacuucuga

SEQ ID NO: 26355 - RNA, 3360 nt, Artificial Sequence
  derived and/or modified sequence opt1 from ADCY1__Homo_sapiens__NP_066939
auggccggcgcgccccgcgggggcgggggcgggggcggcggggccggcgagcccgggggcgccgagcgggccgccgggaccagccgccggcgcggccugcgggccugcgacgaggaguucgcgugccccgagcucgaggcccuguuccgcggcuacacccugcggcucgagcaggccgccacgcugaaggcgcuggccgugcucucccugcuggccggggcccucgcccuggcggagcugcucggcgcccccgggcccgccccgggccuggccaagggcagccaccccguccacugcgugcuguuccucgcccugcugguggucaccaacgugcgcucccuccaggugccccagcugcagcaggucgggcagcuggcgcuccuguucagccugaccuucgcccuccugugcugccccuucgcccugggcgggccggcccggggcuccgccggggcggccggcggccccgccaccgccgagcaggggguguggcagcuccugcuggugacguucgucagcuacgcccuccugcccgugcgcucccugcucgcgaucggcuucgggcugguggucgccgccagccaccuccuggugaccgccacccuggugcccgcgaagcggccgcgccuguggcggacccucggcgccaacgcccugcuguucgucggggugaacauguacggcguguucguccgcauccucacggagcggucccagcgcaaggccuuccugcaggcccggagcugcaucgaggaccgccugcggcucgaggacgagaacgagaagcaggagcgccugcugaugucccuccugccccggaacguggcgauggagaugaaggaggacuuccugaagccgcccgagcgcaucuuccacaagaucuacauccagcgccacgacaacgugagcauccuguucgccgacaucgucggcuucaccgggcucgccucccagugcaccgcccaggagcuggugaagcugcucaacgagcuguucggcaaguucgacgagcuggccaccgagaaccacugccggcgcaucaagauccucggggacugcuacuacugcgugagcggccugacgcagccgaagaccgaccacgcgcacugcugcgucgagauggggcuggacaugaucgacaccaucaccuccguggccgaggccacggaggucgaccucaacaugcgggugggccugcacaccggccgcgugcugugcgggguccucggccugcggaaguggcaguacgacguguggagcaacgacgugacccuggccaacgucauggaggccgcggggcuccccggcaaggugcacaucaccaagacgacccuggccugccugaacggcgacuacgagguggagcccggguacggccacgagcgcaacuccuuccucaagacccacaacaucgagaccuucuucaucguccccagccaccggcgcaagaucuucccggggcugauccuguccgacaucaagcccgccaagcggaugaaguucaagacggugugcuaccuccuggugcagcugaugcacugccgcaagauguucaaggccgagauccccuucagcaacgucaugaccugcgaggacgacgacaagcggcgcgcgcuccggaccgccagcgagaagcugcgcaaccgguccagcuucuccaccaacgugguguacacgacccccggcacccgcgucaaccgguacaucagccgccugcucgaggcccggcagaccgagcuggagauggccgaccugaacuucuucacgcucaaguacaagcacguggagcgcgagcagaaguaccaccagcugcaggacgaguacuucaccuccgccgugguccugacccucauccuggcggcccuguucgggcucguguaccugcugaucuucccgcagagcguggucgugcuccugcugcucguguucugcaucugcuuccuggucgccugcgugcuguaccuccacaucacccgcgugcagugcuuccccggcugccugacgauccagauccggaccguccugugcaucuucaucguggugcucaucuacuccgucgcccagggcugcgugguggggugccugcccugggccuggagcuccaagcccaacagcucccuggucgugcucagcuccggcgggcagcgcaccgcgcugccgacccugcccugcgagagcacccaccacgcccuccugugcugccuggugggcacgcucccccuggccaucuucuuccgggucuccagccugccgaagaugauccuccuguccgggcugaccaccagcuacauccucgugcuggagcuguccggcuacacccgcacgggcgggggcgccgugagcgggcggagcuacgagcccaucgucgccauccuccuguucuccugcgcgcuggcccuccacgcccgccagguggacauccggcugcgccuggacuaccucugggccgcgcaggccgaggaggagcgggaggacauggagaaggugaagcuggacaaccgccggauccuguucaaccuccugcccgcccacgucgcccagcacuuccugaugagcaacccccgcaacauggaccucuacuaccaguccuacagccaggugggcgugauguucgccuccaucccgaacuucaacgacuucuacaucgagcuggacgggaacaacaugggcgucgagugccugcggcuccugaacgagaucaucgcggacuucgacgagcugauggagaaggacuucuacaaggacaucgagaagaucaagaccaucggcagcaccuacauggccgccguggggcucgcccccaccuccggcacgaaggccaagaaguccaucagcagccaccuguccacccuggcggacuucgccaucgagauguucgacgugcucgacgagaucaacuaccagagcuacaacgacuucguccugcgcguggggaucaacgugggccccgucguggccggggucaucggcgcccggcgcccccaguacgacaucuggggcaacaccgugaacguggccucccggauggacagcaccgggguccagggccgcauccaggugacggaggaggugcaccggcugcuccgccggugcccguaccacuucgucugccgcgggaagguguccgugaagggcaagggcgagaugcugaccuacuuccuggaggggcgcaccgacggcaacgggagccagauccggucccucggccuggaccgcaagaugugccccuucgggcgggcgggccugcagggccgccggccgcccgucugccccaugcccggggugagcgugcgcgccggccugccgccccacagccccgggcaguaccuccccuccgccgccgccggcaaggaggcguga

SEQ ID NO: 26356 - RNA, 3276 nt, Artificial Sequence
  derived and/or modified sequence opt1 from ADCY2__Homo_sapiens__NP_065433
auguggcaggaggccaugcgccggcgccgguaccugcgcgaccggagcgaggaggccgcgggcgggggcgacgggcucccccgcucccgggacuggcuguacgagagcuacuacugcaugucccagcagcacccgcugaucguguuccuccugcugaucgucaugggcagcugccucgcccugcuggccguguucuucgcccucgggcuggagguggaggaccacgucgccuuccugaucaccgugcccaccgcgcucgccaucuucuucgccaucuucauccuggugugcaucgaguccgucuucaagaagcugcuccgccuguucagccuggugaucuggaucugccucguggccaugggcuaccuguucaugugcuucggcgggaccgucucccccugggaccaggugagcuucuuccuguucaucaucuucguggucuacaccaugcuccccuucaacaugcgggacgcgaucaucgccuccgugcugaccagcuccagccacaccaucgugcuguccgucugccucagcgccacgccgggcgggaaggagcaccugguguggcagauccuggccaacgugaucaucuucaucugcggcaaccucgccggggcguaccacaagcaccugauggagcuggcccuccagcagaccuaccaggacacgugcaacugcaucaagucccgcaucaagcuggaguucgagaagcggcagcaggagcgccugcuccugagccugcuccccgcccacaucgccauggagaugaaggccgagaucauccagcggcugcagggccccaaggcgggccagauggagaacaccaacaacuuccacaaccuguacgucaagcgccacaccaacguguccauccucuacgccgacaucgugggguucacccggcuggccagcgacugcucccccggcgagcugguccacaugcucaacgagcuguucgggaaguucgaccagaucgccaaggagaacgagugcaugcgcaucaagauccugggcgacugcuacuacugcgugagcggccucccgaucagccugcccaaccacgccaagaacugcgugaagauggggcuggacaugugcgaggcgaucaagaagguccgggacgccaccggcguggacaucaacaugcgcgucggggugcacuccggcaacgugcucugcggggucaucggccugcagaaguggcaguacgacguguggagccacgacgugacccuggccaaccacauggaggccggcgggguccccggccgggugcacaucuccagcgugacgcuggagcaccucaacggggccuacaaggucgaggagggcgacggggacauccgcgaccccuaccugaagcagcaccuggugaagaccuacuucgugaucaacccgaagggcgagcggcgcagcccccagcaccucuuccgcccccggcacacccuggacggcgcgaagaugcgcgccuccguccggaugacccgcuaccuggaguccuggggcgccgccaagcccuucgcgcaccuccaccaccgggacagcaugacgaccgagaacgggaagaucuccaccaccgacgugccgauggggcagcacaacuuccagaaccgcacgcugcggaccaagagccagaagaagcgcuucgaggaggagcugaacgagcggaugauccaggccaucgacggcaucaacgcccagaagcaguggcucaaguccgaggacauccagcgcaucagccugcuguucuacaacaaggugcucgagaaggaguaccgggccaccgcccugcccgcguucaaguacuacgugaccugcgccugccugaucuucuucugcaucuucaucguccagauccucgugcugcccaagacguccguccuggggaucagcuucggcgccgccuuccuccugcuggccuucauccucuucgugugcuucgcgggccagcugcugcagugcuccaagaaggccagcccccuccugauguggcugcucaaguccagcgggaucaucgccaaccgcccguggccccggaucucccugaccaucaucaccaccgccaucauccugaugauggccguguucaacauguucuuccucagcgacagcgaggagacgaucccgcccaccgcgaacaccaccaacacguccuucagcgccuccaacaaccaggucgccauccugcgcgcccagaaccuguucuuccuccccuacuucaucuacagcugcauccugggccugaucuccugcagcguguuccuccgggugaacuacgagcugaagaugcugaucaugauggucgcgcucgugggguacaacaccauccugcugcacacccacgcccacgugcucggcgacuacucccagguccuguucgagcgccccggcaucuggaaggaccugaagaccauggggagcgugucccucagcaucuucuucaucacgcugcuggugcucggccggcagaacgaguacuacugccgccuggacuuccuguggaagaacaaguucaagaaggagcgggaggagaucgagaccauggagaaccucaaccgcguccugcuggagaacgugcuccccgcccacguggccgagcacuuccuggcccgcucccugaagaacgaggagcucuaccaccagagcuacgacugcgucugcgugauguucgcguccauccccgacuucaaggaguucuacaccgagagcgacgugaacaaggaggggcuggagugccugcggcuccugaacgagaucaucgccgacuucgacgaccugcucuccaagccgaaguucagcggcgucgagaagaucaagaccaucggguccaccuacauggccgccacgggccugagcgccgugcccagccaggagcacucccaggagcccgagcgccaguacaugcacaucggcaccaugguggaguucgcguucgcccuggucgggaagcucgacgccaucaacaagcacagcuucaacgacuucaagcugcgggugggcaucaaccacgggccggugaucgccggcgucaucggggcccagaagccccaguacgacaucuggggcaacaccgugaacguggcgucccgcauggacagcaccggcguccuggacaagauccaggugacggaggagaccucccucgugcugcagacccugggguacacgugcacgugccggggcaucaucaacgucaaggggaagggcgaccucaagaccuacuucgugaacaccgagaugagccgcucccugagccaguccaacguggccagcuga

SEQ ID NO: 26357 - RNA, 3435 nt, Artificial Sequence
  derived and/or modified sequence opt1 from ADCY3__Homo_sapiens__NP_004027
augccccgcaaccagggcuucagcgagccggaguacuccgccgaguacagcgccgaguacuccgugagccugcccuccgaccccgaccgcggggucggccggacccacgagaucagcgugcggaacuccgggagcugccucugccugccccgcuucaugcggcugaccuucgugccggagucccucgagaaccuguaccagacguacuucaagcgccagcggcacgagacccugcucguccuggugguguucgcggcccuguucgacugcuacgucguggugaugugcgccgucguguucagcuccgacaagcucgccagccuggccguggcgggcaucgggcugguccucgacaucauccuguucgugcugugcaagaagggccuccugcccgaccgcgugacccggcgcguccugcccuacgugcucuggcugcugaucaccgcccagaucuucuccuaccucggccugaacuucgcccgggcccacgcggccagcgacacggugggguggcaggucuucuucguguucuccuucuucaucacccugccccucagccuguccccgaucgugaucaucagcgucguguccugcgugguccacacccuggugcucggcgucaccguggcccagcagcagcaggaggagcugaaggggaugcagcugcuccgcgagauccuggccaacguguuccuguaccucugcgccaucgcggucggcaucaugagcuacuacauggccgaccggaagcaccgcaaggccuuccuggaggcccggcagagccuggaggugaagaugaaccucgaggagcagucccagcagcaggagaaccugaugcugagcauccuccccaagcacguggccgacgagaugcugaaggacaugaagaaggacgagucccagaaggaccagcagcaguucaacacgauguacauguaccgccacgagaacgucagcauccuguucgcggacaucgugggguucacccagcucuccagcgccugcuccgcccaggagcuggugaagcugcucaacgagcuguucgcccgguucgacaagcuggccgcgaaguaccaccagcuccgcaucaagauccugggcgacugcuacuacugcaucugcggccugcccgacuaccgggaggaccacgccgucugcagcauccugauggggcucgccaugguggaggccaucuccuacgugcgcgagaagaccaagaccggcgucgacaugcgggugggggugcacacgggcaccguccugggcggggugcugggccagaagcgcuggcaguacgacguguggagcaccgacgucaccguggccaacaagauggaggccgggggcauccccgggcgcgugcacaucucccagagcacgauggacugccucaagggcgaguucgacgucgagccgggcgacgggggcucccggugcgacuaccuggaggagaaggggaucgagaccuaccugaucaucgcgagcaagcccgaggugaagaagaccgccacccagaacggccucaacggguccgcccugcccaacggcgcgcccgccagcuccaagagcuccagcccggcccugaucgagacgaaggagcccaacggcagcgcccacuccagcggguccaccagcgagaagcccgaggagcaggacgcccaggcggacaaccccuccuucccgaacccccgccggcgccuccggcugcaggaccuggccgaccgcguggucgacgccagcgaggacgagcacgagcucaaccagcugcugaacgaggcccuccuggagcgggaguccgcccagguggugaagaagcgcaacaccuuccugcucagcaugcgguucauggaccccgagauggagacccgcuacuccgucgagaaggagaagcagagcggcgcggccuucuccugcagcugcguggugcugcugugcacggcccucgucgagauccugaucgaccccuggcugaugaccaacuacgugaccuucauggugggggagauccuccugcugauccucaccaucugcucccuggccgccaucuucccgcgggcguuccccaagaagcuggucgccuucagcacguggaucgaccgcacccggugggcccgcaacaccugggccaugcucgcgaucuucauccuggugauggccaacguggucgacaugcuguccugccuccaguacuacaccggccccagcaacgccacggccgggauggagaccgagggcuccugccuggagaaccccaaguacuacaacuacguggccgugcugagccucaucgcgaccaucaugcugguccaggugagccacauggugaagcugacccucaugcugcuggucgccggcgccguggccacgaucaaccucuacgccuggcggccgguguucgacgaguacgaccacaagcgcuuccgggagcacgaccugcccauggucgcgcuggagcagaugcagggguucaaccccggccucaacgggaccgaccgccugccgcuggugcccuccaaguacagcaugaccgugauggucuuccucaugaugcuguccuucuacuacuucagccggcacguggagaagcuggcccgcacccucuuccuguggaagaucgaggugcacgaccagaaggagcgcgucuacgagaugcggcgcuggaacgaggcccuggugaccaacaugcuccccgagcacgucgcccggcacuuccugggcuccaagaagcgcgacgaggagcuguacagccagacguacgacgagaucggcgugauguucgccucccuccccaacuucgcggacuucuacaccgaggagagcaucaacaacgggggcaucgagugccugcgguuccugaacgagaucaucuccgacuucgacagccuccuggacaacccgaaguuccgcgugaucaccaagaucaagaccaucggguccacguacauggccgccagcggcgucacccccgacgugaacaccaacggguucgccuccagcaacaaggaggacaaguccgagcgggagcgcuggcagcaccuggcggaccucgccgacuucgcccuggccaugaaggacacccugacgaacaucaacaaccagagcuucaacaacuucaugcuccggaucggcaugaacaagggcggggugcuggccggcgucaucggggcgcgcaagccccacuacgacaucuggggcaacaccgugaacguggccucccggauggagagcaccggggucaugggcaacauccaggugguggaggagacccaggucauccugcgcgaguacggcuuccgguucgugcgccgggggcccaucuucgugaagggcaagggggagcuccugacguucuuccugaagggccgcgacaagcucgccaccuucccgaacgggcccuccgucacccugccccaccaggugguggacaacagcuga

SEQ ID NO: 26358 - RNA, 2736 nt, Artificial Sequence
  derived and/or modified sequence opt1 from ADCY5__Homo_sapiens__NP_001186571
augaagucccagaaggagggcugcugcucccgcggggaccugagcauccagaccggccccgggggcgagugggccccgcggcgccucguguccaacguccugaucuucagcugcaccaacaucgugggggugugcacgcacuaccccgccgaggucucccagcggcaggcguuccaggagacccgcgagugcauccaggcccggcugcacagccagcgcgagaaccagcagcaggagcggcuccugcuguccgugcucccccgccacguggccauggagaugaaggccgacaucaacgccaagcaggaggacaugauguuccacaagaucuacauccagaagcacgacaacgucagcauccuguucgcggacaucgagggcuucaccucccuggccagccagugcaccgcccaggagcucgugaugacgcugaacgagcuguucgcccgguucgacaagcucgcggccgagaaccacugccugcgcaucaagauccugggcgacugcuacuacugcguguccgggcuccccgaggcccgggccgaccacgcccacugcugcgucgagaugggcauggacaugaucgaggcgaucagccuggugcgcgaggugaccggggucaacgugaacaugcgggugggcauccacuccgggcgcguccacugcggcgugcugggccuccggaaguggcaguucgacguguggagcaacgacgucacccuggccaaccacauggaggccgggggcaaggccgggcgcauccacaucaccaaggccacgcugaacuaccucaacggcgacuacgagguggagccgggcugcgggggcgagcggaacgcguaccugaaggagcacuccaucgagaccuuccugauccuccgcugcacccagaagcggaaggaggagaaggccaugaucgccaagaugaaccgccagcggaccaacagcaucgggcacaacccgccccacuggggcgccgagcgccccuucuacaaccaccucgggggcaaccagguguccaaggagaugaagcgcaugggcuucgaggaccccaaggacaagaacgcccaggagagcgcgaaccccgaggacgaggucgacgaguuccuggggcgggccaucgacgcccgcuccaucgaccggcuccgcagcgagcacgugcggaaguuccugcugacguuccgcgagcccgaccucgagaagaaguacagcaagcaggucgacgaccgguucggcgccuacguggccugcgcgucccugguguuccuguucaucugcuucguccagaucaccaucgugccccacagcaucuucaugcucuccuucuaccugaccugcagccugcuccugacccugguggucuucguguccgugaucuacagcugcgucaagcuguucccgagcccccugcagacgcugagccgcaagaucgugcgguccaagaugaacagcacccucgugggggucuucaccaucacccugguguuccuggccgccuucgugaacauguucacgugcaacucccgcgaccuccugggcugccuggcccaggagcacaacaucagcgcgucccaggucaacgccugccacguggccgagagcgccgugaacuacucccucggggacgagcagggcuucugcggcagccccuggcccaacugcaacuucccggaguacuucaccuacuccguccugcugagccugcucgccugcuccguguuccugcagaucagcugcaucgggaagcuggugcucaugcuggcgaucgagcugaucuacguccucaucguggaggugcccggcgucacccuguucgacaacgccgaccugcucgugaccgccaacgccaucgacuucuucaacaacgggacgagccagugccccgagcacgccaccaagguggcgcugaaggucgugacccccaucaucaucuccguguucguccuggcccucuaccugcacgcccagcaggucgagagcaccgcccggcuggacuuccucuggaagcugcaggccacggaggagaaggaggagauggaggagcugcaggcguacaaccgccggcuccugcacaacauccugccgaaggacguggccgcccacuuccucgcccgcgagcggcgcaacgacgagcuguacuaccaguccugcgagugcguggcggugauguucgccagcaucgccaacuucuccgaguucuacguggagcuggaggccaacaacgagggcgucgagugccuccggcugcugaacgagaucaucgccgacuucgacgagaucaucagcgaggaccgcuuccggcagcucgagaagaucaagaccaucggguccaccuacauggcggccagcggccugaacgacuccaccuacgacaaggugggcaagacgcacaucaaggcccuggccgacuucgccaugaagcucauggaccagaugaaguacaucaacgagcacagcuucaacaacuuccagaugaagaucgggcugaacaucggccccguggucgcgggggugaucggcgcccgcaagccccaguacgacaucuggggcaacaccgugaacgucgccucccgcauggacagcaccggggugcccgaccggauccaggugaccacggacauguaccagguccuggccgccaacaccuaccagcucgagugccgcggcguggugaaggucaaggggaagggcgagaugaugaccuacuuccugaacgggggcccgccccuguccuga

SEQ ID NO: 26359 - RNA, 3507 nt, Artificial Sequence
  derived and/or modified sequence opt1 from ADCY6__Homo_sapiens__NP_056085
augagcugguucuccggccugcucgugcccaaggucgacgagcgcaagaccgccuggggcgagcggaacgggcagaagcgcagccggcgccgggggacccgcgccggcggguucugcacgccgcgguacauguccugccugcgcgacgcggagccgcccagccccacccccgccggcccgccccggugccccuggcaggacgacgccuucauccgccggggcgggcccggcaaggggaaggagcugggccuccgcgccguggcccugggguucgaggacaccgaggugaccacgaccgcgggcggcaccgccgaggucgcccccgacgccgugccccgguccgggcgcagcugcuggcggcgccuggugcaggucuuccaguccaagcaguuccggagcgcgaagcucgagcgccuguaccagcgguacuucuuccagaugaaccaguccagccugacccuccugauggccgugcuggugcuccugacggccguccugcucgccuuccacgccgcgcccgcccgcccgcagcccgccuacguggcccugcuggccugcgcggccgcccucuucgugggccugauggucgugugcaaccggcacuccuuccgccaggacagcauguggguggucuccuacguggugcuggggauccucgccgccguccaggugggcggcgcgcuggccgccgacccccgcagccccuccgccgggcuguggugcccgguguucuucgucuacaucgccuacacccuccugcccauccggaugcgcgcggccgugcugagcggccucgggcuguccacccugcaccucauccuggccuggcagcugaaccggggcgacgccuuccucuggaagcagcugggggcgaacgugcuccucuuccugugcaccaacgucaucggcaucugcacgcacuaccccgccgaggugagccagcgccaggccuuccaggagacccggggcuacauccaggcccgccugcaccuccagcacgagaaccggcagcaggagcgccugcugcucuccguccugccccagcacguggccauggagaugaaggaggacaucaacaccaagaaggaggacaugauguuccacaagaucuacauccagaagcacgacaacgugagcauccuguucgcggacaucgagggguucaccagccucgccucccagugcacggcccaggagcuggucaugacccugaacgagcuguucgcccgguucgacaagcuggccgcggagaaccacugccugcgcaucaagauccugggcgacugcuacuacugcgugagcgggcucccggaggcccgggccgaccacgcccacugcugcguggagaugggcgucgacaugaucgaggccaucucccuggugcgcgaggugaccggggucaacgugaacaugcgggugggcauccacagcggccgcguccacugcggggugcugggccuccggaaguggcaguucgacgugugguccaacgacgucacccuggcgaaccacauggaggccgggggccgcgccgggcggauccacaucacgcgcgccacccugcaguaccucaacggcgacuacgagguggagcccggccgcgggggcgagcggaacgcguaccugaaggagcagcacaucgagaccuuccugauccucggggccagccagaagcgcaaggaggagaaggccaugcuggccaagcugcagcggacccgcgccaacuccauggagggccucaugccccggugggugcccgaccgcgcguucagccggacgaaggacuccaaggccuuccgccagaugggcaucgacgacagcuccaaggacaaccgggggacccaggacgcccugaacccggaggacgaggucgacgaguuccugagccgcgccaucgacgcccgguccaucgaccagcuccgcaaggaccacgugcggcgcuuccugcugaccuuccagcgggaggaccucgagaagaaguacagccgcaagguggacccccgguucggcgcguacgucgccugcgcccugcugguguucugcuucaucugcuucauccagcuccugaucuucccccacuccacccugaugcucgggaucuacgccagcaucuuccugcugcuccugaucacggugcugaucugcgccgucuacuccugcggcagccucuuccccaaggcgcugcagcgccugucccggagcaucgugcgcagccgggcccacuccaccgccguggggaucuucagcguccuccugguguucaccuccgccaucgcgaacauguucacgugcaaccacaccccgauccgcagcugcgccgcccggaugcugaaccucacccccgccgacaucaccgccugccaccuccagcagcugaacuacucccugggccuggacgcgccccugugcgagggcaccaugccgacgugcagcuuccccgaguacuucaucgggaacaugcuccugucccugcucgccagcuccguguuccugcacaucagcuccaucggcaagcuggccaugaucuucguccucgggcugaucuaccuggugcuccugcugcucggcccgcccgccaccaucuucgacaacuacgaccugcugcucggggugcacggccuggccagcuccaacgagaccuucgacggccuggacugccccgcggccgggcgcgucgcccucaaguacaugacccccgugauccugcugguguucgcccucgcccuguaccugcacgcgcagcaggucgagagcaccgcccgccucgacuuccuguggaagcugcaggccacgggcgagaaggaggagauggaggagcuccaggccuacaaccggcgccugcugcacaacauccuccccaaggacguggccgcgcacuuccuggcccgggagcgccggaacgacgagcuguacuaccaguccugcgagugcguggccgucauguucgccagcaucgcgaacuucuccgaguucuacguggagcucgaggccaacaacgaggggguggagugccugcgccugcucaacgagaucaucgccgacuucgacgagaucaucagcgaggagcgguuccgccagcuggagaagaucaagaccaucggcagcaccuacauggccgccuccgggcugaacgcgagcaccuacgaccaggucggccggucccacaucacggcccucgccgacuacgccaugcgccugauggagcagaugaagcacaucaacgagcacagcuucaacaacuuccagaugaagaucggccugaacauggggcccgugguggccggcgucaucggggcgcggaagccgcaguacgacaucuggggcaacaccgugaacguguccagccgcauggacuccaccgggguccccgaccggauccaggugaccacggaccucuaccaggugcuggccgccaagggcuaccagcuggagugccgcggcgucgugaaggucaaggggaagggcgagaugaccaccuacuuccucaacgggggccccagcuccuga

SEQ ID NO: 26360 - RNA, 3243 nt, Artificial Sequence
  derived and/or modified sequence opt1 from ADCY7__Homo_sapiens__NP_001105
augcccgccaagggccgcuacuuccugaacgagggggaggagggcccggaccaggacgcccucuacgagaaguaccagcugaccagccagcacgggccccugcuccugacccugcuccugguggcggccacggccugcgucgcccugaucaucaucgccuucucccagggcgaccccagccggcaccaggcgauccucgggauggccuuccuggugcuggccguguucgccgcgcucuccguccugauguacguggagugccugcuccgccgguggcugcgcgcccuggcccuccugaccugggccugccugguggcccucggcuacguccugguguucgacgcguggaccaaggccgccugcgccugggagcagguccccuucuuccuguucaucguguucgugguguacacccuccugccguucagcaugcggggcgccgucgcggugggggccguguccacggccagccaccuccucguccugggcucccugaugggcggguucaccacccccagcgugcgcguggggcuccagcugcuggccaacgccgucaucuuccucugcggcaaccugaccggcgcguuccacaagcaccagaugcaggacgccucccgggaccuguucacguacaccgugaagugcauccagauccgccggaagcuccgcaucgagaagcggcagcaggagaaccugcugcucagcgugcugcccgcccacaucuccauggggaugaagcuggccaucaucgagcgccucaaggagcacggcgaccggcgcugcaugcccgacaacaacuuccacagccuguacgucaagcggcaccagaacguguccauccuguacgccgacaucgugggguucacccagcucgcgagcgacugcuccccgaaggagcuggucgugguccugaacgagcuguucggcaaguucgaccagaucgccaaggccaacgagugcaugcgcaucaagauccugggcgacugcuacuacugcgugagcgggcugcccgugucccugcccacccacgcccggaacugcgucaagaugggccucgacaugugccaggcgaucaagcagguccgcgaggccacggggguggacaucaacaugcgggugggcauccacagcgggaacgugcugugcggcgugaucggccugcgcaaguggcaguacgacgucuggucccacgacgugagccucgccaaccggauggaggccgccggggugcccggccgcguccacaucaccgaggcgacccugaagcaccuggacaaggccuacgagguggaggacgggcacggccagcagcgcgacccguaccucaaggagaugaacauccggaccuaccuggugaucgacccccgcagccagcagccgccgccgcccucccagcaccucccccggcccaagggggacgccgcccugaagaugcgcgccagcguccggaugacgcgcuaccuggaguccuggggcgcggcccggcccuucgcccaccugaaccaccgcgagagcguguccagcggcgagacccacgugcccaacgggcggcgccccaaguccgucccccagcggcaccgccggacccccgaccgcagcaugucccccaagggccggagcgaggacgacuccuacgacgacgagaugcucagcgccaucgaggggcuguccagcacccgccccugcugcuccaagagcgacgacuucuacacguucggcuccaucuuccuggagaagggguucgagcgggaguaccgccucgcccccaucccgcgggcgcgccacgacuucgccugcgccagccugaucuucgugugcauccugcucgugcacguccugcugaugccccgcaccgccgcgcucggcguguccuucggccugguggccugcguccuggggcucgugcugggccugugcuucgccaccaaguucagccggugcugccccgcccgcgggacccucugcacgaucagcgagcggguggagacccagccgcugcugcgccucacccuggccguccugaccaucggcucccuccugacgguggcgaucaucaaccugccccucaugcccuuccaggugcccgagcugccggucggcaacgagaccgggcugcucgccgccagcuccaagacccgggcccugugcgagccccugcccuacuacacgugcagcugcgugcucggcuucaucgccugcuccguguuccugcgcaugagccuggagcccaaggucgugcuccugaccguggcgcuggucgccuaccucgugcuguucaaccuguccccgugcuggcagugggacugcugcgggcagggccucgggaaccugaccaagcccaacggcaccaccagcggcacgcccuccugcagcuggaaggaccugaagaccaugaccaacuucuaccucgugcuguucuacaucacccugcucacccugucccggcagaucgacuacuacugccgccuggacugccucuggaagaagaaguucaagaaggagcacgaggaguucgagacgauggagaacgucaaccggcugcugcucgagaacgugcugcccgcccacguggccgcccacuucaucggggacaagcugaacgaggacugguaccaccagagcuacgacugcgucugcgugauguucgcguccgugccggacuucaaggucuucuacaccgagugcgacgugaacaaggagggccucgagugccugcgccugcucaacgagaucaucgccgacuucgacgagcugcugcucaagcccaaguucagcgggguggagaagaucaagaccaucggcuccaccuacauggccgccgcggggcugagcgucgccuccggccacgagaaccaggagcuggagcggcagcacgcccacaucggcgugaugguggaguucagcaucgcccucaugagcaagcuggacgggaucaaccgccacuccuucaacagcuuccggcugcgcgucggcaucaaccacgggcccgugaucgccggcgucaucggggcgcggaagccccaguacgacaucuggggcaacacggugaacguggccucccgcauggagagcaccggcgagcucgggaagauccaggucaccgaggagaccugcacgauccugcagggccugggguacuccugcgagugccggggccucaucaacgugaaggggaagggcgagcugcgcaccuacuucgugugcaccgacaccgccaaguuccagggccuggggcucaacuga

SEQ ID NO: 26361 - RNA, 3756 nt, Artificial Sequence
  derived and/or modified sequence opt1 from ADCY8__Homo_sapiens__NP_001106
auggagcugagcgacgugcgcugccucaccggcuccgaggagcuguacaccauccaccccacgccgcccgccggggacggccggagcgccucccgcccccagcggcugcucuggcagaccgcgguccgccacaucaccgagcagcgguucauccacgggcaccgcggcgggagcggcuccggcagcgggggcuccgggaaggccagcgaccccgccggcgggggcccgaaccaccacgcgccccagcuguccggcgacagcgcccugccccucuacucccuggggcccggcgagcgggcccacagcacgugcgggaccaagguguucccggagcgcuccggcagcggcuccgccagcggguccggcgggggcggggaccugggcuuccuccaccuggacugcgcccccagcaacuccgacuucuuccugaacggcggguacagcuaccggggcgugaucuuccccacccuccgcaacagcuucaagucccgggaccuggagcgccuguaccagcgguacuuccucgggcagcgccgcaagagcgaggucgugaugaacgugcuggacguccugaccaagcucacccugcuggugcuccaccugucccuggccagcgcgcccauggacccgcucaagggcauccugcugggguucuucacgggcaucgagguggucaucugcgcccucguggugguccggaaggacaccaccucccacaccuaccugcaguacagcggcguggugacgugggucgccaugaccacccagauccuggccgccgggcucggcuacgggcugcugggcgacgggaucggcuacgugcuguucacccuguucgcgacguacuccaugcugccccucccccugaccugggccauccuggccggccucgggaccagccugcuccaggugauccuccaggucgugaucccccggcuggccgugaucuccaucaaccaggucguggcccaggcggugcuguucaugugcaugaacaccgccggcaucuucaucagcuaccucuccgaccgcgcccagcggcaggccuuccuggagacgcgccggugcgucgaggcccgccugcgccucgagaccgagaaccagcggcaggagcgccuggugcugagcguccugccgcgguucguggugcucgagaugaucaacgacaugaccaacgucgaggacgagcaccuccagcaccaguuccaccgcaucuacauccaccgguacgagaacguguccauccuguucgcggacgugaagggguucaccaaccucagcacgacccuguccgcccaggagcugguccgcaugcucaacgagcuguucgcccgguucgaccgccuggcccacgagcaccacugccuccggaucaagauccugggcgacugcuacuacugcgugagcggccugcccgagccccgccaggaccacgcccacugcugcguggagauggggcucuccaugaucaagaccauccgguacguccgcagccggaccaagcacgacguggacaugcgcaucggcauccacuccgggagcgugcugugcggcguccuggggcuccggaaguggcaguucgacguguggagcugggacguggacaucgcgaacaagcuggaguccggcggcauccccgggcgcauccacaucagcaaggccacgcuggacugccucaacggcgacuacaacgucgaggaggggcacggcaaggagcggaacgaguuccugcgcaagcacaacaucgagaccuaccugaucaagcagccggaggacucccuccugagccugcccgaggacaucgugaaggaguccgugagcuccagcgaccggcgcaacuccggggccaccuucaccgagggcagcuggucccccgagcuccccuucgacaacaucgucggcaagcagaacacgcuggccgcgcugacccgcaacagcaucaaccuccugccgaaccaccuggcccaggcccuccacgugcaguccgggcccgaggagaucaacaagcggaucgagcacaccaucgaccugcgcagcggcgacaagcugcggcgcgagcacaucaagcccuucucccucauguucaaggacagcucccuggagcacaaguacagccagaugcgggacgagguguucaagagcaaccuggucugcgccuucaucgugcuccuguucaucaccgccauccagucccugcuccccagcucccgcgugaugccgaugacgauccaguucagcauccugaucaugcugcacuccgcgcucguccugaucaccaccgccgaggacuacaagugccugccccucauccugcggaagaccugcugcuggaucaacgagaccuaccuggcccgcaacgugaucaucuucgccagcauccucaucaacuuccugggggccauccugaacauccucuggugcgacuucgacaaguccaucccccugaagaaccugacguucaacagcuccgcgguguucaccgacaucugcagcuacccggaguacuucgucuucaccggcgugcucgccauggugaccugcgccgucuuccugcggcugaacuccgugcucaagcuggccgugcugcucaucaugaucgccaucuacgcgcugcugacggagaccgucuacgccgggcuguuccugcgcuacgacaaccugaaccacagcggcgaggacuuccucggcaccaaggaggugucccugcugcucauggccauguuccugcuggccguguucuaccacgggcagcagcucgaguacaccgcgcggcuggacuuccuguggcgcguccaggccaaggaggagaucaacgagaugaaggagcuccgggagcacaacgagaacaugcugcgcaacauccugcccagccacguggcccggcacuuccucgagaaggaccgcgacaacgaggagcuguacucccagagcuacgacgccgugggcgucauguucgccuccauccccggguucgcggacuucuacagccagacggagaugaacaaccagggcguggagugccugcggcuccugaacgagaucaucgccgacuucgacgagcugcucggggaggaccgcuuccaggacaucgagaagaucaagaccaucggcuccaccuacauggccgugagcggccugagccccgagaagcagcagugcgaggacaagugggggcaccugugcgcccucgccgacuucucccuggcgcugaccgagagcauccaggagaucaacaagcacuccuucaacaacuucgagcuccggaucggcaucagccacggguccgucguggccggcgugaucggcgccaagaagccgcaguacgacaucugggggaagacggucaaccuggccagccgcauggacuccaccggcgugagcgggcggauccaggugcccgaggagaccuaccugauccucaaggaccagggcuucgccuucgacuaccgcggggagaucuacgucaagggcaucuccgagcaggagggcaagaucaagaccuacuuccugcuggggcgcgugcagcccaaccccuucauccugccgccccggcgccuccccggccaguacagccuggcggccgugguccuggggcucgugcagucccugaaccggcagcgccagaagcagcugcucaacgagaacaacaacacgggcaucaucaaggggcacuacaaccggcgcacccugcugagccccuccggcaccgagccgggcgcccaggccgaggggaccgacaagagcgaccuccccuga

SEQ ID NO: 26362 - RNA, 4062 nt, Artificial Sequence
  derived and/or modified sequence opt1 from ADCY9__Homo_sapiens__NP_001107
auggccagcccgccccaccagcagcugcuccaccaccacuccaccgaggugagcugcgacuccagcggcgacuccaacagcguccgcgugaagaucaaccccaagcagcuguccagcaacucccaccccaagcacugcaaguacagcaucuccagcuccugcagcuccagcggggacuccggcggggugccccggcgcgucggcgggggcggccggcugcgccggcagaagaagcucccgcagcuguucgagcgcgccagcucccgguggugggaccccaaguucgacagcgugaaccuggaggaggcgugccucgagcgcugcuucccccagacccagcggcgcuuccgguacgcccuguucuacaucggguucgccugccugcucuggagcaucuacuucgccgugcacaugcgcucccggcugaucgucaugguggcccccgcgcugugcuuccuccuggugugcgucggcuucuuccuguucacguucaccaagcucuacgcccgccacuacgccuggaccagccuggcccugacccuccugguguucgcgcugacgcucgccgcccaguuccaggugcugaccccggucuccgggcggggcgacagcuccaaccugaccgccaccgcccgccccacggacacgugccucagccaggugggguccuucagcaugugcaucgaggugcuguuccugcucuacaccgucaugcaccucccccuguaccucucccugugccugggcguggcguacagcguccucuucgagaccuucggcuaccacuuccgggacgaggccugcuuccccuccccgggggccggcgcccugcacugggagcugcucagccgcgggcugcugcacggcugcauccacgccaucggcguccaccucuucgugaugucccaggugcggagccgcuccacguuccugaaggucgggcagagcaucaugcacggcaaggaccuggagguggagaaggcgcucaaggagcggaugauccacuccgugaugccccgcaucaucgccgacgaccugaugaagcagggggacgaggagagcgagaacuccgucaagcgccacgccaccagcagccccaagaaccggaagaagaaguccagcauccagaaggcccccaucgccuuccgcccguucaagaugcagcagaucgaggagguguccauccuguucgcggacaucgucggcuucaccaagaugagcgccaacaaguccgcccacgcccucguggggcugcugaacgaccucuucggccgguucgaccgccugugcgaggagaccaagugcgagaagaucagcacgcugggcgacugcuacuacugcguggccgggugccccgagccccgggcggaccacgccuacugcugcaucgagaugggccuggggaugaucaaggccaucgagcaguucugccaggagaagaaggagauggugaacaugcgcgugggcgugcacaccgggaccguccugugcggcauccugggcaugcggcgcuucaaguucgacgugugguccaacgacgugaaccuggccaaccucauggagcagcugggggucgcgggcaaggugcacaucagcgaggccaccgccaaguaccuggacgaccgguacgagauggaggacgggaaggugaucgagcgccucggccaguccgucguggccgaccagcugaaggggcugaagaccuaccucaucagcggccagcgggccaaggagucccgcugcagcugcgcggaggcccugcuguccggcuucgaggugaucgacgggagccaggucuccagcggcccccgggggcagggcaccgccuccagcggcaacgugagcgaccucgcccagaccgugaagaccuucgacaaccugaagacgugcccguccugcgggaucaccuucgcccccaagagcgaggcgggcgccgagggcggggcgccccagaacgggugccaggacgagcacaagaacuccaccaaggccagcggcggccccaacccgaagacccagaacgggcugcucuccccgccccaggaggagaagcugacgaacagccagaccucccugugcgagauccuccaggagaagggccgcugggccggggucagccuggaccaguccgcccugcucccccugcgguucaagaacauccgcgagaagaccgacgcccacuucguggacgugaucaaggaggacagccugaugaaggacuacuucuucaagccgcccaucaaccaguucucccucaacuuccuggaccaggagcuggagcggagcuaccgcaccuccuaccaggaggaggucaucaagaacagccccgugaagacguucgccucccccaccuucagcucccuccuggacguguuccugagcaccaccgucuuccucacgcuguccacgaccugcuuccugaaguacgaggccgcgaccgugcccccgccgcccgccgcccucgccguguucagcgccgcgcugcugcucgagguccugagccuggccguguccauccggaugguguucuuccucgaggacgucauggccugcaccaagcgccugcuggaguggaucgccggcuggcucccccgccacugcaucggggccauccuggugagccugcccgcgcucgccguguacucccacgucaccagcgaguacgagaccaacauccacuuccccguguucaccggcuccgccgcccugaucgccgugguccacuacugcaacuucugccagcugagcuccuggaugcggagcucccucgcgaccguggugggcgccgggccccugcugcuccuguacgucagccugugccccgacuccagcgugcucacgagcccccuggacgccgugcagaacuucuccuccgagcgcaaccccugcaacagcuccgucccgcgggaccugcgccggcccgccagccucaucggccaggagguggugcuggucuucuuccugcuccugcugcucgugugguuccugaaccgcgaguucgagguguccuaccggcugcacuaccacggggacgucgaggcggaccuccaccgcaccaagauccagagcaugcgggaccaggccgacuggcugcugcgcaacaucauccccuaccacguggccgagcagcucaaggugagccagaccuacuccaagaaccacgacagcggcggggucaucuucgccuccaucgugaacuucagcgaguucuacgaggagaacuacgagggcggcaaggagugcuaccggguccugaacgagcugaucggggacuucgacgagcuccuguccaagcccgacuacagcuccaucgagaagaucaagaccaucggcgccacguacauggcggccagcgggcugaacaccgcccaggcccaggacggcucccacccgcaggagcaccuccagauccuguucgaguucgccaaggagaugaugcgcgugguggacgacuucaacaacaacaugcugugguucaacuucaagcuccgggucggguucaaccacggcccccugaccgcgggcgugaucgggaccacgaagcugcucuacgacaucuggggcgacaccgugaacaucgccagccgcauggacaccaccggggucgagugccggauccagguguccgaggagagcuaccgcgugcuguccaagaugggcuacgacuucgacuaccggggcacggucaacgugaaggggaagggccagaugaagaccuaccuguaccccaagugcaccgaccaccgcgugaucccccagcaccagcucagcaucuccccggacauccggguccagguggacgggagcaucggccgcucccccaccgacgagaucgccaaccuggugcccagcguccaguacguggacaagacgucccuggggagcgacagcuccacccaggccaaggacgcccaccucagccccaagcggccguggaaggagcccgugaaggcggaggagcgcggccgcuucggcaaggccaucgagaaggacgacugcgacgagaccgggaucgaggaggccaacgagcugaccaagcugaacgucuccaagagcguguga

SEQ ID NO: 26363 - RNA, 531 nt, Artificial Sequence
  derived and/or modified sequence opt1 from ADCYAP1__Homo_sapiens__NP_001093203
augaccaugugcagcggcgcccgccuggcccuccugguguacgggaucaucaugcacuccagcgucuacuccagccccgcggccgccggccugcgguucccggggauccgccccgaggaggaggccuacggcgaggacgggaacccccuccccgacuucgacggcuccgagccgcccggcgccgggagccccgcguccgcgccccgggccgccgccgccugguaccgcccggccggccggcgcgacguggcccacgggauccugaacgaggccuaccggaaggugcuggaccagcucagcgcgggcaagcaccuccagucccuggucgcccgcggggugggcggcagccucgggggcggggccggcgacgacgccgagccccuguccaagcggcacagcgacggcaucuucaccgacuccuacagccgcuaccggaagcagauggccgugaagaaguaccuggcggccguccuggggaagcgcuacaagcagcgggugaagaacaagggccgccggaucgccuaccuguga

SEQ ID NO: 26364 - RNA, 1407 nt, Artificial Sequence
  derived and/or modified sequence opt1 from ADCYAP1R1__Homo_sapiens__NP_001109
auggccggcgugguccacgugagccuggccgcgcuccugcugcuccccauggccccggccaugcacuccgacugcaucuucaagaaggagcaggccaugugccuggagaagauccagcgcgccaacgagcugaugggguucaacgacagcucccccggcugccccgggaugugggacaacaucacgugcuggaagcccgcgcacgugggcgagaugguccucgugagcugcccggagcuguuccggaucuucaaccccgaccaggugugggagaccgagaccaucggggaguccgacuucggcgacagcaacucccuggaccucagcgacaugggcgucgugucccgcaacugcaccgaggacggguggagcgagcccuucccccacuacuucgacgccugcggcuucgacgaguacgaguccgagaccggggaccaggacuacuacuaccugagcgugaaggcccuguacaccgucggcuacuccacgagccucgugacccugaccaccgccauggugauccugugccgguuccgcaagcuccacugcacgcggaacuucauccacaugaaccuguucgucuccuucaugcugcgcgcgaucagcguguucaucaaggacuggauccucuacgccgagcaggacuccaaccacugcuucaucagcaccguggagugcaaggccgucaugguguucuuccacuacugcguggucuccaacuacuucuggcuguucaucgaggggcuguaccucuucacccugcugguggagaccuucuucccggagcggcgcuacuucuacugguacacgaucaucggcuggggcacccccaccgugugcgucaccgugugggccacgcuccggcuguacuucgacgacaccgggugcugggacaugaacgacagcaccgcccuguggugggugaucaagggccccgucguggggagcaucauggucaacuucguccucuucaucggcaucaucgugauccuggugcagaagcugcagucccccgacaugggcgggaacgagagcuccaucuaccuccgccuggcgcggagcacccugcuccugaucccgcuguucggcauccacuacacgguguucgccuucucccccgagaacgugagcaagcgcgagcggcucgucuucgagcuggggcugggcuccuuccagggguucgugguggccguccucuacugcuuccugaacggcgaggugcaggccgagaucaagcgcaaguggcggagcuggaaggugaaccgcuacuucgccgucgacuucaagcaccggcaccccucccuggcgagcuccggcgugaacgggggcacccagcucagcauccuguccaagagcuccagccagauccgcauguccgggcugcccgccgacaaccucgccaccuga

SEQ ID NO: 26365 - RNA, 2214 nt, Artificial Sequence
  derived and/or modified sequence opt1 from ADD1__Homo_sapiens__NP_001110
augaacggggacagccgcgccgccguggucaccagcccgccgcccaccacggcgccccacaaggagcgguacuucgaccgcguggacgagaacaaccccgaguaccugcgggagcgcaacauggccccggaccuccggcaggacuucaacaugauggagcagaagaagcgcgugagcaugauccugcagucccccgccuucugcgaggagcuggagagcaugauccaggagcaguucaagaaggggaagaaccccaccggccuccuggcccugcagcagaucgccgacuucaugaccaccaacguccccaacguguacccggcggcgccccagggcggcauggccgcccucaacaugucccuggggauggugacgcccgucaacgaccugcggggcagcgacuccaucgccuacgacaagggcgagaagcuccugcgcugcaagcuggccgccuucuaccggcucgccgaccuguucggguggagccagcugaucuacaaccacaucaccacccgcgugaacuccgagcaggagcacuuccucaucgugcccuucggccugcuguacagcgaggucaccgccuccagccucgugaagaucaaccugcagggggacaucguggaccggggcuccacgaaccugggggucaaccaggcgggcuucacccuccacagcgccaucuacgccgcccgcccggacgugaagugcgugguccacauccacacccccgccggcgcggccguguccgccaugaagugcgggcugcugcccaucagccccgaggcccucucccugggcgagguggccuaccacgacuaccacgggauccuggucgacgaggaggagaaggugcucauccagaagaaccugggccccaagagcaaggugcugauccuccggaaccacggccuggucuccgugggggagagcguggaggaggcguucuacuacauccacaaccuggucguggccugcgagauccagguccgcacccucgccagcgccggcgggcccgacaaccuggugcugcucaaccccgagaaguacaaggccaagucccggagccccggcuccccggugggggagggcacgggcagcccgcccaaguggcagaucggggagcaggaguucgaggcgcugaugcgcaugcuggacaaccucggcuaccggaccggguaccccuaccgcuaccccgcccugcgggagaaguccaagaaguacagcgacgucgaggugcccgccuccgugaccggcuacagcuucgccuccgacggggacagcgggaccugcagcccccugcgccacagcuuccagaagcagcagcgggagaagacgcgcuggcucaacuccggccgcggggacgaggcgagcgaggagggccagaacggguccagccccaaguccaagaccaaguggaccaaggaggacggccaccggaccagcacguccgccgucccgaaccuguucgugccccugaacaccaaccccaaggaggugcaggagaugcgcaacaagauccgggagcagaaccuccaggacaucaagaccgccgggccgcagagccagguccugugcggcguggugauggaccgcagccugguccagggcgagcucgugaccgccuccaaggccaucaucgagaaggaguaccagccccacgugaucgucagcacgaccgggcccaaccccuucaccacccugacggaccgggagcuggaggaguaccgccgggagguggagcgcaagcagaagggcuccgaggagaaccuggacgaggcgcgggagcagaaggagaaguccccgcccgaccagcccgccgugccccacccgccgcccuccacccccaucaagcucgaggaggaccugguccccgagcccaccaccggggacgacagcgacgccgccacguucaagcccacccugcccgaccucuccccggacgagcccagcgaggcccugggcuuccccaugcuggagaaggaggaggaggcgcaccggcccccgucccccaccgaggcccccaccgaggccagccccgagccggcccccgaccccgccccgguggcggaggaggccgcccccuccgccguggaggagggcgcggccgccgaccccgggagcgacggcucccccggcaagagcccguccaagaagaagaagaaguuccgcacgcccagcuuccucaagaaguccaagaagaaguccgacagcuga

SEQ ID NO: 26366 - RNA, 1728 nt, Artificial Sequence
  derived and/or modified sequence opt1 from ADD2__Homo_sapiens__NP_001171984
augccccgccggcgcgugccgggcgccaacugcaagcccaccgggaagaugagcgaggagaccguccccgaggccgcgagcccgcccccgccccagggccagcccuacuucgaccgguucagcgaggacgaccccgaguacaugcgccugcggaaccgcgccgccgaccuccggcaggacuucaaccugauggagcagaagaagcgcgugacgaugauccugcagucccccagcuuccgggaggagcucgaggggcugauccaggagcagaugaagaagggcaacaacuccagcaacaucugggcccugcgccagaucgccgacuucauggcguccaccagccacgccguguuccccaccuccagcaugaacgucuccaugaugacccccaucaacgaccuccacacggccgacagccugaaccuggccaagggggagcggcucaugcgcugcaagaucuccagcguguaccggcugcuggaccucuacggcugggcgcagcuguccgacaccuacgugacccugcgcgucagcaaggagcaggaccacuuccucaucuccccgaagggcgugagcugcuccgaggugaccgccagcagccugaucaaggucaacauccugggggaggugguggagaagggcuccagcugcuuccccgucgacacgaccggguucugccuccacuccgccaucuacgccgcccggcccgacgugcgcugcaucauccaccuccacacccccgcgaccgccgccgugagcgccaugaaguggggccugcugccggucucccacaacgcccugcuggugggggacauggcguacuacgacuucaacggcgagauggagcaggaggccgaccggaucaaccuccagaagugccugggccccacgugcaagauccuggugcuccgcaaccacggggucguggcccugggcgacaccguggaggaggccuucuacaagaucuuccaccuccaggccgcgugcgagauccaggucagcgcccuguccagcgccgggggcguggagaaccugauccugcucgagcaggagaagcaccggccccacgaggugggcuccguccagugggccgggagcaccuucggccccaugcagaagucccgccugggggagcacgaguucgaggcccugaugcggaugcucgacaaccugggcuaccgcaccggguacacguaccgccacccguucgugcaggagaagaccaagcacaagagcgaggucgagauccccgcgaccgugaccgccuucguguucgaggaggacggcgcccccguccccgcccugcggcagcacgcgcagaagcagcagaaggagaagacgcgcuggcucaacaccccgaacaccuaccugcgggugaacguggccgacgagguccagcgcuccaugggcagcccccggcccaagaccacguggaugaaggccgacgagguggagaaguccagcuccgggaugcccauccgcaucgagaacccgaaccaguucgugccccuguacaccgacccccaggagguccucgagaugcggaacaagauccgcgagcagaaccggcaggacgucaagagcgccggcccgcagucccagcugcuggccagcgugaucgcggagaagucccgcucccccguggagcagcggcucccccugaccgggggcgagaccugccugcccagcggguccagcgugccgggcgccggccuccaggaccccuga

SEQ ID NO: 26367 - RNA, 2121 nt, Artificial Sequence
  derived and/or modified sequence opt1 from ADD3__Homo_sapiens__NP_058432
augagcuccgacgccagccagggcgugaucaccacgcccccgccgcccuccaugccccacaaggagcgcuacuucgaccggaucaacgagaacgaccccgaguacauccgcgagcggaacaugagccccgaccugcgccaggacuucaacaugauggagcagcggaagcgcgucacccagauccuccagucccccgccuuccgggaggaccuggagugccugauccaggagcagaugaagaaggggcacaaccccaccggccuccuggcgcugcagcagaucgccgacuacaucauggccaacagcuucuccggguucagcuccccgccccucagccugggcauggugacccccaucaacgaccugcccggggccgacaccuccagcuacgugaagggcgagaagcucacgcgcugcaagcuggccucccuguaccggcucgucgaccuguucggcugggcgcaccuggccaacaccuacaucagcgugcgcaucuccaaggagcaggaccacaucaucaucaucccgcgggggcucagcuucuccgaggccaccgccagcaaccuggugaaggucaacaucaucggcgaggugguggaccagggguccaccaaccugaagaucgaccacacgggcuucagcccccacgcggccaucuacagcacccgccccgacgucaagugcgugauccacauccacacccucgccaccgccgccguguccagcaugaagugcgggauccugcccaucucccaggagagccugcuccugggcgacgucgcguacuacgacuaccagggcucccuggaggagcaggaggagcggauccagcuccagaaggugcuggggccgagcugcaaggugcugguccuccgcaaccacggcgugguggcccugggggagacgcuggaggaggccuuccacuacaucuucaacguccagcucgccugcgagauccaggugcaggcccuggcgggcgccggcgggguggacaaccugcacguccucgacuuccagaaguacaaggccuucaccuacaccguggccgccuccggcgggggcggggugaacaugggcagccaccagaaguggaaggucggcgagaucgaguucgaggggcugaugcggacccuggacaaccucggcuaccgcacgggguacgcguaccggcacccccugauccgcgagaagccccggcacaaguccgacguggagauccccgccaccgucaccgccuucagcuucgaggacgacaccgugccgcugagcccccucaaguacauggcccagcgccagcagcgggagaagacgcgcuggcugaacucccccaacaccuacaugaaggugaacguccccgaggagucccgcaacggcgagaccagcccgcggaccaagaucacguggaugaaggccgaggacuccagcaagguguccgggggcacccccaucaagaucgaggaccccaaccaguucgugccccugaacaccaacccgaacgagguccucgagaagcgcaacaagauccgggagcagaaccgcuacgaccugaagaccgcgggcccccagagccagcugcucgccgggaucgugguggacaagcccccguccacgaugcaguucgaggacgacgaccacggcccgcccgccccgcccaaccccuucagccaccugaccgagggggagcuggaggaguacaagcggaccaucgagcgcaagcagcagggccucgaggacgccgagcaggagcugcugagcgacgacgcguccagcgucucccagauccagagccagacccagagcccccagaacgugcccgagaagcuggaggagaaccacgagcuguucuccaaguccuucaucagcauggaggugcccgucaugguggugaacgggaaggacgacaugcacgacgucgaggacgagcucgccaagcgggugucccgccugagcacguccaccaccaucgagaacaucgagaucaccaucaagagccccgagaagaucgaggaggugcucucccccgagggcagccccuccaagagcccguccaagaagaagaagaaguuccggacgcccagcuuccugaagaagaacaagaagaaggagaaggucgaggccuga

SEQ ID NO: 26368 - RNA, 5004 nt, Artificial Sequence
  derived and/or modified sequence opt1 from ADGB__Homo_sapiens__NP_078970
auggccagcaagcagaccaagaagaaggaggugcaccgcaucaacagcgcccacgggagcgacaagagcaaggacuucuaccccuucgggagcaacguccagagcggcagcaccgagcagaagaaggggaaguucccccuguggcccgaguggagcgaggccgacaucaacagcgagaagugggacgccggcaagggggccaaggagaaggacaagaccggcaagagccccguguuccacuucuucgaggaccccgagggcaagaucgagcucccgcccagccugaagaucuacagcuggaagcggccccaggacauccuguucagccagacccccguggucgugaagaacgagaucaccuucgaccucuucuccgccaacgagcaccuccugugcagcgagcucaugcgcuggaucaucuccgagaucuacgccguguggaagaucuucaacgggggcauccugagcaacuacuucaaggggaccuccggcgagccgccccugcuccccuggaagcccugggagcacaucuacagccugugcaaggccgucaaggggcacaugccccuguucaacuccuacggcaaguacguggugaagcucuacuggaugggcugcuggcggaagaucacgaucgacgacuuccugcccuucgacgaggacaacaaccugcuccugcccgccaccaccuacgaguucgagcuguggcccaugcuccugagcaaggccaucaucaagcuggccaacaucgacauccacgucgcggaccgccgggagcucggggaguucaccgugauccacgcccugacgggcuggcugccggaggugaucagccuccaccccggguacauggacaaggucugggagcugcugaaggagauccuccccgaguucaagcuguccgacgaggccagcuccgagagcaagaucgccgugcuggacuccaagcucaaggagcccggcaaggagggcaaggaggggaaggagaucaaggacggcaaggaggugaaggacgucaaggaguucaagccggagagcucccugaccacccugaaggcccccgagaaguccgacaaggugcccaaggagaaggcggacgcccgcgacaucgggaagaagcgguccaaggacggcgagaaggagaaguucaaguucagccuccacgggucccgccccagcuccgaggugcaguacagcguccagucccugagcgacugcuccagcgccauccagaccucccacauggugguguacgccacguucaccccgcuguaccucuucgagaacaagaucuucagccuggagaagauggccgacagcgcggagaagcugcgggaguacggccucucccacaucugcagccaccccguccuggugacccgcucccggagcugcccccugguggcgccgcccaagcccccgccccugccgcccuggaagcugauccgccagaagaaggagaccgucaucacggacgaggcccaggagcugaucgugaagaagcccgagcgguuccucgagaucuccagccccuuccugaacuaccgcaugacccccuucaccauccccaccgagaugcacuucguccggucccugaucaagaagggcaucccgcccgggagcgaccuccccuccgugagcgagacggacgagaccgccacccacucccagaccgaccugagccagaucacgaaggccaccucccagggcaacaccgcgagccaggugauccuggggaagggcaccgacgagcagacggacuucgggcugggcgacgcccaccaguccgacggccucaaccuggagcgcgagaucgucagccagaccaccgccacccaggagaagucccaggaggagcugcccacgaccaacaacagcgugagcaaggagaucuggcucgacuucgaggacuucugcgugugcuuccagaacaucuacaucuuccacaagcccuccagcuacugccugaacuuccagaaguccgaguucaaguucagcgaggagcgggucuccuacuaccuguucguggacagccucaagccgaucgagcugcuggugugcuucuccgcccucguccgcuggggcgaguacggcgcccugaccaaggacuccccgcccaucgagcccgggcugcucaccgcggagacguucuccuggaagucccugaagccgggcucccuggugcucaagauccacaccuacgccaccaaggccaccgugguccggcugcccguggggcgccacaugcuccuguucaacgccuacagccccgugggccacuccauccacaucugcagcauggucuccuucgugaucggcgacgagcacgugguccugcccaacuucgagccggagagcugccgguucaccgagcagucccugcucaucaugaaggcgaucgggaacgugaucgccaacuucaaggacaagggcaagcugagcgccgcccugaaggaccuccagacggcccacuaccccgugcccuuccacgacaaggagcugaccgcgcagcacuuccgcgucuuccaccugucccucuggcgccugaugaagaaggugcagaucaccaagcccccgcccaacuucaaguucgccuuccgggccauggugcuggaccucgagcugcugaacagcagccucgaggaggucucccugguggaguggcuggacgugaaguacugcaugcccaccagcgacaaggaguacuccgccgaggaggucgccgcggccaucaagauccaggccauguggcgcgggacguacgugcggcuccugaugaaggcccgcaucccggacaccaaggagaacaucagcguggccgacacccugcagaaggucugggcggugcucgagaugaaccuggagcaguacgccgugucccugcuccggcugauguucaagagcaagugcaagucccuggagagcuaccccugcuaccaggacgaggagaccaagaucgccuucgccgacuacacggucaccuaccaggagcagccgcccaacuccugguucaucguguuccgcgagaccuuccucgugcaccaggacaugauccuggucccgaagguguacaccacgcugcccaucugcauccuccacaucgugaacaacgacaccauggagcagguccccaagguguuccagaaggugguccccuaccuguacaccaagaacaagaagggcuacaccuucguggcggaggccuucacgggcgacaccuacguggccgccagccgguggaagcugcgccucaucggguccagcgccccgcugcccugccugucccgggacagccccugcaacuccuucgcgaucaaggagauccgcgacuacuacauccccaacgacaagaagauccucuuccgguacagcgucaaggugcugaccccgcagcccgccaccauccaggugcgcacguccaagcccgacgccuucaucaagcugcagguccucgagaacgaggagaccauggugagcuccaccggcaaggggcaggccaucauccccgccuuccacuuccucaagagcgagaagggccugagcucccagagcuccaagcacauccucagcuuccacuccgcgagcaagaaggagcaggagguguacgucaagaagaaggccgcccaggggauccagaaguccccgaagggccgggccgugagcgccauccaggacaucggccugccccuggucgaggaggagaccacguccacccccacccgcgaggacagcuccagcacgccccugcagaacuacaaguacaucauccagugcuccgugcuguacaacagcuggccgcugacggagucccagcucaccuucgugcaggcgcugaaggaccugaagaaguccaacaccaaggccuacggggagcggcacgaggagcucaucaaccugggcucccccgacagccacaccaucuccgaggggcagaaguccagcgucacguccaagaccacccgcaagggcaaggagaaguccuccgagaaggagaagaccgccaaggagaagcaggcgccccgguucgagccccagaucagcacggugcacccgcagcaggaggaccccaacaagcccuacuggauccugcgccucgugaccgagcacaacgaguccgagcuguucgaggucaagaaggacaccgagcgggcggacgagauccgcgccaugaagcaggccugggagaccaccgagcccgggcgcgccaucaaggccagccaggcgcggcugcacuaccucuccggcuucaucaagaagacgagcgacgccgaguccccgcccaucagcgagucccagaccaagcccaaggaggagguggagaccgccgcccgcggcgugaaggagccgaacagcaagaacuccgccgggagcgaguccaaggagaugacccagacgggcagcggguccgcggucuggaagaaguggcagcugaccaagggccugcgggacguggccaagagcaccuccagcgagagcgggggcguguccagccccggcaaggaggagcgcgagcaguccacccggaaggagaacauccagacggggccccgcacccggagccccaccauccucgagaccuccccgcgccugauccggaaggcccuggaguucauggaccucagccaguacguccgcaagacggacaccgacccccugcugcagaccgacgagcucaaccagcagcaggccaugcagaaggccgaggagauccaccaguuccggcagcaccgcacccgggugcuguccauccgcaacaucgaccaggaggagcggcugaagcucaaggacgaggugcuggacauguacaaggagaugcaggacagccuggacgaggcgcgccagaagaucuucgacauccgggaggaguaccgcaacaagcuccuggaggccgagcaccugaagcucgagacgcuggccgcccaggaggccgcgaugaagcuggagaccgagaagaugacccccgcccccgacacccagaagaagaagaagggcaagaagaaguga

SEQ ID NO: 26369 - RNA, 1683 nt, Artificial Sequence
  derived and/or modified sequence opt1 from ADGRA1__Homo_sapiens__NP_001077378
auggaccugaagaccgugcucagccugccccgcuacccgggcgaguuccugcaccccgucguguacgccugcaccgccgugaugcuccugugccugcucgcguccuucgucacguacaucgugcaccagagcgccauccggaucucccgcaaggggcggcacacccugcugaacuucugcuuccacgccgcccucaccuucaccguguucgccggcgggaucaaccgcacgaaguaccccauccugugccaggcggucggcaucgugcugcacuacagcacccucuccaccaugcuguggaucggggugaccgcccggaacaucuacaagcaggucacgaagaaggcgccccugugccucgacaccgaccagccgcccuacccccgccagccccugcugcgguucuaccucgugagcggcggcgugccguucaucaucugcggggucaccgccgccaccaacauccgcaacuacggcacggaggacgaggacaccgccuacugcuggauggccugggagcccucccugggggccuucuacggccccgccgcgaucaucacccuggugaccugcguguacuuccucgggacguacguccagcugcggcgccaccccggccggcgcuacgagcugcggacccagccggaggagcagcgccggcucgccacccccgagggcgggcgcggcauccggcccgggacgcccccggcccacgacgcccccggcgccagcgugcugcagaacgagcacuccuuccaggcgcagcugcgcgccgccgccuucacccucuuccuguucaccgccaccugggcguucggcgcccuggccgugagccaggggcacuuccucgacauggucuucuccugccuguacggcgccuucugcgugacccuggggcuguucgugcugauccaccacugcgccaagcgggaggacgucuggcagugcuggugggcgugcugcccgccccgcaaggacgcccaccccgcccuggacgccaacggcgcggcccucgggcgggccgccugccugcacagccccggccugggccagccccgcggguucgcccacccgcccggccccugcaagaugacgaaccuccaggcggcccaggggcacgccuccugccugagccccgccacccccugcugcgccaagaugcacugcgagccgcugaccgcggacgaggcccacgugcaccuccaggaggagggcgccuucgggcacgacccccaccuccacggcugccugcagggccgcaccaagcccccguacuucucccggcaccccgccgaggagcccgaguacgccuaccacauccccagcucccucgacgggagcccgcgcuccagccggacggacagcccgcccuccagccuggacggccccgcggggacccacacccuggccugcugcacccagggcgaccccuuccccauggugacgcagcccgagggguccgacggcagccccgcccucuacuccugcccgacccagcccggccgcgaggccgcgcuggggcccggccaccuggagaugcugcggcgcacccagagccuccccuucgggggcccgucccagaacggccugcccaaggggaagcugcucgagggccugcccuucgggaccgacggcacggggaacauccggaccggccccuggaagaacgagaccaccgucuga

SEQ ID NO: 26370 - RNA, 4017 nt, Artificial Sequence
  derived and/or modified sequence opt1 from ADGRA2__Homo_sapiens__NP_116166
augggcgccgggggccgccggaugcgcggggcccccgcgcggcugcuccugccgcugcuccccuggcugcugcuccugcuggcccccgaggcccgcggcgcccccgggugcccgcucagcauccgguccugcaagugcagcggcgagcgccccaagggccuguccgggggcgugcccgggcccgcccggcgccgggucgugugcagcggcggggaccugccggagccccccgagcccggccuccugccgaacggcaccgugacccugcuccuguccaacaacaagaucacggggcugcgcaacggcagcuuccucgggcugucccugcucgagaagcuggaccugcggaacaacaucaucagcaccguccagcccggcgcguuccucggccugggggagcugaagcgccucgaccuguccaacaaccggaucggcugccugaccagcgagaccuuccaggggcucccccgccugcugcggcucaacaucuccggcaacaucuucagcucccugcagcccgggguguucgacgagcugccggcccucaagguggucgaccugggcacggaguuccugaccugcgacugccaccuccgcuggcugcugcccugggcccagaaccggagccuccagcuguccgagcacacccugugcgccuaccccagcgcgcuccacgcccaggcccugggcucccugcaggaggcccagcucugcugcgagggggcccuggagcugcacacccaccaccugauccccagccuccgccaggugguguuccagggcgaccggcugccguuccagugcuccgcgagcuaccuggggaacgacacgcgcauccggugguaccacaaccgcgcccccgucgagggcgacgagcaggccgggauccuccuggccgagagccugauccacgacugcaccuucaucaccuccgagcucacccugagccacaucggcgugugggccuccggcgagugggagugcacggugagcauggcgcaggggaacgccuccaagaaggucgagaucguggugcuggagaccagcgccuccuacugccccgccgagcgcgucgccaacaaccggggcgacuuccgcuggccccggacccucgcggggaucaccgccuaccagagcugccugcaguacccguucacguccgugccccugggcgggggcgcccccggcacccgcgccagccggcgcugcgaccgggccgggcgcugggagcccggcgacuacucccacugccucuacaccaacgacaucacccgggugcuguacacguucguccugaugccgaucaacgcgagcaacgcccucacccuggcccaccagcugcgcguguacaccgccgaggcggccuccuucagcgacaugauggacguggucuacguggcccagaugauccagaaguuccucggguacguggaccagaucaaggagcuggucgaggugauggucgacauggccuccaaccugaugcucguggacgagcaccugcuguggcucgcccagcgggaggacaaggcgugcagccgcaucgugggcgcccuggagcggaucggcggggccgcccuguccccccacgcccagcacaucagcgucaacgcgcgcaacguggcccucgaggccuaccugaucaagccccacuccuacgugggccugaccugcacggccuuccagcggcgcgaggggggcgucccggggacccggcccggcagccccggccagaaccccccgcccgagcccgagcccccggccgaccagcagcuccgcuuccggugcaccaccgggcgccccaacgugagccuguccagcuuccacaucaagaacuccguggcgcuggccagcauccagcucccccccucccuguucagcucccugccggccgcccucgcgccccccguccccccggacugcacgcugcagcugcucguguuccgcaacggccggcuguuccacagccacuccaacaccagccgccccggggccgccggccccgggaagcggcgcggcguggccacccccgucaucuucgccggcaccuccgggugcggcguggggaaccugacggagccgguggcggucagccuccggcacugggccgagggcgccgagcccguggccgccugguggucccaggaggggcccggcgaggcgggcggguggaccagcgagggcugccagcugcgcuccagccagcccaacguguccgcccugcacugccagcaccucgggaacgucgccgugcugauggagcugagcgccuucccgcgggaggugggcggggccggcgcgggccuccaccccgucguguaccccugcaccgcccugcugcuccugugccuguucgccaccaucaucacguacauccucaaccacagcuccauccgcgugagccggaagggguggcacaugcugcugaaccucugcuuccacaucgccaugaccuccgcggucuucgccggcgggaucacccugaccaacuaccagauggugugccaggccgugggcaucacccugcacuacagcucccucagcacgcugcuguggaugggcgucaaggcccgcgugcuccacaaggagcugaccuggcgggccccgcccccccaggagggggaccccgcgcugccgacccccucccccaugcuccgcuucuaccugaucgccggcgggaucccccugaucaucugcggcaucaccgccgccgugaacauccacaacuaccgggaccacagcccguacugcuggcucgucuggcgccccucccugggggccuucuacauccccguggcgcugauccuccugaucacguggaucuacuuccugugcgccggccuccggcugcgcggcccccuggcccagaacccgaaggccgggaacagccgggccucccucgaggcgggcgaggagcugcgcgggagcacccggcugcgcggcuccgggccccuccugagcgacuccggcagccugcucgccaccggcuccgcccggguggggacccccggccccccggaggacggggacagccuguacucccccggcguccagcugggggcccucgugacgacccacuuccuguaccuggccaugugggcgugcggcgcccucgccgugagccagcgcuggcugccccgcgucgugugcagcugccuguacggcguggccgcguccgcccucgggcuguucgucuucacccaccacugcgcccggcgccgggacgugcgcgccagcuggcgggccugcugccccccggcgucccccgccgccccccacgcccccccgcgcgcccugcccgcggccgccgaggacggcagccccguguucggggagggccccccgucccugaagagcucccccagcggcuccagcgggcacccccucgcccugggcccgugcaagcugaccaaccuccagcuggcccagucccaggucugcgaggcgggggccgccgccggcggggagggcgagcccgagcccgcgggcacgcgggggaaccuggcccaccgccaccccaacaacgugcaccacggccggcgcgcccacaagagccgggccaaggggcaccgcgccggcgaggcgugcgggaagaaccggcucaaggcccugcgcggcggcgccgccggggcccuggagcuccuguccagcgaguccggcagccugcacaacuccccgaccgacagcuaccucggguccagccggaacagccccggcgcggggcugcagcuggagggcgagcccaugcucacccccuccgagggcagcgacaccuccgccgccccgcugagcgaggccgggcgcgccggccagcggcgcuccgcgagccgggacucccugaaggggggcggggcccucgagaaggagagccaccgccgcuccuacccccugaacgccgccagccugaacggcgcgcccaagggcgggaaguacgacgacgugacgcucaugggcgccgaggucgccuccgggggcugcaugaagaccggccuguggaagagcgagaccaccguguga

SEQ ID NO: 26371 - RNA, 3966 nt, Artificial Sequence
  derived and/or modified sequence opt1 from ADGRA3__Homo_sapiens__NP_660333
auggagcccccgggccgccggcgcgggcgggcccagccgccccugcuccugccccugagccuccuggcccugcucgcgcugcugggcgggggcgggggcggcggggccgccgcccuccccgccggcugcaagcacgacgggcgcccccggggcgcggggcgcgccgccggcgccgcggagggcaagguggucugcuccagccuggagcuggcccaggugcucccgcccgacacccugcccaaccggaccgugacgcugauccucuccaacaacaagaucagcgagcugaagaacggguccuucagcggccugucccuccuggagcgccuggaccuccggaacaaccugaucagcuccaucgaccccggggccuucuggggccugagcucccucaagcgccuggaccugaccaacaaccggaucggcugccucaacgccgacaucuuccgcgggcugaccaaccugguccggcucaaccugagcggcaaccuguucuccagccucucccaggggaccuucgacuaccuggccagccugcgcucccucgaguuccagacggaguaccugcugugcgacugcaacauccucuggaugcaccggugggugaaggagaagaacaucaccgugcgcgacacccggugcgucuaccccaagagccugcaggcgcagcccgugaccggcgugaagcaggagcugcucacgugcgacccgccccuggagcugcccuccuucuacaugacccccagccaccgccaggucguguucgagggggacagccucccguuccagugcauggccuccuacaucgaccaggacaugcagguccugugguaccaggacggccggaucgucgagaccgacgagagccagggcaucuucguggagaagaacaugauccacaacugcucccugaucgccagcgcccucaccaucuccaacauccaggccgggagcacgggcaacugggggugccacgugcagaccaagcgcggcaacaacacccggaccgucgacaucguggugcuggaguccagcgcgcaguacugcccgcccgagcgcgucgugaacaacaagggggacuuccgcuggccccggacgcuggccggcaucaccgccuaccugcagugcacccgcaacacccacggcuccgggaucuaccccggcaacccccaggacgagcggaaggccuggcgccggugcgaccgcgggggcuucugggccgacgacgacuacagccggugccaguacgcgaacgacgugacgcgcguccucuacauguucaaccagaugccccugaaccugaccaacgccguggccaccgcccggcagcuccuggccuacaccguggaggcggccaacuucuccgacaagauggacgugaucuucguggccgagaugaucgagaaguucgggcgcuucacgaaggaggagaaguccaaggagcugggcgacgucaugguggacaucgccagcaacaucaugcucgcggacgagcgggugcuguggcuggcccagcgcgaggccaaggccugcagccggaucguccagugccuccagcgcaucgccaccuaccggcuggcgggcggggcccacguguacuccaccuacagccccaacaucgcccuggaggccuacgugaucaaguccaccggcuucacggggaugaccugcaccgucuuccagaagguggccgcgagcgaccgcaccggccucuccgacuacggccggcgcgacccggaggggaaccuggacaagcagcugagcuucaagugcaacgugagcaacacguucuccagccucgcccugaagaacaccaucgucgaggccuccauccagcugccgcccagccucuucucccccaagcagaagcgggagcugcgccccaccgacgacagccuguacaagcuccagcugaucgccuuccgcaacggcaagcuguuccccgccaccgggaacuccacgaaccucgcggacgacggcaagcggcgcaccguggugacccccgucauccugaccaagaucgacggggugaacguggacacccaccacaucccggucaacgugacgcugcggcgcaucgcccacggcgccgacgccguggcggcccggugggacuucgaccuccugaacggccagggcggguggaaguccgacgggugccacauccuguacagcgacgagaacaucaccaccauccagugcuacagccucuccaacuacgccguccugauggaccugaccggcagcgagcucuacacgcaggccgccucccugcugcaccccgugguguacaccaccgcgaucauccuccugcugugccuccuggccgucaucgugagcuacaucuaccaccacucccugauccgcaucagccucaaguccuggcacaugcuggugaaccugugcuuccacaucuuccugaccugcgucguguucgucgggggcaucacgcagacccggaacgccagcaucugccaggccgugggcaucauccuccacuacagcacccuggccaccgugcucugggugggggucacggcgcgcaacaucuacaagcaggucaccaagaaggccaagcggugccaggaccccgacgagcccccgcccccgccccgccccaugcugcgguucuaccugaucggcgggggcauccccaucaucgugugcgggaucaccgccgccgccaacaucaagaacuacggcucccgccccaacgcgcccuacugcuggauggccugggagccgagccucggcgccuucuacgggcccgccuccuucaucaccuucgugaacugcauguacuuccugagcaucuucauccagcugaagcggcaccccgagcgcaaguacgagcucaaggagcccacggaggagcagcagcggcuggcggccaacgagaacggcgagaucaaccaccaggacuccaugagccugucccucaucagcaccuccgcccuggagaacgagcacaccuuccacagccagcugcucggggccucccugacccugcuccuguacguggcccuguggauguucggcgcgcucgccgugagccuguacuacccgcuggaccucgucuucuccuucguguucggggccacgagccuguccuucagcgccuucuucgugguccaccacugcgugaaccgcgaggacgugcggcuggccuggaucaugaccugcugccccggccgcuccagcuacuccguccaggugaacgugcagccgcccaacagcaacggcaccaacggggaggcgcccaagugccccaacagcuccgccgagagcuccugcaccaacaagagcgccuccagcuucaagaacuccagccagggcugcaagcucacgaaccugcaggccgccgcggcccagugccacgccaacucccugccccucaacagcacgccccagcuggacaacucccugaccgagcacagcauggacaacgacaucaagaugcacgucgccccgcucgaggugcaguuccggaccaacgugcacuccagccgccaccacaagaaccgguccaaggggcaccgcgccagccgccugaccguccugcgggaguacgcguacgacgugcccaccuccguggagggcagcguccagaacggccuccccaagucccgccuggggaacaacgagggccacagccggagccgccgggccuaccuggccuaccgcgagcggcaguacaacccgccccagcaggacuccagcgacgccugcuccacccuccccaagagcucccgcaacuucgagaagcccgugagcaccacguccaagaaggacgcgcugcggaagccggccgucguggagcuggagaaccagcagaaguccuacgggcucaaccuggccauccagaacggccccaucaagagcaacgggcaggagggcccccugcucggcaccgacagcaccgggaacgugcgcaccggccuguggaagcacgagacgaccgucuga

SEQ ID NO: 26372 - RNA, 4755 nt, Artificial Sequence
  derived and/or modified sequence opt1 from ADGRB1__Homo_sapiens__XP_011515501
augcgcggccaggccgccgcccccgggcccgucuggauccuggcgccccugcugcugcuccugcugcuccugggccggcgcgcccgggccgccgccggggccgacgccggccccgggcccgagccgugcgccacccugguccagggcaaguucuucggcuacuucagcgcggccgccguguuccccgccaacgccucccgcugcagcuggacccuccggaaccccgacccccgccgguacacccuguacaugaagguggccaaggcccccguccccugcuccgggcccggccgcgugcggaccuaccaguucgacagcuuccuggaguccacccgcaccuaccucgggguggagagcuucgacgagguccugcggcugugcgaccccuccgcgccccucgccuuccugcaggccagcaagcaguuccugcagaugcgccggcagcagccgccccagcacgacggccuccgcccccgggccgggccgcccggccccacggacgacuucuccguggaguaccugguggucggcaaccgcaaccccagccgggccgccugccagaugcugugccgcuggcucgacgccugccuggccgggucccggagcucccaccccugcggcaucaugcagacccccugcgccugccucgggggcgaggccggcgggcccgccgccggcccccucgcgccccgcggggacgugugccugcgggacgccguggccggcgggcccgagaacugccugaccagccucacccaggaccgcggcggccacggggccacgggcggguggaagcuguggucccuguggggcgagugcacccgcgacugcgggggcggccuccagacccggacccgcacgugccugcccgcccccggggucgagggcgggggcugcgagggggugcuggaggagggccggcagugcaaccgcgaggccugcggccccgccgggcggaccagcucccgcagccagucccuccggagcaccgacgcccgccggcgcgaggagcugggcgacgagcugcagcaguucggguuccccgcgccccagaccggcgaccccgccgcggaggaguggagccccugguccgugugcagcuccacgugcggcgagggguggcagacccggacccgcuucugcgucagcuccagcuacuccacccagugcagcggcccccuccgggagcagcgccugugcaacaacuccgccgugugccccgugcacggggccugggacgaguggagccccuggucccugugcagcuccacgugcggccggggguuccgcgaccggacccggaccugccggccgccccaguucggcggcaaccccugcgaggggcccgagaagcagaccaaguucugcaacaucgcccucugccccggccgcgccgucgacgggaacuggaacgaguggagcuccuggagcgcgugcuccgccagcugcucccagggccgccagcagcggacgcgcgagugcaacgggcccagcuacggcggcgccgagugccaggggcacuggguggagacccgggacugcuuccugcagcagugccccguggacggcaaguggcaggccugggccagcuggggguccugcagcgugaccugcggcgcggggucccagcgccgggagcgcgugugcagcggccccuucuucggcggggccgccugccagggcccccaggacgaguaccggcagugcgggacccagcgcugccccgagccccacgagaucugcgacgaggacaacuucggcgccgugaucuggaaggagacgcccgcgggggaggucgccgccgugcggugcccccgcaacgccaccggccugauccuccggcgcugcgagcuggacgaggagggcaucgccuacugggagccgcccaccuacauccggugcgucuccaucgacuaccgcaacauccagaugaugacccgggagcaccuggcgaaggcccagcgcgggcuccccggcgagggggugagcgaggugauccagacgcuggucgagaucucccaggacggcaccagcuacuccggcgaccugcucagcaccaucgacgugcugcggaacaugaccgagaucuuccgccgggccuacuacucccccacgcccggggacgugcagaacuucguccagauccugagcaaccugcucgccgaggagaaccgcgacaagugggaggaggcccagcuggcgggccccaacgccaaggagcuguuccggcucguggaggacuucguggacgucaucggguuccgcaugaaggaccugcgcgacgccuaccaggugaccgacaaccuggugcucuccauccacaagcugcccgccagcggcgccaccgacaucuccuuccccaugaagggguggcgggcgaccggcgacugggccaagguccccgaggaccgcgugaccgugagcaaguccgucuucagcacgggccugaccgaggccgacgaggccagcguguucguggucgggaccgugcucuaccggaaccugggcuccuuccuggcgcuccagcgcaacaccacggugcugaacagcaaggucaucuccgugaccgugaagccgccgccccgcagccugcgcacgccccuggagaucgaguucgcccacauguacaacgggaccacgaaccagaccugcauccugugggacgagaccgacgucccguccagcuccgcgccgccccagcugggccccuggagcuggcgggggugccgcaccgugccgcucgacgcccugcggacgcgcugccugugcgaccggcucuccaccuucgccauccuggcgcagcugagcgccgacgccaacauggagaaggccacccuccccuccgugacccugaucgucggcugcggcgugagcucccugacgcuccugaugcuggugaucaucuacgucagcguguggcgcuacauccgguccgagcgcagcgugauccucaucaacuucugccuguccaucaucagcuccaacgcccugauccucaucgggcagacccagacccggaacaaggucgugugcacccugguggcggccuuccugcacuucuucuuccucagcagcuucugcuggguccugacggaggccuggcaguccuacauggccgugaccggccaccuccgcaaccggcugauccgcaagcgguuccugugccugggguggggccuccccgcccugguggucgcgaucagcgugggguucaccaaggccaagggcuacuccaccaugaacuacugcuggcugagccucgagggcgggcugcuguacgccuucgugggccccgccgccgcggucgugcucgugaacauggucaucgggauccugguguucaacaagcugguguccaaggacggcaucacggacaagaagcucaaggagcgcgccggcgccagccugugguccagcugcgucgugcugccgcuccuggcccugaccuggauguccgcggugcucgccgucaccgaccgccggagcgcccuguuccagauccuguucgccguguucgacucccucgagggguucgucaucgugauggugcacugcauccugcgccgggagguccaggacgccgugaagugccgcguggucgaccggcaggaggagggcaacggggacagcggcggguccuuccagaacggccacgcgcagcugaugaccgacuucgagaaggacguggaccucgccugccgcagcgugcugaacaaggacaucgccgccugccggacggccaccaucaccggcacccugaagcgccccucccuccccgaggaggagaagcugaagcuggcgcacgccaaggggcccccgacgaacuucaacagccuccccgccaacgucuccaagcugcaccuccacggcagcccccgguaccccgggggcccgcuccccgacuuccccaaccacucccugacccugaagcgcgacaaggcccccaagagcagcuucgugggggacggcgacaucuucaagaagcucgacuccgagcugagccgggcccaggagaaggcgcuggacaccuccuacgugauccucccgaccgccacggccacccugcgccccaagcccaaggaggagcccaaguacagcauccacaucgaccagaugccgcagacccggcugauccaccucuccaccgcccccgaggcgagccugcccgcccgcuccccgcccagccggcagccgcccuccggcgggccgcccgaggcgccgcccgcccagccgccgccgcccccgcccccgcccccgcccccgccccagcagccgcugccgccgccgcccaaccucgagcccgcgccgcccagccugggcgaccccggggagcccgcggcccaccccggcccguccaccgggcccagcacgaagaacgagaacgucgccacccuguccgugagcucccucgagcgccggaagucccgcuacgccgagcuggacuucgagaagaucaugcacacccggaagcgccaccaggacauguuccaggaccugaaccggaagcuccagcacgccgcggagaaggacaaggaggugcugggccccgacuccaagcccgagaagcagcagaccccgaacaagcgccccugggagagccugcgcaaggcccacggcacgcccaccugggucaagaaggagcucgagccccugcagccgagcccccuggagcugcggagcguggagugggagcgcagcggggccaccaucccccucgugggccaggacaucaucgaccugcagaccgaggucuga

SEQ ID NO: 26373 - RNA, 4755 nt, Artificial Sequence
  derived and/or modified sequence opt1 from ADGRB2__Homo_sapiens__NP_001281264
auggagaacaccggcuggauggggaagggccaccgcaugacccccgccugcccgcugcuccugagcgugauccugucccuccggcuggccacggcguucgaccccgcccccagcgccugcuccgcccuggccagcgggguccucuacggcgcguucucccugcaggaccuguuccccaccaucgccagcgggugcuccuggacccucgagaacccggaccccaccaaguacagccuguaccugcgcuucaaccggcaggagcaggugugcgcccacuucgccccccgccuccugccccuggaccacuaccucgugaacuucacgugccugcggccgucccccgaggaggcggucgcccaggccgagagcgaggugggccgccccgaggaggaggaggccgaggccgcggccggccuggagcucugcuccgggagcggccccuucaccuuccugcacuucgacaagaacuucgugcagcugugccucuccgccgagccgagcgaggccccccggcugcuggcccccgcggcccucgccuuccgcuucgucgaggugcugcugaucaacaacaacaacuccagccaguucaccugcggggugcucugccggugguccgaggagugcggccgcgccgccgggcgggcgugcggcuucgcccagcccggcugcagcugcccgggggaggccggcgccggguccaccacgaccaccagccccggcccccccgccgcgcacacccugagcaacgcccuggucccgggcgggcccgccccccccgccgaggcggaccuccacuccggcagcuccaacgaccuguucacgaccgagaugcgcuacggggaggagccggaggaggagcccaaggugaagacccaguggccccggagcgccgacgagcccggccuguacauggcccagaccggggacccggccgccgaggaguggucccccuggagcgugugcucccucacgugcggccagggccugcagguccgcacccggagcugcguguccagccccuacgggacccugugcuccggcccgcuccgcgagacccggcccugcaacaacagcgcgacgugccccgugcacggggucugggaggaguggggcuccuggagccugugcucccgcagcugcgggcggggcucccgcagccggaugcgcaccugcgugcccccgcagcacggcgggaaggccugcgagggccccgagcugcagaccaagcucugcuccauggccgccugccccguggaggggcaguggcuggaguggggccccugggggccgugcagcaccagcugcgccaacggcacgcagcagcgcucccggaagugcagcgucgcgggccccgccugggccaccugcaccggggcccugaccgacacgcgcgagugcuccaaccucgagugccccgccaccgacagcaaguggggccccuggaacgcguggucccugugcagcaagaccugcgacaccggguggcagcggcgcuuccggaugugccaggccacgggcacccagggcuacccgugcgaggggaccggcgaggaggugaagcccugcuccgagaagcgcugccccgccuuccacgagaugugccgggacgaguacgugaugcugaugaccuggaagaaggccgcggccggggagaucaucuacaacaagugccccccgaacgccagcggcuccgccagccgccggugccuccuguccgcccagggggucgcguacuggggccugcccagcuucgcccgcugcaucucccacgaguaccgguaccucuaccugagccugcgcgagcaccuggccaagggccagcggaugcucgccggggagggcaugucccagguggugcgcagccugcaggagcugcucgcccggcgcacguacuacuccggggaccugcuguucagcgucgacauccuccggaacgugaccgacaccuucaagcgcgcgaccuacguccccagcgccgacgacgugcagcgguucuuccagguggucuccuucaugguggacgccgagaacaaggagaagugggacgacgcccagcaggugagccccggcuccguccaccugcugcgcgugguggaggacuucauccaccucgucggggacgcccugaaggcguuccagagcucccugaucgugaccgacaaccucgugaucagcauccagcgcgagccggucuccgccgugagcuccgacaucacguuccccaugcggggccgccggggcaugaaggacugggugcgccacagcgaggaccggcuguuccugcccaaggagguccucucccugagcucccccgggaagccggccaccagcggcgccgcggggucccccggccgcgggcggggccccggcaccgugccgcccgggcccggccacagccaccagcgccugcuccccgccgacccggacgaguccagcuacuucgugaucggggccguccuguaccggacccugggccucauccugccccccccccgcccgccccuggccgugacgucccgggugaugaccgucaccgugcgcccccccacccagccgcccgccgagccccucaucacgguggagcugagcuacaucaucaacgggaccaccgacccccacugcgcgagcugggacuacucccgggccgacgccagcuccggcgacugggacaccgagaacugccagacgcuggagacccaggccgcccacacccgcugccagugccagcaccucagcaccuucgcgguccuggcccagccgcccaaggaccugacgcucgagcuggccggcucccccagcgugccccuggugaucgggugcgccgucuccugcauggcccuccugacccugcucgcgaucuacgccgccuucuggcgguucaucaagagcgagcgcuccaucauccugcugaacuucugccucagcauccuggccuccaacauccugauccucgugggccagagccgggugcuguccaagggggucugcaccaugaccgccgcguuccugcacuucuucuuccucagcuccuucugcugggugcugacggaggccuggcagagcuaccuggccgugaucggccgcaugcggacccgccucguccggaagcgcuuccugugccugggcugggggcucccggcccuggugguggcggucuccgugggcuucacccgcaccaagggguacggcacgagcuccuacugcuggcugagccucgaggggggccugcuguacgccuucgugggccccgccgccgucaucgugcucgugaacaugcugaucgggaucaucgucuucaacaagcugauggcccgggacggcaucagcgacaaguccaagaagcagcgcgcggggagcgagcggugccccugggccucccuccugcugcccugcagcgccugcggcgccgugccguccccccuccugagcuccgccagcgcgcgcaacgccauggccucccuguggagcuccugcgugguccucccccugcuggcccucaccuggaugagcgccgugcuggcgaugaccgaccggcgcuccgugcuguuccaggcccucuucgccgucuucaacagcgcccagggguucgugaucaccgcggugcacugcuuccugcggcgcgagguccaggacguggucaagugccagaugggcgugugccgggccgacgaguccgaggacagccccgacuccugcaagaacggccagcugcagauccucagcgacuucgagaaggacguggaccuggccugccagacgguccuguucaaggaggugaacaccugcaacccguccaccaucaccgggacgcucagccgccugagccuggacgaggacgaggagcccaaguccugccucgugggccccgaggggagccuguccuucagcccgcugcccggcaacauccucguccccauggccgccucccccgggcugggcgagccgccccccccccaggaggcgaacccgguguacaugugcggcgaggggggccugcggcagcucgaccugaccuggcugcgccccaccgagcccgggagcgagggcgacuacauggugcucccccggcgcacccugucccugcagccgggcgggggcgggggcgggggcgaggacgccccccgggcccgccccgagggcacgccccggcgcgccgccaagaccgucgcgcacaccgagggguacccgagcuuccucuccguggaccacagcggccuggggcugggccccgccuacgggucccugcagaaccccuacggcaugaccuuccagcccccgccccccacccccagcgcccggcaggugccggagcccggcgagcgcucccgcacgaugccccggaccguccccgggagcaccaugaagaugggcucccucgagcgcaagaagcugcgguacagcgaccuggacuucgaggugaugcacacccgcaagcggcacuccgagcucuaccacgagcugaaccagaaguuccacacguucgaccgcuaccggagccaguccaccgccaagcgcgagaagcgguggagcgugagcuccgggggcgccgcggagcgcagcgucugcaccgacaagccgucccccggggagcggcccagccugucccagcaccgccggcaccagagcugguccaccuucaagagcaugacgcucggcucccugccgcccaagccccgcgagcggcugacccuccaccgcgccgccgccugggagcccaccgagccgcccgacggcgacuuccagaccgagguguga

SEQ ID NO: 26374 - RNA, 4569 nt, Artificial Sequence
  derived and/or modified sequence opt1 from ADGRB3__Homo_sapiens__NP_001695
augaaggccgugcgcaaccugcucaucuacaucuucagcaccuaccugcuggucauguucggcuucaacgccgcgcaggacuucuggugcuccacccucgugaagggggugaucuacggcagcuacuccgucagcgagauguuccccaagaacuucacgaacugcaccuggacccuggagaacccggaccccaccaaguacuccaucuaccugaaguucagcaagaaggaccucuccugcagcaacuucucccugcuggccuaccaguucgaccacuucagccacgagaagaucaaggaccuccugcggaagaaccacuccaucaugcagcugugcaacagcaagaacgccuucguguuccuccaguacgacaagaacuucauccagauccgccggguguuccccacgaacuuccccgggcugcagaagaagggcgaggaggaccagaaguccuucuucgaguuccugguccucaacaaggugagcccgucccaguucgggugccacgugcugugcaccuggcuggagagcugccucaaguccgagaacggccgcaccgagagcugcggcaucauguacaccaagugcacgugcccccagcaccugggggaguggggcaucgacgaccagucccugauccuccugaacaacgucgugcugccccucaacgagcagaccgaggggugccugacccaggagcugcagaccacccaggugugcaaccucacccgggaggccaagcggcccccgaaggaggaguucggcaugaugggggaccacaccaucaagagccagcgcccccgcagcguccacgagaagcgggugccccaggagcaggccgacgcggccaaguucauggcccagaccggcgaguccggcguggaggaguggagccagugguccacgugcagcgugaccugcgggcagggcucccagguccgcacccggaccugcgugagccccuacgggacgcacugcuccggcccgcugcgcgagagccgggucugcaacaacaccgcccugugccccgugcacggcgugugggaggaguggucccccuggagccucugcuccuucacgugcgggcgcggccagcggacccgcacgcggagcugcacgcccccgcaguacgggggccgccccugcgaggggcccgagacccaccacaagcccugcaacaucgcgcugugcccggucgacggccaguggcaggagugguccagcuggucccagugcagcgugaccugcuccaacggcacccagcagcggagccgccagugcaccgccgccgcccacgggggcuccgagugccgggggcccugggccgagagccgcgagugcuacaaccccgagugcaccgcgaacggccaguggaaccagugggggcacuggagcggcugcuccaagagcugcgacggcgggugggagcgccggauccggaccugccagggcgccgugaucacggggcagcagugcgagggcaccggggaggagguccgccgcugcuccgagcagcggugccccgccccguacgagaucugccccgaggacuaccugaugagcaugguguggaagcgcacccccgccggcgaccucgccuucaaccagugcccccugaacgcgaccggcacgaccucccggcgcugcagccugucccuccacggggucgccuucugggagcagccgagcuucgcccggugcaucuccaacgaguaccgccaccuccagcacagcaucaaggagcaccuggccaagggccagcggaugcuggccggggacggcaugucccaggugaccaagacccugcuggaccucacccagcgcaagaacuucuacgcgggcgaccugcugaugagcguggagauccuccggaacgucacggacaccuucaagcgcgccuccuacauccccgccagcgacggggugcagaacuucuuccagaucguguccaaccugcuggacgaggagaacaaggagaagugggaggacgcccagcagaucuaccccggcagcaucgagcucaugcaggucaucgaggacuucauccacaucguggggaugggcaugauggacuuccagaacuccuaccugaugaccgggaacguggucgccagcauccagaagcugccggcggccagcgugcugaccgacaucaacuuccccaugaagggccggaagggcaugguggacugggcccgcaacuccgaggaccgggucgugauccccaagagcaucuucacgcccguguccagcaaggagcucgacgaguccagcgucuucgugcugggggccgugcuguacaagaaccucgaccugauccugccgacccuccgcaacuacaccgucaucaacuccaagaucaucguggugaccauccggcccgagcccaagacgaccgacagcuuccuggagaucgagcuggcgcaccucgccaacggcacccugaaccccuacugcguccugugggacgacuccaagaccaacgagagccucgggacgugguccacccagggcugcaagaccgugcugaccgacgccagccacacgaagugccugugcgaccgccucuccaccuucgccauccuggcccagcagccgcgcgagaucaucauggagagcuccgggacccccagcgugacccugaucgucggcuccggccucagcugccuggcgcugaucacgcucgccgugguguacgccgcccuguggcgguacauccgcuccgagcggagcaucauccugaucaacuucugccucagcaucaucuccagcaacauccugauccuggucgggcagacccagacccacaacaaguccaucugcaccacgaccaccgccuuccuccacuucuucuuccuggcgagcuucugcugggugcugaccgaggccuggcaguccuacauggccgugacgggcaagauccgcacccggcucauccgcaagcgguuccugugccugggguggggccuccccgcccuggucguggccaccagcgugggguucacccgcacgaagggcuacggcaccgaccacuacugcuggcugucccucgagggcgggcugcuguacgcguucgucgggcccgccgccgccguggugcucgucaacauggugaucggcauccugguguucaacaagcuggucagccgggacgggauccucgacaagaagcugaagcaccgcgcgggccagauguccgagccgcacagcggccugacccucaagugcgccaagugcggggugguguccaccacggcccugagcgccaccaccgccuccaacgcgauggccagccugugguccagcugcgucgugcucccccugcuggcccucaccuggauguccgccgugcuggccaugaccgacaagcggagcauccuguuccagauccucuucgcggucuucgacucccugcagggcuucgugaucgugaugguccacugcauccugcgccgggaggugcaggacgccuuccgcugccggcuccgcaacugccaggaccccaucaacgccgacagcagcuccagcuuccccaacgggcacgcccagaucaugacggacuucgagaaggacguggacaucgccugccgguccguccugcacaaggacaucggcccgugccgcgcggccaccaucaccggcacccugagccggaucucccucaacgacgacgaggaggagaaggggacgaaccccgagggccugagcuacuccacccugcccgggaacgugaucagcaaggucaucauccagcagcccaccggccuccacaugccgauguccaugaacgagcugagcaaccccugccugaagaaggagaacuccgagcuccgccggaccguguaccugugcacggacgacaaccugcgcggggccgacauggacaucgugcacccccaggagcgcaugauggagagcgacuacaucgucaugccccgguccagcgugaacaaccagccguccaugaaggaggagagcaagaugaacaucggcauggagacccucccccacgagcgccugcugcacuacaaggugaaccccgaguucaacaugaacccgcccgucauggaccaguucaacaugaaccucgagcagcaccuggcgccccaggagcacaugcagaaccugcccuucgagccgcggaccgccgugaagaacuucauggccuccgagcucgacgacaacgccggccugagccgcuccgagaccgggagcacgaucagcauguccagccuggagcggcgcaagucccgguacagcgaccucgacuucgagaaggugaugcacacccgcaagcggcacauggagcuguuccaggagcugaaccagaaguuccagacccucgaccgcuuccgggacauccccaacaccuccagcauggagaaccccgcccccaacaagaacccgugggacacguucaagaaccccuccgaguacccccacuacaccaccaucaacguccuggacaccgaggccaaggacgcgcuggagcuccgccccgccgagugggagaagugccugaaccugccgcucgacgugcaggagggcgacuuccagacggagguguga

SEQ ID NO: 26375 - RNA, 2625 nt, Artificial Sequence
  derived and/or modified sequence opt1 from ADGRD1__Homo_sapiens__NP_942122
auggagaagcugcuccgccugugcugcugguacagcuggcugcuccuguucuacuacaacuuccaggugcggggcgucuacucccgcagccaggaccaccccggguuccaggugcuggccuccgccagccacuacuggccgcucgagaacguggacggcauccacgagcugcaggacaccaccggggacaucgucgagggcaaggugaacaaggggaucuaccugaaggaggagaagggcgugacgcuccuguacuacggccgguacaacuccagcugcaucuccaagcccgagcagugcgggcccgagggcgucaccuucagcuucuucuggaagacccagggggagcagucccgccccaucccgagcgcguacggcggccaggugaucuccaacggguucaaggugugcagcuccggcgggcggggcagcgucgagcuguacacccgcgacaacuccaugacgugggaggccagcuucuccccgcccgggcccuacuggacccacgugcuguucaccuggaaguccaaggagggccugaagguguacgucaacggcacccugagcacgagcgaccccagcgggaaggugucccgggacuacggcgagagcaacgugaaccucgucaucggguccgagcaggaccaggccaagugcuacgagaacggcgccuucgacgaguucaucaucugggagcgcgcccugacccccgacgagaucgcgauguacuucaccgccgccaucgggaagcacgcccugcucagcuccacccugcccagccuguucaugacguccaccgcgagccccgugaugccgaccgacgccuaccaccccaucaucaccaaccucacggaggagcggaagaccuuccagucccccggcgugauccugagcuaccugcagaacgucucccucagccugcccuccaagagccuguccgagcagaccgcccucaaccugaccaagacguuccugaaggccgugggcgagauccuccugcugccgggguggaucgcccucagcgaggacuccgcggugguccugagccugaucgacaccaucgacaccgugaugggccacguguccagcaaccuccacgggagcacgccccaggucaccguggagggcuccagcgccauggccgaguucuccgucgccaagauccugcccaagaccgugaacagcucccacuaccgcuuccccgcccacgggcagagcuucauccagaucccgcacgaggcguuccaccggcacgccugguccaccguggucggccugcucuaccacagcaugcacuacuaccugaacaacaucuggcccgcccacaccaagaucgccgaggccaugcaccaccaggacugccuccucuucgcgacgucccaccugaucagccuggagguguccccgccgcccacccucagccagaaccuguccggcagcccccugaucaccgugcaccucaagcaccgccugacccggaagcagcacuccgaggccacgaacagcuccaaccgcgucuucguguacugcgccuuccuggacuucagcagcggggagggcgugugguccaaccacgggugcgcccugacccggggcaaccucaccuacagcgucugccgcugcacccaccugacgaacuucgccauccugaugcaggucgugccccucgagcuggcgcgggggcaccagguggcccuguccagcaucuccuacgugggcugcagccucuccgugcugugccuggucgccacccucgugaccuucgccgugcugagcuccgucagcaccauccgcaaccagcgguaccacauccacgcgaaccuguccuucgccgugcucguggcccagguccugcugcucaucagcuuccgccuggagcccggcaccacgcccugccaggugauggccgugcugcuccacuacuucuuccuguccgccuucgcguggaugcuggucgaggggcuccaccuguacagcauggugaucaagguguucggcuccgaggacagcaagcaccgguacuacuacgggaugggcuggggcuucccccugcucaucugcaucaucucccugagcuucgccauggacuccuacgggaccagcaacaacugcuggcugagccucgccuccggcgccaucugggccuucgucgcgcccgcccuguucgugaucguggucaacaucgggauccugaucgccgugacccgcgugaucagccagaucuccgccgacaacuacaagauccacggcgacccgagcgccuucaagcucaccgcgaaggccgucgccgugcugcugcccauccucgggacguccuggguguucggcguccuggccgugaacggcugcgcgguggucuuccaguacauguucgccacccugaacagccuccaggggcuguucaucuuccuguuccacugccuccugaacuccgaggugcgcgccgccuucaagcacaagaccaagguguggagccugaccuccagcuccgcccggacgagcaacgcgaagcccuuccacuccgaccucaugaacggcacccgccccgggauggccagcaccaagcuguccccgugggacaagagcucccacagcgcccaccgggucgaccuguccgccguguga

SEQ ID NO: 26376 - RNA, 2925 nt, Artificial Sequence
  derived and/or modified sequence opt1 from ADGRD2__Homo_sapiens__XP_006717411
auggugaccggccccgaggaggggaacagcgagauggacgccccguggggcgccggggagcgcuggcugcacggcgcggccgucgaccgguccggggugagccucggccccccccccaccccgcaggugaaccagggcacgcuggggccccaggucgcccccguggccgccggcgagguggucaagaccgcggggggcgugugcaaguucuccgggcagcgccugagcugguggcaggcccaggaguccugcgagcagcaguucggccaccucgcccugcagcccccggacggcgugcuggccagccggcuccgcgaccccgucuggguggggcagcgggaggcgccccugcgccggcccccgcagcgccgggcccgcaccaccgccgugcuggucuucgacgagcggacggccgaccgcgccgcgcggcuccgcuccccccugcccgagcuggccgcccucaccgccugcacccacgugcagugggacugcgccagccccgacccggcggcccuguucuccguggccgcccccgcccugcccaacgcgcuccagcugcgggccuucgccgagcccggcggggucgugcgcgccgcccuggugguccggggccagcacgcgccguuccucgccgccuuccgcgccgacggccgguggcaccacgugugcgcgaccugggagcagcgcgggggccggugggcccuguucagcgacgggcgccgccgggccggcgcccgcgggcugggcgccggccaccccgugcccuccgggggcauccucguccuggggcaggaccaggacagccugggcgggggcuucuccgugcggcacgcgcucagcggcaaccugacggacuuccaccugugggcccgcgcccucucccccgcccagcugcaccgggcccgcgcgugcgccccgcccagcgaggggcugcucuuccggugggaccccggcgcccuggacgugacccccucccugcucccgaccgucugggugcgccugcugugccccguccccagcgaggagugcccgaccuggaaccccgggccccgguccgagggcagcgagcucugccuggagccccagccguuccugugcugcuaccgcacggagcccuaccggcgccuccaggacgcccagagcuggcccgggcaggacgugaucucccgggugaacgcccuggcgaacgacaucguccugcuccccgacccgcugagcgaggugcacggcgcccugucccccgccgaggccagcuccuuccucggccugcuggagcacgugcucgcgauggagauggccccccuggggcccgccgcccugcuggccgucgugcgcuuccucaagcggguggucgcgcugggcgccggggacccggagcugcuccugaccggccccugggagcagcugagccagggcgugguguccgucgccagccucgugcuggaggagcagguggccgacaccuggcugucccuccgcgaggucaucgggggccccauggcccugguggcgagcgugcagcggcuggccccccuccuguccaccagcaugacguccgagcgcccgcggaugcgcauccagcaccgccacgccgggcugagcggcgucaccgugauccacuccugguucaccagccggguguuccagcacacccucgaggggcccgaccuggagccccaggcccccgccuccagcgaggaggcgaaccgcguccagcgguuccuguccacgcaggugggcagcgccaucaucagcuccgaggugugggacgucaccggcgaggugaacguggccaugaccuuccaccuccagcaccgcgcccagagcccgcuguuccccccccaccccccgucccccuacaccgggggcgcgugggccacgaccgggugcagcgucgccgcccuguaccucgacuccaccgccugcuucugcaaccacagcaccuccuucgcgauccugcugcagaucuacgaggugcagcggggccccgaggaggagagccuccugcgcacgcuguccuucguggggugcggcgucagcuucugcgcccucaccaccaccuuccugcuguuccucguggccggcgugccgaaguccgagcggacgaccguccacaagaaccugaccuucagccuggccuccgccgagggguuccucaugaccagcgagugggcgaaggccaacgagguggccugcguggccgucacgguggccaugcacuuccuguuccugguggcguucuccuggaugcucgucgagggccugcugcucuggcgcaaggugguggccgucagcaugcaccccgggcccggcaugcggcuguaccacgccaccggguggggcgugcccgugggcaucgucgccgugacccuggccaugcucccgcacgacuacguggcgcccgggcacugcuggcugaacguccacaccaacgccaucugggccuucgugggccccgugcuguucguccucaccgccaacacgugcauccuggcgcgcguggucaugaucaccguguccagcgcccggcgccgggcccgcaugcugagcccccagccgugccuccagcagcagaucuggacccagaucugggccaccgugaagcccguccuggugcugcuccccgugcuggggcugacguggcucgccggcauccugguccaccugucccccgcgugggccuacgccgccguggggcucaacagcauccagggccuguacaucuuccugguguacgccgcgugcaacgaggagguccgguccgcccuccagcgcauggccgagaagaagguggccgaggugcugcgggcccugggcgucugggggggcgcggccaaggagcacagccucccguucuccgugcugccccuguuccucccccccaagccgagcaccccccgccacccccugaaggcccccgccuga

SEQ ID NO: 26377 - RNA, 2604 nt, Artificial Sequence
  derived and/or modified sequence opt1 from ADGRE1__Homo_sapiens__NP_001243181
augcgcggcuucaaccugcuccuguucugggggugcugcgugaugcacagcugggagggccacauccggcccacccgcaagccgaacaccaaggggaacaacugccgggacuccacgcugugccccgccuacgccaccugcaccaacaccgucgacagcuacuacugcgcgugcaagcagggcuuccucuccagcaacgggcagaaccacuucaaggaccccggcgugcgcugcaaggacaucaacgagugccugacguccagcgugugccccgagcacuccgacugcgucaacagcaugggcuccuacagcugcuccugccaggugggguucaucagccggaacuccaccugcgaggacguggacgagugcgccgacccgcgcgccugccccgagcacgccaccugcaacaacaccgucggcaacuacagcugcuucugcaaccccggguucgaguccagcuccggccaccugagcuuccaggggcucaaggccuccugcgaggacaucgacgagugcacggagaugugccccaucaacagcaccugcaccaacaccccgggcagcuacuucugcacgugccaccccggcuucgcgcccuccaacgggcagcugaacuucaccgaccagggcguggagugccgggacaucgacgagugccgccaggaccccagcaccugcgggccgaacuccaucugcaccaacgcccugggcagcuacuccugcggcugcaucgccggguuccaccccaaccccgagggcagccagaaggacgggaacuucuccugccagcgggugcucuucaagugcaaggaggacgucauccccgacaacaagcagauccagcagugccaggagggcacggccgugaagccggcguacgugagcuucugcgcccagaucaacaacaucuucuccguccuggacaaggugugcgagaacaagaccaccguggucagccugaagaacaccacggaguccuucgugcccgugcucaagcagaucagcaccuggaccaaguucaccaaggaggagacguccagccuggccaccgucuuccuggaguccguggagagcaugacccucgccuccuucuggaagcccagcgccaacaucacccccgcggugcgcacggaguaccuggacaucgaguccaaggucaucaacaaggagugcagcgaggagaacgugacccuggaccucguggccaagggggacaagaugaagaucggcugcagcaccaucgaggaguccgagagcaccgagacgaccggcgucgccuucguguccuucgucgggauggagagcgugcugaacgagcgguucuucaaggaccaccaggccccgcugaccaccuccgagaucaagcucaagaugaacagccgcguggucggcgggaucaugacgggcgagaagaaggacggguucuccgaccccaucaucuacacccuggagaacauccagcccaagcagaaguucgagcggcccaucugcgugagcugguccaccgacgugaagggcggccgcuggaccagcuucgggugcgucauccuggaggccuccgagaccuacacgaucugcagcugcaaccagauggcgaaccucgccgugaucauggccuccggcgagcugaccauggacuucagccuguacaucaucucccacguggggaucaucaucagccucgucugccuggugcuggccaucgccaccuuccuccugugccgguccauccgcaaccacaacaccuaccugcaccuccaccugugcgugugccugcuccuggcgaagacgcuguuccucgccggcauccacaagaccgacaacaagauggggugcgccaucaucgccggcuuccugcacuaccuguuccucgccugcuucuucuggaugcuggucgaggcggugauccuguuccucauggugcggaaccugaaggucgugaacuacuucagcagccgcaacaucaagaugcugcacaucugcgccuucggcuacgggcucccgaugcugguggucgugaucuccgccagcgugcagccccagggcuacgggaugcacaaccggugcuggcugaacaccgagaccggcuucaucugguccuuccugggccccgucugcacggugaucguggucagcaaguacuacaacucccucgccaagugcgugcugaaggaggagcagggggaccugcgcgaccucgaguuccccggcaccugcgcggccgagcggaucaacagccugcugcucaccuggacccuguggauccugcgccagcgccucuccagcgugaacgccgaggucuccacgcugaaggacacccggcugcucaccuucaaggccuucgcccagcuguucauccuggggugcagcugggugcucggcaucuuccagaucgggccgguggcgggcgucauggccuaccuguucaccaucaucaacucccugcagggcgccuucaucuuccucauccacugccugcugaacgggcaggugcgcgaggaguacaagcgguggaucacgggcaagaccaagcccagcucccagagccagaccucccgcauccuccugagcuccaugcccagcgccuccaagaccggguga

SEQ ID NO: 26378 - RNA, 2298 nt, Artificial Sequence
  derived and/or modified sequence opt1 from ADGRE2__Homo_sapiens__NP_001257981
augggcgggcgcguguuccuggucuuccucgccuucugcguguggcugacccugcccggcgccgagacccaggacagccgggggugcgcgcgcuggugcccgcaggacuccagcugcgugaacgccacggccugccggugcaaccccggcuucuccagcuucuccgagaucaucaccacccccauggagaccugcgacgacaucaacgagugcgccacgcucagcaaggucuccugcgggaaguucagcgacugcuggaacaccgagggcuccuacgacugcgugugcagccccggcuacgagccgguguccggggccaagaccuucaagaacgagagcgagaacacgugccaggacgucgacgagugccagcagaacccccgccugugcaaguccuacgggaccugcgugaacacccugggcagcuacacgugccagugccuccccggcuucaagcugaagcccgaggacccgaagcugugcaccgacgugaacgagugcaccuccgggcagaaccccugccacagcuccacccacugccucaacaacgucggcagcuaccagugccggugccgccccggcuggcagcccaucccggggucccccaacggccccaacaacaccgugugcgaggacguggacgagugcagcagcgggcagcaccagugcgacuccagcaccgucugcuucaacacggugggcuccuacagcugccggugccgccccggcuggaagccgcggcacgggauccccaacaaccagaaggacaccgugugcgaggacaugaccuucuccaccuggacgccgccgcccggcguccacagccagacccugucccgcuucuucgacaaggugcaggaccuggggcgggacuacaagcccggccucgcgaacaacaccauccagagcauccugcaggcccuggacgagcuccuggaggcccccggggaccuggagacccucccccgccugcagcagcacugcguggccucccaccuccucgacggccuggaggacguccugcggggccucagcaagaaccuguccaacgggcugcucaacuucagcuaccccgcgggcacggagcugucccuggaggugcagaagcaggucgaccgcagcgugacccuccggcagaaccaggccgugaugcagcuggacuggaaccaggcccagaaguccggggaccccggccccagcguggucgggcugguguccauccccggcaugggcaagcuccuggccgaggccccgcugguccucgagcccgagaagcagaugcugcugcacgagacccaccaggggcuccugcaggacggcagccccauccugcucuccgacgugaucagcgcguuccugagcaacaacgacacccagaaccuguccagcccggugacguucaccuucucccaccgcgaggaggaccccguccucaccgugaucaccuacauggggcugagcgugucccugcucugccugcugcuggccgcccucacguuccugcugugcaaggccauccagaacaccagcaccucccuccaccuccagcugagccugugccuguuccuggcccaccuccuguuccuggucgcgaucgaccagaccggccacaaggugcucugcuccaucaucgccgggacgcugcacuaccuguaccucgccacccugaccuggaugcugcucgaggcccuguaccuguuccucaccgcccggaaccugaccguggucaacuacagcuccaucaaccgcuucaugaagaagcugauguuccccgugggcuacggcgugcccgcggucacgguggccaucagcgccgccucccggccgcaccucuacgggacccccagccgcugcuggcugcagcccgagaagggcuucaucuggggguuccugggccccgugugcgccaucuucuccgucaaccucgugcuguuccuggugacccucuggauccugaagaaccggcugagcucccucaacagcgaggucagcacccugcgcaacacgcgcaugcuggcguucaaggccaccgcccagcuguucauccugggcugcaccuggugccuggggauccuccaggugggcccggccgcgcgggugauggccuaccuguucaccaucaucaacucccugcagggggucuucaucuuccucguguacugccugcugagccagcagguccgcgagcaguacggcaagugguccaaggggauccggaagcucaagacggagagcgagaugcacacccuguccagcuccgccaaggccgacaccagcaagcccuccaccgugaacuga

SEQ ID NO: 26379 - RNA, 2361 nt, Artificial Sequence
  derived and/or modified sequence opt1 from ADGRE5__Homo_sapiens__NP_001020331
augggcgggcgcguguuccuggccuucugcgucuggcucacccugcccggcgccgagacccaggacagccgggggugcgcgcgcuggugcccgcagaacuccagcugcgugaacgccacggccugccggugcaaccccggcuucuccagcuucuccgagaucaucaccacccccaccgagacgugcgacgacaucaacgagugcgccacccccagcaagguguccugcgggaaguucagcgacugcuggaacaccgagggcuccuacgacugcgucugcagcccgggcuacgagcccguguccggggccaagaccuucaagaacgagagcgagaacacgugccaggacguggacgagugccagcagaacccccgccugugcaaguccuacgggaccugcgucaacacccucgggagcuacacgugccagugccugcccggcuucaaguucaucccggaggaccccaaggugugcacggacguggacgagugcuccagcgggcagcaccagugcgacuccagcaccgucugcuucaacaccgugggcuccuacagcugccggugccgccccggcuggaagccccggcacgggaucccgaacaaccagaaggacaccgugugcgaggacaugacguucagcaccuggaccccgccgcccggcguccacucccagacccugagccgcuucuucgacaaggugcaggaccucgggcgggacuccaagacgagcuccgcggaggugaccauccagaacgucaucaagcugguggacgagcugauggaggcccccggcgacguggaggcccucgccccgcccguccgccaccugaucgcgacccagcugcucagcaaccuggaggacaucaugcggauccuggccaagucccuccccaagggccccuucaccuacaucagccccuccaacaccgagcugacccugaugauccaggagcgcggcgacaagaacgugaccaugggccagagcuccgcccggaugaagcucaacugggccguggccgcgggggccgaggaccccggccccgccgucgccgggauccugagcauccagaacaugaccacgcugcucgccaacgcgucccugaaccugcacagcaagaagcaggccgagcucgaggagaucuacgaguccagcauccgcggcgugcagcugcggcgccuguccgccgugaacagcaucuuccucucccacaacaacaccaaggagcugaacagccccauccuguucgccuucagccaccucgaguccagcgacggcgaggccgggcgggacccgcccgcgaaggacgucaugcccggcccccgccaggagcugcugugcgccuucuggaaguccgacagcgaccgcgggggccacugggccaccgaggggugccaggugcucggcuccaagaacggcagcaccacgugccagugcucccaccugagcuccuucgccauccugauggcccacuacgacgucgaggacuggaagcucacccugaucacccggguggggcuggcgcucagccuguucugccugcuccugugcauccugaccuuccuccuggugcggcccauccagggcucccgcacgaccauccaccuccaccugugcaucugccuguucgucgggagcaccaucuuccuggccggcaucgagaacgagggcggccagguggggcugcgcugccggcucguggccgggcugcugcacuacugcuuccucgccgcguucugcuggaugucccuggagggccuggagcucuacuuccuggucgugcgcguguuccaggggcagggccugagcacccgguggcucugccugaucggcuacggggucccccugcucaucgugggcguguccgccgccaucuacagcaagggguacggccgcccgcgguacugcuggcuggacuucgagcagggguuccugugguccuuccucggccccgucaccuucaucauccugugcaacgccgugaucuucgugacgaccgucuggaagcugacccagaaguucagcgagaucaaccccgacaugaagaagcucaagaaggcccgcgcgcugaccaucacggccaucgcccagcuguuccuccugggcugcaccuggguguucgggcuguucaucuucgacgaccggagccucgugcugaccuacgucuucaccauccugaacugccuccagggcgccuuccuguaccugcuccacugccugcugaacaagaaggugcgcgaggaguaccggaagugggccugccucguggccgggggcuccaaguacagcgaguucacguccaccaccagcgggaccggccacaaccagacgcgcgcgcugcgggccuccgagagcggcaucuga

SEQ ID NO: 26380 - RNA, 4041 nt, Artificial Sequence
  derived and/or modified sequence opt1 from ADGRF5__Homo_sapiens__NP_056049
augaaguccccgcgccggaccacccugugccucauguucaucgugaucuacagcagcaaggccgcccugaacuggaacuacgaguccacgauccacccccugagccuccacgagcacgagcccgcgggcgaggaggcccugcgccagaagcgggccgucgccaccaagucccccaccgccgaggaguacaccgugaacaucgagaucagcuucgagaacgcguccuuccuggaccccaucaaggccuaccucaacagccuguccuucccgauccacgggaacaacacggaccagaucaccgacauccugagcaucaacgugaccaccgucugccgccccgccggcaacgagaucuggugcuccugcgagacgggguacggcuggccccgggagcgcugccuccacaaccugaucugccaggagcgggacguguuccugcccgggcaccacugcagcugccucaaggagcugccgcccaacggccccuucugccugcuccaggaggacgugacccugaacaugcgcguccggcugaacgugggcuuccaggaggaccucaugaacaccuccagcgcccuguaccgcuccuacaagaccgaccuggagacggcguuccggaagggguacggcauccuccccggguucaagggcgugaccgucaccggguucaagagcggcuccgugguggucaccuacgaggugaagacgaccccgcccagccuggagcugauccacaaggccaacgagcaggucgugcagucccucaaccagaccuacaagauggacuacaacagcuuccaggccgugaccaucaacgagagcaacuucuucgugacgcccgagaucaucuucgagggcgacaccgucucccuggugugcgagaaggaggugcugagcuccaacgucagcuggcgcuacgaggagcagcagcucgagauccagaacuccagccgguucuccaucuacaccgcccuguucaacaacaugaccagcguguccaagcugacgauccacaacaucacccccggggacgccggcgaguacgugugcaagcucauccuggacaucuucgaguacgagugcaagaagaagaucgacgucaugccgauccagauccuggcgaacgaggagaugaaggugaugugcgacaacaaccccgucagccucaacugcugcucccaggggaacgugaacuggagcaagguggaguggaagcaggagggcaagaucaacauccccggcacccccgagaccgacaucgacuccagcugcucccgcuacacgcugaaggccgacgggacccagugcccgagcggcuccagcgggaccaccgucaucuacacgugcgaguucaucuccgccuacggcgcccgggggagcgccaacaucaaggugaccuucaucagcguggcgaaccugaccaucacccccgaccccaucuccgucagcgagggccagaacuucuccaucaagugcaucagcgacguguccaacuacgacgagguguacuggaacacgagcgccggcaucaagaucuaccagcgcuucuacaccacccggcgcuaccucgacggggccgaguccguccugaccgugaagaccagcacgcgggaguggaacggcaccuaccacugcaucuuccgcuacaagaacuccuacagcaucgccaccaaggacgugaucguccacccccugccgcucaagcugaacaucaugguggacccccuggaggccaccguguccugcagcgggucccaccacaucaagugcugcaucgaggaggacggcgacuacaaggucacguuccacaccgggagcuccagccuccccgcggccaaggaggugaacaagaagcaggucugcuacaagcacaacuucaacgccuccagcgugagcuggugcuccaagaccguggacgugugcugccacuucaccaacgccgccaacaacagcgucuggucccccagcaugaagcugaaccuggugccgggcgagaacaucacgugccaggaccccgugaucggcgucggggagcccggcaaggugauccagaagcucugccgguucuccaacgugccgagcucccccgagagccccaucgggggcaccaucaccuacaagugcgucgggucccagugggaggagaagcgcaacgacugcaucagcgcgcccaucaacucccugcugcagauggccaaggcccucaucaagagcccgucccaggacgagaugcugcccaccuaccugaaggaccugagcaucuccaucgacaaggccgagcacgagaucagcuccagccccggcucccucggcgcgaucaucaacauccuggaccugcucagcacggugcccacccaggugaacagcgagaugaugacccacguccuguccaccgugaacgugauccuggggaagccgguccucaacacguggaaggugcugcagcagcaguggaccaaccagagcucccagcugcuccacagcguggagcgcuucucccaggcccugcagagcggcgacuccccgccccugagcuucucccagaccaacguccagaugagcuccauggugaucaagagcucccaccccgagaccuaccagcagcgguucguguuccccuacuucgaccucugggggaacgucgugaucgacaagagcuaccuggagaaccugcaguccgacagcuccaucgugacgauggccuuccccacccuccaggccauccuggcccaggacauccaggagaacaacuucgcggagagccuggucaugaccaccacggugucccacaacaccaccaugcccuuccgcaucagcaugaccuucaagaacaacagccccuccggcggcgagacgaagugcguguucuggaacuuccggcucgccaacaacaccgggggcugggacagcuccgggugcuacgucgaggagggcgacggggacaacgugaccugcaucugcgaccaccugaccagcuucuccauccugaugagcccggacucccccgaccccagcucccuccugggcauccugcucgacaucaucagcuacgugggcgucggguucuccauccugagccuggccgccugccucgugguggaggccgucguguggaaguccgucacgaagaaccgcaccagcuacaugcggcacacgugcaucgugaacaucgcggccucccugcugguggccaacaccugguucaucgucguggccgccauccaggacaaccgcuacauccucugcaagaccgcgugcguggccgccaccuucuucauccacuucuucuaccugagcgucuucuucuggaugcugacccucggccugaugcuguucuaccggcucguguucauccugcacgagaccucccgcagcacccagaaggccaucgcguucugccugggguacggcugcccccucgccaucuccgugaucacgcugggggccacccagccgcgggaggucuacacccgcaagaacgugugcuggcugaacugggaggacaccaaggcccuccuggccuucgcgauccccgcccugaucaucguggucgugaacaucacgaucaccaucguggucaucaccaagauccuccggcccagcaucggcgacaagcccugcaagcaggagaaguccagccuguuccagaucagcaaguccaucggcgugcugaccccgcuccuggggcugacguggggcuucgggcucaccaccguguuccccggcaccaaccuggucuuccacaucaucuucgccauccugaacguguuccagggccucuucauccugcuguucgggugccucugggaccugaaggugcaggaggcccugcucaacaaguucagccugucccgcuggagcucccagcacagcaaguccacgagccugggcuccagcacccccgucuucuccaugagcuccccgaucagccggcgcuucaacaaccucuucgggaagaccggcaccuacaacguguccacgcccgaggccaccagcuccagccuggagaacagcuccagcgcguccagccugcucaacuga

SEQ ID NO: 26381 - RNA, 1572 nt, Artificial Sequence
  derived and/or modified sequence opt1 from ADGRG1__Homo_sapiens__NP_001277071
augacgccccagagccugcuccagaccacgcuguuccugcucucccugcuguuccucgugcagggcgcccacgggcgcggccaccgggaggacuuccgcuucugcagccagcagcugcagucccuggagagcaagcucaccuccguccgguucaugggggacauggugagcuucgaggaggaccgcaucaacgccaccguguggaagcugcagccgaccgcgggccugcaggaccuccacauccacucccggcaggaggaggagcagagcgagaucauggaguacuccguccugcugccccgcacccucuuccagcggaccaaggggcgcagcggcgaggccgagaagcggcugcugcucguggacuucuccagccaggcccuguuccaggacaagaacuccagccaggugcugggcgagaagguccucgggaucguggugcagaacaccaaggucgccaaccugaccgagcccguggugcugacguuccagcaccagcuccagcccaagaacgucacccugcagugcguguucuggguggaggacccgacccuguccagccccggccacugguccagcgccgggugcgagaccguccgccgggagacgcagaccuccugcuucugcaaccaccucaccuacuucgcggugcugauggugagcagcgucgagguggacgccgugcacaagcacuaccugucccuccugagcuacgucggcugcgugguguccgcccuggccugccucgucaccaucgcggccuaccugugcagccgcgugccccugcccugccggcgcaagccgcgggacuacacgaucaagguccacaugaaccuccugcuggccguguuccuccuggacaccuccuuccugcucagcgagcccguggcccugaccggguccgaggccggcugccgcgcgagcgccaucuuccugcacuucucccuccugaccugccugagcuggaugggccucgagggguacaaccuguaccggcuggucguggagguguucggcacguacguccccggguaccugcucaagcuguccgccaugggcuggggcuuccccaucuuccuggugacccucguggcccuggucgacguggacaacuacgggccgaucauccuggccgugcaccgcacccccgagggcgucaucuaccccagcaugugcuggauccgggacucccucgugagcuacaucaccaaccuggggcuguucucccucguguuccuguucaacauggcgaugcuggccacgauggucgugcagauccuccgccugcggccccacacccagaaguggagccacgugcugacccuccugggccugucccucguccuggggcugccgugggcccucaucuucuucagcuucgccuccggcaccuuccagcugguggugcuguaccucuucagcaucaucacgagcuuccagggcuuccugaucuucaucugguacugguccaugcgccugcaggcccgcgggggccccagcccccucaaguccaacagcgacuccgcgcggcugcccaucagcuccgggagcaccuccagcucccgcaucuga

SEQ ID NO: 26382 - RNA, 3054 nt, Artificial Sequence
  derived and/or modified sequence opt1 from ADGRG2__Homo_sapiens__NP_001073327
augguguucagcguccgccagugcggccacguggggcggaccgaggaggugcugcucaccuucaagaucuuccuggucaucaucugccugcacguggugcucgucacgucccuggaggaggacaccgacaacagcucccugagcccgccgcccgccaagcucuccguggugagcuucgcccccuccagcaacggcacccccgaggucgagaccacgucccugaacgacgugacccugagccuccugcccuccaacgagaccgagaagaccaagaucacgaucgugaagaccuucaacgcgagcggggucaagccccagcgcaacaucugcaaccuguccagcaucugcaacgacuccgccuucuuccggggcgagaucauguuccaguacgacaaggagagcaccgugccccagaaccagcacaucaccaacgggacgcucaccggcgugcugucccugagcgagcucaagcgcuccgagcugaacaagacccugcagacccucagcgagacguacuucaucaugugcgccaccgccgaggcccagagcacccugaacugcaccuucacgaucaagcugaacaacaccaugaacgcgugcgccgucaucgccgcccucgagcgggugaagauccgccccauggagcacugcugcugcuccgugcggaucccgugccccagcucccccgaggagcuggagaagcugcagugcgaccuccaggaccccaucgucugccuggcggaccacccgcgcggcccgcccuucagcuccagccaguccauccccguggugccccgggccaccguccugagccaggugcccaaggccaccuccuucgccgagccgcccgacuacagccccgugacgcacaacguccccucccccaucggggagauccagccccucagcccgcagcccuccgcccccaucgcgagcucccccgccaucgacaugccgccccagagcgagaccaucuccagccccaugccgcagacccacguguccggcaccccgccgcccgucaaggccagcuucagcucccccacggugagcgcccccgccaacgugaacaccaccuccgcgccgcccguccagaccgacaucgugaacacgagcuccaucagcgaccuggagaaccaggugcugcagauggagaaggcccucucccuggggagccuggagcccaaccucgccggcgagaugaucaaccaggucucccgccugcugcacagcccgcccgacaugcucgcgccccuggcccagcggcugcucaaggugguggacgacaucgggcugcagcugaacuucuccaacaccaccaucagccucaccucccccagccuggcccuggccgucauccgcgugaacgccuccagcuucaacacgaccaccuucguggcccaggaccccgccaaccuccaggucucccuggagacccaggcgcccgagaacagcaucggcaccaucacgcugcccagcucccucaugaacaaccugcccgcccacgacauggagcuggccagccgggugcaguucaacuucuucgagacccccgcccuguuccaggaccccucccucgagaaccugagccugaucuccuacgugaucagcuccagcgucgcgaaccucaccgugcgcaaccugacccggaacgugacggucacccugaagcacaucaaccccucccaggacgagcucaccgugcgcugcguguucugggaccugggccggaacgggggccgcgggggcuggagcgacaacggcugcuccgucaaggaccggcgccugaacgagaccaucugcacgugcagccaccucaccuccuucggggugcugcuggaccucagccggaccuccgugcugccggcccagaugauggcccugaccuucaucacguacaucggcugcgggcucagcuccaucuuccugagcgucacccuggugaccuacaucgccuucgagaagauccgccgcgacuaccccuccaagauccucauccagcugugcgccgcgcugcuccugcugaaccucguguuccugcuggacagcuggaucgcccucuacaagaugcagggccugugcaucagcgucgccguguuccugcacuacuuccuccugguguccuucaccuggauggggcuggaggccuuccacauguaccucgcccuggucaagguguucaacacguacauccggaaguacauccugaaguucugcaucgugggcuggggcguccccgcggugguggucaccaucauccucaccaucagccccgacaacuacgggcugggcuccuacgggaaguucccgaacggcagccccgacgacuucugcuggaucaacaacaacgccguguucuacaucaccguggucggguacuucugcgugaucuuccugcucaacguguccauguucaucgucgugcuggugcagcugugccgcaucaagaagaagaagcagcucggcgcccagcggaagacgagcauccaggaccugcgcuccaucgccggccugaccuuccuccuggggaucaccuggggcuucgccuucuucgcgugggggcccgucaacgugaccuucauguaccuguucgccaucuucaacacgcuccagggcuucuucaucuucaucuucuacugcguggccaaggagaacguccggaagcaguggcgccgguaccugugcugcgggaagcugcgccucgccgagaacagcgacugguccaagaccgcgaccaacggccugaagaagcagaccgugaaccagggcgugagcuccagcuccaacagccugcaguccagcuccaacagcacgaacuccaccacccuccuggucaacaacgacugcagcgugcacgccagcgggaacggcaacgccuccaccgagcggaacggggucagcuucuccgugcagaacggcgacgugugccugcacgacuucacgggcaagcagcacauguucaacgagaaggaggacagcugcaacgggaagggccgcauggcccuccggcgcaccuccaagcgggggagccugcacuucaucgagcagauguga

SEQ ID NO: 26383 - RNA, 1650 nt, Artificial Sequence
  derived and/or modified sequence opt1 from ADGRG3__Homo_sapiens__NP_740746
auggccacgccccgcggccugggggcccuccugcugcuccugcugcucccgaccagcggccaggagaagcccaccgaggggccccggaacacgugccugggcuccaacaacauguacgacaucuucaaccugaacgacaaggcgcucugcuucaccaagugccgccagagcggguccgacagcugcaacguggagaaccugcagcgguacuggcugaacuacgaggcccaccucaugaaggagggccugacccagaaggucaacacccccuuccugaaggcccucgugcagaaccuguccaccaacaccgccgaggacuucuacuucagccuggagccgucccaggugccccgccaggucaugaaggacgaggacaagccgcccgaccgggugcgccuccccaagagccuguuccggucccugcccggcaaccgcagcgugguccggcucgccgugaccauccuggacaucgggcccggcacgcuguucaaggggccccgccucggccugggggacggcuccggcgugcugaacaaccggcucgucgggcugagcgugggccagaugcacgugaccaagcuggcggagccgcucgagaucgucuucucccaccagcggcccccgcccaacaugacccugaccugcguguucugggacgugacgaaggggaccaccggcgacuggagcuccgagggcugcagcaccgagguccgccccgaggggacggugugcugcugcgaccaccugaccuucuucgcccuccugcugcgccccacccucgaccaguccaccgugcacauccugacgcggaucagccaggccggcugcggggucuccaugaucuuccuggccuucaccaucauccucuacgcguuccugcgccugagccgggagcgcuucaagagcgaggacgcccccaagauccacguggcccucggcgggucccuguuccugcucaaccuggccuuccuggugaacgucggcagcggcuccaaggggagcgacgccgcgugcugggcccggggcgccguguuccacuacuuccuccugugcgccuucaccuggauggggcuggaggccuuccaccuguaccuccuggcggugcgcgucuucaacaccuacuucggccacuacuuccugaagcucucccuggugggguggggccugcccgcccucauggucaucggcacggggagcgccaacuccuacggccuguacaccauccgggaccgcgagaaccgcaccagccuggagcucugcugguuccgggaggggaccacgauguacgcccuguacaucaccgugcacggcuacuuccugaucaccuuccucuucgggauggugguccuggcccuggugguguggaagaucuucacccucucccgcgcgacggccgucaaggagcggggcaagaaccgcaagaaggugcugacccugcucggccugagcucccuggugggggucaccuggggccucgccaucuucaccccgcuggggcugagcacgguguacaucuucgcccucuucaacucccugcagggcguguucaucugcugcugguucaccauccuguaccuccccagccaguccaccaccgucagcuccagcaccgcccggcuggaccaggcgcacuccgccagccaggaguga

SEQ ID NO: 26384 - RNA, 3582 nt, Artificial Sequence
  derived and/or modified sequence opt1 from ADGRG6__Homo_sapiens__NP_001027566
augauguuccgcagcgaccggaugugguccugccacuggaaguggaagcccagcccgcuccuguuccuguucgcccuguacaucaugugcgugccccacuccgucuggggcugcgccaacugccgcguggugcucagcaaccccuccgggaccuucaccagccccugcuacccgaacgacuaccccaacucccaggcgugcauguggacgcugcgggcccccaccggcuacaucauccagaucaccuucaacgacuucgacaucgaggaggcccccaacugcaucuacgacagccugucccucgacaacggggagagccagaccaaguucugcggcgccacggccaaggggcuguccuucaacagcuccgcgaacgagaugcacgucagcuucuccagcgacuucuccauccagaagaagggcuucaacgccagcuacauccgcguggccgugucccugcggaaccagaaggucauccucccgcagaccagcgacgccuaccaggugagcguggcgaaguccaucagcauccccgagcuguccgccuucacccugugcuucgaggccaccaaggucggccacgaggacagcgacuggacggccuucuccuacagcaacgccuccuucacccagcuccugagcuucgggaaggcgaaguccggcuacuuccugagcaucuccgacagcaagugccuccugaacaacgcccugcccgugaaggagaaggaggacaucuucgccgaguccuucgagcagcucugccugguguggaacaacagccugggguccaucggcgucaacuucaagcgcaacuacgagaccgugcccugcgacagcaccaucuccaaggugaucccggggaacggcaagcuccugcugggcagcaaccagaacgagaucgucucccucaagggggacaucuacaacuuccggcuguggaacuucacgaugaacgccaagauccugagcaaccucagcugcaacgugaagggcaacguggucgacuggcagaacgacuucuggaacauccccaaccuggcccugaaggcggaguccaaccucagcugcggguccuaccugaucccccugcccgccgccgagcucgccagcugcgccgaccugggcacccugugccaggacggcaucaucuaccgcaucuccguggugauccagaacauccuccggcacccggaggucaaggugcagagcaagguggcggaguggcugaacuccaccuuccagaacuggaacuacaccgucuacguggucaacaucagcuuccaccuguccgccggggaggacaagaucaaggugaagcgcagccucgaggacgagccccggcuggugcugugggcccuccuggucuacaacgccacgaacaacaccaaccuggagggcaagaucauccagcagaagcuccugaagaacaacgagucccuggacgaggggcuccgccugcacaccgugaacgugcggcagcugggccacugccuggccauggaggagcccaagggguacuacuggcccagcauccagccguccgaguacguccuccccugccccgacaagcccggcuucagcgcgucccgcaucugcuucuacaacgccaccaacccgcuggugacguacuggggccccguggacaucagcaacugccugaaggaggccaacgaggucgccaaccagauccucaaccugaccgcggacgggcagaaccugaccuccgccaacaucaccaacaucguggagcaggucaagcggaucgugaacaaggaggagaacaucgacaucacgcucggcagcacccugaugaacaucuucagcaacauccuguccagcuccgacagcgaccuccuggaguccagcuccgaggcccugaagaccaucgacgagcucgccuucaagaucgaccugaacagcaccucccacgugaacaucacgacccgcaaccuggcccucagcguguccagccugcugcccgggaccaacgcgaucuccaacuucagcaucggccuccccuccaacaacgagagcuacuuccagauggacuucgaguccgggcaggucgacccgcuggccagcgugauccugccgcccaaccuccuggagaaccugucccccgaggacagcgugcucguccggcgcgcccaguucaccuucuucaacaagacgggccuguuccaggacgugggcccccagcggaagacccuggugagcuacgucauggccugcuccaucgggaacaucaccauccagaaccucaaggaccccgugcagaucaagaucaagcacacccgcacgcaggaggugcaccaccccaucugcgccuucugggaccugaacaagaacaagagcuucggcggguggaacaccuccggcugcgucgcgcaccgggacagcgacgccuccgagaccgugugccugugcaaccacuucacccacuucggggugcucauggaccugccgcgcagcgccucccagcuggacgcccgcaacaccaagguccucacguucaucagcuacaucggcugcggcaucuccgccaucuucagcgcggccacccugcugaccuacguggccuucgagaagcuccggcgcgacuaccccuccaagauccugaugaaccugagcaccgcccuccuguuccugaaccuccuguuccugcucgacggguggaucacguccuucaacguggacggccugugcaucgcggucgccgugcugcuccacuucuuccugcuggccaccuucaccuggauggggcucgaggccauccacauguacaucgcccuggugaaggucuucaacaccuacauccggcgcuacauccugaaguucugcaucaucggcuggggccuccccgcgcugguggugagcgucgugcuggccucccggaacaacaacgagguguacgggaaggagagcuacggcaaggagaagggggacgaguucugcuggauccaggaccccgucaucuucuacgugacgugcgccggcuacuucggggugauguucuuccucaacaucgccauguucaucgucgugauggugcagaucugcggccgcaacggcaagcgguccaaccgcacccugcgggaggagguccugcgcaaccuccggagcguggugucccugaccuuccugcucgggaugaccuggggcuucgccuucuucgcgugggggccgcugaacauccccuucauguaccuguucagcaucuucaacagccuccagggccuguucaucuucaucuuccacugcgccaugaaggagaacguccagaagcaguggcgccggcaccugugcugcgggcgcuuccggcucgccgacaacuccgacuggagcaagacggccaccaacaucaucaagaaguccagcgacaaccugggcaagucccugagcuccagcuccaucggcagcaacuccaccuaccucaccagcaaguccaagagcuccagcacgaccuacuucaagcgcaacucccacaccgacaacgugagcuacgagcacuccuucaacaagagcgggagccugcggcagugcuuccacggccaggugcuggucaagaccgggcccugcuga

SEQ ID NO: 26385 - RNA, 2394 nt, Artificial Sequence
  derived and/or modified sequence opt1 from ADGRG7__Homo_sapiens__NP_116176
auggccagcugccgcgccuggaaccugcgggugcucgucgcgguggugugcggccugcugaccgggaucauccucggccuggggaucuggcgcaucgucauccggauccagcgcggcaaguccaccagcuccagcuccacgcccaccgaguucugccggaacgggggcaccugggagaacggccgcugcaucugcaccgaggaguggaaggggcugcggugcacgaucgccaacuucugcgagaacagcaccuacaugggcuucaccuucgcccgcaucccgguggggcgguacggccccucccuccagaccugcgggaaggacacgcccaacgccggcaaccccauggccgugcgccugugcagccugucccucuacggcgagaucgagcugcagaaggucaccaucgggaacugcaacgagaaccuggagacccucgagaagcaggucaaggacgugaccgcgccgcugaacaacaucagcuccgaggugcagauccugacgagcgacgccaacaagcucaccgccgagaacaucaccuccgccacccggguggugggccagaucuucaacacgagccgcaacgcgucccccgaggccaagaaggucgccaucgugaccgugagccagcugcuggacgccuccgaggacgccuuccagcgggucgcggccaccgccaacgacgacgcccucaccacgcugaucgagcagauggagaccuacagccugucccucgggaaccagagcgugguggagcccaacaucgccauccagagcgcgaacuucuccagcgagaacgccgucggccccuccaacgugcgcuucagcgugcagaagggcgccuccagcucccuggucagcuccagcaccuucauccacaccaacguggacgggcugaacccggacgcccagacggagcuccaggugcugcugaacaugaccaagaacuacaccaagaccugcggcuucgucguguaccagaacgacaagcuguuccaguccaagacguucaccgccaagagcgacuucucccagaagaucaucagcuccaagaccgacgagaacgagcaggaccagagcgcguccgucgacaugguguucagccccaaguacaaccagaaggaguuccagcucuacuccuacgccugcguguacuggaaccugagcgccaaggacugggacaccuacgggugccagaaggacaagggcacggacggguuccuccggugccgcugcaaccacaccaccaacuucgccguccugaugaccuucaagaaggacuaccaguaccccaagagccuggacauccucuccaacgugggcugcgcccugagcgugacgggccuggcgcucaccgucaucuuccagaucgugacccggaaggugcgcaagaccuccgucaccugggugcuggugaaccugugcaucagcaugcucaucuucaaccugcuguucgucuucgggaucgagaacuccaacaagaaccuccagacgagcgacggcgacaucaacaacaucgacuucgacaacaacgacaucccccggaccgacaccaucaacaucccgaaccccaugugcaccgccaucgccgcccugcugcacuacuuccuccuggugacguucaccuggaacgcgcuguccgccgcccagcucuacuaccugcugauccgcaccaugaagccccugccccggcacuucauccucuucaucagccugaucggguggggcgugccggccaucgucguggccaucaccgugggggucaucuacucccagaacggcaacaacccccagugggagcuggacuaccgccaggagaagaucugcuggcucgcgauccccgagcccaacggcgugaucaagagcccgcugcugugguccuucaucgugcccgucacgaucauccucaucagcaacguggugauguucaucaccaucuccaucaagguccuguggaagaacaaccagaaccugaccagcaccaagaagguguccagcaugaagaagaucguguccacgcucagcgucgccgugguguucgggaucaccuggauccuggccuaccugaugcucgucaacgacgacagcauccgcaucguguucuccuacaucuucugccuguucaacaccacccagggccugcagaucuucauccucuacacggugcggaccaaggucuuccagagcgaggccuccaaggugcugaugcugcucagcuccaucgggcgccgcaagagccugcccuccgugacccggccccggcugcgcgucaagauguacaacuuccuccggagccugccgacccugcacgagcgcuuccggcuccuggagacgucccccagcaccgaggagaucacccuguccgagagcgacaacgccaaggaguccaucuga

SEQ ID NO: 26386 - RNA, 4425 nt, Artificial Sequence
  derived and/or modified sequence opt1 from ADGRL1__Homo_sapiens__NP_001008701
auggcccgccuggccgcggugcucuggaaccugugcgucaccgccgugcuggugaccagcgccacgcagggccucucccgggccgggcugcccuucggccugaugcgccgggagcucgccugcgagggguacccgaucgagcugcgcugccccggcagcgacgucaucaugguggagaacgcgaacuacgggcggaccgacgacaagaucugcgacgccgaccccuuccagauggagaacgugcagugcuaccugcccgacgccuucaagaucaugucccagcgcugcaacaaccggacccagugcgucgugguggccggcagcgacgcguucccggaccccugccccggcaccuacaaguaccucgagguccaguacgacugcgugcccuacaagguggagcagaaggucuucgugugcccggggacgcugcagaaggugcuggagcccaccuccacccacgagagcgagcaccaguccggcgccuggugcaaggacccccuccaggccggggaccgcaucuacgucaugcccuggaucccguaccggaccgacacgcugaccgaguacgccagcugggaggacuacguggccgcgcgccacaccaccacguaccggcugcccaaccgcguggacggcaccggguucgucguguacgacggcgccguguucuacaacaaggagcggacccgcaacaucgucaaguacgaccuccggacccgcaucaaguccggcgagacggugaucaacaccgccaacuaccacgacaccagccccuaccggugggggggcaagaccgacaucgaccuggccguggacgagaacgggcugugggucaucuacgccacggagggcaacaacggccgccucguggucucccagcugaaccccuacacccugcgguucgaggggaccugggagaccggcuacgacaagcgcagcgcguccaacgccuucauggugugcggggugcucuacguccugcggagcguguacguggacgacgacuccgaggccgccggcaaccgcgucgacuacgccuucaacacgaacgcgaaccgcgaggagccggugagccugaccuuccccaaccccuaccaguucaucuccagcguggacuacaacccccgggacaaccagcucuacgucuggaacaacuacuucguggugcgcuacucccuggaguucgggccgcccgaccccagcgccggccccgccaccagcccgccccuguccaccacgaccaccgcccggcccaccccccucacgagcaccgccuccccggcggccaccaccccccugcgccgggccccccugacgacccacccggucggcgccaucaaccagcucgggcccgaccugccccccgcgaccgccccggugcccagcacccgccggccccccgccccgaaccugcacgugucccccgagcucuucugcgagccccgcgagguccggcgcgugcaguggcccgccacccagcagggcaugcugguggagcggccgugccccaaggggacgcgcggcaucgccagcuuccagugccugcccgcgcucgggcuguggaacccccggggcccggaccuguccaacugcaccagccccugggucaaccagguggcccagaagaucaaguccggcgagaacgccgccaacaucgccagcgagcucgcgcgccacacccggggguccaucuacgccggcgacgugagcuccagcgucaagcugauggagcagcugcucgacauccuggacgcccagcugcaggcccuccgccccaucgagcgggaguccgccgggaagaacuacaacaagaugcacaagcgcgagcggaccugcaaggacuacaucaaggcggugguggagacggucgacaaccugcugcgccccgaggcccucgagagcuggaaggacaugaacgccaccgagcaggugcacaccgccaccaugcugcuggacgugcuggaggagggcgcguuccuccuggccgacaacguccgcgagccggcccgguuccuggccgccaaggagaacguggugcucgaggucacggugcugaacaccgaggggcaggugcaggagcuggucuucccccaggaggaguacccccgcaagaacuccauccagcucagcgcgaagaccaucaagcagaacucccggaacggcguggugaaggucguguucauccuguacaacaaccugggccucuuccugagcaccgagaacgccacggugaagcuggccggggaggccggccccgggggcccgggcggggccagccucgucgugaacucccaggugaucgcggccagcaucaacaaggaguccagccgcgucuuccugauggaccccgugaucuucaccguggcccaccuggaggacaagaaccacuucaacgccaacugcuccuucuggaacuacagcgagcgguccaugcucggcuacuggagcacccaggggugccgccuggucgaguccaacaagacccacacgaccugcgccugcagccaccugaccaacuucgcggugcucauggcccaccgggagaucuaccagggccgcaucaacgagcugcugcucuccgugaucaccugggucgggaucgugaucagccuggugugccuggccaucugcaucuccacguucugcuuccuccggggccugcagaccgaccgcaacaccauccacaagaaccugugcaucaaccucuuccuggccgagcugcucuuccuggucggcaucgacaagacccaguacgagaucgcgugccccaucuucgccgggcugcuccacuacuucuuccuggccgccuucagcuggcugugccucgagggcgugcaccuguaccugcuccuggucgagguguucgaguccgaguacagccggacgaaguacuacuaccuggggggcuacugcuucccggcccucguggucgggaucgcggccgccaucgacuaccgcuccuacggcaccgagaaggccugcuggcugcggguggacaacuacuucaucuggagcuucaucggccccgugagcuucgucaucguggugaaccuggucuuccucauggugacccugcacaagaugauccgcuccagcuccgugcugaagcccgacagcucccggcucgacaacaucaagagcugggcccugggggcgaucgcccugcucuuccugcugggccucaccugggccuucgggcugcuguucaucaacaaggaguccgucgugauggccuaccucuucacgaccuucaacgccuuccagggcguguucaucuucgucuuccacugcgcgcugcagaagaaggugcacaaggaguacagcaagugccugcgccacuccuacugcugcauccggagccccccggggggcacccacggcucccucaagaccagcgccaugcgcuccaacacgcgguacuacaccgggacccagagccgcauccggcgcauguggaacgacaccgugcgcaagcagacggaguccagcuucauggccggcgacaucaacuccacccccacccugaaccgggggaccaugggcaaccaccugcucaccaaccccguccugcagccccgcgggggcacgagcccguacaacacccugaucgccgaguccgugggcuucaaccccagcagcccccccguguucaacuccccggggagcuaccgggagcccaagcacccccucggcgggcgcgaggccugcggcauggacacccugccccugaacggcaacuucaacaacuccuacagccuccgguccggggacuucccgcccggcgacgggggccccgagcccccgcgcgggcggaaccuggcggacgccgccgccuucgagaagaugaucaucagcgagcugguccacaacaaccuccgcggcuccagcuccgcggccaagggccccccccccccggagccccccgugcccccggugcccgggggcgggggcgaggaggaggccgggggccccggcggggccgaccgggccgagaucgagcugcuguacaaggcgcucgaggagccgcugcugcucccccgcgcccagagcguccuguaccaguccgaccuggacgagagcgaguccugcaccgccgaggacggcgccacgagccggccccucuccagccccccggggcgcgacucccuguacgccagcggcgcgaaccugcgggacucccccagcuaccccgacagcucccccgaggggccgagcgaggcccuccccccccccccgcccgccccccccggcccgcccgagaucuacuacaccucccgcccccccgcccugguggcccggaacccgcugcagggcuacuaccaggugcgccggcccagccacgagggguaccucgcggcccccggccuggaggggcccggcccggacggcgacgggcagaugcagcuggucaccucccucuga

SEQ ID NO: 26387 - RNA, 4410 nt, Artificial Sequence
  derived and/or modified sequence opt1 from ADGRL3__Homo_sapiens__NP_056051
auguggcccagccagcugcucaucuucaugaugcugcuggcccccaucauccacgccuucucccgcgcgcccauccccauggccgugguccggcgcgagcucagcugcgaguccuaccccaucgagcugcggugcccgggcaccgacgugaucaugaucgagagcgccaacuacgggcgcaccgacgacaagaucugcgacuccgaccccgcccagauggagaacauccggugcuaccugcccgacgccuacaagaucaugagccagcgcugcaacaaccggacgcagugcgcgguggucgccggccccgacguguucccggaccccugccccgggaccuacaaguaccucgaggugcaguacgagugcguccccuacaagguggagcagaagguguuccugugcccgggccugcucaagggggucuaccaguccgagcaccuguucgagagcgaccaccaguccggcgccuggugcaaggacccccugcaggccagcgacaagaucuacuacaugcccuggacccccuaccgcaccgacacgcucaccgaguacuccagcaaggacgacuucaucgcgggccggccgaccaccacguacaagcugccccaccgcguggacgggaccggcuucguggucuacgacggggcccuguucuucaacaaggagcggacccgcaacaucgugaaguucgaccuccggacccgcaucaaguccggcgaggccaucaucgccaacgccaacuaccacgacacgagccccuaccgguggggcgggaaguccgacaucgaccuggcgguggacgagaacggccugugggucaucuacgccaccgagcagaacaacgggaagaucgugaucagccagcucaaccccuacacccugcgcaucgagggcaccugggacacggccuacgacaagcgguccgccagcaacgccuucaugaucugcgggauccuguacguggucaaguccguguacgaggacgacgacaacgaggcgaccggcaacaagaucgacuacaucuacaacaccgaccagagcaaggacagccucguggacgucccguuccccaacuccuaccaguacaucgccgccguggacuacaacccccgcgacaaccugcuguacguguggaacaacuaccacgucgugaaguacagccucgacuucggcccccuggacucccggagcgggcaggcccaccacggccaggucuccuacaucagcccgcccauccaccuggacuccgagcucgagcgccccagcgugaaggacaucuccaccacggggccccugggcauggggagcaccaccaccuccacgacccugcggaccaccacgcucagcccgggccgcuccaccacccccagcguguccggccgccggaaccgcagcaccuccacgcccagcccggccgucgaggugcuggacgacaugaccacccaccuccccuccgcgagcagccagauccccgcccuggaggaguccugcgaggccguggaggcccgggagaucaugugguucaagacccgccaggggcagaucgccaagcagcccugcccggcgggcacgaucggggucagcaccuaccugugccuggcccccgacggcaucugggacccccaggggcccgaccucuccaacugcagcuccccgugggugaaccacaucacccagaagcucaagagcggcgagaccgccgccaacaucgcgcgggagcuggccgagcagacccgcaaccaccugaacgccggcgacaucacguacuccgugcgggccauggaccagcuggucgggcugcucgacgugcagcugcgcaaccugacccccggcgggaaggacagcgccgcgcggucccucaacaagcugcagaagcgcgagcggagcugccgcgccuacgugcaggccauggucgagaccgugaacaaccugcuccagccccaggcccugaacgccuggcgggaccugaccacguccgaccagcugcgcgcggccaccaugcuccugcacaccguggaggagagcgccuucguccuggccgacaaccuccugaagaccgacaucgugcgggagaacacggacaacaucaagcuggagguggcccgccucuccaccgagggcaaccuggaggaccugaaguuccccgagaacauggggcacggcagcaccauccagcucuccgcgaacacccugaagcagaacggccggaacggggagauccgcgucgccuucgugcuguacaacaaccucggcccguaccugagcacggagaacgccuccaugaagcuggggaccgaggcccucagcaccaaccacagcgugaucgucaacucccccgugaucaccgcggccaucaacaaggaguucagcaacaagguguaccuggccgaccccgucguguucacggugaagcacaucaagcaguccgaggagaacuucaaccccaacugcagcuucugguccuacagcaagcggaccaugaccggcuacugguccacccagggcugccgccugcucacgaccaacaagacccacaccacgugcagcugcaaccaccugaccaacuucgccguccugauggcccacguggaggugaagcacuccgacgcgguccacgaccuccugcuggacgugaucaccuggguggggauccuccugagccuggucugccuccugaucugcaucuucaccuucugcuucuuccgcggccugcaguccgaccggaacacgauccacaagaaccucugcaucagccuguucguggccgagcuccuguuccugaucgggaucaaccgcaccgaccagccgaucgccugcgccguguucgccgcgcugcuccacuucuucuuccuggccgccuucaccuggauguuccuggagggcguccagcucuacaucaugcugguggagguguucgaguccgagcacagccggcgcaaguacuucuaccuggucggguacggcaugcccgcccucaucguggccguguccgcggccgucgacuaccggagcuacggcaccgacaaggugugcuggcugcgccuggacacguacuucaucugguccuucaucgggcccgccacccucaucaucaugcugaacgugaucuuccugggcaucgcccucuacaagauguuccaccacaccgcgauccugaagcccgagagcgggugccuggacaacaucaacuacgaggacaaccggccguucaucaaguccugggucaucggcgccaucgcccuccugugccugcucgggcugaccugggccuucggccugauguacaucaacgagagcacggugaucauggccuaccucuucaccaucuucaacagccugcagggcauguucaucuucaucuuccacugcgugcugcagaagaagguccgcaaggaguacgggaagugccuccggacccacugcugcuccggcaagagcaccgaguccagcaucggguccggcaagaccagcgggucccgcacgcccggccgguacagcaccggcucccagagccgcauccggcgcauguggaacgacaccgugcggaagcaguccgagagcuccuucaucaccggggacaucaacagcuccgcgagccugaaccgcgagggccugcucaacaacgcccgggacacguccgugauggacacccugccccugaacgggaaccacggcaacagcuacuccaucgccagcggggaguaccucagcaacugcguccagaucaucgaccgcggcuacaaccacaacgagaccgcccuggagaagaagauccugaaggagcucaccuccaacuacauccccagcuaccugaacaaccacgagcgguccagcgagcagaaccgcaaccugaugaacaagcucgugaacaaccugggcuccgggcgggaggacgacgccaucguccuggacgacgcgacgagcuucaaccacgaggagucccucggccuggagcugauccacgaggagagcgacgccccgcuccugccgccccgcguguacuccaccgagaaccaccagccccaccacuacacccgccggcgcaucccccaggaccacagcgaguccuucuucccccugcucaccaacgagcacacggaggaccugcagagcccccaccgggacucccuguacaccagcaugccgacccucgccgggguggccgccaccgaguccgucacgaccagcacccagaccgagcccccgcccgcgaagugcggcgacgccgaggacguguacuacaaguccaugcccaaccugggcagccgcaaccacgugcaccagcugcacacguacuaccagcucgggcggggcuccagcgacggguucaucgucccgcccaacaaggacggcaccccgcccgaggggagcuccaagggccccgcccaccuggugaccagccuguga

SEQ ID NO: 26388 - RNA, 18921 nt, Artificial Sequence
  derived and/or modified sequence opt1 from ADGRV1__Homo_sapiens__NP_115495
augagcguguuccugggccccgggaugcccuccgccagccuccuggucaaccugcucuccgcccugcugauccucuucguguucggcgagaccgagauccgguucaccgggcagacggaguucguggucaacgagaccagcaccaccgugauccggcugaucaucgagcggaucggcgagcccgccaacgugacggccaucgucucccuguacggggaggacgccggcgacuucuucgacaccuacgccgccgcguucauccccgccggcgagaccaaccggaccguguacaucgccgugugcgacgacgaccuccccgagcccgacgagacguucaucuuccaccugacccugcagaagcccagcgccaacgucaagcucggguggccccgcaccgugaccgugacgauccuguccaacgacaacgcguucggcaucaucagcuucaacaugcugcccuccaucgccgucagcgagcccaaggggcggaacgaguccaugccccucacccugauccgcgagaagggcaccuacgggauggugauggugaccuucgaggucgagggcggccccaacccgcccgacgaggaccugagccccgugaaggggaacaucacguucccgcccggccgggccaccgugaucuacaaccucaccguccuggacgacgaggugccggagaacgacgagaucuuccugauccagcucaaguccguggagggcggggccgagaucaacaccagccgcaacuccaucgagaucaucaucaagaagaacgacagccccguccgguuccugcaguccaucuaccuggugcccgaggaggaccacauccucaucauccccgugguccgcggcaaggacaacaacgggaaccugaucggcagcgacgaguacgagguguccaucagcuacgccgucacgaccgggaacagcaccgcgcacgcccagcagaaccuggacuucaucgaccuccagccgaacaccacggugguguucccgcccuucauccacgagucccaccugaaguuccagaucgucgacgacaccauccccgagaucgccgagagcuuccacaucaugcugcucaaggacacccugcagggcgacgccgugcugaucuccccgagcgugguccaggugaccaucaagcccaacgacaagcccuacggggugcucuccuucaacagcguccuguucgagcggacggugaucaucgacgaggaccgcaucucccgguacgaggagaucaccgugguccgcaacggcggcacccacgggaacgugagcgccaacugggugcugacccggaacuccacggaccccagcccggucaccgcggacauccgccccuccagcggcgugcuccacuucgcccaggggcagaugcuggccaccaucccccugaccguggucgacgacgaccucccggaggaggccgaggccuaccugcugcagauccucccccacacgauccggggcggggcggagguguccgagcccgccgagcugcuguucuacauccaggacagcgacgacguguacggccucaucaccuucuuccccauggagaaccagaagaucgaguccagcccgggcgagcgcuaccugucccugagcuucacccggcucgggggcaccaagggggacguccgccugcuguacuccgugcuguacauccccgccggcgccguggacccccuccaggccaaggaggggauccugaacaucagccggcgcaacgaccugaucuuccccgagcagaagacccaggucacgaccaagcucccgauccgcaacgacgcguuccugcagaacggcgcccacuuccuggugcagcucgagaccguggagcugcugaacaucaucccccucaucccgcccaucagcccccgguucggcgagaucugcaacaucucccugcuggucacccccgccaucgccaacggggagaucggcuuccucagcaaccugcccaucauccugcacgagcccgaggacuucgcggccgaggugguguacaucccgcuccaccgcgacgggacggacggccaggccaccgucuacuggucccugaagcccagcggcuucaacuccaaggccgugacccccgacgacaucgggcccuucaacggcagcgugcuguuccucuccgggcagagcgacaccacgaucaacaucaccaucaagggcgacgacaucccggagaugaacgagaccgucacccugucccuggaccgggugaacguggagaaccagguccucaagagcggguacacgucccgcgaccugaucauccuggagaacgacgaccccggcggcguguucgaguucagccccgccucccgggggcccuacgugaucaaggagggcgagagcgucgagcuccacaucauccgcucccgggggagccuggugaagcaguuccugcacuaccgcguggagccgcgggacuccaacgaguucuacggcaacaccgggguccucgaguucaagcccggcgagcgcgagaucgugaucacccugcuggcgcggcucgacggcauccccgagcuggacgagcacuacugggugguccugagcagccacggggagcgcgaguccaagcucggcagcgccaccaucgugaacaucacgauccugaagaacgacgacccgcacgggaucaucgaguucguguccgacggccugaucgucaugaucaacgagagcaagggggacgccaucuacuccgccguguacgacgugguccggaaccgcggcaacuucggcgacgugagcgucuccuggguggugagccccgacuucacccaggacgucuuccccgugcaggggaccguggucuucggcgaccaggaguucuccaagaacaucaccaucuacagccuccccgacgagaucccggaggagauggaggaguucacggugauccugcugaacgggaccggcggggccaaggugggcaaccggaccaccgcgacgcuccgcauccggcgcaacgacgaccccaucuacuucgccgagccccgggucgugcgcgugcaggagggcgagaccgccaacuucaccguccugcgcaacggguccguggacgugaccugcaugguccaguacgccacgaaggacggcaaggccaccgcgcgggagcgcgacuucauccccguggagaagggggagacccugaucuucgaggugggcagccggcagcaguccaucagcaucuucgucaacgaggacggcaucccggagaccgacgagcccuucuacaucauccuccugaacuccacgggggacaccgugguguaccaguacggcgucgccaccgugaucaucgaggccaacgacgaccccaacgggaucuucagccuggagcccaucgacaaggccguggaggagggcaagaccaacgcguucuggauccuccgccaccggggguacuucggcuccgucagcguguccuggcagcuguuccagaacgacagcgcccugcagccgggccaggaguucuacgagacgagcgggaccgugaacuucauggacggcgaggaggccaagcccaucauccuccacgccuuccccgacaagauccccgaguucaacgaguucuacuuccugaagcuggucaacaucuccgggggcagcccggggcccggcggccagcucgccgagaccaaccuccaggugaccgugaugguccccuucaacgacgaccccuucgggguguucauccuggacccggagugccucgagcgcgagguggcggaggacguccuguccgaggacgacaugagcuacaucaccaacuucacgauccugcggcagcagggcguguucggggacgugcagcucggcugggagauccuguccagcgaguuccccgccgggcugccgcccaugaucgacuuccuccuggucggcaucuucccgaccaccgugcaccuccagcagcacaugcgccggcaccacuccggcaccgacgcccucuacuucacggggcuggagggcgccuucgggaccgugaaccccaaguaccaccccagccgcaacaacaccaucgccaacuucaccuucuccgcgugggucaugcccaacgccaacacgaacggcuucaucaucgccaaggacgacggcaacgggagcaucuacuacggcgugaagauccagaccaacgagucccacgugacccugagccuccacuacaagacccugggguccaacgccacguacaucgccaagaccaccgucaugaaguaccuggaggagagcguguggcuccaccuccugaucauccucgaggacggcaucaucgaguucuaccuggacgggaacgcgaugccgcggggcaucaagucccugaagggcgaggccaucaccgacgggcccggcauccuccgcaucggggccggcaucaacgggaacgaccgguucacgggccugaugcaggacgugcgcagcuacgagcggaagcugacccucgaggagaucuacgagcugcacgccaugcccgcgaaguccgaccugcacccgaucagcggcuaccucgaguuccgccagggggagaccaacaaguccuucaucaucagcgcccgggacgacaacgacgaggagggcgaggagcuguucauccugaagcucgucagcguguacgggggcgcccgcaucuccgaggagaacaccacggcccggcugaccauccagaaguccgacaacgccaacgggcuguucggcuucaccggcgcgugcauccccgagaucgccgaggagggguccaccaucagcugcguggucgagcgcacgcggggcgcccucgacuacgugcacguguucuacaccaucucccagaucgagaccgacgggaucaacuaccuggucgacgacuucgccaacgccagcggcaccaucacguuccugcccuggcagcgcuccgaggugcucaacaucuacguccuggacgacgacauccccgagcugaacgaguacuuccgcgugacccucgugagcgcgaucccgggggacggcaagcugggcuccacccccaccagcggggccuccaucgaccccgagaaggagacgaccgacaucaccaucaaggccagcgaccaccccuacggccugcugcaguucuccaccgggcucccgccccagcccaaggacgccaugacgcugcccgccagcuccgucccgcacaucaccguggaggaggaggacggcgagauccggcugcucgugauccgcgcgcagggccugcuggggcgggucaccgccgaguuccgcaccgugagccucaccgccuucucccccgaggacuaccagaacguggccggcacgcuggaguuccagcccggggagcgguacaaguacaucuucaucaacaucaccgacaacagcauccccgagcuggagaaguccuucaaggucgagcuccugaaccuggagggcgggguggccgagcuguuccgcguggacggcagcggcagcggggacggcgacauggaguucuuccugccgaccauccacaagcgggcgucccugggggucgccagccagauccucgugaccaucgccgccuccgaccacgcgcacggcguguucgaguucagccccgagucccuguucgucagcgggacggagcccgaggacggcuacuccaccgugacccugaacgugauccgccaccacggcacccucagccccgucacgcugcacuggaacaucgacuccgacccggacggggaccuggccuucaccagcggcaacaucaccuucgagaucgggcagaccuccgccaacaucacgguggagauccuccccgacgaggaccccgagcuggacaaggccuucagcguguccguccugagcguguccagcggcucccucggggcccacaucaacgcgacccugaccgugcuggccagcgacgaccccuacggcaucuucaucuucuccgagaagaaccggccggucaagguggaggaggccacccagaacaucacgcucagcaucauccgccugaagggccugauggggaaggugcucgucagcuacgccacccuggacgacauggagaagccgcccuacuucccgcccaaccuggcccgggcgacccagggccgcgacuacauccccgccuccggguucgcccucuucggcgccaaccagagcgaggccaccaucgcgaucuccauccuggacgacgacgagcccgagcggagcgaguccguguucaucgagcugcucaacagcacgcugguggccaagguccagucccgcagcauccccaacagcccccggcuggggcccaagguggagaccaucgcccagcucaucaucaucgccaacgacgacgcguucggcacccugcagcugagcgcccccaucgugcgcgucgccgagaaccacgugggcccgaucaucaacgugacccggaccggcggggccuucgccgacgucuccgugaaguucaaggcggugcccaucaccgccaucgccggggaggacuacagcaucgccuccagcgacgucgugcuccuggagggggagaccuccaaggccgugcccaucuacgucaucaacgacaucuaccccgagcuggaggagagcuuccucgugcagcugaugaacgagaccacgggcggggcgcgccugggcgcccucaccgaggccgugaucaucaucgaggccuccgacgacccguacgggcuguucggcuuccagaucaccaagcugaucgucgaggagcccgaguucaacagcgugaaggugaaccuccccaucauccggaacuccgggacccugggcaacgucacggugcaguggguggccaccaucaacggccagcuggcgaccggggaccuccgcgucgugagcggcaacgucaccuucgcccccggggagacgauccagacccugcugcucgaggugcuggccgacgacgugccggagaucgaggaggucauccaggugcagcugaccgacgccagcggcgggggcaccaucggccucgaccgcaucgcgaacaucaucauccccgccaacgacgaccccuacgggacgguggccuucgcccagauggucuaccgggugcaggagccccuggagcgcuccagcugcgccaacaucaccgugcggcgcuccggcgggcacuucggccggcugcuccuguucuacagcaccuccgacaucgacgucguggcgcuggccauggaggaggggcaggaccuccugagcuacuacgaguccccgauccagggcgugcccgacccccuguggcgcaccuggaugaacgucagcgccgugggcgagccccucuacacgugcgccacgcugugccugaaggagcaggccugcuccgcguucagcuucuucuccgccagcgaggggccgcagugcuucuggaugaccuccuggaucagccccgccgugaacaacuccgacuucuggaccuaccggaagaacaugacccgcgucgccagccucuucuccggccaggccguggcggggagcgacuacgagcccgugacgcggcagugggccaucaugcaggagggcgacgaguucgccaaccugaccgucagcauccugcccgacgacuucccggagauggacgaguccuuccucaucagccugcuggaggugcaccucaugaacaucuccgccagccugaagaaccagcccaccaucggccagcccaacaucuccaccguggucaucgcccugaacggggacgcguucggcguguucgugaucuacaacaucagcccgaacacguccgaggacggccuguucgucgaggugcaggagcagccccagacccugguggagcugaugauccaccgcaccggcgggagccucggccaggucgccguggaguggcggguggucggcgggaccgccacggagggccuggacuucaucggggccggcgagauccugaccuucgcggagggggagaccaagaagaccgugauccucacgauccuggacgacuccgagcccgaggacgacgagagcaucaucgugucccuggucuacaccgagggcggcagccgcauccuccccuccagcgacaccgugcgggugaacauccuggccaacgacaacgucgccgggaucguguccuuccagaccgccagccgcuccgugaucggccacgagggggagauccugcaguuccacgucauccggacguucccgggccgcgggaacgugaccgugaacuggaagaucaucggccagaaccucgagcugaacuucgccaacuucagcggccagcuguucuuccccgaggggucccucaacaccacccuguucguccaccuccuggacgacaacauccccgaggagaaggagguguaccaggugauccuguacgacguccggacgcagggcgugcccccggcggggaucgcccugcuggacgcccagggcuacgccgccgugcugaccgucgaggcgagcgacgagccccacggggugcugaacuucgcccugagcucccgcuucgugcuccugcaggaggccaacaucaccauccagcuguucaucaaccgggaguucggcagccucggcgccaucaacgucaccuacacgaccgugcccgggaugcugucccugaagaaccagaccgucggcaaccucgccgagcccgagguggacuucgugccgaucaucggguuccugauccuggaggagggcgagaccgcggccgccaucaacaucacgauccucgaggacgacguccccgagcuggaggaguacuuccuggugaaccucaccuacgugggccugaccauggccgcgagcaccuccuucccgccccggcuggacagcgaggggcucacggcccaggucaucaucgacgccaacgacggcgcccgcggggugaucgaguggcagcagucccgcuucgaggugaacgagacccacggcagccugacccuggucgcccagcgcucccgggagccgcucgggcacgugagccuguucguguacgcgcagaaccuggaggcccaggucggccucgacuacaucuucacccccaugauccugcacuucgccgacggcgagcgcuacaagaacgugaacaucaugauccuggacgacgacauccccgagggggacgagaaguuccagcucauccugaccaaccccuccccgggccuggagcucgggaagaacacgaucgcccugaucaucgugcuggccaacgacgacggccccgggguccucagcuucaacaacuccgagcacuucuuccugcgggagcccaccgcgcuguacgugcaggagagcguggccguccucuacaucgugcgcgagcccgcccagggccuguucggcaccgugaccguccaguucaucgugacggaggugaacuccagcaacgaguccaaggaccugaccccgagcaagggguacaucguccucgaggagggcgugcgguucaaggcccugcagaucuccgccauccuggacaccgagcccgagauggacgaguacuucgugugcacccucuucaaccccaccggcggggcgcgccuggggguccacgugcagacccugaucaccgugcuccagaaccaggcgccccuggggcuguucagcaucagcgccgucgagaaccgggccaccuccaucgacaucgaggaggcgaaccgcacgguguaccucaacgugagccggaccaacggcaucgaccuggccgucuccgugcagugggagaccgugagcgagaccgccuucgggaugcgcggcauggacgucguguucuccguguuccagagcuuccuggacgaguccgccagcggguggugcuucuucacgcucgagaaccugaucuacggcaucaugcugcggaaguccagcgucaccguguaccgcuggcagggcaucuucaucccgguggaggaccucaacaucgagaaccccaagaccugcgaggccuucaacaucggguucucccccuacuucgucaucacccacgaggagcggaacgaggagaagccgagccugaacuccguguucacguucaccagcggcuucaagcuguuccucgugcagaccaucaucauccuggaguccagccagguccgcuacuucaccuccgacagccaggacuaccugaucaucgcgucccagcgggacgacagcgagcucacccagguguuccgcuggaacgggggcagcuucgugcugcaccagaagcugcccguccgcggggugcucaccguggcccuguucaacaagggcggcuccgucuuccuggccaucagccaggccaacgcccgccucaacucccugcuguuccgguggagcggguccggcuucaucaacuuccaggaggugcccgucagcgggaccaccgagguggaggcgcucuccagcgccaacgacaucuaccugaucuucgccgagaacguguuccugggcgaccagaacuccaucgacaucuucaucugggagauggggcagagcuccuuccgcuacuuccagagcgucgacuucgccgccgugaaccgcauccacuccuucacgcccgcgagcggcaucgcccacauccuccugaucggccaggacauguccgcccuguacugcuggaacagcgagcggaaccaguucuccuucgugcucgaggucccgagcgccuacgacguggccuccgugaccgucaagagccugaacagcuccaagaaccugaucgcgcucgugggggcccacagccacaucuacgagcuggccuacaucuccagccacuccgacuucauccccagcuccggcgagcugaucuucgagcccggggagcgcgaggccaccaucgcggugaacauccucgacgacaccguccccgagaaggaggagagcuucaaggugcagcugaagaacccgaagggcggggccgagaucggcaucaacgacuccgugacgaucaccauccugagcaacgacgacgccuacggcaucgucgccuucgcccagaacucccucuacaagcaggucgaggagauggagcaggacagccuggugacccugaacgucgagcggcucaaggggaccuacggccgcaucacgaucgcgugggaggccgacggguccaucagcgacaucuuccccaccuccggcgugauccuguucaccgagggccaggugcugagcaccaucacccucacgauccuggccgacaacauccccgagcuguccgaggucgugaucgugacccucacccggaucaccacggagggcgucgaggacagcuacaagggcgccaccaucgaccaggaccgcuccaagagcgugaucaccacccugcccaacgacagcccguucgggcuggugggcuggcgggccgcguccgucuucauccgcguggccgagcccaaggagaacacgaccacccuccagcugcagaucgcccgggacaaggggcugcugggcgacaucgccauccaccuccgcgcccagcccaacuuccugcugcacguggacaaccaggcgaccgagaacgaggacuacguccuccaggagacgaucaucaucaugaaggagaacaucaaggaggcccacgccgaggugagcauccugcccgacgaccugccggagcucgaggagggcuucaucgugaccaucaccgaggucaaccuggugaacuccgacuucagcaccgggcagcccuccgugcggcgccccggcauggagaucgccgagaucaugaucgaggagaacgacgacccccgggggaucuucauguuccacgucacgcgcggcgcgggggaggugaucaccgccuacgaggugccgccgccccugaacguccuccaggugcccgugguccggcuggccggcagcuucggcgccgugaacguguacuggaaggccucccccgacagcgcggggcuggaggacuucaagcccucccacggcauccucgaguucgccgacaagcaggucaccgccaugaucgagaucaccaucaucgacgacgccgaguucgagcugacggagaccuucaacaucagccugaucuccguggccgggggcgggcgccucggcgacgacguggucgugaccguggucaucccccagaacgacagccccuucggcguguucggguucgaggagaagaccgucaugaucgacgagucccugagcuccgacgacccggacagcuacgugacgcugaccgugguccggucccccggcgggaagggcaccgugcgccucgaguggaccaucgacgagaaggcgaagcacaaccugagcccccugaacgggacgcuccacuucgacgagaccgagagccagaagaccaucgugcugcacacccugcaggacacgguccucgaggaggaccggcgcuucaccauccagcugaucuccaucgacgagguggagaucagcccggugaagggcuccgccagcaucaucauccggggcgacaagcgcgccuccggggaggucggcaucgcccccagcucccgccacauccugaucggggagcccagcgccaaguacaacggcaccgcgaucaucucccucgugcggggccccgggauccugggcgaggugaccgucuucuggcgcaucuucccgcccagcgugggggaguucgccgagacguccggcaagcugaccaugcgggacgagcagagcgccgugaucgucgugauccaggcccucaacgacgacauccccgaggagaaguccuucuacgaguuccagcugaccgccgugagcgagggcgggguccuguccgagagcuccagcaccgcgaacaucaccgugguggccuccgacagccccuacggccgcuucgccuucagccacgagcagcuccgggucuccgaggcccagcgcgugaacaucacgaucauccggagcuccggggacuucggccacgugcgccugugguacaagaccaugagcgggaccgcggaggccggccuggacuucgucccggccgccggggagcuccuguucgaggccggcgagaugcggaagucccugcacguggagauccucgacgacgacuaccccgagggccccgaggaguucagccugaccaucacgaagguggagcugcaggggcgcggcuacgacuucaccauccaggagaacgggcuccagaucgaccagcccccggagaucggcaacaucuccaucguccggaucaucaucaugaagaacgacaacgcggaggggaucaucgaguucgaccccaaguacaccgccuucgagguggaggaggacgugggccugaucaugauccccgucgugcgccugcacggcaccuacggguacgugacggccgacuucaucagccaguccagcuccgccagccccggcggggucgacuacauccuccacggcuccaccgugaccuuccagcacgggcagaaccugagcuucaucaacaucuccaucaucgacgacaacgagagcgaguucgaggagccgaucgagauccugcucaccggcgccacgggcggggcggugcugggccggcaccuggucucccgcaucaucaucgccaagagcgacucccccuucggggugauccgguuccucaaccagagcaagaucagcaucgccaaccccaacuccaccaugauccugagccuggugcucgagcgcaccggcggccugcugggggagauccaggucaacugggagaccgugggccccaacucccaggaggcccuccugccgcagaaccgggacaucgccgaccccgugagcgggcuguucuacuucggcgagggggagggcggcguccgcacgaucauccucaccaucuacccccacgaggagaucgagguggaggagaccuucaucaucaagcugcaccuggugaagggggaggcgaagcucgacucccgggccaaggacgucacccugacgauccaggaguucggcgaccccaacgggguggugcaguucgccccggagacccugagcaagaagaccuacuccgagccccucgcccuggagggcccccugcucaucaccuucuucguccgccgcgugaaggggacguucggcgagaucaugguguacugggagcugagcuccgaguucgacaucaccgaggacuuccugagcaccuccggcuucuucaccaucgcggacggggagagcgaggccuccuucgacguccaccuccugcccgacgaggugccggagaucgaggaggacuacgucauccagcuggugagcguggagggcggggccgagcucgaccuggagaaguccaucacgugguucagcgucuacgccaacgacgacccccacggcguguucgcccuguacuccgaccggcagagcauccucaucgggcagaaccugauccgcuccauccagaucaacaucacccggcuggcgggcaccuucggcgacguggccgucgggcuccgcaucagcagcgaccacaaggagcagcccaucgugaccgagaacgccgagcggcagcugguggucaaggacggcgccacguacaagguggacguggucccgaucaagaaccagguguuccugucccucgggagcaacuucacccugcagcuggugaccgucaugcucgugggcgggcgcuucuacggcaugcccaccauccugcaggaggccaaguccgcggugcugcccgucagcgagaaggccgccaacucccaggugggcuucgagagcacggccuuccagcucaugaacaucaccgccgggaccucccacgugaugaucagccggcgcggcaccuacggggcgcuguccgucgccuggaccacgggcuacgcccccggccuggagaucccggaguucaucgugguggggaacaugacccccacccucggcagccuguccuucagccacggggagcagcggaagggcgucuuccuguggaccuuccccucccccggguggccggaggccuucgugcugcaccucagcggcgugcaguccagcgcgcccggcggggcccagcugcgcuccggcuucaucgucgccgagaucgagcccauggggguguuccaguucagcacguccagccggaacaucaucgugagcgaggacacccagaugauccgccugcacguccagcgccuguucggcuuccacuccgaccugaucaaggugagcuaccagaccaccgccggguccgccaagccccuggaggacuucgagccggugcagaacggcgagcuguucuuccagaaguuccagacggaggucgacuucgagaucaccaucaucaacgaccagcugagcgagaucgaggaguucuucuacaucaaccugaccuccguggagauccgcggccuccagaaguucgacgugaacuggagcccccggcugaaccuggacuucuccgucgcggugaucaccauccucgacaacgacgaccuggccgggauggacaucagcuuccccgagacgaccguggccgucgccguggacaccacccugauccccguggagacggaguccaccaccuaccucagcaccuccaagacgaccaccauccugcagccgaccaacgucguggccaucgugacggaggcgaccggcgucagcgccauccccgagaagcuggugacccuccacgggacccccgccguguccgagaagcccgacgucgccacggugaccgccaacgugagcauccacggcaccuucucccuggggccgagcaucgucuacaucgaggaggagaugaagaacggcaccuucaacacggcggaggugcugauccgccggaccggcggguucaccggcaacguguccaucaccgucaagacguucggggagcgcugcgcccagauggagcccaacgcccuccccuuccggggcaucuacggcaucagcaaccugaccugggccguggaggaggaggacuucgaggagcagacccugacccucaucuuccuggacggggagcgcgagcggaaggucuccgugcagauccuggacgacgacgagcccgagggccaggaguucuucuacguguuccucacgaacccgcagggcggggcccagaucgucgaggagaaggacgacaccggguucgcggccuucgccauggugaucaucaccggcagcgaccugcacaacggcaucaucggguucagcgaggagucccagagcggccuggagcuccgcgagggggccgugaugcgccggcugcaccugaucgucacccgccagcccaaccgggcguucgaggacgugaagguguucuggcgcgucacccucaacaagacgguggugguccugcagaaggacggcgugaaccugguggaggagcuccaguccgucagcgggaccacgacgugcacgaugggccagaccaagugcuucaucuccaucgagcugaagcccgagaaggugccccagguggaggucuacuucuucguggagcuguacgaggccaccgccggcgccgccaucaacaacagcgcgcgguucgcccagaucaagauccucgaguccgacgagagccagucccugguguacuucagcgucgggucccgccuggccguggcccacaagaaggccacccucaucagccuccagguggcgcgggacuccggcacggggcugaugaugagcgucaacuucuccacccaggagcuccgcagcgccgagaccaucggccggaccaucaucucccccgccaucagcgggaaggacuucgugaucacggagggcacccugguguucgagcccggccagcgcagcaccguccuggacgugauccucacccccgagacggggucccugaacagcuucccgaagcgguuccagaucgugcuguucgaccccaagggcggggcccgcaucgacaaggucuacggcaccgccaacaucacccucguguccgacgcggacagccaggccaucugggggcuggccgaccagcugcaccagcccgugaacgacgacauccucaaccggguccugcacaccaucuccaugaagguggccacggagaacaccgacgagcagcugagcgcgaugaugcaccucaucgagaagaucaccaccgagggcaagauccaggccuucuccguggccagccgcacgcuguucuacgagauccugugcucccucaucaaccccaagcggaaggacacccgcggcuucagccacuucgccgaggucaccgagaacuucgccuucucccugcugaccaacgugacgugcgggagcccgggcgagaaguccaagaccauccucgacagcugccccuaccuguccauccuggcgcuccacugguacccccagcagaucaacgggcacaaguucgagggcaaggagggcgacuacauccggauccccgagcgccugcuggacgugcaggacgccgagaucauggccgggaaguccacgugcaagcucguccaguucaccgaguacuccagccagcagugguucaucuccggcaacaaccugccgacccugaagaacaaggugcucagccugagcgugaaggggcaguccagccagcugcucaccaacgacaacgagguccuguaccggaucuacgccgccgagccccgcaucaucccccagaccucccugugccuccuguggaaccaggcggccgccagcuggcuguccgacagccaguucugcaaggugguggaggagaccgccgacuacgucgagugcgccugcucccacaugagcguguacgcgguguacgcccgcacggacaaccucuccagcuacaacgaggccuucuucaccuccggcuucaucugcaucagcgggcugugccuggccguccucucccacaucuucugcgcgcgguacagcauguucgccgccaagcugcugacccacaugauggccgccucccucggcacccagauccuguuccuggcgagcgccuacgccagcccccagcucgccgaggagagcugcuccgccauggcggccgugacccacuaccuguaccugugccaguucagcuggaugcucauccagagcgugaacuucugguacguccuggugaugaacgacgagcacacggagcgccgguaccuccucuucuuccugcuguccuggggccugccggccuucgucgugauccuccugaucgugauccugaaggggaucuaccaccagagcaugucccagaucuacggccucauccacggggaccugugcuucauccccaacgucuacgccgcccuguucaccgcggcccucgugccccugaccugccugguggucguguucguggucuucauccacgccuaccaggugaagccccaguggaaggccuacgacgacguguuccgcggccggaccaacgccgcggagaucccgcucauccuguaccuguucgcccucaucagcgucacguggcuguggggcgggcugcacauggccuaccgccacuucuggaugcucgugcuguucgugaucuucaacucccugcagggccucuacgucuucaugguguacuucauccugcacaaccagaugugcugccccaugaaggccagcuacaccguggagaugaacgggcaccccggccccuccaccgcguucuucaccccggggagcggcaugccgcccgccgggggcgagaucuccaagagcacgcagaaccugaucggcgccauggaggaggugccgcccgacugggagcgggccuccuuccagcaggggagccaggccucccccgaccucaagcccagcccccagaacggcgcgaccuuccccuccagcgggggcuacggccaggggucccugaucgccgacgaggagagccaggaguucgacgaccugaucuucgcccucaagaccggcgccgggcuguccgugagcgacaacgagagcggccaggggucccaggagggcggcacccugacggacagccagaucguggagcuccgccggauccccaucgccgacacccaccuguga

SEQ ID NO: 26389 - RNA, 1128 nt, Artificial Sequence
  derived and/or modified sequence opt1 from ADH1A__Homo_sapiens__NP_000658
augagcaccgccggcaaggugaucaagugcaaggccgcgguccugugggagcucaagaagcccuucuccaucgaggagguggagguggccccgcccaaggcccacgagguccgcaucaagaugguggccguggggaucugcggcaccgacgaccacgucgugagcgggacgauggugacgccccugcccgucauccugggccacgaggccgcggggaucguggaguccgugggcgagggcgucaccaccgugaagccgggggacaaggugaucccccucgccaucccccagugcggcaagugccggaucugcaagaaccccgagagcaacuacugccugaagaacgacgucuccaacccgcaggggacccugcaggacggcaccagccgcuucacgugccggcgcaagcccauccaccacuuccucgggaucuccaccuucagccaguacaccgugguggacgagaacgccgucgccaagaucgacgcggccagcccccuggagaaggugugccugaucggcugcggcuucuccaccggguacggcuccgccgugaacgucgccaaggugacccccgggagcacgugcgccguguucggccucggcggggucggccuguccgcgaucauggggugcaaggccgccggcgccgcccggaucaucgcgguggacaucaacaaggacaaguucgccaaggccaaggagcugggggccaccgagugcaucaacccgcaggacuacaagaagcccauccaggagguccucaaggagaugaccgacggcggcguggacuucagcuucgaggugaucgggcgccuggacaccaugauggccucccugcucugcugccacgaggcgugcggcaccagcgucaucgugggggugccgcccgacucccagaaccugagcaugaaccccaugcugcuccugacgggccggaccuggaagggggccauccugggcggcuucaaguccaaggagugcguccccaagcucguggccgacuucauggccaagaaguucagccuggacgcccugaucacccacgugcuccccuucgagaagaucaacgagggguucgaccugcugcacagcggcaaguccauccgcaccauccucauguucuga

SEQ ID NO: 26390 - RNA, 1128 nt, Artificial Sequence
  derived and/or modified sequence opt1 from ADH1B__Homo_sapiens__NP_000659
augagcaccgccggcaaggugaucaagugcaaggccgcgguccugugggaggugaagaagcccuucuccaucgaggacguggaggucgccccgcccaaggccuacgaggugcgcaucaagaugguggccgucgggaucugccacaccgacgaccacguggugagcggcaaccucgucacgccccugcccgugauccuggggcacgaggccgcgggcaucguggaguccgucggggagggcgugaccaccgugaagccgggcgacaaggucaucccccucuucacgccccagugcgggaagugccgggugugcaagaaccccgagagcaacuacugccugaagaacgaccugggcaacccgcgcgggacccuccaggacggcacccggcgcuucacgugccgggggaagcccauccaccacuuccugggcaccuccaccuucagccaguacaccguggucgacgagaacgccguggccaagaucgacgccgcgagcccccuggagaaggugugccucaucggcugcggguucuccaccggcuacggguccgccgucaacguggccaaggugacccccggcagcacgugcgccgucuucggccucgggggcguggggcuguccgccgucaugggcugcaaggcggccggggccgcccgcaucaucgccguggacaucaacaaggacaaguucgcgaaggccaaggagcugggcgccaccgagugcaucaacccgcaggacuacaagaagcccauccaggaggugcugaaggagaugaccgacggcggggucgacuucagcuucgaggugaucggccggcuggacaccaugauggccucccuccugugcugccacgaggccugcgggacgagcgugaucgucggcgugccgcccgcgucccagaaccugagcaucaaccccaugcuccugcugaccgggcgcaccuggaagggcgccguguacggcggguucaaguccaaggagggcauccccaagcucgucgccgacuucauggccaagaaguucagccuggacgcccugaucacccacgugcuccccuucgagaagaucaacgagggguucgaccugcugcacuccggcaagagcauccggacggugcucaccuucuga

SEQ ID NO: 26391 - RNA, 1143 nt, Artificial Sequence
  derived and/or modified sequence opt1 from ADH4__Homo_sapiens__NP_000661
augggcaccaaggggaaggugaucaagugcaaggccgccaucgcgugggaggccggcaagccccugugcaucgaggaggucgagguggccccgcccaaggcccacgaggugcgcauccagaucaucgccaccagccucugccacacggacgcgaccgucaucgacuccaaguucgaggggcuggccuuccccgugaucgugggccacgaggccgccgggaucgucgagagcaucggccccggcgugaccaacgugaagccgggggacaaggucaucccccuguacgcgccccucugccggaagugcaaguucugccugagcccccugaccaaccucugcggcaagaucuccaaccugaaguccccggccagcgaccagcagcugauggaggacaagacgucccgcuucacgugcaaggggaagcccguguaccacuucuucggcaccagcaccuucucccaguacaccguggucagcgacaucaaccucgccaagaucgacgacgacgccaaccuggagcgggugugccugcucgggugcggcuucuccaccggcuacggggccgcgaucaacaacgccaaggugacccccggcagcacgugcgccgucuucgggcugggcggcguggggcuguccgccgugaugggcugcaaggccgcgggggccagccgcaucaucggcaucgacaucaacuccgagaaguucgucaaggccaaggcccucggggccaccgacugccugaacccccgggaccugcacaagccgauccaggaggugaucaucgagcucaccaagggcggcguggacuucgcgcuggacugcgccgggggcagcgagaccaugaaggccgcccuggacugcaccacggccggguggggcuccugcaccuucaucggggucgcggccggcagcaagggccucaccaucuuccccgaggagcugaucaucgggcgcaccaucaacggcacguucuucgggggcuggaaguccguggacagcauccccaagcuggugaccgacuacaagaacaagaaguucaaccucgacgcccuggucacccacacccugcccuucgacaagaucagcgaggccuucgaccucaugaaccaggggaaguccgugcggacgauccugaucuucuga

SEQ ID NO: 26392 - RNA, 1125 nt, Artificial Sequence
  derived and/or modified sequence opt1 from ADH5__Homo_sapiens__NP_000662
auggccaacgaggugaucaagugcaaggccgcggucgccugggaggccggcaagccccugagcaucgaggagaucgagguggccccgcccaaggcccacgaggugcgcaucaagaucaucgcgaccgccgucugccacaccgacgccuacacgcucuccggggccgaccccgagggcugcuuccccgugauccuggggcacgagggcgcggggaucguggagagcgucggcgagggcgugaccaagcugaaggccggggacaccgugaucccgcucuacaucccccagugcggcgagugcaaguucugccugaaccccaagaccaaccugugccagaagauccgggucacgcaggggaagggccucaugcccgacgggaccucccgcuucacgugcaagggcaagaccauccugcacuacaugggcaccagcaccuucuccgaguacaccgugguggccgacaucagcgucgccaagaucgacccgcuggcgccccucgacaaggugugccugcuggggugcggcaucuccaccggguacggcgccgccgugaacacggccaagcucgagcccggcagcgucugcgccguguucgggcugggcggggugggccuggccgucaucauggggugcaagguggcgggcgccucccggaucaucggcguggacaucaacaaggacaaguucgcccgcgccaaggaguucggggccaccgagugcaucaacccccaggacuucagcaagccgauccaggagguccucaucgagaugaccgacggcgggguggacuacuccuucgagugcaucggcaacgugaaggucaugcgggcggcccuggaggccugccacaagggguggggcgugagcgucguggugggcgucgccgccuccggggaggagaucgcgacccgccccuuccagcuggugacgggccggaccuggaaggggaccgccuucggcggguggaaguccguggagagcguccccaagcucgugagcgaguacauguccaagaagaucaagguggacgaguucgucacccacaaccugagcuucgacgagaucaacaaggccuucgagcugaugcacuccggcaagagcauccgcacgguggugaagaucuga

SEQ ID NO: 26393 - RNA, 1107 nt, Artificial Sequence
  derived and/or modified sequence opt1 from ADH6__Homo_sapiens__NP_000663
augagcaccaccggccaggugauccgcugcaaggccgccauccuguggaagcccggggcgccguucuccaucgaggaggucgagguggccccgcccaaggccaaggaggugcggaucaaggucguggccacgggccucugcgggaccgagaugaaggugcugggcagcaagcaccuggaccuccuguaccccaccauccuggggcacgagggcgccggcaucgucgaguccaucggggagggcgugagcaccgugaagcccggggacaaggucaucacccucuuccugccccagugcggcgagugcaccuccugccugaacagcgaggggaacuucugcauccaguucaagcaguccaagacccagcucaugagcgacggcaccucccgcuucacgugcaagggcaagagcaucuaccacuucgggaacaccuccaccuucugcgaguacaccgugaucaaggagaucagcguggcgaagaucgacgccgucgcgccccuggagaaggugugccugaucuccugcggcuucagcacgggguucggcgccgccaucaacaccgccaaggugacccccggcuccacgugcgccgucuucgggcucggcggggugggccugagcguggucauggggugcaaggccgccggcgcggcccggaucaucggcguggacgugaacaaggagaaguucaagaaggcccaggagcugggggccacggagugccucaacccgcaggaccugaagaagcccauccaggagguccuguucgacaugaccgacgccggcaucgacuucugcuucgaggcgaucgggaaccucgacgugcuggccgccgcccuggccuccugcaacgagagcuacggcgugugcgucguggucggggugcuccccgcguccgugcagcugaagaucagcggccagcuguucuucagcggccgcucccucaaggggagcgucuucggcggguggaagucccggcagcacauccccaagcugguggccgacuacauggccgagaagcugaaccucgacccgcugaucacccacacccugaaccucgacaagaucaacgaggccguggagcugaugaagacgggcaagugguga

SEQ ID NO: 26394 - RNA, 1161 nt, Artificial Sequence
  derived and/or modified sequence opt1 from ADH7__Homo_sapiens__NP_000664
auguucgccgagauccagauccaggacaaggaccgcaugggcaccgccgggaaggugaucaagugcaaggcggccguccugugggagcagaagcagcccuucagcaucgaggagaucgagguggccccgcccaagaccaaggaggugcggaucaagauccucgccacgggcaucugccgcaccgacgaccacgucaucaaggggaccaugguguccaaguuccccgugaucgucggccacgaggccaccgggaucguggagagcaucggcgagggcgugacgaccgucaagcccggggacaaggugaucccgcuguuccugccccagugccgggagugcaacgcgugccgcaaccccgacggcaaccucugcauccgguccgacaucaccgggcgcggcgugcuggccgacgggaccacgcgguucacgugcaagggcaagcccguccaccacuucaugaacaccagcaccuucaccgaguacaccgugguggacgaguccagcgucgccaagaucgacgacgccgcgccgcccgagaaggugugccugaucggcugcggguucuccaccggcuacggggccgccgugaagaccggcaaggucaagcccggcagcacgugcgugguguucgggcucggcggggucggccuguccgugaucauggggugcaagagcgccggcgccucccgcaucaucggcaucgaccugaacaaggacaaguucgagaaggcgauggccgugggggccaccgagugcaucagccccaaggacuccaccaagccgaucagcgagguccucuccgagaugaccggcaacaacgugggguacacguucgaggucaucggccaccuggagaccaugaucgacgcccuggccagcugccacaugaacuacgggaccuccgugguggucggcgugccgcccagcgcgaagaugcucaccuacgaccccaugcugcuguucacgggccggaccuggaaggggugcguguucggcgggcucaagucccgcgacgacguccccaagcuggugaccgaguuccuggccaagaaguucgaccucgaccagcugaucacccacgugcugcccuucaagaagaucagcgagggcuucgagcuccugaacagcgggcaguccauccggacgguccugaccuucuga

SEQ ID NO: 26395 - RNA, 1404 nt, Artificial Sequence
  derived and/or modified sequence opt1 from ADHFE1__Homo_sapiens__NP_653251
auggccgccgcggcccgcgcccggguggccuaccugcuccgccagcugcagcgggccgcgugccagugccccacccacagccacaccuacucccaggccccgggccugagccccuccgggaagacgaccgacuacgccuucgagauggccgucagcaacauccgcuacggcgcggccgugaccaaggagguggggauggaccucaagaacaugggcgccaagaacgucugccugaugaccgacaagaaccuguccaagcucccgcccguccagguggccauggacagccuggugaagaacgggauccccuucacgguguacgacaacgugcgggucgagcccaccgacuccagcuucauggaggccaucgaguucgcgcagaagggcgccuucgacgccuacguggccgugggcgggggcuccaccauggacacgugcaaggccgcgaaccuguacgccagcagcccccacuccgacuuccucgacuacgucuccgcccccaucgggaagggcaagccggugagcgugccccugaagccccugaucgccguccccaccaccuccgggaccggcagcgagaccacgggcguggccaucuucgacuacgagcaccucaaggugaagaucgggaucaccucccgcgcgaucaagccgacccugggccugaucgacccccuccacacccugcacaugcccgcccgggucguggccaacagcggguucgacgugcugugccacgcccucgaguccuacacgacccugcccuaccaccuccgcagcccgugccccagcaaccccaucacccggcccgccuaccagggcuccaacccgaucagcgacaucugggcgauccacgcccuccgcaucgucgccaaguaccugaagcgggccgugcgcaaccccgacgaccuggaggcgcggucccacaugcaccucgccagcgccuucgccggcaucggguucggcaacgccggggugcaccugugccacggcauguccuaccccaucagcgggcuggucaagauguacaaggcgaaggacuacaacguggaccacccccucgucccgcacggccuguccguggugcugaccagccccgccgucuucacguucaccgcccagauguuccccgagcgccaccucgagauggccgagauccugggcgccgacacccggaccgcgcgcauccaggacgccgggcuggugcucgccgacacgcugcggaaguuccuguucgaccucgacguggacgacggccuggccgccgucggguacuccaaggcggacauccccgcccuggugaagggcacccucccgcaggagcgcgugaccaagcuggcccccugcccccagagcgaggaggaccuggccgcgcuguucgaggccuccaugaagcuguacuga

SEQ ID NO: 26396 - RNA, 540 nt, Artificial Sequence
  derived and/or modified sequence opt1 from ADI1__Homo_sapiens__NP_060739
auggugcaggccugguacauggacgacgcccccggcgacccgcgccagccccaccggcccgaccccgggcgcccggucggccuggagcagcuccggcgccugggggugcuguacuggaagcucgacgcggacaaguacgagaacgaccccgagcuggagaagauccggcgcgagcggaacuacagcuggauggacaucaucaccaucugcaaggacaagcugcccaacuacgaggagaagaucaagauguucuacgaggagcaccuccaccuggacgacgagauccgcuacauccuggacggcuccggguacuucgacgugcgggacaaggaggaccaguggauccgcaucuucauggagaagggcgacauggucacccuccccgccggcaucuaccaccgguucacgguggacgagaagaacuacaccaaggccaugcgccuguucgugggggagccggucuggaccgccuacaaccggcccgccgaccacuucgaggcgcgcggccaguacgugaaguuccuggcccagaccgccuga

SEQ ID NO: 26397 - RNA, 243 nt, Artificial Sequence
  derived and/or modified sequence opt1 from ADIG__Homo_sapiens__NP_001018092
augaaguacccccugaugccgcucgugaacgaccugaccuucagcuuccuggucuucugguucugccuccccgugggccugcugcuccugcugaucaucuggcuccgcuuccugcugucccaggacagcgaggagaacgacuccagcgugugccucgacugggagcccugguccaaggggcccgccgaguucugcuggaagggcacccugcacgggcaggagaaggagcggccgugcugguga

SEQ ID NO: 26398 - RNA, 735 nt, Artificial Sequence
  derived and/or modified sequence opt1 from ADIPOQ__Homo_sapiens__NP_001171271
augcugcuccugggcgccgugcugcuccugcuggcccuccccgggcacgaccaggagaccaccacgcagggcccggggguccugcugccccuccccaagggcgcgugcaccggguggauggccggcauccccggccacccggggcacaacggcgcccccgggcgcgacggccgggacgggacccccggcgagaagggcgagaagggggaccccggccugaucgggccgaagggcgacaucggcgagaccggggugcccggcgccgaggggccccgcggcuuccccgggauccagggccggaagggcgagccgggggagggcgccuacguguaccgcagcgcguucuccgucgggcuggagacguacgugaccauccccaacaugcccauccgguucaccaagaucuucuacaaccagcagaaccacuacgacggcagcaccgggaaguuccacugcaacauccccggccucuacuacuucgccuaccacaucacgguguacaugaaggacgucaaggugucccuguucaagaaggacaaggccaugcuguucaccuacgaccaguaccaggagaacaacguggaccaggccagcggcuccguccuccugcaccuggaggugggggaccagguguggcuccaggucuacggcgagggggagcgcaacggccuguacgcggacaacgacaacgacagcaccuucaccggguuccugcucuaccacgacacgaacuga

SEQ ID NO: 26399 - RNA, 1128 nt, Artificial Sequence
  derived and/or modified sequence opt1 from ADIPOR1__Homo_sapiens__NP_001277558
augagcucccacaagggcagcguggucgcccaggggaacggcgcccccgcguccaaccgcgaggccgacaccguggagcuggccgagcucgggccgcugcuggaggagaagggcaagcgggugaucgccaacccgcccaaggccgaggaggagcagaccugccccgucccccaggaggaggaggaggaggugcgcgugcucacgcugccccugcaggcgcaccacgccauggagaagauggaggaguucgucuacaaggugugggaggggcgguggcgcgugauccccuacgacguccuccccgacuggcugaaggacaacgacuaccugcuccacggccaccggccgcccaugcccagcuuccgcgccugcuucaaguccaucuuccggauccacaccgagaccggcaacaucuggacccaccuccugggguucguccucuuccuguuccugggcauccucacgaugcugcgccccaacauguacuucauggccccgcugcaggagaaggugguguucgggauguucuuccucggcgcggugcugugccugagcuucuccuggcuguuccacaccguguacugccacagcgagaaggucucccggaccuucagcaagcuggacuacuccgggaucgcccugcucaucaugggcagcuucgugcccuggcuguacuacuccuucuacugcagcccccagccccgccugaucuaccucuccaucgugugcguccugggcaucagcgccaucaucguggcccagugggaccgguucgccaccccgaagcaccgccagacgcgggcggggguguuccugggccucgggcuguccggcgucgugcccaccaugcacuucaccaucgccgagggcuucgugaaggccaccacggucgggcagaugggcugguucuuccugauggccgugauguacaucaccggggccggccucuacgcggcccgcauccccgagcgguucuuccccgggaaguucgacaucugguuccagagccaccagaucuuccacguccuggugguggccgccgccuucguccacuucuacggcguguccaaccugcaggaguuccgcuacggccucgagggcgggugcaccgacgacacccugcuguga

SEQ ID NO: 26400 - RNA, 1161 nt, Artificial Sequence
  derived and/or modified sequence opt1 from ADIPOR2__Homo_sapiens__XP_006719081
augaacgagcccaccgagaaccgccugggcugcagccggaccccggagcccgacauccgccuccggaaggggcaccagcuggacggcacgcgccgcggggacaacgacucccaccagggcgaccuggagcccauccucgaggccagcgugcuguccagccaccacaagaaguccagcgaggagcacgaguacuccgacgaggcgccccaggaggacgagggguucaugggcaugagcccgcugcuccaggcccaccacgccauggagaagauggaggaguucgucugcaaggugugggagggccgcuggcgggugaucccccacgacguccugcccgacuggcugaaggacaacgacuuccuccugcacgggcaccggcccccgaugcccuccuuccgggccugcuucaagagcaucuuccgcauccacaccgagaccggcaacaucuggacccaccuccuggggugcguguucuuccugugccugggcaucuucuacauguuccggcccaacaucuccuucguggcgccccuccaggagaaggucguguucgggcuguucuuccugggcgccauccucugccugagcuucuccuggcuguuccacacgguguacugccacagcgagggcgucucccgccucuucagcaagcuggacuacuccgggaucgcccugcucaucaugggcagcuucgugccguggcuguacuacuccuucuacugcaacccccagcccugcuucaucuaccugaucgugaucugcguccucgggaucgccgccaucaucgugagccagugggacauguucgccacgccccaguaccggggcgugcgcgcgggcgucuuccuggggcugggccucagcgggaucaucccgacccugcacuacgugaucuccgagggcuuccugaaggccgccaccaucgggcagaucggcuggcucaugcugauggccagccuguacaucaccggcgccgcgcucuacgccgcccggauccccgagcgcuucuuccccgggaagugcgacaucugguuccacucccaccagcuguuccacaucuucguggucgccggcgccuucgugcacuuccacggggugagcaaccugcaggaguuccgguucaugaucggcgggggcugcuccgaggaggacgcgcucuga

SEQ ID NO: 26401 - RNA, 231 nt, Artificial Sequence
  derived and/or modified sequence opt1 from ADIRF__Homo_sapiens__NP_006820
auggccagcaagggccugcaggaccucaagcagcagguggaggggaccgcccaggaggcggucuccgccgccggcgccgccgcgcagcaggugguggaccaggccaccgaggccgggcagaaggccauggaccagcuggcgaagacgacccaggagaccaucgacaagaccgccaaccaggccagcgacacguucuccggcaucgggaagaaguucggccugcucaaguga

SEQ ID NO: 26402 - RNA, 1038 nt, Artificial Sequence
  derived and/or modified sequence opt1 from ADK__Homo_sapiens__NP_001114
augaccagcgugcgcgagaacauccuguucggcauggggaacccccuccuggacaucuccgccgucguggacaaggacuuccuggacaaguacagccucaagccgaacgaccagauccuggccgaggacaagcacaaggagcuguucgacgagcucgugaagaaguucaaggucgaguaccacgcgggcggguccacccagaacagcaucaagguggcccaguggaugauccagcagccccacaaggccgccacguucuucggcugcaucgggaucgacaaguucggcgagauccugaagcggaaggccgcggaggcccacguggacgcccacuacuacgagcagaacgagcagcccaccgggaccugcgccgcgugcaucaccggggacaaccgcucccugaucgccaaccucgccgccgccaacugcuacaagaaggagaagcaccuggaccuggagaagaacuggaugcucgucgagaaggcgcgggugugcuacaucgccggcuucuuccugacggugagccccgaguccguccugaagguggcccaccacgccagcgagaacaaccgcaucuucacccucaaccuguccgccccguucaucagccaguucuacaaggagucccugaugaaggugaugcccuacgucgacauccucuucgggaacgagaccgaggcggccaccuucgcccgggagcagggcuucgagacgaaggacaucaaggagaucgccaagaagacccaggcccugcccaagaugaacagcaagcgccagcggaucgugaucuucacccaggggcgcgacgacaccaucauggcgacggaguccgaggugaccgccuucgccguccuggaccaggaccagaaggagaucaucgacaccaacggcgccggcgacgccuucgugggcggcuuccucagccagcugguguccgacaagccccugaccgagugcauccgggcggggcacuacgccgccagcaucaucauccgccggacgggcugcaccuucccggagaagcccgacuuccacuga

SEQ ID NO: 26403 - RNA, 447 nt, Artificial Sequence
  derived and/or modified sequence opt1 from ADM2__Homo_sapiens__NP_001240774
auggcccgcauccccaccgccgcgcugggcugcaucagccuccugugccugcagcucccggggucccugagccggucccugggcggggacccccgccccgugaagccccgggagccgcccgcccgcagccccuccagcucccuccagccccggcacccggcgccccgccccgucguguggaagcugcaccgggcccugcaggcccagcgcggcgccgggcucgcccccgugaugggccagccgcugcgggacggcgggcgccagcacagcggcccccggcgccacuccgggccccggcgcacccaggcccagcugcuccgggucggcugcgugcuggggacgugccaggugcagaaccugagccaccgccucuggcagcugaugggccccgccggccggcaggacuccgcgccggucgaccccagcagcccccacuccuacggguga

SEQ ID NO: 26404 - RNA, 558 nt, Artificial Sequence
  derived and/or modified sequence opt1 from ADM__Homo_sapiens__NP_001115
augaagcuggugagcgucgcccucauguaccugggcucccuggccuuccucggggccgacaccgcccgccuggacguggccagcgaguuccggaagaaguggaacaagugggcccugucccgcggcaagcgggagcuccgcaugagcuccagcuaccccaccgggcuggccgacgugaaggcgggcccggcccagacgcugauccggccccaggacaugaagggggccucccgcagccccgaggacuccagccccgacgccgcgcggauccgcgucaagcgguaccgccaguccaugaacaacuuccagggccuccggagcuucggcugccgcuucgggaccugcaccgugcagaagcuggcccaccagaucuaccaguucaccgacaaggacaaggacaacguggccccgcgguccaagaucagcccccagggcuacgggcgccggcgccggcgcucccugcccgaggccggccccgggcggacgcucgucagcuccaagccgcaggcccacggcgcgcccgccccgcccagcggcuccgcgccccacuuccuguga

SEQ ID NO: 26405 - RNA, 3309 nt, Artificial Sequence
  derived and/or modified sequence opt1 from ADNP__Homo_sapiens__XP_011527049
auguuccagcugcccgugaacaaccucggcagccugcgcaaggcccggaagaccgucaagaagauccuguccgacaucgggcucgaguacugcaaggagcacaucgaggacuucaagcaguucgagccgaacgacuucuaccugaagaacaccacgugggaggacgugggccugugggaccccagccucaccaagaaccaggacuaccgcaccaagcccuucugcugcuccgccugccccuucagcuccaaguucuucagcgcguacaagucccacuuccggaacgugcacagcgaggacuucgagaaccgcauccugcugaacugcccguacugcaccuucaacgccgacaagaagacgcucgagacccacaucaagaucuuccacgcccccaacgccuccgcccccagcuccagccuguccaccuucaaggacaagaacaagaacgacgggcugaagcccaagcaggcggacagcgucgagcaggccguguacuacugcaagaagugcaccuaccgggacccgcucuacgagaucgugcgcaagcacaucuaccgggagcacuuccagcacgucgccgcccccuacaucgcgaaggccggcgagaagucccugaacggggccgugccccugggcagcaacgcccgcgaggaguccagcauccacugcaagcggugccucuucaugcccaaguccuacgaggcccuggugcagcacgucaucgaggaccacgagcgcaucggcuaccaggugacggcgaugaucgggcacaccaacguggucgugccgcggagcaagccccugaugcucaucgcccccaagccccaggacaagaaguccaugggccugccgccccgcaucgggagccuggccagcggcaacgugcggucccuccccagccagcagauggucaaccgccuguccauccccaagccgaaccugaacagcaccggggugaacaugauguccagcgugcaccuccagcagaacaacuacggcgucaaguccgugggccagggguacagcgugggccaguccaugcggcuggggcugggcggcaacgcccccgucagcaucccccagcagucccagagcgugaagcagcuccugcccuccgggaacggccgcagcuacgggcugggcuccgagcagcggagccaggccccggcgcgcuacucccuccagagcgccaacgccagcucccugagcuccgggcagcucaagagccccucccugagccagucccaggccagccgggugcugggccaguccagcuccaagcccgccgcggccgccaccgggcccccgcccgggaacacgagcuccacccagaaguggaagaucugcaccaucugcaacgagcuguuccccgagaacgucuacagcgugcacuucgagaaggagcacaaggccgagaaggucccggccguggcgaacuacaucaugaagauccacaacuucaccuccaagugccucuacugcaaccgcuaccugcccacggacacccugcucaaccacaugcugauccacggccugagcugccccuacugccgguccaccuucaacgacguggagaagauggccgcccacaugcgcaugguccacaucgacgaggagauggggcccaagaccgacagcacgcucagcuucgaccugacccugcagcagggcucccacaccaacauccaccuccuggugaccacguacaaccugcgcgacgccccggcggagagcguggccuaccacgcccagaacaacccgcccgucccgcccaagccccagcccaaggugcaggagaaggccgacauccccgugaaguccagcccccaggccgcgguccccuacaagaaggacguggggaagacccucugcccccugugcuucuccauccugaagggccccaucagcgacgcccuggcccaccaccuccgggagcgccaccaggugauccagaccguccacccgguggagaagaagcugaccuacaagugcauccacugccugggcguguacacguccaacaugaccgccagcaccaucacccuccaccugguccacugccggggcgugggcaagacgcagaacgggcaggacaagaccaacgcccccucccgccugaaccagagccccucccucgcgcccgugaagcggaccuacgagcagauggaguucccgcugcugaagaagcgcaagcucgacgacgacagcgacucccccagcuucuucgaggagaagcccgaggagcccgucgugcuggcccuggacccgaagggccacgaggacgacuccuacgaggcccgcaagagcuuccucaccaaguacuucaacaagcagcccuaccccacgcggcgggagaucgagaagcuggccgccucccuguggcucuggaaguccgacaucgcgagccacuucagcaacaagcgcaagaagugcgugcgggacugcgagaaguacaagccggggguccugcugggcuucaacaugaaggagcucaacaaggugaagcacgagauggacuucgacgccgaguggcuguucgagaaccacgacgagaaggacagccgcgugaacgccuccaagaccgccgacaagaagcugaaccucggcaaggaggacgacagcuccagcgacuccuucgagaaccuggaggaggagagcaacgaguccgggagccccuucgaccccgucuucgagguggagcccaagaucuccaacgacaacccggaggagcacgugcugaaggucauccccgaggacgcgagcgaguccgaggagaagcucgaccagaaggaggacggcagcaaguacgagaccauccaccugaccgaggagcccaccaagcugaugcacaacgccuccgacagcgagguggaccaggacgacguggucgaguggaaggacggggccucccccagcgaguccggcccgggcagccagcaggucuccgacuucgaggacaacacgugcgagaugaagcccgggaccuggagcgacgagagcucccagagcgaggacgcccgguccagcaagcccgccgcgaagaagaaggccaccaugcagggcgaccgcgagcagcucaaguggaagaacuccagcuacgggaagguggagggcuucugguccaaggaccagagccaguggaagaacgccuccgagaacgacgagcggcugagcaacccccagaucgaguggcagaacuccaccaucgacagcgaggacggggagcaguucgacaacaugacggacggcguggccgagccgaugcacggcucccuggccggggugaagcucagcucccagcaggcguga

SEQ ID NO: 26406 - RNA, 813 nt, Artificial Sequence
  derived and/or modified sequence opt1 from ADO__Homo_sapiens__NP_116193
augccccgcgacaacauggccagccugauccagcggaucgcccgccaggcgugccucaccuuccggggcuccgggggcgggcgcggcgccagcgaccgggacgccgccuccgggccggaggcccccaugcagcccggcuuccccgagaaccugagcaagcugaagucccuccugacccagcugcgcgcggaggaccucaacaucgccccgcggaaggccacccugcagccccugccgcccaaccucccgcccgugaccuacaugcacaucuacgagaccgacggcuucagccugggggucuuccugcucaaguccggcaccagcaucccccugcacgaccaccccgggaugcacggcaugcugaaggugcucuacgggacggugcgcaucuccugcauggacaagcuggacgccggcggcgggcagcggccccgcgcgcugccgcccgagcagcaguucgagccgccccuccagccccgggagcgcgaggccguccggcccggcgugcugcgcagccgggccgaguacaccgaggccuccgggcccugcauccugacgccccaccgcgacaaccuccaccagaucgacgccguggagggccccgcggccuuccuggacauccuggccccgcccuacgaccccgacgacggccgggacugccacuacuaccgcguccucgagcccgugcggcccaaggaggccagcuccagcgccugcgaccugccccgcgagguguggcugcucgagaccccgcaggcggacgacuucuggugcgagggggagcccuaccccggcccgaaggucuuccccuga

SEQ ID NO: 26407 - RNA, 981 nt, Artificial Sequence
  derived and/or modified sequence opt1 from ADORA1__Homo_sapiens__NP_000665
augcccccgagcaucuccgccuuccaggccgcguacaucggcaucgaggugcugaucgcccucgucagcgugcccgggaacgugcuggucaucugggccgugaaggugaaccaggcccugcgcgacgccaccuucugcuucaucgucucccucgcgguggccgacguggccgucggcgcccuggugaucccccuggcgauccucaucaacaucgggccccagaccuacuuccacacgugccugaugguggccugcccgguccugauccucacccagagcuccauccuggcccugcucgccaucgccguggaccgguaccugcgcgugaagaucccccugcgguacaagauggucgugacgccccgccgggcggccguggccaucgccggcugcuggauccucagcuucgucguggggcugacccccauguucggcuggaacaaccuguccgccguggagcgcgcgugggccgccaacggcagcaugggggagccggucaucaagugcgaguucgagaaggugaucuccauggaguacaugguguacuucaacuucuucgucugggugcucccgccccugcugcucaugguccugaucuaccuggagguguucuaccucauccggaagcagcugaacaagaaggugagcgccuccagcggcgacccccagaaguacuacgggaaggagcugaagaucgccaagucccucgcgcugauccuguuccucuucgcccugagcuggcugccccuccacauccugaacugcaucacccuguucugccccuccugccacaagcccagcauccucaccuacaucgccaucuuccugacccacggcaacuccgccaugaaccccaucgucuacgccuuccgcauccagaaguuccgggugaccuuccugaagaucuggaacgaccacuuccgcugccagccggcgccgcccaucgacgaggaccuccccgaggagcggcccgacgacuga

SEQ ID NO: 26408 - RNA, 1239 nt, Artificial Sequence
  derived and/or modified sequence opt1 from ADORA2A__Homo_sapiens__NP_001265429
augcccaucaugggcagcuccguguacaucaccgucgagcuggccaucgccgugcucgcgauccuggggaacgugcuggucugcugggccguguggcucaacagcaaccugcagaacgugaccaacuacuucgucgugucccuggccgccgccgacaucgcggugggcguccucgccaucccguucgccaucacgaucagcaccggguucugcgccgcgugccacggcugccuguucaucgccugcuucgugcuggugcucacccaguccagcaucuucucccugcuggccaucgccaucgaccgcuacaucgccauccggaucccccuccgcuacaacgggcuggucaccggcacgcgggcgaagggcaucaucgccaucugcugggugcugagcuucgccaucgggcucacccccaugcugggcuggaacaacugcgggcagcccaaggagggcaagaaccacucccaggggugcggcgagggccagguggccugccuguucgaggacgucgugccgaugaacuacaugguguacuucaacuucuucgccugcguccucgugccccugcugcucaugcuggggguguaccugcgcaucuuccucgcggcccggcgccagcugaagcagauggagagccagccccugcccggcgagcgggcccgcuccacccuccagaaggagguccacgccgccaagagccuggcgaucaucguggggcuguucgcccucugcuggcugccgcugcacaucaucaacugcuucaccuucuucugccccgacugcucccacgcgccccucuggcugauguaccuggccaucgugcucagccacacgaacuccgucgugaaccccuucaucuacgccuaccggauccgcgaguuccggcagaccuuccgcaagaucauccggagccacguccugcgccagcaggagccguucaaggccgccggcaccuccgcccgggugcuggccgcgcacggcagcgacggggagcaggucucccuccgccugaacggccacccgcccggggugugggccaacggcagcgcgccccaccccgagcggcgccccaacggguacgcccugggccucgugagcggcggguccgcccaggagagccagggcaacaccgggcugcccgacguggagcugcucucccacgagcugaagggcgucugccccgagccgcccgggcuggacgacccccucgcccaggacggcgccggcgugagcuga

SEQ ID NO: 26409 - RNA, 999 nt, Artificial Sequence
  derived and/or modified sequence opt1 from ADORA2B__Homo_sapiens__NP_000667
augcugcucgagacccaggacgcccuguacguggcccuggagcucgucaucgcggcccugagcguggccggcaacgugcuggucugcgccgccguggggaccgcgaacacgcuccagacccccaccaacuacuuccuggugucccuggccgccgccgacgucgcggugggccucuucgccaucccguucgccaucaccaucagccugggguucugcacggacuucuacggcugccuguuccucgccugcuucgugcugguccugacccaguccagcaucuucucccuccuggccguggcgguggaccgcuaccuggccaucugcgucccccuccgguacaagagccuggugaccgggacccgcgcccggggcgugaucgccguccugugggugcucgccuucggcaucgggcugacgcccuuccugggcuggaacuccaaggacagcgcgaccaacaacugcaccgagcccugggacgggaccacgaacgaguccugcugccucgugaagugccuguucgagaacgucgugccgaugagcuacaugguguacuucaacuucuucggcugcguccugccgccccuccugaucaugcuggugaucuacaucaagaucuuccucguggccugccgccagcugcagcggaccgagcugauggaccacucccgcaccacccuccagcgggagauccacgccgccaagagccuggccaugaucgucgggaucuucgcgcugugcuggcuccccgugcacgccgucaacugcgugacgcuguuccagcccgcccagggcaagaacaagcccaagugggccaugaacauggccauccugcucucccacgcgaacagcguggucaaccccaucguguacgccuaccgcaaccgggacuuccgcuacaccuuccacaagaucaucucccgguaccugcugugccaggccgacgucaagagcggcaacgggcaggccggcgugcagcccgcgcucggggugggccuguga

SEQ ID NO: 26410 - RNA, 1491 nt, Artificial Sequence
  derived and/or modified sequence opt1 from ADPGK__Homo_sapiens__NP_112574
auggcccuguggcgcggcagcgccuacgcgggguuccucgcccuggccgugggcugcgucuuccugcucgagcccgagcugccgggguccgcccugcggagccucugguccagccugugccugggccccgcccccgcgcccccggggcccgugucccccgagggccgccucgccgccgccugggacgcgcugaucgugcggcccguccgccgguggcgccggguggccgugggcgucaacgccugcguggacgugguccugagcggggugaagcuccugcaggcccugggccucuccccggggaacggcaaggaccacagcauccugcacucccgcaacgaccuggaggaggccuucauccacuucauggggaagggcgcggccgccgagcgguucuucagcgacaaggagaccuuccacgacaucgcccagguggccuccgaguuccccggcgcgcagcacuacgucgggggcaacgccgcccucaucgggcagaaguucgccgccaacagcgaccugaaggugcugcucugcggccccgugggccccaagcugcacgagcugcucgacgacaacgucuucgugccgcccgagucccugcaggagguggacgaguuccaccugauccucgaguaccaggcgggggaggaguggggccagcugaaggcgccccacgccaaccgcuucaucuucagccacgaccuguccaacggggccaugaacaugcucgaggucuucgugagcucccuggaggaguuccagcccgaccuggugguccucagcggccugcacaugauggaggggcaguccaaggagcugcagcggaagcgccuccuggagguggugaccagcaucagcgacaucccgacgggcauccccguccaccuggagcucgccuccaugaccaaccgggagcugaugagcuccaucgugcaccaggucuuccccgccgugaccagccugggccucaacgagcaggagcugcuguuccucacccaguccgccagcgggccccacuccagccuguccagcuggaacggcgugccggacgucgggaugguguccgacauccuguucuggauccucaaggagcacggccgcagcaagucccgggccagcgaccugacgcgcauccacuuccacacccugguguaccacauccuggccaccgucgacgggcacugggcgaaccagcucgccgccguggccgccggcgcgcggguggccggcacccaggccugcgccacggagaccaucgacaccucccgcgucagccugcgggcgccccaggaguucaugaccucccacagcgaggccgggucccgcaucgugcugaaccccaacaagcccguggucgaguggcaccgggagggcaucagcuuccacuucacgccggugcucgugugcaaggaccccauccgcaccgucgggcugggcgacgccaucagcgccgaggggcuguucuacuccgaggugcacccccacuacuga

SEQ ID NO: 26411 - RNA, 1074 nt, Artificial Sequence
  derived and/or modified sequence opt1 from ADPRH__Homo_sapiens__NP_001278878
auggagaaguacguggccgccaugguccugagcgcggccggcgacgcccucggguacuacaacggcaagugggaguuccugcaggacggggagaagauccaccgccagcuggcccagcucggcgggcuggacgcccuggacgugggccgguggcgcguguccgacgacaccgucaugcaccucgcgaccgccgaggcccugguggaggccggcaaggcgcccaagcugacgcagcucuacuaccugcuggccaagcacuaccaggacugcauggaggacauggacgggcgggccccgggcggggccagcgugcacaacgccaugcagcucaagcccggcaagcccaacggguggcgcauccccuucaacucccacgagggcggcugcggggcggccaugcgggccaugugcaucggccugcgcuucccgcaccacagccagcuggacacccucauccaggucuccaucgagagcgggcggaugacccaccaccaccccaccggcuaccugggcgcccuggccuccgcccucuucacggcguacgccgugaacagccgcccgccccugcagugggggaagggccugauggagcuccugcccgaggccaagaaguacaucgugcaguccggguacuucgucgaggagaaccugcagcacuggagcuacuuccagaccaagugggagaacuaccucaagcugcggggcauccuggacggggaguccgcccccaccuuccccgagagcuucggcgugaaggagcgcgaccaguucuacaccucccucagcuacuccggcuggggcgggagcuccgggcacgacgcgcccaugaucgccuacgacgccgugcuggccgccggcgacagcuggaaggagcuggcgcaccgggccuucuuccacgggggcgacuccgacagcacggccgccaucgcgggcugcugguggggcgucauguacggguucaagggggugagcccguccaacuacgagaagcucgaguaccgcaaccggcuggaggagaccgcccgcgcccuguacagccucggcuccaaggaggacaccgugaucagccuguga

SEQ ID NO: 26412 - RNA, 1065 nt, Artificial Sequence
  derived and/or modified sequence opt1 from ADPRHL1__Homo_sapiens__NP_612439
auggagaaguucaaggccgccaugcugcucggcagcgugggggacgcgcugggcuaccgcaacgucugcaaggagaacuccaccguggggaugaagauccaggaggagcugcagcggagcggcgggcucgaccaccuggugcugucccccggcgaguggccggucagcgacaacaccaucaugcacaucgccacggccgaggcccucaccaccgacuacuggugccuggacgaccuguaccgcgagauggugcggugcuacguggagaucgucgagaagcuccccgagcgccggcccgaccccgccaccaucgagggcugcgcgcagcugaagccgaacaacuaccugcucgccuggcacacgcccuucaacgagaagggguccggcuucggggccgccaccaaggcgaugugcaucggccugcgcuacuggaagcccgagcggcuggagacccucaucgaggugagcguggagugcgggcgcaugacccacaaccaccccacgggcuuccugggcucccugugcaccgcccucuucgucagcuucgccgcccaggggaagccgcuggugcaguggggccgggacaugcugcgcgccgugccccucgcggaggaguacugccggaagaccauccgccacaccgccgaguaccaggagcacugguucuacuucgaggccaaguggcaguucuaccuggaggagcggaagaucuccaaggacagcgagaacaaggccaucuuccccgacaacuacgacgccgaggagcgcgagaagacguaccggaagugguccagcgaggggcgcggcggccggcgcgggcacgacgcgcccaugaucgccuacgacgcccugcucgccgccggcaacuccuggaccgagcugugccaccgggcgauguuccacgggggcgagagcgccgccaccgggaccaucgccggcugccuguucggccuccuguacgggcuggaccucgucccgaagggccuguaccaggaccuggaggacaaggagaagcucgaggaccugggggccgcgcuguaccgccucuccacggaggagaaguga

SEQ ID NO: 26413 - RNA, 630 nt, Artificial Sequence
  derived and/or modified sequence opt1 from ADPRHL2__Homo_sapiens__XP_011539938
augcgcguggccggcaucagccuggccuacuccagcguccaggacgugcagaaguucgcgcggcucuccgcccagcugacccacgccagcucccugggguacaacggcgccauccuccaggcccuggcggugcaccuggcccuccagggggagagcuccagcgagcacuuccugaagcagcugcucggccacauggaggaccuggagggggacgcccaguccguccuggacgcccgcgagcucggcauggaggagcggcccuacagcucccgccugaagaagaucggcgagcugcucgaccaggcgagcgugacccgggaggagguggucuccgagcuggggaacggcaucgccgccuucgagagcgugccgacggccaucuacugcuuccugcgcugcauggagcccgaccccgagauccccuccgccuucaacagccuccagcggacccugaucuacuccaucagccucgggggcgacaccgacaccaucgcgacgauggccggggccaucgccggcgccuacuacggcauggaccaggugccggaguccuggcagcagagcugcgagggguacgaggagaccgacauccuggcgcagagccugcaccgcgucuuccagaaguccuga

SEQ ID NO: 26414 - RNA, 1401 nt, Artificial Sequence
  derived and/or modified sequence opt1 from ADRA1A__Homo_sapiens__NP_000671
augguguuccugagcggcaacgccuccgacagcuccaacugcacccagcccccggcccccgucaacaucagcaaggcgauccuccugggggugauccugggcgggcucauccuguucggcgugcuggggaacauccucgucauccuguccguggccugccaccgccaccuccacagcgugacccacuacuacaucgucaaccucgccguggccgaccugcugcucacguccaccgugcugcccuucagcgccaucuucgagguccugggcuacugggcguucggccggguguucugcaacaucugggccgccguggacguccucugcugcaccgccuccaucauggggcugugcaucaucagcaucgaccgcuacaucggcguguccuacccccugcgguacccgaccaucgugacgcagcgccgggggcucauggcgcugcugugcgucugggcccucagccuggugaucuccaucggcccccuguucggguggcgccagcccgcccccgaggacgagaccaucugccagaucaacgaggagccgggcuacgugcuguucagcgcccugggcuccuucuaccugccccucgccaucauccuggucauguacugccggguguacguggucgcgaagcgcgagagccgggggcugaaguccggccucaagaccgacaagagcgacuccgagcaggucacccugcgcauccaccggaagaacgcccccgccgggggcagcggcauggccagcgccaagacgaagacccacuucuccgugcgccugcucaaguucagccgggagaagaaggcggccaagacccuggggaucguggugggcugcuucguccugugcuggcuccccuucuuccuggugaugccgaucggguccuucuuccccgacuucaagcccagcgagaccguguucaagaucgucuucuggcugggcuaccucaacuccugcaucaaccccaucaucuacccgugcagcucccaggaguucaagaaggccuuccagaacgugcugcgcauccagugccugugccggaagcagagcuccaagcacgcccucggguacacgcugcacccgcccagccaggccguggagggccagcacaaggacaugguccgcauccccgugggcucccgggagaccuucuaccgcaucagcaagaccgacggggugugcgaguggaaguucuucuccagcaugccccggggcuccgcgcgcaucaccgucagcaaggaccaguccagcugcacgaccgcccgggugcgcuccaagagcuuccuccaggugugcugcugcgucgggcccagcacccccucccuggacaagaaccaccaggugcccaccaucaaggugcacacgaucagccuguccgagaacggcgaggaggucuga

SEQ ID NO: 26415 - RNA, 1563 nt, Artificial Sequence
  derived and/or modified sequence opt1 from ADRA1B__Homo_sapiens__NP_000670
augaaccccgaccuggacaccggccacaacaccagcgccccggcccacuggggcgagcucaagaacgcgaacuucacggggcccaaccagaccuccagcaacuccacccugccccagcuggacaucacccgcgccaucagcguggggcucguccugggcgccuucauccuguucgccaucguggggaacauccucgugauccuguccgucgccugcaaccggcaccuccgcacgcccaccaacuacuucaucgugaaccucgcgauggccgaccugcugcucagcuucaccgugcugccguucuccgccgcccuggagguccucggcuacugggugcugggccggaucuucugcgacaucugggcggccguggacguccugugcugcaccgccagcauccucucccugugcgccaucagcaucgaccgcuacaucggggugcgguacucccugcaguaccccacgcucgugacccgccggaaggccauccuggcgcugcucagcgucugggugcuguccaccgugaucagcaucggcccccugcucggguggaaggagcccgccccgaacgacgacaaggagugcggcgucaccgaggagcccuucuacgcccuguucuccagccugggguccuucuacaucccccucgccgugauccuggugauguacugccgcgucuacaucguggccaagcggacgaccaagaaccuggaggcgggcgugaugaaggagaugagcaacuccaaggagcucacccugcgcauccacagcaagaacuuccacgaggacacccugagcuccacgaaggccaagggccacaacccccggagcuccaucgccgucaagcuguucaaguucagccgcgagaagaaggccgccaagacccuggggaucguggugggcauguucauccugugcuggcucccguucuucaucgcgcugccccuggggucccucuucagcacccugaagccgcccgacgccgucuucaagguggucuucuggcugggcuacuucaacuccugccucaaccccaucaucuaccccugcagcuccaaggaguucaagcgggccuucgugcgcauccugggcugccagugccgggggcgcggccggcgccggcgccggcgccgccggcgccucgggggcugcgccuacaccuaccggcccuggacgcgcgggggcagccuggagcggucccagagccgcaaggacucccuggacgacagcggcuccugccugagcgggucccagcggacccugcccagcgccuccccgagccccggcuaccucgggcgcggcgcgcccccgcccguggagcugugcgccuuccccgaguggaaggcccccggggcccugcucagccugcccgcgccggagccgcccggccggcgcggccggcacgacuccgggccccuguucaccuucaagcuccugaccgagcccgagagccccggcacggacgggggcgccuccaacgggggcugcgaggccgccgccgacgucgcgaacggccagcccggguucaagagcaacaugccgcuggcccccggccaguucuga

SEQ ID NO: 26416 - RNA, 1719 nt, Artificial Sequence
  derived and/or modified sequence opt1 from ADRA1D__Homo_sapiens__NP_000669
augaccuuccgcgaccugcucagcguguccuucgagggcccccggccggacagcuccgccgggggcagcuccgccgggggcgggggcggcagcgccgggggcgccgcccccuccgaggggcccgccgucggcggggugcccggcggcgccgggggcgggggcggcguggucggggcgggcagcggggaggacaaccgcuccagcgccggcgagccgggguccgccggcgccggcggggacgugaacggcaccgcggccgucgggggccugguggugagcgcccagggggugggcgucggcguguuccuggccgccuucauccucauggcgguggccgggaaccugcuggucauccucuccguggccugcaaccggcaccuccagacggugaccaacuacuucaucgucaaccuggccguggccgaccugcugcugagcgcgaccgugcuccccuucuccgccaccauggagguccugggcuucugggccuucgggcgcgccuucugcgacgugugggccgcgguggacguccugugcugcacggccagcauccucucccugugcaccaucagcguggaccgguacgugggcguccgccacucccugaaguaccccgccaucaugaccgagcggaaggccgccgcgauccucgcccugcuguggguggucgcccucguggugagcgucgggccccugcugggcuggaaggagccggugccgcccgacgagcgcuucugcggcaucaccgaggaggccggguacgcgguguucagcuccgucugcagcuucuaccuccccauggccgugaucguggucauguacugccggguguacguggucgcccgcuccacgacccggagccuggaggccggcgugaagcgcgagcgggggaaggccuccgaggugguccugcgcauccacugccggggcgcggccaccggcgccgacggggcccacggcaugcgcagcgccaaggggcacaccuuccgguccagccucuccgugcgccugcugaaguucagccgggagaagaaggcggccaagacgcucgccaucguggucggcguguucgugcugugcugguuccccuucuucuucguccugccccucgggucccuguucccccagcugaagcccagcgagggcguguucaaggugaucuucuggcucggcuacuucaacuccugcgucaacccgcugaucuaccccugcagcucccgcgaguucaagcgggccuuccugcgccuccugcgcugccagugccggcgccggcgccggcgccggccccuguggcgcguguacgggcaccacuggcgggccagcaccuccggccuccgccaggacugcgcgcccagcuccggggacgccccgcccggcgcgccccuggcccugaccgcgcuccccgacccggaccccgagccgcccgggacccccgagaugcaggcccccguggccagccggcgcaagcccccgagcgccuuccgggaguggcgccugcugggccccuuccggcgccccacgacccagcuccgggccaaggucuccagccugucccacaagauccgcgcgggcggggcccagcgggccgaggccgccugcgcgcagcgcagcgagguggaggccgugucccugggcgucccccacgagguggccgagggggcgaccugccaggccuacgagcuggccgacuacagcaaccuccgcgagaccgacaucuga

SEQ ID NO: 26417 - RNA, 1398 nt, Artificial Sequence
  derived and/or modified sequence opt1 from ADRA2A__Homo_sapiens__NP_000672
auguuccgccaggagcagccccuggccgagggcagcuucgccccgauggggucccuccagcccgacgcgggcaacgccagcuggaacgggaccgaggcccccggcgggggcgcccgggccacccccuacucccuccaggugacgcugacccuggucugccuggcgggccugcucaugcugcugaccguguucgggaacgugcucgucaucaucgccguguucaccagccgcgcccugaaggccccgcagaaccuguuccucgugucccuggcgagcgccgacauccuggucgccacgcucgugauccccuucucccuggccaacgaggugaugggcuacugguacuucgggaaggccuggugcgagaucuaccuggcgcucgacguccuguucugcaccagcuccaucgugcaccugugcgccaucagccucgaccgguacugguccaucacccaggccaucgaguacaaccugaagcgcacgccccggcgcaucaaggccaucaucaucaccgugugggucaucagcgccgugaucuccuucccgccccugaucagcaucgagaagaagggcgggggcggcgggccccagcccgcggagccccggugcgagaucaacgaccagaagugguacgugaucuccagcugcaucggcuccuucuucgccccgugccucaucaugauccuggucuacgugcgcaucuaccagaucgccaagcggcgcacccgggugccgcccagccgccgggggcccgacgccgucgccgcgccgcccggcggcaccgagcgccggcccaacgggcugggccccgagcgcuccgccgggcccggcggggccgaggccgagccccuccccacccagcugaacggcgcccccggcgagccggcgcccgccgggccccgggacacggacgcccuggaccucgaggagagcagcuccagcgaccacgccgagcggcccccgggcccccgccgccccgagcgggggccgcgcggcaaggggaaggcgcgcgccucccaggugaagcccggcgacagccugccccggcgcggccccggggccaccggcaucgggaccccggccgccggccccggggaggagcgggugggcgcggccaaggccucccgcuggcggggccgccagaaccgggagaagcgcuucaccuucguccuggccguggugaucggggucuucguggucugcugguuccccuucuucuucacguacacccucaccgccgugggcugcagcgugccccggacccuguucaaguucuucuucugguucggguacugcaacuccagccugaacccggucaucuacacgaucuucaaccacgacuuccgccgggcguucaagaagauccucugccgcggcgaccggaagcgcaucguguga

SEQ ID NO: 26418 - RNA, 1353 nt, Artificial Sequence
  derived and/or modified sequence opt1 from ADRA2B__Homo_sapiens__NP_000673
auggaccaccaggaccccuacagcgugcaggccaccgccgcgaucgccgccgccaucaccuuccugauccucuucacgaucuucggcaacgcccuggucauccuggcggugcucaccucccgcagccugcgggccccgcagaaccuguuccucgugucccuggccgccgcggacauccuggucgccacccucaucauccccuucagccuggccaacgagcugcucggguacugguacuuccgccggaccuggugcgagguguaccuggcccuggacguccucuucugcacguccagcaucgugcaccugugcgccaucucccuggaccgcuacugggcggugagccgggcccucgaguacaacuccaagcgcacgccccggcgcaucaagugcaucauccugaccguguggcugaucgccgccgucaucagccugcccccgcucaucuacaagggcgaccaggggccccagccccggggccgcccccagugcaagcugaaccaggaggccugguacauccucgcguccagcaucggguccuucuucgccccgugccugaucaugauccugguguaccuccggaucuaccugaucgccaagcgcagcaaccggcgcggcccccgggccaagggcgggcccggccagggggaguccaagcagccccgcccggaccacggcggggcccuggcgagcgccaagcuccccgcccuggccuccguggccagcgcgcgggaggucaacggccacuccaagagcaccggcgagaaggaggagggggagacccccgaggacaccggcacccgcgcccugcccccgagcugggccgcccuccccaacuccgggcagggccagaaggagggcgugugcggggcgagccccgaggacgaggccgaggaggaggaggaggaggaggaggaggaggaggagugcgagccccaggccgugccggucucccccgccagcgccugcuccccgccccugcagcagccccagggcagccgggugcuggcgacccuccgcggccaggugcugcuggggcgcggggucggcgccaucggcgggcagugguggcggcgccgggcccagcucacgcgcgagaagcgguucaccuucgugcuggccguggucaucggcguguucgugcugugcugguuccccuucuucuucuccuacagccucggggccaucugccccaagcacugcaaggucccccacggccuguuccaguucuucuucuggaucggguacugcaacuccagccugaacccggugaucuacaccaucuucaaccaggacuuccgccgggcguuccgccggauccucugccgccccuggacccagacggccugguga

SEQ ID NO: 26419 - RNA, 1389 nt, Artificial Sequence
  derived and/or modified sequence opt1 from ADRA2C__Homo_sapiens__NP_000674
auggccagccccgcccuggcggccgcccucgccguggccgcggccgccggcccgaacgccuccggggcgggcgagcgcgggagcggcggggucgccaacgccuccggcgccagcuggggcccgccccgggggcaguacuccgccggcgcgguggccgggcuggccgccguggucggcuuccugaucguguucaccguggucgggaacgugcucguggucaucgccgugcugaccagccgcgcgcugcgggcgccccagaaccucuuccuggugucccuggccagcgccgacauccucgucgccacgcuggugaugcccuucucccuggccaacgagcucauggccuacugguacuucggccagguguggugcggcgucuaccuggcccuggacguccucuucugcaccagcuccaucgugcaccugugcgccaucagccuggaccgcuacugguccgugacccaggccguggaguacaaccucaagcggacgccccgccgggugaaggcgaccaucgucgccguguggcugaucagcgccgugaucuccuucccgccccuggucagccucuaccgccagcccgacggggccgcguacccccagugcggccugaacgacgagaccugguacauccuguccagcugcaucggguccuucuucgcccccugccucaucaugggccugguguacgcccggaucuaccgcgucgccaagcugcggacccgcacccucagcgagaagcgggcccccgugggcccggacggggcgagccccacgaccgagaacggccugggggccgccgccggcgccggggagaacggccacugcgcgccgccgcccgccgacguggagcccgacgaguccagcgccgccgccgagcgccggcgccggcgcggcgcgcugcggcgcgggggccggcgccgcgccggggccgagggcggggccggcggcgcggacgggcagggcgccgggcccggcgccgccgaguccggggcccucaccgcgagccggucccccggccccggcgggcgccugagccgggccuccagccgcuccgucgaguucuuccugagccggcgccggcgcgcccgguccagcgugugccgccggaagguggcccaggcccgcgagaagcgguucaccuucguccucgcgguggugaugggcgucuucgugcugugcugguuccccuucuucuucuccuacagccuguacgggaucugccgcgaggccugccaggugcccggcccccucuucaaguucuucuucuggaucggcuacugcaacuccagccugaacccggucaucuacacgguguucaaccaggacuuccggcgcuccuucaagcacauccuguuccggcgccggcgccgcggguuccggcaguga

SEQ ID NO: 26420 - RNA, 1434 nt, Artificial Sequence
  derived and/or modified sequence opt1 from ADRB1__Homo_sapiens__NP_000675
augggcgccggggugcugguccucggcgccagcgagcccgggaaccuguccagcgcggccccgcugcccgacggcgccgccaccgccgcgcgccuccuggugcccgccuccccgcccgccagccugcucccgcccgccuccgagagccccgagccccugucccagcaguggaccgcggggaugggccugcucauggcccugaucgugcugcucaucgucgccggcaacgugcuggugaucgucgccaucgccaagacgccccggcugcagacccucaccaaccuguucaucaugagccuggcguccgccgaccucgugauggggcugcuggugguccccuucggcgccaccaucguggugugggggcgcugggaguacggcagcuucuucugcgagcucuggacguccgucgacgugcugugcgugaccgccagcaucgagacccugugcgucaucgcccucgaccgguaccuggcgaucaccucccccuuccgcuaccagagccugcucacgcgggcccgcgcccgggggcuggugugcaccgugugggccaucuccgcccuggucagcuuccucccgauccugaugcacugguggcgcgcggaguccgacgaggcccggcgcugcuacaacgaccccaagugcugcgacuucgugaccaaccgggccuacgccaucgccagcuccguggucagcuucuacgugccccugugcaucauggcguucguguaccuccgcgucuuccgggaggcccagaagcaggucaagaagaucgacagcugcgagcgccgguuccugggcggccccgcccgcccgcccucccccagccccuccccggugcccgcccccgcgcccccgcccgggccgccccggcccgccgccgccgccgcgaccgcgccccuggccaacggccgcgccgggaagcggcgccccagccggcucguggcccugcgcgagcagaaggcccugaagacgcucggcaucaucaugggcguguucacccugugcuggcugccguucuuccucgccaacgucgugaaggccuuccaccgcgagcuggugcccgaccggcuguucgucuucuucaacuggcucggguacgccaacuccgccuucaaccccaucaucuacugccgcagccccgacuuccggaaggcguuccagggccugcugugcugcgcccgccgggccgcccgccggcgccacgcgacccacggggaccggccgcgcgccuccggcugccucgcccggcccgggcccccgcccagccccggcgccgccuccgacgacgacgacgacgacguggugggcgcgaccccgcccgcccgccugcuggagcccugggccgggugcaacggcggggccgccgcggacagcgacuccagccuggacgagcccugccggcccggcuucgccuccgagagcaaggucuga

SEQ ID NO: 26421 - RNA, 1242 nt, Artificial Sequence
  derived and/or modified sequence opt1 from ADRB2__Homo_sapiens__NP_000015
augggccagcccgggaacggcagcgccuuccugcucgccccgaaccgcucccacgcgcccgaccacgacgugacccagcagcgggacgaggucugggugguggggaugggcaucgucaugagccugaucgugcuggccaucguguucgggaacguccucgugaucaccgccaucgccaaguucgagcgccugcagacggugaccaacuacuucaucaccucccuggccugcgcggaccucgucaugggccuggccguggugcccuucggcgccgcccacauccugaugaagauguggaccuucgggaacuucuggugcgaguucuggacgagcaucgacguccucugcgugaccgcguccaucgagacccugugcgugaucgccgucgaccgguacuucgccaucaccagccccuucaaguaccagucccugcucacgaagaacaaggcccgcgugaucauccugaugguguggaucgucagcggccugaccuccuuccucccgauccagaugcacugguaccgggccacccaccaggaggcgaucaacugcuacgccaacgagaccugcugcgacuucuucacgaaccaggccuacgccaucgccagcuccaucgugagcuucuacgugccccuggucaucaugguguucguguacucccgcgucuuccaggaggcgaagcggcagcugcagaagaucgacaagagcgaggggcgcuuccacgugcagaaccucucccaggucgagcaggacggccggaccgggcacggccugcgccggagcuccaaguucugccugaaggagcacaaggcccucaagacccugggcaucaucauggggaccuucacgcugugcuggcuccccuucuucaucgugaacaucgugcacgucauccaggacaaccugauccgcaaggagguguacauccugcucaacuggaucggcuacgugaacagcggguucaacccccugaucuacugccgguccccggacuuccgcaucgccuuccaggagcugcucugccugcggcgcagcagccugaaggccuacggcaacggcuacuccagcaacgggaacaccggcgagcaguccggguaccacgucgagcaggagaaggagaacaagcuccugugcgaggaccugcccggcaccgaggacuucguggggcaccagggcaccgugcccagcgacaacaucgacucccagggccggaacugcagcacgaacgacucccuccuguga

SEQ ID NO: 26422 - RNA, 1227 nt, Artificial Sequence
  derived and/or modified sequence opt1 from ADRB3__Homo_sapiens__NP_000016
auggcccccuggccgcacgagaacagcucccuggcccccuggcccgaccuccccacccuggcgccgaacaccgccaacacgagcggccugcccggggugcccugggaggccgcccucgccggcgcgcugcuggcccucgccguccuggccaccgucgggggcaaccugcucgugaucguggcgaucgccuggacgccccgccugcagaccaugaccaacguguucgugaccucccuggccgccgccgaccucgucauggggcugcugguggugccgcccgcggccacccucgcccugaccggccacuggccccugggcgccacggggugcgagcucuggaccagcgucgacgugcugugcgugaccgccuccaucgagacccugugcgcgcucgccgucgaccgguaccuggccgugacgaacccccugcgcuacggcgcccucgugaccaagcggugcgcccgcaccgcggucgugcuggugugggucgugagcgccgccguguccuucgccccgaucaugagccagugguggcgggucggggccgacgcggaggcccagcgcugccacuccaacccccggugcugcgccuucgccagcaacaugcccuacgugcugcucuccagcuccgugagcuucuaccugccccugcucgucaugcuguucguguacgcgcgcgucuucgugguggccacccggcagcugcgccuccugcggggcgagcuggggcgcuucccgcccgaggaguccccgcccgcccccagccggucccucgcccccgcccccgucggcacgugcgcgcccccggagggcgugcccgccugcgggcgccggcccgcccgccugcugccccuccgggagcaccgcgcccugugcacccugggccucaucauggggaccuucacccugugcuggcugccguucuuccucgccaacgugcugcgggcgcugggcggccccagccucguccccgggccggccuuccuggcccugaacuggcugggcuacgccaacuccgccuucaacccccucaucuacugccgcagccccgacuuccggagcgcguuccgccgccugcugugccggugcgggcgccggcucccgcccgagcccugcgccgccgcccgccccgcgcuguuccccuccggcgugccggccgcccggagcucccccgcccagccccgccugugccagcggcucgacggggccagcuggggcguguccuga

SEQ ID NO: 26423 - RNA, 2070 nt, Artificial Sequence
  derived and/or modified sequence opt1 from ADRBK1__Homo_sapiens__NP_001610
auggccgaccuggaggccgugcucgcggacgucagcuaccugauggccauggagaaguccaaggccacccccgccgcccgcgcgagcaagaagauccugcucccggagcccuccauccggagcgugaugcagaaguaccuggaggaccgcggcgaggugaccuucgagaagaucuucucccagaagcugggguaccuccuguuccgggacuucugccugaaccaccucgaggaggcccgcccccuggucgaguucuacgaggagaucaagaaguacgagaagcuggagacggaggaggagcggguggcccgcagccgggagaucuucgacuccuacaucaugaaggagcuccuggccugcagccaccccuucuccaagagcgcgaccgagcacgugcagggccaccuggggaagaagcaggucccgcccgaccucuuccagcccuacaucgaggagaucugccagaaccugcgcggcgacguguuccagaaguucaucgaguccgacaaguucacccgguucugccaguggaagaacguggagcugaacauccaccucaccaugaacgacuucagcguccaccgcaucaucgggcggggcggcuucggggagguguacggcugccgcaaggccgacacggggaagauguacgccaugaagugccuggacaagaagcggaucaagaugaagcagggcgagacccuggcccucaacgagcgcaucaugcugucccuggugagcaccggggacugccccuucaucgucugcauguccuacgccuuccacaccccggacaagcucagcuucauccuggaccugaugaacggcggcgaccuccacuaccaccugucccagcacgggguguucagcgaggcggacaugcgguucuacgccgccgagaucauccugggccucgagcacaugcacaaccgcuucguggucuaccgggaccugaagcccgccaacauccugcucgacgagcacgggcacgugcgcaucuccgaccugggccuggccugcgacuucagcaagaagaagccccacgcgagcgugggcacgcacggguacauggcccccgagguccuccagaagggcguggccuacgacuccagcgccgacugguucucccuggggugcaugcuguucaagcuccugcggggccacagcccguuccgccagcacaagaccaaggacaagcacgagaucgaccggaugacccugaccauggccguggagcuccccgacuccuucagccccgagcugcgcucccugcucgaggggcugcugcagcgcgacgucaaccggcgccucggcugccugggccgcggggcgcaggaggugaaggagagccccuucuuccggucccuggacuggcagaugguguuccugcagaaguacccgccgccccucaucccgccccggggcgaggucaacgccgccgacgccuucgacaucgggagcuucgacgaggaggacacgaagggcaucaagcugcuggacuccgaccaggagcucuaccgcaacuucccccugaccaucagcgagcgguggcagcaggagguggccgagaccgucuucgacaccaucaacgcggagacggaccgccuggaggcccggaagaaggccaagaacaagcagcucgggcacgaggaggacuacgcccugggcaaggacugcaucaugcacggcuacauguccaagauggggaaccccuuccugacccaguggcagcgccgguacuucuaccucuuccccaaccgccuggaguggcggggcgagggggaggcgccccagagccugcucaccauggaggagauccaguccguggaggagacccagaucaaggagcgcaagugccugcugcucaagauccggggcgggaagcaguucauccugcagugcgacagcgaccccgagcuggugcaguggaagaaggagcuccgcgacgccuaccgggaggcccagcagcugguccagcgcgugcccaagaugaagaacaagccccgguccccgguggucgagcugagcaaggugccccucgugcagcgcggcuccgccaacggccuguga

SEQ ID NO: 26424 - RNA, 2067 nt, Artificial Sequence
  derived and/or modified sequence opt1 from ADRBK2__Homo_sapiens__NP_005151
auggccgaccuggaggccgugcucgcggacgucagcuaccugauggccauggagaaguccaaggccacccccgccgcccgcgcgagcaagcggaucgugcugccggagcccuccauccgcagcgugaugcagaaguaccucgccgagcggaacgagaucaccuucgacaagaucuucaaccagaagaucggcuuccugcuguucaaggacuucugccucaacgagaucaacgaggccgucccccaggugaaguucuacgaggagaucaaggaguacgagaagcuggacaacgaggaggaccgccugugccggucccgccagaucuacgacgccuacaucaugaaggagcuccugagcugcucccaccccuucagcaagcaggcgguggagcacguccagucccaccugagcaagaagcaggucacguccacccucuuccagccguacaucgaggagaucugcgagagccugcgcggggacaucuuccagaaguucauggaguccgacaaguucacccgguucugccaguggaagaacguggagcugaacauccaccucaccaugaacgaguucagcgugcaccggaucaucggccgcgggggcuucggggagguguacggcugccggaaggccgacacgggcaagauguacgccaugaagugccuggacaagaagcgcaucaagaugaagcagggggagacccuggcccucaacgagcggaucaugcugucccuggugagcaccggcgacugccccuucaucgucugcaugaccuacgccuuccacacgcccgacaagcucugcuucauccuggaccugaugaacgggggcgaccuccacuaccaccugucccagcacgggguguucagcgagaaggagaugcgcuucuacgcgaccgagaucauccugggccucgagcacaugcacaaccgguucguggucuaccgcgaccugaagcccgccaacauccugcucgacgagcacggccacgcccggaucuccgaccuggggcuggccugcgacuucagcaagaagaagccgcacgccagcgugggcacccacggguacauggcgcccgaggugcuccagaagggcaccgccuacgacuccagcgccgacugguucucccugggcugcaugcuguucaagcuccugcgcgggcacagccccuuccggcagcacaagacgaaggacaagcacgagaucgaccgcaugacccugaccgucaacguggagcuccccgacaccuucuccccggagcucaagagccugcuggagggccugcugcagcgggacguguccaagcgccucgggugccacggcgggggcagccaggaggucaaggagcacuccuucuucaagggcguggacuggcagcacguguaccugcagaaguacccgccgccccugaucccgccccgcggggaggucaacgccgccgacgcguucgacaucggcagcuucgacgaggaggacacgaaggggaucaagcuccuggacugcgaccaggagcuguacaagaacuucccccuggugaucuccgagcgguggcagcaggaggucaccgagaccguguacgaggccgugaacgccgacaccgacaagaucgaggcccgcaagcgggccaagaacaagcagcucggccacgaggaggacuacgcgcuggggaaggacugcaucaugcacggcuacaugcugaagcucggcaaccccuuccugacgcaguggcagcgccgguacuucuaccuguuccccaaccgccucgaguggcgcggggagggcgagagccggcagaaccugcugaccauggagcagauccucuccgucgaggagacccagaucaaggacaagaagugcauccuguuccggaucaagggcgggaagcaguucgugcugcagugcgagagcgaccccgaguucgugcaguggaagaaggagcucaacgagaccuucaaggaggcccagcgccugcugcggcgcgcccccaaguuccucaacaagccccgguccgggacggucgagcugcccaagcccagccugugccaccgcaacuccaacggccucuga

SEQ ID NO: 26425 - RNA, 1224 nt, Artificial Sequence
  derived and/or modified sequence opt1 from ADRM1__Homo_sapiens__XP_011526804
augaccaccagcggcgcccuguuccccucccucgugccggggagccgcggcgccuccaacaaguaccuggucgaguuccgggcggggaagaugagccugaagggcacgaccgugacccccgacaagcgcaaggggcucguguacauccagcagaccgacgacucccugauccacuucugcuggaaggaccggacgagcggcaacgucgaggacgaccugaucaucuuccccgacgacugcgaguucaagcgcgugccccagugcccguccggccggguguacguccucaaguucaaggccgggagcaagcgccuguucuucuggaugcaggagcccaagaccgaccaggacgaggagcacugccggaaggugaacgaguaccugaacaacccgcccaugcccggcgcccucggggccuccggcagcuccgggcacgagcugagcgcccugggcggcgagggcggccuccagucccugcuggggaacaugagccacucccagcucaugcagcugaucggccccgcgggccugggcgggcucgggggccugggggcccugaccggccccggccucgccagccugcugggguccagcgggcccccgggguccagcagcuccagcuccagccgcucccagagcgccgcggugacccccuccagcacgaccuccagcacccgggccacccccgcccccuccgccccggccgcggccagcgccacgucccccagccccgcccccuccagcggcaacggggccuccaccgcggccagcccgacccagcccauccagcucuccgaccugcagagcauccuggccaccaugaacguccccgccggccccgccggcgggcagcaggucgaccucgcgagcgugcugacgccggagaucauggcccccauccuggccaacgccgacgugcaggagcgccuccugcccuaccugcccuccggcgagagccucccgcagaccgccgacgagauccagaacacccugaccagcccccaguuccagcaggcgcuggggauguucuccgccgcccucgccuccggccagcuggggccccugaugugccaguucggccucccggcggaggccguggaggccgccaacaagggcgacguggaggccuucgcgaaggccaugcagaacaacgccaagcccgagcagaaggagggggacacgaaggacaagaaggacgaggaggaggacaugagccuggacuga

SEQ ID NO: 26426 - RNA, 1455 nt, Artificial Sequence
  derived and/or modified sequence opt1 from ADSL__Homo_sapiens__NP_000017
auggccgccggcggggaccacggcagccccgacuccuaccgcagcccgcuggcgucccgguacgccagccccgagaugugcuucguguucuccgaccgcuacaaguuccggaccuggcgccagcucuggcuguggcuggccgaggccgagcagacccucgggcugcccaucacggacgagcagauccaggagaugaaguccaaccuggagaacaucgacuucaagauggccgcggaggaggagaagcggcuccgccacgacgucauggcccacgugcacaccuucggccacugcugccccaaggccgccgggaucauccaccugggcgcgaccagcugcuacgugggcgacaacaccgaccugaucauccuccggaacgcccuggaccugcuccugccgaagcuggcccgcgucaucagccggcucgccgacuucgccaaggagcgcgcgucccugcccacgcugggguucacccacuuccagcccgcccagcucaccaccgugggcaagcggugcugccuguggauccaggaccugugcauggaccuccagaaccugaagcgcgugcgggacgaccugcgcuuccgcggggucaagggcacgaccgggacccaggccagcuuccuccagcuguucgagggcgacgaccacaagguggagcagcuggacaagauggugaccgagaaggccggcuucaagcgggccuucaucaucacggggcagaccuacacccggaaggucgacaucgaggugcucuccgugcuggcgagccugggcgccuccguccacaagaucugcaccgacauccgccuccuggccaaccugaaggagauggaggagcccuucgagaagcagcagaucgggagcuccgccaugccguacaagcggaaccccaugcgcagcgagcggugcugcucccucgcccgccaccugaugacgcuggugauggacccccuccagaccgcgagcgugcagugguucgagcgcacccuggacgacuccgccaaccggcgcaucugccuggccgaggccuuccucaccgccgacacgauccugaacacccugcagaacaucagcgagggccucgucguguaccccaaggugaucgagcggcgcauccggcaggagcugccguucauggcgaccgagaacaucaucauggccauggucaaggccggcgggagccgccaggacugccacgagaagauccgggugcugucccagcaggccgcgagcguggucaagcaggagggcggggacaacgaccucaucgagcgcauccagguggacgccuacuucucccccauccacagccagcuggaccaccuccuggaccccuccagcuucaccggccgggccucccagcagguccagcgcuuccuggaggaggagguguacccccugcugaagccguacgagagcgugaugaaggucaaggccgagcucugccuguga

SEQ ID NO: 26427 - RNA, 1371 nt, Artificial Sequence
  derived and/or modified sequence opt1 from ADSS__Homo_sapiens__NP_001117
auggccuucgccgagaccuaccccgcggccagcucccugccgaacggcgacugcgggcgcccccgggcccgccccggcgggaaccgggugaccgucgugcucggcgcccaguggggcgacgaggggaagggcaagguggucgaccugcuggcccaggacgcggacaucgugugccgcugccagggcgggaacaacgccgggcacacgguggucguggacagcguggaguacgacuuccaccuccugcccuccggcaucaucaacccgaacgucaccgccuucaucgggaacggcguggugauccaccuccccggccuguucgaggaggccgagaagaacguccagaaggggaagggccuggaggggugggagaagcggcugaucaucagcgaccgcgcgcacaucguguucgacuuccaccaggccgccgacggcauccaggagcagcagcggcaggagcaggccggcaagaaccucgggaccaccaagaagggcaucgggcccguguacuccagcaaggccgcgcgcuccggccugcggaugugcgaccuggucagcgacuucgacggguucuccgagcgcuucaaggugcucgccaaccaguacaagagcaucuaccccacgcuggagaucgacaucgagggcgagcugcagaagcucaagggcuacauggagaagaucaagccgauggugcgggacggggucuacuuccuguacgaggcccugcacggcccgcccaagaagauccucguggagggggccaacgccgcgcugcuggacaucgacuucggcaccuaccccuucgugaccuccagcaacugcaccgucgggggcgugugcacgggccucgggaugccgccccagaacgugggcgaggucuacgggguggucaaggccuacaccacccgcgugggcaucggggccuuccccaccgagcaggacaacgagaucggcgagcugcugcagacgcggggccgcgaguucggggugaccaccggccggaagcgccggugcggguggcucgaccugguccugcucaaguacgcccacaugaucaacggcuucaccgcccuggcgcugacgaagcucgacauccuggacauguucaccgagaucaaggugggcguggccuacaagcuggacggggagaucaucccccacauccccgccaaccaggagguccucaacaagguggaggugcaguacaagacccugcccggcuggaacaccgacaucuccaacgcccgcgccuucaaggagcugcccgucaacgcgcagaacuacgugcgguucaucgaggacgagcuccagauccccgugaaguggaucggggucggcaagagccgcgaguccaugauccagcuguucuga

SEQ ID NO: 26428 - RNA, 1374 nt, Artificial Sequence
  derived and/or modified sequence opt1 from ADSSL1__Homo_sapiens__NP_689541
augagcgggacccgcgccuccaacgaccggcccccgggggccggcggggugaagcgcggccggcugcagcaggaggcggccgccaccgggagccgcgucacgguggugcucggcgcccaguggggcgacgaggggaagggcaaggucguggaccugcuggccaccgacgcggacaucaucucccggugccagggcgggaacaacgccgggcacaccguggucguggacggcaaggaguacgacuuccaccuccugcccagcggcaucaucaacaccaaggccguguccuucaucgggaacggcgucgugauccaccuccccggccucuucgaggaggccgagaagaacgagaagaaggggcugaaggacugggagaagcgccugaucaucagcgaccgggcgcaccucguguucgacuuccaccaggccgucgacggccugcaggaggugcagcgccaggcccaggaggggaagaacaucggcacgaccaagaaggggaucggccccaccuacuccagcaaggccgcccggaccgggcugcgcaucugcgaccuccuguccgacuucgacgaguucagcucccgguucaagaaccuggcgcaccagcaccagagcauguucccgacgcucgagaucgacaucgagggccagcugaagcgccugaagggcuucgccgagcggauccgccccauggugcgggacggggucuacuucauguacgaggcccuccacggcccgcccaagaagauccugguggagggggccaacgccgcgcugcucgacaucgacuucggcaccuaccccuucgugaccuccagcaacugcaccgucgggggcgugugcacgggccuggggaucccgccccagaacaucggcgacguguacggggucgugaaggccuacaccacccgcgugggcaucggggccuuccccaccgagcagaucaacgagaucggcggccugcuccagacgcgggggcacgaguggggcgucaccaccgggcgcaagcggcgcugcggcuggcuggaccugaugauccuccgguacgcccacauggugaacggcuucaccgcccuggcgcugacgaagcucgacauccuggacguccugggggaggugaaggugggcgucuccuacaagcucaacgggaagcgcauccccuacuuccccgccaaccaggagaugcugcagaagguggagguggaguacgagacccugcccggcuggaaggccgacaccaccggggcccgccggugggaggaccugcccccgcaggcccagaacuacauccgcuucgucgagaaccacgugggcguggcggucaagugggugggcgugggcaagagccgggaguccaugauccagcuguucuga

SEQ ID NO: 26429 - RNA, 747 nt, Artificial Sequence
  derived and/or modified sequence opt1 from ADTRP__Homo_sapiens__NP_001137420
augaccaagaccagcacgugcaucuaccacuuccuggugcucuccugguacaccuuccugaacuacuacaucagccaggagggcaaggacgaggucaagcccaagauccuggccaacggggcccgcuggaaguacaugacccuccugaaccugcucaagaaccggaccgcgggcuucgacaucuaccagccgggguccuuccgccagcugcugcagacgaucuucuacggcgugaccugccucgacgacgugcugaagcggaccaagggcgggaaggacaucaaguuccugaccgccuuccgcgaccuccuguucacgacccuggccuuccccgucagcaccuucguguuccucgccuucuggauccuguuccuguacaaccgggaccucaucuaccccaaggugcuggacaccgucauccccguguggcugaaccacgccaugcacacguucaucuucccgaucacccucgcggaggugguccugcgcccccacuccuaccccagcaagaagaccggccugacccuccuggccgccgccuccaucgcguacaucagccggauccuguggcucuacuucgagacggggaccuggguguaccccguguucgccaagcugucccugcucggccuggccgccuucuucagccuguccuacgucuucaucgccagcaucuaccuccugggggagaagcugaaccacuggaaguggggcgacaugcgccagccgcggaagaagcgcaaguga

SEQ ID NO: 26430 - RNA, 1554 nt, Artificial Sequence
  derived and/or modified sequence opt1 from AEBP2__Homo_sapiens__NP_001107648
auggccgccgcgaucaccgacauggccgaccuggaggagcucagccgccugagcccccugccgcccggcucccccggguccgccgcccggggccgcgccgagcccccggaggaggaggaggaggaggaggaggaggaggaggaggcggaggccgaggccguggccgcgcuccugcugaacgggggcagcgggggcggcgggggcgggggcgggggcggcgucgggggcggggaggccgagaccauguccgagcccagccccgaguccgccagccaggccggcgaggacgaggacgaggaggaggacgacgaggaggaggaggacgaguccagcuccagcggcgggggcgaggaggaguccagcgccgagucccucguggggagcuccggcgggagcuccagcgacgagacgcggagccugucccccggcgcggccagcuccagcuccggcgacggggacggcaaggaggggcuggaggagccgaagggcccccgcgggagccagggcggcgggggcgggggcuccagcuccagcuccguggucagcuccgggggcgacgagggcuacgggaccggcgggggcggcagcuccgccaccagcgggggccggcgcgggucccucgagaugagcuccgacggcgagccccugagccggauggacagcgaggacuccaucagcuccaccaucauggacguggacagcacgaucuccagcgggcgcuccacccccgccaugaugaacggccagggcagcaccaccuccagcuccaagaacaucgccuacaacugcugcugggaccagugccaggcgugcuucaacagcuccccggaccuggccgaccacauccggagcauccacguggacgggcagcgcggcggggucuucgugugccucuggaagggcugcaagguguacaacacgcccuccaccagccaguccuggcugcagcggcacaugcugacccacagcggggacaagcccuucaagugcgucgugggcggcugcaacgccagcuucgccucccagggcgggcucgcccgccacgugcccacccacuucagccagcagaacuccagcaaggucuccagccagccgaaggcgaaggaggagucccccagcaaggccgggaugaacaagcggcgcaagcugaagaacaagcggcgccggucccugccccgcccccacgacuucuucgacgcccagacgcucgacgccauccggcaccgcgccaucugcuucaaccugagcgcgcacaucgagucccugggcaaggggcacagcgugguguuccacuccaccgucaucgccaagcggaaggaggacagcggcaagaucaagcuccugcugcacuggaugccggaggacauccuccccgacgugugggugaacgaguccgagcgccaccagcugaagaccaaggucgugcaccugagcaagcuccccaaggacaccgcccugcugcucgaccccaacaucuaccgcacgaugccgcagaagcggcugaagcgcacccugauccggaagguguucaaccucuaccuguccaagcaguga

SEQ ID NO: 26431 - RNA, 978 nt, Artificial Sequence
  derived and/or modified sequence opt1 from AEN__Homo_sapiens__NP_073604
auggugccccgcgaggccccggagagcgcccagugccugugccccucccucaccauccccaacgcgaaggacguccugcggaagcgccacaagcggcgcagccggcagcaccagcgcuucauggcccggaaggcccugcuccaggagcagggccugcuguccaugcccccggagcccgggagcagcccccuccccaccccguucggcgccgccacggcgaccgaggccgccuccuccgggaagcagugccugcgcgccggcagcggguccgcgcccugcagccggcgccccgcccccggcaaggccuccggcccgcugcccagcaagugcguggccaucgacugcgagaugguggggaccggcccccgggggcgcgucuccgagcucgcccggugcagcaucguguccuaccacggcaacgugcuguacgacaaguacauccgccccgagaugccgaucgcggacuaccggacccgcuggagcgggaucacgcggcagcacaugcgcaaggccguccccuuccagguggcccagaaggagauccugaagcuccugaagggcaagguggucgugggccacgcccugcacaacgacuuccaggcccucaaguacgugcacccccggucccagacccgcgacaccaccuacguccccaacuuccugagcgagccggggcugcacacgcgggcgcgcgugucccucaaggaccuggcccugcagcuccugcacaagaagauccaggugggccagcacgggcacagcagcgucgaggacgccaccaccgccauggagcuguaccgccucguggaggugcagugggagcagcaggaggcccggucccuguggaccugccccgaggaccgcgagcccgacagcuccacggacauggagcaguacauggaggaccaguacuggcccgacgaccuggcgcacggcagccggggcggggcccgcgaggcccaggaccggcgcaacuga

SEQ ID NO: 26432 - RNA, 795 nt, Artificial Sequence
  derived and/or modified sequence opt1 from AES__Homo_sapiens__NP_945320
augugccacaagaacggcuucccccaggagggcgggaucaccgccgccuuccugcagaagcgcaagcuccggcugagcaagaaccaccgcccggcgcgggccaaggugaccgagcacgugcgcgggacgcggcccggccgcgccaccgccgggcccgccgcgagcacccgggccgccggcagccuguucuucgaccgcuggggcaaccgggggcccgccggcugccgcggguccagccaccucccgcagcagcugaaguucaccacguccgacagcugcgaccggaucaaggacgaguuccagcugcuccaggcgcaguaccacucccugaagcuggagugcgacaagcucgccagcgagaaguccgagaugcagcgccacuacgugauguacuacgagaugagcuacggccugaacaucgagaugcacaagcaggccgagaucgugaagcggcugaacgggaucugcgcccagguccuccccuaccugucccaggagcaccagcagcagguccugggcgccaucgagcgcgcgaagcaggucaccgcccccgagcucaacagcaucauccggcagcagcugcaggcccaccagcugucccagcuccaggcccuggcccugccccucaccccgcugcccgugggccugcagccgcccagccuccccgcgguguccgccgggaccggccugcugagccucuccgcccuggggagccaggcccaccuguccaaggaggacaagaacggccacgacggcgacacgcaccaggaggacgacggggagaaguccgacuga

SEQ ID NO: 26433 - RNA, 2445 nt, Artificial Sequence
  derived and/or modified sequence opt1 from AFAP1__Homo_sapiens__NP_001128119
auggaggagcugaucguggagcuccgccuguuccuggagcuccuggaccacgaguaccugaccagcaccguccgggagaagaaggccgugaucacgaacauccuccugcgcauccaguccagcaagggcuucgacgugaaggaccacgcccagaagcaggagaccgcgaacucccugcccgccccgccccagaugccccuccccgagaucccgcagcccuggcugccgcccgacagcgggcccccgccccugcccaccuccagccuccccgagggcuacuacgaggaggccgucccccugucccccgggaaggcccccgaguacaucaccagcaacuacgacuccgacgccaugagcuccagcuacgaguccuacgacgaggaggaggaggacggcaaggggaagaagacgcggcaccaguggccgagcgaggaggcguccauggaccuggugaaggacgccaagaucugcgccuuccuccugcgcaagaagcgguucggccaguggaccaagcugcucugcgugaucaaggacaccaagcugcugugcuacaagagcuccaaggaccagcagccccagauggagcucccccugcagggcugcaacaucaccuacauccccaaggacagcaagaagaagaagcacgagcugaagaucacgcagcaggggaccgacccgcucguccuggccgugcaguccaaggagcaggcggagcaguggcugaaggugaucaaggaggccuacagcggcugcagcgggcccgucgacuccgagugcccgccgccgcccagcucccccgugcacaaggccgagcucgagaagaagcugagcuccgagcgccccagcuccgacggcgaggggguggucgagaacggcaucacgaccugcaacggcaaggagcaggucaagcggaagaaguccagcaagagcgaggccaaggggaccguguccaaggugaccggcaagaagaucaccaagaucaucagccuggggaagaagaagcccuccaccgacgagcagacgagcuccgccgaggaggacgugccgaccugcggcuaccucaacgugcugagcaacucccgcuggcgggagcgcuggugccgggucaaggacaacaagcugaucuuccacaaggaccgcaccgaccucaagacccacaucgugagcaucccccugcggggcugcgaggugauccccgggcuggacuccaagcacccccucacguuccgccugcugcggaacggccaggaggucgcggugcucgaggccagcagcuccgaggacauggggcgcuggaucggcauccugcuggccgagaccgggagcuccaccgaccccgaggcccuccacuacgacuacaucgacguggagaugagcgccuccgucauccagaccgcgaagcagacguucugcuucaugaaccggcgcgugaucagcgccaaccccuaccugggcggcaccuccaacggguacgcccaccccagcggcaccgcccugcacuacgacgacguccccugcaucaacggguccugggagcccgaggacggcuuccccgccagcugcucccgggggcucggcgaggaggugcuguacgacaacgcgggccuguacgacaaccucccgccgccccacaucuucgcccgcuacagccccgccgaccggaaggccucccgccugagcgccgacaagcuguccagcaaccacuacaaguaccccgcguccgcccagagcgugaccaacacgagcuccgucgggcgcgccagccugggccucaacucccagcugaaggggaagaagccgcccguggccagcaacggcgugaccgggaagggcaagacccuguccagccagcccaagaaggcggaccccgccgccgucgugaagcggaccggcuccaacgccgcccaguacaaguacgggaagaaccgcguggaggcggacgccaagcggcuccagacgaaggaggaggagcugcugaagcgcaaggaggcccuccggaaccgccuggcccagcugcggaaggagcgcaaggaccuccgggccgcgaucgaggucaacgccggccgcaagccccaggccauccuggaggagaagcugaagcagcucgaggaggagugccggcagaaggaggccgagcgcgugagccuggagcuggagcucaccgaggugaaggagucccugaagaaggcccuggccgggggcgucacccucggccuggcgaucgagcccaagagcgggaccuccagcccccaguccccgguguuccggcaccgcacgcuggagaacagccccaucuccagcugcgacaccuccgacaccgagggccccgugcccgucaacagcgccgccgugcucaagaagucccaggcggccccggggagcagccccugccggggccacgugcugcgcaaggccaaggagugggagcugaagaacgggaccuga

SEQ ID NO: 26434 - RNA, 2178 nt, Artificial Sequence
  derived and/or modified sequence opt1 from AFAP1L1__Homo_sapiens__NP_001139809
auggaccgcggccaggugcuggagcagcuccugcccgagcugaccgggcuccugagccugcucgaccacgaguaccuguccgacaccacgcuggagaagaagauggccgucgccagcauccuccagucccugcagccgcugcccgcgaaggaggugagcuaccucuacgugaacaccgccgaccugcacuccggccccagcuucgucgagucccuguucgaggaguucgacugcgaccucagcgaccugcgggacaugcccgaggacgacggggagccguccaagggcgccagccccgagcuggccaagagcccccgccuccggaacgccgcggaccugcccccgccccugcccaacaagcccccgcccgaggacuacuacgaggaggcccucccccuggggcccggcaagagcccggaguacaucuccagccacaacggcugcucccccagccacuccaucguggacggguacuacgaggacgccgacagcuccuaccccgccacccgcgugaacggcgagcucaagagcagcuacaacgacuccgacgcgaugagcuccagcuacgaguccuacgacgaggaggaggaggagggcaagagcccccagccgcggcaccaguggcccuccgaggaggccagcaugcaccugguccgcgagugccggaucugcgccuuccugcugcgcaagaagcgguucgggcagugggccaagcagcucaccgugauccgcgaggaccagcugcugugcuacaaguccagcaaggaccggcagccccaccuccgccuggcccuggacacgugcuccaucaucuacgugcccaaggacagccggcacaagcgccacgagcuccgguucacccagggggcgaccgagguccuggugcuggcccuccagucccgcgagcaggccgaggaguggcugaaggugauccgggaggucagcaagccggugggcggcgccgaggggguggaggucccccgcucccccgugcugcucugcaagcuggaccuggacaagcggcucagccaggagaagcagaccuccgacagcgacuccgugggcgucggggacaacugcagcacgcugggccgccgggagaccugcgaccacggcaaggggaagaaguccucccuggccgagcucaagggcagcaugucccgcgcggccgggcgcaagaucacccggaucaucggcuucagcaagaagaagacccuggccgacgaccugcagacguccagcaccgaggaggaggugcccugcugcggguaccucaacgugcuggucaaccagggcuggaaggagcgcuggugccggcugaagugcaacacccuguacuuccacaaggaccacauggaccuccgcacccacgugaacgccaucgcccugcagggcugcgagguggcgccgggguucggcccccggcaccccuucgccuuccgcauccugcggaaccgccaggaggucgccauccucgaggccuccugcagcgaggacauggggcgguggcugggccugcuccugguggagauggggucccgcgucacgccggaggcccugcacuacgacuacguggacguggagacccucaccagcaucgucuccgcgggccggaacagcuuccuguacgcccgcuccugccagaaccaguggcccgagccccggguguacgacgacgugcccuacgagaagaugcaggacgaggagccggagcgccccaccggcgcccaggucaagcggcacgccagcuccugcagcgagaagucccaccgcguggacccccaggugaaggucaagcggcacgcgagcagcgccaaccaguacaaguacgggaagaaccgcgccgaggaggacgcccggcgcuaccugguggagaaggagaagcucgagaaggagaaggagacgauccgcaccgagcugaucgcccugcggcaggagaagcgcgagcucaaggaggcgauccgguccagccccggcgccaagcugaaggcccuggaggaggccguggccacccucgaggcgcagugccgcgccaaggaggagcggcgcaucgaccuggagcugaagcucgucgccgugaaggagcggcugcagcagucccuggccgggggcccggcccucgggcugagcguguccagcaagcccaaguccggcgagugggagaugaagaagaccuga

SEQ ID NO: 26435 - RNA, 2457 nt, Artificial Sequence
  derived and/or modified sequence opt1 from AFAP1L2__Homo_sapiens__NP_001001936
auggagcgcuacaaggcccuggagcagcuccugaccgagcuggacgacuuccucaagauccuggaccaggagaaccugagcuccaccgcccucgugaagaaguccugccuggcggagcugcuccggcuguacacgaaguccagcuccagcgacgaggaguacaucuacaugaacaaggucaccaucaacaagcagcagaacgccgagucccagggcaaggcccccgaggagcaggggcugcucccgaacggcgagcccagccagcacuccagcgcgccccagaagucccugcccgaccugccgccgcccaagaugauccccgagcgcaagcagcucgccauccccaagaccgagagccccgagggguacuacgaggaggccgagcccuacgacaccucccugaacgaggacggcgaggccgugagcuccagcuacgaguccuacgacgaggaggacgggagcaagggcaaguccgcccccuaccaguggccgagccccgaggccggcaucgagcugaugcgggacgcgcgcaucugcgccuuccucuggcggaagaaguggcuggggcagugggccaagcagcugugcgugaucaaggacaaccgccuccugugcuacaagagcuccaaggaccacagcccccagcuggacgucaaccuccugggcuccagcgugauccacaaggagaagcagguccggaagaaggagcacaagcugaagaucacgcccaugaacgccgacgugaucgugcucgggcugcaguccaaggaccaggccgagcaguggcugcgcgugauccaggaggucagcggccucccguccgagggggcgagcgagggcaaccaguacacccccgacgcccagcgguucaacugccagaagcccgacaucgccgagaaguaccuguccgccagcgaguacggcuccagcguggacgggcaccccgaggugccggagaccaaggacgucaagaagaagugcuccgccggccugaagcucagcaaccugaugaaccuggggcgcaagaaguccaccagccucgagcccguggagcggucccuggagacgagcuccuaccugaacgugcucgucaacagccaguggaagucccgcuggugcagcgugcgggacaaccaccuccacuucuaccaggaccgcaaccggagcaagguggcgcagcagccccugucccuggucggcugcgagguggugcccgacccgagccccgaccaccuguacuccuuccgcauccugcacaagggcgaggagcucgccaagcuggaggccaagagcuccgaggagauggggcacuggcugggccuccugcugagcgaguccgggagcaagaccgaccccgaggaguucaccuacgacuacgucgacgccgaccggguguccugcaucgugagcgccgcgaagaacucccugcuccugaugcagcgcaaguucagcgagcccaacaccuacaucgacggccugccgucccaggaccggcaggaggagcucuacgacgacgucgaccugagcgagcugacggccgccguggagcccaccgaggaggccacccccgucgccgacgacccgaacgagcgcgaguccgaccggguguaccucgaccugacccccgucaagagcuuccugcacgggcccagcuccgcgcaggcccaggccagcucccccacgcucagcugccuggacaacgccaccgaggcgcugccggccgacuccggccccggccccacccccgacgagccgugcaucaagugccccgagaaccucggggagcagcagcuggagagccuggagcccgaggaccccucccuccgcaucaccacggugaagauccagaccgagcagcagcgcaucagcuucccgcccuccugccccgacgccgugguggccacgcccccgggcgccagcccgcccgucaaggaccggcugcgcgugaccuccgcggagaucaagcuggggaagaaccggaccgaggccgaggugaagcgcuacaccgaggagaaggagcggcucgagaagaagaaggaggagauccgcggccaccuggcccagcugcggaaggagaagcgcgagcucaaggagacccugcugaagugcaccgacaaggagguccucgccagccuggagcagaagcugaaggagaucgacgaggagugccgcggggaggagucccggcggguggaccucgagcugagcaucauggaggugaaggacaaccugaagaaggccgaggcgggccccgucacgcucggcaccaccguggacaccacgcaccuggagaacgugagcccccgccccaaggccgucacccccgccagcgcccccgacugcaccccggugaacuccgccaccacgcugaagaaccggccccucagcguggucgugaccgggaagggcaccgugcugcagaaggcgaaggagugggagaagaagggggccuccuga

SEQ ID NO: 26436 - RNA, 3657 nt, Artificial Sequence
  derived and/or modified sequence opt1 from AFF1__Homo_sapiens__NP_001160165
auggccuucaccgagcgcgugaacagcuccggcaacagccuguacaacgacgaccggaaccuccugcgcauccgggagaaggagcgccggaaccaggaggcccaccaggagaaggaggcguuccccgagaagaucccgcuguucggggagcccuacaagaccgccaagggcgacgagcucuccagccgcauccagaacaugcuggggaacuacgaggaggucaaggaguuccuguccacgaagagccacacccaccggcucgacgccuccgagaaccgccugggcaagcccaaguacccccugaucccggacaaggggagcuccauccccagcuccagcuuccacaccuccgugcaccaccagagcauccacacccccgccuccggcccccucagcgugggcaacaucucccacaacccgaagauggcccagccccggacggagcccaugcccagccugcacgcgaaguccugcgggccgcccgacagccagcaccugacccaggaccgccucggccaggagggguucggcagcucccaccacaagaagggggaccggcgcgccgacggcgaccacugcgccagcgucaccgacuccgcccccgagcgggagcugagcccccugaucucccucccgagccccgugcccccccuguccccgauccacagcaaccagcagacccugccccgcacgcagggcuccagcaaggugcacggguccagcaacaacuccaagggcuacugccccgcgaagagccccaaggaccucgccgucaaggugcacgacaaggagaccccgcaggacucccugguggcccccgcccagccccccagccagaccuucccgccccccucccugccgagcaaguccgucgccaugcagcagaagcccaccgcguacgugcggcccauggacgggcaggaccaggcccccagcgagagcccggagcucaagccccugcccgaggacuaccgccagcagacguucgagaagaccgaccugaaggugcccgccaaggccaagcucaccaagcugaagaugccgucccagagcgucgagcagaccuacuccaacgaggugcacugcguggaggagauccugaaggagaugacgcacagcuggccccccccccucaccgccauccacaccccguccaccgcggagcccagcaaguuccccuuccccacgaaggacucccagcacgucagcuccgugacccagaaccagaagcaguacgacaccagcuccaagacccacagcaacucccagcagggcacgagcuccaugcuggaggacgaccugcagcucagcgacuccgaggacagcgacagcgagcagaccccggagaagccccccuccagcuccgcccccccgagcgccccccagucccugcccgagcccguggccagcgcccacuccagcuccgcggagagcgaguccaccagcgacuccgacagcuccagcgacuccgagagcgaguccagcagcuccgacagcgaggagaacgagccgcuggagacccccgcccccgagccggagccccccacgaccaacaaguggcagcucgacaacuggcugaccaaggucucccagcccgccgccccgcccgagggcccccggagcaccgagcccccgcgccggcaccccgaguccaaggggagcuccgacagcgccacgucccaggagcacagcgaguccaaggacccccccccgaagagcuccagcaaggcgccccgcgccccccccgaggccccgcaccccggcaagcgguccugccagaagagccccgcccagcaggagcccccgcagcgccagaccguggggaccaagcagcccaagaagcccgugaaggcguccgcccgcgccggcagccggaccucccugcagggggagcgcgagcccggccuccugccguacggcagccgggaccagacgagcaaggacaagcccaaggucaagaccaaggggcgcccccgggccgccgcguccaacgagcccaagccggccgugccccccagcuccgagaagaagaagcacaagagcucccugccggcccccagcaaggcccucuccggccccgagcccgccaaggacaacguggaggaccgcaccccggagcacuucgcgcuggucccccugaccgagagccaggggcccccccacuccggcagcgggucccggaccagcggcugccgccaggccguggucgugcaggaggacucccggaaggaccgccucccgcugccccugcgggacacgaagcuccugagcccccugcgcgacacccccccgccccagucccucauggugaagaucacccuggaccugcugagccggaucccccagcccccgggcaaggggucccgccagcggaaggccgaggacaagcagccccccgccggcaagaagcacagcuccgagaagcgcagcagcgacuccagcuccaagcucgccaagaagcggaagggggaggcggagcgcgacugcgacaacaagaagauccggcuggagaaggagaucaagagccaguccagcuccagcuccagcucccacaaggagagcuccaagaccaagcccagccgcccguccagccaguccagcaagaaggagaugcugcccccccccccggucuccagcagcucccagaagcccgccaagcccgcccucaagcgcagccggcgcgaggccgacacgugcggccaggaccccccgaaguccgcgagcuccaccaagagcaaccacaaggacuccagcauccccaagcagcggcgcguggaggggaagggcucccggagcuccagcgagcacaagggcuccagcggggacaccgccaaccccuucccggugcccucccugcccaacggcaacagcaagcccgggaagccgcaggucaaguucgacaagcagcaggccgaccugcacaugcgcgaggccaagaagaugaagcagaaggccgagcucaugaccgaccgggugggcaaggcguucaaguaccuggaggccgugcuguccuucaucgagugcggcaucgccacggagagcgagucccagagcagcaaguccgccuacagcgucuacuccgagaccguggaccucaucaaguucaucaugagccugaaguccuucagcgacgccaccgcgcccacccaggagaagaucuucgccgugcugugcaugcgcugccaguccauccucaacauggccauguuccggugcaagaaggacaucgccaucaaguacagccgcacgcugaacaagcacuucgaguccagcuccaaggucgcccaggcgcccagccccugcaucgcccgguccaccgggaccccgagcccccugucccccaugcccagcccggccuccagcgugggcagccaguccagcgccggguccgugggcagcuccggggucgcggccaccaucagcacgcccgugaccauccagaacaugaccuccagcuacgugaccaucacgucccacguccucaccgccuucgaccugugggagcaggccgaggcccugacccgcaagaacaaggaguucuucgcgcggcucagcaccaacgugugcacgcuggcccugaacuccagccucguggaccugguccacuacacccgccagggcuuccagcagcugcaggagcucaccaagacccccuga

SEQ ID NO: 26437 - RNA, 3831 nt, Artificial Sequence
  derived and/or modified sequence opt1 from AFF2__Homo_sapiens__NP_001162593
auggaccuguucgacuucuuccgcgacugggaccucgagcagcagugccacuacgagcaggaccggagcgcccugaagaagcgcgagugggagcggcgcaaccaggaggugcagcaggaggacgaccuguucuccagcggcuucgaccucuucggggagcccuacaagaccaacaagggcgacgcccuggcgaaccggguccagaacacccuggggaacuacgacgagaugaagaaccuccugacgaaccacuccaaccagaaccaccuggugggcaucccgaagaacagcgugccccagaaccccaacaacaagaacgagcccuccuucuucccggagcagaagaaccgcaucauccccccccaccaggacaacacccaccccagcgccccgaugcccccccccuccgucgugauccucaacagcacccugauccacuccaaccggaagagcaagccggaguggucccgcgacagccacaaccccuccaccgugcuggccagccaggccuccgggcagcccaacaagaugcagacgcucacccaggaccagagccaggccaagcuggaggacuucuucgucuaccccgcggagcagccgcagaucggcgagguggaggaguccaaccccagcgccaaggaggacuccaaccccaacagcagcggcgaggacgccuucaaggagaucuuccaguccaacagccccgaggaguccgaguucgccgugcaggcgccggggagcccccuggucgccuccagccuccuggcccccuccagcggccuguccgugcagaacuuccccccggggcucuacugcaagaccagcaugggccagcagaagcccaccgccuacgugcggcccauggacgggcaggaccaggcccccgacaucuccccgacgcugaagcccagcaucgaguucgagaacuccuucggcaaccugagcuucggcacccuccuggacgggaagcccuccgcggccagcuccaagaccaagcugccgaaguucaccauccuccagacgagcgaggucucccugcccagcgaccccagcugcguggaggagauccugcgcgagucccagcaccucacccccggcuucacccugcagaaguggaacgacccgaccacgcgggccagcaccaaguccgugagcuucaaguccaugcuggaggacgaccucaagcugagcuccgacgaggacgaccuggagcccgucaagacccucaccacgcagugcaccgccaccgagcuguaccaggccguggagaaggcgaagccccgcaacaaccccgugaacccgccccuggccaccccccagcccccgcccgccguccaggccagcgggggcuccggcagcuccagcgaguccgagagcuccagcgaguccgacagcgacacggagagcuccaccaccgacagcgaguccaacgaggccccccggguggcgacccccgagccggagccccccagcacgaacaaguggcagcucgacaaguggcugaacaaggugaccucccagaacaagagcuucaucugcgggcagaacgagacccccauggagaccaucucccugccgccccccaucauccagcccauggagguccagaugaaggugaagacgaacgccagccaggugccggccgagcccaaggagcgcccccuccugucccugauccgggagaaggcccgcccgcggcccacccagaagauccccgagaccaaggcccucaagcacaagcugagcaccacguccgagaccgucagccagcgcaccaucggcaagaagcagcccaagaagguggagaagaacaccuccaccgacgaguucacguggccgaagcccaacaucaccagcuccacccccaaggagaaggagagcgucgagcugcacgaccccccgcgggggcgcaacaaggcgaccgcccacaagcccgccccccggaaggagccccgcccgaacaucccccucgcccccgagaagaagaaguaccgcggccccgggaagaucgugccgaagucccgggaguucaucgagacggacagcuccaccagcgacagcaacaccgaccaggaggagacccugcagaucaaggugcugccccccugcaucaucuccggcggcaacacggcgaagagcaaggagaucugcggggccucccucacccugagcacccugauguccagcuccggcagcaacaacaaccuguccaucagcaacgaggagcccaccuucuccccgauccccgucaugcagacggagauccucagcccccugcgcgaccacgagaaccugaagaaccucugggugaagaucgaccuggaccugcucucccgggugcccgggcacagcucccugcacgccgccccggccaagcccgaccacaaggagaccgcgaccaagcccaagcgccagaccgccgucacggccguggagaagcccgccccgaagggcaagcggaagcacaagcccaucgagguggccgagaagauccccgagaagaagcagcgccuggaggaggcgaccaccaucugccuccugccgcccugcaucagccccgcccccccgcacaagccccccaacacccgggagaacaacuccagccgccgggccaaccgccggaaggaggagaagcuguuccccccgccccucuccccccugcccgaggacccgccccgccggcgcaacgucagcgggaacaacggccccuucggccaggacaagaacaucgccaugacggggcagaucaccagcaccaagcccaagcggaccgagggcaaguucugcgccacguucaaggggaucuccgagggcgacaccccgaagaaggcgagcuccgccaccaucaccgugacgaacaccgccaucgccaccgcgaccgugacggccaccgccaucgucaccaccacggugaccgccaccgccaccgcgaccgccacgaccaccaccacgaccaccaccaucagcacgaucaccuccaccaucaccacggggcugauggacagcucccaccucgagaugaccagcugggccgcccugccccugcucuccagcuccagcaccaacgugcgccggcccaagcugaccuucgacgacuccguccacaacgccgacuacuacaugcaggaggcgaagaagcugaagcacaaggccgacgcccucuucgagaaguucggcaaggccgugaacuacgccgacgcggcccugagcuucacggagugcggcaacgccauggagcgcgacccccuggaggccaaguccccguacaccauguacagcgagaccguggagcuccugcgguacgcgaugcgccugaagaacuucgccuccccccucgccagcgacggggacaagaagcuggccguccugugcuaccgcugccucucccugcuguaccuccggauguucaagcugaagaaggaccacgccaugaaguacagccgcagccugauggaguacuucaagcagaacgcguccaagguggcccagauccccagccccuggguguccaacggcaagaacaccccgagccccgucucccucaacaacgugagccccaucaacgccauggggaacugcaacaacggccccgugacgaucccgcagcggauccaccacauggccgccucccacgucaacaucaccagcaacgugcugcgcggcuacgagcacugggacauggcggacaagcugacccgggagaacaaggaguucuucggggaccucgacacccugaugggcccccugacgcagcacuccagcaugaccaaccucgugcgcuacguccggcaggggcugugcuggcugcgcaucgacgcccaccuccuguga

SEQ ID NO: 26438 - RNA, 3756 nt, Artificial Sequence
  derived and/or modified sequence opt1 from AFF3__Homo_sapiens__NP_001020279
auggacagcuucgaccuggcccuccugcaggagugggaccuggagucccucuggggcgaggacauccugaaccagcgcaacgacagccugguggucgaguuccaguccagcgccucccggugccgcagcguguacgagcccgaccggaacgcgcuccgccggaaggagcgcgagcggcgcaaccaggagacccagcaggacgacgggaccuucaacuccagcuacucccuguucagcgagccguacaagacgaacaagggcgacgagcuguccaaccggauccagaacacccucgggaacuacgacgagaugaaggacuuccugaccgaccgcagcaaccagucccaccuggugggcguccccaagcccggggugccccagaccccggugaacaagaucgacgagcacuucgucgccgacagccgggcccagaaccagcccuccagcaucugcuccacgaccaccagcacccccgccgccgugcccgugcagcaguccaagcgcggcacgaugggcuggcagaaggcggggcacccgcccagcgacggccagcagcgggccacccagcaggggagccuccgcacccugcugggcgacggggucggccggcagcagccccgcgccaagcaggucugcaacguggaggucggccuccagacccaggagcggcccccggccauggcggccaagcacuccagcuccgggcacugcgugcagaacuucccgcccagccuggccuccaagcccagccuggugcagcagaagcccacggccuacguccgccccauggacggccaggaccaggcccccgacgagucccccaagcucaagagcuccagcgagaccuccgugcacugcaccagcuaccgcggggugccggcguccaagcccgagcccgcccgggccaaggccaagcugagcaaguucuccauccccaagcagggcgaggagagccgguccggcgagaccaacagcugcgucgaggagaucauccgcgagaugacguggcugccgccccucuccgccauccaggcgcccgggaagguggagcccaccaaguucccguuccccaacaaggacagccagcuggugagcuccggccacaacaaccccaagaagggggacgccgagccggagagccccgacaacggcaccuccaacaccagcaugcuggaggacgaccucaagcuguccagcgacgaggaggagaacgagcagcaggccgcccagcgcacggcccugcgggcgcucuccgacagcgccguggugcagcagcccaacugccgcaccuccgugcccagcuccaaggggagcuccagcuccagcuccagcggcagcuccagcuccagcuccgacagcgaguccagcuccggcagcgacuccgagaccgagagcuccagcuccgagagcgagggguccaagccgccccacuucagcucccccgaggccgagcccgccagcagcaacaaguggcagcuggacaaguggcugaacaaggucaacccgcacaagccgcccauccucauccagaacgagucccacggcagcgaguccaaccaguacuacaaccccgugaaggaggacguccaggacugcgggaaggugcccgacgugugccagcccagccugcgggagaaggagaucaaguccacgugcaaggaggagcagcgcccccggaccgccaacaaggcgcccggcagcaagggggucaagcagaaguccccgcccgccgccguggccguggcggucagcgccgccgccccgccgcccgccgugcccugcgcgcccgccgagaacgcccccgcccccgcccgccgguccgcgggcaagaagcccacccgccggaccgagcgcaccagcgccggcgacggggccaacugccaccggcccgaggagccggccgccgcggacgcccugggcacguccguggucgugccgcccgagcccaccaagacccgccccugcgggaacaaccgggccagccaccgcaaggagcuccgguccagcgugaccugcgagaagcgccggacgcgcggccugucccggaucguccccaagagcaaggaguucaucgagaccgaguccagcuccagcagcuccagcuccgacagcgaccuggaguccgagcaggaggaguacccccucagcaaggcccagaccguggcggccuccgccagcuccgggaacgaccagcgccugaaggaggccgccgcgaacggcggcagcgggccccgcgccccggugggcuccaucaacgcccggaccacgagcgacaucgccaaggagcuggaggagcaguucuacacccucguccccuucgggcgcaacgagcugcugagcccccucaaggacagcgacgagauccggucccugugggugaagaucgaccugacccuccugagccgcauccccgagcaccucccgcaggagcccggcgugcuguccgcccccgcgaccaaggacagcgaguccgcgcccccgagccacaccagcgacacgcccgccgagaaggcccugcccaaguccaagcggaagcgcaagugcgacaacgaggacgacuaccgggagaucaagaagucccagggcgagaaggacuccagcucccgccuggccaccagcaccuccaacacccugagcgccaaccacugcaacaugaacaucaacuccgucgccauccccaucaacaagaacgagaagaugcuccggagcccgaucagcccccuguccgacgccuccaagcacaaguacacgagcgaggaccugaccuccagcucccgccccaacgggaacagccucuucaccuccgccagcagcuccaagaagcccaaggcggacagccagcugcagccgcacggcggggaccugaccaaggccgcccacaacaacuccgagaacaucccccuccacaagagccggccccagacgaagcccugguccccgggcagcaacgggcaccgcgacugcaagcggcagaagcugguguucgacgacaugccccgcuccgccgacuacuucaugcaggaggccaagcggaugaagcacaaggcggacgccaugguggagaaguucggcaaggcccugaacuacgccgaggccgcgcucagcuucaucgagugcggcaacgccauggagcaggggcccauggaguccaagagcccguacaccauguacuccgagaccgucgagcugauccgcuacgccaugcggcugaagacccacagcggccccaacgccacgcccgaggacaagcagcucgccgcgcugugcuaccgcugccuggcccuccuguacuggcggauguuccgccugaagcgggaccacgccgugaaguacuccaaggcccucaucgacuacuucaagaacagcuccaaggccgcgcaggcccccagcccguggggcgccuccggcaagagcaccgggacccccucccccaugagccccaacccgagccccgccuccagcguggggucccagggcagccuguccaacgcgagcgcccugucccccagcaccaucgucuccaucccccagcgcauccaccagauggccgccaaccacgugagcaucacgaacuccauccuccacagcuacgacuacugggagauggccgacaaccuggcgaaggagaaccgcgaguucuucaacgaccuggaccuccugauggggccggugacccugcacuccagcauggagcaccucguccaguacucccagcagggccugcacuggcugcggaacagcgcccaccucuccuga

SEQ ID NO: 26439 - RNA, 3492 nt, Artificial Sequence
  derived and/or modified sequence opt1 from AFF4__Homo_sapiens__NP_055238
augaaccgcgaggaccggaacgugcugcgcaugaaggagcgggagcgccggaaccaggagauccagcagggcgaggacgccuucccgcccagcagcccccucuucgccgagcccuacaaggucaccuccaaggaggacaagcuguccagccgcauccaguccaugcuggggaacuacgacgagaugaaggacuucaucggcgaccggagcauccccaagcucguggcgaucccgaagcccaccgugccgcccuccgccgacgagaaguccaaccccaacuucuucgagcagcgccacgggggcucccaccagagcuccaaguggacgcccgucgggcccgcccccagcaccucccagagccagaagcgguccagcggccugcaguccggccacagcucccagcgcaccagcgccgggagcuccagcggcaccaacuccagcgggcagcggcacgaccgcgaguccuacaacaacagcggcuccagcucccggaagaaggggcagcacggcagcgagcacuccaagagccgcuccagcuccccgggcaagccccaggccgugagcucccugaacagcucccacagccggagccacgggaacgaccaccacuccaaggagcaccagcgcagcaagagcccccgggaccccgacgcgaacugggacuccccgucccgcgugcccuucagcuccggccagcacagcacgcaguccuucccgcccagccucauguccaagagcaacuccaugcugcagaagcccaccgccuacguccggcccauggacgggcaggagagcauggagcccaagcuguccagcgagcacuacuccagccagagccacggcaacuccaugaccgagcucaagcccagcuccaaggcccaccugaccaagcugaagaucccgagccagccccucgacgccuccgcgagcggcgacguguccugcguggacgagauccugaaggagaugacgcacagcuggcccccgccccugaccgccauccacacccccugcaagaccgagcccuccaaguucccguuccccacgaaggagagccagcaguccaacuucgggaccggcgagcagaagcgcuacaaccccagcaagaccuccaacgggcaccagagcaaguccaugcucaaggacgaccugaagcugagcuccagcgaggacagcgacggcgagcaggacugcgacaagaccaugccccggagcacgccggggagcaacuccgagcccagccaccacaacuccgagggcgccgacaacagccgcgacgacuccagcucccacagcggcuccgagagcuccagcggguccgacagcgaguccgagagcuccagcuccgacagcgaggccaacgagcccagccaguccgccagccccgagccggagcccccgcccaccaacaaguggcagcucgacaacuggcugaacaaggucaacccccacaaggugucccccgcgagcuccguggacagcaacauccccuccagccagggcuacaagaaggaggggcgcgagcagggcaccgggaacuccuacaccgacacgagcggccccaaggagaccuccagcgccaccccgggccgggacuccaagaccauccagaaggggagcgaguccggccgcgggcggcagaagucccccgcccagagcgacagcacgacccagcgccggaccgucggcaagaagcagcccaagaaggccgagaaggccgcggccgaggagccccgcgggggccugaagaucgaguccgagaccccgguggaccucgccagcagcaugcccuccagccggcacaaggccgccacgaagggcucccgcaagcccaacaucaagaaggagagcaaguccagcccccggccgaccgcggagaagaagaaguacaaguccaccagcaaguccagccagaagucccgcgagaucaucgagaccgacacgagcuccagcgacuccgacgagagcgagucccugccgcccagcucccagacccccaaguaccccgagagcaaccggacccccgugaagcccagcuccgucgaggaggaggacagcuucuuccgccagcggauguucuccccgauggaggagaaggagcugcucagcccccuguccgagcccgacgaccgcuacccccugaucgugaagaucgaccucaaccugcugacccggaucccggggaagcccuacaaggagacggagccgcccaagggcgagaagaagaacgugcccgagaagcacacccgcgaggcccagaagcaggccagcgagaaggucuccaacaaggggaagcggaagcacaagaacgaggacgacaaccgcgccagcgaguccaagaagcccaagaccgaggacaagaacagcgccggccacaagcccuccagcaaccgggaguccagcaagcaguccgcggccaaggagaaggaccuccugcccagcccggccggccccgugcccuccaaggaccccaagaccgagcacgggagccgcaagcgcaccaucucccagagcagcucccucaagagcuccagcaacuccaacaaggagacgagcggcuccagcaagaacuccagcuccaccagcaagcagaagaagaccgaggggaagaccuccagcuccagcaaggaggugaaggagaaggccccguccagcagcuccaacugcccgcccagcgcgcccacgcuggacuccagcaagccccggcgcaccaagcuggucuucgacgaccggaacuacuccgccgaccacuaccugcaggaggccaagaagcucaagcacaacgccgacgcccugagcgaccgcuucgagaaggcgguguacuaccuggacgccguggucuccuucaucgagugcggcaacgcccucgagaagaacgcccaggagagcaagucccccuuccccauguacagcgagaccguggaccugaucaaguacaccaugaagcugaagaacuaccucgcccccgacgcgacggccgccgacaagcggcugaccguccugugccuccgcugcgagucccugcuguaccuccggcuguucaagcugaagaaggagaacgcccugaaguacagcaagacccucaccgagcaccugaagaacuccuacaacaacagccaggccccgucccccgggcugggcagcaaggcggugggcaugcccuccccggugagccccaagcucucccccgggaacagcggcaacuacagcuccggggccagcuccgccagcgccuccggcagcuccgucacgaucccccagaagauccaccagauggcggccagcuacguccaggugaccuccaacuuccuguacgccaccgagaucugggaccaggccgagcagcugagcaaggagcagaaggaguucuucgccgagcucgacaaggugauggggccgcugaucuucaacgcguccaucaugaccgaccuggugcgcuacacgcggcagggccuccacuggcugcgccaggacgccaagcugaucagcuga

SEQ ID NO: 26440 - RNA, 2394 nt, Artificial Sequence
  derived and/or modified sequence opt1 from AFG3L2__Homo_sapiens__NP_006787
auggcccaccgcugccugcggcucuggggccgcgggggcugcuggccccgggggcugcagcagcugcucgugcccggcggggucggccccggcgagcagcccugccugcgcacccuguaccgguucgugaccacgcaggcccgcgcgagccggaacucccuccugaccgacaucaucgccgccuaccagcgcuucugcagccggcccccgaagggguucgagaaguacuuccccaacggcaagaacgggaagaaggccuccgagcccaaggaggugaugggcgagaagaaggagagcaagcccgccgcgaccacccgcuccagcgggggcggcgggggcgggggcggcaagcgcgggggcaagaaggacgacucccacugguggagccgguuccagaagggggacaucccgugggacgacaaggacuuccggauguucuuccuguggacggcccucuucuggggcggggucauguucuaccugcugcucaagcgcuccggccgggagaucaccuggaaggacuucgugaacaacuaccugagcaagggcguggucgaccgccuggagguggugaacaagcgguucguccgcgugaccuucacccccgggaagacgcccguggacggccaguacgucugguucaacaucggguccguggacaccuucgagcggaaccucgagacccugcagcaggagcugggcaucgagggggagaaccgcgugcccgucguguacaucgccgagagcgacggcuccuuccuccugagcaugcugccgaccgugcucaucaucgccuuccugcuguacacgauccggcgcggccccgcggggaucggccgcaccgggcggggcaugggcggccucuucuccgucggggagaccaccgccaaggugcugaaggacgagaucgacgugaaguucaaggacgucgccgggugcgaggaggccaagcuggagaucauggaguucgugaacuuccucaagaaccccaagcaguaccaggaccugggcgccaagauccccaagggggcgauccugacgggcccgcccggcaccgggaagacccuccuggccaaggccaccgccggcgaggccaacgugcccuucaucacggucagcggguccgaguuccuggagauguucgugggcgucgggcccgcgcgcgugcgggaccucuucgcccuggcccgcaagaacgccccgugcauccuguucaucgacgagaucgacgccgugggccggaagcgcggccgggggaacuucggcgggcagagcgagcaggagaacacccucaaccagcugcuggucgagauggacggcuucaacaccaccacgaacguggugauccucgcggggaccaaccgccccgacauccuggaccccgcccugcuccggcccggccgcuucgaccggcagaucuucaucggcccgcccgacaucaaggggcgcgccuccaucuucaagguccaccuccggccccugaagcuggacagcacccuggagaaggacaagcuggcccgcaagcucgccagccugacccccggcuucuccggggcggacguggccaacgugugcaacgaggccgcccugaucgcggcccggcaccugagcgacuccaucaaccagaagcacuucgagcaggccaucgagcgcgucaucggcgggcucgagaagaagacccaggugcugcagccggaggagaagaagacgguggccuaccacgaggccggccacgcggucgccggcugguaccuggagcacgccgacccccuccugaaggugagcaucaucccccgggggaagggccugggguacgcccaguaccucccgaaggagcaguaccuguacaccaaggagcagcugcucgaccgcaugugcaugacccugggcgggcggguguccgaggagaucuucuucggccgcaucacgaccggcgcccaggacgaccugcgcaaggucacccagagcgcguacgcccagaucgugcaguucgggaugaacgagaaggugggccagaucuccuucgaccucccccggcagggggacaugguccuggagaagcccuacagcgaggccaccgcccgccugaucgacgacgaggugcggauccucaucaacgacgccuacaagcgcacgguggcgcugcugaccgagaagaaggccgacgucgagaagguggcccuccugcugcucgagaaggaggugcuggacaagaacgacauggucgagcugcucggcccccggccguucgccgagaaguccaccuacgaggaguucguggagggcaccgggagccuggacgaggacaccucccugcccgagggccucaaggacuggaacaaggagcgcgagaaggagaaggaggagccgcccggggagaagguggcgaacuga

SEQ ID NO: 26441 - RNA, 1800 nt, Artificial Sequence
  derived and/or modified sequence opt1 from AFM__Homo_sapiens__NP_001124
augaagcugcucaagcugaccggcuucaucuucuuccuguucuuccucaccgagagccugacgcugcccacccagccccgcgacaucgagaacuucaacuccacccagaaguucaucgaggacaacaucgaguacaucaccaucaucgccuucgcccaguacgugcaggaggcgacguucgaggagauggagaagcucgucaaggacaugguggaguacaaggaccggugcauggccgacaagacccugcccgagugcagcaagcugcccaacaacgugcuccaggagaagaucugcgccauggaggggcugccccagaagcacaacuucucccacugcugcagcaaggucgacgcccagcgccggcugugcuucuucuacaacaagaaguccgacgugggcuuccucccgcccuuccccacccuggaccccgaggagaagugccaggccuacgagagcaaccgcgagucccugcucaaccacuuccuguacgagguggcgcggcgcaacccguucgucuucgcccccacccugcucacgguggccgugcacuucgaggaggucgccaagagcugcugcgaggagcagaacaaggugaacugccugcagacccgggcgauccccgugacccaguaccugaaggccuucuccagcuaccagaagcacgucugcggggcccuccugaaguucggcaccaagguggugcacuucaucuacaucgccauccugucccagaaguuccccaagaucgaguucaaggagcucaucagccuggucgaggacguguccagcaacuacgacgggugcugcgagggcgacgugguccagugcauccgcgacacguccaaggugaugaaccacaucugcagcaagcaggacuccaucagcuccaagaucaaggagugcugcgagaagaagaucccggagcggggccagugcaucaucaacagcaacaaggacgaccgccccaaggaccugagccuccgggaggggaaguucaccgacuccgagaacgugugccaggagcgcgacgccgaccccgacaccuucuucgcgaaguucaccuucgaguacagccggcgccaccccgaccuguccaucccggagcugcuccggaucguccagaucuacaaggaccugcugcgcaacugcugcaacacggagaacccgcccggcugcuaccgguacgccgaggacaaguucaacgagaccaccgagaagucccucaagauggugcagcaggagugcaagcacuuccagaaccuggggaaggacggccugaaguaccacuaccucauccgccugaccaagaucgcgccccagcugagcacggaggagcucgugagccugggggagaagauggucaccgccuucacgaccugcugcacccuguccgaggaguucgccugcguggacaaccucgccgaccuggucuucggcgagcugugcggcgugaacgagaaccggaccaucaaccccgccguggaccacugcugcaagaccaacuucgccuuccgccggcccugcuucgagagccucaaggccgacaagaccuacgucccgccgcccuucucccaggaccuguucacguuccacgccgacaugugccagagccagaacgaggagcugcagcgcaagaccgaccgcuuccucgugaaccuggugaagcugaagcacgagcugaccgacgaggagcuccagucccuguucaccaacuucgcgaacgucguggacaagugcugcaaggccgagagccccgaggugugcuucaacgaggagucccccaagaucgggaacuga

SEQ ID NO: 26442 - RNA, 1830 nt, Artificial Sequence
  derived and/or modified sequence opt1 from AFP__Homo_sapiens__NP_001125
augaaguggguggagagcaucuuccugaucuuccuccugaacuucaccgagucccgcacccugcaccggaacgaguacggcaucgccagcauccucgacuccuaccagugcacggccgagaucagccuggcggaccuggccaccaucuucuucgcccaguucguccaggaggccaccuacaaggagguguccaagauggugaaggacgcccucaccgcgaucgagaagcccacgggggacgagcagagcuccggcugccuggagaaccagcugcccgccuuccucgaggagcugugccacgagaaggagauccuggagaaguacgggcacagcgacugcugcucccagagcgaggagggccgccacaacugcuuccucgcccacaagaagcccacccccgccuccaucccccuguuccaggucccggagcccgugaccagcugcgaggcguacgaggaggaccgggagaccuucaugaacaaguucaucuacgagaucgcccgccggcaccccuuccuguacgcccccacgauccuccugugggccgcccgcuacgacaagaucaucccguccugcugcaaggcggagaacgccguggagugcuuccagaccaaggccgccaccgucaccaaggagcugcgggagagcucccuccugaaccagcacgccugcgcggugaugaagaacuucgggacgcgcaccuuccaggccaucaccgugaccaagcugagccagaaguucacgaaggucaacuucaccgagauccagaagcucgugcuggacguggcccacguccacgagcacugcugccggggcgacgugcuggacugccuccaggacggcgagaagaucauguccuacaucugcagccagcaggacacccuguccaacaagaucaccgagugcugcaagcugacgacccucgagcgcgggcagugcaucauccacgccgagaacgacgagaagcccgagggccugagccccaaccugaaccgguuccucggggaccgcgacuucaaccaguucagcuccggcgagaagaacaucuuccuggccagcuucgugcacgaguacucccggcgccacccccagcuggcggucagcgugauccuccggguggccaagggguaccaggagcugcuggagaagugcuuccagaccgagaacccgcucgagugccaggacaagggcgaggaggagcugcagaaguacauccaggagucccaggcccuggccaagcgcagcugcggccucuuccagaagcugggggaguacuaccugcagaacgccuuccucgucgcguacaccaagaaggcgccccagcugacguccagcgagcugauggccaucacccggaagauggccgccaccgccgcgaccugcugccagcucuccgaggacaagcugcuggccugcggcgagggggccgccgacaucaucaucggccaccucugcauccgccacgagaugacgcccgugaaccccggcguggggcagugcugcaccagcuccuacgccaaccggcgcccgugcuucagcucccuggucguggacgagaccuacgugccgcccgccuucagcgacgacaaguucaucuuccacaaggaccugugccaggcccagggcgucgcccugcagaccaugaagcaggaguuccucaucaaccuggugaagcagaagccccagaucacggaggagcagcuggaggcggucaucgccgacuucuccgggcuccuggagaagugcugccagggccaggagcaggaggugugcuucgccgaggaggggcagaagcugaucagcaagacccgggccgcccucggcguguga

SEQ ID NO: 26443 - RNA, 1041 nt, Artificial Sequence
  derived and/or modified sequence opt1 from AGA__Homo_sapiens__NP_000018
auggcccgcaagagcaaccugcccgugcuccuggucccguuccugcucugccaggcccuggugcggugcuccagcccccugccccucguggucaacaccuggcccuucaagaacgcgaccgaggccgccuggcgcgcccuggccuccggcgggagcgcgcuggacgccguggaguccggcugcgccaugugcgagcgggagcagugcgacgggagcgugggcuucgggggcuccccggacgagcucggcgagacgacccuggacgccaugaucauggacgggaccaccauggacgucggcgcggugggggaccugcgccggaucaagaacgccaucggcguggcccgcaagguccucgagcacacgacccacacccugcuggugggggagagcgccaccacguucgcccaguccaugggcuucaucaacgaggaccucagcaccaccgcgucccaggcccugcacagcgacuggcuggcccggaacugccagcccaacuacuggcgcaacgugauccccgaccccuccaaguacugcggcccguacaagccgcccgggauccucaagcaggacauccccauccacaaggagaccgaggacgaccggggccacgacacgaucgggauggucgugauccacaagaccggccacaucgccgccggcaccagcaccaacgggaucaaguucaagauccacggccgcgugggggacucccccauccccggcgcgggggccuacgccgacgacacggccggcgccgcggccgccaccggcaacggggacauccugaugcgguuccugcccagcuaccaggccgucgaguacaugcgccggggcgaggaccccaccaucgccugccagaaggugaucucccgcauccagaagcacuucccggaguucuucggggcggugaucugcgccaacgucaccggcagcuacggggccgccugcaacaagcucuccacguucacccaguucagcuucaugguguacaacagcgagaagaaccagcccaccgaggagaagguggacugcaucuga

SEQ ID NO: 26444 - RNA, 2574 nt, Artificial Sequence
  derived and/or modified sequence opt1 from AGAP1__Homo_sapiens__NP_001032208
augaacuaccagcagcagcuggccaacagcgccgcgauccgcgccgagauccagcgguucgaguccgugcaccccaacaucuacagcaucuacgagcuccuggagcgcgucgaggagccggugcugcagaaccagauccgggagcacgugaucgccaucgaggacgccuucgucaacucccaggaguggacccucagccgcuccgugcccgagcugaaggugggcaucgucgggaaccuggccagcggcaaguccgcgcucgugcaccgguaccugaccgggacguacgugcaggaggagagccccgagggcgggcgcuucaagaaggagaucgucguggacggccaguccuaccugcuccugauccgggacgagggcgggcccccggaggcccaguucgccauguggguggacgccgucaucuucguguucagccuggaggacgagaucuccuuccagaccguguaccacuacuacagccgcauggcgaacuaccggaacaccuccgagaucccccucguccuggugggcacccaggacgccaucagcuccgccaacccccgcgugaucgacgacgcccgggcccgcaagcugagcaacgaccucaagcggugcacguacuacgagaccugcgcgaccuacgggcugaacgucgagcgcguguuccaggacguggcccagaagaucgucgccacccggaagaagcagcagcuguccaucggccccugcaagagccucccgaacucccccagccacagcuccgugugcagcgcccagguguccgccguccacaucagccagacguccaacgggggcggcagccuguccgacuacagcuccagcgugcccuccacccccagcaccucccagaaggagcugcgcaucgacgucccgcccaccgcgaacacgcccacccccgugcggaagcagagcaagcgccgguccaaccucuucaccagccgcaagggguccgacccggacaaggagaagaagggccuggagagccgggccgacuccaucgggagcggccgcgccauccccaucaagcagggcaugcugcucaagcgcagcgggaagucccugaacaaggaguggaagaagaaguacgugacccugugcgacaacggcguccucacguaccaccccagccugcacgacuacaugcagaacgugcacgggaaggagaucgaccugcuccggaccaccgugaagguccccggcaagcgcccgccccgggccaccuccgccugcgcgcccaucagcucccccaagacgaacgggcugagcaaggacauguccagccugcacaucuccccgaacagcggcaacgugaccuccgccagcggcucccagauggccagcgggaucucccucgugagcuucaacucccgccccgacggcaugcaccagcggagcuacagcgucuccagcgccgaccagugguccgaggccaccgugaucgcgaacagcgccaucuccagcgacaccgggcugggcgacuccgugugcagcucccccagcaucuccagcacgaccucccccaagcuggacccgccgcccagcccccacgccaaccgcaagaagcaccggcgcaagaaguccaccagcaacuucaaggccgacgggcucuccggcaccgcggaggagcaggaggagaacuucgaguucaucaucgucagccugacgggccagaccuggcacuucgaggccaccaccuacgaggagcgggacgccugggugcaggccaucgagucccagauccuggccagccuccagagcugcgaguccagcaagaacaagucccgccugacgagccaguccgaggcgauggcccugcagagcauccggaacaugcgcgggaacucccacugcguggacugcgagacccagaaccccaacugggccagccucaaccugggcgcccugaugugcaucgagugcuccgggauccaccggaaccucggcacccaccugagccgcguccggucccuggaccucgacgacuggcccguggagcugaucaaggugaugagcuccaucgggaacgagcuggccaacagcgucugggaggaguccagccagggccgcaccaagcccuccguggacagcacgcgggaggagaaggagcgcuggauccgggcgaaguacgagcagaagcuguuccucgccccgcugcccugcaccgagcugucccucggccagcaccuccugcgcgccaccgccgacgaggaccugcgcaccgccauccugcugcucgcgcacgggagccgggacgaggugaacgagaccugcggcgagggggacggccgcacggcccugcaccuggccugccggaagggcaacgucgugcucgcccagcugcugaucugguacgggguggacgucaccgcgcgcgacgcccacggcaacaccgcccucgccuacgcccggcaggcgagcucccaggagugcaucgacgugcugcugcaguacgggugccccgacgagcgcuucgugcucauggccacccccaaccugagccggcgcaacaacaaccggaacaacuccagcggccgcgucccgacgaucaucuga

SEQ ID NO: 26445 - RNA, 3579 nt, Artificial Sequence
  derived and/or modified sequence opt1 from AGAP2__Homo_sapiens__NP_001116244
augagccgcggcgccggggcccugcagcggcgcaccaccacguaccucaucucccugacccuggugaagcucgagagcguccccccgcccccccccuccccgagcgcggccgccgccggcgccgcgggggcccggggcuccgagaccggggaccccggcagcccccgcggcgccgaggagcccgggaagaagcggcacgagcgccuguuccaccggcaggacgcccuguggaucuccaccagcuccgcgggcacggggggcgccgagccgcccgcccucagccccgcccccgccuccccggcgcgccccgugagccccgcccccgggcggcgccugucccugugggccgugccgcccggccccccccucagcggcgggcuguccccggaccccaagcccggcggggcccccaccagcucccggcgcccgcugcucagcucccccagcuggggcggccccgagcccgaggggcgggccggcgggggcaucccggggagcuccagcccccaccccggcaccggcucccgccggcugaaggucgcgccgcccccccccgccccgaagcccugcaagaccgugacgaccagcggggccaaggccggcgggggcaagggggccggcucccgccugagcuggcccgaguccgagggcaagccccgggugaaggggagcaaguccagcgcgggcaccggggccuccgucagcgccgccgccaccgcggccgccgccggcgggggcggcuccacggcgagcaccuccgggggcgugggggccggcgccggcgcccgcgggaagcucagcccgcggaagggcaaguccaagacccuggacaacagcgaccugcaccccgggccccccgccggcuccccgcccccccucacccugcccccgacgcccagccccgcgaccgccgugaccgccgccagcgcccagcccccggggcccgcgccccccaucacccuggagccgcccgcccccggccucaagcgcggccgggaggggggccgcgccuccacgcgcgaccggaagaugcugaaguucaucagcgggaucuucaccaaguccaccggcgggccgcccggcagcggcccccugcccgggccgcccucccucagcuccggcagcgggucccgcgagcugcugggcgccgagcuccgggccagccccaaggcggucaucaacucccaggaguggacccugagccgcuccauccccgagcugcggcucggggugcugggcgacgcccgcagcggcaaguccagccugauccaccgguuccucacgggguccuaccaggugcuggagaagaccgagagcgagcaguacaagaaggagaugcuggucgacggccagacccaccucgugcugauccgcgaggaggccggggccccggacgcgaaguucagcggcugggccgacgccgugaucuucgucuucucccuggaggacgagaacagcuuccaggccgugucccggcuccacgggcagcugagcucccugcgcggcgagggccgggggggccucgcccuggcgcugguggggacccaggaccgcaucagcgccuccagcccccgggucgugggcgacgcccgcgcccgggcccucugcgcggacaugaagcgcugcuccuacuacgagacgugcgccaccuacggccugaacguggaccgggucuuccaggagguggcccagaagguggucacccugcgcaagcagcagcagcuccuggccgccugcaagagccugcccuccagccccucccacagcgcggccuccaccccgguggccgggcaggccagcaacggcgggcacacguccgacuacagcuccagccugcccagcucccccaacgucggccaccgggagcuccgcgcggaggccgccgccguggccgggcugagcacccccggcucccugcaccgcgcggccaagcggcgcaccagccucuucgccaaccggcgcggcuccgacagcgagaagcggucccuggacagccgcggggagaccacgggcuccgggcgggccaucccgaucaagcagagcuuccugcucaagcgcuccggcaacagccugaacaaggaguggaagaagaaguacgugacccuguccagcaacggguuccuccuguaccaccccuccaucaacgacuacauccacagcacccacggcaaggagauggaccugcuccggaccaccgucaaggugcccggcaagcgccccccgcgggccaucuccgcguucgggcccagcgccuccaucaacggccuggugaaggacaugagcacgguccagaugggggagggccuggaggccaccacccccaugcccagcccgucccccagccccuccagccuccagcccccgcccgaccagaccuccaagcaccugcugaagcccgaccgcaaccucgcccgggcccugagcacggacugcaccccguccggggaccugagcccccucucccgcgagccccccccgagccccauggugaagaagcagcggcgcaagaagcugaccacccccuccaagacggagggcagcgcgggccaggccgaggccaagcggaagauguggaagcugaaguccuucgggagccuccgcaacaucuacaaggccgaggagaacuucgaguuccugaucguguccagcaccggccagaccuggcacuucgaggccgcguccuucgaggagcgggacgccuggguccaggccaucgagagccagauccuggccucccuccagugcugcgagagcagcaaggugaagcugcgcaccgacucccagagcgaggcgguggccauccaggccauccggaacgccaaggggaacuccaucugcgucgacugcggcgcccccaacccgacgugggcgagccugaaccucggcgcccugaucugcaucgagugcuccgggauccaccgcaaccugggcacccaccucagccgcgugcggucccuggaccuggacgacuggccccgcgagcucacccuggugcugaccgccaucgggaacgacacggccaaccgggucugggagagcgacacccgcggccgggccaagcccucccgcgacagcucccgggaggagcgcgagagcuggauccgggcgaaguacgagcagcuccuguuccuggccccccucuccaccagcgaggagccgcuggggcgccagcugugggccgccgugcaggcccaggacguggcgaccguccuccugcugcucgcccacgcccggcacggcccccuggacacguccguggaggacccccagcugcgcagcccccuccaccuggccgcggagcuggcccacguggucaucacccagcuccugcugugguacggcgccgacguggccgcccgggacgcgcaggggcgcaccgcccucuucuacgcccggcaggccggcucccagcugugcgccgacauccugcuccagcacgggugcccgggcgaggggggcagcgcggccaccacgcccuccgccgccaccacccccagcaucaccgccacgcccagcccgcgccggcgcuccagcgcggccuccgugggccgggccgacgcccccgucgcgcugguguga

SEQ ID NO: 26446 - RNA, 1191 nt, Artificial Sequence
  derived and/or modified sequence opt1 from AGAP3__Homo_sapiens__NP_001036000
augaacuuccaggccggcgggggccagagcccccagcagcagcagucccuggccgcgcccgggggcgggggcgccgccgcccagcagcucgugugcggcgggcaguucggcggggccggcccgggggcgggcggcgggggcgggcccagccagcagcuggccggcgggcccccgcagcaguucgcccuguccaacagcgccgcgauccgcgccgagauccagcgguucgaguccguccaccccaacaucuacgccaucuacgaccucaucgagcgcaucgaggaccuggcccugcagaaccagauccgggagcacgugaucagcaucgaggacuccuucgugaacagccaggaguggacccucucccgcagcguccccgagcugaagguggggaucgugggcaaccuguccagcgggaaguccgcccucguccaccgguaccugaccggcacguacgugcaggaggagagccccgagggcggccgcuucaagaaggagaucguggucgacggccaguccuaccugcuccugauccgggacgagggcgggccgcccgagcugcaguucgcggccuggguggacgccguggucuucguguucagccucgaggacgagaucuccuuccagaccguguacaacuacuuccugcgccugugcagcuuccggaacgccuccgagguccccauggugcucguggggacccaggacgccaucagcgcggccaacccccgcgucaucgacgacagccgggcccgcaagcuguccaccgaccugaagcggugcacguacuacgagaccugcgccaccuacggccucaacguggagcgcguguuccaggacgucgcccagaaggugguggcgcugcggaagaagcagcagcuggccaucgggccgugcaagagccuccccaacucccccagccacuccgccgucagcgccgccuccauccccgcggugcacaucaaccaggccaccaacggcggcgggagcgccuucuccgacuacagcuccagcgucccguccacgcccagcaucucccagcgcgagcugcggaucgagaccaucgccgcgagcuccacccccacccccauccgcaagcagagcaagcggcgcuccaacaucuucacgaucugcgccaccgugagcaacuucagcuccaccaagcggccguuccagcugcuccccaacuga

SEQ ID NO: 26447 - RNA, 1992 nt, Artificial Sequence
  derived and/or modified sequence opt1 from AGAP4__Homo_sapiens__NP_597703
augggcaacauccugaccugccgcgugcaccccagcgucucccucgaguucgaccagcagcaggggagcgugugcccguccgagagcgagaucuacgaggccggcgccggggaccggauggcgggcgcccccauggccgccgccgugcagcccgcggaggucaccguggaggugggggaggaccugcacaugcaccacguccgcgaccgggagaugcccgaggcccuggaguucaacccguccgccaaccccgaggccagcacgaucuuccagcgcaacucccagaccgacgugguggagauccggcgcagcaacugcaccaaccacgucuccaccgugcgguucagccagcaguacucccucugcagcacgaucuuccuggacgacuccaccgcgauccagcacuaccugaccaugaccaucaucagcgugacgcucgagaucccccaccacaucacccagcgcgacgccgaccggucccugagcauccccgacgagcagcugcacuccuucgccgucagcaccgugcacaucaugaagaagcgcaacggcggcgggucccucaacaacuacagcagcuccaucccgagcacccccuccacgagccaggaggacccccaguucuccgugcccccgaccgccaacacccccacccccgucugcaagcggagcaugcgcugguccaaccuguucacgagcgagaagggcuccgaccccgacaaggagcggaaggccccggagaaccacgcggacaccaucgggagcggccgcgccauccccaucaagcaggggaugcugcucaagcgguccggcaaguggcugaagaccuggaagaagaaguacgugacccugugcagcaacggcgugcucacguacuacuccagccugggggacuacaugaagaacauccacaagaaggagaucgaccugcagaccuccaccaucaagguccccggcaaguggcccagccucgccaccuccgccugcacgccgaucagcaccuccaagagcaacgggcugagcaaggacauggacaccggccugggcgacuccaucugcuucagccccuccaucagcuccaccacgagccccaagcucaacccgccgcccagcccccacgccaacaagaagaagcaccugaagaagaaguccaccaacaacuucaugaucguguccgcgaccgggcagaccuggcacuucgaggccacgaccuacgaggagcgcgacgccugggugcaggccauccagagccagauccuggccucccuccagagcugcgaguccagcaaguccaagagccagcugaccucccagagcaaggcgauggcccugcagagcauccagaacaugcggggcaacgcccacugcgucgacugcgagacccagaaccccaagugggccucccucaaccugggggugcugaugugcaucgagugcagcggcauccaccgcucccucgggacgcggcugagccgcgugcggucccuggagcucgacgacuggcccgucgagcugcgcaaggugaugagcuccaucggcaacgaccuggccaacagcaucugggagggcuccagccaggggcagaccaagcccuccgagaaguccacccgcgaggagaaggagcgguggauccgcagcaaguacgaggagaagcuguuccucgcgccccugccgugcaccgagcucagccugggccagcagcugcuccgggccaccgccgacgaggaccugcagacggccauccugcuccuggcgcacgggucccgcgaggaggucaacgagaccugcggcgagggggacggcugcaccgcccugcaccucgccugccggaagggcaacguggugcuggcccagcugcugaucugguacggggucgacgugauggcccgcgacgcgcacggcaacaccgcccucacguacgcccggcaggccagcucccaggagugcaucaacgugcugcugcaguacgggugccccgacaagugcgucuga

SEQ ID NO: 26448 - RNA, 3201 nt, Artificial Sequence
  derived and/or modified sequence opt1 from AGBL1__Homo_sapiens__NP_689549
augaucagcaagggcggguccgaggcccugcuccagacccugguggacaccgcccgcacggcgcccccggacuacgacauccugcucccccuguuccggcugcucgccaaggucggccugcgcgacaagaagaucgggcggaaggcccuggagcucgaggcccuggacgugacccugauccucgcccgcaagaaccugagccacggccagaaccugcuccacugccugugggcgcugcggguguucgccuccagcgucuccaugggggccaugcucggcaucaacggcgccauggagcugcuguucaaggugaucacccccuacacccgcaagcggacgcaggcgauccgcgccgccaccgaggugcucgccgcccugcucaagagcaaguccaacgggcggcgcgcggucaaccggggcuacgugaccagccugcuggggcugcaccaggacuggcacucccacgacaccgccaacgccuacgugcagauccgccggggccuccugcugugccuccgccacaucgccgcccugcggagcgggcgcgaggcguuccuggccgcccagggcauggagauccucuucuccacgacccagaacugccuggacgacaagagcauggagcccgucaucuccguggugcugcagauccuccggcagugcuacccgaccagcccccugccccuggucaccgccuccagcgccuacgcguuccccgugccgggcugcaucacgaccgagccgccccacgaccuccccgaggaggacuucgaggacgacggggacgacgagguggacaaggacuccgacaccgaggacggcaaggucgaggacgacgaccuggagaccgacgugaacaagcugagcuccaagcccgggcucgaccgccccgaggaggagcugaugcaguacgaggugaugugccuggagcucagcuacagcuucgaggagcugcaguccaagcugggcgacgaccucaacagcgagaagacgcaguacgccaaccaccaccacauccccgccgccgccuccagcaagcagcacugcuacuccaaggaccagagcuccugcggccaggagcgggaguacgcgguccagaccagccugcugugccgcgugaagaccgggcgguccaccgugcaccugggcagcaagaagaaccccggggucaaccucuaccagaacgugcaguccaacagccugcgccgcgacuccagcgaguccgagaucccggacauccaggccagccccaaggccgacgccugggacguggacgcgaucuucugcccccggauguccgccagcuucuccaacagcacgcgcacccgggaggucgugaaggucaucgacaagcugcuccagacccaccugaagcgcgugcccuuccacgacccguaccuguacauggccaaggcccggcgcaccagcuccguggucgacuucaagaugauggccuuccccgacguguggggccacugcccgccgcccacgacccagcccaugcucgagcggaagugcggggugcagcgcauccggaucuucgaggacauccgccggcugauccagcccagcgacgucaucaacaaggugguguucucccuggacgagcccuggccccuccaggacaacgcgagcaacugccugcgcuucuucuccaaguucgagagcggcaaccugcggaaggccauccagguccgcgaguucgaguacgaccuccuggugaacgccgacgugaacuccacccagcaccagcagugguucuacuucaaggucagcggcaugcaggccgccauccccuaccacuucaacaucaucaacugcgagaagcccaacucccaguucaacuacgggaugcagccgacccuguacagcgugaaggaggcgcuccugggcaagcccacguggauccggaccgggcacgagaucugcuacuacaagaaccacuaccgccaguccaccgccguggccggcggggccagcggcaagugcuacuacacccugacguucgccgucaccuucccccacuccgaggacgugugcuaccucgcguaccacuaccccuacaccuacaccgcccugaugacgcaccuggacauccucgagaaguccgugaaccugaaggaggucuacuuccggcaggacgugcugugccagacccucggcgggaacccgugcccccuggugaccaucaccgccaugcccgagagcaacagcgacgagcaccuggagcaguuccgccaccggcccuaccaggucaucaccgcccgcgugcacccgggcgaguccaacgcgagcugggugaugaaggggacgcucgaguuccuggucagcuccgaccccguggcccgccugcuccgggagaacuucaucuucaagaucauccccaugcugaaccccgacggcgugaucaacgggaaccaccgcugcagccuguccggcgaggaccucaaccggcaguggcugagcccguccgcccaccuccagcccaccaucuaccacgccaagggccugcuguaccaccugagcuccaucgggcgcagccccgucguguucugcgacuuccacggccacucccagaagaagaacguguuccucuacgggugcagcaucaaggagacccuguggcaggccgcgugcaccgucggcacguccaccauccuggaggaggugaacuaccggacccuccccaagauccuggacaagcuggccccggccuucaccaugagcuccugcagcuuccucguggagaagucccgcgccagcacggcccgggucgugguguggcgcgagaugggcgucucccggagcuacaccauggaguccagcuacugcgggugcaaccagggccccuaccagugcacccagcgccugcuggagcggaccaagaacgagcgcgcgcaccccguggacgggcuccagggccugcaguucgggacgcgggagcuggaggagaugggcgccauguucugccucggccugcugauccucgagcucaagagcgccuccugcagccaccagcugcuggcccaggccgcgacccugcuguccgccgaggaggacgcccucgaccagcaccuccagcgccucaagagcuccaacuuccugcccaagcacaucugguucgccuaccacuucuucgcgaucaccaacuucuucaagaugaaccugcugcugcacgugagcccggucugcgacaccuga

SEQ ID NO: 26449 - RNA, 2709 nt, Artificial Sequence
  derived and/or modified sequence opt1 from AGBL2__Homo_sapiens__NP_079059
auguuccccgcccuggagacccaccucaagcagaccaucccggaccccuacgaggacuucauguaccgccaccuccaguacuacggcuacuucaaggcccagcgggggagccugcccaacuccgcgacgcaccagcacgugcgcaagaacaacccccagugccuccugaacggcagccugggggagaaggacgaccucaucccggacacccugcagaaggagaagcugcucuggcccaucucccugagcuccgccguccaccggcagaucgaggccaucaaccgcgacuuccacagcugccugggcuggaugcaguggcgggggcucuccagccugcagccgccgccgccccgcuucaaggacucccccgccagcgccuuccggguggcgggcaucaccgacucccacaugcugagccucccccaccuccgcucccggcagcugcuguacgacgagcuggacgaggugaacccccgccugcgggagccccaggagcuguucagcauccuguccaccaagcgcccccugcaggcgccccgguggcccaucgagugcgaggucaucaaggagaacauccaccacaucgagugggccccgccccagcccgaguacuucuaccagcccaagggcaacgagaaggugcccgagaucgugggggagaagaagggcacggucguguaccagcucgacagcgugcccaucgagggguccuacuucaccagcucccgcgucggcgggaagcggggcaucgugaaggagcuggccgugacccugcagggccccgaggacaacacccuccuguucgagagccgcuucgagagcgggaaccugcagaaggccguccggguggacacguacgaguacgagcucacccugcgcaccgaccuguacaccaacaagcacacgcagugguucuacuuccgggugcagaacacccgcaaggacgccaccuaccgguucaccaucgucaaccuccugaagccgaagucccuguacacggugggcaugaagccccuccuguacagccagcuggacgccaacacccgcaacaucggguggcgccgggagggcaacgagaucaaguacuacaagaacaacaccgacgacggccagcagcccuucuacugccucaccuggacgauccaguuccccuacgaccaggacacgugcuucuucgcccacuucuacccguacaccuacaccgaccugcagugcuaccugcucuccguggccaacaaccccauccagagccaguucugcaagcugcagacccugugccgcucccucgcggggaacaccgucuaccugcugaccaucaccaaccccagccagacgccgcaggaggccgccgccaagaaggccguggugcucuccgcgcggguccaccccggcgagagcaacggguccugggugaugaagggcuuccuggacuucauccugagcaacucccccgacgcccagcugcuccgcgacaucuucguguucaagguccugcccaugcugaacccggacggggugaucgucggcaacuaccggugcagccucgccggccgcgaccugaaccggcacuacaagaccauccugaaggaguccuuccccugcaucugguacacccgcaacaugaucaagcggcuccuggaggagcgcgaggugcugcucuacugcgacuuccacgggcacagccggaagaacaacaucuuccuguacggcugcaacaacaacaaccgcaaguacuggcugcacgagcggguguucccccucaugcugugcaagaacgcccccgacaaguucuccuuccacagcugcaacuucaagguccagaagugcaaggaggggaccggccgcguggugauguggcggauggggauccugaacuccuacacgauggagagcaccuucggcggcuccacccucgggaacaagcgcgacacccacuucacgaucgaggaccucaagagccugggcuaccacgucugcgacacccugcuggacuucugcgacccggaccagaugaaguucacccagugccuggccgagcucaaggagcugcugcggcaggagauccacaagaaguuccacgagcucgggcaggacguggaccuggagggcagcugguccgacaucagccuguccgacaucgagagcuccaccagcggguccgacagcucccucagcgacggccugcccgugcaccuggcgaacaucgccgacgagcucacccagaagaagaagauguucaagaagaagaagaagaagucccugcagacgcgcaagcagcggaacgagcaguaccagaagaagaaccugaugcagaagcucaagcugaccgaggacaccagcgagaaggccggcuucgccuccacccugcagaagcagcccacguucuucaagaacagcgagaacuccagcuuccuccccaugaagaacgagaacccgcgccugaacgagaccaaccugaaccgccgggacaaggacacgccccucgaccccuccauggccacccugauccugcccaagaacaaggggcgcaugcagaacaagaagccgggcuucaccgucagcugcagccccaagcggaccaucaacuccagccaggagcccgcgcccgggaugaagccgaacuggccccgcucccgguaccccgccaccaagcgcggcugcgccgccauggcggccuaccccagccuccacaucuacaccuacccguga

SEQ ID NO: 26450 - RNA, 2763 nt, Artificial Sequence
  derived and/or modified sequence opt1 from AGBL3__Homo_sapiens__NP_848658
augagcgaggacuccgagaaggaggacuacagcgaccgcaccaucuccgacgaggacgagagcgacgaggacauguucaugaaguucguguccgaggaccugcaccggugcgcccuccugaccgccgacagcuucggcgaccccuucuucccgcgcacgacccagauccugcucgaguaccagcuggggcggugggucccccgccugcgggagccccgcgaccucuacggcguguccagcuccgggccccugagcccgacccgguggcccuaccacugcgaggugaucgacgagaagguccagcacaucgacuggacccccuccugccccgagccgguguacauccccacgggccuggagaccgagccccucuaccccgacagcaaggaggcgaccguggucuaccuggccgaggacgccuacaaggagccgugcuucguguacucccgcgucgggggcaaccggacgccccugaagcagcccguggacuaccgcgacaacacccucauguucgaggcccgguucgagagcggcaaccugcagaagguggugaaggucgccgaguacgaguaccagcugaccgugcgccccgaccucuucaccaacaagcacacccagugguacuacuuccaggugacgaacaugcgggcggggaucgucuaccgcuucaccaucgugaacuucaccaagccggccucccuguacagccggggcaugcgcccccuguucuacuccgagaaggaggccaaggcccaccacaucggguggcagcggaucggcgaccagaucaaguacuaccgcaacaaccccgggcaggacggccggcacuacuucagccucaccuggacguuccaguucccccacaacaaggacacgugcuacuucgcgcacugcuacccguacaccuacaccaaccugcaggaguaccuguccggcaucaacaacgaccccgugcgcagcaaguucugcaagauccggguccucugccacacccuggcccgcaacaugguguacauccugaccaucaccacgccccucaagaacagcgacucccgcaagcggaaggccgugauccugaccgcccgcguccaccccggggagaccaacagcuccuggaucaugaagggcuuccuggacuacauccucgggaacagcuccgacgcccagcugcugcgggacaccuucguguucaagguggucccgaugcucaaccccgacggcgugaucgucggcaacuaccgcugcagccuggcggggcgggaccugaaccgcaacuacaccucccuccugaaggagagcuuccccuccgugugguacacgcggaacauggugcaccgccugauggagaagcgggaggucauccucuacugcgaccugcacggccacagccgcaaggagaacaucuucauguacgggugcgacggcuccgaccggagcaagacccuguaccuccagcagcgcaucuucccccugaugcuguccaagaacugcccggacaaguucagcuucuccgccugcaaguucaacgugcagaaguccaaggaggggaccggccggguggucauguggaagaugggcauccgcaacagcuucaccauggaggccacguucugcgggagcacccucggcaacaagcgggggacccacuucuccaccaaggaccuggagagcaugggcuaccacuucugcgacagccugcucgacuacugcgaccccgaccgcacgaaguacuaccggugccugaaggagcuggaggagauggagcgccacaucacccucgagaagguguucgaggacuccgacacccccgugaucgacaucacccuggacgucgagagcuccagccggggguccgacagcuccgagagcaucgacucccugaccuaccugcucaagcugacgagccagaagaagcaccugaagaccaagaaggagcgcaacuccaccaucgccagccaccagaacgcccgcggccaggagguguacgaccggggccaccuccugcagcgccacacccaguccaacagcgacgugaaggacacgcggccgaacgagcccgacgacuacauggucgacuacuuccgccggcagcugcccaaccaggggcucgaccugcaccacaaccugaaguccaagaucaaggagugcaucagcuuccaguccaagaagaccggcaucaacuggaccgacgacgagaagcgcagcuacaaggacaaggggaucgugcagacccaggagauccuccaguaccugcugcccaucgugcacagcacgaagaacaugcagaccacccagaucaagcagcuguucaacccgcggaccaacuuccagauccagcaccagcucaaccccgcgacgugccgcaacaucaagaaguacuccaccagcuggaccgcgccccggaaccaccccuucgucauccagggcgacgugauggccaacuccagcgagugggugcaguccaagccgcaccgcagccuggagucccucagcccccugaaggggcccaagaagaacaagcacucccagaucugggccaucaagaacgaggacaucaagccccugagcuccaagugggagaccgccagcuccagcuucggcauggacgccaacguccucaaguacaagucccugcaggccgaggagacgaaccagcagagcuccaagcacaccgcccugcaccucaccaagaacaaggacgagcaggccaacaagaacgacggccagccgacccuguaccugaaguuccagcgggagagcuga

SEQ ID NO: 26451 - RNA, 1521 nt, Artificial Sequence
  derived and/or modified sequence opt1 from AGBL4__Homo_sapiens__XP_011540611
auggccgagggcagccaguccgcccccgaggcggggaacgacaugggcaacgacgacgccaucgggggcaacgugagcaaguacaucguccugccgaccggguacugcggccagcccaagaagggccaccucaucuucgacgccugcuucgaguccgggaaccugggccgcguggaccaggugagcgaguucgaguacgaccuguucauccggcccgacacgugcaacccccgcuuccgggucugguucaacuucaccguggagaacgugaaggagucccagguccgcgagaucguggacaccuuccgggugguccuccgcgugaucuucaacaucgugaacuucagcaagaccaagucccuguaccgggacgggauggccccgauggucaagagcaccucccgccccaaguggcagcggcugccgcccaagaacguguacuacuaccgcugccccgaccaccggaagaacuacgugaugagcuucgccuucugcuucgaccgcgaggaggacaucuaccaguucgcguacugcuaccccuacacguacacccgguuccagcacuaccucgacucccugcagaagcgcaacauggacuacuucuuccgggagcagcugggccagagcguccagcagcgcaagcucgaccugcugaccaucaccucccccgacaaccuccgggagggggccgagcagaaggugguguucaucacgggccgcguccaccccggcgagaccccgagcuccuucgugugccaggggaucaucgacuuccuggugagccagcaccccaucgccugcguccugcgggaguaccucguguucaagaucgcccccaugcugaaccccgacggcguguaccuggggaacuaccgcugcucccucaugggcuucgaccugaaccggcacuggcuggacccgagccccuggguccaccccacccuccacggcgugaagcagcugaucguccagauguacaacgaccccaagaccucccuggaguucuacaucgacauccacgcgcacagcacgaugaugaacggguucauguacggcaacaucuucgaggacgaggagcgcuuccagcgccaggccaucuucccgaagcuccugugccagaacgccgaggacuucagcuacuccagcaccuccuucaaccgggacgccgugaaggccgggaccggccgccgguuccucgggggccugcuggaccacaccagcuacugcuacacgcuggagguguccuucuacagcuacaucaucuccggcaccaccgcggccguccccuacaccgaggaggccuacaugaagcucgggcgcaacguggcccggacguuccuggacuacuaccgccugaaccccguggucgagaagguggccauccccaugccgcggcuccgcaaggagaaguccccgcccuacaagcacccccugcugcggggccccgcgagcaacuaccccaacagcaagggggacaagaaguccagcgugaaccacaaggaccccuccaccccguucuga

SEQ ID NO: 26452 - RNA, 1215 nt, Artificial Sequence
  derived and/or modified sequence opt1 from AGER__Homo_sapiens__NP_001127
auggccgccggcaccgcggugggggccuggguccuggugcucagccuguggggcgccguggucggggcccagaacaucaccgcccgcaucggcgagccccuggugcucaagugcaagggggcgccgaagaagccgccccagcggcuggaguggaagcugaacacgggccgcaccgaggccuggaaggugcucagcccccagggcgggggcccgugggacuccgucgcccgggugcugcccaacgggucccuguuccuccccgccgugggcauccaggacgaggggaucuuccgcugccaggcgaugaaccggaacggcaaggagaccaagagcaacuaccgcguccggguguaccagauccccggcaagccggagaucguggacuccgccagcgagcugaccgccgggguccccaacaaggugggcacgugcguguccgaggggagcuaccccgccggcacccuguccuggcaccucgacggcaagccccuggucccgaacgagaagggggugagcgugaaggagcagacccgccggcaccccgagaccggccuguucacgcuccaguccgagcugauggucacccccgcccgcgggggcgacccccggccgaccuucagcugcuccuucagccccgggcugccccgccaccgggcgcuccgcaccgcccccauccagccgcgggugugggagcccgugccccuggaggagguccagcuggugguggagcccgagggcggcgccgucgcccccgggggcacggugacccugaccugcgagguccccgcccagcccagcccccagauccacuggaugaaggacggggugccgcucccccugcccccgucccccgugcucauccugcccgagaucggcccccaggaccaggggaccuacuccugcgucgcgacgcacagcucccacggcccgcaggagagccgcgccgugagcaucuccaucaucgagcccggcgaggaggggcccaccgccggcagcgucgggggcuccgggcugggcacccucgcccuggcccugggcauccucgggggccuggggaccgcggcccugcucaucggcgugauccuguggcagcggcgccagcggcgcggcgaggagcggaaggcccccgagaaccaggaggaggaggaggagcgcgccgagcugaaccagagcgaggagccggaggccggggaguccagcacgggcgggcccuga

SEQ ID NO: 26453 - RNA, 1755 nt, Artificial Sequence
  derived and/or modified sequence opt1 from AGFG1__Homo_sapiens__NP_001128659
auggccgccagcgcgaagcgcaagcaggaggagaagcaccugaagaugcuccgggacaugaccggccugccccacaaccgcaagugcuucgacugcgaccagcgggggccgaccuacgugaacaugacggucggcuccuucgugugcaccagcugcuccgggagccugcgcggccucaacccgccccaccgggugaaguccaucagcaugaccaccuucacgcagcaggagaucgaguuccugcagaagcacgggaacgaggucugcaagcagaucuggcugggccucuucgacgaccgcuccagcgccauccccgacuuccgggacccccagaaggugaaggaguuccugcaggagaaguacgagaagaagcgcugguacgugccgcccgagcaggccaaggucguggccuccgugcacgccagcaucuccggcagcuccgcgagcuccaccagcuccacccccgaggucaagccccucaagagccugcugggggacuccgcccccacccugcaccucaacaagggcacgcccagccagagccccgugguggggcggucccagggccagcagcaggagaagaagcaguucgaccugcugagcgaccucggguccgacaucuucgccgccccggcgccccagagcaccgccaccgccaacuucgccaacuucgcccacuucaacucccacgcggcccagaacagcgccaacgccgacuucgccaacuucgacgcguucggccaguccagcggcuccagcaacuucgggggcuuccccaccgccucccacagccccuuccagccgcagacgaccgccuuccgcaugcuguccagcuccugcagcuucggggaguucaccuccgccuucccccugcaggccacccacagcggcuccgcggccagcgucaacgccaacuucgcccacuucgacaacuuccccaagagcuccagcgccgacuucggcacguucaacaccucccagagccaccagaccgcguccgccgugagcaagguguccaccaacaaggccgggcuccagacggccgacaaguacgcggcccuggccaaccuggacaacaucuucagcgccggccagggcggggaccagggguccggcuucggcaccaccgggaaggcccccgucggcagcgugguguccgucccgagccaguccagcgcguccagcgacaaguacgccgcccucgccgagcuggacuccguguucagcagcgccgcgaccuccagcaacgccuacacguccaccagcaacgccuccagcaacguguucgggaccguccccgugguggccuccgcccagacccagcccgcgagcuccagcguccccgccccguucggcgccacgcccuccaccaaccccuucguggccgcggccgggcccagcgucgccuccagcaccaacccguuccagaccaacgcccggggcgccacggcggccaccuucggcaccgccuccaugagcaugcccaccggguucggcacgcccgccccguacucccugcccaccagcuucuccgggagcuuccagcagcccgccuuccccgcgcaggccgccuucccgcagcagaccgccuucagccagcagcccaacggcuucgccgcguucgggcagaccaagcccguggugacccccuucggccaggucgccgccgccggcguguccagcaacccguucaugacgggggcgcccaccggccaguuccccaccggguccagcuccaccaaccccuuccucuga

SEQ ID NO: 26454 - RNA, 1446 nt, Artificial Sequence
  derived and/or modified sequence opt1 from AGFG2__Homo_sapiens__NP_006067
auggugauggccgccaagaagggccccgggcccggcgggggcgucagcgggggcaaggcggaggccgaggccgccuccgagguguggugccgccgggugcgcgagcugggcgggugcagccaggccggcaaccggcacugcuucgagugcgcgcagcgcggggucaccuacguggacaucaccgugggcuccuucgucugcacgaccugcagcgggcuccugcggggccugaacccgccccaccgcgugaaguccaucagcaugaccaccuucacggagcccgagguggucuuccuccagucccggggcaacgaggugugccgcaagaucuggcuggggcuguucgacgcccggaccagccucgugcccgacucccgcgacccccagaaggucaaggaguuccugcaggagaaguacgagaagaagcggugguacgugccgcccgaccaggugaagggccccaccuacaccaaggggagcgccuccacgcccguccagggcagcauccccgagggcaagccccugcgcacccuccugggggacccggcccccucccugagcguggcggccuccaccagcucccagcccgugagccagucccacgcccggaccagccaggcccgcagcacgcagcccccgccccacuccagcgucaagaaggccuccaccgaccuccuggcggacaucggcggggaccccuucgccgcgccccagauggccccggccuucgccgccuuccccgccuucggcgggcagacccccagccagggcggcuucgccaacuucgacgccuucuccagcgggcccuccagcuccguguucggcagccugccgcccgcggggcaggccuccuuccaggcccagcccacccccgccggcagcucccaggggacgccguucggcgccacgccccucgcgcccgccagccagccgaacucccuggccgacgugggcagcuuccuggggcccggcguccccgccgcgggggugcccuccagccucuucggcauggccgggcaggucccgccccugcaguccgugaccaugggcggcgggggcgggagcagcaccggccuggccuucggcgccuucaccaaccccuucaccgcccccgcggcccaguccccgcuccccagcaccaaccccuuccagcccaacgggcuggccccgggccccggguucggcauguccagcgccgggcccggcuucccccaggccgugccgcccaccggcgcguucgccuccagcuuccccgcgccccuguucccgccccagacgccccucguccagcagcagaacggguccagcuucggcgaccugggguccgccaagcugggccagcggccccucagccagccggccgggaucuccaccaaccccuucaugaccggccccagcuccagcccguucgccuccaagccgcccaccacgaaccccuuccuguga

SEQ ID NO: 26455 - RNA, 2145 nt, Artificial Sequence
  derived and/or modified sequence opt1 from AGGF1__Homo_sapiens__NP_060516
auggccagcgaggcccccuccccgccccgcagcccgccgccgcccaccucccccgagcccgagcuggcgcagcuccggcgcaagguggagaagcuggagcgggagcugcgcagcugcaagcggcagguccgcgagaucgagaagcuccugcaccacaccgagcggcuguaccagaacgccgaguccaacaaccaggagcuccgcacccagguggaggagcugagcaagauccugcagcggggccgcaacgaggacaacaagaaguccgacguggagguccagacggagaaccacgcccccuggagcaucuccgacuacuucuaccagaccuacuacaacgacgugagccuccccaacaaggugaccgagcuguccgaccagcaggaccaggccaucgagacgagcauccugaacuccaaggaccaccuccaggucgagaacgacgccuaccccgggaccgaccggaccgagaacgugaaguaccgccagguggaccacuucgcgagcaacucccaggagcccgccagcgcccuggccaccgaggacacgucccuggagggcagcucccucgcggagagccugcgggccgccgccgaggccgcggucagccagaccggguucuccuacgacgagaacaccggccuguacuucgaccacagcaccggguucuacuacgacuccgagaaccagcucuacuacgaccccagcacgggcaucuacuacuacugcgacguggaguccggccgcuaccaguuccacagccggguggaccugcagcccuaccccaccuccagcaccaagcaguccaaggacaagaagcugaagaagaagcgcaaggaccccgacagcuccgccaccaacgaggagaaggaccucaacagcgaggaccagaaggccuucuccgucgagcacacgagcugcaacgaggaggagaacuucgccaacaugaagaagaaggccaagaucgggauccaccacaagaacuccccgcccaaggugaccgugcccaccagcggcaacaccaucgagagcccccugcacgagaacaucuccaacuccacgagcuucaaggacgagaagaucauggagaccgacagcgagccggaggagggggagaucaccgacucccagaccgaggacagcuacgacgaggcgaucacguccgagggcaacgucaccgccgaggacagcgaggacgaggacgaggacaagaucuggccgcccugcauccgggugaucgugauccgcucccccguccugcagaucgggagccucuucaucaucaccgccgugaaccccgccaccaucggccgggagaaggacauggagcacacgcugcgcauccccgaggugggcgucuccaaguuccacgccgagaucuacuucgaccacgaccugcagagcuacgugcucguggaccaggggucccagaacggcaccaucgucaacgggaagcagauccugcagcccaagaccaagugcgaccccuacgugcuggagcacggcgacgaggucaagaucggcgagaccgugcucagcuuccacauccacccgggguccgacacgugcgacggcugcgagcccggccaggugcgggcgcaccuccgccuggacaagaaggacgagagcuucgucgggcccacccuguccaaggaggagaaggagcuggagcgccggaaggagcugaagaagauccgcgugaaguacgggcuccagaacaccgaguacgaggacgagaagacccugaagaacccgaaguacaaggaccgggccggcaagcgccgggagcaggucggcagcgaggggacguuccagcgcgacgacgcccccgccuccgugcacagcgagaucaccgacuccaacaagggccggaagaugcuggagaagaugggguggaagaagggcgaggggcucggcaaggacggcgggggcaugaagacccccauccagcugcagcugcgccggacccacgccgggcucggcaccgggaagcccagcagcuucgaggacgugcaccuccugcagaacaagaacaagaagaacugggacaaggcgcgcgagcgguucacggagaacuucccggagaccaagccccagaaggacgaccccggcaccaugcccugggugaagggcacccuggaguga

SEQ ID NO: 26456 - RNA, 1053 nt, Artificial Sequence
  derived and/or modified sequence opt1 from AGK__Homo_sapiens__XP_005250080
augaccguguucuucaagacccugcgcaaccacuggaagaagacgaccgccggccucugccugcugaccuggggcgggcacuggcucuacgggaagcacugcgacaaccugcugcggcgcgccgcgugccaggaggcccaggucuucggcaaccagcucaucccgcccaacgcccaggugaagaaggccaccguguuccugaaccccgccgcgugcaaggggaaggcccggacgcuguucgagaagaacgccgcccccauccuccaccugagcggcauggacgucaccaucgugaagaccgacuacgagggccaggcgaagaagcugcucgagcugauggagaacaccgacgugaucaucgucgccgggggcgacgggacgcugcaggagguggugaccggcguccuccgccggaccgacgaggccaccuucuccaagauccccaucggguucaucccgcugggcgagacgagcucccugagccacacccucuucgccgaguccggcaacaaggugcagcacaucaccgacgccacccuggcgaucgugaagggggagacggucccccuggacgugcuccagaucaagggcgagaaggagcagcccguguucgccaugaccgggcugcgcuggggcagcuuccgggacgccggcgucaagguguccaaguacugguaccuggggccccucaagaucaaggccgcccacuucuucagcacccugaaggaguggccgcagacccaccaggcguccaucagcuacacgggccccaccgagcgcccgcccaacgagcccgaggagacccccgugcagcggcccucccuguaccgccggauccuccgccggcuggccagcuacugggcccagccccaggacgcccugucccaggaggucagcccggagguguggaaggacgugcagcucuccaccaucgagcugagcaucacgacccgcaacaaccagcuggaccccaccuccaaggaggacuuccucaacaucugcaucgagcccgacaccaucagcaagggggacuucaucacgaucggcaaguga

SEQ ID NO: 26457 - RNA, 1338 nt, Artificial Sequence
  derived and/or modified sequence opt1 from AGMO__Homo_sapiens__NP_001004320
augaagaaccccgaggcccagcaggacgugagcgucucccagggcuuccgcaugcuguucuacaccaugaagccgagcgagaccuccuuccagacgcucgaggaggugcccgacuacgugaagaaggccacccccuucuucaucagccugaugcugcucgagcuggucguguccuggauccugaaggggaagcccccgggccggcucgacgacgcgcugaccagcaucuccgccggggugcugagccgccuccccucccuguucuuccggagcaucgagcugaccuccuacaucuacaucugggagaacuaccgccucuucaaccugcccugggacagccccuggacgugguacuccgccuuccugggcgucgacuucggguacuacugguuccaccggauggcccacgaggugaacaucaugugggccggccaccagacccaccacagcuccgaggacuacaaccucagcaccgcgcugcgccaguccgugcugcagaucuacaccagcuggaucuucuacuccccgcucgcccuguucaucccgcccagcgucuacgccgugcaccuccaguucaaccugcuguaccaguucuggauccacacggaggugaucaacaaccugggcccccucgagcugauccugaacacccccagccaccaccggguccaccacgggcgcaaccgguacugcaucgacaagaacuacgccggcgugcucaucaucugggacaagaucuucgggaccuucgaggcggagaacgagaagguggucuacggccugacccaccccaucaacacguucgagcccaucaaggugcaguuccaccaccuguucuccaucuggaccaccuucugggccacccccggguucuucaacaaguucagcgugaucuucaagggcccgggcugggggcccggcaagccccgccucgggcuguccgaggagauccccgaggucacgggcaaggaggugccguucagcuccagcuccagccagcugcucaagaucuacaccgugguccaguucgcccugaugcuggccuucuacgaggagaccuucgccgacaccgcggcccucucccaggugacgcugcugcuccgggugugcuucaucauccugacccugaccagcaucggcuuccuccuggaccagcgccccaaggccgccaucauggagacccugcggugccucauguuccugaugcuguaccgcuucgggcaccucaagccccugguccccucccugagcuccgccuucgagaucguguucagcaucugcaucgcguucuggggcguccgguccaugaagcagcugacgagccacccguggaaguga

SEQ ID NO: 26458 - RNA, 2478 nt, Artificial Sequence
  derived and/or modified sequence opt1 from AGO2__Homo_sapiens__NP_001158095
auguacagcggcgccgggcccgcccuggcgccgcccgccccgcccccgcccauccagggcuacgccuucaagccgccgccccgccccgacuucgggaccuccggccggaccaucaagcuccaggccaacuucuucgagauggacauccccaagaucgacaucuaccacuacgagcuggacaucaagcccgagaagugcccccgccgggugaaccgcgagaucgucgagcacauggugcagcacuucaagacgcagaucuucggggaccggaagcccguguucgacggccgcaagaaccuguacaccgccaugccccuccccaucggccgggacaaggucgagcuggaggugacccugcccggggagggcaaggaccgcaucuucaaggugagcaucaagugggucuccugcgugagccuccaggcgcugcacgacgcccuguccgggcggcuccccagcgugcccuucgagaccauccaggcccuggacgucgugaugcgccaccuccccuccaugcgguacacgccggugggccgcagcuucuucaccgccuccgaggggugcagcaacccccugggcggcgggcgggaggucugguucggcuuccaccaguccgugcgccccagccuguggaagaugaugcugaacaucgacguguccgcgaccgccuucuacaaggcccagcccgucaucgaguucgugugcgaggugcucgacuucaagagcaucgaggagcagcagaagccgcugaccgacucccagcgggucaaguucacgaaggagaucaaggggcugaagguggagaucacccacugcggccagaugaagcgcaaguaccgggugugcaacgucacccgccggcccgccagccaccagaccuucccccuccagcaggaguccggccagacgguggagugcaccguggcccaguacuucaaggaccgccacaagcugguccugcgguacccccaccucccgugccuccagguggggcaggagcagaagcacaccuaccugccccuggaggucugcaacaucguggcgggccagcgcugcaucaagaagcugaccgacaaccagacgagcaccaugauccgcgccaccgcccgguccgcccccgaccgccaggaggagaucagcaagcugaugcggagcgccuccuucaacaccgacccguacgugcgcgaguucgggaucauggucaaggacgagaugacggacgugaccggccgggugcuccagccgcccagcauccuguacgggggccgcaacaaggcgaucgccacccccguccagggcgugugggacaugcggaacaagcaguuccacaccgggaucgagaucaaggugugggccaucgccugcuucgcgccccagcgccagugcacggagguccaccugaaguccuucaccgagcagcuccggaagaucagccgcgacgccggcaugcccauccaggggcagcccugcuucugcaaguacgcccagggcgccgacuccguggagcccauguuccggcaccugaagaacaccuacgccgggcugcagcucguggucgugauccugccgggcaagacccccguguacgccgaggucaagcgcgugggcgacacggugcuggggauggcgacccagugcguccagaugaagaacgugcagcggaccacgccccagacccucagcaaccugugccugaagaucaacgugaagcucggcggggucaacaacauccugcugccccagggccgcccgcccguguuccagcagcccgugaucuuccucggggccgacgucacccacccgcccgccggcgacggcaagaagcccuccaucgccgcggugguggggagcauggacgcccaccccaaccgguacugcgccaccguccgcgugcagcagcaccggcaggagaucauccaggaccuggccgccauggugcgcgagcugcucauccaguucuacaaguccacccgguucaagcccacgcgcaucaucuucuaccgcgacggcgucagcgaggggcaguuccagcagguccugcaccacgagcugcucgcgauccgggaggccugcaucaagcuggagaaggacuaccagccgggcaucaccuucaucguggugcagaagcgccaccacacccggcuguucugcaccgacaagaacgagcgcggcaccucccggcccagccacuaccacgugcugugggacgacaaccgcuucuccagcgacgagcuccagauccugacguaccagcugugccacaccuacgugcggugcacccgcuccgucagcauccccgcccccgccuacuacgcccaccucguggcguuccgggcccgcuaccaccugguggacaaggagcacgacuccgccgaggggagccacaccuccggccagagcaacgggcgggaccaccaggcccuggccaaggcgguccaggugcaccaggacacgcuccgcaccauguacuucgccuga

SEQ ID NO: 26459 - RNA, 864 nt, Artificial Sequence
  derived and/or modified sequence opt1 from AGPAT1__Homo_sapiens__XP_005248862
augguggcccggauggaccuguggcccggcgccuggaugcuccugcugcuccuguuccugcuccugcuguuccuccugccgacccugugguucugcagccccuccgcgaaguacuucuucaagauggccuucuacaacggguggauccucuuccuggccguccuggccauccccgugugcgccgugcggggccgcaacgucgagaacaugaagauccuccggcugaugcugcuccacaucaaguaccuguacgggauccgcguggaggugcggggcgcgcaccacuucccgcccagccagcccuacgucgugguguccaaccaccagagcucccuggaccuccuggggaugauggagguccugcccggccgcugcgugcccaucgccaagcgggagcuccugugggccggcagcgccgggcuggcgugcuggcucgccggcgugaucuucaucgaccgcaagcggaccggggacgccaucuccgucaugagcgagguggcccagacgcugcugacccaggacgugcgcgucuggguguucccggagggcacccggaaccacaacggguccaugcuccccuucaagcgcggcgccuuccaccuggcggugcaggcccagguccccaucgugcccaucgugaugagcuccuaccaggacuucuacugcaagaaggagcggcgcuucaccagcggccagugccagguccgggugcugccgcccgugcccacggaggggcucacccccgacgacgucccggcccuggccgaccgcgugcggcacuccaugcugaccgucuuccgcgagaucagcaccgacggccgcgggggcggcgacuaccucaagaagcccgggggcgggggcuga

SEQ ID NO: 26460 - RNA, 741 nt, Artificial Sequence
  derived and/or modified sequence opt1 from AGPAT2__Homo_sapiens__NP_001012745
auggagcuguggcccugccucgccgccgcgcugcugcuccugcugcuccuggugcagcugagccgcgccgccgaguucuacgccaaggucgcccucuacugcgcgcugugcuucaccguguccgccguggccagccuggucugccuccugcggcacggcgggcgcaccguggagaacauguccaucaucggcugguucgugcggagcuucaaguacuucuacgggcugcgcuucgagguccgggacccgcgccggcuccaggaggcccgccccugcgugaucguguccaaccaccagagcauccuggacaugaugggccugauggagguccuccccgagcggugcgugcagaucgcgaagcgcgagcugcuguuccucgggcccgugggccugaucauguaccugggcggggucuucuucaucaaccggcagcgcuccagcacggccaugaccgugauggccgaccucggcgagcggauggugcgcgagaacgucccgaucgugcccguggucuacuccagcuucuccagcuucuacaacaccaagaagaaguucuucaccuccgggacggugaccgugcagguccuggaggccauccccaccagcggccugaccgccgcggacgugcccgcccucguggacacgugccaccgggccaugcgcaccaccuuccugcacaucuccaagaccccgcaggagaacggggccacggccggcagcggcguccagcccgcgcaguga

SEQ ID NO: 26461 - RNA, 1131 nt, Artificial Sequence
  derived and/or modified sequence opt1 from AGPAT3__Homo_sapiens__XP_006724093
augggccugcucgccuuccugaagacccaguucgugcugcaccuccuggucggguucguguucguggucagcggccuggugaucaacuucgugcagcucugcacccuggcccuguggcccgucuccaagcagcucuaccgccggcugaacugccgccuggcguacagccucuggucccagcuggugaugcugcucgagugguggagcugcacggagugcacccuguucaccgaccaggccaccguggagcgguucgggaaggagcacgccgucaucauccugaaccacaacuucgagaucgacuuccucugcggcuggacgaugugcgagcgcuucggggugcugggcuccagcaaggugcuggccaagaaggagcuccuguacgucccgcugaucggcuggaccugguacuuccucgagaucguguucugcaagcggaagugggaggaggaccgcgacaccguggucgaggggcugcggcgccuguccgacuaccccgaguacaugugguuccuccuguacugcgagggcacccgguucacggagaccaagcaccgcgugagcauggagguggccgcggccaaggggcugcccguccucaaguaccaccuccugccccggaccaagggcuucaccacggccgugaagugccugcgcgggaccguggccgcggucuacgacgugacccugaacuuccggggcaacaagaacccgucccugcucggcauccuguacgggaagaaguacgaggccgacaugugcgugcgccgguucccccuggaggacaucccccucgacgagaaggaggccgcccaguggcugcacaagcuguaccaggagaaggacgcccuccaggagaucuacaaccagaagggcauguuccccggggagcaguucaagccggcgcgccggcccuggacccugcugaacuuccucagcugggccacgauccugcugagcccccucuucuccuucguccugggcguguucgccuccggcagcccccugcugauccucaccuuccugggguucgucggcgccgccuccuucggggugcgccggcugaucggcgugaccgagaucgagaaggggagcuccuacggcaaccaggaguucaagaagaaggaguga

SEQ ID NO: 26462 - RNA, 1137 nt, Artificial Sequence
  derived and/or modified sequence opt1 from AGPAT4__Homo_sapiens__NP_064518
auggaccuggccggccuccucaagagccaguuccugugccaccucguguucugcuacgucuucaucgccuccgggcugaucaucaacaccauccagcuguucacccuccugcuguggcccaucaacaagcagcuguuccgcaagaucaacugccggcugagcuacugcaucuccagccagcuggugaugcuccuggaguggugguccggcacggagugcaccaucuucaccgacccgcgcgcguaccugaaguacgggaaggagaacgccaucgugguccucaaccacaaguucgagaucgacuuccugugcggcuggagccuguccgagcgguucgggcuccugggcggcagcaaggugcuggccaagaaggagcucgccuacgugcccaucaucggguggaugugguacuucaccgagauggucuucugcucccgcaagugggagcaggaccggaagacgguggccaccagccugcagcaccuccgcgacuaccccgagaaguacuucuuccucauccacugcgagggcacccgguucaccgagaagaagcacgagaucuccaugcaggucgcgcgcgccaaggggcugccccggcugaagcaccaccuccugccgcgcacgaagggcuucgccaucaccgugcggagccugcgcaacgugguguccgccgucuacgacugcacccucaacuuccggaacaacgagaaccccacccugcugggggugcucaacggcaagaaguaccacgcggaccuguacgugcgccggaucccccuggaggacauccccgaggacgacgacgagugcagcgccuggcuccacaagcuguaccaggagaaggacgccuuccaggaggaguacuaccgcacgggcaccuucccggagacccccauggucccgccccggcgccccuggacccuggugaacuggcuguucugggccucccuggugcuguaccccuucuuccaguuccucgucagcaugauccgguccgggagcucccugacgcuggccagcuucauccucguguucuucguggcgagcgucggcgugcgcuggaugaucggggugaccgagaucgacaagggcuccgccuacggcaacagcgacuccaagcagaagcugaacgacuga

SEQ ID NO: 26463 - RNA, 1305 nt, Artificial Sequence
  derived and/or modified sequence opt1 from AGPAT9__Homo_sapiens__NP_001243350
auggagggcgccgagcuggccgggaagauccucagcaccuggcugacccuggugcucggcuucauccugcugcccuccgucuucggggugagccucggcaucuccgagaucuacaugaagauccuggugaagacgcuggagugggcgaccauccgcaucgagaaggggaccccgaaggagagcauccucaagaacuccgccagcgucggcaucauccagcgggacgagucccccauggagaagggccugagcgggcugcgcggccgggacuucgagcucuccgacguguucuacuucagcaagaaggggcuggaggccaucguggaggacgaggucacccagcgcuucuccagcgaggagcugguguccuggaaccuccugacgcggaccaacgugaacuuccaguacaucagccugcgccucaccauggucugggugcugggcgugaucguccgguacugcgugcugcucccccugcgcgugacccuggccuucaucgggaucucccuccuggucaucggcacgacccuggugggccagcuccccgacagcucccugaagaacuggcugagcgagcucgugcaccugaccugcugccggaucugcguccgcgcccuguccgggaccauccacuaccacaacaagcaguaccggccgcagaagggcgggaucugcguggcgaaccacacgagccccaucgacgugcucauccugaccaccgacggcugcuacgccauggucggccaggugcacgggggccugauggggaucauccagcgcgccauggugaaggccugcccccacgucugguucgagcggagcgagaugaaggaccgccaccucgugaccaagcggcugaaggagcacaucgcggacaagaagaagcugcccauccucaucuucccggagggcacgugcaucaacaacaccuccgucaugauguucaagaaggggagcuucgagaucggcggcaccauccaccccguggccaucaaguacaacccccaguucggggacgccuucuggaacuccagcaaguacaacaugguguccuaccugcugcgcaugaugaccagcugggccaucgucugcgacgugugguacaugcccccgaugacgcgggaggagggcgaggacgccgugcaguucgcgaaccgcgucaaguccgccaucgccauccagggcgggcucaccgagcugcccugggacgggggccugaagcgggccaaggugaaggacaucuucaaggaggagcagcagaagaacuacagcaagaugaucgugggcaacgggucccucagcuga

SEQ ID NO: 26464 - RNA, 1977 nt, Artificial Sequence
  derived and/or modified sequence opt1 from AGPS__Homo_sapiens__NP_003650
auggccgaggccgcggccgccgccggcgggaccggccugggggccggcgcgagcuacggguccgccgccgaccgcgaccgggaccccgacccggaccgcgccggccggcgccuccgggugcugagcggccaccuccuggggcgcccccgggaggcgcuguccaccaacgagugcaaggcccgccgggccgccagcgccgcgacggccgcccccaccgccacccccgccgcgcaggaguccggcaccaucccgaagaagcgccaggaggucaugaaguggaacggguggggcuacaacgacagcaaguucaucuucaacaagaaggggcagaucgagcugacgggcaagcgguacccccucuccggcauggggcugcccaccuucaaggaguggauccagaacacccugggcgugaacguggagcacaagaccacgagcaaggccucccucaaccccagcgacaccccgcccuccgucgugaacgaggacuuccugcacgaccugaaggagaccaacaucagcuacucccaggaggccgacgaccgcguguuccgggcccacgggcacugccuccacgagaucuuccugcugcgcgagggcauguucgagcggauccccgacaucguccucuggccgaccugccacgacgacguggugaagaucgucaaccuggccugcaaguacaaccugugcaucauccccaucggcgggggcacgagcguguccuacgggcucaugugccccgcggacgagacccgcaccaucaucagccuggacaccucccagaugaaccggauccuguggguggacgagaacaaccucacggcccacgucgaggccggcaucaccgggcaggagcuggagcgccagcugaaggagagcggcuacugcaccggccacgagcccgacucccucgaguucagcaccgucgggggcugggugagcacgcgggccuccgggaugaagaagaacaucuacggcaacaucgaggaccugguggugcacaucaagauggugacgccccgcgggaucaucgagaaguccugccagggcccgcggaugagcaccggccccgacauccaccacuucaucauggggagcgagggcacccugggggucaucaccgaggccaccaucaagauccgccccgugcccgaguaccagaaguacggcuccguggcguucccgaacuucgagcagggggucgccugccuccgcgagaucgccaagcagcggugcgcccccgcgagcauccgccugauggacaacaagcaguuccaguucggccacgcccugaagccccagguguccagcaucuucaccuccuuccucgacggccugaagaaguucuacaucaccaaguucaagggguucgaccccaaccagcugagcguggccacgcuccuguucgagggcgaccgggagaagguccugcagcacgagaagcaggucuacgacaucgccgccaaguucgggggccucgcggccggcgaggacaacgggcagcgcggcuaccugcugaccuacgugaucgccuacauccgggaccucgcccuggaguacuacgugcugggggaguccuucgagaccagcgccccgugggaccgcguggucgaccucugccggaacgugaaggagcgcaucacccgggagugcaaggagaagggcgugcaguucgcgcccuucuccacgugccgcgucacccagaccuacgacgccggggccugcaucuacuucuacuucgccuucaacuaccggggcaucagcgacccccugaccguguucgagcagacggaggccgcggcccgcgaggagauccuggccaacggcgggucccucagccaccaccacggcguggggaagcugcggaagcaguggcugaaggaguccaucagcgacgucggcuucgggaugcucaaguccgugaaggaguacguggaccccaacaacaucuucggcaaccgcaaccugcuguga

SEQ ID NO: 26465 - RNA, 528 nt, Artificial Sequence
  derived and/or modified sequence opt1 from AGR2__Homo_sapiens__NP_006399
auggagaagauccccgugagcgccuuccugcuccuggucgcccuguccuacacccucgcgcgcgacaccacggugaagccgggcgccaagaaggacaccaaggacagccggcccaagcugccccagacccugucccgcggguggggcgaccagcucaucuggacccagacguacgaggaggcccuguacaagagcaagaccuccaacaagccccugaugaucauccaccaccucgacgagugcccgcacagccaggcccugaagaagguguucgccgagaacaaggagauccagaagcuggcggagcaguucguccuccugaaccugguguacgagaccaccgacaagcaccucucccccgacgggcaguacgugccccggaucauguucgucgaccccagccugacggugcgcgccgacaucaccggccgguacuccaaccgccuguacgccuacgagccggccgacaccgcgcuccugcuggacaacaugaagaaggcccucaagcugcugaagaccgagcucuga

SEQ ID NO: 26466 - RNA, 501 nt, Artificial Sequence
  derived and/or modified sequence opt1 from AGR3__Homo_sapiens__NP_789783
augaugcugcacagcgcccucggccugugccugcuccuggugaccgucuccagcaaccuggccaucgcgaucaagaaggagaagcggcccccgcagacccucucccgcggguggggcgacgacaucacgugggugcagaccuacgaggaggggcuguucuacgcccagaaguccaagaagccccugauggugauccaccaccucgaggacugccaguacagccaggcccugaagaaggucuucgcccagaacgaggagauccaggagauggcccagaacaaguucaucaugcugaaccucaugcacgagaccaccgacaagaaccugagccccgacggccaguacgugccccgcaucauguucguggacccgucccugacgguccgggcggacaucgccgggcgcuacagcaaccggcucuacaccuacgagccccgcgaccugccccugcucaucgagaacaugaagaaggcccugcggcugauccaguccgagcucuga

SEQ ID NO: 26467 - RNA, 4416 nt, Artificial Sequence
  derived and/or modified sequence opt1 from AGRN__Homo_sapiens__XP_011539733
augcugcacgugcacgccugcacccaccagaucagccuccacgucgccuccgcgggccccugcgagaccugcggggacgccgugugcgccuucggcgccgugugcagcgccgggcagugcgucugcccgcgcugcgagcaccccccccccggcccggugugcggguccgacggcgugacguacggcagcgcgugcgagcugcgggaggccgccugccugcagcagacccagaucgaggaggcccgcgcggggcccugcgagcaggccgagugcggcuccgggggcagcggguccggcgaggacggcgacugcgagcaggagcucugccggcagcgcgggggcaucugggacgaggacagcgaggacgggcccugcgucugcgacuucuccugccagagcgugcccggcuccccggugugcggcagcgacggggucaccuacuccaccgagugcgagcugaagaaggcccggugcgagagccagcgcggccuguacguggccgcccagggggcgugccggggccccacguucgccccccuccccccgguggccccccugcacugcgcccagacccccuacgggugcugccaggacaacaucaccgccgcgcgcggcgucggccuggccgggugccccuccgccugccagugcaacccgcacggcagcuacgggggcaccugcgaccccgccacggggcagugcuccugccggcccggcgugggcgggcuccgcugcgaccggugcgagcccggcuucuggaacuuccgcgggaucgugaccgacggccggagcgggugcaccccgugcuccugcgacccccagggcgccguccgcgacgacugcgagcagaugaccggccugugcagcugcaagcccgggguggcgggccccaagugcgggcagugcccggacggccgggcccugggccccgccgggugcgaggccgacgccagcgcgcccgccacgugcgccgagaugcgcugcgaguucggcgcccggugcguggaggaguccgggagcgcgcacugcgucugccccaugcucaccugcccggaggccaacgccaccaaggugugcggcuccgacggggugaccuacggcaacgagugccagcugaagacgaucgccugccgccagggccugcagaucagcauccagucccucgggcccugccaggaggccgucgcgcccagcacccacccgaccuccgccagcgugaccgugacgacccccggccugcugcucucccaggcccugcccgcccccccgggggcccugccccucgcgcccagcuccaccgcccacagccagaccacgcccccgcccuccagccggccccgcaccaccgccuccgucccccggaccacgguguggccgguccugaccgugccccccaccgcccccagcccggcccccucccugguggcgagcgccuucggcgaguccgggagcaccgacggcagcuccgacgaggagcucagcggcgaccaggaggccuccgggggcgggagcggcgggcuggagccccuggagggcuccagcgucgccacgcccggcccgcccguggagcgcgcguccugcuacaacagcgcccucgggugcugcuccgacggcaagacccccagccuggacgccgagggguccaacugccccgccaccaagguguuccagggcguccuggagcucgaggggguggagggccaggagcuguucuacaccccggagauggccgaccccaagagcgagcuguucggcgagacggcgcgcuccaucgagagcacccucgacgaccuguuccggaacuccgacgugaagaaggacuuccgcagcguccggcugcgcgaccucgggcccggcaaguccgugcgggccaucguggacguccacuucgacccgaccaccgccuuccgcgcccccgacguggcccgggcgcugcugcgccagauccaggugagccggcgccggagccucgggguccgccggccccugcaggagcacgugcgcuucauggacuucgacugguuccccgccuucaucaccggcgccacguccggcgccaucgccgcgggggccaccgcccgggccaccaccgcgagccgccugccguccagcgccgugacgccccgggccccccaccccucccacaccagccagccggucgccaagaccaccgccgcgcccacgacccgccggccccccaccaccgccccgucccgcgugcccggccgccggccccccgccccgcagcagccccccaagcccugcgacagccagccgugcuuccacgggggcacgugccaggacugggcccucgggggcggcuucaccugcuccugccccgccgggcgcggcggggcggugugcgagaagguccugggcgcccccgugcccgccuucgaggggcggagcuuccuggccuucccgacccuccgcgccuaccacacccugcggcuggcgcucgaguuccgcgcccuggagccccagggccugcugcucuacaacggcaacgcccgggggaaggacuuccuggcccuggcccuccuggacggccgcgugcagcugcgguucgacacgggguccggccccgcgguccucaccagcgccgugcccguggagccggggcaguggcaccgccuggagcugucccggcacuggcgccggggcacccucagcgucgacggcgagacccccgugcugggggagucccccagcggcacggacgggcugaaccucgacaccgaccuguucgugggcggcgucccggaggaccaggccgccguggcgcuggagcgcaccuucgugggggccggccuccgggggugcauccgccugcuggacgucaacaaccagcggcucgagcugggcaucgggcccggcgccgccacccgcggcuccggggugggcgagugcggggaccaccccugccugcccaacccgugccacggcggggcccccugccagaaccucgaggcgggccgguuccacugccagugcccccccggccgcguggggccgacgugcgccgacgagaagagccccugccagcccaaccccugccacggcgccgccccgugccggguccugcccgaggggggcgcccagugcgagugcccccuggggcgcgagggcaccuucugccagaccgcguccggccaggacgggagcggccccuuccucgccgacuucaacggguucagccaccuggagcugcgcggccuccacaccuucgcccgggaccugggggagaagauggcccuggaggugguguuccucgcccgcggcccguccggccugcugcucuacaacgggcagaagacggacggcaagggggacuucgucagccuggcgcugcgggaccgccggcucgaguuccgcuacgaccugggcaagggcgccgccgugauccggucccgcgagcccgugacccugggggccuggacccgggucagccucgagcgcaacggccggaagggggcgcugcgcgugggcgacgggccccgggugcugggcgagucccccaagagccgcaaggucccgcacaccgugcucaaccugaaggagccccuguacgugggcggggcccccgacuucuccaagcucgcccgggccgccgcggucagcuccggcuucgacggggccauccagcuggugagccugggcgggcgccagcuccugacgcccgagcacgugcugcggcaggucgacgugaccuccuucgccggccacccgugcacccgcgccagcggccaccccugccucaacggggccuccugcgucccccgggaggcggccuacgugugccugugccccggcggguucagcggcccgcacugcgagaaggggcugguggagaaguccgccggcgacgucgacacccucgccuucgacggccgcacguucguggaguaccugaacgccgugaccgagagcgagaaggcgcugcaguccaaccacuucgagcucagccugcgcaccgaggccacccaggggcugguccucugguccggcaaggccaccgagcgggccgacuacguggcgcuggccaucguggacgggcaccugcagcucagcuacaaccugggcagccagcccgucgugcugcgcuccacggugcccgucaacaccaaccgguggcuccgcgugguggcccaccgggagcagcgcgaggggagccugcaggucggcaacgaggccccggugaccggcuccagcccccugggggccacccagcucgacacggacggcgcgcuguggcuggggggccuccccgagcugcccgugggcccggcccugcccaaggccuacgggaccggcuucgucgggugccuccgggacgugguggucggccgccacccccugcaccugcucgaggacgccgugaccaagcccgagcugcggccgugccccacccccuga

SEQ ID NO: 26468 - RNA, 399 nt, Artificial Sequence
  derived and/or modified sequence opt1 from AGRP__Homo_sapiens__XP_011521229
augcugaccgccgccgugcucagcugcgcgcugcugcucgcccugcccgccacccgcggcgcccagauggggcuggccccgauggagggcauccggcgccccgaccaggcgcuccugcccgagcugcccgggcucggccugcgggccccgcugaagaagacgaccgccgagcaggccgaggaggaccuccugcaggaggcgcaggcccuggccgaggugcucgaccugcaggaccgcgagccccgguccagccgccggugcgugcgccugcacgaguccugccucgggcagcagguccccugcugcgaccccugcgcgaccugcuacugccgguucuucaacgccuucugcuacugccgcaagcugggcaccgccaugaacccgugcagccggacguga

SEQ ID NO: 26469 - RNA, 1458 nt, Artificial Sequence
  derived and/or modified sequence opt1 from AGT__Homo_sapiens__NP_000020
augcgcaagcgggcgccccagagcgagauggccccggccggcgugucccugcgcgccaccauccucugccugcuggccugggccgggcucgccgcgggcgaccgggucuacauccaccccuuccaccuggugauccacaacgagagcacgugcgagcagcuggccaaggccaacgccgggaagcccaaggaccccaccuucaucccggcgcccauccaggccaagaccucccccguggacgagaaggcccuccaggaccagcugguccugguggccgccaagcucgacaccgaggacaagcugcgcgcggccauggugggcaugcuggccaacuuccucggguuccggaucuacggcaugcacagcgagcuguggggcgucgugcacggggccaccgugcugucccccacggccgucuucggcacccucgcgagccuguaccugggggcccucgaccacaccgccgaccgccugcaggccauccugggcgugccguggaaggacaagaacugcaccucccggcucgacgcccacaaggugcugagcgcgcugcaggccguccaggggcuccugguggcccagggccgcgccgacucccaggcccagcugcuccugagcacgguggucggcguguucaccgcgcccgggcugcaccucaagcagcccuucgugcagggccuggcccuguacacccccgucgugcucccgcggucccuggacuucaccgagcuggacguggccgccgagaagaucgaccgcuucaugcaggcggucacgggguggaagaccggcugcagccucaugggcgccuccguggacagcacccuggccuucaacaccuacgugcacuuccaggggaagaugaagggcuucucccugcucgccgagccccaggaguucugggucgacaacagcacguccgugagcguccccaugcuguccgggaugggcaccuuccagcacuggagcgacauccaggacaacuucagcgugacccaggugcccuucaccgaguccgccugccugcuccugauccagccgcacuacgcgagcgaccuggacaaggucgaggggcucacguuccagcagaacucccugaacuggaugaagaagcugagcccccggaccauccaccucaccaugccccagcuggugcugcagggcuccuacgaccugcaggaccuccuggcccaggccgagcugcccgccauccuccacaccgagcugaaccugcagaagcucagcaacgaccgcauccgggugggcgagguccugaacuccaucuucuucgagcuggaggccgacgagcgcgagccgacggagagcacccagcagcucaacaagcccgaggugcuggaggugacccugaaccggcccuuccucuucgcggucuacgaccaguccgccaccgcccugcacuuccuggggcgcguggccaacccccucagcacggccuga

SEQ ID NO: 26470 - RNA, 3837 nt, Artificial Sequence
  derived and/or modified sequence opt1 from AGTPBP1__Homo_sapiens__NP_001273644
augcgcaccggcagcgccgccuccagcgcggccgccgccgccgcggccgccgccgcguccgccagccccgccaccggggugugcaugaagacgccgggcgggggccggcgcgggauccggcgcgaccccggcgccgagcccggcgccgcggcccugcgggggccccgccagcggccgauccucucccgccugaccaacaacagccggaucgucggccugcucgcccagcuggagaagaucaacgccgagcccuccgagagcgacaccgcccgcuacgugaccuccaagauccugcaccucgcgcagagccaggagaagacgcggcgcgagaugaccgccaagggguccaccggcauggagauccugcugagcacccucgagaacacgaaggaccugcagaccacccugaacauccucuccauccugguggagcuggucagcgccgggggcggccggcgcguguccuuccucgugaccaagggcgggagccagauccugcugcagcuccugaugaacgccuccaaggagagcccgccccacgaggaccugaugguccagauccacuccauccucgccaagaucgggcccaaggacaagaaguucggcgugaaggcgcggaucaacggcgcccugaacaucacgcugaaccucgugaagcagaaccugcagaaccaccgccugguccuccccugccugcagcugcuccggguguacagcgccaacagcgugaacuccgucagccuggggaagaacggcgugguggagcugauguucaagaucaucgggcccuucuccaagaagaacagcucccucaucaaggucgcccuggacacccuggccgcgcuccucaagagcaagaccaacgcccgccgggccguggaccgcggcuacgugcagguccugcugaccaucuacguggacuggcaccggcacgacaaccgccaccgcaacaugcugauccggaaggggauccugcagucccucaagagcgugacgaacaucaagcugggccgcaaggccuucaucgacgcgaacggcaugaagauccuguacaacaccucccaggagugccucgccguccggacccuggacccccuggugaacaccagcucccucaucaugcgcaagugcuucccgaagaaccggcugccccugcccacgaucaagagcuccuuccacuuccagcugcccgugaucccggucaccgggcccguggcccagcucuacagccugccgcccgaggucgacgacgugguggacgaguccgacgacaacgacgacaucgacgucgaggccgagaacgagaccgagaacgaggacgaccuggaccagaacuucaagaacgacgacaucgagaccgacaucaacaagcucaagccccagcaggagcccggccgcacgaucgaggaccugaagauguacgagcaccuguuccccgagcucguggacgacuuccaggacuacgaccugaucagcaaggagcccaagccguucguguucgaggggaagguccggggccccaucguggugcccaccgccggggaggagaccuccggcaacagcggcaaccugcgcaaggucgugaugaaggagaacaucuccagcaagggggacgagggcgagaagaaguccaccuucauggaccucgcgaaggaggacaucaaggacaacgaccggacgcugcagcagcagcccggggaccagaaccgcaccaucuccagcgugcacggccugaacaacgacaucgucaaggcccucgaccggaucacccugcagaacaucccgucccagaccgcccccggguucacggccgagaugaagaaggacugcagccugccccucaccgugcugaccugcgccaaggcgugcccgcacauggcgaccugcggcaacgugcuguucgagggccgcacgguccagcucgggaagcugugcugcaccggcguggagaccgaggacgacgaggacaccgaguccaacagcuccguggagcaggccagcgucgaggugcccgacgggcccacccugcacgaccccgaccucuacaucgagaucgugaagaacacgaaguccgucccggaguacagcgagguggccuaccccgacuacuucggccacaucccgccgcccuucaaggagcccauccuggagcggcccuacggcgugcagcgcaccaagaucgcccaggacaucgagcggcugauccaccaguccgacaucaucgaccgcgucguguacgaccucgacaaccccaacuacaccauccccgaggagggggacauccugaaguucaacagcaaguucgaguccggcaaccugcggaaggugauccagauccgcaagaacgaguacgaccucauccugaacagcgacaucaacuccaaccacuaccaccagugguucuacuucgaggucagcgggaugcggcccggcguggccuaccgcuucaacaucaucaacugcgagaaguccaacagccaguucaacuacgggaugcagccccugauguacagcgugcaggaggcccucaacgcccgccccugguggauccggaugggcaccgacaucugcuacuacaagaaccacuucucccgcagcuccgucgccgcgggcgggcagaagggcaagagcuacuacacgaucaccuucaccgugaacuucccgcacaaggacgacgugugcuacuucgccuaccacuaccccuacaccuacuccacgcugcagaugcaccuccagaagcuggagagcgcccacaacccccagcagaucuacuuccggaaggacguccugugcgagacccuguccgggaacagcugcccccucgugaccaucaccgccaugccggaguccaacuacuacgagcacaucugccacuuccgcaaccggcccuacguguuccugagcgcccgcguccaccccggcgagacgaacgcguccugggugaugaaggggacccuggaguaccucaugagcaacaaccccaccgcccagucccugcgggagagcuacaucuucaagaucgugccgaugcugaaccccgacggcgucaucaacggcaaccaccgcugcucccucagcggggaggaccugaaccggcaguggcagucccccagcccggaccugcaccccaccaucuaccacgccaagggccuccugcaguaccuggccgccgugaagcgccucccccugguguacugcgacuaccacgggcacucccggaagaagaacgucuucauguacggcugcagcaucaaggagacgguguggcacaccaacgacaacgcgaccagcugcgacguggucgaggacaccggguaccgcacgcugcccaagauccucucccacaucgccccggccuucugcaugagcuccugcagcuucgugguggagaaguccaaggagagcaccgcccgggucgugguguggcgcgagaucggcguccagcgguccuacaccauggagagcacccugugcggcugcgaccaggggaaguacaagggccugcagaucgggacgcgcgagcucgaggagaugggcgccaaguucugcguggggcugcugcggcucaagcgccugaccagcccccuggaguacaaccuccccagcucccugcuggacuucgagaacgaccucaucgagagcuccugcaaggucaccagccccaccacguacgugcuggacgaggacgagccgcgguuccuggaggagguggacuacuccgcggagagcaacgacgagcucgacaucgagcuggccgagaacgucggcgacuacgagcccuccgcccaggaggaggugcugagcgacuccgagcucagccgcaccuaccugcccuga

SEQ ID NO: 26471 - RNA, 1185 nt, Artificial Sequence
  derived and/or modified sequence opt1 from AGTR1__Homo_sapiens__NP_004826
augaagaagaugaaccacaagagcaccgacucccccaaggccccgcagcugcgcggcgggguguucgacaucgucuucgccaccaacagcacccaggugaucaagaugauccucaacuccagcacggaggacggcaucaagcggauccaggacgacugccccaaggcggggcgccacaacuacaucuucgugaugauccccacccuguacuccaucaucuucgucgugggcaucuucgggaacagccugguggucaucgugaucuacuucuacaugaagcucaagaccguggccuccgucuuccugcugaaccucgcccuggccgaccugugcuuccuccugacgcugccccucugggccguguacaccgcgauggaguaccgguggccguucggcaacuaccugugcaagaucgccagcgccuccgugagcuucaaccuguacgccuccgucuuccuccugaccugccugagcaucgaccgcuaccucgcgaucgugcaccccaugaagucccggcugcgccggaccaugcugguggccaaggucacgugcaucaucaucuggcuccuggccggccuggccagccuccccgccaucauccaccgcaacguguucuucaucgagaacaccaacaucaccgugugcgcguuccacuacgagucccagaacagcacccugcccaucgggcugggccucacgaagaacauccugggguuccuguucccguuccucaucauccugaccuccuacacccugaucuggaaggcccucaagaaggccuacgagauccagaagaacaagccccggaacgacgacaucuucaagaucaucauggccaucguccuguucuucuucuucagcuggaucccccaccagaucuucaccuuccuggacgugcucauccagcugggcaucauccgcgacugccggaucgccgacaucguggacacggcgaugcccaucaccaucugcaucgccuacuucaacaacugccugaacccccucuucuacggguuccugggcaagaaguucaagcgcuacuuccugcagcuccugaaguacaucccgcccaaggccaagucccacagcaaccugagcaccaagauguccacccucagcuaccggcccuccgacaacgucagcuccagcacgaagaagccggcccccugcuucgagguggaguga

SEQ ID NO: 26472 - RNA, 1092 nt, Artificial Sequence
  derived and/or modified sequence opt1 from AGTR2__Homo_sapiens__XP_011535835
augaagggcaacagcacccuggccaccacguccaagaacaucaccagcgggcuccacuucggccuggugaacaucuccgggaacaacgagagcacccugaacugcucccagaagcccagcgacaagcaccucgacgccaucccgauccuguacuacaucaucuucgucaucggcuuccuggugaacaucguggucgugacccucuucugcugccagaaggggcccaagaagguguccagcaucuacaucuucaaccuggcggucgccgaccugcuccugcuggccacgcucccccugugggccaccuacuacuccuaccgcuacgacuggcuguucggccccgugaugugcaagguguucggcagcuuccucacccugaacauguucgccuccaucuucuucaucacgugcaugagcgucgaccgguaccaguccgugaucuacccguuccugagccagcgccggaaccccuggcaggcguccuacaucgugccccucgucuggugcauggccugccugagcucccugcccaccuucuacuuccgcgacgugcggaccaucgaguaccucggggugaacgccugcaucauggccuucccgcccgagaaguacgcgcaguggagcgccggcaucgcccugaugaagaacauccugggguucaucaucccccucaucuucaucgcgaccugcuacuucggcauccgcaagcaccuccugaagaccaacuccuacgggaagaaccggaucacgcgcgaccagguccugaagauggccgccgccguggugcuggccuucaucaucugcuggcugcccuuccacguccucaccuuccuggacgcccuggccuggaugggcgugaucaacagcugcgaggugaucgcggucaucgaccucgcccugccguucgccauccugcucggcuucaccaacagcugcgugaaccccuuccuguacugcuucguggggaaccgguuccagcagaagcugcgcuccgucuuccgggugcccaucaccuggcuccagggcaagcgcgagagcauguccugccgcaagagcuccagccugcgggagauggagacguucgucuccuga

SEQ ID NO: 26473 - RNA, 1545 nt, Artificial Sequence
  derived and/or modified sequence opt1 from AGXT2__Homo_sapiens__NP_114106
augacccugaucuggcgccaccuccugcggccccugugccucgugaccagcgccccgcgcauccuggagaugcaccccuuccugucccucggcacgagccggaccuccgucaccaagcugagccugcacaccaagccccgcaugcccccgugcgacuucaugcccgagcgguaccagucccucggguacaaccgcgugcuggagauccacaaggagcaccugagccccguggucacggccuacuuccagaagccccuccugcugcaccagggccacauggaguggcuguucgacgcggaggggucccgguaccucgacuucuucagcggcaucgugaccguguccgucgggcacugccacccgaaggugaacgccguggcccagaagcagcugggccgccucuggcacaccagcaccgucuucuuccacccgcccaugcacgaguacgccgagaagcuggccgcgcugcuccccgagccccugaaggugaucuuccuggugaacuccggcagcgaggccaacgagcucgccaugcugauggcccgggcgcacuccaacaacaucgacaucaucagcuuccgcggggccuaccacggcugcucccccuacacgcuggggcucaccaacgucggcaccuacaagauggagcugcccgggggcaccggcugccagcccacgaugugcccggacguguuccgggggcccuggggcgggagccacugccgcgacucccccgugcagaccauccggaagugcagcugcgcccccgacugcugccaggccaaggaccaguacaucgagcaguucaaggacacccuguccaccagcgucgccaagagcaucgcgggcuucuucgccgagccgauccagggcgugaacggggugguccaguaccccaagggcuuccucaaggaggccuucgagcuggugcgcgcccgcgggggcgugugcaucgccgacgagguccagacgggguucggccggcugggcucccacuucuggggguuccagacccacgacgugcuccccgacaucgugaccauggcgaagggcaucgggaacggcuuccccauggccgccgucaucaccacgccggagaucgccaagagccuggccaagugccugcagcacuucaacaccuucgggggcaaccccauggcgugcgccaucggcuccgccgugcucgaggucaucaaggaggagaaccugcaggagaacagccaggagguggggaccuacaugcugcucaaguucgccaagcugcgggacgaguucgagaucgugggcgacguccgcgggaagggccugaugaucgggaucgagauggugcaggacaagaucuccugccggccccucccccgcgaggaggugaaccagauccacgaggacugcaagcacaugggccugcuggucggccgggggagcaucuucucccagaccuuccgcaucgccccgagcaugugcaucacgaagcccgagguggacuucgcgguggaggucuuccgcuccgcccucacccagcacauggagcggcgcgccaaguga

SEQ ID NO: 26474 - RNA, 1179 nt, Artificial Sequence
  derived and/or modified sequence opt1 from AGXT__Homo_sapiens__NP_000021
auggccagccacaagcugcucgugacgcccccgaaggcccugcugaagccccucuccauccccaaccagcugcugcucggccccgggccgagcaaccugccgccccgcaucauggcggccggcgggcugcagaugaucggcuccaugagcaaggacauguaccagaucauggacgagaucaaggaggggauccaguacgucuuccagacccggaacccccucacccuggugaucuccggcagcggccacugcgcccuggaggccgcccucgugaacguccuggagcccggggacuccuuccuggugggcgcgaacgggaucuggggccagcgcgccguggacaucggggagcggaucggcgcccgcguccaccccaugaccaaggaccccggcgggcacuacacccuccaggagguggaggagggccuggcccagcacaagcccgugcuccucuuccugacccacggggagagcuccacgggcguccugcagccgcucgacggcuucggggagcugugccaccgguacaagugccugcuccugguggacagcguggcgucccugggcgggacgccccucuacauggaccgccagggcaucgacauccuguacagcgggucccagaaggcccugaacgccccgcccggcaccagccucaucuccuucagcgacaaggccaagaagaagauguacucccggaagaccaagcccuucagcuucuaccuggacaucaaguggcuggccaacuucuggggcugcgacgaccagccccgcauguaccaccacaccauccccgucaucucccucuacagccugcgggagagccuggcgcucaucgccgagcaggggcuggagaacuccuggcgccagcaccgggaggccgccgccuaccugcacggccgccuccaggcgcuggggcugcagcuguucgugaaggaccccgcccugcggcugccgaccgugaccaccgucgccgugcccgccggcuacgacuggcgcgacaucgugagcuacgucaucgaccacuucgacaucgagaucaugggcgggcucggccccuccacggggaaggugcugcggaucggccugcucgggugcaacgccacccgcgagaacguggaccgggucaccgaggcgcugcgcgccgcccugcagcacugccccaagaagaagcuguga

SEQ ID NO: 26475 - RNA, 1299 nt, Artificial Sequence
  derived and/or modified sequence opt1 from AHCY__Homo_sapiens__NP_000678
augagcgacaagcugcccuacaagguggccgacaucggccucgccgcgugggggcgcaaggcccuggacaucgccgagaacgagaugccgggccugaugcggaugcgcgagcgguacuccgccagcaagccccucaagggggcccgcaucgcgggcugccugcacaugaccgucgagaccgccgugcugaucgagacgcucgugacccugggggccgagguccagugguccagcugcaacaucuucuccacccaggaccacgccgcggccgccaucgccaaggccggcauccccguguacgcguggaagggcgagaccgacgaggaguaccuguggugcaucgagcagacgcucuacuucaaggacgggccccugaacaugauccuggacgacggcggggaccucaccaaccugauccacaccaaguacccgcagcugcuccccggcauccgggggaucagcgaggagaccacgaccggcgugcacaaccuguacaagaugauggccaacggcauccugaagguccccgccaucaacgugaacgacuccgugaccaagagcaaguucgacaaccucuacgggugccgcgagucccugaucgacggcaucaagcgggccaccgacgucaugaucgccgggaagguggcgguggucgccggcuacggcgacguggggaagggcugcgcccaggcccugcgcggguucggcgcccgggugaucaucacggagaucgaccccaucaacgcgcuccaggccgccauggagggguacgaggucaccaccauggacgaggccugccaggagggcaacaucuucgugaccacgaccggcugcaucgacaucauccuggggcgccacuucgagcagaugaaggacgacgccaucgugugcaacaucggccacuucgacgucgagaucgacgugaaguggcugaacgagaacgcgguggagaaggucaacaucaagccccagguggaccgguaccgccucaagaacgggcggcgcaucauccugcuggccgagggccggcucgugaaccuggggugcgccaugggccacccgagcuucgucauguccaacagcuucaccaaccaggugauggcccagaucgagcuguggacccaccccgacaaguaccccgucggcgugcacuuccucccgaagaagcuggacgaggcgguggccgaggcccaccuggggaagcucaacgucaagcugacgaagcugaccgagaagcaggcccaguaccucggcauguccugcgacgggcccuucaagcccgaccacuaccgcuacuga

SEQ ID NO: 26476 - RNA, 1833 nt, Artificial Sequence
  derived and/or modified sequence opt1 from AHCYL2__Homo_sapiens__NP_001124192
augagcgugcaggucguguccgccgccgcggccgccaaggugcccgaggucgagcugaaggaccucagcccguccgaggccgagagccagcugggccuguccaccgccgcggugggggccauggccccgcccgccggcgggggcgaccccgaggcgcccgcccccgccgccgagcgcccgcccgugcccgggcccggcagcggccccgccgcggcccucucccccgccgccgggaaggucccgcaggccagcgcgaugaagcgguccgacccccaccaccagcaccagcgccaccgggacggcggggaggcccuggugagccccgacggcaccgugacggaggcgccccgcaccgucaagaagauccaguucgccgaccagaagcaggaguucaacaagcggccgaccaagaucgggcgccggucccugagccgcuccaucagccaguccagcaccgacuccuacagcuccgccgccagcuacacggacagcuccgacgacgagaccagcccccgggacaagcagcagaagaacuccaagggcagcuccgacuucugcgugaagaacaucaagcaggccgaguucggccgccgggagaucgagaucgccgagcaggagaugcccgcccucauggcccugcgcaagcgggcgcagggggagaagccccuggccggcgccaagaucguggggugcacccacaucaccgcccagacggcgguccucauggagacccugggcgcccugggcgcccagugccgcugggccgccugcaacaucuacagcacccucaacgagguggcggccgcccuggccgaguccggguucccgguguucgccuggaagggcgagagcgaggacgacuucugguggugcaucgaccggugcgucaacguggagggguggcagcccaacaugauccuggacgacggcggggaccucacccacuggaucuacaagaaguaccccaacauguucaagaagaucaagggcaucguggaggaguccgucacgggcgugcaccgccuguaccagcugagcaaggcggggaagcucugcgugcccgccaugaacgucaacgacuccgugaccaagcagaaguucgacaaccuguacugcugccgggagagcauccuggacggccucaagcgcaccaccgacaugauguucgggggcaagcaggucguggugugcggguacggcgaggucggcaaggggugcugcgccgcccugaaggccaugggcuccaucguguacgugacggagaucgacccgaucugcgcgcugcaggccugcauggacggguuccggcucgucaagcugaacgaggugauccgccagguggacaucgucaucacgugcaccggcaacaagaacguggugacccgggagcaccuggaccgcaugaagaacagcugcaucgucugcaacauggggcacuccaacaccgagaucgacguggccagccuccgcacccccgagcugaccugggagcgggugcgcucccaggucgaccacgugaucuggcccgacggcaagcggaucgugcugcucgccgagggccgccugcugaaccucagcugcuccaccguccccacguucgugcugagcaucaccgcgaccacccaggcccuggcccucaucgagcuguacaacgccccggaggggcgguacaagcaggacguguaccugcuccccaagaagauggacgaguacgucgccagccugcaccuccccacguucgacgcgcaccugaccgagcugaccgacgagcaggccaaguaccugggccucaacaagaacgggccguucaagcccaacuacuaccgcuacuga

SEQ ID NO: 26477 - RNA, 3162 nt, Artificial Sequence
  derived and/or modified sequence opt1 from AHI1__Homo_sapiens__NP_001128304
augcccaccgccgagagcgaggccaaggugaagaccaagguccgcuucgaggagcugcucaagacccacuccgaccugaugcgggagaagaagaagcugaagaagaagcucgugcgcagcgaggagaacaucucccccgacaccauccggagcaaccugcacuacaugaaggagaccaccuccgacgaccccgacacgauccgcagcaaccugccccacaucaaggagaccaccuccgacgacgugagcgcggccaacaccaacaaccucaagaaguccacgcgggucaccaagaacaagcugcgcaacacccagcuggccaccgagaaccccaacggcgacgccagcguggaggaggacaagcaggggaagccgaacaagaaggugaucaagacggucccccagcucaccacccaggaccugaagcccgagacccccgagaacaagguggacuccacgcaccagaagacccacaccaagccgcagcccggcguggaccaccagaaguccgagaaggccaacgaggggcgggaggagaccgaccuggaggaggacgaggagcucaugcaggcguaccagugccacgucacggaggagauggccaaggagaucaagcgcaagauccggaagaagcugaaggagcagcugaccuacuuccccagcgacacccucuuccacgacgacaagcugagcuccgagaagcgcaagaagaagaaggaggugcccguguucagcaaggccgagaccuccacgcugaccaucagcggcgacaccgucgagggggagcagaagaaggaguccagcgugcggagcguguccagcgacucccaccaggacgacgagaucagcuccauggagcagagcaccgaggacuccaugcaggacgacacgaagccgaagcccaagaagaccaagaagaagaccaaggccgucgcggacaacaacgaggacguggacggcgacggcgugcacgagaucaccagccgcgacucccccgucuaccccaagugccuccuggacgacgaccuggugcucgggguguacauccaccggacggaccgccucaagagcgacuucaugaucucccacccgauggucaagauccacgugguggacgagcacaccggccaguacgucaagaaggacgacagcgggcggcccguguccagcuacuacgagaaggagaacgucgacuacauccugcccaucaugacccagcccuacgacuucaagcagcugaagucccgccugccggagugggaggagcagaucguguucaacgagaacuuccccuaccugcuccggggcagcgacgagucccccaaggugauccuguucuucgagauccuggacuuccucagcgucgacgagaucaagaacaacuccgaggugcagaaccaggagugcggguuccgcaagaucgccugggccuuccugaagcugcucggcgccaacggcaacgccaacaucaacagcaagcugcggcugcagcucuacuacccgcccaccaagccccgcagcccccuguccguggucgaggcguucgagugguggagcaagugcccccggaaccacuacccguccacgcuguacgugaccgugcgcgggcucaagguccccgacugcaucaagcccagcuaccgcuccaugauggcccugcaggaggagaagggcaagccggugcacugcgagcggcaccacgagagcuccagcguggacaccgagcccgggcuggaggaguccaaggaggucaucaaguggaagcgccuccccggccaggccugccggauccccaacaagcaccuguucagccugaacgccggcgagcgcgggugcuucugccucgacuucucccacaacggccggauccuggccgcggccugcgccagccgcgacggguacccgaucauccuguacgagauccccuccggccgguucaugcgcgagcucugcgggcaccugaacaucaucuacgaccugagcugguccaaggacgaccacuacauccugaccagcuccagcgacggcaccgcccggaucuggaagaacgagaucaacaacacgaacaccuuccgcgugcucccccaccccagcuucguguacaccgccaaguuccacccggcgguccgggagcugguggugaccggcugcuacgacuccaugauccgcaucuggaaggucgagaugcgggaggacagcgccauccuggugcgccaguucgacgugcacaaguccuucaucaacagccucugcuucgacacggaggggcaccacauguacuccggcgacugcaccggggucaucgugguguggaacaccuacgucaagaucaacgaccuggagcacagcgugcaccacuggaccaucaacaaggagaucaaggagacggaguucaagggcauccccaucuccuaccuggagauccaccccaacgggaagcggcuccugauccacaccaaggacagcacccugcgcaucauggaccuccggauccugguggcccgcaaguucgucggcgccgccaacuaccgggagaagauccacuccacccugacgcccugcggcaccuuccucuucgcggggagcgaggacggcaucguguacguguggaacccggagaccggggagcaggucgccauguacuccgaccugcccuucaagagccccauccgcgacaucuccuaccaccccuucgagaacaugguggccuucugcgccuucggccagaacgagccgauccugcucuacaucuacgacuuccacguggcgcagcaggaggccgagauguucaagcgcuacaacgggaccuucccccugcccggcauccaccagagccaggacgcccugugcacgugccccaagcucccgcaccagggcuccuuccagaucgacgaguucguccacaccgagagcuccagcaccaagaugcagcuggugaagcagcggcuggagaccgugacggaggucauccgcuccugcgccgccaaggugaacaagaaccucagcuucaccagcccgcccgcgguguccagccagcaguccaagcugaagcagagcaacaugcugaccgcccaggagauccuccaccaguucggguucacccagacggacucccacuucgccgaguucaacacgugcauccugugguggaagaagcacuga

SEQ ID NO: 26478 - RNA, 450 nt, Artificial Sequence
  derived and/or modified sequence opt1 from AHNAK__Homo_sapiens__NP_076965
auggagaaggaggagaccacccgcgagcugcuccugcccaacuggcagggcagcgggucccacggccugaccaucgcccagcgggacgacgggguguucguccaggaggugacccagaacagcccggccgcgcgcaccggcguggucaaggagggggaccagaucgugggcgccaccaucuacuucgacaaccuccaguccggcgaggugacgcagcugcugaacaccauggggcaccacaccgucggccucaagcugcaccggaagggggaccgcagccccgagcccggccagaccuggacgcgggagguguucuccagcugcuccagcgaggugguccugaacacgccccagccguccgcccucgagugcaaggaccagaacaagcagaaggaggccagcucccaggccggggcggugagcguguccacccccaacgccggccuguga

SEQ ID NO: 26479 - RNA, 2547 nt, Artificial Sequence
  derived and/or modified sequence opt1 from AHR__Homo_sapiens__NP_001612
augaacagcuccagcgccaacaucaccuacgccucccgcaagcggcgcaagcccgugcagaagaccgucaagccgauccccgcggagggcaucaagagcaaccccuccaagcggcaccgcgaccggcugaacacggagcucgaccgccuggccagccugcuccccuucccgcaggacgugaucaacaagcuggacaagcuguccgugcuccggcugagcgucuccuaccugcgcgccaagagcuucuucgacguggcccucaaguccagccccaccgagcggaacgggggccaggacaacugccgcgccgcgaacuuccgggaggggcugaaccugcaggagggcgaguuccuccugcaggcccugaacggguucgugcucgucgugaccaccgacgcccugguguucuacgccuccagcacgauccaggacuaccugggcuuccagcaguccgacgucauccaccagagcguguacgagcucauccacaccgaggaccgcgcggaguuccagcggcagcugcacugggcccugaaccccucccagugcaccgagagcggccaggggaucgaggaggccaccggccucccccagacgguggucugcuacaacccggaccagaucccgcccgagaacagcccccugauggagcgcugcuucaucugccggcugcgcugccuccuggacaacuccagcggguuccuggccaugaacuuccagggcaagcucaaguaccugcacgggcagaagaagaagggcaaggacggcuccauccugccgccccagcucgcccuguucgcgaucgccacgccccugcagcccccgagcauccucgagauccggaccaagaacuucaucuuccgcaccaagcacaagcuggacuucacccccaucgggugcgacgccaagggccggaucgugcugggguacaccgaggccgagcucugcacccgcggcuccggcuaccaguucauccacgccgcggacaugcuguacugcgccgagagccacauccggaugaucaagaccggggaguccggcaugaucguguuccgccugcucacgaagaacaaccgcuggaccuggguccagagcaacgcccggcugcuguacaagaacgggcgccccgacuacaucaucgugacccagcggccccucaccgacgaggagggcacggagcaccuccgcaagcggaacaccaagcugcccuucauguucaccaccggggaggccgugcuguacgaggccacgaaccccuuccccgcgaucauggacccccugccgcugcgcaccaagaacggcaccuccggcaaggacagcgccaccacguccacccucagcaaggacucccugaaccccagcucccugcuggccgccaugaugcagcaggacgagagcaucuaccucuaccccgccuccagcaccuccagcaccgcgcccuucgagaacaacuucuucaacgaguccaugaacgagugccggaacuggcaggacaacacggccccgauggggaacgacaccauccugaagcacgagcagaucgaccagccccaggacgucaacagcuucgccggcgggcaccccggccuguuccaggacagcaagaacuccgaccucuacagcaucaugaagaaccuggggaucgacuucgaggacauccgccacaugcagaacgagaaguucuuccggaacgacuucuccggcgagguggacuuccgcgacaucgaccugaccgacgagauccucaccuacgugcaggacagccuguccaagagcccguucauccccuccgacuaccagcagcagcagagccuggcccucaacuccagcugcaugguccaggagcaccuccaccuggagcagcagcagcagcaccaccagaagcaggucgugguggagccccagcagcagcugugccagaagaugaagcacaugcaggucaacggcauguucgagaacuggaacuccaaccaguucgugcccuucaacugcccgcagcaggacccccagcaguacaacguguucacggaccugcacgggaucagccaggaguuccccuacaaguccgagauggacagcaugcccuacacccagaacuucaucuccugcaaccagccggugcugccccagcacagcaagugcaccgagcucgacuaccccaugggcuccuucgagcccagcccguaccccaccaccagcucccuggaggacuucgucacgugccugcagcuccccgagaaccagaagcacgggcugaacccccagagcgcgaucaucaccccgcagaccugcuacgccggcgccguguccauguaccagugccagcccgagccccagcacacccacguggggcagaugcaguacaaccccguccugccgggccagcaggccuuccucaacaaguuccagaacggcgugcugaacgagacguaccccgccgagcugaacaacaucaacaacacccagaccaccacgcaccuccagccccugcaccaccccagcgaggcgcggccguuccccgaccugaccuccagcggguuccucuga

SEQ ID NO: 26480 - RNA, 2106 nt, Artificial Sequence
  derived and/or modified sequence opt1 from AHRR__Homo_sapiens__NP_001229341
augccccgcaccaugaucccgcccggcgagugcaccuacgccgggcggaagcgccggcgcccccugcagaagcagcggcccgccgugggcgcggagaaguccaacccgagcaagcgccaccgggaccgccucaacgccgagcuggaccaccuggccagccuccugcccuucccgcccgacaucaucuccaagcuggacaagcucagcguccugcggcuguccgugagcuaccuccgcgugaaguccuucuuccaggucgugcaggagcagagcucccggcagcccgccgccggggcgcccagccccggcgacuccugcccccuggccgggagcgccgugcuggagggccgccuccugcuggagucccucaacggcuucgcccuggucgugagcgcggaggggacgaucuucuacgccuccgccaccaucguggacuaccugggcuuccaccagaccgacgucaugcaccagaacaucuacgacuacauccacguggacgaccggcaggacuucugccgccagcuccacugggccauggacccgccccagguggucuucgggcagcccccgccccuggagaccggcgacgacgccauccuggggcggcuccugcgcgcgcaggaguggggcacgggcacccccaccgaguacagcgccuuccugacccggugcuucaucugccgcgugcggugccuccuggacuccacgagcggguuccugaccaugcaguuccagggcaagcucaaguuccuguucgggcagaagaagaaggcccccuccggcgccaugcugcccccgcgccucagccuguucugcaucgccgcgcccgugcugcuccccagcgccgccgagaugaagaugcgguccgcccugcugcgcgccaagccccgcgcggacaccgccgccaccgccgacgccaaggucaaggcgacgaccagccucugcgaguccgagcugcacggcaagccgaacuacagcgccgggcgguccagccgcgaguccggcgugcuggugcuccgggagcagaccgacgccgggcgcugggcccagguccccgcgcgggcccccugccugugccugcgcggcgggcccgaccucgugcuggacccgaagggcggcagcggggaccgggaggaggagcagcaccgcaugcugucccgggccagcggcgugaccgggcgccgggagacgcccggccccaccaagccgcuccccuggaccgccgggaagcacuccgaggacggcgcccgcccccggcugcagcccagcaagaacgacccgcccucccugcgccccaugccccggggcagcugccucccgugccccugcguccaggggaccuuccgcaacucccccaucagccacccgcccucccccagccccuccgcguacagcagccggacgucccgccccaugcgggacgugggcgaggaccaggugcacccgccccugugccacuucccccagcgcagccugcagcaccagcugccccagccgggggcccagcgcuucgccacccggggcuaccccauggaggacaugaagcuccaggggguccccaugcccccgggcgaccugugcggccccacccugcuccuggacguguccaucaagauggagaaggacagcgggugcgagggcgccgccgacgggugcguccccucccagguguggcugggcgcgagcgaccgcucccacccggccaccuuccccacgcggaugcaccucaagaccgagcccgacagccgccagcaggucuacaucucccaccugggccacggggugcggggcgcccagccccacgggcgcgccaccgccggccggagccgcgagcugaccccguuccaccccgcgcacugcgccugccucgagcccacggacgggcugccccaguccgagccgccccaccagcugugcgcccggggccgcggcgagcagagcugcacgugccgggccgcggaggccgcccccguggugaagcgcgagccccucgacuccccgcagugggccacccacagccaggggaugguccccggcaugcugcccaaguccgcccuggcgacccucgugcccccgcaggccagcgggugcaccuuccugcccuga

SEQ ID NO: 26481 - RNA, 1017 nt, Artificial Sequence
  derived and/or modified sequence opt1 from AHSA1__Homo_sapiens__NP_036243
auggccaaguggggcgagggggacccccgcuggaucguggaggagcgggccgacgcgaccaacgucaacaacuggcacuggaccgagcgcgacgccagcaacugguccacggacaagcugaagacccucuuccuggccguccaggugcagaacgaggagggcaagugcgaggugaccgaggugagcaagcuggacggggaggccuccaucaacaaccggaagggcaagcucaucuucuucuacgaguggagcgugaagcugaacuggaccgggacguccaagagcggcguccaguacaagggccacguggagaucccgaaccuguccgacgagaacagcguggacgaggucgagaucuccgugagccucgccaaggacgagcccgacaccaaccugguggcgcugaugaaggaggagggggucaagcuccugcgcgaggccaugggcaucuacaucuccacccugaagaccgaguucacgcaggggaugauccuccccaccaugaacggcgagagcguggaccccguggggcagccggcccugaagaccgaggagcggaaggccaagcccgcgcccuccaagacccaggcccgccccgucggcgugaagaucccgacgugcaagaucacccugaaggagaccuuccucaccagccccgaggagcuguaccggguguucacgacccaggagcugguccaggccuucacccacgcccccgccacccucgaggcggaccgcggcgggaaguuccacaugguggacggcaacguguccggggaguucacggaccugguccccgagaagcacaucgugaugaaguggcgguucaagagcuggccggagggccacuucgccaccaucacccugaccuucaucgacaagaacggcgagacggagcucugcauggaggggcgcggcauccccgcccccgaggaggagcggacccgccagggguggcagcgguacuacuucgagggcaucaagcagaccuucggguacggcgcccgccuguucuga

SEQ ID NO: 26482 - RNA, 414 nt, Artificial Sequence
  derived and/or modified sequence opt1 from AHSA2__Homo_sapiens__NP_689605
augauccugcccaccaaggccauggccacccaggagcucacggugaagcgcaagcugagcggcaacacccugcagguccaggcguccagcccgguggcccucggggugcggauccccaccgucgcccugcacaugauggagcuguucgacaccacgguggagcagcucuacuccaucuucaccgugaaggagcugaccaacaagaagaucaucaugaaguggcgcugcggcaacuggcccgaggagcacuacgccauggucgcccugaacuucgugcccacccucgggcagacggagcugcagcugaaggaguuccucagcaucugcaaggaggagaacaugaaguucugcuggcagaagcagcacuucgaggagaucaagggcucccugcagcugaccccgcucaacggguga

SEQ ID NO: 26483 - RNA, 1104 nt, Artificial Sequence
  derived and/or modified sequence opt1 from AHSG__Homo_sapiens__NP_001613
augaagucccuggugcuccugcugugccucgcccagcuguggggcugccacagcgcgccccacgggcccggccugaucuaccgccagcccaacugcgacgaccccgagaccgaggaggccgcccucgucgccaucgacuacaucaaccagaaccugcccuggggguacaagcacacccugaaccagaucgacgaggugaagguguggccgcagcagcccagcggcgagcuguucgagaucgagaucgacacgcuggagacgaccugccacguccuggaccccacccccguggcccggugcuccgugcgccagcucaaggagcacgccgucgagggggacugcgacuuccagcugcugaagcucgacggcaaguucagcgugguguacgcgaagugcgacuccagcccggacuccgccgaggacguccggaaggugugccaggacugcccccugcuggcgccccucaacgacacccgcgugguccacgccgccaaggccgcccuggccgccuucaacgcgcagaacaacggcagcaacuuccagcuggaggagaucucccgggcccagcucgugccccugccgcccagcaccuacguggaguucaccgucuccgggaccgacugcguggccaaggaggccacggaggccgcgaagugcaaccugcucgccgagaagcaguacggcuucugcaaggccacccugagcgagaagcucgggggcgccgagguggccgugaccugcauggucuuccagacccagcccguguccagccagccccagccggagggggcgaacgaggccguccccacgcccgugguggaccccgacgccccgcccuccccgccccucggcgcccccggccugccgcccgccgggagcccgcccgacucccacguccugcucgcggccccgcccggccaccagcugcaccgcgcccacuacgaccugcggcacaccuucauggggguggucagccucggcucccccagcggcgaggugagccacccccgcaagacccggaccgugguccagcccuccgugggggccgcggccggccccguggucccgcccugccccgggcgcauccggcacuucaagguguga

SEQ ID NO: 26484 - RNA, 597 nt, Artificial Sequence
  derived and/or modified sequence opt1 from AICDA__Homo_sapiens__NP_065712
auggacagccugcucaugaaccgccggaaguuccuguaccaguucaagaacgugcgcugggccaagggccggcgcgagaccuaccugugcuacgucgugaagcggcgcgacuccgccaccagcuucucccucgacuucggguaccugcggaacaagaacggcugccacguggagcuccuguuccugcgcuacaucagcgacugggaccuggaccccgggcggugcuaccgcgucacgugguucaccuccuggagcccgugcuacgacugcgcgcggcacguggccgacuuccuccgcggcaaccccaaccugucccugcggaucuucaccgcccgccucuacuucugcgaggaccggaaggccgagcccgaggggcugcgccggcugcaccgcgccggcgugcagaucgcgaucaugaccuucaaggacuacuucuacugcuggaacacguucgucgagaaccacgagcggaccuucaaggccugggagggccuccacgagaacagcgugcgccugucccggcagcugcgccgcauccuccugccccuguacgagguggacgaccuccgggacgccuuccgcacccuggggcuguga

SEQ ID NO: 26485 - RNA, 921 nt, Artificial Sequence
  derived and/or modified sequence opt1 from AIDA__Homo_sapiens__NP_073742
augagcgaggugacccgcucccugcugcagcgguggggcgccagcuuccgccgcggggccgacuucgacuccuggggccagcuggucgaggcgaucgacgaguaccagauccuggcccggcaccuccagaaggaggcccaggcccagcacaacaacagcgaguucaccgaggagcagaagaagacgaucgggaagaucgcgaccugccuggagcugcgguccgccgcccuccagagcacccagucccaggaggaguucaagcuggaggaccugaagaagcucgagcccauccugaagaacauccugaccuacaacaaggaguucccguucgacgugcagcccgugccccuccgccggauccuggcccccggcgaggaggagaaccuggaguucgaggaggacgaggaggagggcggggccggcgcggggagcccggacuccuuccccgcccgcguccccggcacgcuccugccccggcugccgagcgagcccgggaugacccuccugaccauccgcaucgagaagaucggccugaaggacgccgggcagugcaucgaccccuacaucaccguguccgugaaggaccucaacggcaucgaccugacgcccguccaggacaccccgguggccagccggaaggaggacaccuacgugcacuucaacgucgacaucgagcugcagaagcacguggagaagcucaccaagggcgccgcgaucuucuucgaguucaagcacuacaagcccaagaagcgcuucacguccaccaagugcuucgccuucauggagauggacgagaucaagcccgggcccaucgugaucgagcuguacaagaagccgaccgacuucaagcggaagaagcugcagcuccugaccaagaagccccuguaccuccaccuccaccagacgcugcacaaggaguga

SEQ ID NO: 26486 - RNA, 444 nt, Artificial Sequence
  derived and/or modified sequence opt1 from AIF1__Homo_sapiens__NP_001614
augagccagacccgcgaccugcagggcgggaaggccuucggccuccugaaggcccagcaggaggagcggcuggacgagaucaacaagcaguuccucgacgaccccaaguacuccagcgacgaggaccugccguccaagcuggagggguucaaggagaaguacauggaguucgaccucaacggcaacggggacaucgacaucaugagccugaagcgcaugcuggagaagcucggcgugcccaagacccaccuggagcugaagaagcucaucggcgaggucuccagcggguccggcgagacguucagcuaccccgacuuccugcggaugaugcuggggaagcgcuccgcgauccucaagaugauccugauguacgaggagaaggcccgggagaaggagaagcccaccggcccgcccgccaagaaggccaucagcgagcugcccuga

SEQ ID NO: 26487 - RNA, 825 nt, Artificial Sequence
  derived and/or modified sequence opt1 from AIFM1__Homo_sapiens__NP_001124318
augggcaagauccugcccgaguaccucagcaacuggaccauggagaaggugcgccgggagggggucaaggugaugccgaacgccaucgugcaguccgucggcgugagcuccgggaagcugcugaucaagcucaaggacggccgcaagguggagaccgaccacaucgucgccgcgguggggcuggagcccaacguggagcuggccaagacgggcggccucgagaucgacagcgacuucgggggcuuccgggucaacgccgagcugcaggcccgcuccaacaucuggguggccggggacgcggccugcuucuacgacaucaagcugggccggcgccggguggagcaccacgaccacgccgucgugagcgggcgccucgccggcgagaacaugaccggcgcggccaagcccuacuggcaccaguccauguucuggagcgaccuggggcccgacgugggcuacgaggccaucgggcuggucgacuccagccucccgaccgugggcguguucgccaaggccaccgcgcaggacaaccccaaguccgccacggagcagagcggcaccgggauccgguccgagagcgagaccgaguccgaggccagcgagaucaccaucccgcccuccacgcccgccgucccccaggcccccgugcagggcgaggacuacgggaagggcgugaucuucuaccugcgcgacaaggucgugguggggaucguccuguggaacaucuucaaccggaugcccaucgcgcgcaagaucaucaaggacggcgagcagcacgaggaccucaacgagguggccaagcuguucaacauccacgaggacuga

SEQ ID NO: 26488 - RNA, 1122 nt, Artificial Sequence
  derived and/or modified sequence opt1 from AIFM2__Homo_sapiens__NP_001185625
augggcagccagguguccgucgagagcggggcccugcacguggugaucgucggcgggggcuucgggggcaucgccgcggccucccagcuccaggcccugaacgugcccuucaugcugguggacaugaaggacagcuuccaccacaacgucgccgcccuccgcgcguccguggagaccggcuucgccaagaagaccuucaucagcuacuccgugacguucaaggacaacuuccggcaggggcuggucgugggcaucgaccugaagaaccagauggugcuccugcagggcggggaggcccugcccuucagccaccucauccuggccaccggguccaccggccccuuccccggcaaguucaacgaggucagcucccagcaggcggccauccaggccuacgaggacauggugcgccaggugcagcggagccgcuucaucgucguggucgggggcggguccgccggcguggagauggccgcggagaucaagaccgaguaccccgagaaggaggugacgcugauccacagccagguggcccucgccgacaaggagcugcugccguccguccggcaggaggugaaggagauccuccugcgcaagggcgugcagcugcuccugagcgagcgggucuccaaccuggaggagcucccccugaacgaguaccgcgaguacaucaaggugcagaccgacaaggggaccgaggucgccaccaaccuggugauccucugcacgggcaucaagaucaacagcuccgccuaccggaaggcguucgagagccgccuggccagcuccggggcccugcgggugaacgagcaccuccaggucgagggccacagcaacguguacgccaucggggacugcgccgacgugcgcacccccaagauggcguaccuggccggccugcacgccaacaucgccgucgccaacaucgugaacuccgugaagcagcggccccuccaggcguacaagccgggcgcccugaccuuccugcucagcauggggcgcaacgacggcgucgggcagaucuccggcuucuacguggggcggcugauggugcgccugaccaagagccgggaccucuucgucuccacgagcuggaagaccaugcgccaguccccgcccuga

SEQ ID NO: 26489 - RNA, 1797 nt, Artificial Sequence
  derived and/or modified sequence opt1 from AIFM3__Homo_sapiens__NP_001018070
augggcgggugcuucagcaagcccaagccgguggagcugaagaucgaggucgugcuccccgagaaggagcgcggcaaggaggagcuguccgccagcgggaagggcagcccccgggccuaccaggggaacggcaccgcgcgccacuuccacaccgaggagcggcuguccacgccccacccguaccccagcccccaggacugcguggaggccgccgucugccacgugaaggaccucgagaacggccagaugcgcgagguggagcugggguggggcaagguccugcucgugaaggacaacggggaguuccacgcccugggccacaagugcccccacuacggggccccgcuggugaagggcguccucucccggggccgcgugcggugccccuggcacggggcgugcuucaacaucuccaccggcgaccuggaggacuuccccgggcuggacagccuccacaaguuccaggugaagaucgagaaggagaaggucuacgugcgcgccuccaagcaggcccugcagcugcagcggcgcaccaaggugauggccaagugcaucagccccuccgcgggcuacagcuccagcaccaacguccucaucgugggcgccggggccgccggccuggugugcgccgagacgcugcggcaggagggguucuccgaccgcaucguccucugcacccuggaccggcaccucccguacgaccgccccaagcugagcaagucccuggacacccagcccgagcagcuggcgcuccggcccaaggaguucuuccgcgccuacggcaucgaggugcugaccgaggcccagguggucacgguggacgugcggaccaagaaggucguguucaaggacggguucaagcuggaguacagcaagcuccugcuggccccgggcuccagccccaagacccucagcugcaagggcaaggaggucgagaacguguucaccauccgcacgcccgaggacgccaaccgggugguccgccuggcgcgggggcgcaacgugguggucgugggcgccggguuccugggcauggagguggccgccuaccucaccgagaaggcccacuccgucagcgugguggagcuggaggagacccccuuccgccgguuccugggggagcgcgucggccgggcgcucaugaagauguucgagaacaaccgcgugaaguucuacaugcagaccgagguguccgagcugcggggccaggaggggaagcugaaggaggucgugcucaagagcuccaaggugguccgcgccgacgugugcguggucggcaucggggccgugccggccacgggcuuccugcggcagagcgggaucggccuggacucccgcggcuucauccccgugaacaagaugaugcagaccaacguccccgggguguucgccgcgggcgacgccgugaccuucccccucgccuggcggaacaaccgcaaggucaacaucccgcacuggcagauggcccacgcgcaggggcggguggccgcccagaacaugcuggcccaggaggccgagaugagcaccgugcccuaccuguggacggcgauguucggcaagucccuccgcuacgccggcuacggggagggcuucgacgacgucaucauccagggggaccuggaggagcugaaguucguggccuucuacaccaagggcgacgaggugaucgccgucgccagcaugaacuacgaccccaucguguccaagguggcggagguccucgccagcgggcgggccauccgcaagcgggagguggagaccggcgacauguccuggcugaccggcaaggggagcuga

SEQ ID NO: 26490 - RNA, 687 nt, Artificial Sequence
  derived and/or modified sequence opt1 from AIG1__Homo_sapiens__NP_001273516
auggccauccugcucagcuacugcagcauccugugcaacuacaaggccaucgagaugcccagccaccagaccuacggcggguccuggaaguuccugaccuucaucgaccucgugauccaggcggucuucuucggcaucugcgugcugacggaccugagcucccuccugacccgcgggagcggcaaccaggagcaggagcggcagcugaagaagcucaucucccugcgcgacuggaugcuggccgugcucgccuucccggucgggguguucguggucgccguguucuggaucaucuacgccuacgaccgggagaugaucuaccccaagcugcuggacaacuucauccccggcuggcucaaccacggcaugcacaccaccgugcugcccuucauccugaucgagaugcgcacgagccaccaccaguacccgucccggagcuccgggcucaccgcgaucugcaccuucagcgucggcuacauccugugggugugcugggugcaccacgucaccgggauguggguguaccccuuccuggagcacaucggccccggggcccgcaucaucuucuucggcuccacgaccauccucaugaacuuccuguaccugcucggcgaggugcugaacaacuacaucugggacacccagaaguccauggaggaggagaaggagaagcccaagcuggaguga

SEQ ID NO: 26491 - RNA, 5172 nt, Artificial Sequence
  derived and/or modified sequence opt1 from AIM1__Homo_sapiens__NP_001615
auggagaagcgcagcuccgggcggcgcagcgggcggcgccggggcucccagaaguccaccgacucccccggggccgacgccgagcugcccgagagcgccgcccgcgacgacgccguguucgacgacgaggucgcccccaacgccgcguccgacaacgccagcgccgagaagaaggucaagagcccccgggccgcccucgacggcgggguggccagcgccgccucccccgagagcaagccgucccccggcaccaagggccagcugcgcggggagagcgaccgguccaagcagccgccgcccgccagcucccccaccaagcgcaagggccggagccgcgcgcuggaggccgugcccgcgccgcccgccuccgggccccgggcccccgcgaaggaguccccgcccaagcgcgugcccgaccccagccccgugaccaagggcaccgccgccgaguccggggaggaggccgcccgggcgaucccccgcgagcuccccgucaagagcuccagccugcugcccgagaucaagcccgagcacaagcggggcccccuccccaaccacuucaacggccgcgccgagggcgggcggucccgcgagcuggggcgggccgccggcgcccccggcgcgagcgacgccgacgggcugaagccccgcaaccacuucggcguggggcgcuccaccgugaccaccaaggugacccuccccgccaagcccaagcacguggagcugaaccugaagacccccaagaaccucgacagccugggcaacgagcacaacccguucucccagcccgugcacaaggggaacaccgccaccaagaucagccuguucgagaacaagcggaccaacuccagcccccgccacaccgacauccggggccagcgcaacacgcccgcguccagcaagaccuucgucggccgggccaagcucaaccuggccaagaaggccaaggagauggagcagccggagaagaaggugaugcccaacagcccccagaacggggugcuggucaaggagaccgccaucgagaccaaggugacggugagcgaggaggagauccuccccgcgacccgcggcaugaacggggacuccagcgagaaccaggcccugggcccgcagcccaaccaggacgacaaggccgacguccagaccgacgccgggugccuguccgagcccguggccagcgcgcucauccccgugaaggaccacaagcugcuggagaaggaggacagcgaggccgccgacuccaagagccucguccuggagaacgugaccgacacggcccaggacaucccgaccaccguggacaccaaggaccugccgcccacggccaugcccaagccgcagcacaccuucuccgacagccagucccccgcggagagcucccccggccccagccucucccugagcgccccggcccccggcgacguccccaaggacacgugcgugcagucccccaucagcuccuucccgugcaccgaccugaaggucagcgagaaccacaaggggugcgugcuccccgugucccggcagaacaacgagaagaugccccugcuggagcucggcggggagacgaccccgccccugagcaccgagcgcucccccgaggccgucggcagcgagugccccagccgggugcuggugcagguccgcuccuucgugcucccgguggagagcacccaggacgucuccagccaggugauccccgaguccagcgaggugcgggagguccagcugcccacgugccacuccaacgagcccgagguggugagcgucgcguccugcgccccgccccaggaggaggugcuggggaacgagcacagccacugcaccgccgagcucgccgccaaguccggcccccaggugaucccgccggcgagcgagaagacccugcccauccaggcccagucccagggcagccgcacgccccugauggccgaguccagccccacgaacuccccgagcuccgggaaccaccucgccacgccccagcggcccgaccagaccgucaccaacggccaggacagccccgccagccugcugaacaucuccgcggggagcgacgacuccguguucgacagcuccagcgacauggagaaguucaccgagaucaucaagcagauggacuccgccgugugcaugccgaugaagcgcaagaaggcccggaugcccaacagccccgcgccccacuucgccaugccgcccauccacgaggaccaccucgagaaggucuucgaccccaagguguucacguucggccugggcaagaagaaggagucccagcccgagaugagcccggcgcugcaccucaugcagaaccuggacaccaaguccaagcugcgccccaagcgggccagcgccgagcaguccgugcuguucaagagccuccacaccaacaccaacgggaacuccgagccccuggucaugccggagaucaacgacaaggagaaccgcgacgugacgaacggcgggaucaagcggagccgccuggagaaguccgcccucuucagcucccugcugagcagccucccccaggacaagaucuucucccccagcgugaccuccgucaacaccaugaccacggcguucagcaccucccagaacggcagccugucccagagcuccgugagccagcccaccaccgagggggccccgcccugcggccugaacaaggagcaguccaaccuccugcccgacaacagccugaagguguucaacuucaacuccagcuccacgagccacuccagccucaagucccccagccacauggagaaguacccgcagaaggagaagaccaaggaggaccuggacagccgcuccaaccugcaccuccccgagaccaaguucagcgagcuguccaagcugaagaacgacgacauggagaaggccaaccacaucgagagcgucaucaaguccaaccuccccaacugcgccaacagcgacaccgacuucaugggccuguucaaguccagccgguacgaccccuccaucagcuucuccgggaugagccuguccgacacgaugacccuccgcggcagcgugcagaacaagcugaacccgcggcccgggaagguggucaucuacuccgagcccgacgugagcgagaagugcaucgagguguucuccgacauccaggacugcagcuccuggagccugagccccgucauccucaucaagguggugcgcggcugcuggauccuguacgagcagccgaacuucgaggggcacuccaucccccuggaggagggcgagcucgagcugagcggccugugggggaucgaggacauccucgagcggcacgaggaggccgaguccgacaagcccgucgugaucggcagcauccgccacgugguccaggacuaccgggugucccacaucgaccuguucaccgagcccgaggggcugggcauccucagcuccuacuucgacgacaccgaggagaugcagggguucggcgugaugcagaagacgugcagcaugaagguccacuggggcaccuggcugaucuacgaggagccgggguuccagggcgugcccuucauccuggagcccggggaguaccccgaccucuccuucugggacaccgaggaggcguacaucggcagcaugcgcccgcugaagaugggcgggcggaagguggaguuccccaccgaccccaaggucgugguguacgagaagcccuucuucgagggcaagugcgucgagcuggagacggggaugugcuccuucgugauggagggcggggagaccgaggaggccaccggcgacgaccaccucccguucaccagcgucggcuccaugaaggugcugcgcgggaucuggguggccuacgagaagcccggcuucacggggcaccaguaccugcucgaggagggcgaguaccgggacuggaaggccuggggcggguacaacggcgagcugcagagccugcgccccauccucggggacuucuccaacgcccacaugaucauguacagcgagaagaacuucggcuccaaggggagcuccaucgacguccugggcaucguggcgaaccugaaggagaccggguacggcgugaagacccagagcaucaacguccucagcggcguguggguggccuacgagaacccggacuucaccggggagcaguacauccuggacaagggcuucuacacguccuucgaggacuggggcgggaagaacugcaagaucagcuccguccagcccaucugccuggacagcuucaccgggccccggcgccggaaccagauccaccucuucuccgagccccaguuccagggccacagccaguccuucgaggagaccaccagccagaucgacgacuccuucagcacgaaguccugccgcgugagcggcggguccuggguggucuacgacggcgagaacuucaccgggaaccaguacgugcuggaggagggccacuacccgugccugagcgccaugggcugcccgcccggggccaccuucaagucccuccgguucaucgacguggaguucagcgagcccaccaucauccuguucgagcgcgaggacuucaagggcaagaagaucgagcugaacgccgagaccgucaaccuccggucccugggguucaacacgcagauccgcagcguccaggugaucggcgggaucugggucaccuacgaguacggcagcuaccggggccgccaguuccugcucuccccggcggaggugcccaacugguacgaguucagcgggugccgccagaucggcucccugcggcccuucgugcagaagcgcaucuacuuccggcugcgcaacaaggccaccggccuguucaugagcaccaacggcaaccuggaggaccugaagcuccugcggauccaggucauggaggacgugggggccgacgaccagaucuggaucuaccaggagggcugcaucaagugccgcaucgccgaggacugcugccugacgaucgugggcucccucgucaccagcggguccaagcugggccuggcccucgaccagaacgcggacagccaguucuggucccucaagagcgacgggcggaucuacuccaagcugaagcccaaccucgugcuggacaucaagggcgggacccaguacgaccagaaccacaucauccugaacaccgugagcaaggagaaguucacgcaggucugggaggccauggugcucuacaccuga

SEQ ID NO: 26492 - RNA, 1032 nt, Artificial Sequence
  derived and/or modified sequence opt1 from AIM2__Homo_sapiens__NP_004824
auggagagcaaguacaaggagauccugcuccugaccggccuggacaacaucaccgacgaggagcucgaccgcuucaaguucuuccuguccgacgaguucaacaucgccacggggaagcugcacaccgccaaccggauccagguggcgacccucaugauccagaacgccggcgccgucagcgccgugaugaagaccauccgcaucuuccagaagcugaacuacaugcugcucgccaagcggcugcaggaggagaaggagaagguggacaagcaguacaaguccgucacgaagcccaagccgcugagccaggcggagaugucccccgccgccagcgccgcgauccgcaacgacguggccaagcagcgggccgcccccaaggugagcccccacgucaagccggagcagaagcagaugguggcccagcaggaguccauccgcgagggguuccagaagcggugccuccccgugaugguccugaaggcgaagaagcccuucaccuucgagacccaggagggcaagcaggagauguuccacgccaccguggccacggagaaggaguucuucuucgugaaggucuucaacacccugcucaaggacaaguucauccccaagcgcaucaucaucaucgcccgguacuaccgccacuccggguuccuggaggugaacagcgccucccgggugcuggacgcggagagcgaccagaaggucaacgugccgcucaacaucauccgcaaggccggcgagacccccaagaucaacacccugcagacgcagccccugggcaccaucgugaacggccucuucgucgugcagaaggugaccgagaagaagaagaacauccuguucgaccuguccgacaacaccgggaagauggagguccucggggugcggaacgaggacacgaugaagugcaaggagggcgacaaggugcgccugaccuucuucacccugagcaagaacggggagaagcuccagcugaccuccggcguccacagcacgaucaaggugaucaaggccaagaagaagaccuga

SEQ ID NO: 26493 - RNA, 939 nt, Artificial Sequence
  derived and/or modified sequence opt1 from AIMP1__Homo_sapiens__NP_001135887
auggccaacaacgacgccgugcugaagcgccucgagcagaagggcgcggaggccgaccagaucaucgaguaccugaagcagcaggucagccugcucaaggagaaggccauccugcaggccacccugcgggaggagaagaagcuccgcguggagaacgccaagcugaagaaggagaucgaggagcugaagcaggagcucauccaggcggagauccagaacggggugaagcagauccccuucccguccggcacgccccugcacgccaacagcauggucuccgagaacgugauccagagcaccgccgugaccaccgucuccagcgggaccaaggagcagaucaagggcgggacgggcgacgagaagaaggccaaggagaagaucgagaagaagggcgagaagaaggagaagaagcagcaguccaucgcggggagcgccgacuccaagcccaucgacgugagccggcuggaccuccgcaucggcugcaucaucaccgcccggaagcaccccgacgccgacucccuguacguggaggaggucgacgugggggagaucgccccgcgcaccguggucagcggccuggugaaccacgugccccucgagcagaugcagaaccggauggucauccugcugugcaaccucaagcccgcgaagaugcgcggggugcugucccaggccauggugaugugcgccagcucccccgagaagaucgagauccuggccccgcccaacggcagcguccccggcgaccggaucaccuucgacgccuuccccggggagccggacaaggagcucaaccccaagaagaagaucugggagcagauccagcccgaccugcacacgaacgacgagugcguggcgaccuacaagggcgugcccuucgaggucaaggggaagggcgugugccgcgcccagaccauguccaacagcggcaucaaguga

SEQ ID NO: 26494 - RNA, 963 nt, Artificial Sequence
  derived and/or modified sequence opt1 from AIMP2__Homo_sapiens__NP_006294
augcccauguaccaggugaagccguaccacggcgggggcgcgccccugcgcgucgagcucccgaccugcauguaccggcugcccaacgugcacgggcgcagcuacggccccgcccccggggccggccacgugcaggaggaguccaaccugagccuccaggcccuggagucccggcaggacgacauccugaagcgccucuacgagcugaaggccgccgucgacggccugagcaagaugauccagacccccgacgccgaccucgacgugacgaacaucauccaggcggacgagcccaccacccugaccacgaacgcccuggaccucaacuccgugcuggggaaggacuacggcgcccugaaggacaucgucaucaacgccaacccggcgagcccgccccucucccugcuggugcuccaccggcugcugugcgagcacuuccgcgugcucagcaccguccacacccacuccagcgugaaguccgugcccgagaaccugcugaagugcuucggggagcagaacaagaagcagccccggcaggacuaccagcucggcuucacccugaucuggaagaacguccccaagacgcagaugaaguucagcauccagaccaugugccccaucgagggggagggcaacaucgcccgcuuccuguucucccucuucggccagaagcacaacgccgugaacgccacccugaucgacagcuggguggacaucgccaucuuccagcugaaggagggguccagcaaggagaaggcggccgucuuccgguccaugaacagcgcccucggcaagucccccuggcuggccgggaacgagcugaccguggccgacgugguccucuggagcgugcugcagcagaucggcggcugcagcgugacggucccggcgaacgugcagcgcuggaugcgguccugcgagaaccuggcccccuucaacaccgcccucaagcugcugaaguga

SEQ ID NO: 26495 - RNA, 993 nt, Artificial Sequence
  derived and/or modified sequence opt1 from AIP__Homo_sapiens__NP_003968
auggccgacaucaucgcccgccugcgggaggacggcauccagaagcgcgugauccaggaggggcggggcgagcuccccgacuuccaggacgggaccaaggcgaccuuccacuaccgcacccugcacagcgacgacgagggcaccguccuggacgacucccgggcccgcgggaagccgauggagcucaucaucggcaagaaguucaagcugcccgugugggagaccaucgugugcaccaugcgggagggcgagaucgcccaguuccugugcgacaucaagcacgucgugcucuacccccugguggccaagagccugcgcaacaucgccgucgggaaggacccccucgagggccagcggcacugcugcgggguggcgcagaugcgcgagcacuccagccugggccacgccgaccuggacgcccuccagcagaacccgcagccccugaucuuccacauggagaugcugaagguggagucccccgggacguaccagcaggaccccugggccaugaccgacgaggagaaggcgaaggccgucccgcucauccaccaggagggcaaccggcuguaccgcgagggccacgugaaggaggccgccgccaaguacuacgacgcgaucgccugccugaagaaccuccagaugaaggagcagcccgggagccccgaguggauccagcuggaccagcagaucacgccccugcuccugaacuacugccagugcaagcugguggucgaggaguacuacgaggugcucgaccacugcuccagcauccugaacaaguacgacgacaacgugaaggccuacuucaagcggggcaaggcccacgccgcggucuggaacgcccaggaggcccaggccgacuucgccaaggugcuggagcucgacccggcgcuggcccccguggucucccgcgagcugcgggcccucgaggcccgcauccggcagaaggacgaggaggacaaggcccgcuuccgggggaucuucagccacuga

SEQ ID NO: 26496 - RNA, 966 nt, Artificial Sequence
  derived and/or modified sequence opt1 from AIPL1__Homo_sapiens__NP_001028226
auggacgccgcccugcuccugaacguggagggcgucaagaagaccauccugcacgggggcaccggggagcuccccaacuucaucacgggcagccgcgugaucuuccacuuccggaccaugaagugcgacgaggagcgcaccgugaucgacgacucccggcaggucgggcagccgaugcacaucaucaucggcaacauguucaagcuggaggugugggagauccugcucaccagcaugcgcgugcacgaggucgcggaguucuggugcgacacgaucguggacgcccccuccgacuaccagcgggagaccuggaaccugagcaaccacgagaagaugaaggccgugcccguccugcacggcgaggggaaccgccucuucaagcugggccgguacgaggaggccuccagcaaguaccaggaggccaucaucugccugcgcaaccuccagaccaaggagaagcccugggaggugcaguggcugaagcuggagaagaugaucaacacccucauccugaacuacugccagugccugcucaagaaggaggaguacuacgaggugcuggagcacacguccgacauccugcggcaccacccggggaucgucaaggcguacuacgugcgcgcccgggcccacgccgagguguggaacgaggcggaggccaaggccgaccuccagaagguccuggagcuggagcccagcaugcagaaggccgugcgccgggagcuccgccugcuggagaaccggauggccgagaagcaggaggaggagcgccuccggugccgcaacaugcugucccagggcgcgacccagccccccgccgagccgcccaccgagccccccgcccagagcuccaccgagccgcccgccgagccccccacggccccgagcgcggagcuguccgccgggccccccgccgagcccgccaccgagccgccccccagccccggccacucccuccagcacuga

SEQ ID NO: 26497 - RNA, 1638 nt, Artificial Sequence
  derived and/or modified sequence opt1 from AIRE__Homo_sapiens__NP_000374
auggccaccgacgccgcgcugcgccggcuccugcgccugcaccggaccgagaucgccguggccgucgacagcgccuucccccuccugcacgcccuggcggaccacgacguggugccggaggacaaguuccaggagacgcuccaccugaaggagaaggagggcugcccccaggccuuccacgcccugcucuccuggcugcugacccaggacagcaccgccauccucgacuucuggcgcguccuguucaaggacuacaaccuggagcgguacgggcgccuccagcccauccuggacuccuuccccaaggacguggaccugagccagccgcggaagggccgcaagccgcccgcggugcccaaggcccucgugcccccgccccggcugcccaccaagcgcaaggccuccgaggaggcccgggccgcggcccccgccgcccugacgccccgcgggaccgccagccccggcucccagcucaaggcgaagcccccgaagaagcccgagagcuccgccgagcagcagcggcugccccuggggaacggcauccagaccaugagcgccuccguccagcgcgccguggccaugagcuccggcgacguccccggggcgcggggcgccguggaggggauccucauccagcaggucuucgagagcggcggguccaagaagugcauccaggugggcggcgaguucuacaccccgagcaaguucgaggacuccgggagcggcaagaacaaggcccgcuccagcagcgggcccaagccccuggugcgggccaagggcgcccagggcgcggcccccgggggcggggaggcccgccugggccagcagggguccgugccggcgccccucgcccugcccagcgacccccagcugcaccagaagaacgaggacgagugcgccgucugccgggacggcggcgagcucaucugcugcgacgggugcccgcgcgccuuccaccuggccugccuguccccgccccuccgggagauccccagcggcacguggcgcugcuccagcugccugcaggccaccgugcaggaggugcagccccgcgcggaggagccccggccccaggagccgcccgucgagacgccccugcccccggggcuccgcuccgccggcgaggaggugcgggggccgcccggcgagccccuggccggcauggacaccacccugguguacaagcaccuccccgccccgcccagcgccgcgccccugcccgggcuggacuccagcgcccuccacccccugcugugcgucggccccgaggggcagcagaaccucgcccccggcgcccgcugcggggugugcggcgacggcaccgacgugcugcggugcacccacugcgccgcggccuuccacuggcgcugccacuucccggccgggaccucccggcccggcacggggcugcgcugccggagcugcuccggcgacgucacccccgcccccguggagggcguccucgcgccgagccccgcccgccuggcccccgggccggccaaggacgacaccgccucccacgagcccgcgcugcaccgggacgaccuggagagccuccuguccgagcacaccuucgacggcauccugcagugggccauccagagcauggcccgccccgccgcccccuucccguccuga

SEQ ID NO: 26498 - RNA, 1236 nt, Artificial Sequence
  derived and/or modified sequence opt1 from AJAP1__Homo_sapiens__XP_011540088
auguggauccagcagcugcucggccugagcuccaugagcauccgcuggcccgggcggccgcugggcucccacgccuggauccucaucgccauguuccagcuggcgguggaccugcccgccugcgaggcccucgggcccggccccgaguucuggcugcugccgcgcagcccgccccggccgccccgccucugguccuuccggagcgggcagcccgcccgcguccccgcccccgugugguccccgcggccgccccgcguggagcggauccacggccagaugcagaugccccgcgcgcggcgcgcccaccggccccgcgaccaggccgccgcgcugguccccaaggccggccuggccaagccgcccgccgccgccaagagcucccccagccucgcguccagcuccagcuccagcuccagcgccguggccgggggcgcccccgagcagcaggcgcugcugcggcgcgggaagcggcaccuccagggcgacgggcuguccagcuucgacagccgcggcucccggcccaccaccgagacggaguucaucgccuggggccccaccggggacgaggaggcccuggagagcaacaccuuccccggcguguacgggcccaccacggucuccauccuccagacccgcaagaccaccguggccgccacgaccaccaccacgaccaccgcgacccccaugacgcugcagaccaagggcuucaccgagagccuggacccccggcgccgcaucccgggcgggguguccaccacggagcccagcaccucccccagcaacaacggcgaggucacccagccgccccggauccucggggaggccuccggccuggccgugcaccagaucaucaccaucacggugagccugaucauggucaucgccgcccucaucaccacccuggugcugaagaacugcugcgcgcaguccgggaacacccgccggaacagccaccagcgcaagacgaaccagcaggaggaguccugccagaaccucaccgacuuccccagcgcccgggugcccuccagccuggacaucuucaccgccuacaacgagacccugcagugcucccacgagugcguccgcgccagcgugccgguguacacggacgagacccuccacuccaccaccggcgaguacaagagcacguucaacggcaaccggcccagcuccagcgaccgccaccugauccccgucgcguucguguccgagaagugguucgagaucagcugcuga

SEQ ID NO: 26499 - RNA, 1617 nt, Artificial Sequence
  derived and/or modified sequence opt1 from AJUBA__Homo_sapiens__NP_116265
auggagcgccugggcgagaaggccagccggcuccuggagaaguucgggcgccggaagggcgaguccagccgcuccgggagcgacggcacccccgggcccggcaagggccggcuguccgggcucggcgggccccgcaagagcggcccccgcggggccaccggcggccccggggacgagccgcuggagcccgcgcgggagcagggcucccuggacgccgagcggaaccagcgcgggagcuucgaggcgccccgguacgagggcuccuuccccgccggcccgccgcccacgcgcgcccucccccugccccagagccugccgcccgacuuccggcucgagcccaccgcccccgcccugagcccccgcagcuccuucgccagcuccagcgccuccgacgcgagcaagcccuccagcccccgggggagccugcuccuggacggcgccggggccggcggggccggcggcucccgcccgugcagcaaccggaccuccgggaucagcaugggcuacgaccagcgccacgggagcccccugcccgccggccccugccucuucgggccgccccuggcgggcgcccccgccggcuacucccccgggggcgugccguccgccuaccccgagcugcacgccgcgcucgaccggcuguacgcccagcgccccgccggguucggcugccaggagagccggcacuccuacccgcccgcccuggggagccccggcgcccucgcgggcgccggggucggcgccgccgggccccuggagcgccgcggcgcccagccgggccggcacuccgugaccggguacggcgacugcgcggugggggcccgcuaccaggacgagcugacggcccuccugcggcugaccgucggcaccgggggccgcgaggccggcgcgcgcggggagcccagcggcaucgagcccuccgggcucgaggagcccccgggccccuucgugcccgaggccgcccgggcccggaugcgcgagcccgaggcccgggaggacuacuucgggaccugcaucaagugcaacaagggcaucuacggccagagcaacgcgugccaggcccuggacucccuguaccacacgcagugcuucgugugcugcagcugcgggcgcacccuccggugcaaggccuucuacuccgucaacggcagcguguacugcgaggaggacuaccuguucuccggguuccaggaggccgccgagaagugcugcgugugcggccaccugauccucgagaagauccugcaggcgauggggaaguccuaccacccgggcugcuuccgcugcaucgucugcaacaagugccuggacggcauccccuucaccguggacuucagcaaccagguguacugcgucaccgacuaccacaagaacuacgcccccaagugcgccgccugcgggcagcccauccucccguccgagggcugcgaggacaucgugcgggugaucagcauggaccgcgacuaccacuucgagugcuaccacugcgaggacugccggaugcagcuguccgacgaggaggggugcugcugcuucccccuggacggccaccuccugugccacgggugccacaugcagcgccugaacgcccggcagccgcccgcgaacuacaucuga

SEQ ID NO: 26500 - RNA, 585 nt, Artificial Sequence
  derived and/or modified sequence opt1 from AK1__Homo_sapiens__NP_000467
auggaggagaagcugaagaagaccaagaucaucuucguggucggcgggcccggcagcgggaagggcacccagugcgagaagaucgugcagaaguacggguacacgcaccucuccaccggcgaccugcugcgcagcgagguguccagcggcuccgcccgggggaagaagcucagcgagaucauggagaagggccagcuggucccgcuggagaccgugcucgacaugcugcgcgacgccaugguggcgaaggucaacaccuccaagggguuccugaucgacggcuacccccgggaggugcagcagggggaggaguucgagcgccggaucggccagcccacgcuccugcuguacguggacgccggccccgagaccaugacccagcgccuccugaagcgcggggagaccagcggccgggucgacgacaacgaggagacgaucaagaagcggcuggagaccuacuacaaggccaccgagccggugaucgccuucuacgagaagcgcgggaucgugcggaaggucaacgccgagggcuccguggacagcguguucucccaggucugcacccaccucgacgcgcugaaguga

SEQ ID NO: 26501 - RNA, 564 nt, Artificial Sequence
  derived and/or modified sequence opt1 from AK3__Homo_sapiens__NP_001186781
augggcgccagcgcccgccugcuccgggcggugaucaugggggcccccggcuccgggaagggcaccgucagcucccgcaucaccacgcacuucgagcugaagcaccugagcuccggggaccuccugcgggacaacaugcugcgcggcaccggcuucccgcggacccucccccaggccgaggcccuggaccgcgccuaccagaucgacaccgugaucaaccugaacgugcccuucgaggucaucaagcagcggcucacggcgcgcuggauccaccccgccagcgggcggguguacaacaucgaguucaacccgcccaagaccgugggcaucgacgaccugaccggggagccccugauccagcgcgaggacgacaagcccgagaccgucaucaagcggcucaaggccuacgaggaccagacgaagccggugcuggaguacuaccagaagaagggcgugcuggagaccuucuccgggaccgagaccaacaagaucuggcccuacgucuacgccuuccuccagacgaaggugccccagcgcagccagaaggcguccgugacccccuga

SEQ ID NO: 26502 - RNA, 510 nt, Artificial Sequence
  derived and/or modified sequence opt1 from AK6__Homo_sapiens__NP_001015891
augugccaccgcaagcccggcaccccgggggugggcaagaccacgcuggggaaggagcucgccagcaaguccggccugaaguacaucaacgucggggaccuggcccgggaggagcagcucuacgacggcuacgacgaggaguacgacugccccauccuggacgaggaccgcgugguggacgagcuggacaaccagaugcgggagggcggggucaucguggacuaccacggcugcgacuucuuccccgagcgcugguuccacaucguguucguccuccggaccgacaccaacgugcuguacgagcgccuggagacccggggguacaacgagaagaagcucacggacaacauccagugcgagaucuuccaggugcuguacgaggaggcgaccgccagcuacaaggaggagaucguccaccagcugcccuccaacaagccggaggagcucgagaacaacguggaccagauccugaaguggaucgagcaguggaucaaggaccacaacagcuga

SEQ ID NO: 26503 - RNA, 2172 nt, Artificial Sequence
  derived and/or modified sequence opt1 from AK7__Homo_sapiens__NP_689540
auggccgaggaggaggagaccgccgcgcugaccgagaaggugauccgcacgcagcgggucuucaucaaccuccuggacagcuacuccagcggcaacaucgggaaguuccuguccaacugcguggugggcgccagccucgaggagaucaccgaggaggaggaggaggaggacgagaacaaguccgccaugcuggaggccagcuccaccaaggucaaggaggggaccuuccagaucgugggcacgcugagcaagcccgacuccccgcgccccgacuucgccguggagaccuacagcgcgaucucccgggaggaccuccugaugcgccugcucgagugcgacgucaucaucuacaacaucaccgagagcucccagcagauggaggaggccaucugggccgugagcgcccuguccgaggaggugagccacuucgagaagcggaagcuguucauccuccuguccaccgucaugacgugggcgcgcagcaaggcccuggaccccgaggacuccgaggugcccuucaccgaggaggacuaccggcgccgcaagagccacccgaacuuccucgaccacaucaacgccgagaagauggugcugaaguucgggaagaaggcccggaaguucgccgcguacgucguggccgccggccugcaguacggcgccgagggcgggaugcuccacaccuucuucaagauggccuggcugggggagauccccgcgcugcccguguucggcgacgggaccaacgucauccccacgauccacgugcucgaccuggccggcgugauccagaacgucaucgaccacgugccgaagccccacuaccugguggccgucgacgagagcgugcacacccucgaggacaucgugaagugcaucuccaagaacaccggccccgggaagauccagaagaucccccgggagaacgccuaccugaccaaggaccugacgcaggacugccucgaccaccuccuggucaaccugcgcauggaggcccuguucgugaaggagaacuucaacauccggugggcggcccagaccggcuucgucgagaacaucaacaccauccugaaggaguacaagcagagccgcgggcucaugccgaucaagaucugcauccugggcccgcccgccgugggcaaguccagcaucgccaaggagcuggccaacuacuacaagcuccaccacauccagcugaaggacgugaucuccgaggcgaucgccaagcuggaggccaucgucgcccccaacgacgugggggagggcgaggaggagguggaggaggaggaggaggaggagaacgucgaggacgcgcaggagcuccuggacgggaucaaggagagcauggagcagaacgccggccagcuggacgaccaguacaucauccgguucaugaaggagaagcucaaguccaugcccugccgcaaccagggguacauccuggacggcuuccccaagaccuacgaccaggccaaggaccuguucaaccaggaggacgaggaggaggaggacgacgugcggggccgcauguuccccuucgacaagcucaucauccccgaguucgugugcgcccuggacgccagcgacgaguuccugaaggagcgggucaucaaccucccggaguccaucguggcggggacgcacuacagccaggaccgcuuccugcgggcccuguccaacuaccgcgacaucaacaucgacgacgagaccguguucaacuacuucgacgagcuggagauccaccccauccacaucgacgucggcaagcucgaggacgcccagaaccgccuggccaucaagcagcugaucaaggagaucggggagccccggaacuacggccucaccgacgaggagaaggccgaggaggagcgcaaggcggccgaggagcggcuggcccgcgaggccgccgaggaggcggagcgggagcaccaggaggccguggagauggccgagaagaucgcccgcugggaggaguggaacaagcggcuggaggaggugaagcgcgaggagcgggagcuccuggaggcgcagagcaucccccugcgcaacuaccucaugaccuacgucaugccgacgcugauccaggggcugaacgagugcugcaacgugcggcccgaggaccccguggacuuccucgccgaguaccuguucaagaacaaccccgaggcccaguga

SEQ ID NO: 26504 - RNA, 1440 nt, Artificial Sequence
  derived and/or modified sequence opt1 from AK8__Homo_sapiens__NP_689785
auggacgccaccaucgcgccccaccgcaucccgcccgagaugccccaguacggcgaggagaaccacaucuucgagcugaugcagaacaugcucgagcagcugcugauccaccagcccgaggacccgauccccuucaugauccagcaccuccaccgggacaacgacaacgugccccgcaucgucauccuggggcccccggccagcggcaagaccacgaucgccauguggcugugcaagcaccucaacuccagccugcugacccucgagaaccugauccugaacgaguucuccuacaccgccaccgaggcccggcgccucuaccugcagcggaagacggugcccagcgcccugcucgugcagcugauccaggagcgccuggcggaggaggacugcaucaagcagggguggauccucgacggcauccccgagacccgggagcaggcccugcgcauccagacccuggggaucacgccccggcacgucaucgugcucuccgccccggacaccgugcugaucgagcgcaaccugggcaagcggaucgacccccagaccggcgagaucuaccacaccaccuucgacuggccgcccgagagcgagauccagaaccgccucaugguccccgaggacaucuccgagcuggagacggcccagaagcugcucgaguaccaccggaacaucgugcgcgugauccccagcuaccccaagauccugaaggucaucuccgcggaccagcccugcguggacguguucuaccaggcccugaccuacguccagagcaaccaccggaccaacgccccguucacgccccgcgugcuccugcuggggcccgugggcuccggcaagagccuccaggccgcccugcuggcgcagaaguaccggcucgucaacgugugcugcgggcagcugcugaaggaggccguggccgaccgcaccaccuucggggagcucauccagcccuucuucgagaaggagauggccgucccggacucccugcugaugaaggugcucagccagcggcuggaccagcaggacugcauccagaagggcugggugcugcacggcgucccccgcgaccucgaccaggcccaccuccugaaccggcugggguacaaccccaaccgcguguucuuccugaacgugcccuucgacuccaucauggagcgccugacccugcggcgcaucgacccggucaccggcgagcgguaccaccucauguacaagcccccgcccacgauggagauccaggcgcgccugcugcagaaccccaaggacgccgaggagcaggucaagcucaagauggaccuguucuaccggaacagcgccgaccuggagcagcucuacggguccgccaucacccugaacggcgaccaggaccccuacaccguguucgaguacaucgagagcggcaucaucaacccccugccgaagaagauccccuga

SEQ ID NO: 26505 - RNA, 1266 nt, Artificial Sequence
  derived and/or modified sequence opt1 from AK9__Homo_sapiens__NP_659462
augaccagccaggagaagaccgaggaguaccccuucgccgacaucuucgacgaggacgagacggagcgcaacuuccugcucuccaagcccgugugcuucgucguguucggcaagcccggggugggcaagaccacccuggcccgguacaucacccaggcguggaagugcauccgcgucgaggcccugcccauccucgaggagcagaucgccgccgagacggagagcggggugaugcugcaguccaugcugaucagcggccaguccauccccgacgagcucgugaucaagcugaugcuggagaagcucaacagcccggaggucugccacuucggguacaucaucaccgagauccccucccugagccaggacgccaugaccacccugcagcagaucgagcucaucaagaaccugaaccugaagcccgacgugaucaucaacaucaagugccccgacuacgaccucugccagcggaucuccggccagcgccagcacaacaacacgggcuacaucuacagccgggaccagugggacccggaggugaucgagaaccaccgcaagaagaagaaggaggcgcagaaggacgggaagggcgaggaggaggaggaggaggaggagcaggaggaggaggaggccuucaucgccgagaugcagauggucgccgagauccugcaccaccuggugcagcggcccgaggacuaccucgagaacguggagaacaucgucaagcuguacaaggagaccauccugcagacccucgaggaggugauggcggagcacaacccccaguaccugaucgagcugaacgggaacaagcccgccgaggagcuguucaugaucgugauggaccgccucaaguaccugaaccucaagcgggccgccauccugaccaagcugcagggcgccgaggaggagaucaacgacacgauggagaacgacgagcuguuccgcacccucgcguccuacaagcugaucgccccgcgguaccgcuggcagcggagcaagugggggcggaccugccccgucaaccucaaggacggcaacaucuacuccggccugcccgacuacagcguguccuuccuggggaagaucuacugccucagcuccgaggaggcccugaagcccuuccugcucaacccgcgccccuaccugcugccgcccaugcccggcccgcccugcaagguguucauccucgggccccaguacagcggcaagaccacgcugugcaacaugcuggccgagaacuacaagggcaaggucaccaacuga

SEQ ID NO: 26506 - RNA, 1989 nt, Artificial Sequence
  derived and/or modified sequence opt1 from AKAP10__Homo_sapiens__NP_009133
augcgcggcgccgggcccagcccgcggcagagcccccgcacccugcggcccgaccccggcccggccaugagcuucuuccgccggaaggugaaggggaaggagcaggagaagaccuccgacgucaagagcaucaaggcguccaucagcgugcacagcccccagaaguccacgaagaaccacgcccuccuggaggccgccggccccucccacguggccaucaacgcgaucagcgccaacauggacuccuucagcuccagccgcaccgccacccugaagaagcagcccucccacauggaggccgcgcacuucggggaccucggccggagcugccuggacuaccagacccaggagacgaaguccagccuguccaagacccucgagcagguccugcacgacaccaucgugcugccguacuucauccaguucauggagcuccgccggauggagcaccuggugaaguucuggcuggaggccgagagcuuccacagcaccacguggucccgcauccgggcccacagccucaacaccgucaagcaguccagccuggccgagcccgugucccccagcaagaagcacgagaccaccgccuccuuccugacggacagccucgacaagcgccuggaggacuccggcagcgcgcagcuguucaugacccacuccgaggggaucgaccucaacaaccggaccaacagcacccagaaccaccuccugcugucccaggagugcgacagcgcccacucccugcgccuggagauggcccgggccggcacgcaccaggugagcauggagacccaggaguccagcuccacccucaccgucgccagccgcaacagccccgcguccccgcugaaggagcugagcgggaagcucaugaaguccaucgagcaggacgccgugaacacguucaccaaguacaucagccccgacgccgccaagcccauccccaucaccgaggccaugcggaacgacaucaucgcgcgcaucugcggcgaggacggccagguggacccgaacugcuucguccuggcccaguccaucguguucagcgccauggagcaggagcacuucuccgaguuccugcggagccaccacuucugcaaguaccagaucgaggugcucaccuccgggacggucuaccuggccgacauccuguucugcgagagcgcccucuucuacuucuccgaguacauggagaaggaggacgcggugaacauccugcaguucuggcuggccgccgacaacuuccagagccagcucgccgcgaagaagggccaguacgacgggcaggaggcccagaacgacgccaugauccuguacgacaaguacuucucccugcaggccacccacccccucggcuucgacgacgugguccgccuggagaucgagagcaacaucugccgggagggcgggccccugcccaacugcuucaccaccccgcuccgccaggccuggacgaccauggagaagguguuccugcccggcuuccuguccagcaaccucuacuacaaguaccugaacgaccugauccacuccgugcgcggggacgaguuccucggcgggaacgucagccugaccgcgcccggcagcguggggcccccggacgagucccaccccggcagcuccgacagcuccgccagccaguccagcgugaagaaggccuccaucaagauccugaagaacuucgacgaggccaucaucgucgacgccgcgagccuggaccccgagucccucuaccagcggaccuacgccggcaagaugacguucgggcgcgugagcgaccugggccaguucauccgggaguccgagcccgagccggacguccgcaagagcaagggguccauguucagccaggccaugaagaagugggugcagggcaacaccgacgaggcccaggaggagcuggccuggaagaucgcgaagaugaucguguccgacaucaugcagcaggcccaguacgaccagccccucgagaaguccaccaagcuguga

SEQ ID NO: 26507 - RNA, 5349 nt, Artificial Sequence
  derived and/or modified sequence opt1 from AKAP12__Homo_sapiens__NP_005091
augggcgccgggagcagcaccgagcagcgcagccccgagcagccgcccgagggcagcagcacccccgccgagcccgagcccagcgggggcgggcccagcgccgaggccgcccccgacaccaccgccgaccccgccaucgcggccagcgaccccgccaccaagcuccuccagaagaacggccagcugagcaccaucaacggcguggccgagcaggacgagcugagccuccaggagggggaccugaacggccagaagggggcgcugaacggccagggggcccucaacagccaggaggaggaggaggugaucgugaccgaggugggccagcgggacagcgaggacgugagcaagcgcgacagcgacaaggagauggccaccaagagcgccguggugcacgacaucaccgacgacggccaggaggagacccccgagaucaucgagcagauccccuccagcgaguccaaccuggaggagcugacccagcccaccgagagccaggccaacgacaucggguucaagaagguguucaaguucgugggcuucaaguucaccgugaagaaggacaagaccgagaagcccgacacgguccagcuccugaccgugaagaaggacgagggggagggcgcggccggcgccggggaccacaaggaccccucccugggcgccggggaggccgcgagcaaggagagcgagcccaagcaguccaccgagaagcccgaggagacccucaagcgggagcagagccacgccgagaucuccccgcccgccgagagcggccaggccguggaggagugcaaggaggagggggaggagaagcaggagaaggagcccuccaagagcgccgagucccccacgagcccggucaccuccgagaccggcagcaccuucaagaaguucuucacgcagggcugggcgggguggcgcaagaagaccuccuuccggaagcccaaggaggacgagguggaggccagcgagaagaagaaggagcaggagcccgagaagguggacaccgaggaggacggcaaggccgaggucgccuccgagaagcugaccgccagcgagcaggcgcacccccaggagccggccgaguccgcccacgagccccgccugagcgccgaguacgagaagguggagcuccccuccgaggagcaggucagcgggucccagggccccagcgaggagaagccggcgccccuggccacggaggucuucgacgagaagaucgaggugcaccaggaggagguggucgccgaggugcacgugagcaccgucgaggagcggaccgaggagcagaagaccgagguggaggagacggccggguccguccccgccgaggagcugguggagauggacgcggagccgcaggaggccgagcccgccaaggagcucgugaagcugaaggagaccugcgucagcggcgaggaccccacccagggcgccgaccugucccccgacgagaaggugcucagcaagccgcccgaggggguggucuccgagguggagaugcugagcucccaggagcgcaugaaggugcagggcagcccccugaagaagcuguucaccuccacggggcugaagaagcugagcggcaagaagcagaaggggaagcggggcggcggggacgaggaguccggcgagcacacccagguccccgccgacagcccggacucccaggaggagcagaagggggagagcuccgcgagcucccccgaggagcccgaggagaucacgugccucgagaagggccuggccgaggugcagcaggacggcgaggccgaggagggggccaccagcgacggcgagaagaagcgcgagggggugacgcccugggccagcuucaagaagauggucaccccgaagaagcgggugcgccggcccuccgagagcgacaaggaggacgagcuggacaaggugaaguccgcgacccucagcuccaccgagagcaccgccuccgagaugcaggaggagaugaagggcagcgucgaggagcccaagcccgaggagccgaagcgcaagguggacacguccgugagcugggaggcccugaucugcgucggguccagcaagaagcgggcccgccggggcuccagcuccgacgaggagggcgggcccaaggcgaugggcggggaccaccagaaggccgacgaggccggcaaggacaaggagaccgggaccgacggcauccuggccggcagccaggagcacgaccccgggcagggcuccagcucccccgagcaggccgggagcccgaccgagggcgagggggugagcacgugggaguccuucaagcgccucgugacgccccggaagaaguccaaguccaagcuggaggagaaguccgaggacuccaucgcgggcagcggcgucgagcacuccacccccgacaccgagcccgggaaggaggagagcuggguguccaucaagaaguucaucccgggccgccggaagaagcgccccgacgggaagcaggagcaggcccccguggaggacgccggcccgacgggggccaacgaggacgacagcgacguccccgccguggugccccuguccgaguacgacgcggucgagcgcgagaagauggaggcccagcaggcccagaaguccgccgagcagcccgagcagaaggccgcgaccgagguguccaaggagcucagcgagucccaggugcacaugauggccgccgccgucgcggacggcacccgggccgccaccaucaucgaggagcgcagcccguccuggaucagcgccuccgugacggagccccuggagcaggucgaggccgaggcggcccugcucaccgaggagguccuggagcgggaggugaucgccgaggaggagccgcccaccgugaccgagccgcugcccgagaaccgcgaggcccggggcgacacggucgugagcgaggccgagcucacccccgaggcggugaccgccgccgagaccgccgggccccugggcgccgaggaggggacggaggcgagcgccgccgaggagaccaccgagauggucuccgccgugagccagcugaccgacuccccggacacgaccgaggaggccacccccgugcaggaggucgagggcggcgugcccgacaucgaggagcaggagcgccggacccaggaggugcuccaggcggucgccgagaaggugaaggaggagagccagcugcccgggacgggcgggccggaggacgugcugcagcccguccagcgcgccgaggccgagcggcccgaggagcaggcggaggccuccggccucaagaaggagaccgacguggugcugaaggucgacgcccaggaggccaagaccgagcccuucacccaggggaagguggucggccagacgaccccggagagcuucgagaaggcgccccaggugaccgaguccaucgagagcuccgagcuggugaccacgugccaggcggagacccuggccggcgucaagagccaggagauggugauggagcaggccaucccgcccgacuccguggagaccccgaccgacagcgagaccgacggguccacgcccgucgccgacuucgacgcccccggcaccacccagaaggacgagaucguggagauccacgaggagaacgagguggcgagcgggacccaguccggcgggacggaggccgaggccguccccgcccagaaggagcgcccgcccgcccccagcuccuucguguuccaggaggagaccaaggagcagagcaagauggaggacacccucgagcacaccgacaaggagguguccgucgagacggugagcauccugagcaagaccgagggcacccaggaggcggaccaguacgccgacgagaagaccaaggacgugccguucuucgagggccuggagggguccaucgacacgggcaucaccgucagccgggagaaggugaccgagguggcccucaagggggagggcaccgaggaggccgagugcaagaaggacgacgcgcuggagcugcagucccacgccaaguccccgcccucccccgucgagcgcgagaugguggugcaggucgagcgggagaagacggaggccgagccgacccacgugaacgaggagaagcucgagcacgagaccgccgugaccgucagcgaggagguguccaagcagcugcugcagacggugaacguccccaucaucgacggggccaaggaggugagcucccucgagggcuccccgccgcccugccugggccaggaggaggcggugugcaccaagauccagguccaguccagcgaggccuccuucacccugaccgccgccgccgaggaggagaaggugcucggggagacggcgaacauccuggagaccggcgagacccuggagcccgccggggcccaccucgugcuggaggagaaguccuccgagaagaacgaggacuucgccgcccaccccggcgaggacgcgguccccaccggccccgacugccaggccaagagcacgcccgugaucguguccgccaccaccaagaaggggcugagcuccgaccucgagggcgagaagaccacgagccugaaguggaaguccgacgaggucgacgagcaggucgccugccaggaggugaaggucuccguggcgaucgaggaccuggagcccgagaacgggauccucgagcuggagaccaagagcuccaagcuggugcagaacaucauccagaccgccgucgaccaguucgugcgcaccgaggagacggccaccgagaugcucaccagcgagcugcagacccaggcccacgugaucaaggccgacucccaggacgcgggccaggagaccgagaaggagggggaggagccccaggccagcgcccaggacgagacgccgaucaccuccgccaaggaggagagcgaguccaccgccgucggccaggcgcacagcgacaucuccaaggacaugagcgaggccuccgagaagaccaugacgguggagguggagggcagcaccgucaacgaccagcagcuggaggagguggugcuccccuccgaggaggagggcggcggggccgggaccaagagcguccccgaggacgacgggcacgcccugcuggccgagcggaucgagaagucccucguggagcccaaggaggacgagaagggcgacgacgucgacgacccggagaaccagaacagcgcgcuggccgacaccgacgccuccggcgggcugacgaaggagagccccgacaccaacggccccaagcagaaggagaaggaggacgcccaggagguggagcuccaggaggggaaggugcacagcgaguccgacaaggccaucacgccccaggcgcaggaggagcugcagaagcaggagcgcgagagcgccaaguccgagcugaccgagagcuga

SEQ ID NO: 26508 - RNA, 4305 nt, Artificial Sequence
  derived and/or modified sequence opt1 from AKAP13__Homo_sapiens__NP_001257475
auguacgagcgccacaagcggcgcuacagccugugcgacaucuccaagguggaccggaccgucgacguggugcuccugaagaucaaccgcgagaacuggugcaccaucgagcccugcccggacgccgccagccugcucgcguccaagcagagccccgagugcgagaacuuccuggacgucggccuggggcgggagugcacguccaagcagggcgugcucaagcgcgagagcggguccgacagcgaccuguuccacucccccagcgacgacauggacuccaucaucuuccccaagccggaggaggagcaccuggccugcgacaucaccggcagcuccagcuccaccgacgacaccgccagccucgaccggcacuccagccacggguccgacgugagccugagccagauccugaagcccaaccgcucccgggaccgccagagccucgacggcuucuacucccacggcaugggggccgagggccgggagagcgaguccgagcccgccgaccccggggacgucgaggaggaggagauggacagcaucacggaggugccggcgaacugcuccgugcugcgcagcuccaugcggagccugucccccuuccgccggcacagcuggggccccgggaagaacgccgccuccgacgccgagaugaaccaccgcagcuucucccucgagggccugaccggcggggcgggcgucgggaacaagcccagcuccagccuggagguguccagcgccaacgccgaggagcuccggcacccguucagcggcgaggagcgcguggacucccuggucagccuguccgaggaggaccucgagagcgaccagcgggagcaccgcauguucgaccagcagaucugccaccgguccaagcagcagggcuucaacuacugcaccagcgccaucuccagcccccugaccaaguccaucagccugaugacgaucucccaccccgggcucgacaacagccgccccuuccacuccaccuuccacaacaccagcgccaaccugaccgaguccaucacggaggagaacuacaacuuccugccgcacagccccuccaagaaggacagcgaguggaaguccggcaccaaggugagccgcaccuucagcuacaucaagaacaagauguccagcuccaagaaguccaaggagaaggagaaggagaaggacaagaucaaggagaaggagaaggacagcaaggacaaggagaaggacaagaagaccgugaacgggcacacguucagcuccauccccgucgugggccccaucagcugcucccagugcaugaagccguucaccaacaaggacgcguacacgugcgccaacugcagcgccuucgugcacaaggggugccgggagucccucgccagcugcgccaaggucaagaugaagcccaagggcucccugcaggcgcacgacaccagcucccugcccaccgugaucaugcgcaacaagcccagccagccgaaggagcggccccgcuccgccgugcuccuggucgacgagaccgccaccacccccaucuucgccaaccggcgcagccagcagagcgugucccugagcaaguccgugagcauccagaacaucacgggcgucgggaacgacgagaacauguccaacaccuggaaguuccucagccacuccaccgacagccugaacaagaucuccaaggugaacgagagcaccgagucccugacggacgagggcgucgggaccgacaugaacgagggccagcuccugggggacuucgagaucgagagcaagcagcuggaggccgaguccuggagccggaucaucgacuccaaguuccucaagcagcagaagaaggacguggugaagcgccaggaggucaucuacgagcugaugcagaccgaguuccaccacgugcggacccugaagaucaugagcggcguguacucccagggcaugauggcggaccuccuguucgagcagcagauggucgagaagcuguuccccugccucgacgagcugaucagcauccacucccaguucuuccagcgcauccuggagcggaagaaggagagccucguggacaagagcgagaagaacuuccugaucaagcgcaucggggacgugcuggucaaccaguucuccggcgagaacgccgagcggcugaagaagacguacgggaaguucugcggccagcacaaccagagcgugaacuacuucaaggaccucuacgccaaggacaagcgcuuccaggccuucgugaagaagaagauguccagcuccgucgugcggcgccuggggaucccggagugcauccugcucgugacccagcggaucaccaaguaccccguccuguuccagcgcauccugcagugcaccaaggacaacgagguggagcaggaggaccucgcccagagccugucccuggugaaggacgucaucggcgcgguggacagcaagguggccuccuacgagaagaagguccggcucaacgagaucuacacgaagaccgacagcaaguccaucaugcgcaugaaguccggccagauguucgccaaggaggaccugaagcgcaagaagcuggugcgggacgggagcguguuccucaagaacgccgcgggccgccugaaggagguccaggccgugcugcucaccgacauccugguguuccugcaggagaaggaccagaaguacaucuucgccagccucgaccagaaguccaccgucaucagccugaagaagcugaucgugcgggagguggcccacgaggagaaggggcuguuccugaucuccaugggcaugaccgaccccgagauggucgaggugcacgccagcuccaaggaggagcgcaacagcuggauccagaucauccaggacacgaucaacacccugaaccgggacgaggacgagggcaucccgagcgagaacgaggaggagaagaagaugcucgacacccgcgcgcgggagcugaaggagcagcugcaccagaaggaccagaagauccuccugcugcucgaggagaaggagaugaucuuccgcgacauggccgagugcuccacgccccugcccgaggacugcagccccacccacuccccgcgggugcuguuccgcagcaacaccgaggaggcccucaagggcgggccccugaugaaguccgccaucaacgaggucgagauccugcaggggcucgugagcggcaaccucgggggcacccugggccccaccguguccagccccaucgagcaggacgucguggggccggugucccucccccggcgcgccgagacguucggcggguucgacagccaccagaugaacgcguccaagggcggggagaaggaggagggcgacgacggccaggaccugcggcgcaccgagagcgacuccgggcugaagaagggcgggaacgccaaccucgucuucaugcugaagcggaacagcgagcaggucgugcaguccguggugcaccuguacgagcuccugagcgcccugcagggcgugguccuccagcaggacuccuacaucgaggaccagaagcuggugcugagcgagcgcgcccucacccggucccugagccgccccagcucccugaucgagcaggagaagcagcggagccucgagaagcagcgccaggaccuggccaaccugcagaagcagcaggcgcaguaccucgaggagaagcggcgccgcgagcgggagugggaggcccgcgagcgggagcugcgcgagcgggaggcccugcucgcccagcgcgaggaggaggugcagcaggggcagcaggaccuggagaaggagcgggaggagcugcagcagaagaagggcaccuaccaguacgaccucgagcgccugcgggcggcccagaagcagcuggagcgcgagcaggagcagcuccggcgcgaggccgagcggcugucccagcgccagacggagcgggaccugugccaggucagccacccccacaccaagcucaugcgcaucccguccuucuuccccagccccgaggagcccccgucccccagcgcccccuccaucgccaagagcggcucccuggacagcgagcuguccgugagccccaagcggaacuccaucagccgcacccacaaggacaaggggccguuccacauccucuccagcaccucccagacgaacaagggccccgaggggcagagccaggcgcccgccagcaccuccgccagcacccggcuguucggccugaccaagcccaaggagaagaaggagaagaagaagaagaacaagacgucccgcagccagccgggggacggccccgccuccgaggugagcgccgagggcgaggagaucuucugcuga

SEQ ID NO: 26509 - RNA, 2088 nt, Artificial Sequence
  derived and/or modified sequence opt1 from AKAP17A__Homo_sapiens__NP_005079
auggccgccgcgaccaucgugcacgacaccagcgaggccgucgagcugugccccgccuacggccucuaccugaagccgaucacgaagaugaccaucuccguggcccugccccagcucaagcagcccggcaagagcaucuccaacugggaggugauggagcgccugaaggggaugguccagaaccaccaguucagcacccugcggaucuccaagagcaccauggacuucauccgcuucgagggggagguggagaacaagucccucgucaagagcuuccuggccugccuggacggcaagacgaucaagcucuccggguucagcgacauccugaaggugcgggcggccgaguucaagaucgacuuccccacccgccacgacugggacuccuucuuccgggacgccaaggacaugaacgagacccugccgggcgagcgccccgacaccauccaccucgagggccugcccugcaagugguucgcccugaaggagagcggguccgagaagcccagcgaggacgugcucgugaaggucuucgagaaguucggcgagauccggaacguggacaucccgaugcuggaccccuaccgcgaggagaugacggggcggaacuuccacaccuucuccuucggcgggcaccugaacuucgaggcguacgugcaguaccgcgaguacaugggcuucauccaggccaugagcgcccuccggggcaugaagcugauguacaagggggaggacggcaaggccgucgccugcaacaucaagguguccuucgacagcaccaagcaccuguccgacgcgagcaucaagaagcgccagcucgagcggcagaagcugcaggagcuggagcagcagcgcgaggagcagaagcggcgcgagaaggaggccgaggagcggcagcgcgccgaggagcggaagcagaaggagcucgaggagcuggagcgcgagcggaagcgcgaggagaagcugcgcaagcgggagcagaagcagcgcgaccgggagcuccgccggaaccagaagaagcuggagaagcugcaggccgaggagcagaagcagcuccaggagaagaucaagcuggaggagcgcaagcugcuccuggcccagcggaaccugcagagcauccgccucaucgcggagcugcugucccgggccaaggccgugaagcuccgcgagcaggagcagaaggaggagaagcugcggcugcagcagcaggaggagcgccggcgccuccaggaggccgagcugcggcgcgucgaggaggagaaggagcgggcccuggggcuccagcgcaaggagcgggagcugcgcgagcgccugcucagcauccugcuguccaagaagcccgacgacagccacacccacgacgagcugggcguggcgcacgccgaccuccugcagcccgugcuggacauccuccagacggucuccagcggcugcguguccgccaccacccugcacccgcucgggggccagccgcccgccggggcccccaaggagagccccgcgcaccccgaggccgacggcgcccccaaguccgugaacgggagcgucgccgaggaggcgcccugcaaggaggugcaguccagcugccggguggucccggaggacggcucccccgagaagcgcugccccggcggggugcugagcugcauccccgacaacaaccagcagccgaagggcauccccgccugcgagcagaacgucucccggaaggacacccgcagcgagcaggacaagugcaaccgggagcccuccaaggggcgcggccgggccacgggggacggccuggccgaccgccacaagcgggagcgcagccgggcccgccgggcguccagccgcgaggacggccggccccgcaaggagcggcgcccgcacaagaagcacgccuacaaggacgacagcccccggcgccgguccaccagccccgaccacacccgcucccgccggagccacuccaaggaccgccaccggcgcgagcggagccgcgagcggcgcggguccgccagccggaagcacucccgccaccggcgccggagcgagcgcucccggagccgcuccccgagccggcaccgcuccaccuggaaccgguga

SEQ ID NO: 26510 - RNA, 2712 nt, Artificial Sequence
  derived and/or modified sequence opt1 from AKAP1__Homo_sapiens__NP_003479
auggccauccaguuccgcagccuguucccccucgcccugccgggcaugcuggcgcuccuggggugguggugguucuucucccggaagaagggccacgugagcucccacgacgagcagcaggucgaggccggggccgugcagcugcgcgccgaccccgccaucaaggagccccuccccguggaggacgucugcccgaagguggugagcaccccgcccuccgucaccgagcccccggagaaggagcugagcacgguguccaagcugcccgcggagccgcccgcccuccugcagacccacccgcccugccggcgcagcgaguccagcggcauccugcccaacaccaccgacaugcggcuccgccccgggacgcggcgcgacgacuccaccaagcuggagcuggcccucaccggcggcgaggccaagagcaucccccuggagugcccccuguccagccccaaggggguccucuucuccagcaaguccgcggaggugugcaagcaggacagccccuucucccgggugccgcgcaaggugcagcccggcuaccccgucgugcccgccgagaagcggagcagcggggagcgcgcccgggagaccggcggggccgagggcacgggcgacgccgugcugggggagaagguccuggaggaggcgcuccugucccgcgagcacgugcuggagcucgagaacagcaagggcccgucccuggccagccuggagggggaggaggacaagggcaaguccagcuccagccagguggucggccccgugcaggaggaggaguacguggccgagaagcuccccucccgguucaucgagagcgcccacaccgagcuggccaaggacgacgcggcccccgccccgcccgucgccgacgccaaggcgcaggaccgcgggguggagggcgagcuggggaacgaggagucccucgaccggaacgaggagggccuggaccgcaacgaggaggggcuggaccggaacgaggagagccucgaccgcaacgaggagggccuggaccggaacgaggagaucaagcgcgccgccuuccagaucaucucccaggugaucagcgaggccaccgagcagguccuggccaccacggugggcaaggucgcggggcgcgugugccaggccucccagcuccagggccagaaggaggagagcugcgugcccguccaccagaagaccgugcuggggccggacaccgccgagcccgccaccgcggaggccgccguggccccgcccgacgccggccugccccuccccgggcugcccgcggagggcuccccgccgcccaagacguacgucagcugccugaagucccuccugagcagccccaccaaggacuccaagcccaacaucagcgcccaccacaucucccuggccagcugccucgcccugaccacccccuccgaggagcugcccgaccgggccggcauccucguggaggacgcgacgugcgugaccugcaugagcgacuccagccaguccgucccccugguggccagccccgggcacugcuccgacagcuucuccaccagcggccuggaggacuccugcaccgagacgagcuccagcccccgcgacaaggccaucaccccgccccugcccgagagcaccgugcccuucuccaacgggguccucaagggcgagcugagcgaccugggggccgaggacggcuggaccauggacgccgaggcggaccacuccggcgggagcgaccggaacuccauggacagcguggacuccugcugcagccucaagaagacggaguccuuccagaacgcccaggccggcagcaaccccaagaagguggaccugaucaucugggagaucgagguccccaagcaccugguggggcgccucaucggcaagcagggccgguacguguccuuccugaagcagaccagcggggccaagaucuacaucuccacccugcccuacacccagagcguccagaucugccacaucgagggcucccagcaccacguggacaaggcgcucaaccugaucgggaagaaguucaaggagcugaaccucacgaacaucuacgccccgccccugcccagccuggcccucccgucccugcccaugaccagcuggcugaugcuccccgacggcaucaccguggaggucaucguggugaaccaggucaacgccgggcaccuguucgugcagcagcacacccaccccacguuccacgcccugcgcucccucgaccagcagauguaccugugcuacagccagccgggcauccccacccugcccacccccguggagaucaccgucaucugcgcggccccgggcgccgacggggccugguggcgggcccaggugguggcgagcuacgaggagaccaacgaggucgagauccgcuacguggacuacggcggguacaagcgggugaaggucgacgugcuccgccagauccgguccgacuucgugacgcugcccuuccagggcgccgagguccugcucgacagcgugaugccccuguccgacgacgaccaguucagccccgaggccgacgccgccauguccgagaugaccgggaacaccgcgcugcucgcccaggugaccagcuacuccccgacgggccugccccugauccagcucuggagcgucgugggcgacgaggugguccugaucaaccgcucccugguggagcgggggcucgcccaguggguggacagcuacuacaccucccuguga

SEQ ID NO: 26511 - RNA, 2847 nt, Artificial Sequence
  derived and/or modified sequence opt1 from AKAP2__Homo_sapiens__NP_001004065
augcgcuggccccagccgggcgccgccgcgcggcugccgcccgagagccccgggccgcccgagucccccgggccgcccgagcgcgaggccgccgccgcccggcgcuggaccggggcggagccccaggacugcgcccccggcagcgggcggcccgagaagccgccccagcucuccgaggacgacaucuggcucaagagcgagggcgacaacuacuccgccacccugcucgagcccgccgcgagcucccugagccccgaccacaagaacauggagaucgagguguccgucgccgagugcaagagcgugcccggcaucacguccacgccccaccccauggaccaccccagcgccuucuacuccccgccccacaacgggcugcucaccgaccaccacgagagccuggacaacgacguggcccgcgagauccgguaccuggacgagguccucgaggccaacugcugcgacuccgcgguggacggcaccuacaacgggaccagcucccccgagcccggcgccgugguccuggugggcggccugagcccgcccgugcacgaggccacccagcccgagcccaccgagcgcaccgccucccggcaggccccgccccacaucgagcucagcaacagcucccccgacccgauggcggaggccgagcgcacgaacggccacagccccucccagccccgggacgcccugggggacagccugcagguccccguguccccgagcuccaccaccagcucccgcugcagcucccgggacggcgaguucacccucacgacccugaagaaggaggccaaguucgagcugcgcgccuuccacgaggacaagaagcccagcaagcuguucgaggacgacgagcacgagaaggagcaguacugcauccggaaggugcgccccuccgaggagaugcuggagcuggagaaggagcggcgcgagcucauccggagccaggcggucaagaagaaccccgggaucgccgccaagugguggaacccgccccaggagaagaccaucgaggagcagcucgacgaggagcaccuggagucccacaagaaguacaaggagcgcaaggagcggcgcgcccagcaggagcagcugcugcugcagaagcagcuccagcagcagcagcagcagccgcccagccagcugugcaccgcccccgcguccagccacgagcgcgccuccaugaucgacaaggccaaggaggacaucgugacggagcagaucgacuucagcgccgcgcggaagcaguuccagcugauggagaacagccgccaggccguggccaagggccaguccacgccccgccucuucagcaucaagcccuucuaccggccccugggcuccgucaacagcgacaagccgcugaccaacccccggccgcccuccgugggcgggccgcccgaggacagcggggccuccgccgcgaagggccagaagucccccggggcccucgagacccccagcgccgccggcagccagggcaacaccgccucccaggggaaggagggccccuacagcgagcccuccaagcgcgggccccugagcaagcugugggcggaggacggcgaguucaccuccgcccgggccgugcucaccgucgugaaggacgacgaccacgggauccuggaccaguucagccgcuccgugaacgucagccugacccaggaggagcucgacagcggccuggacgagcuguccgugcggagccaggacacgaccgugcucgagacccuguccaacgacuucagcauggacaacaucuccgacagcggcgccuccaacgagaccacgaacgcccugcaggagaacagccucgcggacuucucccugccgcagacgccccagaccgacaaccccagcgaggggcgcggcgagggggucuccaagagcuucuccgaccacggcuucuacagccccuccagcacccugggggacuccccgcucguggacgacccccuggaguaccaggccggccugcugguccagaacgccauccagcaggccaucgcggagcaggucgacaaggccgugagcaagaccucccgggacggcgccgagcagcaggggcccgaggccaccguggaggaggccgaggcggccgccuucggcagcgagaagccccagagcauguucgagccgccccagguguccagccccgugcaggagaagcgcgacguccuccccaagauccugccggccgaggaccgggcccugcgcgagcgggggccgccccagccccuccccgcggugcagcccuccggccccaucaacauggaggagacccgccccgagggcagcuacuucuccaaguacagcgaggccgccgagcugcgguccaccgccagccugcucgccacgcaggaguccgacgugauggucgggccguucaagcugcgcagccggaagcagcgcacccuguccaugaucgaggaggagauccgcgcggcccaggagcgggaggaggagcucaagcgccagcgccaggugcugcagagcacccagagcccccggaccaagaacgcccccucccugcccucccggaccugcuacaagacggccccgggcaagaucgagaaggugaagcccccgcccagccccaccaccgaggggcccucccuccagcccgaccuggcgccggaggaggccgccggcacccagcgccccaagaaccugaugcagacgcucauggaggacuacgagacccacaagagcaagcggcgcgagcggauggacgacuccagcguccuggaggccacccgcgugaaccggcgcaagagcgcccuggcgcuccggugggaggccgggaucuacgccaaccaggaggaggaggacaacgaguga

SEQ ID NO: 26512 - RNA, 2562 nt, Artificial Sequence
  derived and/or modified sequence opt1 from AKAP3__Homo_sapiens__NP_001265238
augagcgagaagguggacuggcugcagucccagaacggcgucugcaagguggacguguacagccccggggacaaccaggcccaggacuggaagauggacaccuccaccgacccgguccgcgugcucagcuggcugcggcgcgaccuggagaaguccacggccgaguuccaggacgugcgguucaagcccggcgagagcuucgggggcgagaccuccaacagcggggacccccacaagggcuucuccgucgacuacuacaacaccaccacgaagggcacccccgagcgccuccacuucgagaugacccacaaggagaucccgugccaggggccccgggcgcagcugggcaacgggagcuccguggacgaggugagcuucuacgccaaccgccugaccaaccucgucaucgccauggcccggaaggagaucaacgagaagaucgacggcuccgagaacaagugcguguaccagagccuguacauggggaacgagcccacgcccaccaagucccugagcaagaucgccuccgagcucgugaacgagaccgucagcgcgugcucccgcaacgccgccccggacaaggcccccggcagcggcgaccgggugagcggguccagccaguccccgcccaaccugaaguacaagagcacccugaagaucaaggaguccacgaaggagcgccagggccccgacgacaagccgcccagcaagaaguccuucuucuacaaggagguguucgagagccggaacggggacuacgcgcgcgagggcggccgguucuucccccgcgagcggaagcgcuuccgggggcaggagcgccccgacgacuucaccgccuccgucagcgagggcaucaugaccuacgccaacuccguggugagcgacaugauggucuccaucaugaagacccucaagauccaggugaaggacacgaccaucgccaccauccugcugaagaaggugcuccugaagcacgccaaggaggucgugagcgaccugaucgacuccuuccuccggaaccugcacagcgugaccgggacgcugaugaccgacacccaguucgucuccgcggugaagcgcaccgucuucagccacggcucccagaaggccacggacaucauggacgccaugcuccggaagcuguacaacgugauguucgccaagaaggugcccgagcacguccgcaaggcccaggacaaggcggagagcuacagccugaucuccaugaaggggaugggcgaccccaagaaccgcaacgugaacuucgccaugaaguccgagaccaagcuccgggagaagauguacuccgagcccaagagcgaggaggagaccugcgccaagacccugggcgagcacaucaucaaggaggggcugacgcucuggcacaagucccagcagaaggagugcaagagccugggcuuccagcacgccgccuucgaggcgccgaacacccagcgcaagcccgccuccgacaucagcuucgaguaccccgaggacaucgggaaccugucccugcccccguacccgcccgagaagcccgagaacuucauguacgacagcgacuccugggccaaggaccucaucgugagcgcccugcuccugauccaguaccaccuggcccagggcgggcggcgcgacgcgcgguccuucgucgaggccgccggcaccaccaacuuccccgccaacgagccgcccguggcgcccgacgagagcugccucaaguccgcccccaucgugggcgaccaggagcaggccgagaagaaggaccugcgcagcgucuucuucaacuucauccggaaccugcucuccgagacgaucuucaagcgcgaccagagccccgagcccaaggugccggagcagcccgugaaggaggaccggaagcugugcgagcgcccccuggccagcagcccgccccggcucuacgaggacgacgagacccccggggcccugagcggccugaccaagauggcggucucccagaucgacgggcacaugagcggccagaugguggagcaccucaugaacuccgugaugaagcugugcgucaucaucgccaagagcugcgacgccucccuggccgagcucggggacgacaagagcggcgacgccucccgccugaccagcgcguuccccgacucccuguacgagugccugcccgccaagggcacggggagcgccgaggccgugcuccagaacgccuaccaggcgauccacaacgagaugcggggcaccuccgggcagccgcccgagggcugcgccgcccccaccgugaucgucagcaaccacaaccugaccgacaccgugcagaacaagcagcugcaggccgugcuccagugggucgcggccuccgagcugaacgugcccauccuguacuucgccggcgacgacgaggggauccaggagaagcuccugcagcugagcgccgccgcgguggacaagggcugcuccgucggggaggugcuccagagcgugcugcgcuacgagaaggagcggcagcugaacgaggccgucggcaacgugacgccgcuccagcugcuggacuggcucauggugaaccuguga

SEQ ID NO: 26513 - RNA, 2565 nt, Artificial Sequence
  derived and/or modified sequence opt1 from AKAP4__Homo_sapiens__NP_003877
augauggccuacagcgacaccaccaugauguccgacgacaucgacuggcugcgcagccaccggggcgugugcaaggucgaccucuacaaccccgaggggcagcaggaccaggaccgcaaggugaucugcuucguggacgucuccacccugaacguggaggacaaggacuacaaggacgccgcgagcuccagcuccgagggcaaccugaaccucgggagccuggaggagaaggagaucaucgugaucaaggacaccgagaagaaggaccaguccaagaccgagggcagcgucugccuguucaagcaggccccguccgaccccgugagcgugcucaacuggcugcuguccgaccuccagaaguacgcccugggguuccagcacgcccugagccccuccaccagcacgugcaagcacaaggucggcgacaccgagggcgaguaccaccgggccuccagcgagaacugcuacuccguguacgcggaccaggugaacaucgacuaccucaugaaccgcccccagaaccugcggcuggagaugaccgccgccaagaacaccaacaacaaccagagcccgagcgccccgcccgcgaagccgcccuccacgcagcgcgccgucaucagccccgacggggagugcuccaucgacgaccucagcuucuacgugaaccggcuguccagccuggugauccagauggcccacaaggagaucaaggagaagcucgagggcaaguccaagugccugcaccacagcaucugccccucccccgggaacaaggagcgcaucagcccccggacccccgccuccaagaucgccagcgagauggcguacgaggccgucgagcugaccgccgccgagaugcgcggcaccggggaggagucccgggagggcggccagaaguccuuccucuacagcgagcugagcaacaaguccaagagcggggacaagcagaugucccagcgcgagagcaaggaguucgccgacagcaucuccaagggccugaugguguacgcgaaccagguggccagcgacaugauggucucccucaugaagacgcugaaggugcacagcuccgggaagcccauccccgccagcgugguccugaagcgggugcuccugcgccacaccaaggagaucguguccgaccugaucgacagcugcaugaagaaccuccacaacaucaccggcguccugaugaccgacuccgacuucgugagcgccgucaagcggaaccuguucaaccaguggaagcagaacgccacggacaucauggaggcgaugcucaagcgccugguguccgcccugaucggcgaggagaaggagaccaagagccagucccucagcuacgccucccugaaggccgggagccacgacccgaagugccggaaccagucccuggaguucagcaccaugaaggccgagaugaaggagcgcgacaagggcaagaugaaguccgaccccugcaagagccucaccagcgcggagaaggugggggagcacauccugaaggagggccugacgaucuggaaccagaagcaggggaacuccugcaaggucgccaccaaggccugcagcaacaaggacgagaagggcgagaagaucaacgccuccaccgacagccucgcgaaggaccugaucguguccgcccugaagcucauccaguaccaccugacccagcagacgaagggcaaggacacgugcgaggaggacugccccgggagcaccaugggcuacauggcccaguccacccaguacgagaagugcgggggcgggcagagcgccaaggcccuguccgugaagcagcucgagagccaccgggcgcccggcccguccacgugccagaaggagaaccagcaccuggacagccagaagauggacauguccaacaucguccugaugcugauccagaagcuccugaacgagaaccccuucaagugcgaggaccccugcgagggcgagaacaagugcagcgagccccgcgccuccaaggccgccagcauguccaaccggagcgacaaggccgaggagcagugccaggagcaccaggagcuggacugcaccagcgggaugaagcaggcgaacggccaguucaucgacaagcucguggaguccgugaugaagcugugccugaucauggccaaguacagcaacgacggggccgcccucgccgagcuggaggagcaggcggccuccgccaacaagccgaacuuccgcggcacccgcugcauccacagcggggccaugccccagaacuaccaggacucccugggccacgaggucaucgugaacaaccagugcagcaccaacucccuccagaagcagcugcaggcggugcugcaguggaucgccgccagccaguucaacguccccaugcucuacuucaugggcgacaaggacgggcagcuggagaagcugccccagguguccgccaaggccgcggagaagggcuacagcgucgggggccuccugcaggaggugaugaaguucgccaaggagcggcagccggacgaggccgugggcaagguggcccgcaagcagcugcucgacuggcugcuggccaaccucuga

SEQ ID NO: 26514 - RNA, 1284 nt, Artificial Sequence
  derived and/or modified sequence opt1 from AKAP5__Homo_sapiens__NP_004848
auggagaccaccaucagcgagauccacguggagaacaaggacgagaagcgcuccgccgagggcagccccggggccgagcggcagaaggagaaggcguccaugcugugcuucaagcgccggaagaaggccgccaaggcccucaagccgaaggccggcagcgaggcggccgacgucgcccgcaagugcccccaggaggccggggcguccgaccagcccgagcccacgcggggcgccugggccagccugaagcgccuggugacccggcgcaagcgguccgagagcuccaagcagcagaagccgcucgagggggagaugcagcccgccaucaacgccgaggacgcggaccugagcaagaagaaggccaagucccgccugaagauccccugcaucaaguucccccggggcccgaagcgcagcaaccacuccaagaucaucgaggacagcgacugcuccaucaaggugcaggaggaggccgagauccucgacauccagacccagacgccccugaacgaccaggccaccaaggccaagagcacccaggaccuguccgagggcaucagccggaaggacggggacgaggucugcgaguccaacgugagcaacagcaccaccuccggcgagaaggugaucagcgucgagcucgggcuggacaacggccacuccgcgauccagacggggacccugauccucgaggagaucgagaccaucaaggagaagcaggacgugcagccccagcaggccagcccccuggagaccuccgagacggaccaccagcagccggugcugagcgacgucccgccccuccccgccauccccgaccagcagaucguggaggaggccuccaacagcacccuggaguccgcccccaacggcaaggacuacgagagcaccgagaucguggcggaggagaccaagcccaaggacacggagcugucccaggagagcgacuucaaggagaacggcaucaccgaggagaaguccaagagcgaggaguccaagcgcauggagcccaucgccaucaucaucaccgacaccgagaucagcgaguucgacgucacgaaguccaagaacgugccgaagcaguuccucaucagcgccgagaacgagcaggucgggguguucgccaacgacaacggcuucgaggaccggaccuccgagcaguacgagacccugcugaucgagaccgccagcagccucgugaagaacgcgauccagcuguccaucgagcagcuggugaacgagauggccagcgacgacaacaagaucaacaaccuccugcaguga

SEQ ID NO: 26515 - RNA, 6960 nt, Artificial Sequence
  derived and/or modified sequence opt1 from AKAP6__Homo_sapiens__NP_004265
augcugaccaugagcgucacccugagcccccuccgcagccaggaccuggacccgauggccacggacgccucccccauggcgaucaacaugacccccaccgucgagcagggcgagggggaggaggccaugaaggacauggacagcgaccagcaguacgagaagcccccgccccugcacaccggcgccgacuggaagaucgugcugcaccuccccgagaucgagaccuggcugcggaugaccuccgagcgcgugcgggaccugaccuacagcguccagcaggacuccgacagcaagcacguggacgugcaccugguccagcucaaggacaucugcgaggacaucuccgaccacguggagcagauccacgcccugcuggagaccgaguucagccucaagcugcuguccuacagcgugaacgucaucguggacauccacgccgugcagcuccuguggcaccagcugcgcgucuccgugcucgugcugcgggagcgcauccugcaggggcuccaggacgcgaacggcaacuacacgcggcagaccgacauccugcaggccuucagcgaggagaccaaggaggggcgccuggacucccucaccgaggucgacgacagcggccagcugacgaucaagugcucccagaacuaccugagccucgacugcggcaucaccgccuucgagcuguccgacuacagccccagcgaggaccugcucuccgggcugggcgacaugaccagcucccaggugaagaccaagcccuucgacagcugguccuacagcgagauggagaaggaguuccccgagcugauccgguccguggggcuccugacggucgccgcggacagcaucuccaccaacggcagcgaggccgugaccgaggaggugucccaggucagccuguccguggacgacaagggcgggugcgaggaggacaacgccagcgccguggaggagcagcccggccucacccugggggucuccagcuccagcggcgaggcccugacgaacgcggcccagcccuccagcgagaccgugcagcaggagagcuccagcuccagccaccacgacgccaagaaccagcagccgguccccugcgagaacgccacccccaagcgcaccauccgggacugcuucaacuacaacgaggacucccccacgcagccgacccuccccaagcgcgggcuguuccugaaggaggagaccuucaagaacgaccucaagggcaacggcgggaagcggcagaugguggaccugaagcccgagaugagccgcuccacccccagccugguggacccgcccgaccgguccaagcucugccugguccugcagagcuccuaccccaacagccccuccgccgcgagccaguccuacgagugccuccacaaggugggcaacgggaaccuggagaacacggugaaguuccacaucaaggagaucagcuccagccugggccgccugaacgacugcuacaaggagaagucccggcucaagaagccgcacaagaccuccgaggaggugccgcccugccgcacccccaagcgggggaccggcagcggcaagcaggccaagaacacgaaguccagcgccgugccgaacggggagcuguccuacaccagcaaggccaucgagggcccccagaccaacuccgccagcaccuccagccuggagcccugcaaccagcgcuccuggaacgcgaagcuccagcugcagagcgagacguccagcuccccggccuucacccagagcuccgagagcuccguggggagcgacaacaucaugagccccgucccccugcucuccaagcacaagagcaagaagggccaggccuccagccccucccacgugacccggaacggggagguggucgaggccugguacggcagcgacgaguaccuggcccugccgucccaccucaagcagaccgaggugcuggcgcugaagcucgagaaccugaccaagcugcucccccagaagccccgcggcgagacgauccagaacaucgacgacugggagcugagcgagaugaacuccgacagcgagaucuaccccaccuaccacgugaagaagaagcacacccgccuggggcgggucuccccgagcuccagcuccgacaucgccagcucccucggcgagagcaucgaguccgggccccugagcgacauccugagcgacgaggaguccagcaugccccucgccggcaugaagaaguacgccgacgagaaguccgagcgcgcgagcuccagcgagaagaacgagucccacagcgccaccaaguccgcccugauccagaagcugaugcaggacauccagcaccaggacaacuacgaggccaucugggagaagaucgagggguucgugaacaagcucgacgaguucauccaguggcugaacgaggccauggagacgaccgagaacuggacgccgcccaaggcggagauggacgaccugaagcucuaccuggagacccaccugagcuucaagcucaacguggacucccacugcgcccugaaggaggccgucgaggaggagggccaccagcugcucgagcugaucgccagccacaaggccggccugaaggacaugcuccggaugaucgcgucccaguggaaggagcugcagcgccagaucaagcggcagcacagcuggauccugcgcgcccucgacacgaucaaggccgagauccuggccaccgacguguccguggaggacgaggaggggaccggcagccccaaggccgagguccagcugugcuaccucgaggcgcagcgggacgccguggagcagaugucccugaagcuguacagcgagcaguacaccuccagcagcaagcgcaaggaggaguucgccgacauguccaaggugcacagcgucggguccaacggccuccuggacuucgacagcgaguaccaggagcugugggacuggcucaucgacauggagucccuggugauggacagccacgaccugaugauguccgaggagcagcagcagcaccucuacaagcgguacagcguggagauguccauccgccaccugaagaagacggagcugcucagcaaggucgaggcccugaagaagggcggggugcugcuccccaacgaccugcuggagaagguggacuccaucaacgagaagugggagcuccugggcaagacccugggggagaagauccaggacaccauggcgggccacagcggguccagcccccgggaccuccugucccccgagagcggcucccugguccgccagcucgaggugcggaucaaggagcugaagggcuggcugcgcgacaccgagcuguucaucuucaacagcugccugcggcaggagaaggaggggacgaugaacaccgagaagcagcugcaguacuucaagucccucugccgcgagaucaagcagcggcgccggggcguggccagcauccugcgccugugccagcaccuccuggacgaccgcgagaccugcaaccugaacgccgaccaccagcccaugcagcucaucaucgucaaccuggagcggcgcugggaggccaucgugaugcaggccgugcaguggcagacccggcugcagaagaagauggggaaggagagcgagacgcucaacgucaucgaccccggccugauggaccugaacgggauguccgaggacgcgcucgagugggacgagauggacaucagcaacaagcugaucucccugaacgaggagagcaacgaccucgaccaggagcugcagcccgugaucccgucccugaagcucggcgagaccagcaacgaggaccccggcuacgacgaggaggccgacaaccacgggggcucccaguacgccagcaacaucaccgcccccuccagcccccacaucuaccagguguacucccugcacaacgucgagcuguacgaggacaaccacaugccguuccucaagaacaaccccaaggugaccgggaugacgcagcccaacgugcugaccaagagccuguccaaggacagcuccuucagcuccaccaagagccugccggaccuccugggcggguccaaccuggucaagcccugcgccugccacggcggcgacaugagccagaacagcggguccgagagcggcaucguguccgagggggacaccgagacgaccaccaacagcgagaugugccuccugaacgcgguggacggcucccccagcaaccuggagaccgagcaccucgacccccagaugggggacgccgucaacgugcugaagcagaaguucacggacgagggcgaguccaucaagcugccgaacagcucccagagcuccaucagccccgugggcugcgucaacgggaaggugggcgaccucaacuccaucaccaagcacacccccgacugccugggggaggagcugcagggcaagcacgacguguucaccuucuacgacuacagcuaccuccagggcuccaagcugaagcugcccaugaucaugaagcagagccaguccgagaaggcccacgucgaggacccgcuccugcgcggguucuacuucgacaagaaguccugcaagagcaagcaccagacgaccgagcugcagcccgacgugccgccccacgagcggauccucgccagcgccagccacgagauggaccgcaucuccuacaagagcggcaacaucgagaagaccuucaccgggaugcagaacgcgaagcagcugucccugcucagccacuccagcuccaucgagagccuguccccgggcggggaccuguucggccucggcaucuucaagaacgggagcgacucccugcagcggagcaccucccuggagagcuggcucacguccuacaagagcaacgaggaccuguucuccugccacagcagcggcgacaucuccgucagcuccgggagcgugggcgagcuguccaagcgcacccucgaccugcugaaccggcucgagaacauccagagccccuccgagcagaagaucaagcgcagcguguccgacaucacccugcagagcuccagccagaagauguccuucaccgggcagaugagccuggacaucgccuccagcaucaacgaggacuccgccgccagccucacggagcuguccagcagcgacgagcugucccucugcagcgaggacaucguccugcacaagaacaagauccccgaguccaacgcgagcuuccggaagcgccugacccgguccguggccgacgagagcgacgugaacgucuccaugaucgugaacgugagcugcaccuccgccugcaccgacgacgaggacgacagcgaccuccuguccagcuccacgcugacccucaccgaggaggagcugugcaucaaggacgaggacgacgacagcuccaucgccaccgacgacgagaucuacgaggacugcacgcugaugagcggccucgacuacaucaagaacgagcugcagaccuggauccgccccaagcugucccucacccgggacaagaagcgcugcaacgucagcgacgagaugaagggcuccaaggacaucagcagcuccgagaugaccaacccgagcgacacgcugaacaucgagacccugcucaacggguccgugaagcgggugagcgagaacaacggcaacgggaagaacuccagccacacccacgagcugggcaccaagcgcgagaacaagaagacgaucuucaaggucaacaaggaccccuacguggccgacauggagaacgggaacaucgagggcauccccgagcggcagaagggcaagcccaacgugaccuccaaggucagcgagaaccuggggucccacggcaaggagaucagcgaguccgagcacugcaagugcaaggcgcucauggacagccuggacgacuccaacaccgccgggaaggaguucgugagccaggacgugcgccaccucccgaagaagugccccaaccaccaccacuucgagaaccaguccaccgccagcacgcccaccgagaaguccuucagcgagcuggcccuggagacccgguucaacaaccgccaggacuccgacgcccucaagagcagcgacgacgcgcccuccauggccggcaagagcgccggcugcugccucgcccuggagcagaacgggaccgaggagaacgccuccaucagcaacaucuccugcugcaacugcgagccggacgucuuccaccagaaggacgcggaggacugcagcgugcacaacuucgugaaggagaucaucgacauggccuccacggcccucaagagcaagucccagcccgagaacgaggucgccgcccccaccagccucacccagaucaaggagaaggugcuggagcacucccaccgccccauccagcugcggaagggcgacuucuacagcuaccucucccugagcucccacgacagcgacugcggggaggugaccaacuacaucgaggagaaguccagcacgccgcugccccucgacaccaccgacuccggccuggacgacaaggaggacaucgagugcuucuucgaggcgugcgucgagggggacagcgacggcgaggagcccugcuucagcuccgccccgcccaacgagagcgccgugcccuccgaggccgcgaugccccugcaggccaccgccugcagcuccgaguucagcgacuccagccucuccgccgacgacgccgacacgguggcgcugagcuccccgagcucccaggagcgcgccgaggucggcaaggaggugaacgggcugccccagaccagcuccggcugcgccgagaaccucgaguucacccccagcaagcuggacuccgagaaggagagcagcgggaagcccggcgaguccgggaugccggaggagcacaacgccgccagcgcgaaguccaaggugcaggaccugagccucaaggccaaccagcccaccgacaaggccgcccugcaccccucccccaagacccugacgugcgaggagaaccuccugaaccugcacgagaagcggcaccgcaacaugcaccgguga

SEQ ID NO: 26516 - RNA, 246 nt, Artificial Sequence
  derived and/or modified sequence opt1 from AKAP7__Homo_sapiens__NP_004833
augggccagcugugcugcuuccccuucagccgcgacgaggggaagaucuccgagaagaacggcggggagccggacgacgccgagcucgugcggcugagcaagcgccuggucgagaacgccgugcucaaggcggugcagcaguaccuggaggagacccagaacaagaacaagcccggcgagggguccagcgucaagaccgaggccgccgaccagaacggcaacgacaacgagaacaaccggaaguga

SEQ ID NO: 26517 - RNA, 11724 nt, Artificial Sequence
  derived and/or modified sequence opt1 from AKAP9__Homo_sapiens__NP_005742
auggaggacgaggagcgccagaagaagcuggaggccggcaaggccaagcuggcgcaguuccggcagcgcaaggcccagagcgacgggcagagccccagcaagaagcagaagaagaagcggaagaccagcagcuccaagcacgacgugagcgcccaccacgaccugaacaucgaccagucccagugcaacgagauguacaucaacagcucccagcgcguggagagcaccgugauccccgaguccaccaucaugcggacccugcacagcggcgagaucaccucccacgagcagggguucagcguggagcuggaguccgagaucagcaccacggccgacgacugcuccagcgaggugaacggcugcuccuucgugaugcgcaccgggaagcccaccaaccugcugcgggaggaggaguucggcguggacgacagcuacagcgagcagggcgcccaggacucccccacccaccucgagaugauggagagcgagcuggcggggaagcagcacgagaucgaggagcugaaccgcgagcucgaggagaugcgggugacguacggcaccgaggggcugcagcagcugcaggaguucgaggccgccaucaagcagcgcgacggcaucaucacccagcucaccgccaaccugcagcaggcgcggcgcgagaaggacgagacgaugcgggaguuccuggagcucaccgagcagucccagaagcugcagauccaguuccagcagcugcaggccagcgagacccuccgcaacuccacccacagcuccacggccgccgaccugcugcaggccaagcagcagauccucacccaccagcagcagcuggaggagcaggaccaccuccuggaggacuaccagaagaagaaggaggacuucaccaugcagaucagcuuccugcaggagaagaucaagguguacgagauggagcaggacaagaagguggagaacuccaacaaggaggagauccaggagaaggagaccaucaucgaggagcugaacacgaagaucaucgaggaggagaagaagacccucgagcugaaggacaagcugaccaccgcggacaagcuccugggggagcugcaggagcagaucgugcagaagaaccaggagaucaagaacaugaagcucgagcugacgaacagcaagcagaaggagcggcaguccagcgaggagaucaagcagcugaugggcaccguggaggagcuccagaagcgcaaccacaaggacucccaguucgagaccgacaucgugcagcggauggagcaggagacccagcgcaagcuggagcagcugcgggccgagcucgacgagauguacggccagcagaucgugcagaugaagcaggagcugauccgccagcacauggcccagauggaggagaugaagacgcggcacaagggggagauggagaacgcccugcgcagcuacuccaacaucaccgugaacgaggaccagaucaagcucaugaacguggccaucaacgagcugaacaucaagcugcaggacaccaacagccagaaggagaagcucaaggaggagcugggccugauccucgaggagaagugcgcgcugcagcgccagcuggaggaccuggucgaggagcucuccuucagccgggagcagauccagcgcgcccggcagaccaucgccgagcaggaguccaagcugaacgaggcccacaagagccugagcacgguggaggaccucaaggccgagaucguguccgcgagcgagucccgcaaggagcuggagcugaagcacgaggccgaggucaccaacuacaagaucaagcucgagaugcuggagaaggagaagaacgccgugcuggaccggauggccgagagccaggaggccgagcucgagcgccugcggacccagcuccuguucucccacgaggaggagcugagcaagcugaaggaggaccucgagaucgagcaccgcaucaacaucgagaagcugaaggacaaccuggggauccacuacaagcagcagaucgacggccuccagaacgagaugucccagaagaucgagaccaugcaguucgagaaggacaaccugaucacgaagcagaaccagcugauccucgagaucagcaagcugaaggaccugcagcagucccucgugaacagcaaguccgaggagaugacccugcagaucaacgagcugcagaaggagaucgagauccuccggcaggaggagaaggagaagggcacccuggagcaggagguccaggagcugcagcucaagaccgagcugcuggagaagcagaugaaggagaaggagaacgaccuccaggagaaguucgcgcagcuggaggccgagaacagcauccugaaggacgagaagaagacccucgaggacaugcugaagauccacacgcccgugucccaggaggagcgccugaucuuccucgacagcaucaaguccaagagcaaggacuccgugugggagaaggagaucgagauccugaucgaggagaacgaggaccugaagcagcagugcauccagcucaacgaggagaucgagaagcagcggaacaccuucagcuucgccgagaagaacuucgaggucaacuaccaggagcugcaggaggaguacgccugccugcucaaggugaaggacgaccuggaggacagcaagaacaagcaggagcuggaguacaaguccaagcucaaggcgcugaacgaggagcugcaccuccagcgcaucaacccgaccaccgucaagaugaaguccuccguguucgacgaggacaagacguucguggccgagacccuggagaugggggaggucguggagaaggacaccaccgagcugauggagaagcucgaggugacgaagcgggagaagcuggagcugagccagcgccucuccgaccugagcgagcagcugaagcagaagcacggcgagaucuccuuccucaacgaggaggucaagagccugaagcaggagaaggagcaggucucccugcggugccgcgagcucgagaucaucaucaaccacaaccgggccgagaacgugcagagcugcgacacccaggucuccagccugcuggacgggguggugaccaugaccucccgcggcgccgaggggagcgucuccaaggugaacaagagcuucggcgaggaguccaagaucaugguggaggacaaggucagcuucgagaacaugacggugggcgaggaguccaagcaggagcagcucauccuggaccaccuccccagcgugaccaaggagagcucccuccgggccacccagcccagcgagaacgacaagcugcagaaggagcugaacguccucaaguccgagcagaacgaccugcgccugcagauggaggcgcagcgcaucugccucagccugguguacuccacccacguggaccagguccgggaguacauggagaacgagaaggacaaggcccugugcagccucaaggaggagcugaucuucgcccaggaggagaagaucaaggagcugcagaagauccaccagcucgagcugcagacgaugaagacccaggagaccggggacgagggcaagccccugcaccuccugaucgggaagcugcagaaggccguguccgaggagugcagcuacuuccuccagacccugugcuccgugcugggcgaguacuacacgccggcccucaagugcgaggucaacgcggaggacaaggagaacagcggggacuacaucuccgagaacgaggaccccgagcugcaggacuaccgcuacgaggugcaggacuuccaggagaacaugcacacccugcucaacaaggugaccgaggaguacaacaagcugcugguccugcagacccggcucagcaagaucuggggccagcagacggacggcaugaagcuggaguucggggaggagaaccugcccaaggaggagaccgaguuccucuccauccacagccagaugaccaaccuggaggacaucgacgugaaccacaaguccaagcugagcucccuccaggaccuggagaagaccaagcuggaggagcagguccaggagcucgagagccugaucuccagccugcagcagcagcucaaggagacggagcagaacuacgaggccgagauccacugccugcagaagcgccugcaggccgucagcgaguccaccgugcccccgagccuccccguggacuccgucgugaucaccgagagcgacgcccagcggaccauguaccccggcuccugcgugaagaagaacaucgacgggacgaucgaguucagcggcgaguucggggucaaggaggagaccaacaucgugaagcugcuggagaagcaguaccaggagcagcucgaggaggagguggccaaggucaucguguccaugagcaucgcguucgcccagcagaccgagcugucccgcaucagcggcggcaaggagaacaccgccuccagcaagcaggcccacgcggugugccagcaggagcagcacuacuucaacgagaugaagcugucccaggaccagaucggguuccagacguucgagaccgucgacgugaaguucaaggaggaguucaagccccucagcaaggagcugggcgagcacgggaaggagauccugcucuccaacagcgacccgcacgacauccccgaguccaaggacugcgugcugaccaucagcgaggagauguucuccaaggacaagaccuucaucguccggcagagcauccacgacgagaucagcguguccagcauggacgccucccgccagcugaugcucaacgaggagcagcuggaggacaugcggcaggagcuggugcgccaguaccaggagcaccagcaggccaccgagcuccugcggcaggcccacaugcgccagauggagcggcagcgcgaggaccaggagcagcugcaggaggagaucaagcggcucaaccgccagcuggcccagcggagcuccaucgacaacgagaaccuggucagcgagcgcgagcgggugcuccuggaggagcuggaggcgcucaagcagcugucccuggccggccgcgagaagcucugcugcgagcugcggaacagcuccacgcagacccagaacggcaacgagaaccagggggagguggaggagcagaccuucaaggagaaggagcuggaccgcaagcccgaggacgugcccccggagauccucagcaacgagcgcuacgcccugcagaaggccaacaaccggcugcucaagauccugcuggagguggucaagaccacggccgcgguggaggagaccaucggccgccacgugcucgggauccuggaccgguccagcaagucccagagcuccgccagccugaucuggcgcuccgaggccgaggccagcgucaaguccugcgugcacgaggagcacacccgggugaccgacgagagcauccccagcuacuccggcagcgacaugccccgcaacgacaucaacaugugguccaaggucacggaggaggggaccgagcucagccagcggcuggugcgcuccggcuucgccggcaccgagaucgaccccgagaacgaggagcugaugcucaacaucagcucccggcugcaggcggccguggagaagcugcucgaggccaucagcgagaccuccagccagcuggagcacgccaaggucacgcagaccgagcugaugcgcgaguccuuccggcagaagcaggaggcgaccgagagccucaagugccaggaggagcugcgcgagcggcugcacgaggagucccgcgcccgggagcagcucgccguggagcugagcaaggccgagggggugaucgacggcuacgccgacgagaagacccuguucgagcgccagauccaggagaagacggacaucaucgaccggcucgagcaggagcugcugugcgcguccaaccgccuccaggagcuggaggccgagcagcagcagauccaggaggagcgggagcugcucagccgccagaaggaggccaugaaggccgaggccgggccggucgagcagcagcugcugcaggagaccgagaagcucaugaaggagaagcuggaggugcagugccaggcggagaaggugcgcgacgaccugcagaagcaggucaaggcccucgagaucgacguggaggagcaggucucccgguucaucgagcuggagcaggagaagaacaccgagcugauggaccuccgccagcagaaccaggcccuggagaagcagcuggagaagaugcggaaguuccucgacgagcaggccaucgaccgcgagcacgagcgggacgucuuccagcaggagauccagaagcuggagcagcagcugaagguggugccccgcuuccagcccaucagcgagcaccagacccgggaggucgagcagcucgccaaccaccugaaggagaagacggacaagugcuccgagcugcuccugagcaaggagcagcugcagcgcgacauccaggagcggaacgaggagaucgagaagcucgaguuccgcgugcgggagcuggagcaggcgcugcucgugagcgccgacaccuuccagaaggucgaggaccgcaagcacuucggcgccguggaggccaagcccgagcugucccuggaggugcagcugcaggccgagcgggacgcgaucgaccgcaaggagaaggagaucaccaaccucgaggagcagcuggagcaguuccgggaggagcuggagaacaagaacgaggagguccagcagcuccacaugcagcuggagauccagaagaaggagagcaccacgcgccugcaggagcucgagcaggagaacaagcuguucaaggacgacauggagaagcuggggcucgccaucaaggaguccgacgccaugagcacccaggaccagcacgugcuguucggcaaguucgcccagaucauccaggagaaggagguggagaucgaccagcugaacgagcaggucaccaagcuccagcagcagcugaagaucaccacggacaacaaggugaucgaggagaagaacgagcugauccgggaccucgagacccagaucgagugccugauguccgaccaggagugcgugaagcgcaaccgggaggaggagaucgagcagcugaacgaggucaucgagaagcuccagcaggagcuggcgaacaucggccagaagaccagcaugaacgcccacucccugagcgaggaggccgacucccucaagcaccagcuggacguggugaucgccgagaagcuggcccucgagcagcaggucgagaccgcgaacgaggagaugacguucaugaagaacgugcugaaggagaccaacuucaagaugaaccagcugacccaggagcuguucagccugaagcgcgagcgggaguccguggagaagauccagagcaucccggagaacuccgucaacguggccaucgaccaccugagcaaggacaagcccgagcucgaggugguccugaccgaggacgcccugaagucccucgagaaccagacguacuucaagagcuucgaggagaacgggaagggcuccaucaucaaccuggagacccgccugcuccagcuggagagcaccgugagcgccaaggaccuggagcucacccagugcuacaagcagaucaaggacaugcaggagcaggggcaguucgagaccgagaugcugcagaagaagaucgugaaccugcagaagaucgucgaggagaagguggccgcggcccucgugucccagauccagcuggaggccguccaggaguacgccaaguucugccaggacaaccagacgaucagcuccgagcccgagcgcaccaacauccagaaccugaaccagcuccgggaggacgagcugggcagcgacaucuccgcccugacccuccgcaucagcgagcuggagucccaggugguggagaugcacaccagccugauccucgagaaggagcaggucgagaucgcggagaagaacgugcuggagaaggagaagaagcugcucgagcugcagaagcugcucgaggggaacgagaagaagcagcgggagaaggagaagaagcgcuccccgcaggacgucgaggugcugaagacgaccaccgagcuguuccacagcaacgaggaguccggcuucuucaacgagcucgaggcccugcgggccgagagcguggccaccaaggcggagcuggccuccuacaaggagaaggccgagaagcuccaggaggagcugcuggucaaggagacgaacaugaccagccuccagaaggaccugucccaggugcgcgaccaccuggccgaggccaaggagaagcucagcauccuggagaaggaggacgagaccgaggugcaggaguccaagaaggcgugcauguucgagccccugcccaucaagcucagcaaguccaucgccagccagaccgacggcacgcugaagaucagcuccagcaaccagacgccccagauccuggucaagaacgccgggauccagaucaaccuccaguccgagugcagcuccgaggaggugaccgagaucaucagccaguucaccgagaagaucgagaagaugcaggagcugcacgccgccgagauccuggacauggagucccggcacaucagcgagacggagacccucaagcgcgagcacuacguggcgguccagcugcugaaggaggagugcggcacccucaaggccgugauccagugccugcgguccaaggaggggagcuccaucccggagcuggcccacagcgacgccuaccagacccgcgagaucugcuccagcgacuccggcagcgacugggggcagggcaucuaccucacgcacucccagggcuucgacaucgccagcgaggggcggggcgaggaguccgagagcgcgaccgacagcuuccccaagaagaucaaggggcugcugcgcgccgugcacaacgagggcaugcagguccucucccugaccgagagccccuacuccgacggcgaggaccacagcauccagcaggucuccgagcccuggcuggaggagcggaaggccuacaucaacaccaucagcucccucaaggaccugaucacgaagaugcagcugcagcgcgaggccgagguguacgacagcucccagagccacgaguccuucagcgacuggcgcggggagcuccugcuggcgcuccagcaggucuuccuggaggagcgcuccgugcugcuggccgccuuccggaccgagcucaccgcccugggcaccacggacgccguggggcugcucaacugccuggagcagcgcauccaggagcagggcgucgaguaccaggcggccauggagugccugcagaaggccgaccggcgcagccuccuguccgagauccaggcccugcacgcccagaugaacgggcgcaagaucacccucaagcgggagcaggagagcgagaagccgucccaggagcugcuggaguacaacauccagcagaagcagagccagaugcucgagaugcaggucgagcuguccagcaugaaggaccgcgcgaccgagcugcaggagcagcucagcuccgagaagaugguggucgccgagcucaagagcgagcuggcccagaccaagcucgagcuggagacgacccugaaggcccagcacaagcaccucaaggagcuggaggccuuccggcuggaggugaaggacaagaccgacgaggugcaccuccugaacgacacccuggcguccgagcagaagaagucccgcgagcuccagugggcccuggagaaggagaaggccaagcugggccggagcgaggagcgcgacaaggaggagcucgaggaccugaaguucagccuggagucccagaagcagcggaaccuccagcugaaccugcuccuggagcagcagaagcagcugcucaacgagagccagcagaagaucgagucccagcgcaugcuguacgacgcccagcugagcgaggagcagggccggaaccucgagcugcagguccugcucgaguccgagaaggugcgcauccgggagaugagcuccacgcuggaccgcgagcgggagcugcacgcccagcuccagagcuccgacgggaccggccagagccggccgccccugcccuccgaggaccugcucaaggagcugcagaagcagcuggaggagaagcacagccggaucguggagcuccugaacgagaccgagaaguacaagcuggacucccuccagacccgccagcagauggagaaggaccggcagguccaccgcaagacgcugcagaccgagcaggaggcgaacaccgaggggcagaagaagaugcacgagcugcagagcaagguggaggaccuccagcggcagcuggaggagaagcgccagcaggucuacaagcuggaccucgagggccagcggcugcaggggaucaugcaggaguuccagaagcaggagcuggagcgcgaggagaagcgcgagagccggcgcauccucuaccagaaccugaacgagccgaccaccuggucccugacgagcgaccggacccgcaacuggguccuccagcagaagaucgagggcgagaccaaggaguccaacuacgccaagcugaucgagaugaacggcgggggcaccgggugcaaccacgagcuggagaugauccggcagaagcuccagugcguggccagcaagcuccaggugcugccccagaaggccuccgagcgccuccaguucgagacggcggacgacgaggacuucaucuggguccaggagaacaucgacgagaucauccugcagcugcagaagcucaccggccagcagggggaggagcccagccuggugucccccagcaccuccugcggcagccugaccgagcggcuccugcgccagaacgccgagcugacgggccacaucucccagcucaccgaggagaagaacgaccugcggaacauggugaugaagcuggaggagcagauccgcugguaccggcagaccggggccggccgcgacaacagcucccgguucagccucaacgggggcgccaacaucgaggccaucaucgcguccgagaaggaggucuggaaccgcgagaagcugacccugcagaagucccucaagcgggccgaggccgagguguacaagcugaaggccgagcugcgcaacgacucccuccugcagacgcugagcccggacuccgagcacgugacccugaagcggaucuacggcaaguaccuccgcgccgagagcuuccggaaggcgcugaucuaccagaagaaguaccugcuccugcugcucgggggcuuccaggagugcgaggacgccacccuggcccugcucgcccgcaugggcgggcagcccgccuucaccgaccuggaggucaucacgaaccgccccaagggguucacccgguuccgcagcgcggugcggguguccaucgccaucagccgcaugaaguuccugguccggcgcuggcaccgggugaccggcuccgugagcaucaacaucaaccgcgacggcuucgggcucaaccagggcgccgagaagaccgacuccuucuaccacagcuccgggggccuggagcuguacggggagccccggcacacgaccuaccgcagccgguccgaccucgacuacauccgcagcccgcugcccuuccagaaccgguaccccggcacccccgccgacuucaacccgggcucccuggcgugcagccagcuccagaacuacgaccccgaccgcgcccugaccgacuacaucacgcggcuggaggcccuccagcgccggcuggggaccauccaguccggcagcaccacccaguuccacgccgggaugcgccgguga

SEQ ID NO: 26518 - RNA, 552 nt, Artificial Sequence
  derived and/or modified sequence opt1 from AKIP1__Homo_sapiens__NP_001193575
auggacaacugccuggccgccgcggcccucaacggcguggaccgccggagccugcagcgcuccgcccggcuggcccucgagguccuggagcgcgccaagcggcgcgcgguggacuggcacgcccuggagcggcccaaggggugcaugggcgugcucgcccgcgaggccccgcaccuggagaagcagcccgcggccgggccccagcggguccugcccggcgagaaguacuacagcuccgugccggaggagggcggggccacccacguguaccgcuaccaccggggcgagagcaagcuccacaugugccuggacaucgggaacggccagcgcaaggaccggaagaagaccucccuggggcccggcgggagcuaccagaucuccgagcacgcccccgaggccagccagcccgcggagaacaucuccaaggaccucuacaucgaggucuacccgggcacguacagcgugaccgugggcuccaacgaccugaccaagaagacccacgucguggccguggacagcgggcaguccgucgaccugguguuccccguguga

SEQ ID NO: 26519 - RNA, 612 nt, Artificial Sequence
  derived and/or modified sequence opt1 from AKIRIN2__Homo_sapiens__NP_060534
auggccugcggcgccacccugaagcgcacccucgacuucgacccccugcugagcccggcgucccccaagcggcgccggugcgcgccccucagcgcccccacguccgccgccgccagcccgcuguccgccgccgccgcgaccgccgccagcuucuccgccgccgcggccagcccccagaaguaccugcgcauggagcccucccccuucggggacgugagcucccggcucaccaccgagcagauccuguacaacaucaagcaggaguacaagcgcaugcagaagcggcgccaccuggagacgagcuuccagcagaccgacccgugcugcaccuccgacgcccagccccacgccuuccuccugagcggccccgccucccccgggaccagcuccgcggccagcuccccgcugaagaaggagcagccccucuucacgcugcggcaggucggcaugaucugcgagcgccugcucaaggagcgggaggagaaggugcgcgaggaguacgaggagauccugaacaccaagcuggccgagcaguacgacgccuucgugaaguucacccacgaccagaucaugcggcgcuacggggagcagcccgccagcuacgucagcuga

SEQ ID NO: 26520 - RNA, 4320 nt, Artificial Sequence
  derived and/or modified sequence opt1 from AKNA__Homo_sapiens__NP_110394
auggccagcuccgagaccgagauccgcugggccgagcccggccuggggaagggcccgcagcggcgccggugggcgugggccgaggacaagcgcgacguggaccggagcuccagccaguccugggaggaggagcgccucuuccccaacgccaccagccccgagcugcuggaggacuuccggcucgcccagcagcaccugcccccgcuggagugggacccccacccccagcccgacgggcaccaggacuccgagagcggcgagacguccggggaggaggccgaggcggaggacgucgacagcccggccuccagccacgagccccucgccuggcugccccagcagggccgccagcuggacaugaccgaggaggagcccgacggcacccucgggucccuggagguggaggaggccggcgagagcuccagccggcugggguacgaggcgggccucucccuggaggggcacggcaacaccagcccgauggcccugggccacgggcaggcccgcggcuggguggccuccggggagcaggccagcggcgacaagcucagcgagcacuccgaggucaaccccagcguggagcugucccccgcgcggagcugguccagcggcacggugucccuggaccaccccagcgacucccucgacagcaccugggagggggagaccgacggcccgcagcccaccgcccuggccgagacgcugcccgaggggcccucccaccaccuccugagcccggacggccgcaccgggggcuccgucgcccgggccacccccauggaguuccaggacagcuccgcgccccccgcccagagcccgcagcacgccaccgaccgcuggcggcgcgagacgacccgguucuucugcccccagcccaaggagcacaucuggaagcagaccaagaccucccccaagccgcugcccagccgcuucaucggcuccaucagcccccucaacccgcagccccggcccacgcgccaggggcggccccugccgcgccagggcgccacccuggccgggcgcagcuccagcaacgcgcccaaguacggccgggggcagcucaacuacccccugcccgacuucuccaaggugggcccgcgcgugcgguuccccaaggacgagagcuaccgcccccccaagucccggagccacaaccgcaagccgcaggcccccgcccggccccugaucuucaagucccccgccgagaucguccaggaggugcuccugagcuccggcgaggccgcgcuggccaaggacaccccgcccgcccaccccaucacccgcgugccccaggaguuccagacgccggagcaggccaccgagcucguccaccagcugcaggaggacuaccaccggcugcucaccaaguacgcggaggccgagaacaccaucgaccagcugcgccugggggccaaggugaaccucuucagcgaccccccccagcccaaccacuccauccacacgggcauggugccgcaggggaccaagguccugagcuucaccaucccccagccccgguccgccgagugguggccgggccccgccgaggacccccaggcgagcgccgccuccggguggcccagcgcccgcggcgaccuguccccgagcagccucaccuccaugcccacgcugggcuggcugcccgagaaccgggacaucagcgaggaccaguccagcgccgagcagacccaggcgcucgccucccaggccagccaguuccuggccaagguggaguccuucgagcgccugauccaggccgggcggcucaugccccaggaccaggugaagggcuuccagcgccugaaggcggcccacgccgcccuggaggaggaguaccugaaggcgugccgggagcagcacccggcccagccccucgccgggagcaagggcacccccggccgcuucgacccccggcgcgagcuggaggccgagaucuaccgccugggguccugccucgaggagcugaaggagcacaucgaccagacccagcaggagccggagccccccggcagcgacuccgcccuggacagcacgcccgcgcucccgugccugcaccagcccacccaccugcccgcccccuccgggcaggccccgaugcccgccaucaagaccagcugccccgagcccgccaccacgaccgcggccgccuccaccggcccgugcccccuccacgucaacguggaggugagcuccgggaacagcgaggucgaggaccggccccaggacccccuggcccgccugcggcacaaggagcuccagauggagcagguguaccacggccugauggagcgcuaccuguccgugaagagccucccggaggccaugcggauggaggaggaggaggagggcgaggaggaggaggaggaggaggggggcggggacagccuggaggucgacggcguggcggccacccccgggaaggccgaggccacccgcguccugccccggcagugcccggugcaggcggagaagucccacggcgccccccucgaggaggccacggagaagauggugagcaugaagccccccggcuuccaggccucccuggcccgcgacgggcacaugagcggccuggggaaggcggaggccgccccgcccggccccgggguccccccgcacccccccggcaccaaguccgccgccagccaccaguccagcaugaccucccucgagggcagcgggaucuccgagcggcugccccagaagccgcugcaccgcggcgggggcccccaccucgaggagaccuggauggcgagccccgagacggacuccggguucgugggcagcgagaccucccgggugagcccccugacccagaccccggagcaccgccugucccacaucagcacggccggcacccucgcccagcccuucgccgccuccgucccccgggacggggcgagcuaccccaaggcccgcggcagccugaucccgcggcgcgccaccgagcccuccaccccccggagccaggcccagcgcuaccuguccagccccuccgggccgcuccggcagcgcgcccccaacuucagccuggagcggacgcuggcggccgagauggccgugcccggcuccgaguucgagggccacaagcgcaucagcgagcagccccucccgaacaagaccaucuccccccccccggcccccgcgcccgccgccgccccccugccgugcgggcccaccgagaccauccccagcuuccugcucacgcgcgccggccgggaccaggcgaucugcgagcugcaggaggaggugucccgccugcggcuccgccuggaggacagccugcaccagccccuccagggguccccgacccggcccgccagcgccuucgaccgccccgcccggacccgcggccggcccgccgacuccccggcgaccugggggagccacuacggcuccaagagcacggagcgccugcccggcgagccccggggggaggagcagaucguccccccgggccgccagcgggcccgcuccagcagcgugccccgggaggugcugcgccucucccugagcuccgagagcgagcugcccucccucccccuguucagcgagaaguccaagaccaccaaggacagcccgcaggccgcccgggacgggaagcgcggcgucggguccgccggcuggcccgaccgggugaccuuccgcggccaguacacggggcacgaguaccacgugcugagccccaaggcgguccccaagggcaacgggaccguguccugcccgcacugccgccccauccggacccaggacgccggcggggccgugaccggcgacccccucggcccgccccccgccgacacgcugcagugcccccugugcgggcaggucggcagcccgcccgaggcggacgggcccggcuccgccaccagcggcgccgagaaggccaccacccgccggaaggccuccagcacgcccuccccgaagcagcgcagcaagcaggcgggguccagcccccggccccccccgggccucugguaccuggccaccgccccccccgcccccgccccgcccgcguucgccuacaucagcuccgugcccaucaugcccuacccgcccgccgccguguacuacgcccccgcggggcccaccagcgcccagccggccgccaaguggccccccaccgcgucccccccgcccgcccgccggcaccgccacagcauccagcuggaccucggcgaccuggaggagcugaacaaggcccucucccgggccguccaggccgcggagagcgugcgcuccacgacccggcagaugcgcagcucccugagcgccgaccugcggcaggcccacucccuccgcgggagcugccuguucuga

SEQ ID NO: 26521 - RNA, 951 nt, Artificial Sequence
  derived and/or modified sequence opt1 from AKR1B10__Homo_sapiens__NP_064695
auggccaccuucguggagcugagcaccaaggccaagaugcccaucgucggccucgggacguggaaguccccgcugggcaaggugaaggaggcggugaaggucgccaucgacgccggguaccgccacaucgacugcgccuacguguaccagaacgagcacgaggugggcgaggccauccaggagaagauccaggagaaggcggucaagcgggaggaccuguucaucgugagcaagcucuggcccaccuucuucgagcgcccccuggugcggaaggccuucgagaagacccugaaggaccucaagcuguccuaccuggacgucuaccucauccacuggccccagggguucaagagcggcgacgaccuguucccgaaggacgacaagggcaacgccaucgggggcaaggccaccuuccuggacgcgugggaggccauggaggagcucguggacgaggggcuggugaaggcccugggcgucuccaacuucagccacuuccagaucgagaagcuccugaacaagcccgggcugaaguacaagcccgugacgaaccagguggagugccaccccuaccucacccaggagaagcugauccaguacugccacuccaagggcaucaccgucaccgccuacagcccgcugggcucccccgaccgccccugggccaagcccgaggacccgagccuccuggaggaccccaagaucaaggagaucgcggccaagcacaagaagacggccgcccaggugcugauccgguuccacauccagcgcaacgugaucgucauccccaaguccgugacccccgcccggaucguggagaacauccaggucuucgacuucaagcucagcgacgaggagauggcgaccauccuguccuucaaccgcaacuggcgggccugcaacgugcugcagagcucccaccucgaggacuacccguucaacgccgaguacuga

SEQ ID NO: 26522 - RNA, 951 nt, Artificial Sequence
  derived and/or modified sequence opt1 from AKR1B1__Homo_sapiens__NP_001619
auggccagccgccugcuccugaacaacggcgccaagaugcccauccuggggcucggcaccuggaaguccccgcccggccaggugaccgaggcggucaagguggccaucgacgugggguaccggcacaucgacugcgcccacgucuaccagaacgagaacgagguggggguggccauccaggagaagcugcgcgagcaggucgugaagcgggaggagcuguucaucgugagcaagcucuggugcacguaccacgagaagggccuggucaagggcgccugccagaagacccuguccgaccucaagcuggacuaccuggaccucuaccugauccacuggcccaccggguucaagcccggcaaggaguucuucccgcuggacgagagcgggaacguggugcccuccgacaccaacauccucgacacgugggcggccauggaggagcuggucgacgagggccuggugaaggccaucgggaucagcaacuucaaccaccuccagguggagaugauccugaacaagcccggccugaaguacaagcccgccgucaaccagaucgagugccacccguaccucacccaggagaagcugauccaguacugccaguccaagggcaucguggugaccgcguacagcccccuggggucccccgaccgccccugggccaagccggaggaccccagccuccuggaggacccccggaucaaggccaucgccgccaagcacaacaagaccacggcgcagguccugauccgcuuccccaugcagcggaaccucguggugaucccgaaguccgucacccccgagcgcaucgccgagaacuucaagguguucgacuucgagcugagcucccaggacaugaccacccugcucagcuacaaccggaacuggcgcgugugcgcccugcuguccugcacgagccacaaggacuaccccuuccacgaggaguucuga

SEQ ID NO: 26523 - RNA, 972 nt, Artificial Sequence
  derived and/or modified sequence opt1 from AKR1C1__Homo_sapiens__NP_001344
auggacagcaaguaccagugcgugaagcugaacgacggccacuucaugcccguccucggcuucggcaccuacgccccggccgaggugcccaaguccaaggcgcuggaggccaccaagcuggccaucgaggccggguuccgccacaucgacagcgcccaccucuacaacaacgaggagcaggucggccuggcgauccgguccaagaucgccgacgggagcgugaagcgcgaggacaucuucuacacguccaagcuguggugcaacagccaccggcccgagcucgugcgccccgcccuggagcggucccugaagaaccuccagcuggacuacguggaccuguaccucauccacuucccggucagcgugaagcccggcgaggaggugauccccaaggacgagaacggcaagauccuguucgacaccgucgaccugugcgccaccugggaggcgguggagaagugcaaggacgccgggcucgccaaguccaucggcgugagcaacuucaaccgccggcagcuggagaugauccugaacaagcccgggcucaaguacaagccggucugcaaccagguggagugccaccccuacuucaaccagcgcaagcugcuggacuucugcaaguccaaggacaucgugcucgucgccuacagcgcccugggcucccaccgggaggagcccuggguggaccccaacagcccggugcugcucgaggaccccguccugugcgcgcuggccaagaagcacaagcgcacccccgcccucaucgcccugcgguaccagcugcagcgcgggguggugguccucgccaaguccuacaacgagcagcggauccgccagaacguccagguguucgaguuccagcugacgagcgaggagaugaaggcgaucgacggccugaaccggaacgugcgcuaccucacccuggacaucuucgccgggcccccgaacuaccccuucuccgacgaguacuga

SEQ ID NO: 26524 - RNA, 420 nt, Artificial Sequence
  derived and/or modified sequence opt1 from AKR1C2__Homo_sapiens__NP_001128713
auggacagcaaguaccagugcgugaagcugaacgacggccacuucaugcccguccucggguucggcaccuacgccccggccgaggugcccaaguccaaggcgcuggaggccgugaagcuggccaucgaggccggguuccaccacaucgacagcgcccacgucuacaacaacgaggagcaggucggccucgcgauccgcuccaagaucgccgacgggagcgugaagcgggaggacaucuucuacaccuccaagcuguggagcaacucccaccgccccgagcuggugcggcccgcccucgagcgcagccugaagaaccugcagcucgacuacguggaccuguaccugauccacuucccgguguccgucaaggaggacaucggcauccucacguggaagaagucccccaagcacaacagcuga

SEQ ID NO: 26525 - RNA, 972 nt, Artificial Sequence
  derived and/or modified sequence opt1 from AKR1C3__Homo_sapiens__NP_001240837
auggacagcaagcaccagugccugaagcucaacgacggccacuucaugcccgugcugggguucggcaccuacgccccgcccgaggugccccgcuccaaggcccuggaggugaccaagcucgcgaucgaggccggguuccggcacaucgacagcgcccaccuguacaacaacgaggagcaggucggccuggccauccgcuccaagaucgccgacgggagcgugaagcgggaggacaucuucuacacguccaagcucuggagcaccuuccaccgccccgagcuggugcggccggcgcuggagaacucccucaagaaggcccagcuggacuacguggaccuguaccucauccacagccccaugucccugaagcccggcgaggagcugagccccaccgacgagaacggcaaggucaucuucgacaucguggaccucugcaccacgugggaggccauggagaagugcaaggacgccgggcuggcgaaguccaucggcgugagcaacuucaaccgccggcagcuggagaugauccucaacaagccggggcugaaguacaagcccgucugcaaccagguggagugccaccccuacuucaaccgcuccaagcugcucgacuucugcaagagcaaggacaucgugcuggucgccuacuccgcccugggcagccagcgggacaagcgcuggguggaccccaacuccccggugcuccuggaggaccccguccugugcgcccucgccaagaagcacaagcggacccccgcgcugaucgcccugcgcuaccagcuccagcgcgggguggugguccuggccaagagcuacaacgagcagcggauccggcagaacguccagguguucgaguuccagcugaccgccgaggacaugaaggccaucgacggccucgaccgcaaccugcacuacuucaacuccgacagcuucgcgagccaccccaacuacccguacuccgacgaguacuga

SEQ ID NO: 26526 - RNA, 972 nt, Artificial Sequence
  derived and/or modified sequence opt1 from AKR1C4__Homo_sapiens__NP_001809
auggaccccaaguaccagcgcguggagcugaacgacggccacuucaugccgguccucggguucggcaccuacgccccgcccgaggugccccggaaccgcgccguggaggucaccaagcuggcgaucgaggccggguuccggcacaucgacagcgccuaccuguacaacaacgaggagcaggucggccucgccauccgcuccaagaucgccgacgggagcgugaagcgggaggacaucuucuacacguccaagcuguggugcaccuucuuccagccccagauggugcagcccgcgcuggagagcucccucaagaagcugcagcuggacuacguggaccucuaccugcugcacuuccccauggcccucaagcccggcgagaccccgcugcccaaggacgagaacggcaaggugaucuucgacaccgucgaccugagcgccacgugggaggugauggagaagugcaaggacgccgggcucgcgaaguccaucggcgugagcaacuucaacugccgccagcuggagaugauccugaacaagcccgggcucaaguacaagcccgucugcaaccagguggagugccacccguaccugaaccaguccaagcugcucgacuucugcaagagcaaggacaucgugcuggucgcccacuccgcccugggcacccagcggcacaagcucuggguggaccccaacagccccgugcugcuggaggaccccguccucugcgcccuggccaagaagcacaagcgcaccccggcgcugaucgcccuccgguaccagcugcagcgcgggguggugguccuggccaaguccuacaacgagcagcggauccgcgagaacauccagguguucgaguuccagcucaccagcgaggacaugaaggugcuggacggccugaaccggaacuaccgcuacgucgugauggacuuccucauggaccaccccgacuaccccuucuccgacgaguacuga

SEQ ID NO: 26527 - RNA, 858 nt, Artificial Sequence
  derived and/or modified sequence opt1 from AKR1D1__Homo_sapiens__NP_001177835
auggaccugagcgccgccucccaccgcaucccccucagcgacggcaacuccaucccgaucaucgggcugggcaccuacagcgagcccaaguccacccccaagggggcgugcgccacgagcgugaaggucgccaucgacaccggcuaccggcacaucgacggggccuacaucuaccagaacgagcacgaggugggcgaggccauccgcgagaagaucgcggagggcaaggugcggcgcgaggacaucuucuacugcgggaagcugugggccaccaaccacguccccgagauggugcggccgacccucgagcgcacgcugcgggugcugcagcucgacuacgucgaccuguacaucaucgaggugcccauggccuucaagcccggcgacgagaucuacccccgcgacgagaacgggaaguggcuguaccacaaguccaaccucugcgccaccugggagguggagugccacccguacuucacccagcccaagcugcugaaguucugccagcagcacgacaucgucaucaccgcguacagcccccucggcacgucccggaaccccaucugggugaacgugagcuccccgccccugcugaaggacgcccuccugaacagccuggggaagcgcuacaacaagaccgccgcccagaucguccuccgguucaacauccagcgcggcgugguggucauccccaaguccuucaaccuggagcggaucaaggagaacuuccagaucuucgacuucagccugaccgaggaggagaugaaggacaucgaggcccucaacaagaacgugcgcuucguggagcugcugauguggcgggaccaccccgaguacccguuccacgacgaguacuga

SEQ ID NO: 26528 - RNA, 963 nt, Artificial Sequence
  derived and/or modified sequence opt1 from AKR1E2__Homo_sapiens__NP_001035267
augggcgacauccccgccguggggcugagcuccuggaaggccagcccgggcaaggucaccgaggcggugaaggaggccaucgacgccggguaccgccacuucgacugcgccuacuucuaccacaacgagcgggaggugggcgccgggauccgcugcaagaucaaggagggcgcgguccggcgcgaggaccucuucaucgccaccaagcuguggugcacgugccacaagaagucccugguggagaccgccugccgcaagagccucaaggcccugaagcugaacuaccucgaccuguaccugauccacuggcccaugggcuucaagccgccccaccccgaguggaucauguccugcagcgagcucuccuucugccugagccacccccgggugcaggaccugccccucgacgaguccaacauggucauccccagcgacaccgacuuccuggacaccugggaggcgauggaggaccuggugaucacggggcucgugaagaacaucggcgucuccaacuucaaccacgagcagcuggagcggcugcucaacaagccggggcugcgcuucaagccccugaccaaccagaucgagugccaccccuaccucacccagaagaaccugaucagcuucugccagucccgggacgugagcgugaccgccuaccgcccccugggcggguccugcgagggcgucgaccucaucgacaacccggugaucaagcggaucgccaaggagcacggcaagagccccgcccagauccugauccgcuuccagauccagcggaacgugaucgucauccccggguccaucacgcccagccacaucaaggagaacauccagguguucgacuucgagcugacccagcacgacauggacaacauccucucccugaaccgcaaccugcggcucgccauguucccgaucaccaagaaccacaaggacuaccccuuccacaucgaguacuga

SEQ ID NO: 26529 - RNA, 519 nt, Artificial Sequence
  derived and/or modified sequence opt1 from AKR7A3__Homo_sapiens__XP_011539349
augagccgccagcugucccgggcccgccccgccaccgugcucggcgcgauggagauggggcggcgcauggacgccccgaccagcgccgccgucacgcgggccuuccuggagcgcggccacaccgagaucgacaccgcguucguguacuccgaggggcagagcgagaccauccugggcgggcucggccugcggcugggcggguccgacugccgcgugaagaucgacacgaaggccaucccccucuucggcaacagccugaagcccgacucccugcgguuccagcucgagaccagccugaagcgccugcagugcccccgggucgaccucuucuaccugcacaugccggaccacuccacccccguggaggagacccugcgcgccugccaccagcuccaccaggaggggaaguucguggagcugggccugagcaacuacgccgcgugggaggucgccgagaucugcacgcucugcaaguccaacggguggauccugcccaccguguaccagggcgccugcuga

SEQ ID NO: 26530 - RNA, 1443 nt, Artificial Sequence
  derived and/or modified sequence opt1 from AKT1__Homo_sapiens__NP_001014431
augagcgacguggccaucgucaaggagggcuggcugcacaagcgcggggaguacaucaagaccuggcggccccgcuacuuccuccugaagaacgacggcaccuucaucggguacaaggagcggccgcaggacguggaccagcgcgaggcgccccugaacaacuucuccguggcccagugccagcucaugaagacggagcggccccgccccaacaccuucaucauccggugccugcaguggaccaccgucaucgagcgcacguuccacguggagaccccggaggagcgggaggaguggaccaccgccauccagacgguggccgacggccugaagaagcaggaggaggaggagauggacuuccgcagcgggucccccagcgacaacuccggcgccgaggagauggaggucagccucgccaagcccaagcaccgggugaccaugaacgaguucgaguaccugaagcugcucggcaaggggaccuucggcaaggugauccuggucaaggagaaggcgaccgggcgcuacuacgccaugaagauccugaagaaggaggugaucguggccaaggacgaggucgcccacacgcucaccgagaaccgggugcugcagaacucccgccaccccuuccugaccgcgcucaaguacagcuuccagacccacgaccggcugugcuucgugauggaguacgccaacggcggggagcuguucuuccaccucucccgcgagcgggucuucagcgaggaccgcgcccgguucuacggcgccgagaucguguccgcccuggacuaccugcacagcgagaagaacguggucuaccgcgaccucaagcuggagaaccugaugcucgacaaggacggccacaucaagaucacggacuucgggcugugcaaggagggcaucaaggacggggcgaccaugaagaccuucugcggcaccccggaguaccuggcccccgaggugcucgaggacaacgacuacggccgggccguggacuggugggggcugggcgucgugauguacgagaugaugugcgggcgccugcccuucuacaaccaggaccacgagaagcuguucgagcucauccugauggaggagauccgcuucccccggacgcucggcccggaggccaagucccugcugagcgggcuccugaagaaggaccccaagcagcgccugggcggcggguccgaggacgccaaggagaucaugcagcaccgguucuucgcgggcaucguguggcagcacgucuacgagaagaagcucagcccgcccuucaagccccaggugaccuccgagaccgacacccgcuacuucgacgaggaguucacggcccagaugaucaccaucaccccgcccgaccaggacgacagcauggagugcgucgacuccgagcggcgcccccacuucccccaguucagcuacagcgccuccgggaccgccuga

SEQ ID NO: 26531 - RNA, 771 nt, Artificial Sequence
  derived and/or modified sequence opt1 from AKT1S1__Homo_sapiens__NP_001092103
auggccagcggccgccccgaggagcugugggaggccguggucggggcggccgagcgguuccgcgcccggaccggcaccgagcucgugcugcugacggccgccccgcccccccccccgcgccccgggcccugcgcguacgccgcccacggccggggggcccucgcggaggccgcccgccggugccugcacgacaucgcccuggcccaccgcgcggccaccgccgcccggcccccggcccccccccccgcgccgcagccccccucccccaccccgagccccccccgccccacccucgcccgggaggacaacgaggaggacgaggacgagccgacggagaccgagaccuccggcgagcagcugggcaucagcgacaacgggggccuguucgugauggacgaggacgccacccuccaggaccugccccccuucugcgaguccgaccccgagagcacggacgacgggucccugagcgaggagaccccggccggcccccccaccugcuccguccccccggccagcgcgcuccccacccagcaguacgccaagucccugcccgugagcgugccggucuggggguucaaggagaagcgcacggaggcccgguccagcgacgaggagaacggcccccccuccagccccgaccuggaccgcaucgccgccuccaugcgggcgcucgugcugcgcgaggccgaggacacccagguguucggcgaccugccgcggccccgccucaacaccagcgacuuccagaagcugaagcggaaguacuga

SEQ ID NO: 26532 - RNA, 1260 nt, Artificial Sequence
  derived and/or modified sequence opt1 from AKT2__Homo_sapiens__NP_001229957
augaagaccgagcgcccccggcccaacaccuucgugauccgcugccugcaguggacgaccgucaucgagcggaccuuccacguggacagccccgacgagcgcgaggaguggaugcgggccauccagaugguggccaacucccucaagcagcgcgcgcccggcgaggaccccauggacuacaagugcgggagcccguccgacagcuccaccacggaggagauggaggucgccgugagcaaggcccgggccaaggugaccaugaacgacuucgacuaccugaagcugcucggcaaggggaccuucggcaaggucauccuggugcgcgagaaggccaccgggcgguacuacgcgaugaagauccugcgcaaggaggugaucaucgccaaggacgaggucgcccacacggugaccgagucccgggugcuccagaacacccgccaccccuuccugaccgcccugaaguacgcguuccagacgcacgaccggcucugcuucgucauggaguacgccaacggcggcgagcuguucuuccaccugagccgcgagcggguguucaccgaggagcgcgcccgguucuacggggccgagaucguguccgcccucgaguaccugcacagccgcgacgucguguaccgggacaucaagcuggagaaccucaugcuggacaaggacggccacaucaagaucaccgacuucgggcugugcaaggagggcaucuccgacggggcgaccaugaagacguucugcggcacccccgaguaccucgcccccgaggugcuggaggacaacgacuacggccgcgccgucgacuggugggggcugggcguggugauguacgagaugaugugcgggcggcucccguucuacaaccaggaccacgagcgccuguucgagcugauccucauggaggagauccgcuucccccggacccugagccccgaggccaagucccugcucgccggccugcugaagaaggaccccaagcagcgccucggcgggggcccgagcgacgcgaaggaggucauggagcaccgguucuuccuguccaucaacuggcaggacguggugcagaagaagcugcucccgcccuucaagccccaggucaccagcgagguggacacgcgcuacuucgacgacgaguucaccgcccaguccaucaccaucaccccgcccgaccgguacgacagccuggggcugcucgagcuggaccagcgcacgcacuucccccaguucuccuacagcgccagcauccgggaguga

SEQ ID NO: 26533 - RNA, 1398 nt, Artificial Sequence
  derived and/or modified sequence opt1 from AKT3__Homo_sapiens__NP_001193658
augagcgacgugaccaucgucaaggagggcugggugcagaagcgcggggaguacaucaagaacuggcggccccgcuacuuccugcucaagaccgacggcuccuucaucggguacaaggagaagccccaggacguggaccugcccuacccccugaacaacuucagcgucgccaagugccagcucaugaagacggagcggcccaagccgaacaccuucaucauccgcugccugcaguggaccaccgugaucgagcggacguuccacguggacacccccgaggagcgcgaggaguggaccgaggccauccaggcggucgccgaccggcugcagcgccaggaggaggagcggaugaacugcucccccaccagccagaucgacaacaucggcgaggaggagauggacgccuccacgacccaccacaagcgcaagaccaugaacgacuucgacuaccucaagcugcuggggaagggcaccuucggcaaggugauccucgugcgggagaaggccagcgggaaguacuacgccaugaagauccugaagaaggaggucaucaucgcgaaggacgagguggcccacacgcugaccgagucccgcgugcucaagaacacccggcaccccuuccugaccagccugaaguacuccuuccagacgaaggaccgccucugcuucgucauggaguacgugaacggcggggagcuguucuuccaccugagccgggagcgcguguucuccgaggaccggacccgcuucuacggcgccgagaucgucagcgcccucgacuaccugcacuccgggaagaucguguaccgggaccugaagcucgagaaccugaugcuggacaaggacggccacaucaagaucaccgacuucggccucugcaaggaggggaucaccgacgcggccacgaugaagaccuucugcggcaccccggaguaccuggcccccgaggugcuggaggacaacgacuacgggcgcgccgucgacugguggggccucggcguggugauguacgagaugaugugcgggcggcugcccuucuacaaccaggaccacgagaagcuguucgagcucauccugauggaggacaucaaguucccccgcacccugagcuccgacgccaagagccuccuguccggccugcucaucaaggacccgaacaagcgccucgggggcgggcccgacgacgcgaaggagaucaugcggcacagcuucuucuccggcgucaacuggcaggacguguacgacaagaagcuggugccgcccuucaagccccaggucacgagcgagaccgacacccgcuacuucgacgaggaguucaccgcccagacgaucaccaucaccccgcccgagaagugccagcagagcgacugcggcaugcuggggaacuggaagaaguga

SEQ ID NO: 26534 - RNA, 879 nt, Artificial Sequence
  derived and/or modified sequence opt1 from AKTIP__Homo_sapiens__NP_071921
augaaccccuucuggagcauguccaccagcuccgugcgcaagcggagcgagggcgaggagaagacccugacgggggacgucaagaccuccccgccccgcaccgcccccaagaagcagcuccccagcaucccgaagaacgcccugcccaucaccaagcccacgucccccgcgccggccgcccagagcaccaacggcacccacgccuccuacgggcccuucuaccuggaguacagccuccuggccgaguucacccugguggugaagcagaagcuccccggcgucuacgugcagcccuccuaccggagcgcgcugaugugguucggggugaucuucauccgccacggccuguaccaggacggcgucuucaaguucacgguguacaucccggacaacuaccccgacggggacugcccccggcucguguucgacauccccgucuuccacccgcugguggaccccaccuccggcgagcuggacgugaagcgcgccuucgccaaguggcggcgcaaccacaaccacaucuggcagguccucauguacgcccggcgcguguucuacaagaucgacaccgcgagcccccugaaccccgaggccgccgugcuguacgagaaggacauccagcuguucaaguccaaggucguggacagcgugaaggucugcaccgcccgccucuucgaccagccgaagaucgaggaccccuacgccaucuccuucagccccuggaaccccuccgugcacgacgaggcgcgggagaagaugcugacgcagaagaagccggaggagcagcacaacaagagcgugcacgucgccgggcucagcugggugaagcccggcuccgugcagcccuucagcaaggaggagaagaccgucgccaccuga

SEQ ID NO: 26535 - RNA, 993 nt, Artificial Sequence
  derived and/or modified sequence opt1 from ALAD__Homo_sapiens__NP_000022
augcagccccagagcgugcugcacuccggcuacuuccacccgcuccugcgcgccuggcagaccgccaccacgacccugaacgcgagcaaccucaucuaccccaucuucgucaccgacgugcccgacgacauccagcccaucaccucccugccggggguggcccgguacggcgucaagcgccuggaggagaugcuccggccccugguggaggaggggcugcgcugcgugcucaucuucggcguccccagccgggugcccaaggacgagcgcggguccgccgccgacagcgaggaguccccggccaucgaggcgauccaccuccugcggaagacguuccccaaccugcugguggccugcgacgucugccugugccccuacaccagccacggccacugcggccuccuguccgagaacggggccuuccgcgccgaggagagccggcagcgccuggcggagguggcccucgccuacgccaaggccggcugccagguggucgcgcccuccgacaugauggacgggcggguggaggccaucaaggaggcccugauggcccacggccuggggaaccgcgugagcgucauguccuacagcgccaaguucgcguccugcuucuacggcccguuccgggacgccgccaagagcucccccgccuucggcgaccgccggugcuaccagcucccgcccggggcccgcggccuggcgcugcgggccguggaccgcgacgugcgggagggggccgacaugcucauggucaagcccggcaugcccuaccuggacaucgugcgcgaggugaaggacaagcaccccgaccugccccucgccgucuaccacgugagcggcgaguucgccaugcuguggcacggggcgcaggccggcgccuucgaccugaaggccgcggugcucgaggccaugaccgccuuccggcgcgccggggccgacaucaucaucaccuacuacacgccgcagcugcugcaguggcucaaggaggaguga

SEQ ID NO: 26536 - RNA, 1923 nt, Artificial Sequence
  derived and/or modified sequence opt1 from ALAS1__Homo_sapiens__NP_001291372
auggagagcgugguccgccggugccccuuccugucccgcgugccgcaggccuuccuccagaaggccggcaagagccugcuguucuacgcgcagaacugccccaagaugauggaggugggggccaagcccgcgccccgggcccucuccaccgccgccguccacuaccagcagaucaaggagaccccgcccgccagcgagaaggacaagaccgccaaggccaaggugcagcagacccccgacggcucccagcagagccccgacgggacccagcugccguccggccacccccugcccgcgaccagccaggggaccgccuccaagugccccuuccucgccgcccagaugaaccagcgcggcagcuccguguucugcaaggccagccuggagcugcaggaggacguccaggagaugaacgcggugcggaaggagguggccgagaccuccgccggcccgagcgucguguccgugaagaccgacgggggcgaccccagcgggcuccugaagaacuuccaggacaucaugcagaagcagcgccccgagcgggucucccaccuccuccaggacaaccugcccaagagcguguccaccuuccaguacgaccgcuucuucgagaagaagaucgacgagaagaagaacgaccacacguaccggguguucaagaccgucaaccgccgggcccacaucuucccgauggccgacgacuacagcgacagccugaucaccaagaagcaggucuccguguggugcagcaacgacuaccucggcaugucccgccacccccgggugugcggggcggugauggacacccugaagcagcacggcgccggcgccgggggcacgcgcaacaucagcgggaccuccaaguuccacguggaccuggagcgggagcucgccgaccugcacggcaaggacgccgcgcugcuguucagcuccugcuucgucgccaacgacagcacccuguucacccuggccaagaugaugcccggcugcgagaucuacuccgacagcgggaaccacgccuccaugauccagggcauccgcaacagccgggugcccaaguacaucuuccgccacaacgacgugucccaccuccgggagcugcugcagcgcagcgacccguccguccccaagaucguggccuucgagacgguccacagcauggacggggcggugugcccccucgaggagcugugcgacguggcccacgaguucggcgccaucaccuucgucgacgaggugcacgccguggggcuguacggcgcgcggggcgggggcaucggggaccgcgacggcgucaugcccaagauggacaucaucuccgggacccucggcaaggccuucggcugcgucgggggcuacaucgccagcaccuccagccugaucgacacggugcgcagcuacgccgccggguucaucuucaccaccucccugccgcccaugcuccuggcgggcgcccuggagagcgugcggauccucaaguccgccgaggggcgcgugcugcggcgccagcaccagcggaacgugaagcugaugcgccagaugcucauggacgccggccugcccgucgugcacugccccagccacaucaucccggugcgggucgccgacgcggccaagaacaccgaggugugcgacgagcugaugucccgccacaacaucuacgugcaggccaucaacuaccccacggucccccggggcgaggagcuccugcgcaucgccccgacgccccaccacacgccccagaugaugaacuacuuccuggagaaccuccuggugaccuggaagcaggucgggcuggagcucaagccccacagcuccgccgagugcaacuucugccggcgcccgcugcacuucgaggugaugagcgagcgggagaaguccuacuucagcggccuguccaagcuggugagcgcgcaggccuga

SEQ ID NO: 26537 - RNA, 1764 nt, Artificial Sequence
  derived and/or modified sequence opt1 from ALAS2__Homo_sapiens__NP_000023
auggugaccgccgccaugcugcuccagugcugccccguccuggcgcgcggcccgaccagccugcucgggaagguggugaagacgcaccaguuccuguucggcaucgggcggugccccauccuggccacccagggccccaacugcucccagauccaccucaaggccaccaaggccgggggcgacagccccuccugggccaagggccacugcccguucaugcugagcgagcugcaggacgggaaguccaagaucguccagaaggcggcccccgaggugcaggaggacgugaaggccuucaagaccgaccuccccagcucccuggucagcgugucccugcgcaagcccuucagcggcccgcaggagcaggagcagaucuccgggaaggugacgcaccucauccagaacaacaugcccggcaacuacgucuucagcuacgaccaguucuuccgggacaagaucauggagaagaagcaggaccacaccuaccgcguguucaagaccgugaaccggugggccgacgcguaccccuucgcccagcacuucuccgaggccagcgucgccuccaaggacgugagcguguggugcuccaacgacuaccuggggaugagccgccacccccagguccugcaggccacccaggagacgcuccagcggcacggcgcgggcgccgggggcacccgcaacaucuccgggaccagcaaguuccacguggagcuggagcaggagcuggccgagcuccaccagaaggacagcgcccugcuguucuccagcugcuucguggccaacgacuccacccucuucacgcuggcgaagauccugccgggcugcgagaucuacagcgacgccggcaaccacgccuccaugauccaggggauccggaacagcggcgccgccaaguucgucuuccgccacaacgaccccgaccaccucaagaagcugcuggagaaguccaaccccaagauccccaagaucguggcguucgagaccgugcacagcauggacggggccaucugcccgcucgaggagcugugcgacgucucccaccaguacggcgcccugaccuucguggacgaggugcacgccgucgggcucuacggcagccggggcgccgggaucggcgagcgcgacgggaucaugcacaagaucgacaucaucuccggcacccuggggaaggcguucggcugcgugggcggguacaucgccagcacgcgggaccuggucgacauggugcgcuccuacgccgccggcuucaucuucaccaccagccucccgcccauggugcuguccggggcgcuggagagcguccggcuccugaagggcgaggaggggcaggcccugcgccgggcccaccagcgcaacgugaagcacaugcggcagcuccugauggaccgcggccugcccgugauccccugccccucccacaucauccccauccgggucggcaacgccgcccucaacagcaagcugugcgaccugcuccuguccaagcacgggaucuacgugcaggcgaucaacuaccccaccgugccgcgcggcgaggagcugcuccgccuggcccccagcccccaccacagcccccagaugauggaggacuucgucgagaagcugcugcucgccuggacggccguggggcugccgcugcaggacguguccgucgccgcgugcaacuucugccggcgccccgugcacuucgagcucaugagcgagugggagcgguccuacuucggcaacaugggcccccaguacgugaccaccuacgccuga

SEQ ID NO: 26538 - RNA, 1830 nt, Artificial Sequence
  derived and/or modified sequence opt1 from ALB__Homo_sapiens__NP_000468
augaagugggugaccuucaucagccuccuguuccuguucuccagcgccuacucccgcggcgucuuccggcgcgacgcccacaagagcgagguggcgcaccgguucaaggaccugggggaggagaacuucaaggcccucgugcugaucgccuucgcccaguaccugcagcagugccccuucgaggaccacgucaagcucgugaacgaggugaccgaguucgccaagacgugcgucgcggacgaguccgccgagaacugcgacaagagccugcacacccuguucggcgacaagcucugcaccguggccacccugcgcgagacguacggggagauggccgacugcugcgcgaagcaggagccggagcggaacgagugcuuccugcagcacaaggacgacaaccccaaccucccccgccuggugcggcccgaggucgacgugaugugcaccgccuuccacgacaacgaggagaccuuccugaagaaguaccucuacgagaucgcccgccggcacccguacuucuacgcccccgagcugcuguucuucgccaagcgcuacaaggcggccuucaccgagugcugccaggccgccgacaaggccgcgugccuccugcccaagcuggacgagcuccgggacgagggcaaggccuccagcgccaagcagcgccugaagugcgccucccugcagaaguucggggagcgggccuucaaggcgugggccguggcccgccucagccagcgguuccccaaggccgaguucgccgaggucuccaagcuggugacggaccugaccaaggugcacaccgagugcugccacggcgaccuccuggagugcgcggacgaccgcgccgaccuggccaaguacaucugcgagaaccaggacagcaucuccagcaagcucaaggagugcugcgagaagccgcugcuggagaagucccacugcaucgccgaggucgagaacgacgagaugcccgcggaccuccccagccuggccgccgacuucguggaguccaaggacgugugcaagaacuacgccgaggccaaggacgucuuccugggcauguuccucuacgaguacgcgcggcgccaccccgacuacagcguggugcugcugcuccggcuggccaagaccuacgagacgacccuggagaagugcugcgccgccgccgacccgcacgagugcuacgcgaaggucuucgacgaguucaagccccucguggaggagccccagaaccugaucaagcagaacugcgagcuguucgagcagcucggggaguacaaguuccagaacgcccugcuggugcgcuacaccaagaaggucccccagguguccaccccgacgcucgucgaggugagccggaaccugggcaagguggggagcaagugcugcaagcaccccgaggccaagcgcaugcccugcgccgaggacuaccuguccgucgugcugaaccagcucugcgugcugcacgagaagacccccgucagcgaccgcgugaccaagugcugcaccgagucccuggugaaccggcgcccgugcuucagcgcccucgaggucgacgagacguacgugcccaaggaguucaacgcggagaccuucaccuuccacgccgacaucugcacccuguccgagaaggagcggcagaucaagaagcagacggcccugguggagcucgucaagcacaagcccaaggccaccaaggagcagcugaaggcggugauggacgacuucgccgccuucguggagaagugcugcaaggccgacgacaaggagaccugcuucgccgaggagggcaagaagcuggucgcggccagccaggccgcccucgggcuguga

SEQ ID NO: 26539 - RNA, 1713 nt, Artificial Sequence
  derived and/or modified sequence opt1 from ALCAM__Homo_sapiens__NP_001230209
auggagagcaagggcgccuccagcugccgccuccucuucugccugcugaucuccgccaccguguuccggcccgggcucggcugguacaccgucaacagcgcguacggggacacgaucaucaucccgugccgccuggacgugccccagaaccugauguucggcaaguggaaguacgagaagcccgacgggucccccguguucaucgccuuccggagcuccaccaagaaguccguccaguacgacgacgugccggaguacaaggaccgccucaaccugagcgagaacuacacccugagcaucuccaacgcccggaucagcgacgagaagcgcuucgugugcaugcucgucaccgaggacaacguguucgaggcccccacgaucgugaaggucuucaagcagcccuccaagcccgagaucgugagcaaggcccuguuccuggagaccgagcagcucaagaagcugggcgacugcaucuccgaggacagcuacccggacggcaacaucaccugguaccggaacgggaaggugcugcacccccucgagggcgcggucgugaucaucuucaagaaggagauggaccccgugacccagcuguacacgaugaccuccacccuggaguacaagaccacgaaggccgacauccagaugcccuucacgugcagcgucaccuacuacgggccguccggccagaagaccauccacagcgagcaggccguguucgacaucuacuaccccaccgagcaggucaccauccaggugcucccgcccaagaacgccaucaaggagggggacaacaucacccugaagugccugggcaacggcaacccgccgcccgaggaguuccucuucuaccugcccgggcagcccgagggcauccgcagcuccaacaccuacacgcugaccgacgugcggcgcaacgcgaccggggacuacaagugcagccucaucgacaagaaguccaugaucgccagcaccgccaucacggugcacuaccuggaccugucccucaaccccagcggcgaggucacccggcagaucggcgacgcccugcccguguccugcaccaucagcgccucccgcaacgcgaccguggucuggaugaaggacaacauccggcugcgcagcucccccagcuucuccagccuccacuaccaggacgccgggaacuacgugugcgagacggcccugcaggaggucgagggccugaagaagcgggagucccucacccugaucguggaggggaagccccagaucaagaugaccaagaagaccgaccccagcggccuguccaagacgaucaucugccacguggagggguuccccaagcccgccauccaguggaccaucaccggcagcggcuccgucaucaaccagaccgaggagagcccguacaucaacgggcgcuacuacagcaagaucaucaucucccccgaggagaacgugacgcugaccugcaccgccgagaaccagcuggagcggaccgugaacagccugaacgucuccgcgaacgagaaccgcgagaaggugaacgaccaggccaagcucaucgugggcaucgucguggggcugcugcucgccgcccugguggccggcgucguguacuggcuguacaugaagaaguccaagaccgcgagcaagcacgugaacaaggaccucgggaacauggaggagaacaagaagcuggaggagaacaaccacaagacggaggccuga

SEQ ID NO: 26540 - RNA, 2256 nt, Artificial Sequence
  derived and/or modified sequence opt1 from ALDH16A1__Homo_sapiens__NP_001138868
auggccgccacccgcgcgggcccccgggcccgcgagaucuucaccagccuggaguacgggccggugcccgagucccacgccugcgcccucgccuggcuggacacgcaggaccggugccugggccacuacgucaacgggaaguggcucaagcccgagcaccgcaacagcgugcccugccaggacccgaucaccggcgagaaccuggcguccugccugcaggcccaggccgaggacguggccgcggccgucgaggccgcccggauggccuucaagggguggagcgcgcaccccggcguggugcgcgcccagcaccucacccggcuggccgaggucauccagaagcaccagcgccugcucuggacccuggagucccuggugacgggccgggccgugcgcgagguccgggacggggacgugcagcucgcccagcagcugcugcacuaccacgcgauccaggccagcacccaggaggaggcccucgccggcugggagcccaugggggugaucggccugauccugcccccgaccuucuccuuccucgagaugauguggcgcaucugccccgcccuggcggucgggugcaccgugguggcccuggucccgcccgccagccccgcgccccuccugcuggcccagcucgccggcgagcugggccccuuccccgggauccugaacgugcucuccggcccggccagccuggugcccauccuggccucccagcccgggauccggaaggucgccuucugcggcgcgcccgagggcgggcuccgccugcugauccaggagagcgugugggacgaggccaugcggcgccuccaggagcggaugggccgccugcgguccgggcgcggccuggacggggccguggacaugggcgcccggggcgccgcggccugcgaccucguccagcgcuucgugcgcgaggcccagagccagggggcccagguguuccaggccggcgacgucccguccgagcggcccuucuacccgcccacgcuggugagcaaccugccgcccgcgucccccugcgcccaggucgaggugcccuggcccguggucguggccagccccuuccgcaccgccaaggaggcccuccugguggcgaacgggacgccccggggcggguccgccagcgucuggagcgagcgccugggccaggcccucgagcugggcuacgggcuccaggugggcaccguguggaucaacgcccacgggcugcgggacccguccguccccaccggcgggugcaaggagagcggcugcuccuggcacggcgggcccgacggccuguacgaguaccugcgccccagcgggaccccggcgcggcucuccugccugagcaagaaccugaacuacgacaccuucggccuggccgugcccuccacccuccccgccggccccgagaucgggccgagccccgccccgcccuacggccuguucgucgggggccgcuuccaggcccccggggcgcgguccagccgccccauccgggacuccagcggcaaccugcacggcuacguggccgagggcggggccaaggacauccgcggggccguggaggccgcgcaccaggccuuccccggcugggccgggcagucccccggcgcccgggccgcgcuccugugggcccuggccgccgcgcucgagcgccgcaagagcacgcuggccucccggcuggagcggcagggcgccgagcucaaggccgccgaggcggagguggagcugagcgcccgccggcugcgcgccuggggcgcccgcguccaggcccaggggcacacccuccagguggcggggcugcggggcccggugcugcgccuccgggagccccuggggguccuggccguggugugccccgacgaguggccccuccuggccuucgucucccugcucgccccggcccuggcguacggcaacaccguggugaugguccccagcgccgccugcccccugcucgcccuggaggugugccaggacauggccaccguguuccccgcgggccuggccaacgucgugacgggggaccgcgaccaccucacccggugccuggcccugcaccaggacgugcaggccaugugguacuucggcuccgcgcaggggagccaguucgucgagugggccagcgccggcaaccucaagccggugugggccucccgcgggugcccccgggccugggaccaggaggcggagggcgccggccccgagcuggggcugcgcguggcccggaccaaggcccucuggcugccgaugggcgacuga

SEQ ID NO: 26541 - RNA, 2382 nt, Artificial Sequence
  derived and/or modified sequence opt1 from ALDH18A1__Homo_sapiens__NP_001017423
augcugagccagguguaccgcugcggcuuccagcccuucaaccagcaccuccugccgugggucaagugcaccaccguguuccggucccacugcauccagcccagcgugauccgccacguccgguccuggagcaacauccccuucaucacggugccccugucccgcacccacggcaagagcuucgcccaccgguccgagcucaagcacgccaagcgcaucguggucaagcuggggagcgcgguggugacccgcggggacgagugcggccuggcccucgggcggcuggccuccaucgucgagcaggucagcgugcugcagaaccagggccgggagaugaugcucgugaccuccggcgccguggccuucgggaagcagcgccugcggcacgagauccugcucagccaguccgugcgccaggcgcugcacagcggccagaaccagcugaaggagauggccaucccgguccucgaggcccgggccugcgcggccgccgggcaguccggccugauggcccuguacgaggccauguucacgcaguacagcaucugcgcggcccagauccucgugaccaaccuggacuuccacgacgagcagaagcgccggaaccugaacgggacccuccacgagcugcugcgcaugaacaucgugcccaucgucaacaccaacgacgccguggugccgcccgccgagcccaacuccgaccuccagggcgucaucagcgugaaggacaacgacucccuggccgcgcggcuggccguggagaugaagacggaccuccugaucguccugagcgacguggagggccucuucgacagcccgcccggguccgacgacgccaagcugaucgacaucuucuaccccggcgaccagcagagcgucaccuucgggaccaagucccgcgugggcaugggcgggauggaggccaaggugaaggccgcgcugugggcccuccagggcgggaccagcgucgugaucgccaacggcacgcaccccaagguguccgggcacgucaucaccgacaucguggagggcaagaaggugggcaccuucuucagcgaggucaagcccgccgggcccaccguggagcagcagggcgagauggcccgguccgggggccgcaugcuggcgacgcuggagcccgagcagcgggccgagaucauccaccaccucgccgaccugcugaccgaccagcgcgacgagauccuccuggccaacaagaaggaccuggaggaggcggaggggcgccucgccgccccgcugcugaagcggcucagccuguccaccagcaagcugaacucccucgccaucggccugcgccagaucgccgcgagcucccaggacagcgugggccggguccugcgccggacccgcaucgccaagaaccuggagcucgagcaggucacggugcccaucggggugcugcuggugaucuucgagucccggcccgacugccucccccagguggccgcccuggccaucgcgagcggcaacgggcugcuccugaagggcgggaaggaggccgcccacuccaaccgcauccugcaccuccugacccaggaggcccugagcauccacggcgucaaggaggccgugcagcucgugaacacccgggaggaggucgaggaccugugccgccuggacaagaugaucgaccucaucaucccgcggggcuccagccagcuggugcgcgacauccagaaggcggccaaggggauccccgugaugggccacagcgaggggaucugccacauguacgucgacuccgaggccagcguggacaaggugacccggcugguccgcgacuccaagugcgaguaccccgccgcgugcaacgcccucgagacgcugcugauccaccgggaccuccugcgcacgccccuguucgaccagaucaucgacaugcuccggguggagcaggucaagauccacgccggcccgaaguucgccagcuaccugaccuucucccccagcgaggugaagucccugcgcaccgaguacggcgaccucgagcugugcaucgaggugguggacaacguccaggacgccaucgaccacauccacaaguacgggagcucccacaccgacgugaucgugaccgaggacgagaacaccgcggaguucuuccugcagcacgucgacagcgccugcguguucuggaacgccuccacccgguucagcgacggcuaccgcuucgggcucggcgccgagguggggaucuccacgagccgcauccacgcccggggccccgucggccuggaggggcugcucaccaccaaguggcugcugcgcggcaaggaccacgugguguccgacuucagcgagcacgggucccucaaguaccugcacgagaaccugcccaucccgcagcggaacaccaacuga

SEQ ID NO: 26542 - RNA, 1506 nt, Artificial Sequence
  derived and/or modified sequence opt1 from ALDH1A1__Homo_sapiens__NP_000680
augagcuccagcggcacccccgaccugccggugcuccugaccgaccugaagauccaguacacgaagaucuucaucaacaacgaguggcacgacuccgucagcgggaagaaguuccccguguucaaccccgccaccgaggaggagcucugccagguggaggagggcgacaaggaggacgucgacaaggccgugaaggcggcccgccaggccuuccagaucgggucccccuggcggaccauggacgccagcgagcgcggccggcugcuguacaagcucgccgaccugaucgagcgcgaccggcugcuccuggcgaccauggaguccaugaacgggggcaagcuguacagcaacgccuaccucaacgaccuggccggcugcaucaagacgcugcgcuacugcgccgggugggcggacaagauccagggccggaccaucccgaucgacgggaacuucuucaccuacacccgccacgagcccaucggcgugugcgggcagaucauccccuggaacuucccccucgucaugcugaucuggaagaucggcccggcccuguccugcggcaacacggugguggucaagcccgccgagcagacgccccucaccgcccugcacguggccagccugaucaaggaggcgggguucccgcccggcguggucaacaucgugcccggguacggccccaccgccggcgccgccaucuccagccacauggacaucgacaagguggccuucaccggguccaccgaggucggcaagcucaucaaggaggcggccggcaagagcaaccugaagcgggugacccuggagcucggcgggaagucccccugcaucgugcuggccgacgccgaccuggacaacgccgucgaguucgcgcaccacgggguguucuaccaccagggccagugcugcaucgccgccagccgcaucuucguggaggaguccaucuacgacgaguucguccggcgcagcguggagcgggccaagaaguacauccucgggaacccgcugacccccggcgugacgcaggggccccagaucgacaaggagcaguacgacaagauccuggaccucaucgaguccggcaagaaggagggggccaagcuggagugcggcggcgggcccuggggcaacaagggguacuucguccagccgaccguguucagcaacgucaccgacgagaugcgcaucgcgaaggaggagaucuucggccccgugcagcagaucaugaaguucaagagccuggacgacgugaucaagcgggccaacaacaccuucuacgggcucuccgccggcgucuucacgaaggacaucgacaaggccaucaccaucagcuccgcgcugcaggccggcaccgugugggugaacugcuacggggucgugagcgcccagugccccuucggcggguucaagauguccggcaacggccgcgagcugggggaguacggcuuccacgaguacaccgaggugaagacggucaccgugaagaucagccagaagaacuccuga

SEQ ID NO: 26543 - RNA, 1494 nt, Artificial Sequence
  derived and/or modified sequence opt1 from ALDH1A2__Homo_sapiens__NP_001193826
augaagaaccagugcgagaccguguggcucaagagccccaucaagcugaagcugaucuucaucaacaacgaguggcagaacuccgagagcggccgcgucuucccgguguacaaccccgccaccggggagcaggucugcgaggugcaggaggccgacaaggcggacaucgacaaggccgugcaggccgcccggcuggccuucucccucggcagcguguggcgccggauggacgcguccgagcgcgggcggcugcuggacaagcucgccgaccuggucgagcgcgaccgggccgugcuggccacgauggagagccucaacggcgggaagcccuuccugcaggcguucuacguggaccugcagggcgucaucaagaccuuccgcuacuacgccggcugggccgacaagauccacgggaugaccauccccguggacggcgacuacuucaccuucacgcggcacgagccgaucggggugugcggccagaucauccccuggaacuucccccuccugauguucgccuggaagaucgcccccgcgcugugcugcgggaacaccgucgugaucaagccggccgagcagacgccccucuccgcccuguacaugggcgcccugaucaaggaggccggcuucccgcccggggugaucaacauccuccccggcuacgggcccaccgcgggcgccgccaucgccagccacaucggcaucgacaagaucgccuucaccggguccaccgaggucggcaagcugauccaggaggcggccgggcgcagcaaccugaagcgggugacccucgagcugggcgggaagucccccaacaucaucuucgccgacgccgaccuggacuacgccguggagcaggcgcaccagggcgucuucuucaaccagggccagugcugcaccgccgggagccgcaucuucguggaggaguccaucuacgaggaguucgugcggcgcagcgucgagcgggccaagcgccggguggugggcucccccuucgacccgacgaccgagcaggggccccagaucgacaagaagcaguacaacaagauccucgagcugauccagagcggcgucgccgagggggcgaagcuggagugcggcggcaaggggcucggccgcaagggguucuucaucgagcccaccguguucuccaacgucaccgacgacaugcggaucgccaaggaggagaucuucggccccgugcaggagauccugcgcuucaagacgauggacgaggugaucgagcgggccaacaacagcgacuucgggcuggucgccgccguguucaccaacgacaucaacaaggcgcucaccguguccagcgccaugcaggccggcaccgucuggaucaacugcuacaacgcccugaacgcccagagcccguucggcggguucaagauguccggcaacgggcgcgagaugggcgaguucggccugcgcgaguacagcgaggugaagacggugaccgucaagaucccccagaagaacuccuga

SEQ ID NO: 26544 - RNA, 1539 nt, Artificial Sequence
  derived and/or modified sequence opt1 from ALDH1A3__Homo_sapiens__NP_000684
auggccaccgccaacggcgcgguggagaacgggcagcccgaccgcaagccgcccgcccugccccggcccauccgcaaccucgaggucaaguucaccaagaucuucaucaacaacgaguggcacgagagcaaguccggcaagaaguucgccacgugcaacccgagcacccgggagcagaucugcgagguggaggagggggacaagcccgacguggacaaggccgucgaggccgcccagguggcguuccagcgcggcucccccuggcggcgccuggacgcccugagccgggggcgccuccugcaccagcuggccgaccucguggagcgggaccgcgcgacccuggccgcccuggagaccauggacacgggcaagcccuuccuccacgccuucuucaucgaccuggagggcugcauccggacccugcgcuacuucgccgggugggcggacaagauccagggcaagaccaucccgaccgacgacaacgucgugugcuucacgcggcacgagcccaucggggugugcggcgccaucacccccuggaacuucccccuccugaugcuggucuggaagcucgccccggcccugugcugcgggaacaccauggugcugaagcccgccgagcagacgccccucaccgcgcuguaccugggcucccucaucaaggaggccggcuucccgcccgggguggucaacaucgugcccggcuucgggcccaccgugggcgccgccaucagcucccacccccagaucaacaagaucgccuucaccggcagcaccgaggucgggaagcuggugaaggaggcggccucccgcagcaaccugaagcgggugacgcucgagcugggcgggaagaacccgugcaucgucugcgccgacgccgaccuggaccucgccguggagugcgcgcaccagggcguguucuucaaccaggggcagugcugcaccgccgccucccgcgucuucguggaggagcaggucuacagcgaguucgugcggcgcuccguggaguacgccaagaagcggcccgucggcgaccccuucgacgugaagaccgagcagggcccccagaucgaccagaagcaguucgacaagauccuggagcugaucgagagcgggaagaaggagggcgcgaagcucgagugcgggggcuccgccauggaggacaaggggcuguucaucaagccgaccguguucagcgaggucacggacaacaugcgcaucgccaaggaggagaucuucggccccgugcagcccauccugaaguucaaguccaucgaggaggugaucaagcgggccaacagcaccgacuacggccucaccgccgcggucuucaccaagaaccuggacaaggcccugaagcucgccuccgcccuggagagcgggacgguguggaucaacugcuacaacgcccuguacgcgcaggcccccuucggcggguucaagaugagcggcaacgggcgcgagcucggcgaguacgcccuggccgaguacaccgaggugaagaccgucaccaucaagcugggcgacaagaacccguga

SEQ ID NO: 26545 - RNA, 1554 nt, Artificial Sequence
  derived and/or modified sequence opt1 from ALDH1B1__Homo_sapiens__NP_000683
augcugcgcuuccucgcgccccggcugcugagccuccagggccgcaccgcccgguacuccagcgccgccgcccugccgucccccauccugaaccccgacauccccuacaaccagcuguucaucaacaacgaguggcaggacgccgugagcaagaagaccuucccgacggucaaccccaccaccggggaggugaucggccacguggccgagggggaccgcgcggacgucgaccgggccgugaaggccgcccgcgaggcguuccggcucggcucccccuggcgccggauggacgccagcgagcgcgggcggcugcucaaccgccuggccgaccugguggagcgggaccgcgucuaccucgccucccuggagacccuggacaacggcaagcccuuccaggagagcuacgcccucgaccuggacgaggugaucaagguguaccgguacuucgcgggcugggccgacaaguggcacgggaagacgaucccgauggacggccagcacuucugcuucacccgccacgagcccgucggggugugcggccagaucauccccuggaacuucccccuggugaugcagggguggaagcucgccccggcccuggccaccggcaacaccgucgugaugaagguggcggagcagacgccccuguccgcccucuaccuggccagccugaucaaggaggccggcuucccgcccggggucgugaacaucaucaccggcuacgggcccaccgccggcgcggccaucgcccagcacguggacgucgacaagguggccuucaccggcuccacggagguggggcaccucauccagaaggccgcgggcgacagcaaccugaagcgggucacccuggagcucgggggcaagucccccagcaucgugcuggccgacgccgacauggagcacgccguggagcagugccacgaggcgcuguucuucaacauggggcagugcugcugcgccggcucccgcaccuucgucgaggagagcaucuacaacgaguuccucgagcggaccguggagaaggccaagcagcgcaaggucggcaaccccuucgagcuggacacgcagcaggggccccagguggacaaggagcaguucgagcgggugcugggcuacauccagcucgggcagaaggagggcgccaagcugcugugcgggggcgagcgcuucggcgagcgcggguucuucaucaagccgaccgucuucggcggggugcaggacgacaugcggaucgccaaggaggagaucuucggccccgugcagccccucuucaaguucaagaagaucgaggaggucguggagcgcgcgaacaacacccgguacgggcuggccgccgccguguucacccgcgaccuggacaaggccauguacuucacgcaggcgcuccaggccggcaccgucugggugaacaccuacaacaucgugaccugccacacgcccuucggcggguucaaggaguccggcaacgggcgggagcugggcgaggacggccugaaggccuacaccgaggucaagaccgugaccaucaaggugccgcagaagaacagcuga

SEQ ID NO: 26546 - RNA, 2739 nt, Artificial Sequence
  derived and/or modified sequence opt1 from ALDH1L1__Homo_sapiens__NP_001257293
auggccggccccagcaacccgcccgccaccaugaagaucgcggugaucgggcagucccuguucggccaggaggucuacugccaccuccgcaaggaggggcacgagguggugggcgucuucaccgugcccgacaaggacgggaaggccgacccccugggccuggaggccgagaaggacggcgugccggucuucaaguacagccgguggcgcgccaaggggcaggcccuccccgacgugguggcgaaguaccaggcccugggcgccgagcugaacguccuccccuucugcucccaguucauccccauggagaucaucagcgccccgcggcacggguccaucaucuaccaccccagccugcugccccgccaccggggcgcguccgccaucaacuggacgcucauccacggggacaagaagggcggcuucagcaucuucugggccgacgacgggcuggacaccggcgaccugcuccugcagaaggagugcgaggugcugcccgacgacaccguguccacccucuacaaccgcuuccuguucccggaggggaucaagggcaugguccaggccgugcggcugaucgccgagggcaaggcgccccgccucccccagcccgaggagggggccacguacgagggcauccagaagaaggagaccgccaagaucaacugggaccagccggccgaggccauccacaacuggauccgggggaacgacaaggugcccggcgcguggaccgaggccugcgagcagaagcugaccuucuucaacagcacgcugaacaccuccgggcucguccccgagggcgacgcccugcccaucccgggcgcccaccgccccgggguggugaccaaggccggccugauccucuucgggaacgacgacaagaugcugcuggucaagaacauccagcucgaggacggcaagaugauccuggcgagcaacuucuucaagggggccgccuccagcgugcuggagcucaccgaggccgagcuggugacggccgaggcgguccgguccguguggcagcgcauccugcccaaggugcucgaggucgaggacagcaccgacuucuucaaguccggcgccgccagcguggacgucgugcggcugguggaggaggucaaggagcugugcgacggccucgagcuggagaacgaggacguguacauggccuccaccuucggggacuucauccagcugcucgugcgcaagcugcggggcgacgacgaggagggggagugcagcaucgacuacgucgagauggcggugaacaagcgcaccgugcggaugccccaccagcuguucaucggcggggaguucgucgacgccgagggcgccaagacgagcgagaccaucaacccgaccgacggcuccgugaucugccaggugagccucgcccaggucaccgacguggacaaggccguggcggccgccaaggacgccuucgagaacgggcgcuggggcaagaucuccgcccgggaccgcgggcggcugauguaccgccuggcggaccucauggagcagcaccaggaggagcuggccacgaucgaggcccuggacgccggcgccgucuacacccucgcgcugaagacccacgugggcaugagcauccagaccuuccgcuacuucgccggguggugcgacaagauccagggcuccacgauccccaucaaccaggcccggcccaaccgcaaccugacccugacccggaaggagcccgugggggucugcggcaucaucaucccguggaacuacccccucaugaugcugagcuggaagaccgccgcgugccuggccgccgggaacacgguggugaucaagcccgcccaggucaccccgcucaccgcccugaaguucgcggagcugacccucaaggccggcauccccaagggcguggugaacguccugcccggguccggcagccugguggggcagcgccucuccgaccaccccgacgugcggaagaucggcuucacggggagcaccgaggucggcaagcacaucaugaaguccugcgccaucagcaacgugaagaaggugucccuggagcugggcggcaagagcccgcucaucaucuucgccgacugcgaccugaacaaggccguccagauggggauguccagcguguucuucaacaagggggagaacugcaucgcggccggccgccuguucguggaggacuccauccacgacgaguucguccggcgcgugguggaggagguccggaagaugaagguggggaacccccucgaccgcgacaccgaccacggcccccagaaccaccacgcccaccuggugaagcugauggaguacugccagcacggcgucaaggagggggccacccucgugugcggcgggaaccaggugccccggccgggcuucuucuucgagcccacggucuucaccgacguggaggaccacauguucaucgccaaggaggagagcuucgggcccgugaugaucaucucccgcuucgcggacggcgaccuggacgccguccugagccgggccaacgccaccgaguucggccucgcgagcgggguguucacccgcgacaucaacaaggcccuguacguguccgacaagcugcaggccggcaccgucuucgugaacacguacaacaagaccgacguggccgcccccuucgggggcuucaagcagagcggcuucgggaaggaccucggcgaggcggcccugaacgaguaccugcgggucaagaccgugaccuucgaguacuga

SEQ ID NO: 26547 - RNA, 1554 nt, Artificial Sequence
  derived and/or modified sequence opt1 from ALDH2__Homo_sapiens__NP_000681
augcugcgcgccgccgcgcgguucggcccccgccucgggcggcgccugcugagcgccgccgccacccaggccgugccggcgcccaaccagcagcccgaggucuucugcaaccagaucuucaucaacaacgaguggcacgacgccgugucccggaagaccuuccccacggugaacccgagcaccggcgaggucaucugccagguggccgagggggacaaggaggacguggacaaggccgucaaggcggcccgcgccgccuuccagcucggcucccccuggcggcgcauggacgccagccaccgggggcgccugcugaaccggcucgcggaccugaucgagcgcgaccggaccuaccuggccgcccucgagacccuggacaacggcaagcccuacgugaucuccuaccugguggaccucgacaugguccugaagugccugcgcuacuacgccggcugggccgacaaguaccacgggaagacgauccccaucgacggcgacuucuucagcuacacccggcacgagccggugggggugugcggccagaucauccccuggaacuucccccuccugaugcaggcguggaagcuggggcccgcccucgccaccggcaacgucguggugaugaaggucgccgagcagaccccgcugacggcccuguacguggcgaaccucaucaaggaggccggcuucccgcccgggguggucaacaucgugcccggcuucgggcccaccgccggcgccgccaucgcgucccacgaggacguggacaaggucgccuucaccggcagcaccgagaucgggcgcgugauccagguggccgccggcuccagcaaccugaagcgggucacgcuggagcucgggggcaagucccccaacaucaucaugagcgacgcggacauggacugggccguggagcaggcccacuucgcccuguucuucaaccaggggcagugcugcugcgccggcucccgcaccuucguccaggaggacaucuacgacgaguucguggagcggagcguggcgcgcgccaagucccgggucgugggcaaccccuucgacagcaagaccgagcaggggccccagguggacgagacccaguucaagaagauccugggcuacaucaacacggggaagcaggagggcgccaagcuccugugcgggggcggcaucgccgccgaccgcggguacuucauccagccgaccgucuucggcgacgugcaggacgggaugaccaucgcgaaggaggagaucuucggccccgugaugcagauccugaaguucaagaccaucgaggaggucguggggcgcgccaacaacuccacguacggccucgccgccgccguguucaccaaggaccuggacaaggcgaacuaccugagccaggcccuccaggccggcaccgucugggugaacugcuacgacguguucggggcccagucccccuucggcggguacaagaugagcggcagcggccgggagcugggggaguacggccugcaggcguacaccgaggucaagacggugaccgugaaggucccccagaagaacuccuga

SEQ ID NO: 26548 - RNA, 1362 nt, Artificial Sequence
  derived and/or modified sequence opt1 from ALDH3A1__Homo_sapiens__NP_000682
augagcaagaucuccgaggccgugaagcgcgcccgggcggccuucagcuccggccgcacccggccccugcaguuccgcauccagcagcucgaggcccugcagcggcugauccaggagcaggagcaggagcucgucggggcccuggccgcggaccugcacaagaacgaguggaacgccuacuacgaggaggugguguacguccucgaggagaucgaguacaugauccagaagcugccggagugggccgccgacgagcccguggagaagacgccccagacccagcaggacgagcuguacauccacagcgagccccucggcgugguccuggugaucgggaccuggaacuacccguucaaccugaccauccagcccauggugggcgcgaucgccgccgggaacuccgucgugcucaagcccagcgagcuguccgagaacauggccagccugcucgccaccaucaucccccaguaccuggacaaggaccuguacccggugaucaacggcggcguccccgagacgaccgagcuccugaaggagcgcuucgaccacauccuguacaccggguccaccggcguggggaagaucaucaugacggcggccgccaagcaccucacccccgugacccuggagcugggcggcaagagccccugcuacgucgacaagaacugcgaccucgacguggccugccggcgcaucgccugggggaaguucaugaacuccggccagaccugcguggcgccggacuacauccugugcgaccccagcauccagaaccagaucgucgagaagcugaagaagucccucaaggaguucuacggggaggacgccaagaagucccgggacuacggccgcaucaucagcgcccggcacuuccagcgcgugauggggcugaucgagggccagaagguggccuacggcgggacgggcgacgccgcgacccgguacaucgcccccaccauccugaccgacgucgacccccagagcccggugaugcaggaggagaucuucgggcccgugcuccccaucgucugcgugcgcucccuggaggaggccauccaguucaucaaccagcgggagaagccccuggcccucuacauguucagcuccaacgacaaggucaucaagaagaugaucgccgagacgagcagcggcgggguggcggccaacgacgugaucguccacaucacccugcacucccugccguucggcggcguggggaacagcggcaugggguccuaccacggcaagaaguccuucgagaccuucagccaccgccggagcugccucgugcgcccccugaugaacgacgaggggcugaagguccgguacccgcccucccccgccaagaugacccagcacuga

SEQ ID NO: 26549 - RNA, 1458 nt, Artificial Sequence
  derived and/or modified sequence opt1 from ALDH3A2__Homo_sapiens__NP_000373
auggagcuggaggugcgccggguccgccaggccuuccucagcggccggucccgcccccugcgguuccgccugcagcagcucgaggcccugcggcgcauggugcaggagcgggagaaggacauccugaccgcgaucgccgccgaccucugcaagagcgaguucaacguguacucccaggaggucaucaccgugcugggggagaucgacuucaugcuggagaaccucccggagugggugacggccaagcccgucaagaagaacgugcugaccaugcuggacgaggccuacauccagccccagccccucggcgugguccugaucaucggggcguggaacuacccguucgugcugaccauccagccccucaucggcgccaucgccgccgggaacgcggugaucaucaagcccagcgagcuguccgagaacaccgccaagauccuggccaagcuccugccccaguaccuggaccaggaccucuacaucgucaucaacggcggcguggaggagacgaccgagcugcugaagcagcgcuucgaccacaucuucuacaccgggaacaccgccgugggcaagaucgucauggaggccgcggccaagcaccucacgccggugacccuggagcucgggggcaagagccccugcuacaucgacaaggacugcgaccuggacaucgugugccggcgcaucaccugggggaaguacaugaacugcggccagaccugcaucgcccccgacuacauccugugcgaggccucccugcagaaccagaucgucuggaagaucaaggagacggugaaggaguucuacggcgagaacaucaaggagagccccgacuacgagcggaucaucaaccuccgccacuucaagcggauccugucccugcucgaggggcagaagaucgccuucggcggggagaccgacgaggcgacccgcuacaucgccccgaccgugcugacggacgucgaccccaagaccaaggugaugcaggaggagaucuucggccccauccugcccaucgugccggucaagaacguggacgaggccaucaacuucaucaacgagcgggagaagccccucgcccuguacgucuucagccacaaccacaagcugaucaagcgcaugaucgacgagaccuccagcggcggggugaccggcaacgacgugaucaugcacuucacgcucaacuccuuccccuucgggggcgucgggagcuccggcaugggcgccuaccacgggaagcacagcuucgacaccuucucccaccagcggcccugccugcucaagagccugaagcgcgagggcgcgaacaagcugcgguacccgcccaacucccagagcaagguggacugggggaaguucuuccugcucaagcgcuucaacaaggagaagcugggccugcuccugcugaccuuccuggggaucguggccgccguccucgugaaggccgaguacuacuga

SEQ ID NO: 26550 - RNA, 1407 nt, Artificial Sequence
  derived and/or modified sequence opt1 from ALDH3B1__Homo_sapiens__NP_000685
auggacccccugggcgacacccuccgccggcugcgcgaggccuuccacgccgggcggacccgccccgcggaguuccgggccgcccagcugcagggccucgggcgcuuccugcaggagaacaagcagcugcuccacgacgcccuggcccaggaccugcacaagagcgcguucgaguccgaggugagcgaggucgccaucucccagggcgaggugacgcucgcccugcggaaccugcgcgccuggaugaaggacgagcgggugcccaagaaccucgcgacccagcuggacagcgccuucauccgcaaggagcccuucgggcugguccucaucaucgcccccuggaacuacccgcugaaccugacccucgugccccuggugggcgcccuggccgcgggcaacugcgucgugcucaagcccuccgagaucagcaagaacguggagaagauccuggccgagguccugccccaguacguggaccaguccugcuucgccgugguccucgggggcccgcaggagaccgggcagcugcuggagcaccgguucgacuacaucuucuucacgggcagcccccgcguggggaagaucgugaugaccgccgccgcgaagcaccucacccccgucacccuggagcugggcggcaagaaccccugcuacguggacgacaacugcgacccgcagacgguggccaaccgggucgccugguuccgcuacuucaacgccgggcagaccugcguggcccccgacuacgugcucugcucccccgagaugcaggagcggcugcugcccgcgcuccagagcaccaucacccgcuucuacggcgacgacccgcaguccagccccaaccuggggcggaucaucaaccagaagcaguuccagcgccugcgggcccuccugggcugcggccgcgucgccaucgggggccaguccgacgagagcgaccgguacaucgcccccacggugcugguggacguccaggagauggagcccgugaugcaggaggagaucuucgggccgauccuccccaucgucaacgugcagucccuggacgaggccaucgaguucaucaaccgccgcgagaagccccuggcgcucuacgccuucagcaacuccagccagguggucaagcgggugcugacccagaccuccagcggcggguucugcggcaacgacggcuucaugcacaugacccuggccagccuccccuucgggggcgugggggccuccggcauggggcgcuaccacggcaaguucagcuucgacacguucucccaccaccgggcgugccugcugcgcagcccgggcauggagaagcucaacgcccugcgguacccgccccagagcccccgccggcugcgcaugcugcucgucgccauggaggcccaggggugcuccugcacccugcuguga

SEQ ID NO: 26551 - RNA, 1539 nt, Artificial Sequence
  derived and/or modified sequence opt1 from ALDH4A1__Homo_sapiens__NP_001306147
augcugcuccccgccccggcccugcgccgggcgcugcucagccgccccuggaccggcgccgggcugcgguggaagcacaccuccagccugaagguggccaacgagcccguccucgccuucacgcagggcucccccgagcgcgacgcccugcagaaggcgcugaaggaccucaaggggcggauggaggccaucccgugcguggugggcgacgaggaggucuggaccagcgacgugcaguaccaggugucccccuucaaccacgggcacaaggucgccaaguucugcuacgccgacaagagccugcugaacaaggcgaucgaggccgcccucgccgcccgcaaggagugggaccugaagcccaucgcggaccgggcccagaucuuccugaaggccgccgacaugcucuccggcccccgccgggccgagauccuggcgaagaccauggugggccaggggaagaccgugauccaggccgagaucgacgccgccgccgagcugaucgacuucuuccgcuucaacgcgaaguacgccgucgagcucgagggccagcagccgaucagcgugccgcccuccacgaacagcaccguguaccgggggcuggagggcuucgucgccgccaucucccccuucaacuucaccgccaucgggggcaaccuggcgggcgccccggcccucauggggaacguggugcuguggaagcccagcgacaccgccaugcuggcguccuacgccgucuaccgcauccuccgggaggccggccugccgcccaacaucauccaguucgugcccgccgacgggccccuguucggcgacacggugaccagcuccgagcaccucugcggcaucaacuucaccgggagcguccccaccuucaagcaccuguggaagcaggucgcccagaaccuggaccgcuuccacacguucccccggcucgcgggcgagugcgggggcaagaacuuccacuucgugcaccgcuccgccgacguggagagcgugguguccgggacccugcggagcgccuucgaguacggcggccagaagugcagcgccugcucccgccuguacgucccgcacagccucuggccccagaucaaggggcggcugcuggaggagcacucccgcaucaaggugggcgaccccgccgaggacuucgggaccuucuucagcgcggucaucgacgccaaggagaucuucggccccgugcucuccguguacgucuacccggacgacaaguacaaggagacccugcagcugguggacagcacgaccuccuacgggcucaccggcgccguguucagccaggacaaggacgucgugcaggaggccaccaaggugcugcggaacgccgcgggcaacuucuacaucaacgacaaguccacggggagcaucgucggccagcagcccuucgggggcgcccgcgccuccgggaccaacgacaagcccggcggcccccacuacauccugcgcuggaccagcccccaggugaucaaggagacccacaagccccucggggacugguccuacgccuacaugcaguga

SEQ ID NO: 26552 - RNA, 1647 nt, Artificial Sequence
  derived and/or modified sequence opt1 from ALDH5A1__Homo_sapiens__NP_733936
auggcgaccugcaucuggcugcgcagcugcggcgcccggcgccucggguccaccuuccccggcugccggcugcgcccgcgggccgggggccuggugcccgccagcgggcccgcccccggcccggcccagcuccgcugcuacgccggccggcuggcggggcuguccgccgcccuccugcgcacggacagcuucgucggcgggcgguggcugcccgccgcggccaccuuccccgugcaggaccccgccuccggcgccgcccucgggaugguggcggacugcggcguccgcgaggcccgggccgccgugcgcgccgcguacgaggccuucugccgguggcgcgaggugagcgccaaggagcgguccagccugcugcgcaagugguacaaccucaugauccagaacaaggacgaccuggcccggaucaucaccgccgaguccggcaagccgcugaaggaggcgcacggggagauccucuacagcgccuucuuccuggagugguucuccgaggaggcccgccgggucuacggcgacaucauccacacccccgccaaggaccgccgggcccuggugcucaagcagcccaucgggguggcggccgucaucacgcccuggaacuucccgagcgccaugaucacccgcaaggugggcgccgcgcuggccgccggcugcaccguggucgugaagcccgccgaggacacccccuucuccgcccuggcgcucgccgaggugaaccagggguuccugcuggaccucgacccccugcugcucgccagccaggccggcaucccguccggggucuacaacgugauccccugcagccgcaagaacgccaaggaggugggcgaggcgaucugcacggacccccuggucuccaagaucagcuucaccggguccaccaccacgggcaagauccugcuccaccacgccgccaacagcgugaagcgggugagcauggagcugggcgggcuggcccccuucaucgucuucgacuccgccaacguggaccaggcgguggccggcgccauggccagcaaguuccgcaacaccgggcagaccugcgucugcuccaaccaguuccucgugcagcggggcauccacgacgcguucgucaaggccuucgccgaggccaugaagaagaaccugcgcguggggaacggcuucgaggagggcaccacgcaggggccgcugaucaacgagaaggccguggagaaggucgagaagcaggucaacgacgcggugagcaagggcgccaccguggugaccgggggcaagcggcaccagcucgggaagaacuucuucgagcccacccugcugugcaacgugacgcaggacaugcucugcacccacgaggagaccuucggcccccuggcccccgucaucaaguucgacaccgaggaggaggccaucgccaucgcgaacgccgccgacgugggccuggccggguacuucuacucccaggacccggcccagaucuggcgcguggcggagcagcucgaggucggcauggugggggugaacgagggccugaucagcuccgucgagugccccuucggcggggugaagcagagcggccuggggcgggagggcuccaaguacgggaucgacgaguaccucgagcugaaguacgugugcuacggcggccuguga

SEQ ID NO: 26553 - RNA, 1608 nt, Artificial Sequence
  derived and/or modified sequence opt1 from ALDH6A1__Homo_sapiens__NP_005580
auggccgcccugcucgcggccgccgccgugcgcgcccggauccugcaggucagcuccaaggucaagagcucccccaccugguacagcgcguccagcuucuccagcuccgugccgaccgugaagcuguucaucggcgggaaguucguggagagcaaguccgacaaguggaucgacauccacaaccccgccacgaacgaggugaucggccgcgucccccaggccaccaaggccgagauggacgcggccaucgccagcugcaagcgggccuuccccgccugggcggacaccuccgugcucagccgccagcagguccugcugcgguaccagcagcucaucaaggagaaccugaaggagaucgccaagcugaucacccucgagcaggggaagacgcuggccgacgccgagggcgacguguuccgcgggcuccaggugguggagcacgccugcuccgucaccagccugaugaugggcgagaccaugccguccaucaccaaggacauggaccuguacagcuaccggcugccccucggcgugugcgcggggaucgcccccuucaacuuccccgccaugaucccgcuguggauguuccccauggccauggugugcggcaacacguuccugaugaagcccuccgagcgcguccccggggccaccaugcuccuggcgaagcugcuccaggacagcggcgccccggacgggacccugaacaucauccacggccagcacgaggccgugaacuucaucugcgaccaccccgacaucaaggccaucagcuucgugggcuccaacaaggccggggaguacaucuucgagcggggcagccgccacgggaagcggguccaggcgaacaugggcgccaagaaccacggcguggugaugcccgacgccaacaaggagaacacccugaaccagcucgucggggccgcguucggcgccgccgggcagcgcugcauggcccuguccacggccgugcuggugggcgaggcgaagaaguggcuccccgagcuggucgagcacgccaagaaccugcgggugaacgccggggaccagccgggcgccgaccucggcccccugaucacgccccaggccaaggagcgcgucugcaaccugaucgacagcgggaccaaggagggcgcguccauccuccuggacgggcggaagaucaaggugaagggcuacgagaacgggaacuucgugggccccaccaucaucagcaacgucaagccgaacaugaccugcuacaaggaggagaucuucggccccgugcuggugguccucgagaccgagacccuggacgaggccauccagaucgugaacaacaaccccuacgggaacggcaccgccaucuucacgaccaacggggccaccgcccgcaaguacgcgcaccugguggacgucggccaggugggggugaacguccccaucccggugccccuccccauguucuccuucaccggcagccgguccagcuuccgcggcgacacgaacuucuacgggaagcagggcauccaguucuacacccagcugaagaccaucaccucccaguggaaggaggaggacgccacgcugagcucccccgccguggucaugccgaccauggggcgguga

SEQ ID NO: 26554 - RNA, 1620 nt, Artificial Sequence
  derived and/or modified sequence opt1 from ALDH7A1__Homo_sapiens__NP_001173
auguggcgccugccccgggcccucugcgugcacgccgcgaagaccagcaagcuguccggcccguggagccgccccgccgccuucauguccacccugcucaucaaccagccccaguacgccuggcugaaggagcuggggcuccgggaggagaacgagggcgucuacaacgggagcuggggcgggcgcggcgaggugaucacgaccuacugccccgccaacaacgagccgaucgcgcgggugcgccaggccuccgucgccgacuacgaggagaccgugaagaaggcccgggaggcguggaagaucugggccgacauccccgcccccaagcgcggcgagaucgugcggcagaucggggacgcccugcgcgagaagauccagguccugggcagccucgugucccuggagauggggaagauccugguggagggcgucggggaggugcaggaguacguggacaucugcgacuacgccgucggccucagccggaugaucggcgggcccauccugccguccgagcgcagcggccacgcgcugaucgagcaguggaaccccguggggcucgugggcaucaucaccgccuucaacuuccccgucgccguguacggcuggaacaacgccaucgccaugaucugcgggaacgugugccuguggaagggcgcgcccacgaccucccugaucagcgucgccgugaccaagaucaucgccaaggugcucgaggacaacaagcugccgggggccaucugcucccugaccugcggcggggccgacaucggcacggcgauggccaaggacgagcgggucaaccuccugagcuucaccggcuccacccagguggggaagcaggucggccugauggugcaggagcgcuucgggcggagccuccuggagcugggcgggaacaacgccaucaucgccuucgaggacgccgaccucucccuggugguccccagcgcgcuguucgccgccgugggcaccgccggccagcgcugcacgaccgcgcggcgccucuucauccacgaguccauccacgacgagguggucaaccggcugaagaaggccuacgcccagauccgcguggggaaccccugggaccccaacgugcuguacggcccgcuccacaccaagcaggccgucagcauguuccugggggccguggaggaggcgaagaaggagggcgggaccguggucuacggcggcaaggugauggaccggcccgggaacuacguggagcccacgaucgucaccggccuggggcacgacgccagcaucgcccacaccgagaccuucgcccccauccucuacguguucaaguucaagaacgaggaggagguguucgccuggaacaacgaggucaagcagggccuguccagcuccaucuucacgaaggaccugggccgcaucuuccgcuggcucgggccgaagggcagcgacugcgggaucgugaacgugaacauccccaccuccggcgcggagaucgggggcgccuucggcggggagaagcacaccggcgggggccgggagagcggguccgacgccuggaagcaguacaugcgccggagcacgugcaccaucaacuacuccaaggaccugccccuggcccagggcaucaaguuccaguga

SEQ ID NO: 26555 - RNA, 1557 nt, Artificial Sequence
  derived and/or modified sequence opt1 from ALDH9A1__Homo_sapiens__NP_000687
auguuccugcgcgccggccucgccgcgcugagcccccugcuccggucccugcgcccgagccccguggccgccauguccaccgggaccuucgucgugagccagccccugaacuaccggggcggggcccgcguggagcccgccgacgcguccggcacggagaaggccuucgagccggccaccgggcgggucaucgccaccuucacgugcagcggcgagaaggaggugaaccucgcggugcagaacgccaaggccgccuucaagaucuggucccagaaguccggcauggagcgcugccggauccugcuggaggccgcgcgcaucauccgggagcgcgaggacgagaucgccaccauggagugcaucaacaacggcaagagcaucuucgaggcccggcucgacaucgacaucagcuggcagugccuggaguacuacgccgggcuggccgcguccauggccggggagcacauccagcuccccggcgggagcuucggcuacacccgccgggagccccugggcgucugcguggggaucggcgccuggaacuaccccuuccagaucgccuccuggaaguccgccccggcgcuggccugcgggaacgccaugguguucaagcccagccccuucacccccgucagcgcccuccugcuggccgagaucuacuccgaggcgggcgugccgcccggccucuucaacgugguccagggcggggccgccaccgggcaguuccugugccagcaccccgacguggccaaggugagcuucacgggcuccguccccaccgggaugaagaucauggagaugagcgcgaagggcaucaagccggugacccuggagcucggcggcaagagcccccugaucaucuucuccgacugcgacaugaacaacgccgugaagggggcccugauggccaacuuccucacccaggggcaggucugcugcaacggcacgcgcguguucgugcagaaggagauccuggacaaguucaccgaggaggucgugaagcagacccagcggaucaagaucggggacccccugcucgaggacacccgcaugggcccccugaucaaccggccgcaccuggagcgcgugcucggcuucgucaagguggccaaggagcagggggcgaagguccugugcggcggggacaucuacgugcccgaggaccccaagcugaaggacggcuacuacaugcggcccugcgugcucacgaacugccgcgacgacaugaccugcgucaaggaggagaucuucgggccggugaugagcauccuguccuucgacaccgaggccgaggugcuggagcgggccaacgacaccacguucggccucgccgccggcgucuucacccgcgacauccagcgcgcgcaccgggugguggccgagcugcaggccgggaccugcuucaucaacaacuacaacgucagccccguggagcugcccuucggcggguacaagaaguccggcuucggccgcgagaacgggcgggugaccaucgaguacuacagccagcucaagacggucugcguggagaugggcgacguggaguccgccuucuga

SEQ ID NO: 26556 - RNA, 1257 nt, Artificial Sequence
  derived and/or modified sequence opt1 from ALDOA__Homo_sapiens__NP_001230106
auggcccgccggaagcccgagggcagcuccuucaacaugacccaccugagcauggccauggcguucuccuucccgcccguggccagcgggcagcuccacccccagcugggcaacacccagcaccagacggagcuggggaaggagcucgccaccaccuccaccaugcccuaccaguacccggcccugacgcccgagcagaagaaggagcugagcgacaucgcccaccgcaucgucgcgcccggcaaggggauccucgccgccgacgaguccaccggcagcaucgccaagcggcugcaguccaucggcaccgagaacaccgaggagaaccgccgguucuaccgccagcugcuccugacggcggacgaccgggugaaccccugcaucgggggcgugauccuguuccacgagacccucuaccagaaggccgacgacgggcgcccguucccccaggucaucaagagcaagggcgggguggugggcaucaaggucgacaagggcguggugccccuggccgggaccaacggcgagaccacgacccaggggcuggacggccucuccgagcggugcgcccaguacaagaaggacggcgccgacuucgcgaaguggcgcugcguccugaagaucggggagcacacccccagcgcccuggccaucauggagaacgccaacgugcucgcccgguacgcguccaucugccagcagaacggcaucgugccgaucgucgagcccgagauccugcccgacggggaccacgaccugaagcgcugccaguacgugaccgagaaggugcucgccgccgucuacaaggcccugagcgaccaccacaucuaccuggagggcacgcuccugaagcccaacauggugaccccggggcacgccugcacccagaaguucucccacgaggagaucgcgauggccaccgugacggcccugcggcgcaccgucccgcccgccgugaccggcaucaccuuccucagcggcgggcaguccgaggaggaggccagcaucaaccugaacgcgaucaacaagugcccccugcucaagcccugggcccugacguucuccuacggccgggcccugcaggccagcgcgcucaaggccuggggcgggaagaaggagaaccugaaggccgcccaggaggaguacgugaagcgcgcccuggcgaacagccucgccugccaggggaaguacacccccuccggccaggccggcgccgccgcgagcgagucccuguucgucagcaaccacgccuacuga

SEQ ID NO: 26557 - RNA, 1095 nt, Artificial Sequence
  derived and/or modified sequence opt1 from ALDOB__Homo_sapiens__NP_000026
auggcccaccgcuuccccgcccugacccaggagcagaagaaggagcucagcgagaucgcgcaguccaucguggccaacggcaaggggauccuggccgccgacgagagcgucggcaccauggggaaccggcugcagcgcaucaagguggagaacacggaggagaaccggcgccaguuccgggagauccucuucuccguggacagcuccaucaaccagagcaucggcggggucauccuguuccacgagacccuguaccagaaggacucccagggcaagcuguuccgcaacauccucaaggagaagggcaucgugguggggaucaagcuggaccagggcggggccccgcucgcgggcaccaacaaggagaccacgauccaggggcuggacggccugagcgagcggugcgcccaguacaagaaggacggcgucgacuucgggaaguggcgcgccgugcuccggaucgccgaccagugccccuccagccuggcgauccaggagaacgccaacgcccuggcccgcuacgccuccaucugccagcagaacggccucgugcccaucgucgagcccgaggugaucccggacggggaccacgaccuggagcacugccaguacgugaccgagaagguccuggcggccguguacaaggcccucaacgaccaccacguguaccuggagggcacccugcucaagcccaacauggucaccgccggccacgccugcacgaagaaguacacccccgagcaggucgcgauggccaccgugaccgcccugcaccggacggugcccgccgccgugccggggaucugcuuccugagcggcgggauguccgaggaggacgcgacccucaaccugaacgccaucaaccugugcccccuccccaagcccuggaagcugagcuucuccuacggccgcgcccugcaggccagcgcccucgcggccuggggcgggaaggccgccaacaaggaggcgacccaggaggccuucaugaagcgggccauggccaacugccaggccgcgaagggccaguacgugcacaccggguccagcggcgccgccuccacgcagagccuguucaccgccugcuacaccuacuga

SEQ ID NO: 26558 - RNA, 1095 nt, Artificial Sequence
  derived and/or modified sequence opt1 from ALDOC__Homo_sapiens__NP_005156
augccccacagcuacccggcccuguccgccgagcagaagaaggagcucagcgacaucgcgcugcgcaucguggcccccggcaaggggauccuggccgccgacgaguccgucggcagcauggccaagcggcucucccagaucgggguggagaacaccgaggagaaccgccggcuguaccgccaggugcuguucagcgcggacgaccgggucaagaagugcaucggcggggugaucuucuuccacgagacccucuaccagaaggacgacaacggcgugcccuucguccgcacgauccaggacaagggcaucgugguggggaucaaggucgacaagggcguggugccccuggccgggaccgacggcgagaccaccacgcaggggcuggacggccucuccgagcggugcgcccaguacaagaaggacggcgccgacuucgcgaaguggcgcugcguccugaagaucagcgagcggaccccguccgcccuggccauccucgagaacgccaacgugcuggcccgcuacgcgagcaucugccagcagaacgggaucgugcccaucgucgagcccgagauccugcccgacggcgaccacgaccucaagcggugccaguacgugaccgagaaggugcuggccgccgucuacaaggcccuguccgaccaccacguguaccucgaggggacccugcugaagccgaacauggugacgcccggccacgccugccccaucaaguacacccccgaggagaucgcgauggccaccgucaccgcccuccgccggacggugccgcccgccgugcccggcgucaccuuccugagcgggggccaguccgaggaggaggccagcuucaaccugaacgcgaucaaccgcugcccccucccgcggcccugggcccugaccuucuccuacgggcgcgcccugcaggccagcgcccucaacgcguggcggggccagcgcgacaacgccggggccgccaccgaggaguucaucaagcgggcggaggugaacggccuggccgcccagggcaaguacgagggguccggcgaggacgggggcgccgccgcgcagagccuguacaucgccaaccacgccuacuga

SEQ ID NO: 26559 - RNA, 1422 nt, Artificial Sequence
  derived and/or modified sequence opt1 from ALG10B__Homo_sapiens__NP_001013642
auggcccagcuggagggcuacugcuucagcgccgcgcucuccugcaccuuccuggugagcugccugcuguucuccgccuucagccgcgcccugcgggagcccuacauggacgagaucuuccaccucccccaggcccagcgcuacugcgaggggcacuucucccucagccagugggaccccaugaucaccacgcugcccggccuguaccucgucuccguggggguggucaagcccgccaucuggaucuucggcuggagcgagcacguggugugcuccaucgggaugcugcgguucgucaaccuccucuucagcgugggcaacuucuaccugcuguaccuccuguuccacaaggugcagccgcgcaacaaggcggccuccagcauccagcggguccuguccacccucacccuggccguguuccccacccuguacuucuucaacuuccucuacuacacggaggccggcagcauguucuucacccuguucgcguaccugaugugccucuacgggaaccacaagaccuccgccuuccugggcuucugcggguucauguuccgccagaccaacaucaucugggccguguucugcgccggcaacgucaucgcccagaagcugacggaggcguggaagaccgagcuccagaagaaggaggaccggcugccgcccaucaaggggcccuucgccgaguuccgcaagauccugcaguuccuccuggccuacagcauguccuucaagaaccugagcaugcuguucugccugaccuggcccuacauccugcucggcuuccuguucugcgccuucgugguggucaacggcgggaucgugaucggcgaccgguccagccacgaggccugccugcacuucccccagcuguucuacuucuucagcuucacccuguucuucuccuucccccaccuccucagcccguccaagaucaagacguuccugagccugguguggaagcacgggauccucuuccuggucgugacccugguguccgucuuccucguguggaaguucaccuacgcgcacaaguaccugcuggccgacaaccgccacuacaccuucuacguguggaagcgggucuuccagcgcuacgccauccugaaguaccuccuggugcccgccuacaucuucgccggcuggagcaucgcggacucccucaagagcaagcccaucuucuggaaccugauguucuucaucugccuguucaucgucaucgugccccagaagcugcucgaguuccgguacuucauccugccguacgugaucuaccgccugaacaucacgcucccgcccaccucccggcuggucugcgagcugagcugcuacgccaucgugaacuucaucaccuucuacaucuuccucaacaagaccuuccaguggcccaacucccaggacauccagcgcuucaugugguga

SEQ ID NO: 26560 - RNA, 1422 nt, Artificial Sequence
  derived and/or modified sequence opt1 from ALG10__Homo_sapiens__NP_116223
auggcccagcuggagggcuacuacuucagcgccgcgcucuccugcaccuuccuggugagcugccugcuguucuccgccuucagccgcgcccugcgggagcccuacauggacgagaucuuccaccucccccaggcccagcgcuacugcgaggggcacuucucccucagccagugggaccccaugaucaccacgcugcccggccuguaccucgucuccaucggggugaucaagcccgccaucuggaucuucggcuggagcgagcacguggucugcuccaucgggaugcugcgguucgugaaccugcuguucagcgugggcaacuucuaccugcuguaccuccuguucugcaagguccagccgcgcaacaaggcggccuccagcauccagcgggugcuguccacccucacccuggccguguuccccacccuguacuucuucaacuuccucuacuacacggaggccggcagcauguucuucacccuguucgcguaccugaugugccucuacgggaaccacaagaccuccgccuuccugggcuucugcggguucauguuccgccagaccaacaucaucugggccgucuucugcgccggcaacgugaucgcccagaagcugacggaggcguggaagaccgagcuccagaagaaggaggaccggcugccgcccaucaaggggcccuucgccgaguuccgcaagauccugcaguuccuccuggccuacagcauguccuucaagaaccugagcaugcuccugcugcucaccuggcccuacauccugcugggcuuccucuucugcgccuucguggucgugaacggcgggaucgugaucggcgaccgguccagccacgaggccugccugcacuucccccagcuguucuacuucuucagcuucacccucuucuucuccuucccccaccuccugagcccguccaagaucaagacguuccucagccuggucuggaagcgccggauccuguucuucguggugacccucgucuccguguuccugguguggaaguucaccuacgcgcacaaguaccugcuggccgacaaccgccacuacaccuucuacgucuggaagcggguguuccagcgcuacgagacggugaaguaccuccugguccccgccuacaucuucgccggguggagcaucgccgacucccucaagagcaaguccaucuucuggaaccugauguucuucaucugccuguucaccgugaucgucccccagaagcugcucgaguuccgguacuucauccugcccuacgugaucuaccgccugaacaucccgcucccgcccaccagccggcugaucugcgagcuguccugcuacgcgguggucaacuucaucaccuucuucaucuuccucaacaagacguuccaguggcccaacagccaggacauccagcgcuucaugugguga

SEQ ID NO: 26561 - RNA, 1479 nt, Artificial Sequence
  derived and/or modified sequence opt1 from ALG11__Homo_sapiens__NP_001004127
auggccgccggcgagcgcagcuggugccugugcaagcuccugcgguucuucuacucccuguucuuccccgggcucaucgugugcggcacccugugcgucugccuggugaucgugcucugggggauccgccugcugcuccagcggaagaagaagcuggucagcaccuccaagaacggcaagaaccagauggugaucgcguucuuccacccguacugcaacgccgggggcggcggggagcgcgugcuguggugcgcccuccgggcccugcagaagaaguaccccgaggccgucuacgugguguacacgggcgacgucaacgugaacgggcagcagauccuggagggcgcguuccgccgguucaacauccgccucauccaccccgugcaguucgucuuccugcggaagcgcuaccugguggaggacagccucuacccccacuucacccugcuggggcagucccucggcagcaucuuccugggcugggaggcccugaugcagugcgugccggacgucuacaucgacuccaugggguacgccuucacccucccccuguucaaguacaucggcgggugccaggugggcagcuacgugcacuaccccaccaucuccacggacaugcugagcgucgugaagaaccagaacaucggcuucaacaacgccgcguucaucacccggaaccccuuccucuccaaggugaagcugaucuacuacuaccuguucgccuucaucuacgggcucgucggcagcugcuccgacguggugauggucaacagcuccuggacccugaaccacauccugagccucuggaagguggggaacugcaccaacaucgucuacccgcccugcgacgugcagacguuccuggacaucccccugcacgagaagaagaugacccccggccaccuccugguguccgucgggcaguuccgcccggagaagaaccacccccugcagauccgggccuucgccaagcuccugaacaagaagaugguggagagcccgcccucccugaagcucgugcugaucggcggcugccgcaacaaggacgacgagcugcgggucaaccagcuccgccggcugagcgaggaccugggggugcaggaguacguggaguucaagaucaacauccccuucgacgagcucaagaacuaccugagcgaggccaccaucggccugcacaccauguggaacgagcacuucgggaucggcgucguggagugcauggcggccgggacgaucauccuggcccacaacuccggcggccccaagcucgacaucguggucccccacgagggggacaucaccggcuuccuggccgagagcgaggaggacuacgccgagaccaucgcgcacauccuguccaugagcgccgagaagcgccuccagauccggaaguccgcccgcgccagcgugucccgguucagcgaccaggaguucgaggugaccuuccuguccagcgucgagaagcuguucaaguga

SEQ ID NO: 26562 - RNA, 1467 nt, Artificial Sequence
  derived and/or modified sequence opt1 from ALG12__Homo_sapiens__NP_077010
auggccggcaaggggagcuccggccgccggccccugcuccuggggcugcucguggccgucgcgaccgugcaccuggugaucugcccguacaccaaggucgaggagagcuucaaccugcaggccacgcacgaccuccuguaccacuggcaggaccuggagcaguacgaccaccucgaguuccccggcguggugccccgcaccuuccuggggcccgucgugaucgccguguucuccagcccggccgucuacgugcugucccuccuggagaugagcaaguucuacucccagcugaucgugcggggcguccucggccugggggugaucuucggccuguggacccuccagaaggaggugcgccggcacuucggggccauggucgcgaccauguucugcugggugacggccaugcaguuccaccugauguucuacugcacccgcacccugcccaacgugcucgcccugcccgucgugcugcucgcccuggcggccuggcugcggcacgagugggcccgcuucaucuggcucagcgccuucgccaucaucguguuccgggucgagcugugccuguuccucggccugcugcuccugcuggcgcucgggaaccgcaagguguccgugguccgggcccugcgccacgccgugcccgccggcauccugugccucggccugaccgucgccguggacagcuacuucuggcggcagcugacguggccggaggggaaggugcucugguacaacaccguccugaacaaguccagcaacuggggcaccagcccccugcucugguacuucuacagcgcgcugccccgcgggcugggcugcucccuccuguucaucccccugggccugguggaccggcgcacccacgccccgacggugcucgcccugggguucauggcccuguacagccuccugccccacaaggagcugcgguucaucaucuacgccuuccccaugcucaacaucaccgcggcccgcggcugcuccuaccugcugaacaacuacaagaaguccuggcucuacaaggccgggucccugcuggucaucggccaccucguggugaacgccgccuacagcgcgaccgcccuguacgucagccacuucaacuaccccgggggcguggccaugcagcggcugcaccagcucgugccgccccagaccgacguccugcugcacaucgacguggccgcggcccagacgggcgugucccgcuuccuccaggucaacagcgccuggcgguacgacaagcgcgaggacgugcagcccgggaccggcaugcuggccuacacccacauccugauggaggccgcgcccgggcuccuggcccuguaccgcgacacccaccgggugcucgccuccgucgugggcacgaccggggugagccugaaccugacccagcucccgcccuucaacguccaccuccagaccaagcuggugcugcuggagcgccugccccggcccuccuga

SEQ ID NO: 26563 - RNA, 3414 nt, Artificial Sequence
  derived and/or modified sequence opt1 from ALG13__Homo_sapiens__NP_001093392
augaagugcguguucgucaccguggggaccaccagcuucgacgaccucaucgccugcgugagcgcccccgacagccuccagaagaucgagucccugggguacaaccgccugauccuccagaucgggcgggggaccgucgugcccgagcccuucagcaccgaguccuucacccuggacguguaccgcuacaaggacagccugaaggaggacauccagaaggcggaccucgucaucucccacgccggcgccgggagcugccuggagacgcuggagaagggcaagccccucgugguggucaucaacgagaagcugaugaacaaccaccagcuggagcucgccaagcagcugcacaaggagggccaccuguucuacugcacgugccgggugcugaccugccccgggcaggccaaguccaucgcgagcgcccccggcaagugccaggacuccgccgcccugaccagcacggcguucuccgggcuggacuucggccuccugagcggguaccugcacaagcaggcccucgugaccgccacccacccgaccugcacgcugcuguuccccuccugccacgccuucuucccccucccccugacccccacccuguacaagaugcacaagggcuggaagaacuacugcagccagaagucccucaacgaggccagcauggacgaguaccugggcucccugggccucuuccgcaagcugaccgcgaaggacgccagcugccuguuccgggccaucagcgagcagcuguucugcucccagguccaccaccuggagauccgcaaggccugcgugagcuacaugcgggagaaccagcagacguucgaguccuacguggagggcagcuucgagaaguaccuggagcgccucggggaccccaaggaguccgccggccagcuggagauccgggcgcugagccucaucuacaaccgcgacuucauccuguaccgguuccccggcaagccgcccaccuacgucaccgacaacggguacgaggacaagauccugcucugcuacuccagcuccggccacuacgacagcguguacuccaagcaguuccagagcuccgccgccgugugccaggccguccuguacgagauccuguacaaggacguguucguggucgacgaggaggagcucaagaccgccaucaagcuguuccgcagcggguccaagaagaaccggaacaacgcggugacgggcagcgaggacgcccacaccgacuacaaguccagcaaccagaaccgcauggaggaguggggcgccugcuacaacgccgagaacauccccgagggcuacaacaagggcaccgaggagaccaagucccccgagaaccccagcaagaugcccuuccccuacaaggugcugaaggcccucgaccccgagaucuaccggaacgucgaguucgacguguggcuggacagccgcaaggagcugcagaaguccgacuacauggaguacgcggggcggcaguacuaccugggcgacaagugccaggucugccucgagagcgaggggcgcuacuacaacgcccacauccaggaggugggcaacgagaacaacuccgugacggucuucaucgaggagcuggccgagaagcacguggugccccuggccaaccucaagcccgucacccaggugaugagcgugcccgcguggaacgccaugcccucccggaaggggcgcggcuaccagaagaugcccggcggguacguccccgagaucgugaucagcgagauggacaucaagcagcagaagaagauguucaagaagauccggggcaaggagguguacaugaccauggccuacgggaagggcgacccccugcugccgccccgccuccagcacuccaugcacuacgggcacgacccgcccaugcacuacagccagaccgccggcaacgucauguccaacgagcacuuccacccccagcaccccagcccccgccagggccggggguacggcaugccccgcaacuccagccgguucaucaaccgccacaacaugcccgggcccaagguggacuucuaccccggccccggcaagcggugcugccaguccuacgacaacuucagcuaccgcucccggagcuuccgccggucccaccgccagaugagcugcgugaacaaggagagccaguacggguucacgcccggcaacgggcagaugccccggggccuggaggagaccaucaccuucuacgaggucgaggagggggacgagaccgccuaccccacgcugcccaaccacggcggcccguccaccauggugcccgcgaccagcggguacugcgugggccgccgggggcacuccagcggcaagcagacccucaaccuggaggaggggaacggccaguccgagaacggccgcuaccacgaggaguaccuguaccgggccgagcccgacuacgagacgagcggggucuacuccaccaccgccagcaccgccaaccucucccugcaggaccgcaagagcugcuccaugagcccccaggacaccgugacguccuacaacuacccccagaagaugaugggcaacaucgccgcgguggccgccagcugcgccaacaacguccccgcccccgugcuguccaacggggcggccgccaaccaggccaucagcaccaccuccgugagcucccagaacgcgauccagccccucuucgucagcccgcccacccacggccggcccgugaucgccagccccuccuacccgugccacagcgccaucccccacgccggggccucccugcccccgccgccgcccccgcccccgcccccgcccccgcccccgcccccgcccccgcccccgccgccgcccccgcccccgcccgcgcuggacgugggcgagacgagcaaccuccagcccccgccgccccugcccccgccgcccuacuccugcgaccccagcggcuccgaccugccccaggacaccaagguccuccaguacuacuucaaccuggggcugcagugcuacuaccacagcuacuggcacuccaugguguacgugccccagaugcagcagcagcuccacgucgagaacuaccccguguacaccgagccgccccugguggaccagaccgucccccagugcuacagcgaggugcgccgggaggacggcauccaggccgaggccuccgccaacgacacguuccccaacgccgacagcuccagcgugccccacggggcggucuacuaccccgugauguccgaccccuacggccagccgccccuccccggguucgacagcugccuccccgugguccccgacuacuccugcgugccgcccuggcaccccgugggcaccgccuacggcgggagcucccagauccacggcgccaucaaccccgggcccaucggcugcaucgcccccuccccgcccgccagccacuacgucccccagggcauguga

SEQ ID NO: 26564 - RNA, 1395 nt, Artificial Sequence
  derived and/or modified sequence opt1 from ALG1__Homo_sapiens__NP_061982
auggccgccagcugccuggugcuccuggcgcugugccuccugcugccccuccugcugcucggcggguggaagcgcuggcggcgcggccgggccgcccgccacgucguggccgugguccugggggacgugggccgguccccgcgcaugcaguaccacgcccugagccucgcgaugcacggguucuccgugacccugcugggcuucugcaacagcaagccccacgacgagcuccugcagaacaaccggauccagaucgucggccugaccgagcuccagucccuggccguggggccccgcguguuccaguacggcgucaagguggugcugcaggccauguaccuccuguggaagcugauguggcgggagcccggggccuacaucuuccuccagaacccgcccggccugcccagcaucgcggucugcugguucguggggugccugugcggcuccaagcucgugaucgacuggcacaacuacggcuacagcaucauggggcugguccacggccccaaccacccgcuggugcuccuggccaagugguacgagaaguucuucgggcgccugucccaccucaaccugugcgugacgaacgccaugcgggaggaccuggccgacaacuggcacauccgcgccgucaccguguacgacaagcccgcgagcuucuucaaggagacgccccucgaccugcagcaccggcuguucaugaagcucggcuccaugcacagccccuuccgcgcccgguccgagccggaggaccccgugaccgagcgcagcgccuucaccgagcgggacgccggcuccgggcuggucacccgccugcgggagcgccccgcccuccuggugagcuccaccagcuggaccgaggacgaggacuucuccauccugcucgcggcccuggagaaguucgagcagcugacgcucgacggccacaaccugcccagccuggugugcgucaucaccgggaagggcccgcugcgggaguacuacagccgccucauccaccagaagcacuuccagcacauccaggugugcacccccuggcuggaggccgaggacuacccccugcuccugggguccgccgaccugggcgucugccuccacaccagcuccagcggccuggaccugcccaugaaggugguggacauguucgggugcugccucccggucugcgccgugaacuucaagugccugcacgagcuggugaagcacgaggagaacggccucgucuucgaggacuccgaggagcuggcggcccagcugcagaugcuguucagcaacuuccccgaccccgccgggaagcucaaccaguuccgcaagaaccugcgggagucccagcagcuccgcugggacgagagcugggugcagacggugcugccccuggucauggacaccuga

SEQ ID NO: 26565 - RNA, 564 nt, Artificial Sequence
  derived and/or modified sequence opt1 from ALG1L__Homo_sapiens__NP_001015050
auggagcgcagcgccuucauggagcuggacgccggcucccggcucgugaugcaccuccgcgaguggcccgcgcugcucgucagcuccaccggguggaccgaguucgagcagcugacgcuggacggccacaaccucccgagccuggugugcgugaucaccggguccgucgaccugggcgugugccuccacaugagcuccagcgggcuggaccugcccaugaagguggucgacauguucggcugcugccuccccgugugcgccgugaacuucaagugccugcacgagcuggucaagcacgaggagaacggccucguguucgaggacuccgaggagcuggccgcccugcagaugcuguucagcaacuuccccgacccggccgggaagcugaaccaguucuggaagaaccugcgggagucccagcagcuccgcugggacgagagcugggugcagaccguccugccccuggugauggacauccagcuccugggccagcggcugaagccccgcgaccccugcugcccgucccggagcuucuucuccgagagccaggggaagcccuucuga

SEQ ID NO: 26566 - RNA, 1251 nt, Artificial Sequence
  derived and/or modified sequence opt1 from ALG2__Homo_sapiens__NP_149078
auggccgaggagcagggccgcgagcgggacagcgugcccaagccguccguccuguuccuccaccccgaccugggggugggcggggccgagcgccuggugcucgacgcggcccuggcccugcaggcccggggcugcagcgucaagaucuggaccgcccacuacgaccccgggcacugcuucgcggagucccgcgagcuccccgugcggugcgccggcgacuggcugccgcgcggccugggguggggcgggcggggcgccgccgugugcgcguacguccgcaugguguuccucgcccuguacgugcuguuccucgccgacgaggaguucgacgucguggugugcgaccaggucagcgccugcauccccguguuccggcuggcccgccggcgcaagaagauccuguucuacugccacuuccccgaccuccugcugaccaagcgggacuccuuccucaagcgccuguaccgggcgcccaucgacuggaucgaggaguacacgaccgggauggccgacugcauccuggugaacagccaguucaccgccgccgucuucaaggagaccuucaagucccucagccacaucgacccggacgugcuguaccccucccugaacgugacgagcuucgacuccgucgugcccgagaagcucgacgaccuggugcccaagggcaagaaguuccugcuccugagcaucaaccgcuacgagcggaagaagaaccugacccucgcccuggaggcgcugguccagcuccgcggccggcugaccucccaggacugggagcgcgugcaccugaucguggccgggggcuacgacgagcggguccucgagaacguggagcacuaccaggagcugaagaagaugguccagcagagcgaccuggggcaguacgugaccuuccuccgcuccuucagcgacaagcagaagaucucccugcugcacagcugcacgugcgugcucuacaccccguccaacgagcacuucggcaucgucccccuggaggccauguacaugcagugccccgugaucgccgugaacagcggcgggccccuggagagcaucgaccacuccgucaccggcuuccucugcgagccggaccccgugcacuucagcgaggccaucgagaaguucauccgcgagcccucccugaaggcgaccauggggcuggccggccgggcccgcgugaaggagaaguucagccccgaggccuucacggagcagcucuaccgguacgucaccaagcugcugguguga

SEQ ID NO: 26567 - RNA, 1173 nt, Artificial Sequence
  derived and/or modified sequence opt1 from ALG3__Homo_sapiens__NP_001006942
auguuccccgcccaggccaaggagaacgcgggcuucagcgggugcggcggggacaccgagaucgacuggaaggccuacauggccgagguggagggcgucaucaacgggaccuacgacuacacgcagcugcagggcgacaccggcccgcucguguaccccgccggguucguguacaucuucaugggccuguacuacgccaccucccgcgggaccgacauccggauggcgcagaacaucuucgccguccuguaccucgccacgcugcugcucguguuccugaucuaccaccagaccugcaaggugccgcccuucgucuucuucuucaugugcugcgccagcuaccgcgugcacuccaucuucgugcugcggcuguucaacgaccccgucgcgauggugcugcuguuccucagcaucaaccugcugcucgcccagcgcuggggcugggggugcugcuucuucucccuggccgugagcgucaagaugaacgugcugcuguucgcccccggccugcuguuccuccugcugacccaguucggcuuccgcggggcccuccccaagcugggcaucugcgcggggcuccaggugguccucggccugcccuuccugcucgagaacccguccggcuaccugagccgguccuucgaccuggggcggcaguuccucuuccacuggaccgugaacuggcgcuuccugcccgaggcccuguuccuccaccgggccuuccaccuggcccugcucacggcccaccugacccugcuccugcuguucgcgcucugccgcuggcaccggaccggcgagagcauccugucccugcuccgcgaccccagcaagcggaaggugcccccgcagccccugacccccaaccagaucgucuccacgcuguucaccagcaacuucaucgggaucugcuucucccgcagccugcacuaccaguucuacgugugguacuuccacacccuccccuaccugcugugggccaugccggcccgguggcucacccaccuccugcgccuccuggugcugggccucaucgagcuguccuggaacacguaccccagcaccuccugcagcagcgccgcccugcacaucugccacgcggucauccuccugcagcuguggcucgggccccagcccuucccgaaguccacccagcacagcaagaaggcccacuga

SEQ ID NO: 26568 - RNA, 1404 nt, Artificial Sequence
  derived and/or modified sequence opt1 from ALG8__Homo_sapiens__NP_001007028
auggccgcccugaccaucgcgaccggcacggggaacugguucagcgcccucgcccugggcgugacccugcucaagugccugcugauccccaccuaccacuccaccgacuucgagguccaccgcaacuggcucgccaucacgcacagccugccgaucucccagugguacuacgaggccaccagcgaguggacccuggacuacccgcccuucuucgcgugguucgaguacauccucucccacguggccaaguacuucgaccaggagaugcugaacgugcacaaccugaacuacagcuccagccggacccuccuguuccagcgcuucuccgucaucuucauggacgugcuguucguguacgccguccgggagugcugcaagugcaucgacgggaagaaggugggcaaggagcucacggagaagcccaaguucauccugagcgugcugcuccuguggaacuucgggcugcucaucgucgaccacauccacuuccaguacaacggcuuccuguucggccugaugcuccuguccaucgcccgccuguuccagaagcggcacauggagggggcguuccucuucgccgugcugcugcacuucaagcacaucuaccucuacguggcccccgccuacggcgucuaccugcugcgcagcuacugcuucaccgccaacaagcccgacggguccauccgguggaaguccuucagcuucgugcgcgugaucagccucggccuggucguguuccugguguccgcgcucagccuggggcccuuccuggcccucaaccagcugccccaggucuucucccggcuguucccguucaagcgcggccucugccacgccuacugggcccccaacuucugggcccuguacaacgcgcuggacaaggugcucagcgugaucggccugaagcugaaguuccucgaccccaacaacauccccaaggccagcaugaccuccgggcugguccagcaguuccagcacaccgugcugccgagcgugacgccccuggccacccucaucugcacccugaucgccauccugcccuccaucuucugccucugguucaagccccagggcccgcggggguuccugcgcugccugacccucugcgcccugagcuccuucauguucggcuggcacguccacgagaaggcgauccugcucgccauccugcccaugagccugcucuccgugggcaaggccggggacgccagcaucuuccugauccugacgaccaccggccacuacucccucuucccccugcuguucaccgcccccgagcucccgaucaagauccugcugaugcuccuguucacgaucuacagcaucuccagccugaagacccucuuccggcgcuccuucacccuggucgcgcaggccggggugcaguggcacgaccugagcuga

SEQ ID NO: 26569 - RNA, 1836 nt, Artificial Sequence
  derived and/or modified sequence opt1 from ALG9__Homo_sapiens__NP_001071158
auggccagccgcggcgcccggcagcgccugaagggguccggcgcgagcuccggggacaccgcccccgccgccgacaagcuccgggagcugcugggcagccgcgaggccgggggcgcggagcaccggaccgagcucuccggcaacaaggccggccaggugugggccccggaggggagcacggccuucaagugccugcuguccgcgcgccucugcgccgcccugcugagcaacaucuccgacugcgacgagaccuucaacuacugggagcccacccacuaccucaucuacggggagggcuuccagaccugggaguacagccccgccuacgccauccgguccuacgcguaccugcugcuccacgccuggcccgccgccuuccacgcccgcauccugcagacgaacaagauccuggucuucuacuuccuccggugccugcuggcguucgugagcugcaucugcgagcucuacuucuacaaggccgugugcaagaaguucgggcugcacgucucccgcaugaugcuggccuuccucgugcugagcaccggcauguucugcuccagcuccgccuuccugccgagcuccuucugcauguacaccacccucaucgccaugacgggcugguacauggacaagaccagcaucgcggugcugggggucgccgccggcgccauccugggguggcccuucagcgccgcgcucggccugcccaucgccuucgaccugcucgugaugaagcaccgguggaaguccuucuuccacuggagccugauggcccugauccucuuccuggugcccgucguggugaucgacuccuacuacuacggcaagcuggucaucgccccgcucaacaucgugcuguacaacguguucacgccccacgggcccgaccuguacggcaccgagcccugguacuucuaccucaucaacggguuccugaacuucaacgucgcguucgcccuggcccuccuggugcugccgcucaccagccugauggaguaccugcuccagcgcuuccacgugcagaaccugggccaccccuacuggcugacccuggcccccauguacaucugguucaucaucuucuucauccagccccacaaggaggagcgguuccucuucccggucuacccccugaucugccugugcggggccguggcgcucuccgcccugcagaagugcuaccacuucguguuccagcgcuaccggcuggagcacuacaccgucaccagcaacuggcucgcccugggcacgguguuccuguucggccuccuguccuucagccgcuccguggcccuguuccggggguaccacggcccccucgaccuguaccccgaguucuaccgcaucgccaccgacccgaccauccacaccguccccgaggggcggcccgugaacgucugcgugggcaaggagugguaccgcuuccccagcuccuuccugcucccggacaacuggcagcugcaguucauccccagcgaguuccgggggcagcugcccaagcccuucgcggagggcccgcucgccacgcgcaucgugcccaccgacaugaacgaccagaaccuggaggagcccucccgcuacaucgacaucagcaagugccacuaccuggucgaccucgacaccaugcgggagaccccgcgcgagcccaaguacuccagcaacaaggaggaguggaucucccuggccuaccggcccuuccuggacgccagccgcuccagcaagcuccugcgggccuucuacgugcccuuccugagcgaccaguacacgguguacgucaacuacaccauccucaagccgcgcaaggcgaagcagauccggaagaaguccggcggguga

SEQ ID NO: 26570 - RNA, 1170 nt, Artificial Sequence
  derived and/or modified sequence opt1 from ALKBH1__Homo_sapiens__NP_006011
augggcaagauggccgccgcgguggggagcgucgccacccuggccaccgagcccggcgaggacgccuuccgcaagcuguuccgguucuaccgccagucccggccggggacggccgaccucgagggcgugaucgacuucagcgcggcccacgccgcccgcgggaagggccccggcgcgcagaaggugaucaagucccagcugaacgucagcuccgugagcgagcagaacgccuaccgggccgggcuccagcccguguccaaguggcaggccuacggccugaagggguaccccggcuucaucuucaucccgaaccccuuccugcccggguaccaguggcacugggucaagcagugccucaagcuguacagccagaagcccaacgugugcaaccuggacaagcacauguccaaggaggagacccaggaccucugggagcagagcaaggaguuccugcgcuacaaggaggccaccaagcggcgcccgcggucccugcucgagaagcugcgcugggugaccgucggcuaccacuacaacugggacagcaagaaguacuccgcggaccacuacacgcccuuccccagcgaccugggcuuccucuccgagcaggucgccgccgccugcggguucgaggacuuccgggccgaggcgggcauccugaacuacuaccgccuggacagcacccucgggauccacguggaccgguccgagcuggaccacagcaagccccugcucuccuucagcuucggccagagcgccaucuuccugcugggcgggcuccagcgcgacgaggccccgaccgccauguucaugcacuccggcgacaucaugaucaugagcggguucucccggcugcugaaccacgccgugccccgcgugcuccccaaccccgagggcgaggggcugccgcacugccuggaggcgccccuccccgccgugcugccccgggacagcauggucgagccgugcuccauggaggacuggcaggucugcgccagcuaccugaagaccgcccgcgugaacaugacggugcgccaggugcucgccaccgaccagaacuucccccuggagcccaucgaggacgagaagcgggacaucuccaccgagggcuucugccaccuggacgaccagaacagcgaggugaagcgggcgcgcaucaaccccgacuccuga

SEQ ID NO: 26571 - RNA, 786 nt, Artificial Sequence
  derived and/or modified sequence opt1 from ALKBH2__Homo_sapiens__NP_001001655
auggaccgcuuccuggugaagggcgcccagggcgggcuccugcggaagcaggaggagcaggagcccaccggggaggagccggccguccugggcggggacaaggagagcacccgcaagcggccccgccgggaggcgcccggcaacggcgggcacuccgccggccccagcuggcgccacauccgggccgaggggcucgacugcuccuacacggugcuguucggcaaggccgaggccgacgagaucuuccaggagcuggagaaggagguggaguacuucaccggggcgcucgcccgcguccagguguucggcaaguggcacagcgugccgcggaagcaggccaccuacggcgacgccgggcugaccuacacguucuccggccugacccucagccccaagcccuggauccccguccuggagcgcauccgggaccacguguccggggugaccggccagaccuucaacuucguccugaucaaccgcuacaaggacggcugcgaccacaucggggagcaccgggacgacgagcgcgagcucgcgccgggcagccccaucgccuccgugagcuucggggccugccgggacuucguguuccgccacaaggacucccggggcaagagccccucccgccgggucgccguggugcgccugccccuggcccacgggagccuccugaugaugaaccacccgacgaacacccacugguaccacucccugcccguccggaagaaggugcucgcgccccgcgugaaccugaccuuccgcaagauccugcucaccaagaaguga

SEQ ID NO: 26572 - RNA, 861 nt, Artificial Sequence
  derived and/or modified sequence opt1 from ALKBH3__Homo_sapiens__NP_631917
auggaggagaagcgccggcgcgcccgggugcagggcgccugggcggcccccgucaagagccaggccaucgcccagccggccaccaccgcgaagucccaccuccaccagaagcccgggcagacguggaagaacaaggagcaccaccugagcgaccgcgaguucguguucaaggagccccagcaggucgugcggcgcgcccccgagccgcgggugaucgaccgcgagggcguguacgagaucucccugagccccaccggggucucccgggugugccuguaccccggcuucguggacgucaaggaggccgacuggauccucgagcagcugugccaggacgugcccuggaagcagcgcaccgggauccgggaggacaucaccuaccagcagccgcgccugacggccugguacggcgagcuccccuacaccuacagccggaucaccauggagcccaacccccacuggcacccggugcugcgcacccugaagaaccggaucgaggagaacacgggccacaccuucaacucccuccugugcaaccuguaccgcaacgagaaggacagcgucgacuggcacuccgacgacgagcccagccucgggcggugccccaucaucgcgucccugagcuucggcgccacccgcaccuucgagaugcggaagaagcccccgcccgaggagaacggggacuacacguacguggagcgcgugaagaucccccuggaccacggcacccuccugaucauggagggggccacccaggccgacuggcagcaccggguccccaaggaguaccacucccgcgagccgcgcgugaaccugaccuuccggacgguguaccccgacccccgcggcgcccccugguga

SEQ ID NO: 26573 - RNA, 666 nt, Artificial Sequence
  derived and/or modified sequence opt1 from ALKBH7__Homo_sapiens__NP_115682
auggccggcaccgggcugcucgcccugcgcacccugcccggccccagcugggugcggggguccggccccagcguccucucccgccugcaggacgcggccguggugcggcccggguuccugagcacggccgaggaggagacccucucccgcgagcuggagcccgagcugcggcgccggcgcuacgaguacgaccacugggacgccgccauccacggcuuccgggagaccgagaagucccgcuggagcgaggcgagccgggccauccuccagcgcguccaggccgccgcguucggcccggggcagacccugcuguccagcgugcacgugcucgaccuggaggcccggggcuacaucaagccccacgucgacuccaucaaguucugcggggccacgaucgccggccugagccuccugucccccagcgugaugcgccuggugcacacccaggagcccggggaguggcucgagcugcugcucgagccgggcucccuguacauccugcggggcagcgcccgcuacgacuucucccacgagauccuccgggacgaggagagcuucuucggggagcgccggaucccccgcggccggcgcaucuccgucaucugccgcagccugcccgaggggaugggccccggcgagagcgggcagccgccgcccgcgugcuga

SEQ ID NO: 26574 - RNA, 2004 nt, Artificial Sequence
  derived and/or modified sequence opt1 from ALKBH8__Homo_sapiens__NP_001287939
auguucgccauggacagcaaccaccaguccaacuacaagcugagcaagaccgagaagaaguuccuccgcaagcagaucaaggccaagcacacccugcugcggcacgagggcaucgagacgguguccuacgcgacccagagccucgucguggccaacgggggccuggggaacggcgugucccgcaaccagcugcuccccguccuggagaagugcgggcugguggacgcccuccugaugccgcccaacaagcccuacagcuucgcccgguaccgcaccaccgaggaguccaagcgggccuacgugacgcugaacggcaaggaggucguggacgaccucggccagaagaucacccuguaccugaacuucguggagaagguccaguggaaggagcuccgcccccaggcgcugccgcccgggcugauggugguggaggagaucaucagcuccgaggaggagaagaugcuccuggagagcgucgacuggaccgaggacaccgacaaccagaacucccagaagucccugaagcaccggcgcgugaagcacuucggcuacgaguuccacuacgagaacaacaacguggacaaggacaagccccucagcgggggccugcccgacaucugcgagagcuuccuggagaaguggcuccggaagggguacaucaagcacaagccggaccagaugacgaucaaccaguacgagcccggccagggcauccccgcccacaucgacacccacuccgccuucgaggacgagaucgucagccugucccuggggagcgagaucgugauggacuucaagcaccccgacggcaucgccgugccggucaugcucccccgccggucccugcuggugaugaccggggagagccgcuaccucuggacccacggcaucacgugccggaaguucgacaccgugcaggcgagcgagucccucaagagcggcaucaucaccuccgacgucggggaccugacccugagcaagcgcggccugcggacguccuucaccuuccgcaaggugcggcagacccccugcaacugcagcuacccccuggugugcgacucccagcgcaaggagaccccgcccagcuuccccgaguccgacaaggaggccagccggcucgagcaggaguacguccaccagguguacgaggagaucgccgggcacuucuccagcacgcgccacacccccuggccgcacaucgucgaguuccugaaggcccugcccuccggcagcaucguggccgacaucgggugcggcaacggcaaguaccucgggaucaacaaggagcuguacaugaucggcugcgaccggucccagaaccugguggacaucugccgcgagcgccaguuccaggcguucgucugcgacgcccucgccgugcccgugcggagcggguccugcgacgccugcaucagcaucgccgucauccaccacuucgcgaccgccgagcgccggguggccgcccugcaggagaucgugcgccugcuccggcccggcgggaaggcccugaucuacgucugggcgauggagcaggaguacaacaagcagaaguccaaguaccugcgcggcaaccggaacagccagggcaagaaggaggagaugaacagcgacaccuccgugcagcgcagccucguggagcagaugcgggacauggggucccgcgacagcgccuccagcgucccgcggaucaacgacucccaggagggcgggugcaacagccgccagguguccaacagcaagcugcccgugcacgucaaccggacguccuucuacagccaggacgugcuggugcccuggcaccugaagggcaaccccgacaaggggaagccggucgagcccuucggccccaucggcucccaggacccgagccccguguuccaccgcuacuaccacguguuccgggagggggagcucgagggcgccugccgcaccgucuccgacgugcggauccugcagagcuacuacgaccaggggaacuggugcgugauccugcagaaggccuga

SEQ ID NO: 26575 - RNA, 4863 nt, Artificial Sequence
  derived and/or modified sequence opt1 from ALK__Homo_sapiens__NP_004295
augggcgccaucgggcugcucuggcugcugccccuccugcugagcaccgccgcggugggcuccgggaugggcaccgggcagcgcgccggcagcccggccgccggccccccccuccagccccgggagccgcuguccuacagccgccugcagcggaagucccucgccgucgacuucguggugcccagccuguuccgcgucuacgcgcgggaccugcuccugccccccuccagcuccgagcugaaggccgggcgcccggaggcccggggcagccucgcccuggacugcgcgccccugcuccgccugcuggggcccgcccccggcguguccuggacggccgggagcccggcccccgccgaggcgcggacccucucccgcgugcugaagggcggcagcguccggaagcugcgccgggccaagcagcucgugcuggagcugggggaggaggccauccucgagggcugcguggggccccccggcgaggccgccgucggccugcugcaguucaaccucuccgagcuguucagcugguggauccgccagggggagggccggcugcgcauccggcucaugccggagaagaaggcguccgagguggggcgcgagggccggcugagcgccgccauccgcgccucccagccccggcugcucuuccagaucuucgggaccggccacagcagccuggagucccccaccaacaugcccagcccgucccccgacuacuucacguggaaccugaccuggaucaugaaggacagcuuccccuuccucucccaccgcagccgcuacggccuggagugcuccuucgacuuccccugcgagcuggaguacagcccgccccuccacgaccugcggaaccaguccuggagcuggcgccggauccccuccgaggaggccagccagauggaccugcucgacgggcccggcgcggagcgcuccaaggagaugccgcgggggagcuuccugcugcucaacaccuccgccgacagcaagcacaccauccugucccccuggaugcgcagcuccagcgagcacugcacgcuggccgugagcguccaccggcaccugcagcccuccggccgcuacaucgcccagcuccugccgcacaacgaggccgcgcgggagauccugcucaugcccacccccgggaagcacggcuggaccgugcugcagggccgcaucgggcggcccgacaacccguuccgcguggcccuggaguacaucagcuccggcaaccggagccucuccgccgucgacuucuucgcccugaagaacugcagcgaggggaccucccccggcagcaagauggcgcugcaguccagcuucacgugcuggaacgggaccgugcuccagcugggccaggccugcgacuuccaccaggacugcgcccagggcgaggacgagucccagaugugccgcaagcugcccgugggguucuacugcaacuucgaggacggcuucugcggguggacccagggcacccucagcccccacacgccgcaguggcagguccggacccugaaggacgcccgcuuccaggaccaccaggaccacgcccugcuccuguccaccaccgacgugcccgcgagcgaguccgccacggugaccagcgccaccuuccccgcccccaucaaguccagcccgugcgagcugcggaugagcuggcucauccgcggcguccugcgggggaacgugucccuggugcucgucgagaacaagaccggcaaggagcaggggcgcaugguguggcacgucgccgcguacgagggccugagccuguggcaguggauggugcucccccugcuggacguguccgaccgcuucuggcuccagauggucgccuggugggggcagggcagccgggccaucguggccuucgacaacaucuccaucagccuggacugcuaccugacgaucuccggcgaggacaagauccuccagaacaccgcccccaagagccgcaaccuguucgagcggaaccccaacaaggagcugaagccgggggagaacuccccccgccagacccccaucuucgaccccaccgugcacuggcucuucacgaccugcggcgcgagcgggccgcacggccccacccaggcccagugcaacaacgccuaccagaacuccaaccugagcgucgaggugggguccgagggcccccugaagggcauccagaucuggaaggugcccgccaccgacacguacagcaucuccggguacggcgcggccgggggcaaggggggcaagaacaccaugaugcggagccacggcgucuccgugcucgggaucuucaaccuggagaaggacgacaugcuguacauccucgugggccagcagggggaggacgccugcccgagcaccaaccagcugauccagaaggucugcaucggcgagaacaacgugaucgaggaggagauccgcgugaaccgguccguccacgagugggccgggggcggcgggggcgggggcggcgccaccuacguguucaagaugaaggacggggugcccgucccccugaucaucgcggccggcgggggcgggcgcgccuacggcgccaagacggacaccuuccacccggagcggcucgagaacaacagcagcgugcugggccugaacgggaacuccggcgccgcggggggcgggggcggcuggaacgacaacaccagccuccugugggccgggaagucccugcaggagggcgccaccgggggccacagcugcccccaggccaugaagaagugggggugggagacccgcggcggcuucgggggcgggggcggcgggugcuccagcggcgggggcgggggcggcuacaucgggggcaacgccgcguccaacaacgaccccgagauggacggggaggacggcgugagcuucaucuccccccucgggauccuguacacgccggcccugaaggucauggagggccacggcgaggugaacaucaagcacuaccucaacugcagccacugcgagguggacgagugccacauggaccccgagucccacaaggucaucugcuucugcgaccacgggaccgugcuggccgaggacggcgugagcugcaucgucucccccacccccgagccgcaccugccccucagccugauccuguccguggugaccagcgcccucgucgcggcccuggugcuggccuucuccgggaucaugaucguguaccggcgcaagcaccaggagcuccaggccaugcagauggagcugcagagccccgaguacaagcuguccaagcuccggacgagcaccaucaugaccgacuacaaccccaacuacugcuucgccggcaagaccagcuccaucagcgaccugaaggaggucccgcgcaagaacaucacgcugauccgggggcucggccacggcgcguucggggagguguacgagggccagguguccgggaugcccaacgaccccagcccccugcaggucgccgugaagacccugccggaggugugcuccgagcaggacgagcucgacuuccugauggaggcccugaucaucagcaaguucaaccaccagaacaucguccgcugcaucggcgugucccuccagagccugccccgguucauccugcucgagcugauggccgggggcgaccugaaguccuuccuccgcgagacccggccccgccccagccagccguccagccuggccaugcuggaccuccugcacguggcgcgggacaucgccugcggcugccaguaccuggaggagaaccacuucauccaccgcgacaucgccgcccgcaacugccuccugaccugccccgggcccggccgggucgccaagaucggggacuucggcauggcgcgcgacaucuaccgggccuccuacuaccgcaagggcgggugcgccaugcugcccgugaaguggaugccgcccgaggccuucauggagggcaucuucacgagcaagaccgacaccugguccuucggggugcuccugugggagaucuucagccugggcuacaugcccuaccccuccaagagcaaccaggagguccucgaguucgugaccuccgggggccggauggacccgcccaagaacugccccggcccgguguaccgcaucaugacgcagugcuggcagcaccagcccgaggaccggcccaacuucgccaucauccuggagcgcaucgaguacugcacccaggaccccgacgucaucaacaccgcgcugccgaucgaguacgggccccucguggaggaggaggagaaggugcccguccggcccaaggacccggagggcgugcccccccugcuggucagccagcaggccaagcgcgaggaggagcggagccccgccgccccgcccccccugcccaccacguccagcgggaaggcggccaagaagccgaccgccgccgagaucuccgugcgcgugccccggggccccgccgucgaggggggccacgugaacauggcguucagccaguccaaccccccgagcgagcuccacaaggugcacggcucccgcaacaagcccaccagccuguggaaccccaccuacggguccugguucacggagaagcccaccaagaagaacaacccgaucgccaagaaggagccccacgaccggggcaaccuggggcucgagggcagcugcaccgucccccccaacguggccaccgggcgccugccgggcgccucccugcuccuggagcccagcucccugacggccaacaugaaggaggugccccucuuccggcugcgccacuucccgugcggcaacgucaacuacggguaccagcagcagggccugccccucgaggcggccaccgcccccggggccggccacuacgaggacaccauccugaagagcaagaacuccaugaaccagcccgggccguga

SEQ ID NO: 26576 - RNA, 1176 nt, Artificial Sequence
  derived and/or modified sequence opt1 from ALLC__Homo_sapiens__NP_060906
auggacauggccagcgaguccgugggcgggaagauccuguucgccaccgacgacuucuucgcgcccgccgagaaccucaucaagagcgacuccccgugcuucaaggagcacgaguacaccgaguucggcaaguggauggacgggugggagacgcgccggaagcgcauccccggccacgacuggugcguccugcggcuggggauccagggcgugauccgcggcuucgacguggacgucagcuacuucaccggggacuacgcgccccggguguccauccaggccgccaaccucgaggaggacaagcugcccgagaucccggagcgcggcacccggaccggggccgccgccacgcccgaggaguucgaggccaucgcggagcucaagagcgacgacugguccuaccuggugcccaugaccgagcugaagcccggcaacccggccagcgggcacaacuacuuccuggucaacucccagcagcgcuggacccacauccggcucaacaucuuccccgacggcggcaucgcccgccugcggguguucgggaccggccagaaggacuggacggccaccgaccccaaggagcccgccgaccugguggcgaucgccuucgggggcgucugcgugggcuucagcaacgccaaguucgggcacccgaacaacaucaucggcgucgggggcgccaaguccauggccgacgggugggagaccgcgcgccggcucgaccgcccgcccauccuggagaacgacgagaacggcauccugcucgugcccggcugcgagugggccguguuccggcuggcccaccccggggugaucacccgcaucgagaucgacacgaaguacuucgagggcaacgcccccgacagcugcaaggucgacgggugcauccugaccacccaggaggaggaggccgugauccggcagaaguggauccuccccgcgcacaaguggaagccccugcugccggugaccaagcucucccccaaccagagccaccuguucgacucccugacgcucgagcugcaggacgucaucacccacgcccgccugaccaucgugcccgacggcggggugagccggcuccgccugcggggcuuccccuccagcaucugccugcuccgcccgcgcgagaagcccaugcugaaguucuccgucagcuucaaggccaaccccuga

SEQ ID NO: 26577 - RNA, 12510 nt, Artificial Sequence
  derived and/or modified sequence opt1 from ALMS1__Homo_sapiens__NP_055935
auggagcccgaggaccugcccuggcccggcgagcuggaggaggaggaggaggaggaggaggaggaggaggaggaggaggaggaggaggccgccgccgccgccgccgccaacguggacgacgucgugguggucgaggagguggaggaggaggcggggcgcgagcuggacagcgacagccacuacggcccccagcaccuggagagcaucgacgacgaggaggacgaggaggccaaggccuggcugcaggcccaccccgggcggauccugccgccccugagcccgccccagcaccgcuacagcgagggcgagcggaccucccucgagaagaucgugccgcugaccugccacgucuggcagcagaucguguaccaggggaacagccgcacccagaucuccgacaccaacguggucugccuggagaccaccgcgcagcggggcagcggcgacgaccagaagaccgaguccuggcacugccucccccaggagauggacagcucccagacccuggacaccagccagacccgcuucaacgugcggaccgaggacaccgaggugaccgacuuccccucccuggaggaggggauccucacccagagcgagaaccaggucaaggagcccaaccgcgaccuguucugcuccccgcugcucgugauccaggacagcuucgccucccccgaccugccccugcugaccugccugacccaggaccaggaguucgcccccgacagccuguuccaccaguccgagcucagcuucgccccgcugcggggcauccccgacaagagcgaggacaccgagugguccagccgccccuccgaggugagcgaggcccuguuccaggcgaccgccgaggucgccuccgaccucgccagcucccgguucagcgugucccagcacccccugaucgggagcacggccgugggcucccagugcccguuccugcccagcgagcaggggaacaacgaggagaccaucuccagcgucgacgagcucaagauccccaaggacugcgaccgcuacgacgaccugugcuccuacaugagcuggaagacccggaaggacacccaguggcccgagaacaaccuggcggacaaggaccagguguccguggccacgagcuucgacaucaccgacgagaacaucgccaccaagcgcuccgaccacuucgacgccgcccggagcuacggccaguacuggacccaggaggacagcuccaagcaggcggagacguaccucaccaagggccugcaggggaaggucgagagcgacgugaucacccuggacggccucaacgagaacgccguggucugcuccgagcgcguggccgagcugcagcggaagccgacccgcgagagcgaguaccacuccagcgaccugcggaugcuccgcaugucccccgacacgguccccaaggcccccaagcaccugaaggccggggacaccagcaagggcggcaucgcgaaggugacccaguccaaccugaaguccgggaucaccacgaccccgguggacuccgacaucggcagccaccucucccugagccuggaggaccucucccagcuggccgucagcagcccccuggagaccaccacggggcagcacaccgacacccucaaccagaagacccuggccgacacccaccugacggaggagacccucaaggugaccgccauccccgagccggcggaccagaagaccgccacgcccaccgugcugagcagcucccacagccaccggggcaagcccuccaucuucuaccagcaggggcugcccgacagccaccugaccgaggaggcccucaaggucuccgccgccccgggccuggcggaccagaccacgggcaugagcacccugaccuccaccagcuacucccaccgcgagaagcccgggacguucuaccagcaggagcuccccgagagcaaccugaccgaggagccccuggagguguccgccgccccgggccccguggagcagaagaccgggauccccaccgucagcuccacgagccacucccacguggaggaccuccuguucuucuaccgccagacccugcccgacggccaccucaccgaccaggcccugaaggugagcgccgucuccgggccggcggaccagaagaccggcacggccaccgugcugagcacgccccacucccaccgggagaagcccggcaucuucuaccagcaggaguucgccgacagccaccagaccgaggagacgcucaccaaggugagcgccacccccgggccggccgaccagaagaccgagauccccgcgguccaguccagcuccuacagccagcgcgagaagcccuccauccuguacccccaggaccuggccgacagccaccucccggaggagggccugaagguguccgccguggccgggcccgcggaccagaagacgggccugcccaccguccccagcuccgccuacagccaccgggagaagcuccugguguucuaccagcaggcccugcucgacucccaccuccccgaggaggcccugaaggugagcgccgucuccgggcccgcggacggcaagaccggcacccccgccgugacgagcaccuccagcgccuccagcucccucggggagaagccgagcgccuucuaccagcagacccugcccaacagccaccugaccgaggaggcccucaagguguccaucguccccggccccggggaccagaagacgggcaucccgagcgcgcccuccagcuucuacucccaccgcgagaagcccaucaucuucagccagcagacccugcccgacuuccuguucccggaggaggcccucaagguguccgccgugagcguccuggccgcccagaagaccggcacccccaccguguccagcaacucccacagccacuccgagaaguccuccguguucuaccagcaggagcugcccgacagcgaccucccccgggagucccugaagaugagcgcgaucccggggcugacggaccagaagaccguccccacccccaccgugcccuccggcagcuucagccaccgcgagaagccguccaucuucuaccagcaggaguggcccgacagcuacgccacggagaaggcccucaagguguccaccgggcccggccccgccgaccagaagaccgagaucccggcgguccagagcuccagcuacccccagcgggagaagcccuccgugcuguacccccaggugcugagcgacucccaccucccggaggagagccugaaggucuccgccuuccccgggcccgccgaccagaugaccgacacgcccgccgugccgagcaccuucuacucccagcgcgagaagcccggcaucuucuaccagcagacccugcccgagagccaccucccgaaggaggcccugaagaucuccguggcgcccggccuggccgaccagaagaccgggacgcccaccgucaccagcaccuccuacagccagcaccgggagaagcccuccaucuuccaccagcaggcccucccgggcacgcacauccccgaggaggcccagaaggugagcgccgugaccgggcccggcaaccagaagaccuggaucccccgcguccugagcaccuucuacucccagcgggagaagccggggaucuucuaccagcagacgcugcccggcagccacauccccgaggaggcgcagaaggugucccccgugcucggcccggccgaccagaagaccgggacccccacccccacgagcgccuccuacagccacaccgagaagcccggcaucuucuaccagcagguccugccggacaaccaccccaccgaggaggcccugaagaucuccguggccagcgagcccguggaccagaccacggggacccccgcggucaccuccaccagcuacucccaguaccgcgagaagccgagcaucuucuaccagcagucccuccccagcucccaccugacggaggaggccaagaacgugagcgccgugcccggccccgccgaccagaagaccgucaucccgauccugcccuccaccuucuacagccacaccgagaagcccgggguguucuaccagcagguccucccccacucccacccgacggaggaggcccugaagaucagcguggcgagcgagcccguggaccagaccaccggcacccccaccgucacguccaccagcuacucccagcacaccgagaagccgagcaucuucuaccagcagucccugcccggcagccaccucaccgaggaggccaagaacguguccgccgugcccgggcccggcgaccggaagacggggaucccgacccugcccagcaccuucuacucccacaccgagaagcccggcagcuucuaccagcagguccugccccacucccaccucccggaggaggcccuggaggugagcguggcgcccgggcccgucgaccagacgaucggcacccccaccgugaccuccccgagcuccagcuucggcgagaagcccaucgugaucuacaagcaggccuuccccgaggggcaccuccccgaggagucccucaaggucagcguggccccgggccccguggggcagacgaccggcgcccccaccaucaccagccccuccuacagccagcaccgcgccaaguccggcagcuucuaccagcuggcgcugcucgggucccagaucccggaggaggcccugcgggucagcuccgcccccggccccgccgaccagacgaccgggauccccaccaucaccagcacguccuacagcuucggcgagaagccgaucgugaacuacaagcaggccuuccccgacgggcaccuccccgaggaggcgcucaagguguccaucgucagcggcccgaccgagaagaagaccgacauccccgccggcccccugggguccagcgcccugggcgagaagcccaucaccuucuaccgccaggcccuccuggacuccccgcugaacaaggagguggugaaggucagcgccgcgcccgggcccgccgaccagaagacggagacccuccccgugcacuccaccagcuacuccaaccggggcaagccggugaucuucuaccagcagacccugagcgacagccaccuccccgaggaggcccucaaggugccgcccgugccggggcccgacgcccagaagacggagacccccuccgugagcuccagccuguacuccuaccgcgagaagcccaucgucuucuaccagcaggcgcugccggacagcgagcucacccaggaggcccugaagguguccgccgugccccagcccgccgaccagaagaccggccugagcacggucaccuccagcuucuacucccacaccgagaagcccaacaucagcuaccagcaggagcucccggacucccaccugaccgaggaggcccugaaggugagcaacgugcccggccccgcggaccagaagacgggggucuccaccgugaccagcaccuccuacagccaccgggagaagcccaucguguccuaccagcgcgagcucccgcacuucacggaggccggccugaagauccugcgcguccccgggcccgccgaccagaagaccggcaucaacauccuccccagcaacagcuacccgcagcgggagcacuccgugaucagcuacgagcaggagcugcccgaccugaccgaggugacccucaaggccaucgggguccccggcccggccgaccagaagaccggcauccagaucgcguccagcuccagcuacuccaaccgcgagaaggccagcaucuuccaccagcaggagcugcccgacgugacggaggaggcccugaacguguucgucgugcccgggcagggcgaccggaagaccgagauccccaccgugccgcuguccuacuacagccgccgggagaagcccuccgucaucagccagcaggagcuccccgacucccaccugaccgaggaggcccugaaggugagccccguguccaucccggccgagcagaagacggggauccccaucggccucagcuccagcuacucccacagccacaaggagaagcugaagaucagcaccguccacauccccgacgaccagaagaccgaguuccccgcggccacccuguccagcuacucccagaucgagaagccgaagaucagcacggugaucggccccaacgaccagaagacccccucccagaccgccuuccacagcuccuacagccagaccgugaagcccaacauccucuuccagcagcagcugccggaccgcgaccaguccaaggggauccugaagaucagcgccguccccgagcucacggacgugaacaccggcaagcccgucucccugagcuccagcuacuuccaccgggagaaguccaacaucuucagcccccaggagcugccggggucccacgugaccgaggacgugcucaaggucagcaccauccccggccccgcggggcagaagacggugcugcccaccgcccugccguccagcuucagccaccgcgagaagcccgacaucuucuaccagaaggaccuccccgaccggcaccugaccgaggacgcccugaagaucuccagcgcccucggccaggccgaccagaucaccggccugcagacggugcccuccgggaccuacagccacggcgagaaccacaagcuggucuccgagcacgugcagcgccucaucgacaaccugaacagcuccgacagcuccgugagcuccaacaacguccugcucaacagccaggcggacgaccggguggugaucaacaagccggaguccgccggguuccgcgacgucggcagcgaggagauccaggacgccgagaacuccgccaagacccugaaggagauccggacccugcucauggaggccgagaacauggcgcugaagcgcugcaacuuccccgcgccccuggcccgguuccgcgacaucagcgacaucuccuucauccagagcaagaagguggugugcuucaaggagccguccagcacgggggucagcaacggcgaccuccugcaccggcagcccuucaccgaggagucccccagcucccgcugcauccagaaggacaucggcacccagaccaaccugaagugccggcgcgggaucgagaacugggaguucaucagcuccacgaccgugcggagcccccuccaggaggccgaguccaaggugagcauggcccuggaggagacccugcgccaguaccaggcggccaaguccgucaugcgcagcgagccggagggcugcuccgggaccaucggcaacaagaucaucauccccaugaugacggugaucaagagcgacuccagcuccgacgccagcgacgggaacggcuccugcagcugggacagcaaccuccccgagucccuggagagcguguccgacguccugcucaacuucuuccccuacgugagcccgaagaccuccaucaccgacagccgggaggaggagggcguguccgagagcgaggacgggggcggguccagcgucgacucccuggccgcccacgugaagaaccugcuccagugcgagagcucccugaaccacgcgaaggagauccugcgcaacgccgaggaggaggagagccgggugcgcgcccacgccuggaacaugaaguucaaccucgcgcacgacugcggcuacuccaucagcgagcugaacgaggacgaccggcgcaaggucgaggagaucaaggccgagcuguucgggcacggccggaccacggaccucuccaagggccugcagagcccccgcgggaugggcugcaagcccgaggccgugugcucccacaucaucaucgagagccacgagaaggggugcuuccggacccugaccagcgagcacccccagcucgaccgccacccgugcgccuuccgguccgccggccccagcgagaugacccgcggccggcagaaccccuccagcugccgcgcgaagcacgugaaccuguccgccagccuggaccagaacaacucccacuucaaggucuggaacagccuccagcugaagucccacagccccuuccagaacuucaucccggacgaguucaagaucuccaaggggcugcggaugcccuucgacgagaagauggaccccuggcucagcgagcugguggagcccgccuucgugccgcccaaggaggucgacuuccacuccagcucccagaugcccagccccgagccgaugaagaaguucaccacguccaucaccuucagcucccaccgccacagcaagugcaucagcaacuccagcguggugaaggucggcgugaccgaggggucccagugcaccggcgccagcgugggggucuucaacucccacuucacggaggagcagaacccgccccgggaccugaagcagaagaccagcucccccagcuccuucaagaugcacagcaacucccaggacaaggaggugaccauccucgccgagggccgccggcagagccagaagcugccgguggacuucgagcgcuccuuccaggaggagaagccccuggagcgcagcgacuucaccggcucccacagcgagcccuccacgcgggcgaacugcagcaacuucaaggagauccagaucuccgacaaccacacccucaucagcauggggcgcccgagcuccacccugggcgucaaccggagcuccagccgccugggggugaaggagaagaacgugaccaucacgcccgaccuccccuccugcaucuuccuggagcagcgggagcuguucgagcagagcaaggcgccccgggccgacgaccacguccggaagcaccacuccccgagcccccagcaccaggacuacguggcccccgaccuccccuccugcaucuuccuggagcagcgcgagcuguucgagcagugcaaggccccguacguggaccaccagaugcgggagaaccacagcccccucccccagggccaggacuccaucgcgagcgaccugcccuccccgaucagccuggagcagugccaguccaaggcccccggggucgacgaccagaugaacaagcaccacuucccccucccccagggccaggacugcgugguggagaagaacaaccagcacaagcccaagagccacaucuccaacaucaacgucgaggccaaguucaacaccguggucagccaguccgcccccaaccacugcacccuggcggccagcgccagcacgccgcccuccaaccgcaaggcccugagcugcgugcacaucacgcucugcccgaagaccuccagcaagcuggacuccggcacccuggacgagcgguuccacagccucgacgccgcguccaaggcccgcaugaacagcgaguucaacuucgaccugcacaccguguccagccggucccuggagcccacgagcaagcuccugaccuccaagcccgucgcccaggaccaggagagccugggguuccucggccccaaguccagccuggacuuccagguggugcagccgucccugcccgacagcaacaccaucacccaggaccucaagacgauccccucccagaacagccagaucgucaccagccgccagauccaggugaacaucuccgacuucgaggggcacagcaacccggagggcacccccguguucgccgaccggcugcccgagaagaugaagacgccccuguccgccuucagcgagaagcucuccagcgacgcggucacgcagaucaccaccgaguccccggagaagacccuguucagcuccgagaucuucaucaacgccgaggaccgcgggcacgagaucaucgagcccggcaaccagaagcugcggaaggcccccgugaaguucgccagcuccagcuccgugcagcaggucacguucagccgcggcaccgacgggcagccccuccugcugccguacaagcccuccggcagcaccaagauguacuacgugccccagcuccggcagaucccgcccucccccgacagcaagagcgacaccacgguggaguccagccacuccgggagcaacgacgccaucgcgcccgacuuccccgcccagguccugggcacccgcgacgacgaccuguccgccaccgugaacaucaagcacaaggaggggaucuacagcaagcggguggucaccaaggccucccugcccgugggcgagaagccccuccagaacgagaacgcggacgccagcgugcagguccugaucaccggcgacgagaaccuguccgacaagaagcagcaggagauccacagcacgcgcgccgugaccgaggccgcccaggcgaaggagaaggagucccuccagaaggacaccgccgacagcuccgccgccgccgcggccgagcacagcgcccaggugggggaccccgagaugaagaaccugcccgacaccaaggccaucacgcagaaggaggagauccaccgcaagaagaccgucccggaggaggccuggcccaacaacaaggagucccugcagaucaacaucgaggagagcgagugccacuccgaguucgagaacaccacccggagcguguuccgcuccgcgaaguucuacauccaccaccccgugcaccuccccagcgaccaggacaucugccacgagagccugggcaaguccgucuucaugcggcacagcuggaaggacuucuuccagcaccacccggacaagcaccgcgagcacaugugccugccccuccccuaccagaacauggacaagacgaagaccgacuacacccggaucaagucccugagcaucaacgugaaccuggggaacaaggaggugauggacaccacgaagucccagguccgcgacuaccccaagcacaacggccagaucagcgacccgcagcgggaccagaaggugacccccgagcagaccacccagcacacggugucccucaacgagcuguggaacaaguaccgcgagcggcagcgccagcagcggcagcccgagcugggcgaccgcaaggagcucagccuggucgaccggcuggaccgccucgccaagauccugcagaacccgaucacccacucccugcaggucagcgaguccacccacgacgacagccgcggggagcgcuccgugaaggaguggagcggccggcagcagcagcgcaacaagcuccagaagaagaagcgguucaagucccuggagaagucccacaagaacaccggggagcugaagaaguccaagguccucagccaccaccgcgccggccgcuccaaccagaucaagaucgagcagaucaaguucgacaaguacauccugagcaagcagcccggguucaacuacaucagcaacacguccagcgacugccggcccuccgaggagagcgagcugcucaccgacaccaccacgaacauccuguccggcaccaccagcaccguggaguccgacauccugacgcagaccgaccgcgagguggcccuccacgagcggagcuccagcgucuccaccaucgacaccgcccgccugauccaggcguucggccacgagcgggugugccugagcccccgccggaucaagcucuacuccagcaucacgaaccagcagcgccgguaccuggagaagcgcuccaagcacagcaagaaggugcugaacaccgggcacccgcucgucaccuccgagcacacccggcgccggcacauccagguggccaaccacgugaucagcuccgacagcaucagcuccagcgccuccagcuuccuguccagcaacuccacguucugcaacaagcagaacguccacaugcugaacaagggcauccaggccgggaaccucgagaucgugaacggcgcgaagaagcacacccgcgacguggggaucaccuuccccacccccagcuccagcgaggccaagcuggaggagaacuccgacgucaccagcugguccgaggagaagcgggaggagaagaugcuguucacgggcuaccccgaggaccgcaagcucaagaagaacaagaagaacagccacgagggcguguccugguucgugccggucgagaacguggagagccgguccaagaaggagaacguccccaacacgugcgggcccggcaucagcugguucgagcccaucaccaagacccgcccguggcgggagccccugcgcgagcagaacugccaggggcagcaccuggacggccggggguaccucgccggccccggccgcgaggccgggcgcgaccugcugcggcccuucgugcgcgccacgcuccaggagucccugcaguuccaccggccggacuucaucagccgcagcggcgagcggaucaagcgccugaagcucaucgugcaggagcggaagcugcaguccaugcugcagaccgagcgcgacgcccuguucaacaucgaccgggagcgccaggggcaccagaaccggaugugcccccugcccaagcgcgucuuccuggccauccagaagaacaagcccaucagcaagaaggagaugauccagcgguccaagcgcaucuacgagcagcucccggaggugcagaagaagcgggaggaggagaagcgcaagagcgaguacaaguccuaccggcugcgcgcccagcuguacaagaagcgggugaccaaccagcuccugggccgcaagguccccugggacuga

SEQ ID NO: 26578 - RNA, 2106 nt, Artificial Sequence
  derived and/or modified sequence opt1 from ALOX12B__Homo_sapiens__NP_001130
auggccaccuacaaggugcgcgucgccaccggcacggaccugcucagcgggacccgggacuccaucagccugaccaucgugggcacccagggggagucccacaagcagcugcucaaccacuucggccgcgacuucgccacgggggccgugggccaguacaccguccagugcccccaggaccugggcgagcugaucaucauccggcuccacaaggagcgcuacgccuucuucccgaaggaccccugguacugcaacuacgugcagaucugcgcccccaacgggcggaucuaccacuuccccgccuaccaguggauggacggcuacgagacccuggcgcugcgcgaggccaccgggaagacgaccgccgacgacagccucccggugcugcuggagcaccggaaggaggagauccgcgccaagcaggacuucuaccacuggcgggucuuccuccccggccugcccuccuacgugcacauccccagcuaccgcccgcccgugcggcgccaccggaaccccaaccgccccgaguggaacggguacaucccgggcuuccccauccugaucaacuucaaggcgaccaaguuccucaaccugaaccugcgguacuccuuccucaagaccgccagcuucuucguccgccugggccccauggcccuggccuucaaggugcgggggcuccuggacugcaagcacuccuggaagcgccugaaggacauccggaagaucuuccccggcaagaaguccguggucagcgaguacguggccgagcacugggcggaggacacguucuucggguaccaguaccucaacggcgugaacccgggccugauccgccggugcacccgcauccccgacaaguuccccgucaccgacgacaugguggcccccuuccugggggaggggaccugccuccaggccgagcuggagaaggggaacaucuaccuggccgacuaccgcaucauggagggcaucccgacgguggagcucagcgggcggaagcagcaccacugcgcgccccugugccugcuccacuucggccccgagggcaagaugaugcccaucgccauccagcugucccagaccccggggcccgacugccccaucuuccugcccagcgacuccgagugggacuggcuccuggccaagaccuggguccgcuacgccgaguucuacagccacgaggccaucgcccaccuccuggagacccaccugaucgcggaggccuucugccuggcccuccugcggaaccugccgaugugccacccccucuacaagcugcugaucccccacacgcgcuacaccgugcagaucaacuccaucggccgggccgugcuccugaacgagggcggccugagcgccaaggggaugucccugggcgucgagggcuucgcgggggugauggugcgcgcccucagcgagcugaccuacgacagccuguaccucccgaacgacuucgucgagcggggcgugcaggaccugcccggguacuacuaccgcgacgacucccuggccgucuggaacgcccucgagaaguacgugaccgagaucaucacguacuacuaccccagcgacgcggccguggagggcgaccccgagcugcaguccuggguccaggagaucuucaaggagugccugcucgggcgggagagcuccggcuucccgcgcugccugcggaccgugcccgagcugauccgcuacgugaccaucgucaucuacacgugcagcgccaagcacgccgccgugaacaccggccagauggaguucaccgcguggaugcccaacuuccccgccuccaugcggaacccgcccauccagaccaaggggcucaccacgcuggagaccuucauggacacccugcccgacgugaagaccacgugcaucacccuccugguccuguggacccucagccgcgagcccgacgaccggcgcccgcugggccacuuccccgacauccacuucguggaggaggcgccccggcgcuccaucgaggccuuccggcagcgccugaaccagaucagccacgacauccgccagcggaacaagugccuccccaucccguacuacuaccuggaccccgugcugaucgagaacuccaucagcaucuga

SEQ ID NO: 26579 - RNA, 1992 nt, Artificial Sequence
  derived and/or modified sequence opt1 from ALOX12__Homo_sapiens__NP_000688
augggccgcuaccggauccgcguggccaccggggccuggcuguucagcggcuccuacaaccggguccagcucuggcugguggggacccgcggcgaggcggagcuggagcuccagcugcggcccgcccgcggggaggaggaggaguucgaccacgacguggccgaggaccugggccuccugcaguucguccggcugcgcaagcaccacuggcucguggacgacgccugguucugcgaccggaucacggugcagggcccgggggccugcgcggaggucgccuuccccugcuaccgcugggugcagggcgaggacauccugagccugcccgaggggaccgcccggcuccccggcgacaacgcccuggacauguuccagaagcaccgcgagaaggagcugaaggaccggcagcagaucuacugcugggcgaccuggaaggaggggcucccgcugaccaucgccgccgaccgcaaggacgaccugccgcccaacaugcgguuccacgaggagaagcgccucgacuucgaguggacgcugaaggccggcgcccuggagauggcgcucaagcggguguacacccugcuguccagcuggaacugccucgaggacuucgaccagaucuucuggggccagaaguccgcccuggccgagaagguccgccagugcuggcaggacgacgagcuguucagcuaccaguuccucaacggggccaaccccaugcugcugcggcgcuccaccagccuccccucccggcuggugcugcccagcggcauggaggagcuccaggcccagcuggagaaggagcugcagaacgggucccucuucgaggcggacuucauccugcuggacggcauccccgccaacgugauccgcggcgagaagcaguaccucgccgcgccccuggucaugcugaagauggagccgaacgggaagcuccagcccauggugauccagauccagccgcccaaccccagcucccccacccccacgcuguuccugcccagcgacccgccccucgccuggcugcuggccaaguccugggugcgcaacagcgacuuccagcuccacgagauccaguaccaccuccugaacacccaccuggucgccgaggugaucgccguggccaccaugcggugccugcccggccugcaccccaucuucaaguuccugaucccgcacauccgcuacaccauggagaucaacacgcgggcccgcacccagcucaucuccgacgggggcaucuucgacaaggcggucagcaccgggggcggcgggcacgugcagcugcugcggcgcgccgccgcccagcucaccuacugcucccugugcccgcccgacgaccuggcggaccggggccuccuggggcugcccggcgcccucuacgcccacgacgcccugcgccugugggagaucaucgcccgguacguggaggggaucguccaccucuucuaccagcgcgacgacaucgugaagggcgaccccgagcugcaggcguggugccgggagaucacggaggugggccugugccaggcccaggaccgcggguuccccgucagcuuccagagccagucccagcucugccacuuccugaccaugugcguguucacgugcaccgcccagcacgccgccaucaaccagggccagcuggacugguacgcguggguccccaacgccccgugcaccaugcggaugcccccgcccaccaccaaggaggacgugaccauggccacggugauggggagccuccccgacguccgccaggccugccugcagauggccaucuccuggcaccugagccggcgccagcccgacauggugccccucggccaccacaaggagaaguacuucuccgggcccaagccgaaggcggugcugaaccaguuccggaccgaccuggagaagcucgagaaggagaucaccgcccgcaacgagcagcuggacuggcccuacgaguaccugaagcccagcugcaucgagaacuccgucaccaucuga

SEQ ID NO: 26580 - RNA, 1944 nt, Artificial Sequence
  derived and/or modified sequence opt1 from ALOX15B__Homo_sapiens__NP_001034219
auggccgaguuccgcgugcgggucagcaccggcgaggccuucggggccggcaccugggacaagguguccgugagcaucgucgggacgcgcggcgagagcccgccccugccccucgacaaccuggggaaggaguucaccgccggcgccgaggaggacuuccaggugacccugcccgaggacgugggccggguccuccugcugcgcgugcacaaggccccgcccgugcucccccugcuggggccccucgcccccgacgccugguucugccggugguuccagcugaccccgccccgcggcgggcaccuccuguuccccugcuaccaguggcuggagggcgccgggacgcugguccuccaggagggcaccgccaagguguccugggccgaccaccaccccgugcugcagcagcagcggcaggaggagcugcaggcgcgccaggagauguaccaguggaaggccuacaaccccggcuggccccacugccucgacgagaagaccgucgaggaccuggagcugaacaucaaguacuccaccgccaagaacgccaacuucuaccuccaggccgggagcgcguucgccgagaugaagaucaagggccugcuggaccggaaggggcucuggcgcucccugaacgagaugaagcggaucuucaacuuccgccggacgcccgccgccgagcacgccuucgagcacuggcaggaggacgcguucuucgccagccaguuccugaacggccucaaccccgugcugauccgccggugccacuaccugcccaagaacuuccccgugaccgacgccauggucgccuccgugcucggccccgggaccagccugcaggccgagcuggagaagggcucccucuuccugguggaccacgggauccugagcggcauccagaccaacgucaucaacgggaagccccaguucuccgcggccccgaugacgcuccuguaccagagccccggcugcggcccccugcucccccuggccauccagcugucccagaccccggggcccaacagccccaucuuccuccccaccgacgacaagugggacuggcugcuggccaagaccugggugcgcaacgccgaguucuccuuccacgaggcgcucacgcaccuccugcacagccaccuccugccggagguguucacccuggccacccugcggcagcucccccacugccacccccuguucaaguccaccggcaucgggaucgagggcuucagcgagcugauccagcgcaacaugaagcagcucaacuacagccugcugugccucccggaggacauccggacgcgcggggucgaggacauccccggcuacuacuaccgggacgacggcaugcagaucuggggcgccguggagcgcuucguguccgagaucaucgggaucuacuaccccagcgacgaguccguccaggacgaccgcgagcugcaggccugggugcgggagaucuucagcaagggguuccugaaccaggaguccagcggcauccccuccagccucgagacccgcgaggcgcugguccaguacgugaccauggugaucuucacgugcuccgccaagcacgccgccgucagcgccgggcaguucgacuccugcgcguggaugccgaaccugccgcccagcaugcagcucccgccgcccaccuccaagggccuggcgaccugcgagggcuucaucgccacccugccgcccgugaacgcgaccugcgacgugauccucgcccuguggcugcucagcaaggagcccggggaccagcggccccugggcacguaccccgacgagcacuucaccgaggaggcgccccgccgguccaucgccaccuuccagagccgccuggcccagaucucccgggggauccaggagcgcaaccagggccucguccugcccuacaccuaccuggacccgccccugaucgagaacagcguguccaucuga

SEQ ID NO: 26581 - RNA, 1989 nt, Artificial Sequence
  derived and/or modified sequence opt1 from ALOX15__Homo_sapiens__NP_001131
augggccuguaccgcauccgggugagcaccggggccucccucuacgccggcagcaacaaccagguccagcuguggcugguggggcagcacggcgaggcggcccucgggaagcgccuguggcccgcccggggcaaggagaccgagcugaagguggaggucccggaguaccucggcccccugcuguucgugaagcuccgcaagcggcaccuccugaaggacgacgccugguucugcaacuggaucuccgugcaggggcccggcgccggggacgagguccgcuuccccugcuaccgguggguggagggcaacggggugcugagccugccggagggcacgggccgcaccgucggggaggacccccagggccuguuccagaagcaccgggaggaggagcucgaggagcgccggaagcuguaccgcugggggaacuggaaggacggccugauccucaacauggcgggcgccaagcuguacgaccugcccguggacgagcgguuccucgaggacaagcgcguggacuucgaggucucccuggccaaggggcuggccgaccucgcgaucaaggacagccugaacgugcugaccugcuggaaggaccucgacgacuucaaccggaucuucuggugcggccaguccaagcuggccgagcgcgugcgggacagcuggaaggaggacgcccuguucggguaccaguuccucaacggcgccaaccccgucgugcugcgccgguccgcccaccucccggcgcgccugguguucccgcccgggauggaggagcugcaggcccagcuggagaaggagcucgagggcggcacccuguucgaggccgacuucagccugcucgacgggaucaaggccaacgucauccugugcucccagcagcaccuggccgcgccccucgugaugcugaagcugcagcccgacggcaagcuccugcccauggugauccagcugcagcucccccggacggggagcccgcccccgccccuguuccugcccaccgacccgcccauggccuggcugcucgccaagugcuggguccgcuccagcgacuuccagcugcacgagcugcagucccaccuccugcgcggccaccugauggccgaggugaucguggucgccaccaugcggugccuccccagcauccaccccaucuucaagcugaucaucccccaccuccgcuacacccuggagaucaacgugcgggcgcgcacggggcuggucuccgacaugggcaucuucgaccagaucaugagcaccggcgggggcgggcacgugcagcugcucaagcaggccggcgccuuccugaccuacuccagcuucugcccgcccgacgaccuggccgaccgggggcuccugggcgucaagagcuccuucuacgcccaggacgcgcugcgccucugggagaucaucuaccgguacguggagggcaucgugagccugcacuacaagaccgacguggccgucaaggacgaccccgagcugcagacguggugccgcgagaucaccgagaucgggcuccagggcgcccaggaccggggguuccccgugucccugcaggcccgcgaccaggugugccacuucgucaccaugugcaucuucacgugcaccggccagcacgcgagcgugcaccugggccagcucgacugguacuccugggugcccaacgcccccugcaccaugcggcugccgccgcccaccaccaaggacgccacgcuggagaccgucauggccacccuccccaacuuccaccaggccagccugcagauguccaucaccuggcagcuggggcgccggcagcccgugaugguggcggucggccagcacgaggaggaguacuucagcgggcccgagcccaaggccgugcucaagaaguuccgcgaggagcuggccgcccuggacaaggagaucgagauccggaacgccaagcucgacaugcccuacgaguaccugcgcccguccguggucgagaacagcguggcgaucuga

SEQ ID NO: 26582 - RNA, 657 nt, Artificial Sequence
  derived and/or modified sequence opt1 from ALOX5AP__Homo_sapiens__NP_001191335
augcugaccuucaaccacgacgcccccuggcacacccagaagacgcucaagaccagcgaguucggcaaguccuucgggacccugggccacaucgggaacaucagccaccagugcugggccggcugcgcggccgggggccgcgccgugcuguccggcgagccggaggccaacauggaccaggagaccgucgggaacguggugcuccuggccaucgucacgcugaucagcguggugcagaacggcuucuucgcgcacaaggucgagcacgagucccggacccagaacgggcgcagcuuccagcggaccggcacccucgccuucgagcgcguguacacggccaaccagaacugcguggacgccuaccccaccuuccuggcgguccugugguccgccgggcuccugugcagccaggugcccgccgccuucgccggccugauguaccucuucgugcggcagaaguacuucgucggcuaccugggggagcgcacccaguccacccccggcuacaucuucgggaagcggaucauccuguuccucuuccugaugagcguggcgggcaucuucaacuacuaccugaucuucuucuucggcuccgacuucgagaacuacaucaagacgaucagcaccaccaucuccccgcuccugcugauccccuga

SEQ ID NO: 26583 - RNA, 2025 nt, Artificial Sequence
  derived and/or modified sequence opt1 from ALOX5__Homo_sapiens__NP_000689
augcccagcuacaccgugaccgucgccacgggcucccagugguucgccgggaccgacgacuacaucuaccugagccucgugggcuccgcggggugcagcgagaagcaccuccuggacaagccguucuacaacgacuucgagcgcggcgccguggacuccuacgacgucaccguggacgaggagcucggggagauccagcuggugcggaucgagaagcgcaaguacuggcugaacgacgacugguaccucaaguacaucacccugaagacgccccacggcgacuacaucgaguuccccugcuaccgguggaucaccggcgacgucgagguggugcugcgcgacgggcgggccaagcucgcccgcgacgaccagauccacauccugaagcagcaccggcgcaaggagcuggagacccggcagaagcaguaccgcuggauggaguggaaccccggcuucccgcucagcaucgacgccaagugccacaaggaccugccccgggacauccaguucgacuccgagaagggggucgacuucgugcugaacuacagcaaggcgauggagaaccucuucaucaaccgcuucaugcacauguuccaguccagcuggaacgacuucgccgacuucgagaagaucuucgugaagaucuccaacaccaucagcgagcgggucaugaaccacuggcaggaggaccugauguucggcuaccaguuccugaacgggugcaaccccgugcucauccgccggugcacggagcugcccgagaagcugccggugaccaccgagauggucgagugcucccucgagcgccagcugagccuggagcaggaggugcagcagggcaacaucuucaucguggacuucgagcuccuggacggcaucgacgccaacaagaccgaccccugcacgcugcaguuccucgccgcgcccaucugccugcuguacaagaaccucgccaacaagaucguccccaucgccauccagcugaaccagaucccgggggacgagaaccccaucuuccugcccuccgacgccaaguacgacuggcuccuggccaagaucugggugcggagcuccgacuuccacgugcaccagaccaucacccaccuccugcgcacccaccuggucagcgagguguucggcaucgcgauguaccggcagcugcccgccgugcacccgaucuucaagcuccuggucgcccacgugcgcuucacgaucgccaucaacaccaaggcccgggagcagcugaucugcgagugcgggcuguucgacaaggcgaacgccaccggcggcgggggccacguccagauggugcagcgcgccaugaaggaccugaccuacgccucccugugcuuccccgaggccaucaaggcgcgcgggauggagagcaaggaggacauccccuacuacuucuaccgggacgacggccuccuggugugggaggccauccgcacguucaccgccgaggucguggacaucuacuacgagggggaccagguggucgaggaggaccccgagcugcaggacuucgugaacgacguguacgucuacggcaugcggggccgcaagagcuccggguuccccaagagcgugaagucccgggagcagcucagcgaguaccugaccguggucaucuucaccgccuccgcccagcacgcggccgugaacuucggccaguacgacuggugcagcuggauccccaacgccccgcccacgaugcgcgccccgccgcccaccgcgaaggggguggucaccaucgagcagaucguggacacccugcccgaccggggccgcuccugcuggcaccugggggccgugugggcccucagccaguuccaggagaacgagcuguuccugggcauguaccccgaggagcacuucaucgagaagcccgucaaggaggccauggcccgguuccgcaagaaccucgaggcgaucguguccgugaucgccgagcggaacaagaagaagcagcugcccuacuacuaccugagcccggaccgcauccccaacuccgucgccaucuga

SEQ ID NO: 26584 - RNA, 2532 nt, Artificial Sequence
  derived and/or modified sequence opt1 from ALOXE3__Homo_sapiens__NP_001159432
augccccgcggcgccuuccggcccugccugcccgcccucuacuucgcguuccugaccugccccacccccgagcagcgcaugagcgggacgcaggccccggacauccaccugggcgagcccgcccgggggaccggcugcgugcgcgggaagcagaccuccauccggguccaggacugcggccgccgggaggaggcccgcgccgcgagccgggagcuccgccgggagaaggcccaggagcacccccgcgaguccugggcccacccccagccguaccccgcgccccagccccuggcccugcggccggagacccagcccugccccgccugccgcagcuccccgcccggccggcuccugcugcgccccgcccuccccgggcaccccuuccugcugccgaucauggccguguaccggcucugcgugacgaccggccccuaccugcgcgccgggacccuggacaacaucagcgucacccucgugggcacgugcggggagucccccaagcagcggcuggaccgcaugggccgggacuucgcgcccggcagcgugcagaaguacaagguccgcugcaccgccgagcugggggagcuccugcugcuccgcgugcacaaggagcgguacgccuucuuccgcaaggacuccugguacugcagccggaucugcgugaccgagccggacggcuccgucagccacuuccccugcuaccaguggaucgagggguacugcaccguggagcugcgccccggcacggcccggaccaucugccaggacucccugccccuccugcuggaccaccgcacccgggagcuccgcgcccggcaggagugcuaccgcuggaagaucuacgcgccgggcuuccccugcaugguggacgucaacagcuuccaggagauggaguccgacaagaaguucgcccugaccaagacgacgaccugcguggaccagggggacagcuccggcaaccgguaccugcccggguucccgaugaagaucgacauccccagccucauguacauggagcccaacgugcgcuacuccgccaccaagaccaucagccugcuguucaacgccauccccgccagccucggcaugaagcugcgggggcugcucgaccgcaagggcuccuggaagaagcuggacgacaugcagaacaucuucuggugccacaagaccuucaccaccaaguacgucacggagcacuggugcgaggaccacuucuucggcuaccaguaccugaacggggugaacccggugaugcuccacugcaucagcucccugcccagcaagcugcccgucaccaacgacaugguggcgccccuccugggccaggacacgugccugcagaccgagcucgagcgggggaacaucuuccuggccgacuacuggauccuggccgaggccccgacccacugccucaacggccgccagcaguacguggccgcgccccugugccugcuguggcucagcccccagggggcccuggucccccuggccauccagcucucccagaccccgggccccgacucccccaucuuccugcccaccgacagcgagugggacuggcugcucgccaagaccugggugcggaacuccgaguuccuggugcacgagaacaacacgcacuuccugugcacccaccuccugugcgaggcguucgccauggccacccugcgccagcucccgcugugccaccccaucuacaagcugcuccugccccacacccgguacacgcugcaggucaacaccaucgcccgcgccacccuccugaaccccgagggccugguggaccaggucaccagcaucgggcgccagggccucaucuaccugauguccaccgggcuggcgcacuucacguacaccaacuucugccucccggacagccugcgggcccgcggcgugcuggccauccccaacuaccacuaccgggacgacgggcucaagaucugggccgccaucgaguccuucgugagcgagaucgucggcuacuacuaccccuccgacgcgagcgugcagcaggacuccgagcugcaggccuggaccggcgagaucuucgcccaggccuuccuggggcgcgagagcuccggcuuccccagccggcucugcaccccgggggagauggugaaguuccugacggccaucaucuucaacugcagcgcgcagcacgccgccgucaacuccggccagcacgacuucggcgccuggaugcccaacgcgcccagcuccaugcgccagccgccgccccagaccaaggggaccaccacgcugaagaccuaccucgacacccugcccgaggugaacaucagcugcaacaaccugcuccuguucuggcuggugucccaggagcccaaggaccagcggccccucggcaccuaccccgacgagcacuucacggaggaggcgccccgccggagcaucgccgccuuccagucccgccuggcccagaucagccgggacauccaggagcgcaaccaggggcuggcccucccguacaccuaccuggacccgccccugaucgagaacuccgucagcaucuga

SEQ ID NO: 26585 - RNA, 1587 nt, Artificial Sequence
  derived and/or modified sequence opt1 from ALPI__Homo_sapiens__NP_001622
augcagggccccugggugcugcuccugcuggggcuccgccugcagcugagccucggcgucaucccggccgaggaggagaaccccgccuucuggaaccggcaggcggccgaggcccuggacgccgccaagaagcugcagcccauccagaagguggcgaagaaccucauccuguuccugggggacggccucggggugcccaccgucaccgccacgcgcauccugaagggccagaagaacggcaagcuggggccggagacgccccucgccauggaccgguuccccuaccuggcccuguccaagaccuacaacguggaccgccaggugcccgacagcgcggccaccgccaccgccuaccucugcggcgucaaggccaacuuccagaccaucgggcuguccgcggccgcccgguucaaccagugcaacaccacccgcggcaacgaggugaucagcgugaugaaccgggccaagcaggccgggaaguccgucggcguggugacgaccacccgcguccagcacgcgagcccggccggcaccuacgcccacacggugaaccggaacugguacuccgacgccgacaugcccgccagcgcgcgccaggaggggugccaggacaucgccacccagcugaucuccaacauggacaucgacgugauccucggcgggggccggaaguacauguuccccaugggcacccccgacccggaguaccccgccgacgccagccagaacgggauccgccuggacggcaagaaccugguccaggaguggcucgccaagcaccagggggcgugguacguguggaaccggaccgagcugaugcaggccucccuggaccagagcgugacgcaccucaugggccuguucgagcccggggacaccaaguacgagauccaccgcgaccccacccuggacccgucccucauggagaugaccgaggccgcccugcggcugcucagccgcaacccccggggcuucuaccuguucgucgagggcgggcgcaucgaccacggccaccacgaggggguggcguaccaggcccugacggaggccgugauguucgacgacgccaucgagcgggccggccagcucaccuccgaggaggacacccugacccuggucacggcggaccacagccacguguucuccuucgggggcuacacccuccgcggcagcuccaucuucgggcuggcccccagcaaggcccaggacagcaaggccuacaccuccauccuguacggcaacgggcccggcuacguguucaacagcgggguccggccggacgugaacgaguccgagagcggcucccccgacuaccagcagcaggccgcggucccccucagcuccgagacccacggcggggaggacguggccguguucgcccgcggcccccaggcccaccugguccacggggugcaggagcagagcuucguggcccacgucauggcguucgccgccugccuggagccguacacggccugcgaccucgcgccgcccgccugcaccaccgacgccgcccaccccguggccgcgucccugccccugcucgccggcacccugcugcugcucggcgccagcgccgcccccuga

SEQ ID NO: 26586 - RNA, 3735 nt, Artificial Sequence
  derived and/or modified sequence opt1 from ALPK1__Homo_sapiens__NP_001095876
augaacaaccagaagguggucgccgugcugcuccaggagugcaagcagguccuggaccagcugcuccuggaggcccccgacgugagcgaggaggacaaguccgaggaccagcgcugccgggcgcugcucccgagcgagcugcgcacccugauccaggaggccaaggagaugaaguggcccuucgugcccgagaaguggcaguacaagcaggccgugggccccgaggacaagaccaaccucaaggacgucaucggggccggccugcagcagcugcucgccucccugcgggcgagcauccuggcccgcgacugcgccgccgcggccgccaucguguuccucguggaccgguuccuguacgggcuggacgucuccggcaagcuccuccagguggccaaggggcugcacaagcugcagccggccacgcccaucgcgccccagguggucauccgccaggcccggaucagcgugaacuccggcaagcugcugaaggccgaguacauccucagcucccugaucagcaacaacggcgccaccgggaccuggcuguaccgcaacgaguccgacaaggugcucguccagagcgugugcauccagauccggggccagauccugcagaagcuggggaugugguacgaggccgcggagcucaucugggccuccaucgugggcuaccuggcccugccccagccggacaagaaggggcucagcaccucccugggcauccuggccgacaucuucgucagcauguccaagaacgacuacgagaaguucaagaacaacccccagaucaaccucagccugcugaaggaguucgaccaccaccuccuguccgccgcggaggccugcaagcuggccgccgccuucagcgcguacacgccccucuucgugcugaccgccgugaacauccgcgggaccugccugcucagcuacuccagcuccaacgacugcccgcccgagcugaagaaccugcaccucugcgaggccaaggaggccuucgagaucgggcugcugaccaagcgggacgacgagcccgucacgggcaagcaggagcugcacagcuucgugaaggcggccuucgggcucaccaccgugcaccgccggcugcacggcgagaccggcacgguccacgccgccucccagcugugcaaggaggccauggggaagcucuacaacuucagcaccuccagccgcucccaggaccgggaggcgcugagccaggaggugauguccgucaucgcccaggugaaggagcaccuccaggugcagagcuucuccaacgucgacgaccgcagcuacgugcccgaguccuucgagugccggcuggacaagcugauccugcacggccagggggacuuccagaagauccucgacaccuacagccagcaccacaccuccgugugcgaggucuucgagagcgacugcggcaacaacaagaacgagcagaaggacgccaagacgggggugugcaucaccgcccugaagaccgagaucaagaacaucgacaccguguccacgacccaggagaagccccacugccagcgcgacaccggcaucagcagcucccugaugggcaagaacguccagcgggagcuccgccggggcggccgccgcaacuggacccacagcgacgccuuccgggugucccuggaccaggacguggagacggagaccgagccgagcgacuacuccaacggggagggcgcggucuucaacaagagccuguccgggagccagaccuccagcgccugguccaaccucagcggcuucuccagcuccgccagcugggaggaggugaacuaccacguggacgaccgcuccgcccggaaggagcccggcaaggagcaccuggucgacacccagugcagcacggcccugagcgaggagcucgagaacgaccgcgaggggcgggcgaugcacucccugcacagccagcugcacgaccucucccugcaggagcccaacaacgacaaccuggagcccagccagaaccagccgcagcagcagaugccccucacccccuucagcccccacaacaccccgggcaucuuccuggcccccggggccggccugcucgagggggcccccgagggcauccaggaggugcgcaacaugggcccccggaacaccuccgcgcacucccgcccgagcuaccgguccgccagcugguccagcgacuccgggcgccccaagaacaugggcacgcaccccagcgugcagaaggaggaggccuucgagaucaucgucgaguucccggagaccaacugcgacgugaaggaccggcaggggaaggagcagggcgaggagaucuccgagcgcggcgccgggcccaccuucaaggccagccccuccuggguggaccccgagggcgagaccgcggagagcacggaggacgccccgcuggacuuccaccggguccugcacaacucccucgggaacaucagcaugcugcccugcagcuccuucacccccaacuggcccgugcagaacccggacagccgcaaguccggcgggcccguggccgagcagggcaucgaccccgacgccagcaccgucgacgaggagggccagcugcucgacuccauggacgugcccugcaccaacgggcacggcagccaccggcugugcauccugcgccagccgcccgggcagcgggccgagacccccaacuccagcguguccggcaacauccucuuccccguccugagcgaggacugcacgaccaccgaggaggggaaccagccgggcaacaugcugaacugcucccagaacagcuccagcuccagcgugugguggcucaagucccccgcguucagcuccggcagcagcgagggggacucccccuggagcuaccugaacuccagcggcuccagcugggugucccugcccgggaagaugcgcaaggagauccucgaggcccggacccugcagccggacgacuucgagaagcugcucgccggcguccgccacgacuggcuguuccagcgccuggagaacacggggguguucaagcccagccagcuccaccgggcccacuccgcccugcugcucaaguacagcaagaaguccgagcuguggaccgcgcaggagaccaucguguaccugggcgacuaccucaccgucaagaagaagggccgccagcggaacgccuucugggugcaccaccuccaccaggaggagauccuggggcgcuacgugggcaaggacuacaaggagcagaaggggcuguggcaccacuucacggacgucgagcggcagaugaccgcccagcacuacgugaccgaguucaacaagcgccuguacgagcagaacauccccacccagaucuucuacauccccagcacgauccugcucauccuggaggacaagaccaucaagggcugcaucuccguggagccguacauccugggggaguucgucaagcucagcaacaacaccaagguggugaagaccgaguacaaggccacggaguacggccuggcguacggccacuucuccuacgaguucagcaaccaccgggacgucgugguggaccugcaggggugggucaccggcaacgggaagggccucaucuaccugaccgacccccagauccacuccguggaccagaagguguucaccacgaacuucggcaagcgcgggaucuucuacuucuucaacaaccagcacgucgagugcaacgagaucugccaccggcugagccucacccgccccuccauggagaagccgugcaccuga

SEQ ID NO: 26587 - RNA, 6513 nt, Artificial Sequence
  derived and/or modified sequence opt1 from ALPK2__Homo_sapiens__NP_443179
augaaggacagcgagggcccccagcgcccgccccugugcuuccugagcacccugcugagccagaaggugcccgagaaguccgacgccgugcugcggugcaucaucagcgggcagcccaagcccgaggugaccugguacaagaacggccaggccaucgacggguccggcaucaucagcaacuacgaguucuucgagaaccaguacauccacgugcugcaccuguccugcugcaccaagaacgacgcggccgucuaccagaucagcgccaagaacuccuucgggaugaucugcugcagcgccuccguggagguggagugcagcuccgagaacccccagcucagccccaaccuggaggacgaccgcgaccggggcuggaagcacgagaccggcacccacgaggaggagcgcgccaaccagaucgacgagaaggagcaccccuacaaggaggaggaguccaucagccccgggacgccccgguccgcggacagcucccccagcaagagcaaccacucccugagccuccagucccugggcaaccuggacaucagcgucuccagcuccgagaacccccucggggugaagggcacgcgccacaccggggaggccuacgacccgagcaacaccgaggagaucgccaacggccugcuguuccucaacuccagccacaucuacgagaagcaggaccggugcugccacaagaccgugcacuccauggccagcaaguucacggacggcgaccugaacaacgacgggccccacgacgagggccugcgcuccagccagcagaaccccaagguccagaaguacaucuccuucagccucccccuguccgaggcgaccgcccacaucuacccgggggacagcgccguggccaacaagcagcccagcccccagcugagcagcgaggacuccgacagcgacuacgagcucugccccgagaucacccugaccuacacggaggaguucuccgacgacgaccuggaguaccucgagugcagcgacgugaugaccgacuacuccaacgccgucuggcagcggaaccugcugggcaccgagcacguguuccuccuggagagcgacgacgaggagauggaguucggcgagcacugccucggcgggugcgagcacuuccucuccgggauggggugcgggagccgcguguccggcgacgcgggcccgauggucgccaccgccggguucugcggccaccacagccagccccaggaggugggggugcgguccagccgcgucuccaagcacggccccagcagcccccagacggggaugacccugauccugggcccgcaccaggacggcaccagcuccgugaccgagcaggggcgguacaagcuccccacggcccccgaggccgcggagaacgacuaccccggcauccagggggagacccgcgacagccaccaggcccgggaggaguucgccagcgacaaccugcugaacauggacgaguccgugcgcgagaccgagaugaagcuccugagcggcgaguccgagaacagcgggaugucccagugcugggagaccgccgccgacaagcgggucggcggcaaggaccuguggagcaagcgcgggucccggaaguccgcgcgcgugcggcagccgggcaugaaggggaaccccaagaagcccaacgccaaccuccgcgaguccacgaccgagggcacccugcaccugugcagcgccaaggaguccgccgagccgccccucacccagagcgacaagcgcgagacgucccacaccaccgccgcggccaccggccggagcucccacgccgacgcccgcgagugcgcgaucagcacgcaggccgagcaggaggccaagacccugcagaccuccaccgacagcguguccaaggaggggaacacgaacugcaagggcgaggggaugcaggucaacacccuguucgagaccagccaggugcccgacuggagcgacccgccccagguccaggugcaggagaccgugcgggagaccaucuccugcagccagaugcccgccuucuccgagcccgccggcgaggagagccccuucacggggaccaccaccaucuccuucagcaaccucggcggcguccacaaggagaacgcgucccuggcccagcacagcgaggugaagccgugcacgugcgggccccagcacgaggagaagcaggaccgcgacggcaacauccccgacaacuuccgggaggaccugaaguacgagcaguccaucagcgaggccaacgacgagaccaugucccccgggguguucagccgccaccucccgaaggacgcccgggccgacuuccgcgagcccgucgcgguguccguggccagccccgagcccaccgacaccgcccugacgcuggagaacgucugcgacgagccgcgggaccgcgaggccgugugcgccauggagugcuucgaggcgggcgaccaggggaccugcuucgacaccaucgacucccuggugggccggcccgucgacaaguacagcccccaggagaucugcuccguggacaccgagcucgccgagggccagaacaaggugagcgaccugugcuccagcaacgacaagacgcuggaggucuucuuccagacccaggugagcgagaccuccguguccacgugcaaguccagcaaggacgggaacuccgucaugagcccccucuucaccuccaccuucacccugaacaucagccacaccgccuccgagggcgccacgggggagaaccuggcgaagguggagaacagcaccuacccgcucgccuccaccgugcacgccggccaggagcagcccagccccuccaacagcgggggccuggacgagacccagcugcucuccagcgagaacaacccccugguccaguucaaggagggcggggacaaguccccgagccccuccgccgccgacacgaccgcgacccccgccagcuacagcuccaucgugagcuucccgugggagaagcccaccacgcugaccgccaacaacgagugcuuccaggccacccgcgagaccgaggacacguccaccgugaccaucgccaccgagguccaccccgcgaaguaccucgccgugagcauccccgaggacaagcacgccggcgggacggaggagcgguucccgcgcgccucccacgagaaggugagccaguuccccucccagguccagcuggaccacauccugagcggcgccaccaucaaguccaccaaggagcuccugugccgggcgcccagcgugcccggggugccgcaccacguccugcagcuccccgagggcgagggcuucugcuccaacagcccccuccagguggacaaccuguccggggacaagagccagaccguggaccgcgccgacuuccgguccuacgaggagaacuuccaggagcgcggcagcgagaccaagcaggggguccagcagcagucccucagccagcagggcucccugagcgcccccgacuuccagcagagccugccgacgaccuccgccgcgcaggaggagcggaaccucgugcccaccgcccacagccccgccuccagccgcgagggcgccgggcagcgcuccggcugggggacccgggugagcgucguggccgagacggcgggcgaggaggacucccaggcccugagcaacgugcccucccugagcgacauccuccuggaggaguccaaggaguaccgcccggggaacugggaggccggcaacaagcugaagaucaucacccucgaggccagcgccuccgagaucuggccgccccggcagcugaccaacagcgaguccaaggcgagcgacggcgggcugaucauccccgacaaggucugggccgugccggacucccucaaggccgacgccgugguccccgagcuggcccccagcgagaucgcggcccuggcccacucccccgaggacgccgagagcgcccucgcggacagccgcgagucccacaagggcgaggagccgaccaucagcgugcacuggcggucccugagcucccgcggguucagccagccccggcugcucgaguccagcguggaccccgucgacgagaaggagcuguccgugacggacagccuguccgccgccagcgagaccggcgggaaggagaacgugaacaacgucucccaggaccaggaggagaagcagcucaagauggaccacaccgccuucuucaagaaguuccugaccugccccaagauccuggagagcuccguggacccgaucgacgagaucagcgugaucgaguacacgcgcgcgggcaagcccgagcccuccgagaccaccccgcagggcgcccgggagggcggccagagcaacgacgggaacaugggccacgaggccgagauccagcccgccauccuccagguccccugccugcaggggaccauccugagcgagaaccgcaucucccggagccaggagggcuccaugaagcaggaggccgagcagauccagcccgaggaggcgaagacggccaucuggcagguccuccagccgagcgagggcggggagcgcauccccuccggcugcagcaucgggcagauccaggaguccagcgacggcucccugggcgaggccgagcagagcaagaaggacaaggccgagcugaucucccccaccagcccccucuccagcugccugccgaucaugacccacgccucccugggggucgacacccacaacagcacgggccagauccacgacgugcccgagaacgacaucguggagccccggaagcgccaguacgucuuccccgugucccagaagcgggggaccaucgagaacgagcgcggcaagccgcuccccagcucccccgaccugacccgguuccccugcaccagcagcccggaggggaacgugacggacuuccugaucucccacaagauggaggagcccaagaucgagguccuccagaucggcgagaccaagccgcccagcuccagcuccagcuccgcgaagacccuggccuucaucagcggcgagcgcgagcuggagaaggccccgaagcuccugcaggaccccugccagaaggggacccugggcugcgccaagaagucccgggagcgcgagaagucccucgaggcccgggcggggaagucccccggcacgcugaccgccgugaccgggagcgaggaggugaagcgcaagcccgaggccccgggcuccggccaccuggccgagggggucaagaagaagauccucagccgcguggcggcccugcggcugaagcucgaggagaaggagaacauccgcaagaacuccgccuuccugaagaagaugcccaagcuggagaccagccucucccacacggaggagaagcaggaccccaagaagcccagcugcaagcgggagggccgcgccccggugcugcugaagaagauccaggccgagauguuccccgagcacuccgggaacgucaagcucagcugccaguucgcggagauccacgaggacagcaccaucugcuggaccaaggacuccaagagcaucgcccaggugcagcgguccgccggcgacaacagcaccguguccuucgccaucguccaggccagccccaaggaccaggggcuguacuacugcugcaucaagaacuccuacggcaaggugacggcggaguucaaccugaccgccgaggugcucaagcagcugagcucccgccaggacaccaagggcugcgaggagaucgaguucagccagcugaucuucaaggaggacuuccuccacgacuccuacuucgggggccggcugcgcgggcagaucgccaccgaggagcugcacuucggcgaggggguccaccggaaggccuuccgcagcaccgugaugcacggccucaugccgguguucaagcccggccacgccugcguccugaaggugcacaacgcgaucgccuacgggacgcggaacaacgacgagcugauccagcgcaacuacaagcucgccgcccaggagugcuacgugcagaacaccgcgcgguacuacgccaagaucuacgccgccgaggcccagccccuggagggcuucggggagguccccgagaucaucccgaucuuccugauccaccgccccgagaacaacauccccuacgcgaccguggaggaggagcucaucggcgaguucgugaaguacuccauccgggacggcaaggagaucaacuuccugcgccgggagagcgaggccgggcagaagugcugcaccuuccagcacugggucuaccagaagacguccggcugccugcucgugaccgacaugcagggggugggcaugaagcugaccgacgucgggaucgccacccuggccaagggcuacaagggcuucaaggggaacugcagcaugacguucaucgaccaguucaaggcccugcaccagugcaacaaguacugcaagaugcucggccugaagucccugcagaacaacaaccagaagcagaagcagcccagcaucgggaaguccaaggugcagaccaacagcaugaccaucaagaaggcgggcccggagacccccggggagaagaagacguga

SEQ ID NO: 26588 - RNA, 5724 nt, Artificial Sequence
  derived and/or modified sequence opt1 from ALPK3__Homo_sapiens__NP_065829
auggagguggccuggcugguguacgugcucggccagcagccccuggcccgccagggggagggccagucccggcuggugcccgggcgcggccucguccuguggcugcccgggcucccccgguccagccccuccuggcccgccguggaccuggcgccccucgcccccgcccgcccccggggcccccucaucugccacaccggccacgagcaggccgggcgcgagcccggccccgggagcuccaccaagggccccgugcugcacgaccaggacacgcggugcgccuuccugccgcggccgcccgggccccuccagacccggcgcuacugccggcaccagggccgccagggcagcgggcugggcgccgggcccggcgccggcaccugggcccccgccccgcccggggucuccaagccgcggugccccggccgcgcccggcccggggagggccagcagcaggucaccacggcccgcccgcccgccaucaaccgcggcgcccgccagccccgggcgggcgccgccgccgccggccgcgggcccggcgcgggggccuggcggaccggcgaggccgccgccagcgcggggcccgccgugggcgagggcggggccaugggcucccgccgcgcccccagccggggguggggcgccgggggccgcuccggcgccggcggggacggggaggacgacgggcccguguggauccccagcccggccucccggagcuaccugcucuccgugcgccccgagaccagccuguccagcaaccggcugucccaccccagcagcggccgcuccaccuucugcagcaucaucgcccagcucaccgaggagacccagccccuguucgagaccacccugaagucccggagcguguccgaggacagcgacguccgcuucacgugcaucgugaccggguacccggagcccgaggugaccugguacaaggacgacaccgagcucgaccgguacugcggccugcccaaguacgagaucacgcaccaggggaaccgccacacccugcagcucuaccggugccgcgaggaggacgccgcgaucuaccaggccuccgcccagaacagcaagggcaucgucuccugcagcggggugcuggaggugggcaccaugaccgaguacaagauccaccagcggugguucgccaagcugaagcgcaaggccgcggccaagcuccgggagaucgagcaguccuggaagcacgagaaggccguccccggcgagguggacacgcugcgcaagcugagcccggaccgguuccagcgcaagcggcgccucuccggggcccaggcccccggccccagcgugcccacccgcgagccggagggcgggacccuggcggccuggcaggagggggagaccgagacggcccagcacuccggccugggccucaucaacagcuucgccuccggggaggucaccaccaacggcgaggccgcgcccgagaacggggaggacggcgagcacgggcugcugaccuacaucugcgacgccauggagcucggcccccagcgggcccugaaggaggagagcggcgccaagaagaagaagaaggacgaggaguccaagcaggggcugcgcaagcccgagcucgagaaggcggcccagagccggcgcagcuccgagaacugcaucccgagcuccgacgagcccgacagcugcggcacgcaggggcccgugggcguggagcagguccagacccagccccgggggcgcgccgcccggggcccgggcuccagcgggaccgacuccacccgcaagcccgccagcgcggugggcacgcccgacaaggcccagaaggcccccgggccgggccccggccaggaggucuacuucucccugaaggacauguaccuggagaacacccaggccgugcggccccucggggaggagggcccgcagacccugagcgugcgcgcccccggggagucccccaagggcaaggcgccccugcgggcccgcagcgagggggucccgggcgcccccggccagcccacccacucccucacgccccagccgacccggcccuucaaccgcaagcgguucgcgccgcccaagccgaagggggaggccaccaccgacagcaagcccaucuccagccugucccaggcgcccgagugcggcgcccagagccuggggaaggcgccgccccaggccagcguccaggugcccacgccgcccgcgcgccggcgccacggcacgcgggacuccacccuccaggggcaggccggccaccgcacccccggcgagguccuggagugccagaccacgaccgcccccaccaugagcgccuccagcuccagcgacguggccuccaucggggugagcaccuccggcagccaggggaucaucgagcccauggacauggagacgcaggaggacggccggaccuccgcgaaccagcgcaccgggagcaagaagaacguccaggccgacggcaagauccagguggacggccgcacccgcggggacggcacgcagaccgcccagcgcacccgggccgaccgcaagacccagguggacgccgggacgcaggaguccaagcggccccagagcgaccgcuccgcgcagaagggcaugaugacccagggccgggccgagacccagcuggagaccacgcaggccggggagaagauccaggaggaccgcaaggcccaggccgacaagggcacccaggaggaccggcgcaugcagggggagaagggcaugcagggggagaagggcacccagagcgagggcuccgcgccgaccgccauggaggggcagagcgagcaggaggucgccacgucccuggggccgcccagccggacccccaagcucccgcccaccgccgggccccgcgccccgcugaacaucgagugcuucgugcagacccccgagggcagcugcuuccccaagaagcccgggugccugccgcgguccgaggaggcgguggucacggccagccgcaaccacgagcagaccgugcucggcccccuguccggcaaccugaugcuccccgcccagcccccgcacgaggggagcguggagcaggucggcggggagcggugccgcggcccccaguccagcgggcccguggaggccaagcaggaggacucccccuuccagugcccgaaggaggagcggcccggcggcgugcccugcauggaccagggcggcugcccccuggcggggcugagccaggaggucccgaccaugcccucccuccccggcaccgggcugacggccagccccaaggccggcccgugcuccacccccaccagccagcacggcuccaccgccacguuccugcccagcgaggaccaggugcucauguccagcgcccccacccugcaccuggggcucggcaccccgacccagucccacccgcccgagaccauggcgacgagcuccgagggggccugcgcccaggugcccgacgucgagggccgcaccccgggcccccggagcugcgaccccgggcugaucgacagccugaagaacuaccuccugcugcuccugaagcuguccagcaccgagaccuccggcgccgggggcgagagccaggugggggccgcgacgggcggccucgugccguccgccacccugacccccaccgucgagguggccgggcugagcccccgcacgucccgccggauccucgagcgcguggagaacaaccaccugguccagagcgcccagacccugcuccugucccccugcaccagccggcgccugaccggccuccuggaccgggaggugcaggccgggcgccaggcgcuggccgccgcccggggcuccugggggccgggccccagcucccucacggugcccgcgaucgucguggacgaggaggaccccggccuggccagcgagggggccuccgagggcgagggggaggugagcccggagggccccgggcugcucggcgccucccaggagagcuccauggccggccgccugggggaggcgggcgggcaggccgcccccggccaggggcccagcgccgagagcaucgcccaggagccgucccaggaggagaaguuccccggcgaggcgcugaccggccuccccgccgccacccccgaggagcuggcccugggggcccggcgcaagcgguuccucccgaagguccgcgcggccggcgacggggaggccaccacgcccgaggagcgggagagccccaccgugagcccccggggcccgcgcaagucccuggugcccggcucccccgggacccccggccgcgagcggcgcagcccgacccaggggcggaaggccuccaugcuggaggucccccgcgcggaggaggagcucgccgccggcgaccuggggcccagcccgaaggccggcggccuggacacggagguggcccucgacgaggggaagcaggagacccuggcgaagccccggaaggccaaggaccugcucaaggcgccccaggugauccgcaagauccgcgucgagcaguuccccgacgccuccggcagccugaagcuguggugccaguucuucaacauccucuccgacagcgugcugaccugggccaaggaccagcggccggugggggaggucggccgcuccgcgggggacgagggccccgccgcccuggccaucgugcaggccagccccguggacugcggcgucuaccggugcaccauccacaacgagcacggguccgcgagcacggacuucugccucucccccgaggugcugagcggcuucaucucccgcgaggagggggaggugggcgaggagaucgagaugaccccgauggucuucgccaaggggcuggccgacagcggcugcuggggcgacaagcuguucgggcggcuggugagcgaggagcugcgcggcgggggcuacggcugcgggcuccggaaggccucccaggccaaggucaucuacggccuggagcccaucuucgagagcgggcggaccugcaucaucaagguguccagccugcucguguucggccccuccagcgagaccucccuggucgggcggaacuacgacgugacgauccagggcugcaagauccagaacaugagccgcgaguacugcaagaucuucgcggccgaggcccgggccgcgcccggcuucggggaggugccggagaucaucccccuguaccucaucuaccgccccgccaacaacauccccuacgccacccuggaggaggaccugggcaagccgcucgaguccuacugcagccgggagugggggugcgccgaggcccccaccgcguccggcagcuccgaggccaugcagaagugccagaccuuccagcacuggcuguaccaguggacgaacgggagcuuccuggucaccgaccucgccggcguggacuggaagaugaccgacgugcagaucgccaccaagcugcgcggcuaccaggggcugaaggaguccugcuuccccgcccuccuggaccgguucgcgagcucccaccagugcaacgccuacugcgagcugcucggccugacgccccugaaggggccggaggccgcccacccccaggccaaggcgaagggcagcaagucccccagcgccgggcgcaagggcagccagcucagcccccagccgcagaagaagggccugcccagcccccaggggacccggaaguccgcccccagcuccaaggccaccccgcaggcgagcgagcccgucaccacccagcugcucggccagcccccgacgcaggaggagggguccaaggcccagggcaugcgcuga

SEQ ID NO: 26589 - RNA, 1608 nt, Artificial Sequence
  derived and/or modified sequence opt1 from ALPP__Homo_sapiens__NP_001623
augcugggccccugcaugcuccugcugcuccugcugcucgggcugcgccugcagcucagccugggcaucaucccgguggaggaggagaaccccgacuucuggaaccgggaggccgccgaggcgcugggggccgccaagaagcuccagcccgcccagaccgccgcgaagaaccugaucaucuuccugggcgacgggaugggcgucuccaccgugacggccgcccgcauccucaagggccagaagaaggacaagcuggggcccgagaucccgcuggccauggaccgguuccccuacguggcgcucagcaagaccuacaacgucgacaagcacgugcccgacuccggcgccaccgccaccgccuaccugugcggggugaagggcaacuuccagacgaucgggcugagcgccgcggcccgcuucaaccagugcaacaccacccggggcaacgaggucaucuccgugaugaaccgcgccaagaaggccggcaagagcgugggggucgugaccacgacccgggugcagcacgccucccccgcgggcaccuacgcccacaccgucaaccgcaacugguacagcgacgccgacgugccggccuccgcccggcaggaggggugccaggacaucgcgacgcagcucaucagcaacauggacaucgacgugauccugggcggcgggcgcaaguacauguuccggaugggcacccccgaccccgaguaccccgacgacuacucccagggcgggacccgccuggacgggaagaaccucguccaggaguggcuggccaagcggcagggcgcccgcuacguguggaaccggaccgagcugaugcaggccagccucgacccguccgugacgcaccugaugggccuguucgagcccggggacaugaaguacgagauccaccgcgacagcacccucgaccccucccugauggagaugaccgaggccgcgcugcggcuccugagccgcaacccccggggcuucuuccuguucgucgagggcgggcgcaucgaccacgggcaccacgagucccgggccuaccgcgcccucaccgagacgaucauguucgacgacgccaucgagcgcgcgggccagcugaccagcgaggaggacacccugucccucgugaccgccgaccacagccacguguucagcuucggcggguacccgcugcggggcuccagcaucuucgggcuggcccccggcaaggcccgcgaccggaaggccuacacgguccuccuguacgggaacggccccggcuacgugcugaaggacggggcgcgccccgacgugaccgaguccgagagcggcuccccggaguaccggcagcagagcgccgucccccucgacgaggagacccacgccggggaggacguggccgucuucgcccgcggcccccaggcgcaccuggugcacggcgugcaggagcagaccuucaucgcccacgucauggccuucgccgccugccuggagcccuacacggcgugcgaccucgccccgcccgccgggaccaccgacgccgcgcaccccggccgguccguggugcccgcccugcugccgcugcucgccgggacccugcugcuccuggagacggccaccgcccccuga

SEQ ID NO: 26590 - RNA, 1599 nt, Artificial Sequence
  derived and/or modified sequence opt1 from ALPPL2__Homo_sapiens__NP_112603
augcagggccccugggugcugcuccugcuggggcuccgccugcagcugagccucggcaucaucccggucgaggaggagaaccccgacuucuggaaccggcaggccgccgaggcgcugggggccgccaagaagcugcagcccgcccagaccgccgcgaagaaccucaucaucuuccugggcgacgggaugggcguguccaccgugacggccgcccgcauccugaagggccagaagaaggacaagcucgggcccgagaccuuccuggccauggaccgguucccguacgucgcgcugagcaagaccuacuccguggacaagcacgugcccgacagcggcgccaccgccacggccuaccucugcggggucaagggcaacuuccagaccaucgggcuguccgccgcggcccgcuucaaccagugcaacaccacccggggcaacgaggugaucagcgugaugaaccgcgccaagaaggccggcaaguccgucgggguggugacgaccacccggguccagcacgccagccccgcgggcgccuacgcccacaccgugaaccgcaacugguacuccgacgccgacgugcccgccagcgcgcggcaggaggggugccaggacaucgccacgcagcugaucuccaacauggacaucgacgucauccucggcggcgggcgcaaguacauguucccgaugggcacccccgaccccgaguaccccgacgacuacagccagggcgggacccggcuggacgggaagaaccuggugcaggaguggcucgccaagcaccagggcgcccgcuacguguggaaccggaccgagcugcugcaggccucccucgacccgagcgucacgcaccugaugggccuguucgagcccggggacaugaaguacgagauccaccgcgacuccacccucgaccccagccugauggagaugaccgaggcggcccugcuccugcugucccggaacccccgcggcuucuuccucuucguggagggcgggcggaucgaccacgggcaccacgagagccgcgccuaccgggcccugaccgagacgaucauguucgacgacgcgaucgagcgcgccggccagcugaccuccgaggaggacacccucagccuggugaccgccgaccacagccacgucuucuccuucggcggguacccgcugcggggcagcuccaucuucgggcucgcccccggcaaggcccgcgaccgcaaggcguacacggugcugcuguacgggaacggccccggcuacgugcucaaggacggggcccggcccgacgucaccgagagcgaguccggcagcccggaguaccgccagcaguccgccgugccccuggacggggagacccacgccggcgaggacgucgccguguucgcgcggggcccccaggcccaccuggugcacgggguccaggagcagaccuucaucgcccacgugauggccuucgccgcgugccucgagcccuacacggccugcgaccuggccccgcgcgccggcaccaccgacgcggcccaccccgggcccagcgugguccccgcccugcucccgcugcuggccggcacccugcuccugcuggggacggccaccgcgcccuga

SEQ ID NO: 26591 - RNA, 2862 nt, Artificial Sequence
  derived and/or modified sequence opt1 from ALS2CL__Homo_sapiens__NP_001177636
augugcaaccccgaggaggccgcccugcuccgccuggaggagguguucagcgcgacccuggcccacgucaacucccucgugcugcagccgcugcuccccgccgcccccgaccccagcgacccguggggccgggagugccugcgccugcuccagcagcugcacaaguccagccagcagcugugggaggugaccgaggagucccuccacagccugcaggagcggcugcgcuaccccgacuccacggggcucgagagccugcugcuccugcggggcgccgaccgcguccugcaggcgcacaucgaguacaucgaguccuacaccagcugcaugguggugcaggccuuccagaaggccgccaagcggcgcuccgaguacuggcgggggcagcgcaaggcgcuccggcagcugcugagcggcgucuccagcgagggguccgugggcgccagccucggccaggcccugcaccagccccuggcccaccacgugcagcaguacguccuccugcugcucucccugggggacaccaucggcgagcaccaccccacccgcgagcugguggugaacgccgucacgcuguucgggaaccugcagagcuucaugaagcaggagcuggaccaggcgguggccacccaggcccucuggcacacccugcggggccgccugcgggacgugcucugcaccccggcccaccgccugcugcaggacucccaggacguccccgugacgguggcgccccuccgggccgagcgcguccugcuguucgacgacgcccucgugcugcugcaggggcacaacgugcacaccuucgaccucaagcuggucuggguggaccccggccaggacggcugcaccuuccaccuccugaccccggaggaggaguucagcuucugcgccaaggacagccaggggcaggccguguggcaguggaaggucacgugggccgugcaccaggcgcuccacggcaagaaggacuuccccguccugggggccggccuggagcccucccagcccccggacugccggugcgccgaguacaccuuccaggccgagggccgccucugccaggccaccuacgagggggaguggugccggggccgcccccacgggaagggcacccugaaguggcccgacgggcgcaaccacgugggcaacuucugccagggccuggagcacggguucggcauccggcuccugccccaggcgagcgaggacaaguucgacugcuacaagugccacuggcgcgagggguccaugugcggcuacgggaucugcgaguacagcacggacgagguguacaagggcuacuuccaggagggccugcggcacggguucggcguccucgaguccgggccgcaggcgccccagcccuuccgcuacaccggccacugggagcgggggcagcgcagcggcuacggcaucgaggaggacggggaccggggcgagcgcuacaucgggauguggcaggccggccagcggcacggccccggggugauggugacccaggccggcgucugcuaccaggggaccuuccaggccgacaagacggugggcccggggauccugcuguccgaggacgacagccucuacgagggcaccuucacccgcgaccugacccugaugggcaaggggaaggugacguuccccaacggcuucacccucgagggguccuucggcagcggggccggccggggccugcacacccaggggguccuggacaccgccgcccucccgcccgaccccuccagcacgugcaagcgccagcugggcgugggggccuuccccguggagucccgguggcagggcgucuacagccccuuccgcgacuucgugugcgcggggugcccgcgggaccugcaggaggcccuccugggcuucgacgugcaguccagccgcgagcugcggcgcucccaggacuaccucagcugcgagcggacccaccccgaggacuccgucggcagcauggaggacauccuggaggagcugcuccagcaccgcgagcccaaggcccugcagcuguaccuccgcaaggcccugagcaacucccugcacccccucgggaagcugcugcggacccucaugcugaccuuccaggccacguacgcgggcgugggggccaacaagcaccuccaggagcuggcccaggaggaggugaagcagcacgcccaggagcugugggccgcguaccgcggccugcuccgggucgcccuggagcgcaaggggcaggcccuggaggaggacgaggacaccgagacccgggaccuccaggugcacggccuggugcugccgcucaugcugcccagcuucuacuccgagcuguucacccucuaccugcugcuccacgagcgcgaggacagcuucuacucccagggcaucgccaaccugagccuguuccccgacacgcagcuccuggaguuccuggacguccagaagcaccucuggccccugaaggaccugacccucaccuccaaccagcgguacagccuggugcgcgacaagugcuuccuguccgcgaccgagugccuccagaagaucaugaccacgguggacccgcgggagaagcuggagguccuggagcgcaccuacggggagaucgagggcaccgugagccgggugcucgggcgcgaguacaagcugcccauggacgaccugcucccccugcugaucuacgucgugucccgggcccgcauccagcaccucggcgccgagauccaccugauccgggacaugauggaccccaaccacaccggcgggcuguacgacuuccuccugacggcccuggagagcugcuacgagcacauccagaaggaggacaugcgccuccaccggcugccgggccacuggcacucccgcgagcugugguga

SEQ ID NO: 26592 - RNA, 1269 nt, Artificial Sequence
  derived and/or modified sequence opt1 from ALS2CR12__Homo_sapiens__NP_001120863
auguaccccaacccgcugaucuacugcacgugcugggaccccuggaaccucggcccccgcaagcugaucaagacgccccagcugccgcggaagaacagcaccggguccagcaagcucacgccccuggugcccgcccccaagaaccacaacuaccugcagccgaccaagcccgucgugucccccaagaugaagauccacagcgcccgccaggaggagaccaacaaguccuucuacgaggugaucaacgucagccccggcuaccagcucgugcggaaccgcgagcagaucuccgugacccugggggacgagauguucgaccggaagaagcgcugggagagcgagaucccggacaagggccgguucucccgcaccaacaucaucagcgaccuggaggagcagaucuccgagcucaccgcgaucaucgagcagaugaaccgggaccaccagagcgcccagaagcugcuguccagcgagauggaccuccgcugcgccgagaugaagcagaacuucgagaacaagaaccgggagcugaaggaggcccacgaggccgagcuguccgagcucgagaacaacuacaaggcggcccugaaggccgagaagcuggccgcgcaggagaagcucgaggagauggggaaggaguacaaguaccugaagaacauguuccgcaccuaccaggacagcaucuacgacgagauggaggagaagugguccaagcagaaggccaaguggaagaaggacgagaaguucgagcgggagaacauccugcuccagcagaagaagaagaugaccaagaaguucgagauggagagcggcgaggaggacaagaagaucaacgaguccugcagcgccgucuucgagaacuucauccaggagaaggaggagcugcugaagcagcaccagagcgacacccuccagcuggaggagcugcgcaagaccaaggaggugaugcaggaggagcuccacgcccaggcccugauccuggagucccucaacaccaaccuguacuacacgcagcuggagcuccagaaggagaaggcgaucgugggcaaccuggagaagaugcugcagaccaaguucgccgagaccgaggagaaguacaagcacaccauccagauccucacggaggagaacauccaccugaagcagaagaucaucagcaagaacgaggagaucugcgaggggugcuccggccggcuggccagcaucaccgucuccaaggacgacagcgacaccgugcaggacggguccaagaagggccaggagagcuga

SEQ ID NO: 26593 - RNA, 1191 nt, Artificial Sequence
  derived and/or modified sequence opt1 from ALS2__Homo_sapiens__NP_001129217
auggacagcaagaagcgcuccagcaccgaggccgagggcuccaaggagcgggggcuggugcacaucuggcaggccggcagcuuccccaucaccccggagcgccuccccggguggggcgggaagacgguccugcaggcggcccugggcgugaagcacggcgugcuccugaccgaggacggggaggucuacuccuucggcacccugcccuggcggagcgggcccguggagaucugcccguccagccccauccucgagaacgcccuggugggccaguacgucaucaccguggccacgggguccuuccacagcggcgccgugaccgacaacggcgucgcguacauguggggcgagaacuccgccgggcagugcgccguggccaaccagcaguacgugcccgagcccaacccggucagcaucgcggacuccgaggccagcccccugcucgccgugcgcauccugcagcuggccugcggggaggagcacacccucgcccuguccaucagccgggagaucugggcguggggcaccggcugccagcuggggcucaucacgaccgccuuccccgugaccaagccccagaaggucgagcaccuggccggccgcguggugcugcaggucgccugcggggccuuccacucccucgcgcuggugcagugccugccgagccaggaccucaagcccgugcccgagcggugcaaccagugcucccagcugcugaucaccaugacggacaaggaggaccacgucaucaucagcgacagccacugcugcccccucggcgugacccugaccgagucccaggccgagaaccacgccagcaccgcccuguccccgagcacggagacccucgaccgccaggaggagguguucgagaacacccuggucgccaacgaccaguccguggcgaccgagcugaacgccgucagcgcccagaucacguccagcgacgccauguccagccagcagaacgugauggggaccaccgagaucuccagcgcccggaacauccccuccuaccccgacacccaggcggugaacgaguaccuccgcaagcugagcgaccacuccguccgggaggacagcgagcacggcgagaagcccgugccgucccaggugcccgcccaguucuacaagaucaaggucugccuggagcucaacugcaugggcuucagccuggagacgcugaaguga

SEQ ID NO: 26594 - RNA, 981 nt, Artificial Sequence
  derived and/or modified sequence opt1 from ALX1__Homo_sapiens__XP_005269222
auggaguuccugagcgagaaguucgcccucaaguccccgcccagcaagaacuccgacuucuacaugggcgccgggggcccccuggagcacgugauggagacccuggacaacgagagcuucuacuccaaggcgagcgccgggaagugcguccaggccuucggcccccucccccgcgccgagcaccacgugcggcuggagcgcaccuccccgugccaggacagcuccgugaacuacgggaucacgaaggucgagggccagccccugcacaccgagcucaaccgggccauggacaacugcaacagccugcgcaugucccccgugaagggcaugcaggagaagggggagcuggacgagcucggcgacaagugcgacagcaacguguccagcuccaagaagcggcgccaccggaccaccuucacgagccugcagcuggaggagcucgagaaggucuuccagaagacccacuaccccgacguguacgugcgcgagcagcuggcgcugcggaccgagcucaccgaggcccgcguccaggugugguuccagaaccggcgcgccaaguggcggaagcgcgagcgguacgggcagauccagcaggccaagucccacuucgcggccacguacgacaucagcgugcugccgcgcaccgacuccuacccccagauccagaacaaccugugggccggcaacgccagcgggggcagcgucgugaccuccugcaugcucccccgggacaccagcuccugcaugacgcccuacagccacuccccgcgcaccgacagcuccuacaccggcuucagcaaccaccagaaccaguucucccacgugccccugaacaacuucuucaccgacagccugcucacgggggccaccaacggccacgcguucgagaccaagcccgaguucgagcggcgcuccagcuccaucgccguccugcggaugaaggccaaggagcacaccgccaacaucagcugggccauguga

SEQ ID NO: 26595 - RNA, 1236 nt, Artificial Sequence
  derived and/or modified sequence opt1 from ALX4__Homo_sapiens__NP_068745
augaacgccgagaccugcgugagcuacugcgagucccccgccgcggccauggacgccuacuacagcccggucucccagagccgcgagggcuccagccccuuccgggccuuccccgggggcgacaaguucgggaccacguuccuguccgccgcggccaaggcccagggcuucggggacgccaagagccgcgcgcgguacggcgccggccagcaggaccucgccacgccccuggaguccggggccggcgcccgcgggagcuucaacaaguuccagccgcagcccuccacgccccagccccagccgccgccccagccccagccccagcagcagcagccccagccccagcccccggcgcagccccaccuguaccuccagcggggcgccugcaagaccccgcccgacgggagccugaagcugcaggagggcuccagcggccacuccgccgcccuccaggugcccugcuacgccaaggagagcucccugggggagcccgagcugccgcccgacagcgacaccgugggcauggacuccagcuaccucagcgucaaggaggcgggggugaagggcccccaggaccgcgccuccagcgaccugcccagcccccuggagaaggccgacuccgaguccaacaagggcaagaagcggcgcaaccggaccaccuucaccagcuaccagcucgaggagcuggagaagguguuccagaagacccacuaccccgacgucuacgcccgcgagcagcuggccaugcggaccgaccucaccgaggcgcgcguccaggugugguuccagaaccggcgcgccaaguggcggaagcgcgagcgguucgggcagaugcagcagguccgcacccacuucuccacggccuacgagcugccgcugcucacccgggccgagaacuacgcccagauccagaaccccagcuggcugggcaacaacggggcggccucccccgugccggccugcguggugcccugcgaccccgugcccgccugcaugagcccgcacgcgcacccgcccggcuccggggccagcuccgugaccgacuuccugagcgucuccggcgccggcagccacguggggcagacccacaugggcucccucuucggggccgccagccugucccccggccugaacggguacgagcucaacggcgagcccgaccgcaagacgagcagcaucgcggcccugcggaugaaggccaaggagcacuccgccgccaucagcugggcgaccuga

SEQ ID NO: 26596 - RNA, 795 nt, Artificial Sequence
  derived and/or modified sequence opt1 from ALYREF__Homo_sapiens__NP_005773
augcccgacagcgccccggccauggcggacaagauggacaugucccuggacgacaucaucaagcucaaccgcagccagcggggcgggcgcggcgggggccgggggcgcggccgggccggcucccagggcgggcgcgggggcggggcccaggccgccgcgcgggugaaccgcggcggcgggcccauccggaaccgccccgccaucgcccggggcgccgccgggggcggcgggcgcaaccggcccgcgccguacagccgccccaagcagcugcccgacaaguggcagcacgaccuguucgacuccggcuucgggggcggggccggcgucgagaccggcgggaagcuccuggugagcaaccuggacuucggcguguccgacgccgacauccaggagcuguucgccgaguucgggacccucaagaaggcggccguccacuacgaccggagcggccgcucccuggggacggccgacgugcacuucgagcggaaggccgacgcccucaaggcgaugaagcaguacaacggcgugccccuggacggccgcccgaugaacauccagcuggucaccagccagaucgacgcccagcggcgccccgcccaguccgugaaccgcgggggcaugacccggaaccgcggggccggcggguucggcggcgggggcgggacccggcgcggcacgcggggcggggcccgcggccgggggcgcggcgcggggcggaacagcaagcagcagcucuccgccgaggagcuggacgcccagcuggacgccuacaacgcccgcauggacaccagcuga

SEQ ID NO: 26597 - RNA, 1185 nt, Artificial Sequence
  derived and/or modified sequence opt1 from AMACR__Homo_sapiens__NP_001161067
auggcccugcagggcaucagcguggucgagcucuccgggcuggcccccggcccguucugcgcgauggugcuggccgacuucggggcccgcgugguccggguggaccgccccggcagccgguacgacgugucccgccucgggcggggcaagcgcagccugguccuggaccucaagcagccccggggcgccgccgugcugcgccggcugugcaagcgcuccgacgugcuccuggagcccuuccggcgcggggucauggagaagcugcagcucggcccggagauccugcagcgggagaacccccgccugaucuacgcgcggcucagcggguucggccaguccgggagcuucugccgccuggccggccacgacaucaacuaccuggcccucuccggcgugcugagcaagaucgggcgguccggcgagaaccccuacgcgccccugaaccuccuggccgacuucgccgggggcggccugaugugcgcccucgggaucaucauggcccuguucgaccgcacccggaccggcaagggccaggugaucgacgccaacauggucgaggggacggcguaccugagcuccuuccucuggaagacccagaagcugagccugugggaggccccgcgcgggcagaacaugcucgacggcggcgcccccuucuacaccaccuaccggacggccgacggggaguucauggccgugggcgcgaucgagccccaguucuacgagcugcugaucaaggggcucggccugaaguccgacgagcugcccaaccagaugagcauggacgacuggccggagaugaagaagaaguucgccgacguguucgccgagaagaccaaggccgaguggugccagaucuucgacgggaccgacgccugcgucacccccgugcucacguucgaggaggugguccaccacgaccacaacaaggagcgcggcuccuucaucaccagcgaggagcaggacgugagcccccgccccgcgccgcugcugcucaacacccccgccauccccuccuucaagcgggaccccuucaucggcgagcacaccgaggagauccuggaggaguucggguucagccgcgaggagaucuaccagcugaacuccgacaagaucaucgagagcaacaaggccggcuccaaguucuggauccucuacccgacgcacagcaacauccagaaguga

SEQ ID NO: 26598 - RNA, 1344 nt, Artificial Sequence
  derived and/or modified sequence opt1 from AMBN__Homo_sapiens__NP_057603
augagcgccuccaagaucccccuguucaagaugaaggaccucauccugauccugugccuccuggagaugagcuucgccgugccguucuucccccagcaguccggcacccccgggauggcgagccugucccucgagaccaugcgccagcugggcagccugcagcggcucaacacgcugucccaguacagccgcuacggguucggcaaguccuucaacagccuguggaugcacgggcuccugcccccgcacuccagccugcccuggaugcggccccgcgagcacgagacccagcaguacgaguacucccuccccguccacccgccgccccugcccagccagcccucccugaagccccagcagcccggccucaagcccuuccugcagagcgccgccgccaccaccaaccaggccacggcgcugaaggaggcccuccagccgcccauccaccugggccaccucccccugcaggagggggagcugccccuggugcagcagcaggucgccccguccgacaagccgcccaagcccgagcuccccggcguggacuucgccgacccccaggggcccagccugcccggcauggacuucccggacccccaggggcccucccugccgggccucgacuucgcggacccccagggcagcaccaucuuccagaucgcccggcugaucagccacgggcccaugccccagaacaagcaguccccgcuguaccccggcaugcucuacgugcccuucggggccaaccagcugaacgcccccgcccgccugggcaucaugagcuccgaggagguggcgggcgggcgggaggacccgauggccuacggcgccauguuccccggguucggcgggaugcgccccggcuucgagggcaugccccacaacccggccaugggcggggacuucacccucgaguucgacagccccgucgccgcgaccaaggggcccgagaacgaggagggcggggcccagggcucccccaugccggaggccaaccccgacaaccuggagaaccccgccuuccugacggagcucgagcccgccccgcacgcgggccugcuggcccuccccaaggacgacauccccgggcugccccggagcccguccggcaagaugaaggggcugcccagcgugacccccgccgccgccgacccgcucaugacccccgagcuggcggacguguaccgcaccuacgacgccgacaugacgaccuccgucgacuuccaggaggaggccaccauggacaccacgauggcccccaacagccugcagaccuccaugcccggcaacaaggcgcaggagccggagaugaugcacgacgccuggcacuuccaggagcccuga

SEQ ID NO: 26599 - RNA, 1059 nt, Artificial Sequence
  derived and/or modified sequence opt1 from AMBP__Homo_sapiens__NP_001624
augcgcagccugggcgcccuccugcugcuccuguccgccugccuggcggugagcgccgggcccgucccgaccccgcccgacaacauccaggugcaggagaacuucaacaucucccggaucuacggcaagugguacaaccucgccaucgggagcacgugccccuggcugaagaagaucauggaccgcaugaccguguccacccugguccucggcgagggggccaccgaggccgagaucagcaugaccuccacgcgguggcgcaagggcgugugcgaggagaccagcggcgcguacgagaagaccgacaccgacgggaaguuccuguaccacaaguccaaguggaacaucacgauggagagcuacgugguccacaccaacuacgacgaguacgccaucuuccugaccaagaaguucucccggcaccacggccccaccaucacggccaagcucuacgggcgcgcgccccagcugcgggagacccugcuccaggacuuccgcgugguggcccagggcgucgggauccccgaggacagcaucuucaccauggccgaccggggcgagugcgugcccggcgagcaggagccggagcccauccugaucccccgcgugcggcgcgccguccugccccaggaggaggagggguccggcgggggccagcucgugaccgaggugacgaagaaggaggacagcugccagcugggcuacuccgccgggccgugcaugggcaugaccagccgguacuucuacaacgggaccuccauggccugcgagaccuuccaguacggcgggugcaugggcaacggcaacaacuucgucacggagaaggagugccugcagaccugccgcaccguggcggccugcaaccuccccaucgugcgggggcccugccgcgccuucauccagcugugggccuucgacgccgucaagggcaagugcgugcuguuccccuacgggggcugccaggggaacggcaacaaguucuacagcgagaaggagugccgggaguacugcggcgugccgggggacggcgacgaggagcuccugcgcuucuccaacuga

SEQ ID NO: 26600 - RNA, 3906 nt, Artificial Sequence
  derived and/or modified sequence opt1 from AMBRA1__Homo_sapiens__NP_001254711
augaaggugguccccgagaagaacgccgugcgcauccuguggggccgggagcgcggggcccgggcgaugggcgcccagcgccuccugcaggagcugguggaggacaagacccgguggaugaagugggaggggaagcgcgucgagcucccggacagcccccgguccaccuuccugcuggccuucagccccgaccgcacgcuccuggccuccacccacgugaaccacaacaucuacaucaccgaggugaagaccggcaagugcguccacagccugaucgggcaccggcgcacgcccuggugcgugaccuuccacccgaccaucuccggccucaucgccagcggcugccuggacggggaggugcggaucugggaccugcacggcggguccgagagcugguucaccgacuccaacaacgcgaucgccagccucgccuuccaccccacggcccagcugcugcucaucgcgaccgccaacgagauccacuucugggacuggucccgccgggagcccuucgccgucgugaagaccgccagcgagauggagcgcgugcggcugguccgcuucgacccccugggccacuaccuccugaccgccaucgugaacccguccaaccagcagggggacgacgagcccgagauccccaucgacggcacggagcugagccacuaccggcagcgcgcgcuccugcagucccagcccgugcggcgcaccccgcugcuccacaacuuccugcacaugcugagcucccggagcuccggcauccagaccgagcccuuccacccgcccgagcaggccagcagcacccagcaggaccaggggcuccugaaccgccccuccgccuucagcacgguccaguccagcaccgccggcaacacccugcgcaaccucucccuggggcccacccggcgcagccugggcggcccccucuccagccaccccucccgguaccaccgcgagaucgccccggggcugacgggcagcgaguggacccggaccgugcugucccucaacagccgcuccgaggcggagagcaugcccccgccccggaccuccgccagcuccgugagccugcuguccguccuccgccagcaggagggcgggagccaggccagcguguacacguccgccaccgaggggcggggcuuccccgccagcggccuggcgaccgaguccgacgggggcaacgggagcucccagaacaacagcggcuccauccgccacgagcugcagugcgaccuccggcgcuucuuccuggaguacgaccggcugcaggagcucgaccagagccuguccggggaggcgccccagacccagcaggcccaggagaugcugaacaacaacaucgagagcgagcgccccggccccucccaccagccgacgccccacagcuccgagaacaacagcaaccucucccggggccaccugaaccgcugccgggccugccacaaccugcugaccuucaacaacgacacccuccgcugggagcggaccacgcccaacuacagcuccggggaggccagcagcuccuggcaggucccgagcuccuucgagagcgugcccuccagcggcucccagcugccgccccuggagcgcaccgaggggcagacccccagcuccagccgccucgagcuguccagcuccgccagcccccaggaggagcggaccgugggcguggccuucaaccaggagacggggcacugggagcgcaucuacacccaguccagccgguccggcaccgucagccaggaggcccugcaccaggacaugcccgaggaguccagcgaggaggacagccuccgccggcgcucccuggcccugagcccccggcucgaguacuccggcgcgauccuggcccacugcaagcugcgccucccggggagcugccacucccccgccagcgccucccagguggccggcaccaccggggcgcaccaccacgcccggcugaucuucgccuuccuggucgagauggaguuccaccacgugagccaggccggccucgagcugcugacguccggcgaccuccccaccagcgccucccagagcgcggggaucaccggcgugucccaccgcgccuggccccggcugcuggagagcucccucaucagccugucccgcuacgacggggccggcagccgggagcacccgaucuaccccgaccccgcccgccugucccccgccgcguacuacgcccagcggaugauccaguaccucagccgccgggacagcauccgccagcgguccaugcgcuaccagcagaaccggcugcgcagcuccaccagcuccagcuccagcgacaaccaggggccguccgucgagggcacggaccuggaguucgaggacuucgaggacaacggcgaccgcagccggcaccgcgcgccccggaacgcccgcauguccgcccccagccucgggcgguucgugccccgccgguuccugcugccggaguaccuccccuacgccggcaucuuccacgagcgcgggcagcccggccuggccacccacuccagcgugaaccggguccuggccggggccgugaucggcgacggccaguccgcgguggccagcaacaucgccaacaccaccuaccgccuccaguggugggacuucacgaaguucgaccugcccgagaucuccaacgccagcgucaacgugcuggugcagaacugcaagaucuacaacgacgccuccugcgacaucagcgcggacgggcagcuccuggccgccuucaucccgagcucccagcggggcuuccccgacgaggggauccuggccgucuacagccucgcgccccacaaccugggcgagaugcuguacaccaagcgcuucgggccgaacgccaucuccgugagccucucccccaugggccgguacgugauggucggccuggccagccgccggauccugcuccaccccuccaccgagcacaugguggcccagguguuccgccugcagcaggcccacgggggcgagaccagcaugcggcgcgucuucaacgugcuguaccccaugccggcggaccagcggcgccacguguccaucaacagcgcccgcuggcuccccgagcccgggcugggccuggccuacgggacgaacaagggcgaccucgucaucugccggcccgaggcccugaacuccggcguggaguacuacugggaccagcugaacgagaccguguucaccguccacagcaacucccgcagcuccgagcggccggggaccagccgcgccacguggcggaccgaccgcgacaugggccucaugaacgcgaucgggcugcagccccggaaccccgccaccuccgugaccagccagggcacgcagacccuggcccuccagcugcagaacgccgagacccagaccgagcgcgaggugcccgagccgggcacggccgcguccgggcccggcgagggggagggcagcgaguacggggccagcggcgaggacgcccugucccggauccagcgccucauggccgagggcgggaugaccgccgucgugcagcgggagcagagcaccaccauggcguccaugggcggguucggcaacaacaucaucgugagccaccgcauccaccgguccagccagacggggaccgagcccggcgccgcccacaccuccagcccccagccguccaccagccgcggccugcugcccgaggccgggcagcucgccgagcggggccugagcccccgcacggcguccugggaccagcccgggaccccgggccgggagcccacccagcccacccugcccuccagcuccccgguccccauccccgugagccuccccuccgccgaggggccgacgcugcacugcgagcugaccaacaacaaccaccuccuggacggcggcagcucccgcggggacgccgccggcccccgcggggagccccggaaccgguga

SEQ ID NO: 26601 - RNA, 918 nt, Artificial Sequence
  derived and/or modified sequence opt1 from AMD1__Homo_sapiens__NP_001274143
auggaggccgcccacuucuucgagggcaccgagaagcugcucgaggugugguucagccgccagcagcccgacgcgaaccagggguccggcgaccugcggaccaucccgagcgaguccagcauguucgucuccaagcgccgguucauccugaagacgugcgggaccacccuccugcugaaggcccucgugccccugcugaagcucgcccgcgacuacagcggcuucgacuccauccagagcuucuucuacucccggaagaacuucaugaagcccagccaccagggguacccccaccgcaacuuccaggaggagaucgaguuccugaacgccaucuucccgaacggcgccgcguacugcaugggccggaugaacuccgacugcugguaccuguacacccucgacuuccccgagagccgcgugaucucccagcccgaccagacgcuggagauccugaugagcgagcucgaccccgccgucauggaccaguucuacaugaaggacggggugaccgccaaggacgugacccgggaguccggcauccgcgaccugaucccggggagcgucaucgacgccaccauguucaaccccugcggcuacuccaugaacgggaugaaguccgacggcacguacuggaccauccacaucacccccgagcccgaguucagcuacgugagcuucgagaccaaccugagccagacguccuacgacgaccucauccggaagguggucgagguguucaagccgggcaaguucgugaccacccuguucgucaaccagagcuccaagugccgcaccgugcuggcgagcccccagaagaucgagggguucaagcggcucgacugccaguccgccauguucaacgacuacaacuucguguucacgagcuucgccaagaagcagcagcagcagcaguccuga

SEQ ID NO: 26602 - RNA, 576 nt, Artificial Sequence
  derived and/or modified sequence opt1 from AMELX__Homo_sapiens__NP_001133
augggcaccuggauccuguucgccugccuccugggggccgcguucgccaugccccugccgccccaccccggccaccccggguacaucaacuucagcuacgaggugcucacgccccugaagugguaccaguccauccgcccgcccuaccccagcuacggcuacgagcccaugggcggguggcugcaccaccagaucauccccguccucucccagcagcacccgcccacccacacccugcagccccaccaccacauccccguggugcccgcccagcagcccgucaucccgcagcagcccaugaugcccgugcccggccagcacagcaugaccccgauccagcaccaccagcccaaccugccgccgcccgcccagcagcccuaccagccccagcccgugcagccccagccccaccagcccaugcagccgcagccgcccguccaccccaugcagccccucccgccccagccgccccugccgcccauguuccccaugcagccccugccgcccaugcuccccgaccugacccuggaggccuggcccuccacggacaagaccaagcgggaggagguggacuga

SEQ ID NO: 26603 - RNA, 579 nt, Artificial Sequence
  derived and/or modified sequence opt1 from AMELY__Homo_sapiens__NP_001134
augggcaccuggauccuguucgccugccucgugggggccgcguucgccaugccccugccgccccaccccggccaccccggguacaucaacuucagcuacgagguccugaccccgcucaagugguaccaguccaugauccgcccgcccuacagcuccuacggcuacgagcccaugggcggguggcugcaccaccagaucauccccguggugagccagcagcacccccugacgcacacccuccagucccaccaccacauccccgucgugcccgcccagcagccgcgggugcgccagcaggcccugaugcccguccccggccagcagagcaugacccccacccagcaccaccagccgaaccugccccuccccgcccagcagcccuuccagccgcagcccgugcagccccagccccaccagccgaugcagccccagccgcccgugcagcccaugcagccccugcugccccagccgccccucccgcccauguucccccugcggccccugccgcccauccuccccgaccugcaccuggaggcguggcccgccacggacaagaccaagcaggaggaggucgacuga

SEQ ID NO: 26604 - RNA, 3408 nt, Artificial Sequence
  derived and/or modified sequence opt1 from AMER1__Homo_sapiens__NP_689637
auggagacccagaaggacgaggccgcccaggcgaagggcgccgccgccagcggguccacccgcgagcagacggccgagaagggcgcgaagaacaaggccgccgaggccaccgaggggcccaccagcgagccguccagcuccggccccgggcggcugaagaagaccgcgaugaagcucuucggcggcaagaaggggaucugcacgcugcccagcuucuucggcgggggccgcuccaaggggagcggcaagggcuccagcaagaaggggcuguccaagagcaagacccacgacggccucuccgaggccgcccacgggcccgaggacguggucagcgagggcaccggcuucucccugccgcugcccgagcuccccugccaguuccccagcucccagagcgcccacggggcccuggagaccggcucccggugcaagacgagcguggcgggggccaccgagaaggccguggccgagaaguucccgagcaugcccaagcccaagaagggccugaagggguucuucuccagcauccgccggcaccgcaaguccaaggucaccggcgccgagcagagcgagcccggcgcgaaggggccggagcgggugcgcgcccggccccacgagcacguguccagcgccccccagguccccugcuucgaggagaccuuccaggccccgcgcaaggagaacgccaacccccaggacgcgcccggccccaagguguccccgacgcccgagcccagccccccggccaccgagaagauggccugcaaggaccccgagaagcccauggaggccugcgccuccgcgcacgugcagcccaagccggcccccgaggccagcucccucgaggagccccacagcccggagaccggggagaaggucguggccggcgaggugaacccccccaacgggcccgucggcgacccgcugucccugcucuucggcgacgugaccagccugaaguccuucgacagccugacggggugcggcgacaucaucgcggagcaggacauggacuccaugaccgacagcauggccuccgggggccagcgggccaaccgcgacgggaccaagcggagcagcugccucgugaccuaccagggcggcggggaggagauggcccugcccgacgacgacgacgaggaggaggaggaggaggaggaggucgagcuggaggaggaggaggaggaggugaaggaggaggaggaggacgacgaccucgaguaccugugggagacggcccagauguacccccgccccaacaugaaccugggcuaccacccgaccaccucccccgggcaccacggcuacaugcuccuggaccccgugcggagcuaccccggccuggcgccgggggagcuccugaccccccaguccgaccagcaggagagcgcccccaacuccgacgagggcuacuacgacagcacgacccccggguucgaggacgacuccggcgaggcccuggggcucguccgccgggacugccugccgcgcgacagcuacuccggcgacgcccuguacgaguucuacgagcccgacgacagccucgagaacuccccccccggcgacgacugccuguacgaccugcacgggcggagcuccgagauguucgacccguuccucaacuucgagcccuuccugagcucccgcccccccggcgccauggagaccgaggaggagcggcuggugaccauccagaagcagcuccuguacugggagcugcgccgcgagcagcucgaggcgcaggaggcccgggcccgcgaggcccacgcccgggaggcgcacgcccgcgaggccuacacgcgggaggccuacgggcgcgaggcguacgcccgggaggcccacaccugggaggcccacggccgcgaggcccggacccgcgaggcgcaggcccgggaggugcgcugccgggagacccagguccgcgagacgcaggcccggcaggagaagccggugcuggaguaccagaugcgcccccuggggcccagcgugaugggccucgccgccggcgucuccgggaccagccagaucagccaccggggcaucaccuccgcguucccgaccacggccagcuccgagcccgacuggcgcgacuuccggccccuggagaagcgcuacgaggggaccugcagcaagaaggaccaguccaccugccugaugcagcucuuccagagcgacgccauguucgagcccgacaugcaggaggccaacuucggcggguccccgcgccgggccuaccccaccuacagcccccccgaggacccggaggaggaggagguggagaaggagggcaacgcgaccgucuccuucagccaggcccugguggaguucacguccaacggcaaccuguucagcuccaugagcugcuccagcgacuccgacagcuccuucacccagaaccuccccgagcugccccccauggugaccuucgacaucgccgacgucgagcgcgacggggagggcaagugcgaggagaacccggaguuccacaacgacgaggaccuggccgcgagccuggaggccuucgagcucggguacuaccacaagcacgccuucaacaacuaccacagccgguucuaccagggccugcccugggggguguccagccugccccgcuaccucggccugcccggccugcacccgcggcccccccccgccgccauggcgcucaaccgccggucccgcagccuggacaccgccgagacgcuggagauggagcucuccaacagccaccuggugcagggguaccuggaguccgacgagcuccaggcccagcaggaggacagcgacgaggaggacgaggaggaggaggagggcgaguggucccgggacagcccgcugucccuguacaccgagccccccggggccuacgacuggcccgccugggcgccgugcccccuccccgucggccccggcccggccuggaucagccccaaccagcuggaccgccccuccagccaguccccguaccggcaggccaccugcugcaucccccccaugaccaugagcaucucccugagcgugcccgagucccgcgccccgggggagagcggcccccagcucgcccggcccagccaccugcaccugcccauggggccgugcuacaaccuccagccccaggcgucccagagcaugcgcgcccggccccgcgacgugcugcugcccgucgacgagccguccugcagcuccagcuccggcggguucagccccuccccccucccccaggccaagccggugggcaucacgcacggcaucccccagcugccccgggugcgccccgagcacccgcagccccagcccacccacuacgggcccagcucccuggaccucagcaaggagcgggccgagcagggcgccucccuggcgaccagcuacuccagcaccgccaugaacgggaaccuggccaaguga

SEQ ID NO: 26605 - RNA, 2016 nt, Artificial Sequence
  derived and/or modified sequence opt1 from AMER2__Homo_sapiens__NP_689917
auggagaccagccgcucccggggcgggggcggggccgugagcgagcgcggcggggccggcgcguccgucggcgugugccggcgcaaggccgaggccggggccggcaccgggacgcuggccgcggacauggaccuccacugcgacugcgccgccgagacccccgccgcggagccgcccagcggcaagaucaacaaggccgccuucaagcuguucaagaagcggaaguccgggggcaccaugcccagcaucuucggcgugaagaacaagggggacggcaaguccagcgggcccaccggccugguccgcucccggacgcacgacggccucgccgaggugcuggugcuggagagcgggcgcaaggaggagccgcggggcgggggcgacuccgggggcggcgggggcgggcgccccaaccccgggcccccgcgggccgcgggccccggcggcgggagccucgccuccagcuccgucgccaagagccacuccuucuucagccugcugaagaagaacggccgcuccgagaacgggaagggcgagcccguggacgccagcaaggccgggggcaagcagaagcggggccuccgcgggcuguucagcggcaugcgguggcaccgcaaggacaagcgggcgaaggccgaggccgccgaggggcgcgcccccggcggcgggcugauccucccgggcucccugaccgcgagccuggagugcgugaaggaggagacgccccgggccgcccgcgagcccgaggagcccucccaggacgccccgcgggaccccgccggggagcccgcgggcggggaggagguccccgccccggccgaccgcgcccccgcgcgcagcugccgggaggccgagggccucgcccaccccggcgacaccggggcccgcggcgaggacgccgcggggcaccggcgcgccgagcccggcccgggggaggugcggaccgccgaggacgccucccgcaccggcgccgugcccgucaagaccgugccccugguggacagcgagggcggguccggccgggcgcccgccgccccggaccccgccagcgucgacccgcccuccgaccccagcgccgaccgcaucugccugauguucuccgacgugaccagccucaaguccuucgacagccugacggggugcggcgacaucaucgcggaccaggaggaggaggccgggcccuccugcgacaagcacgugcccggcccgggcaagcccgcccugagcaagaagaaccccggggucguggccuaccagggcgggggcgaggagauggcgucccccgacgagguggacgacaccuaccuccaggaguucugggacaugcugagccagaccgaggagcaggggccggagccccaggagggcgccgccaaggucgccgccgcgcuggagaccaagguggugcccgagacgcccaaggacacccggugcgucgaggccgccaaggacgccuccagcgugaagcgccggcgccucaaccggaucccgaucgagccccaccccaaggaggagcccaagcacccggagaaggagcagcaggagggcguccccaacagcgacgagggguacugggacuccaccacccccggccccgaggaggacagcuccagcuccgggaagaaggccggcaucccgcgcgacagcuacuccggcgacgcgcuguacgaccuguacgccgaccccgacgggagccccgccacgcuccccggcgggaaggacaacgaggagaccuccagccugucccggcugaagccggugagccccggcaccaucacgugcccccuccgcaccccggggucccugcugaaggacagcaagauccccaucuccaucaagcaccucaccaaccugcccagcucccaccccgugguccaccagcagccgagccggagcgagaugccccgcaccaagauccccguguccaaggugcugguccggcgcgugagcaaccgcggccucgccggcaccacgauccgggccaccgcgugccacgacuccgccaagaagcuguga

SEQ ID NO: 26606 - RNA, 2586 nt, Artificial Sequence
  derived and/or modified sequence opt1 from AMER3__Homo_sapiens__NP_001098663
auggagcugaagcgcggcaagaccuucaucaagagcucccuccaggugagccacgagaagcccccggaccccgccgccgucgcggccgcccgggaggggaccggccccugguccgugcugcccgggggccagcagcgcccgcacagcgagaaggggccccaggccucccccagcgcccaggaguacgaccggugccccaacaagggcgcgcagcuggacccgaagggcgggcccgccgcccucugcggcgccacguucaagcccgugcgcaagugcaagacccacgacuccaugagcggggcgggccgggccaccgccgccaccgggcagcuggucggcuccgccagcuuccccggcuccccggggagccgccggaugaucgacuaccgccacuucgugccccagaugcccuucgugcccgcggucgccaaguccaucccgcggaagcgcaucagccugaagcggcccaagaagugcuuccgcaaccucuuccacauccggcgcaacaagacggaggaccuggccucccuggccgccgagggcaagagccuccccucccccggggacccgagcgaccccggcggccggcgcuccaaggcguuccugccgcccggggagggccccgggcuggacggccucugccaggaccugcuggacagcgagcuccuggccgacgccagcuucgggcugugccgggcccucugcgaggacguggccucccugcagagcuucgacucccugaccggcugcggcgagguguucgcggacgagagcuccguccccagccucgagcugaacgaggggcccgagucccccacccaggccgcccagggccuggagagcaaggugccgcgcgggccccuccagggcuccguggagcagcuggccagccccgcccagaacgaggcguccgacuucacccgguucugggacagcgucaaccgcuccgugcggcagcagcagcgcgcccugcucgggccguggcugagcggcccccagggcacggaccgcgaccagucccggcuggacaccgccgggcucgccgagcugccccugugccccugccgcgacccgcggagcggcuccaaggcgagcuccaucgacaccgggacccccaagagcgagcagcccgagagcguguccacgagcgacgagggcuacuacgacuccuucagccccgggcucgaggaggacaagaaggaggccgaguccccgggcacccccgccgccaccuucccccgcgacagcuacuccggcgacgcccuguacgagcuguuccacgaccccagcgaggggccgcucggccccucccccgacgacgaccugugcgucagcgagucccugagcgggcccgcgcucggcaccccgcuguccaucugcagcuuccgggugggcgccgaggagaaccuggcccccgcccccgggcccgaccuccugucccagggcuuccugcagagcuccuggaaggggaaggagugccuccugaagcugugcgacacggagcucgccaucaccaugggcaucgugagcuggcugcgccgggggccgacgccccgcgcgccgcccacccccggccagcccgccgcgcccccgggcagccagggggcgccccgggcccccaccgagaagcugggcgggcgcgagggccuggccuccgacgccgggggcgccaccgucugcagcgcccccucccggcaggagcucugggcccacccgggcaccaccgggcugcuggccggcgagagcaaggcccucgggggcgccacgcaggggaccggcacccugucccgcgacgccagccgggaggaggagacccgcggccacuccgaggggcuguucagcuccauggagagcgcggccacguccaccaccgacaccagcggcaagaacaaggcccccgugcccuccacguggcccugcagccagaaggagccggggccgcccggcgugcucgggugcuuccggggccccuggcgccccggccacgggggcgacacccuggacgccgagcccaugcuggccgggugcgucgcgcggguggccgcccucaagaucuccagcaacgagcagccgcccgccgccuggccgccccgccaggacaugggcuccggccuguucgggcagcggugggcgcgcggccccgacaugcuggagcagaagcagagcuccagcagccccuccaugaccaccauccacgggcuccccuacagcgccuccacgcaggaccagcgcugccgggaccgcgugcaggaccugagcuggcugcgggucgagcccaccggccucggggugcaggccugggccuccgucgaggaccagccccugcagcugagcaccgaggcgguggagcaggucgcccacggcucccagcucgacagcgagccccgcuccgccccggccgcccgguggagcucccagggccaccaccccgagagccuggggcugacccucaacucccagcaggagggcggggugagcgcguccgcccccgagugccgcugcagccugcuggcccgggagggccuccugugcgggcagcccgaggugggcgccuccggcccggccauggcggagccccaccuguga

SEQ ID NO: 26607 - RNA, 1932 nt, Artificial Sequence
  derived and/or modified sequence opt1 from AMFR__Homo_sapiens__NP_001135
augccccuccuguuccuggagcgcuucccguggcccagccugcggaccuacaccggccucuccgggcuggcccugcucggcacgaucaucagcgccuaccgcgcgcugucccagcccgaggccgggcccggcgagccggaccagcugaccgccagccuccagcccgagccgcccgccccggcccggcccuccgccgggggcccccgcgcgcgggacguggcccaguaccugcugagcgacucccucuucgucugggugcuggugaacaccgccugcugcguccugaugcucguggcgaagcugauccagugcaucguguucggcccccugcgcgucagcgagcggcagcaccucaaggacaaguucuggaacuucaucuucuacaaguucaucuucaucuucggggugcugaacgugcagaccgucgaggagguggugauguggugccugugguucgccggccucgucuuccugcaccugauggugcagcucugcaaggaccgcuucgaguaccuguccuucagcccgacgacccccauguccagccacgggcgggugcugucccuccuggucgccaugcugcucagcugcugcggccuggccgccgugugcuccaucaccggguacacccacggcaugcacacgcuggcguucauggccgccgagagccuccuggugaccguccgcaccgcccacgugauccugcgguacgugauccaccucugggaccugaaccacgagggcaccugggaggggaagggcacguacgucuacuacaccgacuucgugauggagcugacccuccugucccuggaccucaugcaccacauccacaugcugcuguucgggaacaucuggcucagcauggccucccuggugaucuucaugcagcugcgcuaccucuuccacgagguccagcggcgcauccggcgccacaagaacuaccugcggguggucggcaacauggaggcgcgcuucgccguggccacccccgaggagcuggccgugaacaacgacgacugcgccaucugcugggacagcaugcaggcggcccggaagcugcccugcggccaccucuuccacaacagcugccugcgcuccuggcuggagcaggacacgagcugcccgaccugccggaugucccucaacaucgccgacaacaaccgcguccgcgaggagcaccagggggagaaccuggacgagaaccuggugcccguggccgccgcggagggccggccccgccucaaccagcacaaccacuucuuccacuucgacgggagccggaucgccuccuggcugcccagcuucuccgucgaggugaugcacaccaccaacauccugggcaucacgcaggccagcaacucccagcucaacgccauggcgcaccagauccaggagauguucccccaggugcccuaccaccugguccugcaggaccuccagcugacccgcagcguggagaucaccaccgacaacauccuggaggggcggauccaggugcccuuccccacgcagcgcuccgacagcauccggccggcccucaacucccccgucgagcgccccagcuccgaccaggaggagggcgagaccagcgcccagaccgagcgggugccccuggaccuguccccgcgccucgaggagacccuggacuucggcgagguggaggucgagcccagcgagguggaggacuucgaggcccgggggucccgcuucagcaagagcgccgacgagcggcagcgcaugcuggugcagcggaaggacgagcuccugcagcaggcgcgcaagcgguuccugaacaaguccagcgaggacgacgccgccuccgagagcuuccuccccuccgagggcgccagcuccgacccggucacgcugcgccggcgcaugcuggccgcggccgccgagcgccggcuccagaagcagcagaccagcuga

SEQ ID NO: 26608 - RNA, 1683 nt, Artificial Sequence
  derived and/or modified sequence opt1 from AMH__Homo_sapiens__NP_000470
augcgcgaccugccccucaccagccuggcccuggugcucuccgcccugggcgcgcugcucgggaccgaggcccugcgggccgaggagccggccgucggcacgagcgggcugaucuuccgcgaggaccucgacuggccgcccggcagcccccaggagccccugugccugguggcccucgggggcgacuccaacggcuccagcagcccccugcggguggucggggcgcuguccgccuacgagcaggccuuccucggcgccgugcagcgcgcgcggugggggccccgcgaccuggccaccuucggcgugugcaacaccggggaccggcaggccgcccugcccucccuccgccggcugggcgccuggcugcgcgacccgggcgggcagcggcucgucgugcugcaccuggaggaggugaccugggagcccacgcccagccuccgcuuccaggagcccccgcccggcggggcgggcccgcccgagcuggcccugcucguccuguaccccggccccgggcccgaggugaccgugacccgggccggccugcccggggcccagucccucugcccgagccgcgacacccgguaccugguccuggccguggaccgccccgcgggcgccuggcggggguccggccucgcccugacgcugcagccccgcggcgaggacagccggcucuccaccgcccgccugcaggcccuccuguucggggacgaccaccggugcuucacccgcaugacccccgcgcugcugcuccugccgcgcagcgagcccgcgccccugcccgcccacggccagcucgacacggugccguucccgccgccccggcccuccgccgagcuggaggagagcccgcccuccgccgaccccuuccuggagacccucacccgccugguccgggcccugcgcgugccgcccgcccgggccagcgcgccccgccuggcccucgaccccgacgcccuggccggguucccccagggccuggugaaccucagcgaccccgccgcccuggagcggcugcucgacggggaggagccccugcugcuccugcugcgccccaccgcggccacgaccggcgaccccgcgccccuccacgaccccaccuccgccccgugggccaccgcccuggcccggcgcgucgccgccgagcugcaggccgcggccgccgagcuccggagccugcccggccugccgcccgccacggcgccccuccuggcccgccugcucgcccugugccccgggggccccgggggccugggggacccccuccgggcccugcugcuccugaaggcccugcagggccuccgcguggaguggcggggccgcgacccgcgggggcccggccgcgcgcagcgguccgccggggccaccgccgccgacggccccugcgcgcugcgcgagcugagcguggaccuccgcgccgagcgguccguccugaucccggagaccuaccaggccaacaacugccagggcgugugcggguggccccagagcgaccgcaacccccgguacggcaaccacgugguccugcuccugaagaugcaggcccgcggggccgcgcuggcccggcccccgugcugcgugcccaccgccuacgccggcaagcuccugaucucccugagcgaggagcgcaucuccgcgcaccacguccccaacaugguggccacggagugcgggugccgguga

SEQ ID NO: 26609 - RNA, 1437 nt, Artificial Sequence
  derived and/or modified sequence opt1 from AMHR2__Homo_sapiens__NP_001158162
augcugggcagccucgggcugugggcccugcuccccaccgccguggaggcgccgcccaaccgccggaccugcgucuucuucgaggcccccggcgugcgcggguccacgaagacccugggcgagcugcucgacaccgggaccgagcugccccgggccauccgcugccuguacagccggugcugcuucggcaucuggaaccucacgcaggaccgcgcccagguggagaugcagggcugccgggacuccgacgagccggggugcgagagccugcacugcgaccccagcccccgcgcccaccccuccccgggcuccacccuguucacgugcagcugcgggaccgacuucugcaacgcgaacuacucccaccucccgccgcccggcagccccgggacccccggcucccagggcccccaggccgcccccggggagagcaucuggauggcccugguccugcucggccuguuccugcuccugcugcuccugcugggguccaucauccucgcgcugcugcagcggaagaacuaccgcgugcggggcgagcccgugcccgagccccgccccgacagcggccgggacugguccgucgagcuccaggagcugccggagcugugcuucagccaggugauccgcgagggcgggcacgccguggucugggccgggcagcuccagggcaagcugguggccaucaaggccuucccgccccgguccguggcgcaguuccaggccgagcgcgcccuguacgagcuccccgggcugcagcacgaccacaucguccgguucaucaccgccagccgcggcggccccgggcggcugcucuccggcccccugcuggugcucgagcugcaccccaaggggagccugugccacuaccucacccaguacaccagcgacuggggcuccagccugcgcauggcccugucccucgcgcaggggcuggccuuccugcacgaggagcgguggcagaacggccaguacaagcccggcaucgcccaccgcgaccucagcucccagaacgugcugauccgcgaggacgggagcugcgccaucggcgaccuggggcuggcccucguccugccgggccugacgcagccgcccgcguggacccccacccagccccaggggcccgccgccaucauggaggccggcacccagcgguacauggcccccgagcuccuggacaagacgcuggaccuccaggacuggggcauggcgcugcgccgggccgacaucuacucccuggcccuccugcugugggagauccucagccgcugcccggaccugcggcccgccgugcaccaccccuccaacuggcccaugcgccagaacugggcgaucccgcugccccucaugagcuacgggcccuggcagugccggcgcggcggggugcccaccucccacccgcccggcgccgcccugccccagacccugaugggcuga

SEQ ID NO: 26610 - RNA, 1185 nt, Artificial Sequence
  derived and/or modified sequence opt1 from AMICA1__Homo_sapiens__NP_001091996
auguucugcccccugaagcucauccugcugccggugcuccuggacuacagccugggccucaacgaccugaacgucagcccgcccgagcugaccgugcacgugggggacagcgcccucaugggcugcgucuuccaguccaccgaggacaagugcaucuucaagaucgacuggacgcugagccccggggagcacgccaaggacgaguacgugcuguacuacuacuccaaccucagcgugcccaucggccgcuuccagaaccggguccaccugaugggggacauccugugcaacgacggcucccuccugcugcaggacgugcaggaggcggaccagggcaccuacaucugcgagauccgccucaagggggagagccagguguucaagaaggccgucgugcugcacgugcugcccgaggagcccaaggagcucaugguccacgugggcgggcugauccagaugggcugcguguuccaguccaccgaggucaagcacgugaccaagguggaguggaucuucagcgggcggcgcgccaaggaggagaucgucuuccgguacuaccacaagcugcgcauguccguggaguacagccaguccuggggccacuuccagaaccgggugaaccucgucggcgacaucuuccgcaacgacgggagcaucaugcugcagggcgugcgggaguccgacgggggcaacuacacgugcagcauccaccugggcaaccucguguucaagaagaccaucguccugcacgugucccccgaggagccgcgcacccuggucacccccgccgcccuccggccccuggugcucgggggcaaccagcuggugaucaucgucgggaucgugugcgcgacgauccugcugcuccccgugcugauccugaucgucaagaagaccugcggcaacaagagcuccgugaacagcaccgugcucgucaagaacaccaagaagacgaacccggagaucaaggagaagcccugccacuucgagcgcugcgagggggagaagcacaucuacagccccaucaucgugcgggaggugaucgaggaggaggagcccuccgagaaguccgaggccaccuacaugaccaugcacccggucuggcccagccugcgcagcgaccggaacaacucccuggagaagaaguccggcggcgggaugcccaagacccagcaggccuucuga

SEQ ID NO: 26611 - RNA, 1569 nt, Artificial Sequence
  derived and/or modified sequence opt1 from AMIGO2__Homo_sapiens__NP_862830
augagccugcgcgugcacacccuccccacccugcugggcgccgucgugcggccggggugccgcgagcuccugugccugcucaugaucacggugaccgucggccccggggccuccggcgugugccccaccgcgugcaucugcgccaccgacaucgugagcugcacgaacaagaaccuguccaagguccccgggaaccuguuccggcucaucaagcgccuggaccugagcuacaaccggaucggccuccuggacuccgaguggaucccggugagcuucgccaagcugaacacccucauccugcgccacaacaacaucaccuccaucagcaccggcuccuucagcacgacccccaaccugaagugccucgaccuguccagcaacaagcugaagaccgugaagaacgccgucuuccaggagcucaaggugcuggaggugcugcuccuguacaacaaccacaucuccuaccuggaccccagcgccuucgggggccucucccagcugcagaagcuguaccucagcgggaacuuccugacccaguuccccauggaccuguacgucggccgguucaagcucgcggagcugauguuccuggacguguccuacaaccgcaucccgagcaugcccaugcaccacaucaaccucgugcccgggaagcagcugcggggcaucuaccugcacggcaaccccuucgucugcgacugcucccucuacagccugcugguguucugguaccgccggcacuucagcuccgugauggacuucaagaacgacuacacgugccgccucuggagcgacucccggcacagccgccagguccugcugcuccaggacuccuucaugaacugcagcgacuccaucaucaacgggagcuuccgggcccugggcuucauccacgaggcccaggugggggagcgccugauggugcacugcgacuccaagaccggcaacgccaacaccgacuucaucugggucggcccggacaaccggcuccuggagcccgacaaggagauggagaacuucuacguguuccacaacgggagccuggugaucgagagcccccgcuucgaggacgcgggcgucuacuccugcaucgccaugaacaagcagcggcugcucaacgagaccguggacgucacgaucaacguguccaacuucaccgugagccgcucccacgcccacgaggccuucaacaccgccuucaccacgcuggcggccugcgucgccagcaucgugcuggugcuccuguaccuguaccucacccccugcccgugcaagugcaagaccaagcggcagaagaacaugcugcaccaguccaacgcccacagcuccauccugagccccgggcccgccagcgacgcguccgccgacgagcgcaaggccggcgccgggaagcgcgucguguuccucgagccccugaaggacaccgccgcgggccagaacggcaaggugcggcuguucccgagcgaggccgucaucgccgaggggauccucaaguccacgcgcggcaagagcgacuccgacagcgugaacuccguguucagcgacacccccuucgucgccuccaccuga

SEQ ID NO: 26612 - RNA, 891 nt, Artificial Sequence
  derived and/or modified sequence opt1 from AMMECR1__Homo_sapiens__NP_001020751
auggccgccggcugcugcggggugaagaagcagaagcugagcuccagccccccguccggcagcgggggcgggggcggcgcguccagcuccagccacugcuccggggagagccagugccgcgccggcgagcucgggcugggcggggccggcacccggcugaacggccucgggggccugaccgggggcggcuccgggagcggcugcacgcugucccccccccaggggugcggcgggggcggcgggggcaucgcccucagccccccgcccuccugcggggucggcacccugcugagcacccccgccgcggccaccuccagcucccccagcagcuccagcgccgccuccagcuccagcccggggucccgcaagaugguggugagcgcggagaugugcugcuucugcuucgacguccucuacugccaccuguacggcuaccagcagccccggacgccccgcuucaccaacgagcccuacgcccugaaggacucccgguucccgcccaugacccgcgacgagcucccccggcuguucugcagcgugucccugcucaccaacuucgaggacgugugcgacuaccuggacugggaggucggcgugcacgggauccgcaucgaguucaucaacgagaagggcagcaagcggacggccaccuaccugcccgagguggccaaggagcaggggugggaccacauccagaccaucgacucccuccugcgcaagggcggguacaaggccccgaucaccaacgaguuccggaagacgaucaagcugacccgcuaccggagcgagaagaugacccucuccuacgcggaguaccuggcccaccgccagcaccaccacuuccagaacggcaucggccacccccugccccccuacaaccacuacagcuga

SEQ ID NO: 26613 - RNA, 1362 nt, Artificial Sequence
  derived and/or modified sequence opt1 from AMN__Homo_sapiens__NP_112205
augggcgugcuggggcgcguccuccuguggcugcagcucugcgcccugacccaggccgugagcaagcugugggugcccaacaccgacuucgacgucgcggccaacuggucccagaaccggacgccgugcgccggcggggccguggaguuccccgccgacaagauggugagcguccucgugcaggagggccacgcgguguccgacaugcugcugccccucgacggggagcugguccuggccagcggcgccggcuucgggguguccgacgugggcagccaccucgacugcggggccggcgagcccgcggucuuccgcgacuccgaccgguucagcuggcacgacccgcaccuguggcgcuccggggacgaggcccccggccuguucuucguggacgccgagcgggugcccugccgccacgacgacgucuucuucccgcccagcgccuccuuccgggugggccucgggcccggcgccagccccgugcgcguccgguccaucagcgcgcuggggcgcaccuucacccgggacgaggaccuggccguguuccucgccucccgcgccggccggcugcgcuuccacggccccggggcccugagcgugggcccggaggacugcgcggaccccuccgggugcgucugcggcaacgccgaggcccagcccuggaucugcgccgcccuccugcagccccucgggggccggugcccgcaggcggccugccacagcgcccugcgcccccagggccagugcugcgaccugugcggggccguggugcugcucacccacggccccgccuucgaccuggagcgguaccgcgcgcggauccuggacacguuccucgggcugccccaguaccacggccugcaggucgccguguccaaggucccgcgcagcagccggcuccgcgaggccgacaccgagauccagguggugcuggucgagaacgggcccgagaccggcggcgccgggcgccuggcgcgggcccuccuggccgacguggccgagaacggcgaggcccugggggugcucgaggcgaccaugcgcgaguccggcgcccacgucugggggagcuccgccgccggccuggccggcgggguggcggccgccgugcugcucgcccugcugguccuccugguggccccgccccugcuccggcgcgcgggccggcugcgcuggcggcgccacgaggccgccgcccccgcgggggcgccccugggcuuccggaaccccguguucgacgucacggccagcgaggagcugccccucccgcgccggcugucccuggugcccaaggccgccgccgacagcaccucccacagcuacuucgugaacccccucuucgccggcgccgaggccgaggccuga

SEQ ID NO: 26614 - RNA, 2028 nt, Artificial Sequence
  derived and/or modified sequence opt1 from AMOT__Homo_sapiens__XP_005262147
augccccgcgcccagccgagcuccgccagcuaccagcccgugcccgcggaccccuucgccaucgucucccgggcccagcagaugguggagauccugagcgacgagaaccgcaaccuccggcaggagcuggagggcugcuacgagaagguggcccgccugcagaaggucgagaccgagauccagcggguguccgaggccuacgagaaccucgucaagagcuccagcaagcgcgaggcgcuggagaaggccaugcggaacaagcuggagggggagauccgccggaugcacgacuucaaccgcgaccuccgggagcgccuggagaccgccaacaagcagcuggccgagaaggaguacgagggcuccgaggacacgcggaagaccaucagccagcuguucgcgaagaacaaggagucccagcgcgagaaggagaagcuggaggccgagcuggccaccgcccggagcaccaacgaggaccagcgccggcacaucgagauccgcgaccaggcccucuccaacgcgcaggccaagguggugaagcuggaggaggagcugaagaagaagcaggucuacguggacaagguggagaagaugcagcaggcccucgugcagcugcaggccgccugcgagaagcgggagcagcuggagcaccgccuccggacgcgccuggagcgcgagcuggagagccuccggauccagcagcgccaggggaacugccagccgaccaacgucuccgaguacaacgcggccgcccugauggagcugcuccgggagaaggaggagcgcauccuggcccuggaggccgacaugaccaagugggagcagaaguaccucgaggagaacgugaugcggcacuucgcgcuggacgccgccgccaccguggccgcgcagcgcgacacgaccgucaucagccacucccccaacaccagcuacgacaccgcccuggaggcccggauccagaaggaggaggaggagauccucauggccaacaagcgcugccuggacauggagggccggaucaagacgcugcacgcgcagaucaucgagaaggacgccaugaucaaggugcuccagcagcgcucccggaaggagcccagcaagaccgagcagcugagcugcaugcgccccgccaagucccugaugagcaucuccaacgccgggagcggccuccugucccacagcuccacccugaccggcagcccgaucauggaggagaagcgggacgacaaguccuggaaggggagccucggcauccugcucgggggcgacuaccgcgccgaguacgugcccuccacgcccagccccgucccgcccuccacgccccuccugagcgcgcacuccaagaccgggagccgggacugcuccacccagaccgagcgcggcaccgagagcaacaagaccgccgccguggcccccaucuccgugccggcccccgucgcggccgccgccaccgccgcggccaucacggccaccgccgcgaccaucaccacgaccaugguggccgccgcccccguggccgucgcggccgccgccgcccccgcggccgccgccgccccgagccccgcgaccgccgccgccaccgcggccgccgugagccccgccgccgcgggccagauccccgccgccgccuccgucgccagcgcggccgccguggccccguccgccgcggccgccgccgccgugcaggucgcgcccgccgcccccgcccccgugccggcgcccgcccuggugcccgucccggcccccgccgccgcgcaggccagcgcccccgcccagacgcaggcccccaccuccgcgccggccguggcccccacccccgcccccaccccgacgcccgccguggcgcaggccgagguccccgccagccccgccaccgggccgggcccccaccggcucuccauccccagccugaccugcaaccccgacaagaccgacgggccgguguuccacuccaacacccuggagcgcaagacgcccauccagauccucggccaggagcccgacgcggagaugguggaguaccugaucuga

SEQ ID NO: 26615 - RNA, 2721 nt, Artificial Sequence
  derived and/or modified sequence opt1 from AMOTL1__Homo_sapiens__NP_001287936
auguggcgcgccaagcugcggcgcgggaccugcgagcccgccgugaaggucgaggacccgcucugcaacuuccacagccccaacuuccugcggaucuccgagguggagaugcgcgggagcgaggacgcggccgccggcaccgugcugcagcggcucauccaggagcagcugcgcuacgggacgcccaccgagaacaugaaccugcucgccauccagcaccaggccaccggcuccgcggggcccgcccacccgaccaacaacuucagcuccacggagaaccugacccaggaggacccccagauggucuaccagagcgcccggcaggagccccagggccaggagcaccagguggacaacaccgugauggagaagcagguccgcuccacccagccccagcagaacaacgaggagcugccgacguacgaggaggccaaggcgcagagccaguucuuccggggccagcagcagcagcagcagcagcagggggccgugggccacggguacuacauggccggcgggaccucccagaagucccgcaccgagggccggcccaccgugaaccgcgccaacuccggccaggcccacaaggacgaggcgcucaaggagcugaagcaggggcacguccggagccuguccgagcgcaucaugcagcucagccuggagcggaacggcgccaagcagcaccucccgggguccggcaacggcaagggguucaaggugggcgggggccccagcccggcccagcccgccgggaaggugcucgacccccgcgggcccccgcccgaguaccccuucaagacgaagcagaugaugucccccgucagcaagacccaggagcacggccuguucuacggcgaccagcacccgggcaugcugcacgagauggugaagcccuaccccgcgccccagcccgugcggaccgacgucgccgugcugcgcuaccagcccccgcccgaguacggcgugaccagccggcccugccagcugcccuuccccagcacgaugcagcagcacagcccgauguccagccagaccuccagcgccuccggcccccugcacagcgucucccucccccugccccugccgauggcccucggggcgccccagcccccgcccgccgccagccccucccagcagcugggccccgacgccuucgccaucguggagcgcgcccagcagaugguggagauccugaccgaggagaaccggguccuccaccaggagcugcagggcuacuacgacaacgccgacaagcugcacaaguucgagaaggagcuccagcgcaucagcgaggcguacgagucccuggucaagagcaccacgaagcgcgagucccuggacaaggccaugcggaacaagcucgagggggagauccgccggcugcacgacuucaaccgcgaccugcgggaccgccucgagaccgccaaccggcagcugagcucccgcgaguacgagggccacgaggacaaggccgcggaggggcacuacgccagccagaacaaggaguuccugaaggagaaggagaagcucgagauggagcuggccgccgugcggaccgccuccgaggaccaccgccggcacaucgagauccuggaccaggcgcucagcaacgcccaggcccgcgugaucaagcuggaggaggagcugcgggagaagcaggccuacguggagaaggucgagaagcuccagcaggcccugacccagcugcaguccgcgugcgagaagcgcgagcagauggagcggcgccuccggacguggcuggagcgcgagcuggacgcccugcggacccagcagaagcacggcaacgggcagcccgccaacaugccggaguacaacgcccccgcccuccuggagcuggugcgcgagaaggaggagcgcauccucgcgcuggaggccgacaugaccaagugggagcagaaguaccuggaggagagcaccauccggcacuucgccaugaacgccgcggccacggccgccgccgagcgcgacaccaccaucaucaaccacagccggaacggcuccuacggcgagagcucccucgaggcgcacaucuggcaggaggaggaggaggugguccaggccaaccgccggugccaggacauggaguacaccaucaagaaccugcacgccaagaucaucgagaaggacgccaugaucaaggugcugcagcagcgcagccggaaggacgccgggaagacggacuccagcucccuccgccccgcgcggagcgugcccuccaucgccgccgccaccggcacccacagccgccagaccucccugacgagcucccagcuggccgaggagaagaaggaggagaagaccuggaaggggagcaucggccuccugcugggcaaggagcaccacgagcacgcguccgccccgcuccugcccccgccgcccaccagcgcccuguccagcaucgccagcaccaccgcggccuccagcgcccacgccaagacgggguccaaggacagcuccacccagaccgacaagagcgccgagcuguucuggcccuccauggcgagccuccccucccggggccgccugagcaccacgcccgcccacucccccguccucaagcaccccgccgccaaggggaccgccgagaagcuggagaacagccccggccacgggaaguccccggaccaccggggccgcgugagcucccugcuccacaagcccgaguuccccgacggcgagaugauggaggugcugaucuga

SEQ ID NO: 26616 - RNA, 1785 nt, Artificial Sequence
  derived and/or modified sequence opt1 from AMPD2__Homo_sapiens__XP_011539550
augcgcaagcugacccacggcaccgggccccggccgcgcgugggcagcgggcagcccuaccggggcgucguggccgcccacguggcgccccgcaagcggaagaaguggcgcgggggcgucggccggcgccggcgcgggcaggccggcgccgggccccgggccgccgagccgggcgcggagcccgcccgcuucuggugggggcucacgugcugcgugaccccgccccaguccggccggggcagccccacccugaacgcccagggggugcugcgcgagaucuggaccuccuucggcagccggucccucgggagcacguggcccaccucccugagcaucgccggccugggcgggcgcgacaccggcgucgcgcuccggcccgugcgccugccccgguccgccggggugcaccuccgcccggccggcaacuucgagcggcuccccuacuucccccaccugagcgcccgcgccggggcgcugggcgucaccuggcucggcuccguggcccgcagccccugccggccguccgggcccggccugagcgccgugcagacgucccgcgggcagccgccccugggcacccgggccagcuggccccaggagcuguucacccgcucccuggccgagagcgagcugcgguccgcgcccuacgaguuccccgaggagagccccaucgagcagcucgaggagcgccggcagcgccuggagcggcagaucagccaggacgucaagcuggagccggacauccuccugcgcgccaagcaggacuuccugaagaccgacuccgacagcgaccuccagcuguacaaggagcagggggagggccagggcgaccggucccugcgcgagcgggacgugcucgagcgcgaguuccagcgggugacgaucagcggggaggagaagugcggcguccccuucaccgaccugcuggacgccgccaaguccguggugcgcgcccucuucauccgggagaaguacauggcgcugagccugcaguccuucugccccaccacccgccgguaccuccagcagcuggccgagaagccccuggagacgcgcaccuacgagcaggggccggacacccccgucagcgccgacgcccccgugcacccgcccgcccucgagcagcaccccuacgagcacugcgagcccuccaccaugccgggcgaccuggggcugggccuccgcauggugcggggcgucgugcacguguacacgcgccgggagcccgacgagcacugcagcgaggucgagcugcccuaccccgaccugcaggaguucguggcggacgucaacgugcucauggcccugaucaucaacgggccgaucaaguccuucugcuaccgccggcugcaguaccucagcuccaaguuccagaugcacgugcugcugaacgagaugaaggagcucgccgcccagaagaaggucccccaccgcgacuucuacaacauccggaagguggacacccacauccacgcgagcuccugcaugaaccagaagcaccuccugcgcuucaucaagcgggccaugaagcgccaccuggaggagaucgugcacgucgagcagggccgggagcagacccugcgcgagguguucgagagcaugaaccugaccgccuacgaccuguccguggacacgcucgacguccacgccgaccggaacaccuuccaccgcuucgacaaguucaacgccaaguacaaccccaucggggagagcgugcugcgggagaucuucaucaagaccgacaaccgcguguccggcaaguacuucgcgcacaucaucaaguga

SEQ ID NO: 26617 - RNA, 2331 nt, Artificial Sequence
  derived and/or modified sequence opt1 from AMPD3__Homo_sapiens__NP_000471
auggcccugagcuccgagcccgccgagaugccgcgccaguuccccaagcucaacaucagcgagguggacgagcagguccggcugcuggcggagaagguguucgccaaggugcuccgcgaggaggacuccaaggacgcccugagccuguucaccguccccgaggacugccccaucggccagaaggaggccaaggagcgggagcuccagaaggagcuggccgagcagaaguccguggagaccgcgaagcgcaagaaguccuucaagaugauccggucccagagccugucccuccagaugccgccccagcaggacuggaaggggccgcccgccgccagccccgccaugucccccacgacccccguggucaccggcgcgaccagccugcccacgccggcccccuacgccaugcccgaguuccagcgcgugaccaucuccggggacuacugcgccggcaucacccuggaggacuacgagcaggccgccaagagccucgccaaggcccugaugauccgggagaaguacgcccgccuggccuaccaccgguucccccgcaucaccucccaguaccucgggcacccgcgggcggacacggccccgcccgaggagggccugcccgacuuccacccgccgccccugccccaggaggaccccuacugccucgacgacgccccgcccaaccuggacuaccuggugcacaugcagggcgggauccucuucgucuacgacaacaagaagaugcuggagcaccaggagccccacagccugcccuaccccgaccucgagaccuacaccguggacaugagccacauccuggcgcugaucaccgacggccccacgaagaccuacugccaccgccggcucaacuuccuggagagcaaguucucccugcacgagaugcucaacgagaugagcgaguucaaggagcugaaguccaacccccaccgcgacuucuacaacgugcggaaggucgacacccacauccacgccgcggccugcaugaaccagaagcaccuccugcgcuucaucaagcacaccuaccagacggagcccgaccggaccguggccgagaagcgcgggcggaagaucacccugcgccagguguucgacggccugcacauggaccccuacgaccucaccgucgacagccuggacgugcacgccgggcggcagacguuccaccgcuucgacaaguucaacagcaaguacaaccccgugggcgccuccgagcugcgcgaccucuaccugaagaccgagaacuaccugggcggggaguacuucgcgcggauggucaaggagguggcccgcgagcucgaggagagcaaguaccaguacuccgagccgcggcugagcaucuacggccgcucccccgaggaguggcccaaccuggccuacugguucauccagcacaagguguacagccccaacaugcgguggaucauccaggucccgcgcaucuacgacaucuuccgguccaagaagcuccugcccaacuucgggaagaugcuggagaacaucuuccucccccuguucaaggccaccaucaacccccaggaccaccgcgagcugcaccuguuccucaaguacgugaccggcuucgacagcguggacgacgaguccaagcacagcgaccacauguucuccgacaagagcccgaaccccgacgucuggacguccgagcagaacccgcccuacagcuacuaccuguacuacauguacgcgaacaucauggugcugaacaaccuccggcgcgagcggggccuguccaccuuccuguuccgcccccacugcggggaggccggcagcaucacccaccucgucuccgccuuccugaccgccgacaacaucagccacgggcugcuccugaagaagucccccgugcugcaguaccucuacuaccuggcccagauccccaucgcgaugagcccccugagcaacaacucccucuuccuggaguacagcaagaacccgcugcgggaguuccuccacaagggccugcacgugucccugagcacggacgaccccaugcaguuccacuacaccaaggaggcccucauggaggaguacgccaucgccgcccaggucuggaagcuguccacgugcgaccugugcgagaucgcgcgcaacagcgugcuccaguccgggcugagccaccaggagaagcagaaguuccugggccagaacuacuacaaggagggccccgaggggaacgacauccggaagaccaacguggcccagauccgcauggccuuccgguacgagacccucugcaacgagcuguccuuccugagcgacgccaugaaguccgaggagaucaccgcccucaccaacuga

SEQ ID NO: 26618 - RNA, 2088 nt, Artificial Sequence
  derived and/or modified sequence opt1 from AMPH__Homo_sapiens__NP_001626
auggccgacaucaagaccggcaucuucgccaagaacgugcagaagcgccugaaccgggcgcaggagaagguccuccagaagcuggggaaggccgacgagaccaaggacgagcaguucgaggaguacgugcagaacuucaagcgccaggaggccgagggcacgcggcugcagcgcgagcuccggggguaccuggccgccaucaagggcaugcaggaggcgagcaugaagcugaccgagucccuccacgagguguacgagcccgacugguacgggcgcgaggacgucaagauggugggcgagaagugcgacgugcugugggaggacuuccaccagaagcuggucgacggcagccuccugacccuggacaccuaccucgggcaguucccggacaucaagaaccggaucgccaagcgcucccggaagcugguggacuacgacagcgcccgccaccaccuggaggcccuccaguccagcaagcggaaggacgagucccgcaucagcaaggcggaggaggaguuccagaaggcccagaagguguucgaggaguucaacgucgaccugcaggaggagcugcccucccucuggagccggcgcgugggcuucuacgugaacacguucaagaacgucuccagccuggaggccaaguuccacaaggagaucgccgugcugugccacaagcucuacgaggugaugaccaagcugggggaccagcacgccgacaaggcguucaccauccagggcgcccccuccgacagcgggccccugcggaucgccaagaccccguccccgcccgaggagcccagcccccuccccucccccacggccagccccaaccacacccuggccccggcgucccccgcccccgcccgcccccggagcccgagccagacccgcaagggcccgcccgucccgccccugcccaaggugacccccacgaaggagcuccagcaggagaacaucaucuccuucuucgaggacaacuucgugcccgagaucagcgucaccacccccucccagaacgaggugcccgaggugaagaaggaggagacccugcuggaccucgacuucgaccccuucaagcccgaggucacgccggccggcagcgccggggugacccacucccccaugagccagacccugcccugggaccuguggaccacguccaccgaccucgugcagccggcgagcggcggguccuucaacggcuucacccagccccaggacaccagccuguucacgaugcagaccgaccaguccaugaucugcaaccuggccgagagcgagcaggccccgcccaccgagcccaaggccgaggagccccucgccgcggucacccccgccgugggccuggaccuggggauggacacgcgggccgaggagcccgucgaggaggccgugaucaucccgggcgcggacgccgacgccgccguggggacccucgucuccgccgcggagggcgcccccggggaggaggccgaggccgagaaggccaccgugcccgcgggcgagggcgugagccuggaggaggccaagaucgggaccgagacgaccgagggcgccgaguccgcccagcccgaggccgaggagcuggaggcgaccgucccgcaggagaaggugauccccagcguggucaucgagcccgccuccaaccacgaggaggagggggagaacgagaucaccaucggcgccgagcccaaggagacgaccgaggacgccgcgccgcccgggcccaccagcgagacccccgagcucgccaccgagcagaagccgauccaggacccccagcccacgcccuccgccccggccaugggcgccgcggaccagcuggccagcgcccgcgaggccagccaggagcugccgcccggcuuccucuacaagguggagacccugcacgacuucgaggccgcgaacuccgacgagcugacccuccagcgcggggacgugguccugguggugcccagcgacuccgaggccgaccaggacgccggcuggcuggucggggugaaggagagcgacuggcugcaguaccgggaccucgccaccuacaagggccuguuccccgagaacuucacgcgccggcuggacuga

SEQ ID NO: 26619 - RNA, 1212 nt, Artificial Sequence
  derived and/or modified sequence opt1 from AMT__Homo_sapiens__NP_000472
augcagcgcgccgugagcgucguggcccggcugggcuuccgccuccaggcguucccgcccgcccugugccggccccuguccugcgcccaggaggugcuccgccggacgccccuguacgacuuccaccuggcccacgggggcaagauggucgccuucgcgggguggagccuccccgugcaguaccgcgacucccacaccgacagccaccuccacacccggcagcacugcucccuguucgacgugagccacaugcugcagaccaagauccugggcuccgaccgcgucaagcugauggagagccucguggugggggacaucgccgagcugcggccgaaccagggcacccugucccucuucaccaacgaggccggcgggauccuggacgaccugaucgucacgaacaccagcgagggccaccucuacgugguguccaacgccgggugcugggagaaggaccuggcgcugaugcaggacaagguccgcgagcuccagaaccagggccgggacguggggcuggaggugcuggacaacgcccuccuggcccugcagggccccaccgccgcccagguccuccaggcgggcguggccgacgaccugcgcaagcugcccuucaugaccagcgccgugauggaggucuucgggguguccggcugccgggugacgcgcugcggguacaccggcgaggacggcgucgagaucagcgugcccguggccggggccguccaccucgcgaccgccauccugaagaacccggaggugaagcuggccggccucgccgcccgggacucccugcgccuggaggcggggcucugccuguacggcaacgacaucgacgagcacaccacgcccgucgaggggagccuguccuggacccucggcaagcggcgccgggccgccauggacuuccccggcgccaaggugaucgugccccagcugaaggggcgcguccagcggcgccgcgugggccugaugugcgagggggccccgaugcgggcgcacagccccauccucaacauggagggcaccaagaucgggaccgugacguccggcugccccagccccagccugaagaagaacgucgccaugggcuacgugccgugcgaguacucccgccccgggaccaugcugcucguggagguccggcgcaagcagcagauggccguggugagcaagaugcccuucguccccaccaacuacuacacccugaaguga

SEQ ID NO: 26620 - RNA, 1497 nt, Artificial Sequence
  derived and/or modified sequence opt1 from AMZ1__Homo_sapiens__XP_011513452
augcugcagugccgccccgcccaggaguucagcuucggcccgcgggcccucaaggacgcccugguguccaccgacgccgcccugcagcagcucuacgucagcgccuucucccccgccgagcgccuguuccuggcggaggccuacaacccccagcggacccucuucugcacgcugcugauccgcaccggguucgacuggcuccugagccggcccgaggccccggaggacuuccagaccuuccacgccucccugcagcaccgcaagccccggcucgcgcgcaagcacaucuaccugcagcccaucgaccugagcgaggagcccgugggcuccagccuccugcaccagcugugcuccugcaccgaggccuucuuccucgggcugcgggugaagugccugccgagcgucgccgccgccuccauccgcugcagcucccggcccagccgcgacuccgaccggcuccagcugcacacggacggcauccugagcuuccucaagaacaacaagcccggggacgcgcugugcgugcugggccucacccuguccgaccuguacccccacgaggccuggagcuucaccuucuccaaguuccucccgggccacgaggugggggucugcagcuucgcccgcuucagcggcgaguuccccaaguccgggcccagcgcccccgaccuggcccugguggaggcggccgccgacggcccggaggcgccccuccaggaccgggggugggcccugugcuucuccgcccugggcauggugcagugcugcaaggugaccugccacgagcucugccaccuccugggccuggggaacugccgcuggcugcggugccugaugcagggcgcccucagccuggacgaggcccugcgccggccccucgaccugugccccaucugccugcgcaagcuccagcacgugcugggguuccggcugaucgagcgcuaccagcgccuguacacguggacccaggccguggucggcaccuggccgucccaggaggccggcgagcccagcgugugggaggacaccccgcccgcguccgccgacagcgggaugugcugcgaguccgacagcgagcccggcacguccgugagcgagccccucacccccgacgccgggucccacaccuucgccagcggccccgaggaggggcuguccuaccuggcggccagcgaggccccgcucccgcccggcggccccgccgaggccaucaaggagcacgagcgguggcuggcgaugugcauccaggcccugcagcgcgaggucgccgaggaggaccucguccagguggaccgggccgucgacgcccuggaccgcugggagauguucaccgggcagcugcccgcgacgcggcaggacccgcccuccagccgcgacuccgugggccuccggaaggugcugggggacaaguucagcagccugcgccggaagcucuccgcccgcaagcuggcccgggccgagagcgcgccccgccccugggacggcgaggaguccuga

SEQ ID NO: 26621 - RNA, 591 nt, Artificial Sequence
  derived and/or modified sequence opt1 from ANAPC10__Homo_sapiens__NP_001243638
augggcggggugaaggagaccaacauccugaagaugaccacgcccaacaagaccccgcccggcgccgaccccaagcagcucgagcgcaccgggaccguccgggagaucggcagccaggccguguggucccugagcuccugcaagcccggguucggcguggaccagcugcgcgacgacaaccucgagacguacuggcagagcgacggcucccagccgcaccuggucaacauccaguuccggcgcaagaccaccgugaagacccugugcaucuacgcggacuacaagagcgacgaguccuacacgcccagcaagaucuccgugcgggucgggaacaacuuccacaaccuccaggagauccgccagcuggagcugguggagcccagcggcuggauccacgugccccucaccgacaaccacaagaagccgacccggaccuucaugauccagaucgccguccuggccaaccaccagaacgggcgcgacacgcacaugcggcagaucaagaucuacacccccguggaggaguccagcaucggcaaguucccccgcugcaccaccaucgacuucaugauguaccgguccauccgcuga

SEQ ID NO: 26622 - RNA, 591 nt, Artificial Sequence
  derived and/or modified sequence opt1 from ANAPC11__Homo_sapiens__NP_001002244
augaaggugaagaucaagugcuggaacggcgucgccaccuggcuguggguggccaacgacgagaacugcgggaucugccgcauggcguucaacggcugcugccccgacugcccgcuccacggggagagcaucucccggugccugggcuggugcccccagcccgugcccguccucgggggccgcgcccacccccaggugcccaucaacaccgccagccccacgcccggccagcacaccgggucccugaugagccgggaggaguccagccgcuccccggaccccaccccgcccgcccuggaccaggagaccagcucccugcuccggugcacgagcccguggugccuggaccacuccugcgaccuguucggcaucaccgaccaggugagcgccgacgggccccgcgcgugccggcagggcgcccgccggcgccuccccgccggggucggccccgugcugccgcugcucccccacgcccugcacccccagguggcggcccggaccgccggcgccgccgcgcugccccacgucccgcccgggauggaggugcagggcgugcgccccgaccucgcccuggccgggggcgccuccuga

SEQ ID NO: 26623 - RNA, 225 nt, Artificial Sequence
  derived and/or modified sequence opt1 from ANAPC13__Homo_sapiens__NP_001229304
auggacagcgaggugcagcgcgacggccggauccuggaccucaucgacgacgccuggcgcgaggacaagcugcccuacgaggacgucgccaucccgcugaacgagcuccccgagcccgagcaggacaacgggggcaccaccgaguccgugaaggagcaggagaugaaguggacggaccuggcgcugcaguaccuccacgagaacgugcccccgaucgggaacuga

SEQ ID NO: 26624 - RNA, 5835 nt, Artificial Sequence
  derived and/or modified sequence opt1 from ANAPC1__Homo_sapiens__NP_073153
auguccaacuucuacgaggagcgcacgaccaugaucgccgcccgggaccugcaggaguucgugcccuucggccgcgaccacugcaagcaccacccgaacgcccucaaccugcagcugcggcagcuccagcccgccuccgagcuguggagcuccgacggggccgccggccugguggggagccuccaggaggugacgauccacgagaagcagaaggaguccuggcagcugcgcaagggcgugagcgagaucggggaggacgucgacuacgacgaggagcuguacguggccggcaacauggugaucugguccaagggcagcaagucccaggcccucgccgucuacaaggccuucaccguggacagccccgugcagcaggcccuguggugcgacuucaucaucucccaggacaagagcgagaaggcguacuccagcaacgaggucgagaagugcaucugcauccugcaguccagcugcaucaacaugcacuccaucgaggggaaggacuacaucgccagccuccccuuccagguggccaacguguggcccaccaaguacggccugcuguucgagcgguccgccagcagccacgaggugccgcccgggagcccccgcgagccgcuccccaccauguucagcaugcugcacccccuggacgagaucacgccccucgugugcaaguccggcagccuguucggguccagccgggugcaguacgucguggaccacgccaugaagaucguguuccugaacaccgacccguccaucgucaugaccuacgacgcggugcagaacgugcacagcgucuggacccuccgccgggugaaguccgaggaggagaacgugguccugaaguucagcgagcagggcggcacgccccagaacguggccaccuccagcucccugaccgcccaccuccgcagccuguccaagggggacagccccgucaccucccccuuccagaacuacagcuccauccacagccagagccgguccacgagcuccccgagccugcacucccgcagccccuccaucagcaacauggccgcccucucccgggcgcacagccccgcccugggcgugcacuccuucagcggggugcagcgcuucaacaucuccagccacaaccagucccccaagcggcacagcaucucccacagcccgaacagcaacuccaacggcagcuuccuggcccccgagaccgagcccaucguccccgagcucugcaucgaccaccuguggaccgagaccaucacgaacauccgcgagaagaacucccaggccagcaagguguucaucaccuccgaccugugcggccagaaguuccucugcuuccugguggagagccagcugcagcuccggugcgucaaguuccaggaguccaacgacaagacccagcugaucuucgggagcgugaccaacaucccggccaaggacgcggcccccguggagaagaucgacacgaugcugguccucgagggcuccgggaaccuggugcuguacaccggcgugguccgcguggggaagguguucauccccggccuccccgccccgagccugaccauguccaacaccaugccccggcccagcacgccgcuggacggcgucuccacccccaagccccucagcaagcugcuggggucccucgacgagguggugcugcugagccccgucccggagcugcgcgacuccagcaagcuccacgacucccuguacaacgaggacugcaccuuccagcagcugggcaccuacauccacagcauccgggaccccgugcacaaccgcgugacgcucgagcugagcaacggguccaugguccgcaucaccauccccgagaucgccaccagcgagcuggugcagaccugccuccaggccaucaaguucauccugcccaaggagaucgcggugcagaugcuggucaagugguacaacgugcacuccgccccgggcgggcccagcuaccacuccgaguggaaccucuucgugacgugccugaugaacaugaugggcuacaacaccgaccggcuggccuggacccgcaacuucgacuucgagggcagccucucccccgucaucgcccccaagaaggcgcggccgagcgagaccggguccgacgacgacugggaguaccugcugaacagcgacuaccaccagaacguggagucccaccuccugaaccgcagccugugccucucccccagcgaggccucccagaugaaggacgaggacuucagccagaaccugucccuggacagcuccacgcuccuguucacccacauccccgccaucuucuucgugcugcaccucgucuacgaggagcugaagcugaacacccucaugggcgaggggaucugcagccugguggagcugcucgugcagcuggcccgggaccugaagcucggccccuacgucgaccacuacuaccgcgacuacccgacccuggugcggaccacggggcaggucugcaccaucgaccccggccagaccggcuucaugcaccaccccagcuucuucaccuccgagcccccgagcaucuaccagugggucuccagcugccugaagggggagggcaugccgcccuaccccuaccucccggggaucugcgagcgcucccggcugguggugcugagcaucgcccucuacauccugggcgacgagucccuggucagcgacgaguccagccaguaccucacgcgcaucaccaucgcgccccagaagcuccagguggagcaggaggagaaccgguucuccuuccgccacagcaccuccgugagcucccuggccgagcggcucgucguguggaugaccaacgugggcuucacgcugcgcgaccuggagacccuccccuucgggaucgcccugccgauccgggacgccaucuaccacugccgcgagcagcccgccagcgacuggcccgaggcggucugccugcucaucggccggcaggaccuguccaagcaggccugcgaggggaaccugcccaagggcaagagcgugcucuccagcgacgugccgagcgggaccgagaccgaggaggaggacgacggcaugaacgacaugaaccacgaggucaugucccugaucuggagcgaggaccugcgcgugcaggacgugcggcgccuccugcaguccgcccaccccguccgcgugaacgucgugcaguaccccgagcugagcgaccacgaguucaucgaggagaaggagaaccggcuccugcagcugugccagcgcacgauggcccuccccgugggccgggggauguucacccuguucuccuaccacccgguccccaccgagccccugcccaucccgaagcucaaccugaccggccgcgcgccgccccggaacacgaccguggaccugaacagcgggaacaucgacgugcccccgaacaugaccuccugggcgagcuuccacaacggcgucgccgccgggcucaagaucgcccccgcgucccagaucgacagcgccuggaucguguacaacaagcccaagcacgccgagcuggccaacgaguacgccggcuuccugauggcgcucggccugaacgggcaccugaccaagcucgccacgcugaacauccacgacuaccugaccaagggccacgagaugaccuccaucgggcuccugcugggcgugagcgccgccaagcucgggaccauggacauguccaucacgcgccugcugagcauccacauccccgcccuccugccgcccaccuccaccgagcuggacgucccccacaacguccagguggcggccgucgugggcaucggccucguguaccaggggaccgcccaccggcacacggccgagguccugcuggccgagaucggccgcccgcccgggcccgagauggaguacugcaccgaccgggagagcuacucccucgcggccggccuggcccuggggauggugugccucggccacggcagcaaccugaucgggauguccgaccugaacgugcccgagcagcuguaccaguacauggucggcgggcaccgccgguuccagaccggcaugcaccgcgagaagcacaagagccccagcuaccagaucaaggagggcgacaccaucaacguggacgugacgugccccggggccacccucgcgcuggccaugaucuaccugaagaccaacaaccgguccaucgccgacuggcuccgcgcccccgacaccauguaccugcuggacuucgucaagcccgaguuccuccugcugcggacgcucgcccgcugccugauccugugggacgacauccucccgaacagcaaguggguggacuccaacgugccccagaucauccgggagaacagcaucucccugagcgagaucgagcugcccugcuccgaggaccucaaccuggagacccugagccaggcgcacgucuacaucaucgccggcgccugccucucccugggguuccgcuucgccggcagcgagaaccuguccgccuucaacugccuccacaaguucgcgaaggacuucaugaccuaccugagcgcccccaacgccuccgugaccgggccgcacaaccuggagaccugccucagcgugguccugcugucccucgccauggugauggccggcagcggcaaccugaaggugcugcagcucugccgguuccugcacaugaagaccgggggcgagaugaacuacggguuccaccuggcgcaccacauggcccucggccugcuguuccucgggggcggccgcuacucccugagcaccuccaacagcagcaucgccgcccugcucugcgcccuguacccccacuuccccgcgcacuccaccgacaaccgguaccaccuccaggcccuccgccaccuguacguccuggccgccgagccccgccuccuggugccgguggacgucgacaccaacacgcccugcuacgcgcugcucgaggugaccuacaaggggacccagugguacgagcagaccaaggaggagcugauggcccccacgcugcuccccgagcugcaccuccugaagcagaucaaggugaagggcccgcgguacugggagcugcugaucgaccugagcaaggggacccagcaccugaaguccauccugagcaaggacggcguccucuacgugaagcugcgcgccgggcagcuguccuacaaggaggaccccaugggcuggcagagccuccuggcccagaccguggccaaccggaacuccgaggcgcgcgccuucaagcccgagaccaucagcgccuucacguccgaccccgcccugcucagcuucgccgaguacuucugcaagccgaccgucaacaugggccagaagcaggagauccuggaccuguucuccagcgugcucuacgagugcgugacccaggagacccccgagaugcugcccgcguacaucgccauggaccaggccauccggcgccuggggcggcgcgagauguccgagacgagcgagcucuggcagaucaagcugguccuggaguucuucuccagccggucccaccaggagcgccuccagaaccaccccaagcggggccuguucaugaacagcgaguuccugccgguggugaagugcaccaucgacaacacccucgaccaguggcugcaggucgggggcgacaugugcgugcacgccuaccugagcggccagccccucgaggagucccagcugagcaugcuggccugcuuccucguguaccacuccguccccgcgccccagcaccucccgcccaucgggcuggagggcagcaccuccuucgccgagcugcuguucaaguucaagcagcugaagaugcccgugcgcgcccuccugcggcuggcgccccugcugcuggggaacccccagcccauggugauguga

SEQ ID NO: 26625 - RNA, 2469 nt, Artificial Sequence
  derived and/or modified sequence opt1 from ANAPC2__Homo_sapiens__NP_037498
auggccgccgcgguggucguggccgagggcgacagcgacucccgccccgggcaggagcugcucguggccuggaacaccgucagcaccggccuggugccgcccgccgcccuggggcucguguccagccggacguccggcgcggucccgcccaaggaggaggagcugcgcgccgccguggaggugcugcgggggcacggccuccacagcguccuggaggagugguucguggaggugcugcagaacgaccuccaggccaacaucucccccgaguucuggaacgcgaucagccagugcgagaacuccgccgacgagccccagugccugcugcuccugcuggacgccuucggccuccuggagagccgccuggaccccuaccuccggucccuggagcugcucgagaaguggacccgccuggggcugcucaugggcaccggggcccagggccugcgggaggagguccacaccaugcugcgcgggguccucuucuucagcacgccccggaccuuccaggagaugauccagcgccuguacggcugcuuccugcggguguacaugcaguccaagcgcaagggcgagggcgggaccgacccggagcucgagggggagcuggacagccgguacgcccgccggcgcuacuaccggcugcuccagagcccccugugcgcgggcugcuccuccgacaagcagcagugcuggugccgccaggcccuggagcaguuccaccagcucagccaggugcugcaccggcugucccuccuggagcgcgugagcgccgaggccgugaccacgacccugcaccaggucacccgggagcgcauggaggaccgcugccggggcgaguacgagcgcagcuuccuccgggaguuccacaaguggaucgagcgcguggugggguggcugggcaaggucuuccugcaggacgggcccgcccggcccgcguccccggaggccggcaacacccuccgccgguggcgcugccacgugcagcgguucuucuaccgcaucuacgccagccugcggaucgaggagcuguucuccaucgugcgcgacuuccccgacagccggcccgccaucgaggaccucaaguacugccuggagcgcacggaccagcggcagcagcugcuggucucccucaaggccgcgcuggagacccgccugcuccaccccggggugaacacgugcgacaucaucacccuguacaucagcgccaucaaggcccugcggguccucgacccguccauggugauccuggagguggccugcgagcccauccgccgguaccugcgcacccgcgaggacaccguccggcagaucguggccggccucaccggcgacagcgacgggaccggcgaccuggcgguggagcuguccaagacggaccccgccagccucgagaccgggcaggacuccgaggacgacagcggcgagcccgaggacugggucccggaccccguggacgccgaccccgggaaguccagcuccaagcgccggagcuccgacaucaucagccugcugguguccaucuacggcagcaaggaccucuucaucaacgaguaccgcagccugcuggccgaccggcuccugcaccaguucuccuucagccccgagcgcgagauccggaacgucgagcugcucaagcugcgcuucggcgaggcgccgaugcacuucugcgaggugaugcugaaggacauggccgacucccggcgcaucaacgccaacauccgggaggaggacgagaagcgccccgccgaggagcagccgcccuucgggguguacgccgucauccucagcuccgaguucuggccgcccuucaaggacgagaagcuggaggugcccgaggacauccgggcggcccuggaggccuacugcaagaaguacgagcagcucaaggccaugcgcacccugagcuggaagcacacccugggccucgugacgauggacgucgagcuggccgaccggacccuguccguggcggugacccccguccaggccgugauccuccuguacuuccaggaccaggccagcuggacccuggaggagcucuccaaggccgugaagaugcccgucgcccugcugcgccggcgcaugagcguguggcuccagcagggggugcugcgggaggagccgcccggcacguucuccgucaucgaggaggagcgcccccaggaccgggacaacauggugcugaucgacagcgacgacgaguccgacagcgggauggcgucccaggccgaccagaaggaggaggagcuccugcuguucuggaccuacauccaggccaugcucaccaaccuggagagccugucccucgaccgcaucuacaacaugcugcgcauguucguggucaccggccccgcccuggcggagaucgaccuccaggagcugcagggcuaccugcagaagaaggugcgggaccagcagcucguguacagcgccggggucuaccgccugcccaagaacugcagcuga

SEQ ID NO: 26626 - RNA, 2430 nt, Artificial Sequence
  derived and/or modified sequence opt1 from ANAPC4__Homo_sapiens__NP_001273685
augcugcgcuucccgaccugcuuccccagcuuccggguggucggcgagaagcagcucccccaggagaucaucuuccugguguggucccccaagcgcgaccugaucgcccucgccaacaccgcgggggaggugcugcugcaccggcucgccagcuuccaccgcgucugguccuucccgcccaacgagaacacgggcaaggaggugaccugccuggccuggcggcccgacgggaagcugcucgccuucgcccuggcggacaccaagaagaucgugcugugcgacgucgagaagcccgagagccuccacuccuucagcguggaggcccccguguccugcaugcacuggauggaggucaccguggagagcuccgugcugacgagcuucuacaacgccgaggacgaguccaaccugcuccugccgaagcugcccacccuccccaagaacuacagcaacaccuccaagaucuucagcgaggagaacuccgacgagaucaucaagcugcugggcgacguccgccucaacauccuggugcucgggggcagcuccggcuucaucgagcucuacgccuacgggauguucaagaucgcgcgggugaccggcaucgccgggacgugccuggcccugugccucagcuccgaccucaagagccugagcgucgugaccgagguguccaccaacggcgccagcgaggucuccuacuuccagcuggagaccaaccugcuguacagcuuccuccccgaggugacgcgcauggcccggaaguucacccacaucuccgcgcugcugcaguacaucaaccucagccugaccugcaugugcgaggccugggaggagauccugaugcagauggacucccgccucaccaaguucgugcaggagaagaacacgaccaccagcguccaggacgaguucaugcaccuccugcugugggggaaggccuccgccgagcugcagacccugcucaugaaccagcugacggugaagggccugaagaagcucggccagagcaucgaguccagcuacuccagcauccagaagcuggugaucucccaccuccagagcggguccgagagccugcuguaccaccuguccgagcugaagggcauggccagcuggaagcagaaguacgagccgcucgggcuggacgcggccggcaucgaggaggccaucaccgccgucggcagcuucauccugaaggccaacgagcuccuccaggugaucgacuccagcaugaagaacuucaaggcguucuuccgguggcuguacgucgccaugcugcgcaugaccgaggaccacgugcugcccgagcugaacaaggugaugacccagaaggacaucacguucgucgccgaguuccucaccgagcacuucaacgaggcccccgaccuguacaaccggaaggggaaguacuucaacguggagcgcgugggccaguaccugaaggacgaggacgacgaccucgucuccccgcccaacaccgaggggaaccagugguacgacuuccugcagaacagcucccaccugaaggagagcccccuccuguuccccuacuacccccggaagucccugcacuucgugaagcgccggauggagaacaucaucgaccagugccuccagaagccggccgacgugaucggcaagagcaugaaccaggcgaucugcaucccccuguaccgcgacacccgguccgaggacagcacgcgccggcuguucaaguuccccuuccucuggaacaacaagaccuccaaccugcacuaccugcuguucaccauccuggaggacagccuguacaagaugugcauccuccgccgccacaccgacaucucccagagcgucuccaacgggcugaucgccaucaaguucggcagcuucacguacgccaccaccgagaaggugcggcgcuccaucuacagcugccuggacgcccaguucuacgacgacgagaccgugacggucgugcucaaggacaccgugggccgggaggggcgcgaccggcugcugguccagcucccccugagccugguguacaacuccgaggacagcgcggaguaccaguucaccggcaccuacuccacccgccucgacgagcagugcagcgccaucccgacgcggaccaugcacuucgagaagcacuggcgccugcuggaguccaugaaggcccaguacguggccgggaacggcuuccggaaggucagcugcgugcucuccagcaaccugcgccacgugcgggucuucgagauggacaucgacgacgagugggagcuggacgaguccagcgacgaggaggaggaggccuccaacaagcccgugaagaucaaggaggaggugcucagcgaguccgaggcggagaaccagcaggccggggccgccgcccuggcgcccgagaucgucaucaagguggagaagcuggaccccgagcucgacagcuga

SEQ ID NO: 26627 - RNA, 1932 nt, Artificial Sequence
  derived and/or modified sequence opt1 from ANAPC5__Homo_sapiens__NP_001131031
auggccgagggcgagcugaaggacauggagcaguucuucgacgaccucagcgacuccuucagcgggaccgagcccgaggugcacaagaccuccgucgugggccuguuccugcgccacaugauccucgccuacagcaagcuguccuucagccagguguucaagcuguacacggcgcuccagcaguacuuccagaacggggagaagaagaccgucgaggacgccgacauggagcugaccucccgggacgagggcgagcgcaagauggagaaggaggagcuggacgugagcgugcgggaggaggaggucuccugcagcgggccgcucucccagaagcaggccgaguucuuccugagccagcaggccucccugcucaagaacgacgagaccaaggcccugacgcccgcgagccugcagaaggagcucaacaaccugcugaaguucaaccccgacuucgccgaggcccacuaccucuccuaccugaacaaccugcgcgugcaggacguguucagcuccacccacagccuccugcacuacuucgaccggcugauccucaccggcgccgaguccaagagcaacggcgaggagggguacggccgcagccugcgguacgcggcccugaaccucgccgcccugcacugccgcuucgggcacuaccagcaggccgagcuggcgcuccaggaggccauccggaucgcccaggaguccaacgaccacgucugccugcagcacugccugagcuggcucuacgugcugggccagaagcgcuccgacagcuacgugcugcucgagcacuccgucaagaaggccgugcacuucgggcugccccgggccuucgcgggcaagaccgccaacaagcugauggacgcccucaaggacagcgaccugcugcacuggaagcacucccucagcgagcugaucgacaucuccaucgcccagaagacggccaucuggcgccuguacggccggagcaccauggcgcuccagcaggcccagaugcugcuguccaugaacagccucgaggccgugaacgccgggguccagcagaacaacaccgaguccuucgccguggcgcugugccaccuggccgagcugcacgccgagcagggcugcuucgccgcggccagcgaggugcucaagcaccugaaggagcgcuucccgcccaacucccagcacgcccagcuguggaugcucugcgaccagaagauccaguucgaccgggccaugaacgacgggaaguaccaccuggccgacagccuggucaccggcaucacggcgcucaacuccaucgagggcguguaccgcaaggccgugguccugcaggcccagaaccagaugagcgaggcccacaagcugcuccagaagcugcuggugcacugccagaagcucaagaacaccgagauggugaucuccguccugcugagcguggccgagcucuacuggcggagcuccagccccaccaucgcgcugcccaugcugcuccaggcccuggcccuguccaaggaguaccgccuccaguaccuggccagcgagaccguccugaaccucgccuucgcgcagcugauccuggggaucccggagcaggcccucucccugcugcacauggccaucgagcccauccucgccgacggcgcgauccuggacaaggggcgggccauguuccugguggccaagugccagguggccagcgccgcguccuacgaccagcccaagaaggccgaggcccucgaggccgccaucgagaaccugaacgaggcgaagaacuacuucgccaaggucgacugcaaggagcgcauccgggacgugguguacuuccaggcccgccuguaccacacgcucggcaagacccaggagcgcaaccggugcgccaugcuguuccgccagcugcaccaggagcuccccagccacggggucccgcugaucaaccaccuguga

SEQ ID NO: 26628 - RNA, 1614 nt, Artificial Sequence
  derived and/or modified sequence opt1 from ANAPC7__Homo_sapiens__NP_001131136
auggaccccggcgacgccgccauccuggagagcucccuccgcauccuguaccggcuguucgagagcgugcucccgccccugcccgcggcccugcagucccgcaugaacgucaucgaccacgugcgggacauggccgccgccgggcuccacagcaacgugcgccugcuguccagccuccugcugaccauguccaacaacaaccccgagcuguucagcccgccccagaaguaccagcuccuggucuaccacgcggacucccucuuccacgacaaggaguaccggaacgccgugagcaaguacaccauggcccugcagcagaagaaggcccuguccaagacgagcaaggugcgccccuccaccggcaacagcgcguccacgccccagagccagugccucccguccgagaucgaggucaaguacaagauggccgagugcuacaccaugcugaagcaggacaaggacgccaucgccauccuggacgggauccccagccggcagcgcacccccaagaucaacaugaugcucgccaaccuguacaagaaggcgggccaggagcggcccuccgugaccagcuacaaggaggugcugcgccagugcccgcucgcccuggacgccauccuggggcuccugagccuguccgucaagggcgccgagguggccagcaugaccaugaacgugauccagaccguccccaaccucgacuggcuguccguguggaucaaggcguacgccuucgugcacacgggcgacaacagccgggccaucuccaccaucugcagccuggagaagaagucccuccugcgcgacaacgucgaccugcucgggagccuggccgaccuguacuuccgggccggcgacaacaagaacuccgugcucaaguucgagcaggcgcagaugcuggaccccuaccugaucaaggggauggacguguacggcuaccuccuggcccgcgaggggcggcuggaggacgucgagaaccucggcugccgccuguucaacaucagcgaccagcacgccgagcccugggugguguccggcugccacagcuucuacuccaagcgguacagccgcgcccuguaccucggggccaaggcgauccagcugaacuccaacagcguccaggcccugcugcucaagggcgccgcccugcggaacauggggcgcgugcaggaggcgaucauccacuuccgggaggccauccgccuggccccgugccgccucgacugcuacgagggccugaucgagugcuaccuggccuccaacagcauccgggaggccauggugauggcgaacaacgucuacaagacccucggcgccaacgcccagacccugacgcugcucgccaccgugugccuggaggaccccgucacccaggagaaggccaagacccugcucgacaaggcgcugacgcagcgccccgacuacaucaaggccguggugaagaaggccgagcugcucucccgggagcagaaguacgaggacgggaucgcccugcugcgcaacgcccucgcgaaccagagcgacugcguccugcaccggauccugggcgacuuccucguggccgugaacgaguaccaggaggccauggaccaguacagcaucgcccugcgcuga

SEQ ID NO: 26629 - RNA, 444 nt, Artificial Sequence
  derived and/or modified sequence opt1 from ANG__Homo_sapiens__NP_001091046
auggugaugggccuggggguccuccugcugguguucgugcucggccuggggcugacgcccccgacccucgcccaggacaacagccgcuacacccacuuccugacccagcacuacgacgccaagccccagggccgggacgaccgcuacugcgaguccaucaugcggcgccgggggcugaccagccccugcaaggacaucaacaccuucauccacggcaacaagcgcuccaucaaggcgaucugcgagaacaagaacggcaacccccaccgggagaaccuccgcaucagcaaguccagcuuccaggucacgaccugcaagcugcacgggggcuccccguggccgcccugccaguaccgggccaccgccggguuccgcaacgugguggucgccugcgagaacggccugcccgugcaccucgaccagagcaucuuccggcgccccuga

SEQ ID NO: 26630 - RNA, 1497 nt, Artificial Sequence
  derived and/or modified sequence opt1 from ANGPT1__Homo_sapiens__NP_001137
augaccguguuccugagcuucgccuuccucgccgcgauccugacccacaucggcugcuccaaccagcgccggagccccgagaacuccgggcgccgguacaaccgcauccagcacggccagugcgccuacacguucauccugccggagcacgacgggaacugccgggagagcaccaccgaccaguacaacaccaacgcccuccagcgcgacgcgccccacgucgagcccgacuucuccagccagaagcugcagcaccuggagcacgugauggagaacuacacgcaguggcuccagaagcuggagaacuacaucguggagaacaugaaguccgagauggcccagauccagcagaacgccguccagaaccacaccgccaccaugcuggagaucggcaccagccuccugucccagacggccgagcagacccggaagcugaccgacguggagacccaggugcucaaccagacgagccgccuggagauccagcugcucgagaacucccugagcaccuacaagcuggagaagcagcuccugcagcagaccaacgagauccugaagauccacgagaagaacucccuccuggagcacaagauccuggagauggaggggaagcacaaggaggagcucgacacccugaaggaggagaaggagaaccugcagggccucgucacgcggcagaccuacaucauccaggagcuggagaagcagcugaaccgcgccaccaccaacaacagcgugcuccagaagcagcagcuggagcugauggacacggugcacaaccucgucaaccugugcaccaaggagggcgugcugcucaagggcgggaagcgggaggaggagaagcccuuccgcgacugcgcggacguguaccaggccggguucaacaaguccggcaucuacaccaucuacaucaacaacaugccggagcccaagaaggucuucugcaacauggacgugaacgggggcggcuggaccgugauccagcaccgggaggacgggagccuggacuuccagcgcggcuggaaggaguacaagaugggguucggcaaccccuccggcgaguacuggcuggggaacgaguucaucuucgccaucacgagccagcggcaguacaugcuccgcaucgagcugauggacugggagggcaaccgggccuacucccaguacgaccgcuuccacaucgggaacgagaagcagaacuaccggcuguaccucaagggccacaccgggaccgccggcaagcagagcagccugauccugcacggcgcggacuucuccaccaaggacgccgacaacgacaacugcaugugcaagugcgcccucaugcugaccgggggcuggugguucgacgccugcgggcccagcaaccugaacggcauguucuacacggccgggcagaaccacggcaagcucaacggcaucaaguggcacuacuucaaggggccguccuacagccugcgcuccaccaccaugaugauccggccccuggacuucuga

SEQ ID NO: 26631 - RNA, 1488 nt, Artificial Sequence
  derived and/or modified sequence opt1 from ANGPT2__Homo_sapiens__NP_001112359
auguggcagaucguguucuucacccugagcugcgaccucguccuggccgccgcguacaacaacuuccgcaaguccauggacagcaucggcaagaagcaguaccaggugcagcacggguccugcagcuacaccuuccugcuccccgagauggacaacugccgguccagcuccagcccguacguguccaacgccguccagcgcgacgcgccccuggaguacgacgacagcgugcagcggcuccaggugcuggagaacaucauggagaacaacacgcaguggcugaugaagcuggagaacuacauccaggacaacaugaagaaggagauggucgagauccagcagaacgccgugcagaaccagaccgccgugaugaucgagaucggcaccaaccuccugaaccagaccgccgagcagacgcgcaagcugaccgacgucgaggcccaggugcucaaccagaccacccggcuggagcugcagcuccuggagcacucccugagcacgaacaagcucgagaagcagauccuggaccagaccuccgagaucaacaagcugcaggacaagaacagcuuccucgagaagaaggugcuggccauggaggacaagcacaucauccagcugcaguccaucaaggaggagaaggaccagcuccagguccuggugagcaagcagaacuccaucaucgaggagcuggagaagaagaucgugaccgccaccgucaacaacagcgugcuccagaagcagcagcacgaccugauggagacggugaacaaccugcucaccaugauguccaccagcaacagcaaggaccccaccgucgcgaaggaggagcagaucuccuuccgcgacugcgccgagguguucaagagcgggcacacgaccaacggcaucuacacccugaccuuccccaacuccacggaggagaucaaggccuacugcgacauggaggccgggggcggcggguggaccaucauccagcggcgcgaggacggcagcguggacuuccagcggaccuggaaggaguacaaggucggguucggcaacccguccggggaguacuggcugggcaacgaguucgugagccagcucaccaaccagcagcgcuacgugcugaagauccaccugaaggacugggagggcaacgaggccuacucccucuacgagcacuucuaccugagcuccgaggagcugaacuaccggauccaccucaaggggcugacgggcaccgcggggaagaucagcuccaucagccagcccggcaacgacuucuccaccaaggacggcgacaacgacaagugcaucugcaagugcagccagaugcugaccgggggcuggugguucgacgccugcgggcccuccaaccucaacggcauguacuacccccagcgccagaacacgaacaaguucaacgggaucaagugguacuacuggaagggcagcggcuacucccugaaggccaccaccaugaugauccggccggccgacuucuga

SEQ ID NO: 26632 - RNA, 1512 nt, Artificial Sequence
  derived and/or modified sequence opt1 from ANGPT4__Homo_sapiens__NP_057069
augcugagccagcucgccaugcugcagggcucccugcuccugguggucgccaccaugagcguggcgcagcagacccgccaggaggccgaccgggggugcgagacgcuggugguccagcacggccacugcuccuacaccuuccuccugcccaagagcgagccgugcccgcccgggcccgaggugucccgcgacagcaacacccugcagcgggagucccucgccaacccccugcaccugggcaagcuccccacccagcaggucaagcagcuggagcaggcccugcagaacaacacgcaguggcucaagaagcuggagcgcgccaucaagaccauccugcggagcaagcucgagcagguccagcagcagauggcgcagaaccagaccgcccccaugcuggagcuggggaccucccuccugaaccagacgaccgcccagauccgcaagcugaccgacauggaggcccagcuccugaaccagaccagccggauggacgcgcagaugcccgagacguuccuguccaccaacaagcucgagaaccagcugcugcuccagcgccagaagcugcagcagcugcagggccagaacagcgcccucgagaagcggcugcaggcccuggagaccaagcagcaggaggagcucgccuccauccugagcaagaaggccaagcugcucaacacccugucccgccagagcgcggcccugacgaacaucgagcggggccuccgcggggugcggcacaacuccagccugcugcaggaccagcagcacucccuccgccagcugcuggugcuccugcggcaccuggugcaggagcgcgccaacgccagcgccccggcguucaucauggccggcgagcaggucuuccaggacugcgccgagauccagcggagcggggccuccgccagcggcguguacaccauccagguguccaacgcgaccaagccccgcaagguguucugcgaccugcagagcuccgggggccgguggacccucauccagcgccgggagaacggcacggugaacuuccagcgcaacuggaaggacuacaagcagggguucggcgaccccgccggggagcacuggcugggcaacgaggucgugcaccagcugacccgccgggccgccuacagccuccgcguggagcugcaggacugggagggccacgaggccuacgcgcaguacgagcacuuccaccugggguccgagaaccagcucuaccggcugagcgucgugggcuacuccgggagcgccggccgccaguccagccuggugcuccagaacaccuccuucagcacccuggacuccgacaacgaccacugccugugcaagugcgcccaggucaugagcgggggcuggugguucgacgccugcggccucuccaaccugaacgggguguacuaccacgcgcccgacaacaaguacaagauggacggcauccgguggcacuacuucaaggggccgagcuacucccugcgcgccagccggaugaugauccgcccccucgacaucuga

SEQ ID NO: 26633 - RNA, 1476 nt, Artificial Sequence
  derived and/or modified sequence opt1 from ANGPTL1__Homo_sapiens__NP_004664
augaagaccuucaccuggacgcugggcguccucuucuuccugcugguggacaccgggcacugccgcggcgggcaguucaagaucaagaagaucaaccagcggcgcuacccccgggccaccgacggcaaggaggaggccaagaagugcgcguacaccuuccucgugccggagcagcgcaucacggggcccaucugcgugaacaccaagggccaggacgccagcaccaucaaggacaugaucacccggauggaccuggagaaccugaaggacguccucucccgccagaagcgggagaucgacgugcugcagcugguggucgacguggacggcaacaucgugaacgaggucaagcuccugcgcaaggagagccggaacaugaacucccgcgugacgcagcuguacaugcagcuccugcacgagaucauccggaagcgcgacaacagccuggagcucucccagcuggagaacaagauccugaacgugaccaccgagaugcucaagauggccacccgguaccgcgagcuggaggucaaguacgccagccugacggaccucgugaacaaccaguccgugaugaucacccugcuggaggagcagugccuccggaucuucagccgccaggacacccacgucuccccgccccugguccagguggugccccagcacauccccaacagccagcaguacacccccgggcugcucggcgggaacgagauccagcgggaccccggcuacccgcgcgaccugaugcccccgcccgaccuggccacgucccccaccaagagccccuucaagaucccgcccgugaccuucaucaacgaggggcccuucaaggacugccagcaggcgaaggaggccggccacuccgugagcggcaucuacaugaucaagcccgagaacuccaacgggcccaugcagcucuggugcgagaacagccuggaccccggcggguggaccgucauccagaagcggacggacggcuccgugaacuucuuccgcaacugggagaacuacaagaagggcuucgggaacaucgacggcgaguacuggcuggggcucgagaacaucuacaugcugagcaaccaggacaacuacaagcugcucaucgagcuggaggacugguccgacaagaagguguacgccgaguacagcagcuuccggcuggagccggaguccgaguucuaccgccuccgccugggcaccuaccaggggaacgccggcgacagcaugauguggcacaacggcaagcaguucaccacccuggaccgggacaaggacauguacgcggggaacugcgcccacuuccacaagggcggguggugguacaacgccugcgcccacuccaaccucaacggcgucugguaccgcgggggccacuaccggagcaagcaccaggacggcaucuucugggccgaguaccgcgggggcuccuacagccugcgggcggugcagaugaugaucaagcccaucgacuga

SEQ ID NO: 26634 - RNA, 1482 nt, Artificial Sequence
  derived and/or modified sequence opt1 from ANGPTL2__Homo_sapiens__NP_036230
augcgcccccugugcgugaccugcugguggcucggccugcuggccgccaugggggcggucgccggccaggaggacggguucgagggcaccgaggaggggagcccgcgggaguucaucuaccucaaccgcuacaagcgggccggcgagucccaggacaagugcacguacaccuucaucgugccccagcagcgcgugaccggcgccaucugcgucaacagcaaggagcccgaggugcugcuggagaaccgggugcacaagcaggagcucgagcugcugaacaacgagcuccugaagcagaagcgccagaucgagacccugcagcagcucgucgagguggacgggggcaucguguccgaggucaagcugcugcggaaggagagccgcaacaugaacucccgggugacgcagcucuacaugcagcugcugcacgagaucauccgcaagcgggacaacgcccucgagcugagccagcuggagaaccgcauccucaaccagaccgcggacaugcugcagcuggccuccaaguacaaggaccucgagcacaaguaccagcaccuggccacccuggcccacaaccagagcgagaucaucgcgcagcucgaggagcacugccagcgggugcccuccgcccgcccggucccccagccgccgcccgccgccccgccccggguguaccagccgcccaccuacaaccgcaucaucaaccagaucagcacgaacgagauccaguccgaccagaaccugaaggugcugcccccgccccuccccaccaugcccacccugaccagccugcccuccagcacggacaagcccuccgggcccuggcgggacugccuccaggcccuggaggacggccacgacaccagcuccaucuaccuggucaagcccgagaacaccaaccgccucaugcaggucuggugcgaccagcggcacgaccccgggggcuggaccgugauccagcgccggcuggacggcagcgugaacuucuuccgcaacugggagacguacaagcagggguucggcaacaucgacggggaguacuggcugggccucgagaacaucuacuggcugaccaaccagggcaacuacaagcugcucgugaccauggaggacugguccgggcgcaagguguucgcggaguacgccagcuuccggcuggagcccgagagcgaguacuacaagcugcgccucggccgguaccacgggaacgccggcgacuccuucaccuggcacaacgggaagcaguucacgacccuggaccgcgaccacgacgucuacaccggcaacugcgcccacuaccagaagggcggguggugguacaacgccugcgcgcacagcaaccugaacggcgugugguaccgcgggggccacuaccggucccgguaccaggacgggguguacugggccgaguuccgcggcggcagcuacucccucaagaaggucgugaugaugauccggcccaaccccaacaccuuccacuga

SEQ ID NO: 26635 - RNA, 1107 nt, Artificial Sequence
  derived and/or modified sequence opt1 from ANGPTL4__Homo_sapiens__NP_001034756
augagcggcgcccccaccgccggggcggcccugaugcucugcgccgccaccgccgugcugcuguccgcgcagggcgggccgguccagagcaagagcccccgcuucgccuccugggacgagaugaacgugcucgcccacggccugcugcagcucgggcagggccugcgggagcacgccgagcgcacgcggucccagcugagcgcgcucgagcgccggcuguccgccugcggcagcgccugccaggggaccgagggcuccaccgaccugccccucgcccccgagagccgcguggacccggagguccugcacucccugcagacccagcucaaggcccagaacagccggauccagcagcuguuccacaagguggcgcagcagcagcgccaccuggagaagcagcaccuccggauccagcaccuccagucccaguucgggcugcuggaccacaagcaccuggaccacgagguggccaagcccgcccgccggaagcgccugcccgagauggcccagcccgucgacccggcccacaacgugagccggcuccaccacggcggguggacggugauccagcgccggcacgacggcuccgucgacuucaaccgccccugggaggcguacaaggccggcuucggggacccccacggcgaguucuggcuggggcuggagaaggugcacagcaucaccggcgaccggaacucccgccucgccgugcagcugcgggacugggacggcaacgccgagcugcuccaguucagcguccaccucgggggcgaggacaccgccuacucccugcagcugaccgcgcccguggccgggcagcugggcgccacgaccgugccgcccagcgggcugagcguccccuucuccaccugggaccaggaccacgaccuccgccgggacaagaacugcgccaagagccuguccggcggcuggugguucgggaccugcagccacuccaaccugaacggccaguacuuccgcagcaucccccagcagcgccagaagcucaagaaggggaucuucuggaagacguggcggggccgcuacuacccgcugcaggccaccaccaugcugauccagcccauggcggccgaggccgccuccuga

SEQ ID NO: 26636 - RNA, 1413 nt, Artificial Sequence
  derived and/or modified sequence opt1 from ANGPTL6__Homo_sapiens__NP_114123
augggcaagcccuggcugcgcgcccuccagcugcugcuccugcugggggccagcugggcgcgggccggcgccccgcgcugcaccuacaccuucgugcucccgccccagaaguucacgggggccgucugcugguccggccccgccagcacccgggcgacccccgaggccgccaacgccuccgagcuggcggcccugcgcaugcggguggggcgccacgaggagcuccugcgggagcugcagcgccucgccgccgccgacggcgcgguggccggcgagguccgggcccugcgcaaggagagccgggggcuguccgcccgccucggccagcugcgggcccagcugcagcacgaggcggggcccggcgccgggcccggcgccgaccucggcgccgagcccgccgcggcccuggcccugcucggggagcgcgugcugaacgccagcgccgaggcgcagcgggccgccgcccgcuuccaccagcuggacgugaaguuccgggagcucgcgcagcuggucacccagcaguccagccugaucgcccgccucgagcggcugugcccgggcggggccggcggccagcagcagguccugcccccgccgccccucgugcccguggugcccgugcgccuggucggguccacgagcgacaccucccggaugcuggaccccgcccccgagccccagcgcgaccagacccagcgccagcaggagcccauggccagccccaugccggcgggccaccccgccgugcccaccaagcccguggggccguggcaggacugcgccgaggcccggcaggccggccacgagcaguccggggucuacgagcuccgcgugggccggcacguggucagcguguggugcgagcagcagcuggagggcgggggcuggacggugauccagcgccggcaggacggguccgucaacuucuucaccaccuggcagcacuacaaggcgggcuucgggcgccccgacggcgaguacuggcugggccucgagcccguguaccagcugaccagccgcggggaccacgagcugcucgugcugcuggaggacuggggcgggcggggcgcccgggcccacuacgacggguucucccucgagcccgagagcgaccacuaccgccugcggcugggccaguaccacggcgacgccggggacucccucagcuggcacaacgacaagccguucagcacggucgaccgcgaccgggacuccuacagcggcaacugcgcccuguaccagcgcgggggcuggugguaccacgcgugcgcccacuccaaccugaacggcguguggcaccacgggggccacuaccggagccgcuaccaggacggggucuacugggccgaguuccggggcggggccuacucccuccgcaaggcggccaugcugauccggccccugaagcuguga

SEQ ID NO: 26637 - RNA, 5643 nt, Artificial Sequence
  derived and/or modified sequence opt1 from ANK1__Homo_sapiens__NP_000028
augcccuacuccgugggcuuccgcgaggccgacgccgcgaccuccuuccugcgggccgcccgcagcgggaaccucgacaaggcccuggaccaccuccgcaacggcguggacaucaacacgugcaaccagaacgggcucaacggccugcaccuggccuccaaggaggggcacgugaagaugguggucgagcuccugcacaaggagaucauccuggagaccaccaccaagaagggcaacaccgcgcuccacaucgccgcccuggccggccaggacgagguggugcgcgagcuggucaacuacggggcgaacgugaacgcccagagccagaagggcuucacgccgcucuacauggccgcccaggagaaccaccuggagguggucaaguuccugcucgagaacggggccaaccagaacguggcgaccgaggacggcuucacgccccuggccguggcccugcagcaggggcacgagaacgucguggcccaccucaucaacuacggcaccaagggcaaggugcggcugcccgcccugcacaucgcggcccgcaacgacgacacccggaccgccgccguccuccugcagaacgaccccaacccggacgugcuguccaagaccggguucacgccccugcacaucgccgcgcacuacgagaaccugaacguggcccagcugcuccugaaccgcggcgccagcgucaacuucaccccgcagaacgggaucacgccccugcacaucgccucccggcgcggcaacgugaucauggugcggcuccugcuggaccgcggcgcccagaucgagaccaagaccaaggacgagcucaccccgcugcacugcgcggcccggaacgggcacguccgcaucagcgagauccugcucgaccacggcgcccccauccaggccaagaccaagaacgggcugucccccauccacauggcggcccagggcgaccaccuggacugcgugcggcuccugcugcaguacgacgccgagaucgacgacaucacccucgaccaccugacgccccugcacguggccgcccacugcgggcaccaccgcgucgcgaaggugcuccuggacaagggcgccaagcccaacagccgggcccugaacggcuucacgccccuccacaucgccugcaagaagaaccacguccgcgugauggagcugcugcugaagaccggggccuccaucgacgcggugaccgagagcggccucacgccccugcacgucgccuccuucauggggcaccuccccaucgugaagaaccuccugcagcggggcgccagccccaacguguccaacgucaagguggagacgccccugcacauggccgcccgcgcggggcacaccgagguggccaaguaccuccugcagaacaaggccaaggucaacgccaaggcgaaggacgaccagacgccccugcacugcgccgcccggaucggccacaccaacauggugaagcuccugcuggagaacaacgccaaccccaaccucgccaccaccgcgggccacaccccgcugcacaucgccgcccgcgaggggcacguggagaccguccuggcccuccuggagaaggaggccagccaggcgugcaugaccaagaagggcuucaccccgcugcacguggccgccaaguacgggaaggugcgcgucgccgagcuccugcuggagcgggacgcccaccccaacgcggccggcaagaacgggcucacgccccugcacguggccgugcaccacaacaaccuggacaucgucaagcuccugcugccccgcggcggcagcccccacagccccgccuggaacggguacacgccccugcacaucgcggccaagcagaaccagguggagguggcccggucccugcugcaguacggcgggagcgccaacgccgagagcguccagggcgugaccccgcuccaccuggcggcccaggagggccacgccgagaugguggcccugcuccuguccaagcaggccaacgggaaccugggcaacaagagcgggcucacgccccugcaccuggucgcgcaggagggccacgugcccguggccgacguccucaucaagcacggggugaugguggacgccaccacccgcaugggcuacaccccgcugcacgucgccucccacuacggcaacaucaagcuggugaaguuccuccugcagcaccaggccgacgugaacgcgaagaccaagcugggguacagcccccuccaccaggccgcccagcagggccacaccgacaucgucacccugcugcucaagaacggggccucccccaacgaggugagcuccgacggcaccaccccgcuggccaucgcgaagcggcugggguacaucagcgugaccgacguccucaagguggugaccgacgagaccuccuucguccuggugagcgacaagcaccgcauguccuuccccgagaccguggacgagauccuggacgucagcgaggacgagggcgaggagcucaucuccuucaaggccgagcggcgcgacagccgggacguggacgaggagaaggagcugcuggacuucgugcccaagcucgaccaggucguggagucccccgccaucccccgcaucccgugcgccaugcccgagaccguggucauccggagcgaggagcaggagcaggcguccaaggaguacgacgaggacagccugauccccuccagccccgccaccgagaccagcgacaacaucuccccgguggccagccccgugcacaccggcuuccuggucuccuucaugguggacgcccgcgggggcagcaugcgggggucccgccacaacggccuccgggucgugaucccgccccggaccugcgccgcgccgacccggaucacgugccgccuggugaagccccagaagcugagcaccccgccgccccucgccgaggaggaggggcuggccucccggaucaucgcccugggccccaccggcgcccaguuccucagccccgucaucguggagaucccccacuucgcgucccacgggcgcggcgaccgcgagcuggugguccugcggagcgagaacggguccguguggaaggagcaccgcagccgguacggcgaguccuaccucgaccagauccugaacgggauggacgaggagcugggcagccucgaggagcuggagaagaagcgcgugugccggaucaucaccaccgacuucccccuguacuucgucaucaugucccgccucugccaggacuacgacacgaucggccccgagggcgggagccugaaguccaagcuggugccccucgugcaggccaccuucccggagaacgccgucaccaagcgggugaagcuggcccugcaggcccagcccgugcccgacgagcucgucaccaagcugcuggggaaccaggcgacguucagccccaucgugaccguggagccgcgccggcgcaaguuccaccggcccaucggccuccgcaucccccugcccccgagcuggaccgacaacccccgggacuccggcgagggggacaccacgagccugcgccuccugugcuccgucaucggcgggaccgaccaggcccagugggaggacaucaccggcaccacgaagcugguguacgccaacgagugcgccaacuucaccaccaacgugagcgcgcgguucuggcucuccgacugcccccgcaccgccgaggccgucaacuucgccacgcugcuguacaaggagcucaccgccgugcccuacauggcgaaguucgugaucuucgccaagaugaacgacccgcgggaggggcgccugcggugcuacugcaugaccgacgacaaggucgacaagacccuggagcagcacgagaacuucguggagguggcccgcagccgggacaucgagguccuggagggcaugucccucuucgccgagcugagcggcaaccuggugcccgugaagaaggccgcgcagcagcgcuccuuccacuuccagagcuuccgcgagaaccggcucgccaugcccgucaaggugcgcgacuccagccgggagcccgggggcucccugagcuuccugcgcaaggccaugaaguacgaggacacccagcacauccucugccaccugaacaucacgaugccgcccugcgccaagggguccggcgccgaggaccggcgccggacccccacgccccuggcgcuccgcuacagcauccuguccgagagcaccccggggucccugagcggcacggagcaggccgagaugaagauggccgugaucagcgagcaccucggccuguccugggccgagcuggcgcgggagcuccaguucagcgucgaggacaucaaccgcauccggguggagaaccccaacucccugcuggagcagagcguggcccuccugaaccugugggucauccgcgaggggcagaacgccaacauggagaaccucuacaccgcccugcaguccaucgaccggggcgagaucgugaacaugcuggaggggagcggccgccagucccggaaccucaagcccgaccgccggcacaccgaccgcgacuacagccugucccccagccagaugaacggguacuccagccugcaggacgagcuccuguccccggccagccugggcugcgcgcucuccagcccccugcgggccgaccaguacuggaacgagguggccguccuggacgccaucccccucgccgcgaccgagcacgacacgaugcuggagauguccgacaugcaggucuggagcgccggccugacccccucccucgugaccgccgaggacagcagccuggagugcuccaaggccgaggacagcgacgccaccgggcacgaguggaagcuggagggcgcgcucuccgaggagccgcgcgggcccgagcugggcagccuggagcucgucgaggacgacacgguggacuccgacgccaccaacggccugaucgaccugcucgagcaggaggaggggcagcgcagcgaggagaagcugcccggcuccaagcggcaggacgacgccaccggggccggccaggacagcgagaacgaggugucccuggucagcgggcaccagcgcggccaggcccggaucacccacuccccgacggugagccaggugaccgagcgcucccaggaccggcuccaggacugggacgcggacggcagcaucgucuccuaccugcaggacgccgcccaggggagcuggcaggaggaggugacccagggcccccacuccuuccaggggaccagcacgaugaccgagggccuggagcccgggggcucccaggaguacgagaaggugcucgucagcgugagcgagcacaccuggaccgagcagcccgaggccgaguccagccaggcggaccgcgaccggcgccagcagggccaggaggagcagguccaggaggccaagaacacguucacccagguggugcaggggaacgaguuccagaacaucccgggcgagcaggucaccgaggagcaguucaccgacgagcaggggaacaucgugacgaagaagaucauccggaaggugguccgccagaucgaccuguccagcgccgacgccgcccaggagcacgaggagguggagcugcggggcuccgggcuccagcccgaccugaucgagggccgcaagggcgcgcagaucgugaagcgggccagccugaagcgcgggaagcaguga

SEQ ID NO: 26638 - RNA, 5592 nt, Artificial Sequence
  derived and/or modified sequence opt1 from ANK2__Homo_sapiens__NP_001120965
augaccaccaugcugcagaaguccgacuccaacgccagcuuccuccgcgccgcgcgggccggcaaccuggacaaggugguggaguaccugaagggcgggaucgacaucaacacgugcaaccagaacgggcucaacgcccugcaccuggccgccaaggagggccacguggggcucgugcaggagcugcugggccgcggcuccagcgucgacuccgccaccaagaaggggaacaccgcccuccacaucgccagccuggccggccaggcggagguggugaagguccuggugaaggagggggccaacaucaacgcccagucccagaacggcuucaccccgcucuacauggccgcccaggagaaccacaucgacguggucaaguaccugcuggagaacggggcgaaccagagcaccgccaccgaggacggcuucacgccccucgccguggcccugcagcagggccacaaccaggccguggccauccugcucgagaacgacaccaaggggaagguccggcugcccgcccugcacaucgccgcccgcaaggacgacaccaaguccgccgcgcuccugcugcagaacgaccacaacgccgacgugcagagcaagaugauggugaaccggaccaccgaguccggcuucaccccgcuccacaucgccgcccacuacgggaacgucaacguggccacccugcugcucaaccgcggcgcggccguggacuucaccgcccggaacggcaucacgccccugcacgucgccagcaagcgcgggaacaccaacauggugaagcugcuccuggaccggggcgggcagaucgacgcgaagacccgcgacggccugaccccgcuccacugcgccgcccgguccgggcacgaccagguggucgagcugcugcucgagcgcggcgcgccccugcuggcccggaccaagaacggccucagcccccugcacauggcggcccagggggaccacguggagugcgugaagcaccuccugcagcacaaggcccccgucgacgacgugacccuggacuaccugaccgcccuccacgucgccgcgcacugcggccacuaccgcgugaccaagcugcugcucgacaagcgggccaaccccaacgcccgcgcccugaacggguucacgccccugcacaucgccugcaagaagaaccggaucaaggugauggagcugcucgucaaguacggcgcguccauccaggccaucaccgagagcgggcugacgcccauccacguggccgccuucaugggccaccugaacaucgugcuccugcugcuccagaacggcgcgucccccgacgucaccaacauccgcggggagaccgcccugcacauggccgcccgggccggccagguggaggugguccgcugccugcuccggaacggggcgcugguggacgcccgcgcccgcgaggagcagacgccccugcacaucgccagccggcucggcaagaccgagaucgugcagcugcugcuccagcacauggcccaccccgacgcggccaccaccaacggguacacgccccugcacaucuccgcccgcgagggccaggucgacguggccagcgugcugcucgaggccggcgcggcccacagccuggccacgaagaagggguucacgccccugcacgucgccgcgaaguacggcucccucgacguggccaagcugcugcuccagcggcgcgccgccgccgacagcgcggggaagaacggccugaccccgcugcacguggccgcccacuacgacaaccagaaggucgcccuccugcugcucgagaagggcgccagcccccacgcgaccgccaagaacggguacacgccccugcacaucgccgccaagaagaaccagaugcagaucgccagcacccugcucaacuacggcgcggagaccaacaucgugaccaagcagggggugacgccccugcaccuggccucccaggagggccacaccgacauggucacccuccugcuggacaagggggccaacauccacaugagcaccaaguccggccucaccagccugcaccuggccgcccaggaggacaaggugaacguggcggacauccucacgaagcacggcgccgaccaggacgcccacaccaagcugggguacacgccccugaucgucgccugccacuacggcaacgugaagauggugaacuuccuccugaagcagggggcgaacgucaacgccaagaccaagaacggcuacacgccccugcaccaggccgcccagcaggggcacacccacaucaucaacgugcuccugcagcacggcgccaagcccaacgcgaccaccgccaacggcaacaccgcccuggccaucgccaagcggcucggguacaucuccguggucgacacccugaagguggugaccgaggaggucaccacgaccaccaccacgaucaccgagaagcacaagcugaacgugcccgagaccaugaccgaggugcucgacgucagcgacgaggagggcgacgacacgaugaccggggacggcggggaguaccugcgccccgaggaccugaaggagcucggcgacgacucccugcccagcucccaguuccuggacggcaugaacuaccuccgguacagccuggagggcgggcgcuccgacagccugcgguccuucagcuccgaccgcagccacacccucagccacgcguccuaccugcgggacagcgccgugauggacgacuccguggucauccccagccaccagguguccacccuggccaaggaggccgagcgcaacagcuaccggcucuccugggggacggagaaccuggacaacguggcccugagcuccagccccauccacuccggccgcgcgagccccugccucgagcgggacaacuccagcuuccuggucuccuucaugguggacgcccgcgggggcgccaugcggggcugccgccacaacgggcugcggaucaucaucccgccccgcaagugcaccgcccccacccgcgugaccugccggcucgucaagcgccaccggcuggcgacgaugccgcccaugguggagggcgaggggcuggccagccgccucaucgaggugggccccuccggcgcccaguuccuggggaagcugcaccucccgaccgcgccgccgccccugaacgagggcgagagccuggucagccggauccuccagcuggggccgcccggcaccaaguuccuggggcccgugaucguggagaucccccacuucgccgcgcuccgcggcaaggagcgggagcuggucgugcugcgcuccgagaacggcgacagcuggaaggagcacuucugcgacuacaccgaggacgagcucaacgagauccugaacgggauggacgagguccuggacuccccggaggaccucgagaagaagcggaucugccgcaucaucacgcgggacuucccccaguacuucgccguggugagccgcaucaagcaggacuccaaccugaucggccccgagggcgggguccugagcuccaccguggugccccagguccaggccguguucccggagggggcccucaccaagcggauccgcgugggccugcaggcccagcccaugcacagcgagcuggucaagaagauccugggcaacaaggcgaccuucucccccaucgugacccucgagccccggcgccggaaguuccacaagccgaucacgaugaccauccccgugcccaaggccagcuccgacgucaugcugaacggguucggcggggacgcccccacccugcgccuccugugcagcaucaccggcgggacgaccccggcccagugggaggacaucaccggcaccacgccccugaccuucgugaacgagugcguguccuucaccaccaacgucagcgcccgguucuggcucaucgacugccgccagauccaggaguccgugacguucgcgagccagguguaccgggagaucaucugcguccccuacauggccaaguucgugguguucgccaagucccacgacccgaucgaggcccgccugcgcugcuucugcaugaccgacgacaaggucgacaagacccuggagcagcaggagaacuucgcggagguggcccggagccgcgacguggagguccucgagggcaagcccaucuacguggacugcuucgggaaccuggugccccugaccaaguccggccagcaccacaucuucagcuucuucgccuucaaggagaaccggcucccccuguucgucaaggugcgcgacacgacccaggagccgugcgggcggcugagcuucaugaaggagcccaaguccacccgcggccucgugcaccaggccaucugcaaccugaacaucacccugcccaucuacacgaaggagagcgaguccgaccaggagcaggaggaggagaucgacaugaccagcgagaagaacccccaggacgagcaggagcggaucgaggagcgccucgccuacaucgcggaccaccugggcuucuccuggaccgagcuggcccgggagcucgacuucaccgaggagcagauccaccagauccgcaucgagaacccgaacagccugcaggaccagucccacgcccugcucaaguacuggcuggagcgggacgggaagcacgccacggacaccaaccuggucgagugccucaccaagaucaaccgcauggacaucgugcaccugauggagaccaacacggagccccugcaggagcggaucagccacuccuacgccgagaucgagcagaccaucacccucgaccacagcgagggcuucuccgugcugcaggaggagcugugcaccgcgcagcacaagcagaaggaggagcaggccgucagcaaggaguccgagacgugcgaccacccgcccaucgugagcgaggaggacaucuccgugggguacagcaccuuccaggacggcgucccgaagaccgagggggacuccagcgccaccgcccucuucccccagacgcacaaggagcagguccagcaggacuucuccggcaagaugcaggaccugcccgaggagagcagccuggaguaccagcaggaguacuucgugaccacccccggcaccgagaccuccgagacgcagaaggccaugaucgucccgagcucccccagcaagacccccgaggagguguccacccccgcggaggaggagaagcucuaccugcagaccccgacgagcuccgagcgcgggggcagccccaucauccaggagcccgaggagcccuccgagcaccgggaggagagcuccccgcgcaagaccagccuggugaucgucgaguccgccgacaaccagcccgagaccugcgagcggcucgacgaggacgccgccuucgagaagggggacgacaugcccgagaucccgcccgagaccgugacggaggaggaguacaucgacgagcacggccacaccguggucaagaaggugacccgcaagaucauccggcgcuacgugagcuccgaggggaccgagaaggaggagaucaugguccagggcaugccccaggagcccgugaacaucgaggagggcgacggguacagcaaggugaucaagcgcgucgugcugaaguccgacacggagcagagcgaggacaacaacgaguga

SEQ ID NO: 26639 - RNA, 5586 nt, Artificial Sequence
  derived and/or modified sequence opt1 from ANK3__Homo_sapiens__NP_001191332
auggccagcagcgccagcuccagccccgcgggcaccgaggacuccgcccccgcccagggcggguucgggagcgacuacucccggagcucccgcaagagcgacgccaacgccuccuaccugcgcgcggcccgggccggccaccucgagaaggcccuggacuacaucaagaacgggguggacaucaacaucugcaaccagaacggccugaacgcgcuccaccuggccagcaaggagggccacgucgaggugguguccgagcugcuccagcgcgaggccaacgucgacgccgccaccaagaaggggaacaccgcgcugcacaucgccagccuggccggccaggccgagguggugaagguccucgugaccaacggggccaacgugaacgcgcagucccagaacggcuucacgccccuguacauggccgcccaggagaaccaccuggaggucgugaaguuccuccuggacaacggggccagccagucccuggccaccgaggacggcuucaccccgcucgcgguggcccugcagcagggccacgaccaggucgugagccugcuccuggagaacgacaccaaggggaaggugcggcugcccgcccuccacaucgccgcccgcaaggacgacaccaaggcggccgcccugcugcuccagaacgacaacaacgccgacgucgaguccaagagcggcuucaccccgcugcacaucgcggcccacuacgggaacaucaacguggccacccugcuccugaaccgggccgccgcgguggacuucaccgcccgcaacgacaucacgccccugcacgucgccagcaagcggggcaacgccaacauggugaagcuccugcuggaccgcggcgccaagaucgacgcgaagacccgggacgggcucaccccgcugcacugcggcgcccgcuccgggcacgagcaggucgucgagaugcugcucgaccgggccgcccccauccugagcaagaccaagaacggccugagcccccuccacauggccacccagggggaccaccugaacugcgugcagcugcuccugcagcacaacgugcccgucgacgacgugaccaacgacuaccugaccgcgcuccacgucgccgcccacugcggccacuacaagguggccaaggugcugcuggacaagaaggcgaaccccaacgccaaggcccucaacggcuucacgccccugcacaucgccugcaagaagaaccgcaucaaggucauggagcugcugcucaagcacggggccuccauccaggcggugaccgaguccggccugacccccauccacguggccgccuucauggggcacgucaacaucgugagccagcugaugcaccacggcgccucccccaacaccaccaacgugcgcggggagaccgcccuccacauggcggcccgcagcggccaggccgaggucgugcgguaccuggugcaggacggcgcccaggucgaggccaaggcgaaggacgaccagacgccccugcacaucuccgcccgccucgggaaggccgacaucgugcagcagcugcugcagcagggcgccagccccaacgcggccaccaccuccggguacaccccgcuccaccugagcgcccgggagggccacgaggacguggccgccuuccugcucgaccacggggcgucccugagcaucaccaccaagaagggcuucacgccccugcacgucgccgccaaguacggcaagcucgagguggccaaccugcugcuccagaaguccgccagccccgacgcggccgggaaguccggccugacgccccugcacguggccgcccacuacgacaaccagaaggucgcccuccugcugcucgaccagggggcgagcccccacgccgccgccaagaacggcuacacgccccugcacaucgccgcgaagaagaaccagauggacaucgccaccacccugcucgaguacggcgccgacgccaacgcggugacccgccaggggaucgccuccgugcaccuggccgcccaggagggccacgucgacauggugagccugcuccuggggcggaacgccaacgugaaccugagcaacaaguccggccucacgccccugcaccuggcggcccaggaggaccgcgucaacguggccgaggugcucgucaaccagggggcccacguggacgcccagaccaagaugggcuacacgccccugcacgugggcugccacuacgggaacaucaagaucgucaacuuccugcuccagcacagcgcgaaggugaacgccaagaccaagaacggcuacacgccccugcaccaggccgcccagcaggggcacacccacaucaucaacgugcugcuccagaacaacgccucccccaacgagcugaccgucaacggcaacaccgcgcuggggaucgcccgccggcucggcuacaucagcgugguggacacccugaagaucgucaccgaggagacgaugaccaccaccacggugaccgagaagcacaagaugaacgugcccgagaccaugaacgagguccuggacauguccgacgacgaggugcgcaaggccaacgcccccgagaugcucagcgacggcgaguacaucuccgacguggaggagggggaggacgcgaugaccggcgacacggacaaguaccuggggccccaggaccugaaggagcucggcgacgacagccugcccgccgagggguacaugggcuucucccugggcgcccggagcgccucccuccgcagcuucuccagcgaccgguccuacacccugaaccgcagcuccuacgcccgggacagcaugaugaucgaggagcugcucguccccagcaaggagcagcaccugaccuucacccgcgaguucgacuccgacagccugcggcacuacuccugggcggccgacacgcucgacaacgugaaccuggugagcucccccauccacagcggguuccuggucuccuucaugguggacgcccgcggcgggagcaugcggggcucccgccaccacgggaugcggaucaucaucccgccccggaagugcaccgcccccacccggaucacgugccgccucgugaagcggcacaagcuggccaacccgccgcccauggucgagggcgagggccuggcgagccgccucguggagauggggcccgccggcgcccaguuccuggggccggugaucgucgagaucccccacuucggcuccaugcggggcaaggagcgcgagcugaucgugcuccgcagcgagaacggggagacguggaaggagcaccaguucgacuccaagaacgaggaccugaccgagcugcucaacggcauggacgaggagcuggacagccccgaggagcuggggaagaagcggaucugccgcaucaucaccaaggacuucccccaguacuucgccgucgugucccggaucaagcaggagagcaaccagaucggcccggagggcgggauccucuccagcaccacggugccccugguccaggccuccuuccccgagggcgcgcugaccaagcgcauccggguggggcuccaggcccagcccgugccggacgagaucgucaagaagauccugggcaacaaggccaccuucagccccaucgugaccguggagccccgccggcgcaaguuccacaagcccaucacgaugaccaucccggugccgccgcccagcggggagggcguguccaacggguacaagggcgacaccaccccgaaccugcggcuccugugcagcaucacgggcgggaccucccccgcccagugggaggacaucaccggcaccacgccccugaccuucaucaaggacugcgugagcuucaccaccaacgucuccgcgcgcuucuggcucgccgacugccaccaggugcuggagaccguggggcuggccacgcagcucuaccgggagcugaucugcgucccguacauggccaaguucgugguguucgccaagaugaacgaccccgucgagagcucccugcgcugcuucugcaugaccgacgacaagguggacaagacccucgagcagcaggagaacuucgaggagguggcgcggagcaaggacaucgagguccuggagggcaagcccaucuacguggacugcuacgggaaccuggcgccccucaccaagggcggccagcagcugguguucaacuucuacuccuucaaggagaaccgccugccguucagcaucaagauccgggacacgucccaggagcccugcgggcgccugagcuuccucaaggagcccaagaccaccaagggccugccccagaccgccgucugcaaccugaacaucacgcucccggcccacaagaagaucgagaagaccgaccggcgccaguccuucgccagccuggcccugcggaagcgcuacuccuaccucaccgagcccgggaugagcccccagucccccugcgagcggaccgacauccgcauggccaucguggccgaccaccugggccugagcuggacggagcucgcccgcgagcugaacuucuccguggacgagaucaaccagauccgggucgagaacccgaacagccugaucagccaguccuucaugcuccugaagaagugggugacccgcgacggcaagaacgccaccaccgacgcgcugacgagcgugcucaccaagaucaaccggaucgacaucgucacccugcuggaggggcccaucuucgacuacggcaacaucuccgggacccgcagcuucgccgacgagaacaacguguuccacgaccccguggacggcuaccccucccuccaggucgagcuggagacgccgaccgggcugcacuacacgccgcccacccccuuccagcaggacgacuacuucagcgacaucuccagcaucgaguccccgcuccggacgcccagccgccuguccgacggccuggugcccagccagggcaacaucgagcacuccgccgacgggcccccgguggucaccgccgaggacgccagccucgaggacuccaagcuggaggacagcgugccccugaccgagaugcccgaggcgguggacgucgacgagucccagcucgagaacgugugccugagcuggcagaacgagaccuccagcggcaaccuggagagcugcgcccaggcccggcgcgugaccgggggccuccuggaccggcuggacgacucccccgaccagugccgcgacagcaucaccuccuaccucaagggggaggccggcaaguucgaggcgaacggcagccacaccgagaucaccccggaggccaagacgaaguccuacuuccccgagagccagaacgacgucgggaagcaguccaccaaggagacccugaagcccaagauccacggcagcgggcacguggaggagccggccagcccccuggccgccuaccagaagucccucgaggagaccuccaagcugaucaucgaggagacgaagcccugcgugcccgucuccaugaagaagaugucccggaccagcccggcggacggcaagccccgccugucccuccacgaggaggaggggagcuccggcagcgagcagaagcagggcgagggguucaaggugaagaccaagaaggagauccggcacguggagaagaagucccacagcuga

SEQ ID NO: 26640 - RNA, 2292 nt, Artificial Sequence
  derived and/or modified sequence opt1 from ANKFN1__Homo_sapiens__NP_694960
auggaggccagccugacccgccggcuccuguucaaggaccgccacuucacgugcuccaagaucaucggccggcgcuucgccugcuucgcgcagcggcugagccaccgccggaagcagucccagugcgaccuccugaacgagagcaccgggcagcugcccacgaccugcuccagcgccgccuccaacagcaucaacuggaacugccgcgugaagaugacccagcagaugcagaaccuccaccugugccaguccaagaagcacagcgccccguccagccccaacgccgcgaagcggcuguaccgcaaccucuccgagaagcugaagggcagccacuccagcuucgacgaggccuacuuccggacccgcaccgaccggcugucccuccgcaagaccagcgucaacuuccaggggaacgaggccauguucgaggccguggagcagcaggacauggacgcggugcagauccugcuguaccaguacacccccgaggagcucgaccugaacacgcccaacuccgagggccugaccccgcucgacaucgccaucaugaccaacaacguccccaucgcccggauccugcugcgcaccggggcccgggagagcccccacuucgugagccucgagucccgcgccaugcaccugaacacgcuggugcaggaggcgcaggagcgggucagcgagcucuccgcccagguggagaacgagggcuucacccuggacaacaccgagaaggagaagcagcugaaggccugggaguggcgcuaccggcucuaccgccgcaugaagaccggcuucgagcacgcccgggcccccgagaugccgacgaacgugugccugauggucaccagcuccaccagccugaccguguccuuccaggagccccucagcgugaacgcggccgucgugacgcgcuacaagguggagugguccaugagcgaggacuucagcccccuggccggggagaucaucauggacaaccugcagacccuccggugcaccaucaccggccugacgauggggcagcaguacuucguccagguguccgccuacaacaugaagggcugggggcccgcccagaccaccaccccggcgugcgccucccccagcaacuggaaggacuacgacgaccgcgagccccggcacaagggccaguccgaggugcuggagggccuccugcagcagguccgcgcccugcaccagcacuacagcugccgggaguccacgaagcuccagaccaccgggcgcaagcagagcgugucccggagccugaagcaccuguuccacagcuccaacaaguucgugaagacccucaagcgcggccuguacaucgccgucaucuucuacuacaaggacaacauccuggugacgaacgaggaccaggugcccaucgucgagaucgacgacagccacaccuccagcaucacccaggacuuccucugguucaccaagcuguccugcaugugggaggacauccgguggcugcgccagagcaucccgaucuccagcuccagcuccacggugcuccagacccggcagaagaugcuggccgcgaccgcccagcugcagaaccugcucgggacccacaaccugggccgcgucuacuacgagcccaucaaggaccggcacggcaacauccugaucgugaccauccgcgagguggagaugcucuacagcuucuucaacgggaaguggaugcagaucuccaagcugcagagccagcggaagucccugagcacgcccgaggagcccaccgcccucgacauccugcugaucaccauccaggacauccucuccuaccacaagcgcagccaccagcggcuguucccgggccuguaccucggguaccugaagcugugcagcuccgucgaccagaucaaggugcucgugacccagaagcugcccaacauccugugccacgucaagauccgcgagaacaacaacaucagccgcgaggagugggaguggauccagaagcucuccggcagcgaguccauggagagcguggaccacacguccgacugccccaugcagcuguucuucuacgagcugcagauggccgugaaggcgcuccugcagcagaucaacaucccccugcaccaggcccggaacuuccgccucuacacccaggagguccuggagauggggcacaacgugagcuuccugcuccugcugccggccuccgacgacgugugcaccgcccccggccagaacaaccccuacacgccccacagcggcuuccucaaccugccgcugcagauguucgagcucgggaucgucgccugcuucaccuga

SEQ ID NO: 26641 - RNA, 3513 nt, Artificial Sequence
  derived and/or modified sequence opt1 from ANKFY1__Homo_sapiens__NP_057460
auggccgaggaggagguggccaagcuggagaagcaccugaugcugcugcgccaggaguacgucaagcuccagaagaagcuggcggagaccgagaagcggugcgcccugcucgccgcccaggccaacaaggagagcuccagcgaguccuucaucagccgccugcuggcgaucguggccgaccucuacgagcaggagcaguacuccgaccugaagaucaaggugggcgaccggcacaucagcgcccacaaguucguccuggccgcgcgcuccgacagcuggucccucgccaaccugagcuccaccaaggagcuggaccucagcgacgccaaccccgaggugacgaugaccaugcugcgguggaucuacaccgacgagcuggaguuccgcgaggacgacguguuccucaccgagcugaugaagcuggccaaccgguuccagcuccagcugcugcgcgagcggugcgagaagggggucaugucccucgugaacgugcgcaacugcauccgguucuaccagacggccgaggagcugaacgcgagcacccugaugaacuacugcgccgagaucaucgccucccacugggacgaccuccgcaaggaggacuucagcuccaugagcgcccagcugcuguacaagaugaucaaguccaagaccgaguacccgcuccacaaggccaucaaggucgagcgggaggacgugguguuccuguaccugaucgagauggacagccagcuccccggcaagcugaacgaggcggaccacaacggggaccuggcccucgaccuggcccugagccgccggcucgaguccaucgccaccacgcuggucagccacaaggccgacguggacaugguggacaaguccggcuggagccugcuccacaaggggauccagcgcggcgaccuguucgcggccaccuuccugaucaagaacggcgccuucgucaacgccgccacccucggggcgcaggagacgccccugcaccugguggcccucuacuccagcaagaagcacuccgccgacgugaugagcgagauggcccagaucgcggaggcccugcugcaggccggcgccaaccccaacaugcaggacuccaaggggcggaccccgcugcacgucagcaucauggccggcaacgaguacguguucucccagcuccugcagugcaagcagcuggaccucgagcugaaggaccacgaggggagcaccgcgcuguggcucgccgugcagcacaucaccgucuccagcgaccaguccgugaaccccuucgaggacgugcccgucgugaacggcaccagcuucgacgagaacuccuucgccgcccgccugauccagcggggcagccacacggacgcccccgacaccgcgaccgggaacugccugcuccagcgcgccgccggcgccgggaacgaggccgcggcccuguuccuggccaccaacggcgcccacgucaaccaccggaacaaguggggcgagacgccgcuccacaccgcgugccgccacgggcuggccaaccugaccgccgagcuccugcagcagggcgccaaccccaaccugcagaccgaggaggcccucccccugcccaaggaggcggccucccugacgagccucgccgacagcgugcaccuccagaccccgcugcacauggccaucgccuacaaccaccccgacguggucuccgugauccucgagcagaaggcgaacgcccugcacgccaccaacaaccugcagaucauccccgacuucagccucaaggacucccgcgaccagaccgugcuggggcuggcccucuggacgggcaugcacaccaucgccgcgcagcugcuggggagcggcgccgccaucaacgacaccauguccgacggccagacccuccugcacauggccauccagcggcaggacagcaaguccgcgcuguuccuccuggagcaccaggccgacaucaacgucagccgcacgcaggacggggagaccgcccugcagcucgccauccggaaccagcugccccuggugguggacgccaucugcacccgcggcgcggacauguccgucccggacgagaaggggaacccgccccucuggcuggcccuggccaacaaccucgaggacaucgccagcacccuggugcggcacggcugcgacgccacgugcugggggcccggccccggcgggugccugcagacccuccugcaccgcgcgaucgacgagaacaacgagcccaccgccugcuuccugauccgguccggcugcgacgugaacagcccccgccagcccggggccaacggcgagggggaggaggaggcccgggacggccagaccccgcuccaccuggccgcguccuggggccuggaggagaccguccagugccuccuggaguucggggccaacgugaacgcccaggacgccgagggccgcacgcccauccacguggccaucagcucccagcacggggucaucauccagcugcucgugagccaccccgacauccaccugaacgugcgggaccgccagggccugacccccuucgcgugcgccaugaccuucaagaacaacaaguccgccgaggccauccucaagcgggagagcggcgcggccgagcaggucgacaacaaggggcgcaacuuccugcacguggccgugcagaacagcgacaucgaguccguccuguuccucaucagcgugcacgccaacgugaacucccggguccaggacgccagcaagcugaccccgcugcaccucgcggugcaggccggcuccgagaucaucgugcgcaaccugcugcucgccggggccaaggucaacgagcugacgaagcaccggcagaccgcccugcaccucgcggcccagcaggaccugcccaccaucugcagcgugcugcucgagaacggcguggacuucgccgccgucgacgagaacgggaacaacgcccugcaccuggcggugaugcacggccgccucaacaacauccgggugcugcugaccgagugcacggucgacgccgaggccuucaaccuccgcggccagagcccccugcacauccuggggcaguacggcaaggagaacgccgcggccaucuucgaccucuuccuggagugcaugccgggguacccccuggacaagcccgacgccgacggcuccaccgugcuccugcuggccuacaugaaggggaacgccaaccucugccgcgcgaucgugcgguccggcgcccgccugggcgucaacaacaaccagggggugaacaucuucaacuaccagguggccaccaagcagcugcuguuccggcugcuggacaugcugagcaaggagcccccguggugcgacggcuccuacugcuacgagugcaccgcccgcuucggggucacgacccggaagcaccacugccgccacugcggccggcuccugugccacaagugcagcaccaaggagauccccaucaucaaguucgaccugaacaagcccgugcgcgugugcaacaucugcuucgacguccucacccucgggggcguguccuga

SEQ ID NO: 26642 - RNA, 7854 nt, Artificial Sequence
  derived and/or modified sequence opt1 from ANKHD1-EIF4EBP3__Homo_sapiens__NP_065741
augcugaccgacagcggcgggggcgggaccuccuucgaggaggaccuggacagcguggcgccccgcuccgcccccgccggcgccagcgagccgccgccgcccggcgggguggggcuggggauccggaccgugcgccuguucggcgaggccgggcccgccuccggcguggggagcuccggcggcgggggcagcggguccggcaccggcgggggcgacgccgcccucgacuucaagcuggccgccgccguccugcggaccgggggcgggggcggcgcgagcggguccgacgaggacgaggugagcgagguggaguccuucauccucgaccaggaggaccuggacaaccccguccugaagaccaccagcgagaucuuccucuccagcaccgccgagggcgccgaccugcgcaccguggaccccgagacccaggcccggcuggaggcccuccuggaggccgccgggaucggcaagcuguccaccgccgacgggaaggccuucgccgaccccgaggugcuccgccggcugaccagcuccgucagcugcgcgcuggacgaggccgccgccgcccucacccgcaugaaggcggagaacagccacaacgccggccagguggacacccggucccuggccgaggccugcagcgacggcgacgugaacgccguccgcaagcugcucgacgaggggcgguccgugaacgagcacaccgaggagggcgagagccugcugugccucgcgugcuccgccggguacuacgagcuggcccaggugcugcucgccaugcacgcgaacgucgaggaccgcggcaacaagggggacaucacgccccucauggccgccagcuccggcggcuaccuggacaucgugaagcuccugcugcuccacgacgccgacgugaacagccaguccgccaccgggaacaccgcgcugaccuacgccugcgccggcggguucgucgacaucgugaaggugcugcucaacgagggcgccaacaucgaggaccacaacgagaacggccacacgccccucauggaggccgcgagcgccgggcacgucgagguggcccgggugcugcucgaccacggcgccgggaucaacacccacuccaacgaguucaaggagagcgcccugacccuggcgugcuacaagggccaccucgacaugguccgcuuccugcuggaggccggggccgaccaggagcacaagaccgacgagaugcacaccgcccucauggaggcgugcauggacggccacguggaggucgcccggcugcugcucgacuccggcgcccaggugaacaugcccgccgacagcuucgaguccccgcugacccuggccgcgugcgggggccacguggagcuggccgcccuccugaucgagcgcggggccaaccuggaggaggucaacgacgagggcuacacgccccugauggaggccgcgcgggaggggcacgaggagaugguggcccugcugcucgcccagggcgccaacaucaacgcccagaccgaggagacccaggagaccgcgcugacccuggccugcugcggcggguucagcgagguggccgacuuccucaucaaggccggcgcggacaucgagcuggggugcuccacgccccugauggaggccagccaggagggccaccucgagcuggucaaguaccugcucgccuccggggccaacgugcacgccaccaccgcgaccggcgacaccgcccugaccuacgccugcgagaacggccacaccgacguggccgacguccugcuccaggccggggcggaccuggagcacgagagcgagggcgggcgcacgccccugaugaaggccgcccgggccggccaccucugcacggugcaguuccugaucagcaagggggccaacgugaaccgcgcgaccgccaacaacgaccacaccgucgugucccuggccugcgccggcggccaccucgccguggucgagcugcugcucgcgcacggggccgacccgacccaccggcugaaggacggcagcaccaugcugaucgaggccgccaagggcggccacacgaacgugguguccuaccuccuggacuaccccaacaacguccugagcgugcccaccaccgacgugucccagcugcccccgcccagccaggaccagucccaggucccccgcgugcccacccacacgcuggcgaugguggucccgccccaggagcccgaccgcaccagccaggagaacucccccgcccugcucggcgugcagaaggggaccagcaagcagaaguccagcucccuccagguggccgaccaggaccugcuccccagcuuccaccccuaccagccccuggagugcaucgucgaggagaccgagggcaagcugaacgagcucgggcagcggaucuccgccaucgagaaggcccagcucaagagccuggagcucauccagggcgagccgcugaacaaggacaagaucgaggagcugaagaagaaccgcgaggagcagguccagaagaagaagaagauccucaaggagcugcagaagguggagcggcagcugcagaugaagacgcagcagcaguucaccaaggaguaccucgagaccaaggggcagaaggacaccgucucccugcaccagcagugcagccaccgcggcguguuccccgagggcgagggggacggcagccugcccgaggaccacuucuccgagcucccccagguggacacgauccuguucaaggacaacgacgucgacgacgagcagcagagcccgcccuccgcggagcagaucgacuucgugcccgugcagccccugagcuccccgcagugcaacuucagcuccgaccucgggagcaacggcaccaacucccuggagcugcagaaggucagcgggaaccagcagaucgugggccagccccagaucgccaucaccggccacgaccaggggcuccuggugcaggagcccgacggccugauggucgccacccccgcccagacgcucaccgacacccuggacgaccugaucgccgcgguguccacccgggugccgacggggagcaacuccagcucccagaccaccgagugccucacccccgagagcugcucccagacgaccagcaacgucgccucccagagcaugccgcccguguacccgagcguggacaucgacgcccacaccgaguccaaccacgacaccgcccugacgcuggccugcgcgggcgggcacgaggagcucgucagcgugcugaucgcccgcgacgccaagaucgagcaccgggacaagaagggcuucacgccccugauccucgccgcgaccgccggccacgugggggucguggagauccugcuggacaagggcggggacaucgaggcccaguccgagcgcaccaaggacacgccccucagccuggccugcuccggcggccggcaggagguggucgaccugcuccuggcccgcggggcgaacaaggagcaccggaacgugagcgacuacacgccccugucccucgccgccagcggcggguacgucaacaucaucaagauccugcugaacgccggcgccgagaucaacucccgcaccgggagcaagcucggcaucuccccgcugaugcuggcggccaugaacggccacgugcccgccgugaagcuccugcuggacauggggagcgacaucaacgcccagaucgagaccaaccggaacacggcccucacccuggcgugcuuccagggccgcgccgaggucgugucccugcuccuggaccggaaggccaacguggagcaccgcgccaagaccgggcugacgccccugauggaggcggccagcggcggguacgccgaggucggccgggugcuccuggacaagggcgccgacgugaacgcgccgcccguccccuccagccgcgacaccgcgcugacgaucgccgccgacaaggggcacuacaaguucugcgagcuccugauccaccggggcgcccacaucgacgugcgcaacaagaaggggaacacgccccuguggcucgccuccaacggcgggcacuucgacgugguccagcugcuggugcaggcgggcgccgacguggacgccgccgacaaccgcaagaucacgccccucaugagcgccuuccggaagggccacgucaagguggugcaguaccuggucaaggaggugaaccaguuccccuccgacaucgagugcaugcgcuacaucgcgaccaucaccgacaaggagcugcucaagaagugccaccagugcguggagaccaucgucaaggccaaggaccagcaggccgccgaggccaacaagaacgcgagcauccugcugaaggagcucgaccuggagaagucccgggaggagucccgcaagcaggcccuggccgccaagcgggagaagcgcaaggagaagcggaagaagaagaaggaggagcagaagcgcaagcaggaggaggacgaggagaacaagcccaaggagaacagcgagcuccccgaggacgaggacgaggaggagaacgacgaggacguggagcaggaggugccgaucgagccgcccuccgcgaccaccacgaccaccaucgggaucagcgccaccuccgccacguucaccaacgucuucggcaagaagcgggccaacguggugaccacccccagcacgaaccgcaagaacaagaagaacaagaccaaggagaccccgcccaccgcccaccugauccugcccgagcagcacaugucccucgcgcagcagaaggccgacaagaacaagaucaacggggagccccggggcgggggcgccggcgggaacagcgacuccgacaaccuggacagcacggacugcaacuccgagagcuccagcggcgggaagucccaggagcugaacuucgucauggacgugaacagcuccaaguacccgagccuccugcugcacucccaggaggagaagaccagcaccgccaccagcaagacgcagacccgccucgagggcgaggugacccccaacucccugagcaccuccuacaagacggucagccugccccucuccagccccaacaucaagcugaaccugaccuccccgaagcggggccagaagcgcgaggagggguggaaggagguggugcggcgcagcaagaagcucuccguccccgccagcguggugucccggaucaugggccgcgggggcugcaacaucaccgcgauccaggacgucaccggggcccacaucgacguggacaagcagaaggacaagaacggcgagcggaugaucacgauccgcggcgggaccgagagcacccgguacgccgugcagcugaucaacgcccugauccaggaccccgccaaggagcucgaggaccugauccccaagaaccacauccgcaccccggcguccaccaagagcauccacgccaacuucuccagcggcgucgggaccaccgccgccuccagcaagaacgcguucccccugggcgcccccacccucgugaccucccaggccacgacccugagcaccuuccagcccgccaacaagcugaacaagaacgugccgaccaacguccgcagcuccuuccccgugagccucccccuggccuacccccacccgcacuucgcgcugcucgccgcccagacgaugcagcagauccggcacccccgccugcccauggcccaguucgggggcaccuucuccccgagccccaacaccuggggccccuuccccgugcggccggucaaccccgggaacaccaacuccagccccaagcacaacaacacgucccgccugcccaaccagaacggcaccgugcucccgagcgaguccgccgggcuggcgaccgccagcugccccaucaccguguccagcgucguggccgccucccagcagcugugcgugacgaacacccggacccccagcuccguccgcaagcagcuguucgccugcgugcccaagaccagcccgcccgcgacggucaucuccagcgugaccagcacgugcagcagccugcccuccgugagcuccgcccccaucaccagcggccaggccccgaccaccuuccugcccgccuccaccagccaggcgcagcucuccagccagaagauggaguccuucagcgccgucccgcccaccaaggagaagguguccacgcaggaccagcccauggccaaccugugcacccccagcuccaccgccaacagcugcuccagcuccgccagcaacacccccggggcgcccgagacgcacccgagcuccagccccacccccaccuccagcaacacccaggaggaggcccagcccuccagcguguccgaccugagcccgauguccaugcccuucgccagcaacuccgagcccgccccgcucacgcugaccagcccccggauggucgccgcggacaaccaggacaccuccaaccugccccagcucgccgugcccgccccgcgcgugagccaccggaugcagccccgcggcuccuucuacagcaugguccccaacgccaccauccaccaggacccccaguccaucuucgugacgaacccggugacccugacgccgccccagggcccgcccgccgcgguccagcugagcuccgccgugaacaucaugaacgggagccagaugcacaucaaccccgccaacaagagccugccgcccaccuucggccccgccacgcuguucaaccacuucuccagccuguucgacuccagccaggugcccgccaaccagggguggggcgacgggccccucuccagccgggucgcgaccgacgccuccuucaccgugcagagcgccuuccugggcaacuccgugcugggccaccucgagaacaugcaccccgacaacagcaaggccccgggguuccgcccgcccucccagcgggucagcaccucccccgugggccugcccagcaucgaccccuccgggagcucccccagcuccagcagcgcgccgcuggccuccuucagcggcauccccggcacccgcguguuccuccaggggcccgcccccgucggcacgccguccuucaaccggcagcacuucagcccccaccccuggaccuccgccagcaacuccagcaccuccgcgccgcccacccuggggcagcccaagggcgugagcgcgucccaggaccgcaagaucccgccgcccaucgggacggagcggcuggcccgcauccggcagggcggcagcguggcccaggcccccgccgggaccuccuucgucgcgcccgugggccacagcgggaucugguccuucggcgugaacgccgucagcgaggggcucuccggcuggagccaguccgugaugggcaaccaccccaugcaccagcagcugagcgaccccagcaccuucucccagcaccagcccauggagcgcgacgacagcgggaugguggcccccuccaacaucuuccaccagcccauggccagcggcuucgucgacuucuccaaggggcugcccaucagcauguacggcgggaccaucauccccucccacccccagcucgccgacgugcccggcggcccgcuguucaacgggcugcacaaccccgaccccgcguggaaccccaugaucaaggugauccagaacagcacggagugcaccgacgcccagcaggccucccuccugccgagcguccccgcccugaagggcgagauccccuccccgcagcucacccgccccaagaagcggaucgggcgccccaugguggcgagccccaaccagcggcaccaggaccaccuccgcccgaaggugcccgccggcguccaggagcugacccacugccccgacacgccccuccugccgcccuccgacagccggggccacaacuccagcaacucccccagccugcaggccgggggcgccgagggggccggcgaccgcgggcgggacacccgcuga

SEQ ID NO: 26643 - RNA, 7629 nt, Artificial Sequence
  derived and/or modified sequence opt1 from ANKHD1__Homo_sapiens__NP_060217
augcugaccgacagcggcgggggcgggaccuccuucgaggaggaccucgacagcguggcgccccgcuccgcccccgccggcgccagcgagccgccgccgcccggcgggguggggcuggggauccggaccgugcgccuguucggcgaggccgggcccgccuccggcguggggagcuccggcggcgggggcagcggguccggcaccggcgggggcgacgccgcccucgacuucaagcuggccgccgccguccugcggaccgggggcgggggcggcgcgagcggguccgacgaggacgaggugagcgagguggaguccuucauccucgaccaggaggaccuggacaaccccguccugaagaccaccagcgagaucuuccucuccagcaccgccgagggcgccgaccugcgcaccguggaccccgagacccaggcccggcuggaggcccuccuggaggccgccgggaucggcaagcuguccaccgccgacgggaaggccuucgccgaccccgaggugcuccgccggcugaccagcuccgucagcugcgcccuggacgaggccgccgccgcccucacccgcaugaaggcggagaacagccacaacgccggccagguggacacccggucccuggccgaggccugcagcgacggcgacgugaacgccguccgcaagcugcucgacgaggggcgguccgugaacgagcacaccgaggagggcgagagccugcugugccucgcgugcuccgccggguacuacgagcuggcccaggugcugcucgccaugcacgcgaacgucgaggaccgcggcaacaagggggacaucacgccccucauggccgccagcuccggcggcuaccuggacaucgugaagcuccugcugcuccacgacgccgacgugaacagccaguccgccaccgggaacaccgcgcugaccuacgccugcgccggcggguucgucgacaucgugaaggugcugcucaacgagggcgccaacaucgaggaccacaacgagaacggccacacgccccucauggaggccgcgagcgccgggcacgucgagguggcccgggugcugcucgaccacggcgccgggaucaacacccacuccaacgaguucaaggagagcgcccugacccuggcgugcuacaagggccaccucgacaugguccgcuuccugcuggaggccggggccgaccaggagcacaagaccgacgagaugcacaccgcccucauggaggcgugcauggacggccacguggaggucgcccggcugcugcucgacuccggcgcccaggugaacaugcccgccgacagcuucgaguccccgcugacccuggccgcgugcgggggccacguggagcuggccgcccuccugaucgagcgcggggccaaccuggaggaggucaacgacgagggcuacacgccccugauggaggccgcgcgggaggggcacgaggagaugguggcccugcugcucgcccagggcgccaacaucaacgcccagaccgaggagacccaggagaccgcgcugacccuggccugcugcggcggguucagcgagguggccgacuuccucaucaaggccggcgcggacaucgagcuggggugcuccacgccccugauggaggccagccaggagggccaccucgagcuggucaaguaccugcucgccuccggggccaacgugcacgccaccaccgcgaccggcgacaccgcccugaccuacgccugcgagaacggccacaccgacguggccgacguccugcuccaggccggggcggaccuggagcacgagagcgagggcgggcgcacgccccugaugaaggccgcccgggccggccaccucugcacggugcaguuccugaucagcaagggggccaacgugaaccgcgcgaccgccaacaacgaccacaccgucgugucccuggccugcgccggcggccaccucgccguggucgagcugcugcucgcgcacggggccgacccgacccaccggcugaaggacggcagcaccaugcugaucgaggccgccaagggcggccacacgaacgugguguccuaccuccuggacuaccccaacaacguccugagcgugcccaccaccgacgugucccagcugcccccgcccagccaggaccagucccaggucccccgcgugcccacccacacgcuggcgaugguggucccgccccaggagcccgaccgcaccagccaggagaacucccccgcccugcucggcgugcagaaggggaccagcaagcagaaguccagcucccuccagguggccgaccaggaccugcuccccagcuuccaccccuaccagccccuggagugcaucgucgaggagaccgagggcaagcugaacgagcucgggcagcggaucuccgccaucgagaaggcccagcucaagagccuggagcucauccagggcgagccgcugaacaaggacaagaucgaggagcugaagaagaaccgcgaggagcagguccagaagaagaagaagauccucaaggagcugcagaagguggagcggcagcugcagaugaagacgcagcagcaguucaccaaggaguaccucgagaccaaggggcagaaggacaccgucucccugcaccagcagugcagccaccgcggcguguuccccgagggcgagggggacggcagccugcccgaggaccacuucuccgagcucccccagguggacacgauccuguucaaggacaacgacgucgacgacgagcagcagagcccgcccuccgcggagcagaucgacuucgugcccgugcagccccugagcuccccgcagugcaacuucagcuccgaccucgggagcaacggcaccaacucccuggagcugcagaaggucagcgggaaccagcagaucgugggccagccccagaucgccaucaccggccacgaccaggggcuccuggugcaggagcccgacggccugauggucgccacccccgcccagacgcucaccgacacccuggacgaccugaucgccgcgguguccacccgggugccgacggggagcaacuccagcucccagaccaccgagugccucacccccgagagcugcucccagacgaccagcaacgucgccucccagagcaugccgcccguguacccgagcguggacaucgacgcccacaccgaguccaaccacgacaccgcccugacgcuggccugcgcgggcgggcacgaggagcucgucagcgugcugaucgcccgcgacgccaagaucgagcaccgggacaagaagggcuucacgccccugauccucgccgcgaccgccggccacgugggggucguggagauccugcuggacaagggcggggacaucgaggcccaguccgagcgcaccaaggacacgccccucagccuggccugcuccggcggccggcaggagguggucgaccugcuccuggcccgcggggcgaacaaggagcaccggaacgugagcgacuacacgccccugucccucgccgccagcggcggguacgucaacaucaucaagauccugcugaacgccggcgccgagaucaacucccgcaccgggagcaagcucggcaucuccccgcugaugcuggcggccaugaacggccacgugcccgccgugaagcuccugcuggacauggggagcgacaucaacgcccagaucgagaccaaccggaacacggcccucacccuggcgugcuuccagggccgcgccgaggucgugucccugcuccuggaccggaaggccaacguggagcaccgcgccaagaccgggcugacgccccugauggaggcggccagcggcggguacgccgaggucggccgggugcuccuggacaagggcgccgacgugaacgcgccgcccguccccuccagccgcgacaccgcgcugacgaucgccgccgacaaggggcacuacaaguucugcgagcuccugauccaccggggcgcccacaucgacgugcgcaacaagaaggggaacacgccccuguggcucgccuccaacggcgggcacuucgacgugguccagcugcuggugcaggcgggcgccgacguggacgccgccgacaaccgcaagaucacgccccucaugagcgccuuccggaagggccacgucaagguggugcaguaccuggucaaggaggugaaccaguuccccuccgacaucgagugcaugcgcuacaucgcgaccaucaccgacaaggagcugcucaagaagugccaccagugcguggagaccaucgucaaggccaaggaccagcaggccgccgaggccaacaagaacgcgagcauccugcugaaggagcucgaccuggagaagucccgggaggagucccgcaagcaggcccuggccgccaagcgggagaagcgcaaggagaagcggaagaagaagaaggaggagcagaagcgcaagcaggaggaggacgaggagaacaagcccaaggagaacagcgagcuccccgaggacgaggacgaggaggagaacgacgaggacguggagcaggaggugccgaucgagccgcccuccgcgaccaccacgaccaccaucgggaucagcgccaccuccgccacguucaccaacgucuucggcaagaagcgggccaacguggugaccacccccagcacgaaccgcaagaacaagaagaacaagaccaaggagaccccgcccaccgcccaccugauccugcccgagcagcacaugucccucgcgcagcagaaggccgacaagaacaagaucaacggggagccccggggcgggggcgccggcgggaacagcgacuccgacaaccuggacagcacggacugcaacuccgagagcuccagcggcgggaagucccaggagcugaacuucgucauggacgugaacagcuccaaguacccgagccuccugcugcacucccaggaggagaagaccagcaccgccaccagcaagacgcagacccgccucgagggcgaggugacccccaacucccugagcaccuccuacaagacggucagccugccccucuccagccccaacaucaagcugaaccugaccuccccgaagcggggccagaagcgcgaggagggguggaaggagguggugcggcgcagcaagaagcucuccguccccgccagcguggugucccggaucaugggccgcgggggcugcaacaucaccgcgauccaggacgucaccggggcccacaucgacguggacaagcagaaggacaagaacggcgagcggaugaucacgauccgcggcgggaccgagagcacccgguacgccgugcagcugaucaacgcccugauccaggaccccgccaaggagcucgaggaccugauccccaagaaccacauccgcaccccggcguccaccaagagcauccacgccaacuucuccagcggcgucgggaccaccgccgccuccagcaagaacgcguucccccugggcgcccccacccucgugaccucccaggccacgacccugagcaccuuccagcccgccaacaagcugaacaagaacgugccgaccaacguccgcagcuccuuccccgugagccucccccuggccuacccccacccgcacuucgcgcugcucgccgcccagacgaugcagcagauccggcacccccgccugcccauggcccaguucgggggcaccuucuccccgagccccaacaccuggggccccuuccccgugcggccggucaaccccgggaacaccaacuccagccccaagcacaacaacacgucccgccugcccaaccagaacggcaccgugcucccgagcgaguccgccgggcuggcgaccgccagcugccccaucaccguguccagcgucguggccgccucccagcagcugugcgugacgaacacccggacccccagcuccguccgcaagcagcuguucgccugcgugcccaagaccagcccgcccgcgacggucaucuccagcgugaccagcacgugcagcagccugcccuccgugagcuccgcccccaucaccagcggccaggccccgaccaccuuccugcccgccuccaccagccaggcgcagcucuccagccagaagauggaguccuucagcgccgucccgcccaccaaggagaagguguccacgcaggaccagcccauggccaaccugugcacccccagcuccaccgccaacagcugcuccagcuccgccagcaacacccccggggcgcccgagacgcacccgagcuccagccccacccccaccuccagcaacacccaggaggaggcccagcccuccagcguguccgaccugagcccgauguccaugcccuucgccagcaacuccgagcccgccccgcucacgcugaccagcccccggauggucgccgcggacaaccaggacaccuccaaccugccccagcucgccgugcccgccccgcgcgugagccaccggaugcagccccgcggcuccuucuacagcaugguccccaacgccaccauccaccaggacccccaguccaucuucgugacgaacccggugacccugacgccgccccagggcccgcccgccgcgguccagcugagcuccgccgugaacaucaugaacgggagccagaugcacaucaaccccgccaacaagagccugccgcccaccuucggccccgccacgcuguucaaccacuucuccagccuguucgacuccagccaggugcccgccaaccagggguggggcgacgggccccucuccagccgggucgcgaccgacgccuccuucaccgugcagagcgccuuccugggcaacuccgugcugggccaccucgagaacaugcaccccgacaacagcaaggccccgggguuccgcccgcccucccagcgggucagcaccucccccgugggccugcccagcaucgaccccuccgggagcucccccagcuccagcagcgcgccgcuggccuccuucagcggcauccccggcacccgcguguuccuccaggggcccgcccccgucggcacgccguccuucaaccggcagcacuucagcccccaccccuggaccuccgccagcaacuccagcaccuccgcgccgcccacccuggggcagcccaagggcgugagcgcgucccaggaccgcaagaucccgccgcccaucgggacggagcggcuggcccgcauccggcagggcggcagcguggcccaggcccccgccgggaccuccuucgucgcgcccgugggccacagcgggaucugguccuucggcgugaacgccgucagcgaggggcucuccggcuggagccaguccgugaugggcaaccaccccaugcaccagcagcugagcgaccccagcaccuucucccagcaccagcccauggagcgcgacgacagcgggaugguggcccccuccaacaucuuccaccagcccauggccagcggcuucgucgacuucuccaaggggcugcccaucagcauguacggcgggaccaucauccccucccacccccagcucgccgacgugcccggcggcccgcuguucaacgggcugcacaaccccgaccccgcguggaaccccaugaucaaggugauccagaacagcacggagugcaccgacgcccagcagaucuggccgggcaccugggcgccccacaucgggaacaugcaccucaaguacgucaacuga

SEQ ID NO: 26644 - RNA, 1479 nt, Artificial Sequence
  derived and/or modified sequence opt1 from ANKH__Homo_sapiens__NP_473368
auggugaaguuccccgcccugacccacuacuggccgcucauccgcuuccuggucccccugggcaucaccaacaucgccaucgacuucggggagcaggcgcucaaccggggcaucgccgccgugaaggaggacgccguggagaugcuggccagcuacgggcuggcguacucccucaugaaguucuucacgggccccaugagcgacuucaagaacgucgggcugguguucgugaacuccaagcgcgaccggaccaaggccguccugugcauggugguggccggcgccaucgcggccgucuuccacacccucaucgccuacagcgaccugggcuacuacaucaucaacaagcugcaccacguggacgaguccguggggagcaagacccgccgggccuuccucuaccuggccgcguuccccuucauggacgccauggccuggacgcacgccggcauccugcucaagcacaaguacuccuuccuggucgggugcgccagcaucuccgacgugaucgcccagguggucuucguggcgauccugcuccacagccaccuggagugccgcgagccgcugcucauccccauccugucccuguacaugggcgcccucgugcggugcaccacccugugccugggguacuacaagaacauccacgacaucauccccgaccgcagcggccccgagcucggcggggacgccaccauccggaagaugcuguccuucugguggccgcuggcccucauccuggcgacgcagcgcaucagccggcccaucgucaaccuguucgugucccgcgaccucggcgggagcuccgccgccaccgaggccguggccauccugaccgcgaccuaccccgucggccacaugcccuacggcuggcugacggagauccgggccguguacccggccuucgacaagaacaaccccagcaacaagcucguguccaccagcaacaccgucaccgccgcgcacaucaagaaguucacguucgugugcauggcccugagccugacccucugcuucgucauguucuggacccccaacguguccgagaagauccugaucgacaucaucgggguggacuucgccuucgccgagcugugcgucgugccccuccgcaucuucagcuucuucccggugcccgucaccgugcgggcccaccugacgggcuggcugaugacccucaagaagaccuucgugcuggcgcccuccagcguccugcgcaucaucgugcucaucgccucccuggugguccugcccuaccugggggugcacggcgccacccucggggugggcagccugcuggccggcuucgucggggaguccacgaugguggccaucgcggccugcuacguguaccggaagcagaagaagaagauggagaacgagagcgccaccgagggcgaggacuccgccaugaccgacaugccgcccaccgaggaggucacggacaucguggagaugcgcgaggagaacgaguga

SEQ ID NO: 26645 - RNA, 2298 nt, Artificial Sequence
  derived and/or modified sequence opt1 from ANKK1__Homo_sapiens__NP_848605
auggccgccgaccccaccgagcugcgccucggcagccugccgguguucacccgggacgacuucgagggggacuggcgccuggucgcguccggcggguucagccagguguuccaggcccggcaccgccgguggcgcaccgaguacgccaucaagugcgcccccugccucccgcccgacgccgcguccagcgacgugaacuaccugaucgaggaggccgccaagaugaagaagaucaaguuccagcacaucgucuccaucuacggcgugugcaagcagccccuggggaucgugauggaguucauggccaacggcagccucgagaagguccuguccacccacagccugugcuggaagcuccgguuccgcaucauccacgagaccucccuggcgaugaacuuccugcacagcaucaagccgccccuccugcaccuggaccucaagcccggcaacauccugcuggacuccaacaugcacgugaagaucagcgacuucgggcucuccaaguggauggagcagagcacccggaugcaguacaucgagcgcuccgcccugcggggcaugcugagcuacaucccgcccgagauguuccucgaguccaacaaggcccccgggcccaaguacgacguguacagcuucgccaucgucaucugggagcugcugacccagaagaagcccuacuccggcuucaacaugaugaugaucaucauccgcguggccgcggggaugcggcccagccuccagcccgugagcgaccaguggcccuccgaggcccagcagauggucgaccugaugaagcgcugcugggaccaggacccgaagaagcggcccugcuuccuggacaucaccaucgagaccgacauccuccugagccugcuccagucccgcguggccgugcccgagagcaaggcccuggcccggaaggucuccugcaagcugagccuccgccagcccggcgaggugaacgaggacaucucccaggagcugauggacagcgacuccggcaacuaccugaagcgggcgcuccagcugagcgaccgcaagaaccuggugccgcgggacgaggagcucugcaucuacgagaacaaggucacgccccugcacuuccugguggcccagggguccguggagcagguccgccuccugcuggcccacgagguggacguggacugccagaccgccagcggcuacacgccccuccugaucgccgcgcaggaccagcagcccgaccugugcgcccuccugcuggcccacggggccgacgccaaccgcgucgacgaggacggcugggcgccgcugcacuucgccgcccagaacggcgacgacgggaccgcccggcuccugcuggaccacggcgcgugcguggacgcccaggagcgcgagggguggacgccccuccaccuggccgcccagaacaacuucgagaacgucgcccggcugcucgugucccgccaggcggaccccaaccugcacgaggccgagggcaagacgccccugcacguggccgccuacuucgggcacgucagccucgugaagcugcugaccucccagggcgccgagcucgacgcgcagcagcggaaccugcgcaccccgcugcaccucgccguggagcggggcaagguccgcgccauccagcaccuccucaagagcggggccgugcccgacgcccuggaccaguccggcuacgggccccugcacaccgcggccgcccggggcaaguaccugaucugcaagaugcugcugcgcuacggggccagccuggagcucccgacccaccagggcuggacgccccugcaccuggcggccuacaagggccaccucgagaucauccaccuccuggccgagucccacgccaacaugggggcccugggcgcggugaacuggacgccccugcaccuggccgcccggcacggggaggaggccgucgugagcgcccuccugcagugcggcgcggaccccaacgccgccgagcagagcggguggaccccgcugcaccucgccgugcagcgcuccaccuuccugagcgucaucaaccugcucgagcaccacgccaacgugcacgcgcggaacaaggugggcuggacccccgcccaccuggccgcccugaagggcaacaccgcgauccucaagguccugguggaggccggggcccagcuggacgugcaggacggcgucuccugcacgccccuccagcuggcccugcgcagccggaagcaggggaucauguccuuccucgagggcaaggagcccagcguggccacccugggcggguccaagccgggcgcggagauggagaucuga

SEQ ID NO: 26646 - RNA, 1956 nt, Artificial Sequence
  derived and/or modified sequence opt1 from ANKLE1__Homo_sapiens__NP_001265373
auguggacccccgugcgccggggcgccgccuggcuggggacccuccugggcccgggggagggcccgcccgagccccgcgggggcgcggcccacgcccacaagccgcccgccggcagccggaaguccacggaccaggccguccgcuucgggcccagccagggcaugugcuccgaggcgcggcuggcccgccggcuccgcgacgcccugcgggaggaggagcccugggccguggaggagcugcuccgcugcggggcggacccgaaccuggugcuggaggacggcgccgccgccguccaccucgccgcgggggcccggcacccccgcggccugcggugccugggcgcccuccugcgccagggcggggaccccaacgcccggagcguggaggcccugacgccccuccacguggcggccgccugggggugccgccggggccuggagcugcuccugucccagggcgccgacccggcccugcgcgaccaggacgggcuccggccccuggaccuggcgcuccagcagggccaccuggagugcgcccgcguccugcaggaccucgacacccggacccgcacccgcacccggaucggggccgagacccaggagcccgagcccgccccgggcacccccgggcugagcggccccacggacgagacccuggacuccaucgcccuccagaagcagcccugccgcggcgacaaccgggacaucgggcuggaggcggacccgggcccgcccagccugcccgugccccucgagaccguggacaagcacggguccagcgccuccccgcccggccacugggacuacagcuccgacgccagcuucgucaccgccguggagguguccggggcggaggaccccgccagcgacacgccgcccugggccggcucccugccgcccacccgccagggccugcuccacgucgugcacgccaaccagcgggugccccgcagccaggggaccgaggccgagcugaacgcgcggcugcaggcccucacccugacgccgcccaacgccgccggcuuccaguccagccccagcuccaugccccugcucgaccgcagccccgcccacuccccgccccggacccccacccccggggcgagcgacugccacugccugugggagcaccagaccuccaucgacagcgacauggccacgcuguggcucaccgaggacgaggccuccagcaccggcgggcgcgagcccgucggccccugccggcaccuccccguguccaccgugagcgaccuggagcugcugaagggccugcgcgcccuggggcccgaguucuccggccacagccucgagcuggccgcggcccugcggacggggugcauccccgacguccaggccgacgaggacgcccucgcgcagcaguucgagcagcccgaccccgcccgccgguggcgcgagggcguggugaaguccagcuucaccuaccugcugcucgacccccgggagacccaggaccugcccgcccgcgccuucucccugaccccggccgagcggcuccagacguucauccgcgcgaucuucuacgucggcaaggggacccgcgcccggcccuacgugcaccugugggaggcccugggccaccacgggcgcagccggaagcagggcucccgccggagccccacccgcuccaaggggaccgccauggagugguggcaggccggccaccuccugguggcgggcgccugggggugcacgugcugcaccguccccagccugagcuccuggcucaaggccagcgacuccuucaucccgcggaccagccgccccggcgccgagugcuggggcguggggcaccccgccuggggcgagauguucgagugcuccagcugcccgaugcugaccgcggcccccaucuccggguuccggcgcggcgucugcgugugcgugugcgucugcgugugcgugugcgucugccugugcgugugcgugugcgucuga

SEQ ID NO: 26647 - RNA, 2817 nt, Artificial Sequence
  derived and/or modified sequence opt1 from ANKLE2__Homo_sapiens__NP_055929
augcuguggccccgccucgccgccgcggagugggccgcccuggccugggagcugcucggcgccagcgugcugcugaucgcgguccgguggcucgugcgccggcuggggccgcgccccggcgggcugggccgguccgggacccccgugcccccgcccagcgccgccgccgcgcccgccuccggcgagaugaccauggacgcccuccuggcccgccugaagcuccugaaccccgacgaccugcgggaggagaucgucaaggccggccucaagugcgggccgaucacgagcaccacccgcuucaucuucgagaagaagcuggcgcaggcccugcucgagcagggcgggcggcuguccagcuucuaccaccacgaggccggcgugaccgcccugucccaggacccccagcgcauccucaagcccgccgaggggaaccccacggaccaggcgggcuucagcgaggaccgggacuucggcuacuccguggggcugaacccgcccgaggaggaggccgucaccagcaagaccugcuccgugccgcccagcgacaccgacacguaccgcgccggcgccaccgccuccaaggagccgccccuguacuacggggugugccccgucuacgaggacgugcccgcgcggaacgagcgcaucuacguguacgagaacaagaaggaggcccuccaggccgucaagaugaucaagggcagccgguucaaggccuucuccacccgcgaggacgccgagaaguucgcgcggggcaucugcgacuacuucccgagccccuccaagaccagccugccccugucccccgugaagacggcgccccucuucagcaacgaccgccugaaggacgggcugugccucagcgaguccgagaccgugaacaaggagcgggccaacagcuacaagaacccccgcacccaggaccugaccgccaagcugcggaaggccgucgagaagggcgaggaggacacguucuccgaccucaucuggagcaacccccgcuaccugaucggguccggcgacaaccccaccaucgugcaggaggggugccgcuacaacgugaugcacgucgccgccaaggagaaccaggccagcaucugccagcugacccucgacgugcuggagaacccggacuucaugcggcugauguaccccgacgacgacgaggccaugcuccagaagcgcauccgguacguggucgaccuguaccugaacacccccgacaagaugggcuacgacacgccgcuccacuucgcgugcaaguucggcaacgccgacguggugaacguccuguccagccaccaccugaucgugaagaacucccgcaacaaguacgacaagacccccgaggacgucaucugcgagcggagcaagaacaaguccguggagcucaaggagcgcauccgggaguaccugaaggggcacuacuacgugccccugcuccgcgccgaggagaccagcucccccgucaucggcgagcuguggagcccggaccagaccgccgaggccucccacgugagccgguacgggggcagcccccgcgaccccgugcugacgcugcgggcguucgccgggccccucagcccggccaaggccgaggacuuccgcaagcuguggaagaccccgccccgggagaaggccggcuuccugcaccacgucaagaaguccgaccccgagcgcggcuucgagcggguggggcgcgagcucgcgcacgagcugggcuaccccuggguggaguacugggaguuccuggggugcuucgucgaccucagcagccaggagggccugcagcggcuggaggaguaccucacccagcaggagaucgggaagaaggcccagcaggagaccggcgagcgcgaggccuccugccgggacaaggccacgaccagcggcuccaacagcaucuccgugcgcgcguuccuggacgaggacgacaugagccuggaggagaucaagaaccgccagaacgccgcccggaacaacuccccgcccaccgugggggccuucggccacacccgcugcagcgccuucccccucgagcaggaggcggaccugaucgaggccgccgagcccggcgggccccacuccagccggaacggccugugccacccccucaaccacucccgcacgcuggccgggaagcggcccaaggccccgcgcggcgaggaggcgcaccucccgcccgucagcgaccugaccguggaguucgacaagcugaaccugcagaacaucgggcgguccgugagcaagacccccgacgaguccaccaagacgaaggaccagauccucaccagccgcaucaacgccgucgagcgggaccugcuggagcccucccccgccgaccagcucggcaacgggcaccgccggaccgagagcgagaugagcgcccgcaucgccaagaugucccugagccccuccagcccgcggcacgaggaccagcuggaggugacccgcgagcccgcgcggcgccucuuccuguucggcgaggagcccuccaagcuggaccaggacgugcucgccgcccuggagugcgccgacgucgacccccaccaguucccggcggugcaccgguggaaguccgccgugcugugcuacucccccagcgaccgccaguccuggcccagccccgccgucaagggccgguucaagucccagcucccggaccugagcgggccccacuccuacagccccggccgcaacuccguggccgggagcaaccccgccaagccgggccuggggucccccggccgguacagccccgugcacggcucccagcuccgccgcauggcgcggcuggccgagcuggccgcccucuga

SEQ ID NO: 26648 - RNA, 3093 nt, Artificial Sequence
  derived and/or modified sequence opt1 from ANKMY1__Homo_sapiens__NP_001269700
auggagggcgcccacgccagccugucccucgaggacgaggugagcggggcgggcucccgccagcggccccuggaggggaagggcggggagaccccggccgccgaggagcccggcagccugaagaacuacgccgucuucgccacccgcgacguguccgcggcccccgagaaggaggaggaggaggccgagggcccccuccgggcccaggaccugcgcgagagcuacauccagcuggugcaggggguccaggaguggcaggacggcugcauguaccagggggaguucggccucaacaugaagcugggguacggcaaguucuccuggccgacgggcgagagcuaccacgggcaguucuaccgggaccacugccacggccuggggaccuacauguggcccgacggcuccagcuucaccggcaccuucuaccucucccaccgcgagggguacggcacgauguacaugaagacccggcuguuccaggggcuguacaaggcggaccagcgcuucggccccgggguggagaccuaccccgacggcagccaggacgugggccucugguuccgggagcagcugaucaagcugugcacccagaucccguccggguucagccuccugcgcuaccccgaguucuccagcuucaucacgcacucccccgcccggaucagccuguccgaggaggagaagaccgaguggggccuccaggaggggcaggaccccuucuucuacgacuacaagcgcuuccugcugaacgacaaccucacccugccgcccgagauguacgucuacagcaccaacagcgaccaccuccccaugacguccagcuuccggaaggagcuggacgcccgcaucuuccugaacgagaucccgcccuucguggaggacggcgagcccugguucaucaucaacgagacgccccugcucgugaagauccagaagcagaccuacaaguuccggaacaagcccgcccacaccuccuggaacaugggggccauccuggagggcaagcgcagcggcuucgcgccgugcgggcccaaggagcagcuguccauggagaugauccucaaggccgaggagggcaaccacgaguggaucugccggauccugaaggacaacuucgccagcgccgacgucgccgacgcgaagggguacaccgugcuggccgccgccgccacccacugccacaacgacaucgugaaccuccugcuggacugcggcgcggacgucaacaagugcuccgacgaggggcucaccgcccugagcaugugcuuccugcuccacuaccccgcccaguccuucaagcccaacguggccgagcgcaccaucccggagccccaggagccgcccaaguuccccgugguccccauccugagcuccagcuucauggacacgaaccuggagucccucuacuacgaggugaacgugcccagccagggcuccuacgagcugcggccgccgcccgcgccccugcuccugccccgcgucagcggcucccacgagggcgggcacuuccaggacaccgggcagugcggcggcagcaucgaccaccgguccagcagccugaagggggacagcccccucgugaagggcucccuggggcacguggaguccggccuggaggacguccuggggaacaccgaccgcggcagccucugcuccgccgagaccaaguucgagagcaacgugugcgugugcgacuucuccaucgagcugagccaggccaugcuggagcgcuccgcccagagccacucccuccugaagauggccagccccucccccugcacgagcuccuucgacaagggcaccaugcggcgcauggcgcugagcaugaucgagcggcgcaagcgguggcgcaccaucaagcuccugcugcggcgcggggccgacccgaaccucugcugcguccccaugcagguccuguuccuggccgugaaggccggcgacguggacggggugcggcuccugcuggagcacggcgcccgcaccgacaucugcuucccgccccagcucuccacgcugacgccccugcacaucgcggccgcccuccccggggaggagggcguccagaucguggagcugcugcuccacgccaucaccgacguggacgccaaggcgagcgacgaggacgacaccuacaagcccggcaagcuggaccugcuccccagcucccugaagcugagcaacgagccggggccgccccaggccuacuacuccaccgacaccgcccuccccgaggagggcgggcggaccgcccugcacauggccugcgagcgcgaggacgacaacaagugcgcgcgggacaucguccgccugcuccugagccacggcgccaaccccaaccugcucugguccgggcacagcccccugucccugagcaucgccuccggcaacgagcucguggugaaggagcugcugacccagggcgccgaccccaaccucccccugacgaaggggcugggcagcgcgcucugcgucgccugcgaccugaccuacgagcaccagcggaacauggacuccaagcuggcccucaucgaccgccugaucagccacggggccgacauccugaagccggugaugcuccggcagggcgagaaggaggccguggggaccgcggucgacuacggcuacuuccgcuucuuccaggaccggcgcaucgcccgcugccccuuccacacccugaugcccgccgagcgggagaccuuccuggcccgcaagcggcuccuggaguacaugggccugcagcuccgccaggccguguucgcgaaggagucccagugggacccgacguggcuguaccugugcaagcgggccgagcucauccccagccaccgcaugaagaagaaggggcccucccugccccggggccuggacgugaaggagcaggggcagaucccguucuucaaguucugcuaccagugcggccgcagcaucggcguccggcuccugcccugcccccgcugcuacgggauccugaccugcuccaaguacugcaagaccaaggccuggaccgaguuccacaagaaggacugcggcgaccucguggccaucgugacgcagcuggagcaggucagccggcgccgggaggaguuccaguga

SEQ ID NO: 26649 - RNA, 663 nt, Artificial Sequence
  derived and/or modified sequence opt1 from ANKRD10__Homo_sapiens__NP_001273650
augagcgccgccggcgcgggggccggcguggaggccggguucuccagcgaggagcugcucucccugcgcuucccccugcaccgggccugccgcgacggcgaccucgccacccugugcagccugcuccagcagaccccgcacgcgcaccuggccuccgaggacagcuucuacggguggacgcccguccacugggccgcccacuucggcaagcuggagugccucgugcagcuggugcgggcgggcgccacccugaacgucuccaccacccgcuacgcccagacgcccgcccacaucgccgcguucgggggccacccccagugccucguguggcugauccaggccggggccaacaucaacaagcccgacugcgagggcgagacccccauccacaaggccgcccggagcgggucccuggagugcaucagcgcgcucguggccaacggcgcccacgucgaguucaucucccagagcuccgugcacagcugccugcccggcgagcugcagcacggggugaccuucgaccccuccguccucauccagugccugaagccggagaagugccaguggcccgacagcucccgccacugcaccaaccccggcuucccccgggugugcccggugagccuggagccgcccgagcucuccagcgagcccuuccuguga

SEQ ID NO: 26650 - RNA, 7992 nt, Artificial Sequence
  derived and/or modified sequence opt1 from ANKRD11__Homo_sapiens__NP_037407
augcccaagggcgggugccccaaggcgccccagcaggaggagcugccccucagcuccgacaugguggagaagcagaccggcaagaaggacaaggacaaggucagccugaccaagacccccaagcuggagcgcggggacggcgggaaggaggugcgggagcgcgccagcaagcggaagcucccguucaccgccggcgccaacggcgagcagaaggacagcgacaccgagaagcaggggcccgagcgcaagcggaucaagaaggagcccgugacccgcaaggccggccugcuguucgggaugggccucagcgggauccgggccggcuacccccugagcgagcgccagcaggucgcccugcucaugcagaugaccgccgaggagagcgccaacagcccgguggacaccacccccaagcaccccagccagagcaccgugugccagaagggcacgcccaacagcgccagcaagaccaaggacaaggucaacaagcggaacgagcgcggggagacccggcugcaccgcgccgccauccggggcgacgcccgccggaucaaggagcugaucagcgagggggccgacgugaacgugaaggacuucgccggcuggaccgcccuccacgaggccugcaaccgcggcuacuacgacgucgccaagcagcugcuggccgccggggccgaggugaacacgaagggccucgacgacgacaccccgcugcacgacgccgccaacaacgggcacuacaagguggucaagcugcuccugcgguacggcgggaacccccagcagagcaaccgcaagggcgagacgccccucaagguggccaacagccccaccauggugaaccuccugcugggcaaggggacguacaccagcuccgaggagagcuccaccgagagcagcgaggaggaggacgccccguccuucgcccccagcuccagcgucgacggcaacaacaccgacuccgaguucgagaaggggcucaagcacaaggcgaagaaccccgagccccagaaggccacggccccggugaaggacgaguacgaguucgacgaggacgacgagcaggaccgggugccgcccgucgacgacaagcaccuccugaagaaggacuaccgcaaggagaccaagagcaacuccuucaucagcauccccaagauggaggugaaguccuacaccaagaacaacaccaucgccccgaagaaggccagccaccggauccucuccgacacgagcgacgaggaggacgcguccgugaccgucggcaccggggagaagcugcgccugagcgcccacaccauccuccccggcuccaagacgcgcgagcccagcaacgccaagcagcagaaggagaagaacaaggugaagaagaagcggaagaaggagaccaagggccgcgaggugcgguucgggaagcgcuccgacaaguucugcagcuccgagagcgagagcgaguccagcgaguccggcgaggacgaccgggacagccugggguccagcggcugccugaaggggagcccccugguccugaaggacccgagccuguucuccagccucuccgccagcuccaccagcucccacggcagcuccgcggcccagaagcagaaccccagccacaccgaccagcacacgaagcacuggcgcaccgacaacuggaagaccaucagcucccccgccuggagcgagguguccagccuguccgacagcacccggacgcgccugaccuccgagagcgacuacuccagcgagggcuccagcgucgagucccucaagccggugcggaagcgccaggagcaccggaagcgcgccagccuguccgagaagaagucccccuuccuguccagcgccgagggggcggugcccaagcucgacaaggagggcaaggucgugaagaagcacaagaccaagcacaagcacaagaacaaggagaaggggcagugcuccaucagccaggagcugaagcucaagagcuucaccuacgaguacgaggacuccaagcagaaguccgacaaggccauccuccuggagaacgaccuguccaccgagaacaagcucaaggugcugaagcacgaccgggaccacuucaagaaggaggagaagcugagcaagaugaagcuggaggagaaggaguggcuguucaaggacgagaagucccugaagcgcaucaaggacacgaacaaggacaucagccgguccuuccgcgaggagaaggaccggagcaacaaggccgagaaggagcgcucccugaaggagaagucccccaaggaggagaagcuccggcuguacaaggaggagcgcaagaagaaguccaaggaccgcccgagcaagcuggagaagaagaacgaccucaaggaggacaagaucuccaaggagaaggagaagaucuucaaggaggacaaggagaagcugaagaaggagaaggucuaccgggaggacagcgccuucgacgaguacugcaacaagaaccaguuccuggagaacgaggacaccaaguucucccucagcgacgaccagcgcgaccggugguucuccgaccugagcgacuccagcuucgacuucaagggcgaggacagcugggacucccccgugaccgacuaccgcgacaugaaguccgacuccguggccaagcugauccucgagaccgucaaggaggacagcaaggagcggcgccgggacucccgcgcgcgggagaagcgcgacuaccgggagcccuucuuccgcaagaaggaccgggacuaccuggacaagaacagcgagaagcgcaaggagcagacggagaagcacaaguccgugcccggcuaccugagcgagaaggacaagaagcggcgcgaguccgccgaggccgggcgggaccgcaaggacgcccucgagagcugcaaggagcggcgcgacggccgggccaagccggaggaggcgcaccgcgaggagcugaaggagugcgggugcgaguccggcuucaaggacaagagcgacggggacuucggcaagggccuggagcccugggagcgccaccaccccgcccgggagaaggagaagaaggacgggcccgacaaggagcgcaaggagaagaccaagccggagcgguacaaggagaaguccagcgacaaggacaaguccgagaaguccauccucgagaagugccagaaggacaaggaguucgacaagugcuucaaggagaagaaggacaccaaggagaagcacaaggacacccacggcaaggacaaggagcgcaaggccucccuggaccaggggaaggagaagaaggagaaggccuuccccggcaucaucagcgaggacuucuccgagaagaaggacgacaagaaggggaaggagaaguccugguacaucgcggacaucuucacggacgagagcgaggacgaccgggacuccugcaugggcagcggcuucaagaugggggaggccuccgaccugccccgcaccgacggccuccaggagaaggaggaggggcgggaggccuacgccagcgaccgccaccggaaguccagcgacaagcagcaccccgagcgccagaaggacaaggagccgcgggaccgccggaaggaccgcggcgccgcggacgccgggcgggacaagaaggagaagguguucgagaagcacaaggagaagaaggacaaggaguccaccgagaaguacaaggaccgcaaggaccgggccagcgucgacuccacccaggacaagaagaacaagcagaagcugcccgagaaggccgagaagaagcacgccgcggaggacaaggccaagagcaagcacaaggagaaguccgacaaggagcacagcaaggagcgcaaguccagccgguccgccgacgccgagaagucccugcucgagaagcuggaggaggaggcccugcacgaguaccgcgaggacuccaacgacaagaucagcgagguguccagcgacagcuucacggaccgcggccaggagcccggccucaccgcguuccuggagguguccuucaccgagcccccgggggacgacaagccccgggagagcgccugccugcccgagaagcucaaggagaaggagcgccaccggcacuccagcuccagcuccaagaagucccacgaccgcgagcgggccaagaaggagaaggccgagaagaaggagaagggcgaggacuacaaggagggcgggucccgcaaggacagcgggcaguacgagaaggacuuccuggaggcggacgccuacggcgucuccuacaacaugaaggccgacaucgaggacgagcuggacaagaccaucgagcuguucagcacggagaagaaggacaagaacgacuccgagcgggagcccagcaagaagaucgagaaggagcugaagccguacggcuccagcgccaucaacauccugaaggagaagaagaagcgcgagaagcaccgggagaaguggcgcgacgagaaggagcggcaccgcgaccggcacgccgacgggcuccugcgccaccaccgggacgagcugcuccgccaccaccgggacgagcagaagcccgcgacccgcgacaaggacagcccgccccgggugcugaaggacaagucccgcgacgagggcccccggcugggggacgccaagcucaaggagaaguucaaggacggcgccgagaaggagaagggcgaccccgugaagauguccaacgggaacgacaaggucgcccccagcaaggacccgggcaagaaggacgcccgcccccgcgagaagcugcugggggacggcgaccucaugaugaccagcuucgagcggaugcugucccagaaggaccuggagaucgaggagcgccacaagcggcacaaggagcgcaugaagcagauggagaagcuccggcaccgcagcggggaccccaagcugaaggagaaggcgaagcccgccgacgacggccggaagaagggccuggacaucccggccaagaagccgcccgggcucgacccgcccuucaaggacaagaagcugaaggaguccacccccaucccgcccgccgccgagaacaagcugcaccccgcgagcggcgccgacuccaaggacuggcucgccgggccccacaugaaggaggugcugcccgccagcccccgcccggaccagucccggcccacgggcgugcccacccccaccagcguccuguccugcccgagcuacgaggaggugaugcacacgccccggacgcccuccugcagcgccgacgacuacgcggaccucguguucgacugcgccgacucccagcacagcacccccgucccgaccgcccccaccuccgccugcagccccuccuucuucgaccgguucagcguggcgagcuccgggcugagcgagaacgccucccaggccccggcccgcccccugagcacgaaccucuaccgguccgugagcgucgacauccgccggacccccgaggaggaguucuccgugggcgacaagcuguuccgccagcagagcgugcccgccgcguccagcuacgacuccccgaugccgcccagcauggaggaccgggcgccccugccgcccguccccgccgagaaguucgccugccucucccccggcuacuacagccccgacuacgggcugcccucccccaagguggacgcccugcacugcccgcccgcggccguggucaccgugacccccagccccgagggcguguucuccagccuccaggccaagcccucccccagcccccgcgccgagcugcugguccccagccucgagggggcccugcccccggaccuggacacguccgaggaccagcaggcgaccgccgccaucaucccgcccgagcccagcuaccucgagccgcuggacgagggccccuucuccgccgugaucaccgaggagcccguggagugggcgcacccgagcgagcaggcccuggccuccagccucaucgggggcaccuccgagaaccccgucagcuggcccgugggcuccgaccugcugcucaagagcccccagcgguucccggagucccccaagcgcuucugccccgccgacccccugcacagcgccgcgccggggcccuucuccgccagcgaggcccccuaccccgccccgcccgccucccccgcgcccuacgcccugccgguggccgagcccggccucgaggacgucaaggacgggguggacgccgugcccgccgcgaucagcacguccgaggccgcccccuacgccccgcccagcggccuggaguccuucuucagcaacugcaagagccugcccgaggcgccccucgacgucgccccggagcccgccugcguggccgccguggcgcaggucgaggcccugggcccccuggagaacuccuuccucgacgggagccgcggccugucccaccugggccagguggagccggugcccugggccgacgccuucgccggccccgaggacgaccucgaccuggggcccuucagccugccggagcucccccugcagaccaaggacgcggccgacggcgaggccgagcccgucgaggagucccuggcgccgcccgaggagaugccgcccggcgcccccggggugaucaacggcggggacgucagcaccgugguggcggaggagccgcccgcccugccgcccgaccaggccuccacccggcuccccgccgagcuggagcccgagcccagcggcgagcccaagcuggacgucgcccucgaggcggccguggaggccgagaccgugccggaggagcgcgcccgcggggaccccgacuccagcgucgagcccgcgcccgugccgcccgagcagcgcccccugggcuccggcgaccagggggccgaggccgaggggccgcccgccgccagccugugcgcgcccgacgggcccgcccccaacacgguggcccaggcccaggccgcggacggcgccgggcccgaggacgacaccgaggccucccgggccgccgcgcccgccgagggcccgcccggcgggauccagcccgaggccgccgagcccaagcccaccgcggaggcccccaaggcgccccgcgucgaggagaucccccagcggaugacccgcaaccgggcccagaugcucgccaaccagagcaagcaggggcccccgcccuccgagaaggagugcgcgcccacgcccgcccccgugacccgcgccaaggcccggggcagcgaggacgacgacgcccaggcgcagcacccccgcaagcggcgcuuccagcgguccacccagcagcugcagcagcagcugaacaccagcacgcagcagacccgcgaggugauccagcagacccucgccgccaucgucgacgccaucaagcuggacgccaucgagcccuaccacuccgaccgggcgaaccccuacuucgaguaccugcagauccgcaagaagaucgaggagaagcggaagauccucugcugcaucaccccgcaggcgccccagugcuacgccgaguacgugacguacaccggcagcuaccugcuggacgggaagccccucagcaagcugcacauccccgugaucgccccgccgcccucccuggcggagccccucaaggagcuguuccgccagcaggaggccguccggggcaagcugcgccuccagcacagcaucgagcgcgagaagcugaucguguccugcgagcaggagauccugcgggugcacugccgcgccgcccggaccaucgccaaccaggcggucccguucagcgccugcaccaugcuccuggacuccgagguguacaacaugccccuggagagccagggcgacgagaacaaguccgugcgcgaccgguucaacgcccgccaguucaucagcuggcuccaggacgucgacgacaaguacgaccggaugaagacgugccugcugaugcgccagcagcacgaggccgccgcgcucaacgccgugcagcggauggaguggcagcugaaggugcaggagcuggaccccgccgggcacaagucccucugcgucaacgaggugccgagcuucuacgugcccauggucgacgugaacgacgacuucgugcugcugcccgccuga

SEQ ID NO: 26651 - RNA, 6120 nt, Artificial Sequence
  derived and/or modified sequence opt1 from ANKRD12__Homo_sapiens__NP_001190985
augcccaagagcggcuucaccaagcccauccagagcgagaacagcgacagcgacagcaacaugguggagaagcccuacgggcgcaagagcaaggacaagaucgcgagcuacagcaagacccccaagaucgagcgcagcgacgugagcaaggagaugaaggagaaguccuccaugaagcgcaagcugcccuucaccaucagccccucccggaacgaggagcgcgacagcgacaccgagaaggagggccccgagaagaagaagaccaagaaggaggccgggaacaagaaguccacccccgugagcauccuguucggcuacccccuguccgagcggaagcagauggcgcugcucaugcagaugaccgcccgcgacaacagccccgacuccacccccaaccaccccagccagaccacccccgcccagaagaagacgcccagcuccagcucccggcagaaggacaaggugaacaagcgcaacgagcgcggggagaccccgcugcacauggccgccauccggggcgacgugaagcaggucaaggagcugaucagccucggcgcgaacgugaacgucaaggacuucgccggguggacgccccugcacgaggccugcaacgugggcuacuacgacguggccaagauccugaucgcggccggggccgacgucaacacccagggccucgacgacgacaccccgcugcacgacuccgccagcuccgggcaccgggacaucgugaagcugcuccugcgccacggcggcaaccccuuccaggccaacaagcacggggagcggcccguggacgucgcggagaccgaggagcuggagcuccugcugaagcgcgaggugccccucagcgacgacgacgaguccuacaccgacagcgaggaggcccaguccgugaaccccagcuccgucgacgagaacaucgacagcgagaccgagaaggacucccugaucugcgagagcaagcagauccugcccuccaagacgccccuccccagcgcccuggacgaguacgaguucaaggacgacgacgacgaggagaucaacaagaugaucgacgaccggcacauccugcgcaaggagcagcggaaggagaacgagcccgaggccgagaagacccaccucuucgccaagcaggagaaggcguucuacccgaaguccuucaagagcaagaagcagaagcccagccgcgugcuguacuccagcaccgaguccagcgacgaggaggcccugcagaacaagaagaucuccaccagcugcuccgugauccccgagacgagcaacuccgacaugcagaccaagaaggaguacgucgugagcggcgagcacaagcagaaggggaaggugaagcggaagcucaagaaccagaacaagaacaaggagaaccaggagcugaagcaggagaaggagggcaaggagaacacccgcaucaccaaccugacggucaacaccggccucgacugcuccgagaagacccgggaggaggggaacuuccgcaagagcuucucccccaaggacgacaccagccugcaccuguuccacaucuccacgggcaagagcccgaagcacuccugcgggcucagcgagaagcagagcacgccccucaagcaggagcacaccaagaccugccugucccccggcagcuccgagaugagccuccagccggaccuggugcgcuacgacaacaccgaguccgaguuccugcccgagagcuccagcgugaaguccugcaagcacaaggagaaguccaagcaccagaaggacuuccaccucgaguucggggagaaguccaacgccaagaucaaggacgaggaccacagccccaccuucgagaacagcgacugcacccugaagaagauggacaaggagggcaagacccugaagaagcacaagcucaagcacaaggagcgggagaaggagaagcacaagaaggagaucgagggcgagaaggagaaguacaagacgaaggacagcgccaaggagcugcagcgcuccgucgaguucgaccgggaguucuggaaggagaacuucuucaagagcgacgagaccgaggaccuguuccucaacauggagcacgagucccugacccuggagaagaaguccaagcucgagaagaacaucaaggacgacaaguccaccaaggagaagcacgugagcaaggagcgcaacuucaaggaggagcgggacaagaucaagaaggagagcgagaaguccuuccgcgaggagaagaucaaggaccugaaggaggagcgggagaacauccccaccgacaaggacagcgaguucacgucccuggggaugagcgccaucgaggaguccaucggccugcaccucgucgagaaggagaucgacaucgagaagcaggagaagcacaucaaggagagcaaggagaagccggagaagcgcucccagaucaaggagaaggacaucgagaagauggagcggaagaccuucgagaaggagaagaagaucaagcacgagcacaagagcgagaaggacaagcuggaccuguccgagugcguggacaagaucaaggagaaggacaagcucuacagccaccacaccgagaagugccacaaggagggggagaaguccaagaacaccgcggccaucaagaagacggacgaccgcgagaagucccgggagaagauggaccgcaagcacgacaaggagaagcccgagaaggagcggcaccuggccgaguccaaggagaagcaccugauggagaagaagaacaagcagagcgacaacuccgaguacagcaaguccgagaagggcaagaacaaggagaaggaccgcgagcucgacaagaaggagaagucccgggacaaggaguccaucaacaucaccaacagcaagcacauccaggaggagaagaaguccuccaucguggacgggaacaaggcccagcacgagaagccccugagccugaaggagaagaccaaggacgagccccucaagaccccggacggcaaggagaaggacaagaaggacaaggacaucgaccgcuacaaggagcgggacaagcacaaggacaagauccagaucaacucccugcugaagcucaagagcgaggccgacaagcccaagcccaaguccagccccgcguccaaggacacgcgcccgaaggagaagcggcuggucaacgacgaccugaugcagaccagcuucgagcgcaugcucucccugaaggaccuggagaucgagcaguggcacaagaagcacaaggagaagaucaagcagaaggagaaggagcgccuccggaaccgcaacugccuggagcugaagaucaaggacaaggagaagaccaagcacacccccacggagagcaagaacaaggagcucacccgguccaagagcuccgaggugaccgacgccuacaccaaggagaagcagcccaaggacgccgugagcaaccgcucccagagcgucgacacgaagaacgugaugacccugggcaaguccagcuucguguccgacaacagccugaaccggagcccccgcuccgagaacgagaagccggggcucagcucccggagcgucuccaugaucagcguggccuccagcgaggacuccugccacaccaccgugacgacgccccggccgcccgucgaguacgacagcgacuucaugcuggaguccagcgagucccagaugagcuucucccagagcccguuccuguccaucgccaagagccccgcccuccacgagcgggagcuggacucccuggccgaccuccccgagcgcaucaagcccccguacgccaaccggcugagcaccagccaccuccgcuccagcuccguggaggacgugaagcucaucaucagcgagggccggcccaccaucgagguccgccggugcuccaugcccagcgugaucugcgagcacacgaagcaguuccagaccaucuccgaggagagcaaccaggggucccugcugaccgugccgggcgacaccagccccucccccaagcccgaggucuucagcaacgugccggagcgcgaccucuccaacgugagcaacauccacuccagcuucgccacgucccccaccggggcgagcaacuccaaguacgucagcgccgaccggaaccugaucaagaacaccgcccccgugaacaccgugauggacagccccguccaccuggagccguccagccaggugggcgugauccagaacaaguccugggagaugcccgucgaccgccucgagacgcugagcacccgggacuucaucugccccaacuccaacauccccgaccaggagagcucccugcagagcuucugcaacuccgagaacaaggugcucaaggagaacgccgacuuccugagccugcgccagaccgagcucccgggcaacuccugcgcccaggaccccgcgagcuucaugccgccccagcagccgugcuccuuccccagccagucccugagcgacgccgaguccaucagcaagcacaugagccuguccuacguggccaaccaggagcccgggauccuccagcagaagaacgccguccagaucaucagcuccgcccuggacaccgacaacgagagcacgaaggacaccgagaacaccuucgugcugggcgacgugcagaagaccgacgcguucguccccguguacuccgacagcaccauccaggaggccuccccgaacuucgagaaggccuacacgcuccccgugcugcccagcgagaaggacuucaacggguccgacgccagcacccagcugaacacccacuacgcguucuccaagcucaccuacaagagcuccagcggccacgaggucgagaacuccacgaccgacacccaggugaucagccacgagaaggagaacaagcuggagucccuggugcucacccaccugagccggugcgacuccgaccugugcgagaugaacgccggcaugcccaaggggaaccucaacgagcaggacccgaagcacugccccgagagcgagaagugccugcugagcaucgaggacgaggagucccagcagagcauccucuccagccuggagaaccacucccagcagagcacgcagcccgagaugcacaaguacggccagcuggucaagguggagcucgaggagaacgccgaggacgacaagaccgagaaccagaucccccagcgcaugacccgcaacaaggccaacaccauggccaaccaguccaagcagauccuggcgagcugcacgcugcucuccgagaaggacagcgaguccagcuccccgcgggggcgcauccggcugaccgaggacgacgacccccagauccaccacccccgcaagcggaaggugagccgcgucccgcagcccguccaggugucccccagccugcuccaggccaaggagaagacccagcagucccuggccgccaucgucgacagccugaagcucgacgagauccagcccuacuccagcgagcgggccaacccguacuucgaguaccugcacauccgcaagaagaucgaggagaagcggaagcugcucugcagcgugaucccccaggcgccccaguacuacgacgaguacgugaccuucaacggcuccuaccugcuggacgggaacccccucagcaagaucugcaucccgacgaucacgccgccgcccucccugagcgacccgcugaaggagcuguuccgccagcaggaggucgugcggaugaagcugcgccugcagcacuccaucgagcgggagaagcucaucgugagcaacgagcaggagguccugcgcgugcacuaccgggccgcccgcacccuggccaaccagacccuccccuucuccgccugcacgguccugcuggacgcggagguguacaacgugccccucgacagccaguccgacgacagcaagaccuccguccgggaccgcuucaacgcccggcaguucaugagcuggcugcaggacguggacgacaaguucgacaagcugaagaccugccugcucaugcgccagcagcacgaggccgccgcgcugaacgccgugcagcgccuggaguggcagcucaagcugcaggagcuggaccccgccaccuacaaguccaucagcaucuacgagauccaggaguucuacgucccgcucguggacgugaacgacgacuucgagcugacgcccaucuga

SEQ ID NO: 26652 - RNA, 2979 nt, Artificial Sequence
  derived and/or modified sequence opt1 from ANKRD18A__Homo_sapiens__NP_671728
augcgcaagcuguucagcuucggccggcgccucgggcaggcccugcuguccagcauggaccaggaguacgccggccccggguacgacauccgggacugggagcuccgcaagauccaccgggcggccaucaagggcgacgccgccgagguggagcgcugccugacccggcgcuuccgggaccuggacgcccgcgaccggaaggaccgcaccguccuccaccuggcgugcgcccacgggcggguccagguggugacgcugcuccugcaccgccggugccagaucgacaucugcgaccgccugaaccggaccccgcucaugaaggccgugcacucccaggaggaggccugcgcgaucgugcugcuggagugcggcgccaaccccaacaucgaggacaucuacggcaacaccgcccuccacuacgccgucuacaacaaggggaccagccuggccgagcgccugcucucccaccacgcgaacaucgaggcccugaacaaggagggcaacacgccccugcuguucgccaucaacagccggcgccagcacaugguggaguuccugcugaagaaccaggccaacauccacgccguggacaacuucaagcggaccgcgcucauccuggccguccagcacaaccuguccagcaucgugacccuccugcugcagcagaacauccgcaucuccagccaggacauguucgggcagaccgccgaggacuacgcccucugcuccgaccugcgcagcauccggcagcagauccuggagcacaagaacaagaugcucaagaaccaccuccgcaacgacaaccaggagacggccgcgaugaagcccgccaaccugaagaagcggaaggagcgcgccaaggccgagcacaaccucaagguggccuccgaggagaagcaggagcggcugcagcgcagcgagaacaagcagccgcaggacucccagagcuacggcaagaagaaggacgcgauguacgggaacuucaugcugaagaaggacaucgccaugcucaaggaggagcuguacgccaucaagaacgacucccugcggaaggagaagaaguacauccaggagaucaagagcaucaccgagaucaacgccaacuucgagaaguccguccgccucaacgagaagaugaucaccaagaccguggcgcgguacagccagcagcugaacgaccugaaggccgagaacgcccgccucaacagcgagcuggagaaggagaagcacaacaaggagcggcuggaggccgagguggagucccuccacagcucccuggccacggcgaucaacgaguacaacgagaucgucgagcgcaaggaccuggagcuggugcucuggcgggccgacgacgugagccgccacgagaagaugggcuccaacaucagccagcugaccgacaagaacgagcugcucaccgagcagguccacaaggcccgggugaaguucaacacccugaagggcaagcugcgcgagacgcgggacgcccuccgcgagaagacccuggcccugggguccgugcagcucgaccugcggcaggcgcagcaccgcaucaaggagaugaagcagaugcaccccaacggcgaggccaaggagagccaguccaucgggaagcagaacagccuggaggagcgcauccggcagcaggagcucgagaaccugcugcucgagcgccagcuggaggacgcccggaaggagggcgacaacaaggagaucgucaucaacauccaccgcgacugccuggagaacggcaaggaggaccuccuggaggagcggaacaaggagcugaugaaggaguacaacuaccucaaggagaagcugcugcagugcgagaaggagaaggccgagcgcgaggugaucgugcgggaguuccaggaggagcucgucgaccaccugaagaccuucuccaucagcgagagcccccuggaggggaccucccacugccacaucaaccucaacgagacguggaccuccaagaagaagcuguuccagguggagauccagcccgaggagaagcacgaggaguuccgcaagcuguucgagcucaucagccugcugaacuacaccgccgaccagauccggaagaagaaccgcgagcucgaggaggaggcgaccggcuacaagaagugccuggagaugacgaucaacaugcugaacgccuucgccaacgaggacuucuccugccacggggaccucaacaccgaccagcugaagauggacauccuguucaagaagcucaagcagaaguucaacgaccuggucgccgagaaggaggcggugagcuccgagugcgugaaccuggccaaggacaacgagguccuccaccaggagcugcugagcaugcggaacgugcaggagaagugcgagaagcucgagaaggacaagaagaugcuggaggaggaggugcugaaccucaagacccacauggagaaggacauggucgagcugggcaagcugcaggaguacaagagcgagcucgacgagcgcgccgugcaggagaucgagaagcuggaggagauccaccuccagaagcaggccgaguacgagaagcagcuggagcagcugaacaaggacaacaccgccucccugaagaagaaggagcucacgcugaaggacguggagugcaaguucagcaagaugaagaccgcguacgaggaggucaccaccgagcuggaggaguucaaggaggccuucgccggggccgugaaggccaacaacuccaugagcaagaagcucaugaaguccgacaagaagaucgcggugaucagcacgaagcuguucaccgagaagcagcggaugaaguacuuccuguccacccucccgacccgccccgagcccgagcugcccugcgucgagaaccugaacagcaucgagcucaaccggaaguacaucccgaagacggccauccgcauccccaccuccaacccccagaccagcaacaacugcaagaacuuccugaccgaggugcugcucugcuga

SEQ ID NO: 26653 - RNA, 960 nt, Artificial Sequence
  derived and/or modified sequence opt1 from ANKRD1__Homo_sapiens__NP_055206
augauggugcugaaggucgaggagcucgugaccggcaagaagaacgggaacggcgaggccggggaguuccugcccgaggacuuccgcgacggcgaguacgaggccgcggugacccuggagaagcaggaggaccucaagacgcugcuggcccacccggucacccucggggagcagcaguggaaguccgagaagcagcgggaggccgagcugaagaagaagaagcuggagcagcgcagcaagcucgagaaccuggaggaccuggagaucaucauccagcucaagaagcggaagaaguaccgcaagaccaaggugcccguggucaaggagcccgagcccgagaucaucaccgagccgguggacgugcccacguuccugaaggccgcccuggagaacaagcuccccgucguggagaaguuccugagcgacaagaacaaccccgacgugugcgacgaguacaagcggaccgcgcugcaccgcgccugccucgagggccaccuggccaucgucgagaagcugauggaggccggcgcgcagaucgaguuccgggacaugcucgaguccaccgccauccacugggccagccgcgggggcaaccuggacgugcugaagcuccugcugaacaagggggccaagaucuccgcccgggacaagcuccugagcaccgcgcugcacguggccguccgcacgggccacuacgagugcgccgagcaccucaucgccugcgaggccgaccugaacgcgaaggaccgggagggggacaccccgcugcacgacgccgugcgccucaaccgguacaagaugauccgccugcugaucauguacggcgccgaccucaacaucaagaacugcgccggcaagacccccauggaccuggugcugcacuggcagaacgggaccaaggccaucuucgacucccuccgggagaacagcuacaagacgucccgcaucgcgaccuucuga

SEQ ID NO: 26654 - RNA, 918 nt, Artificial Sequence
  derived and/or modified sequence opt1 from ANKRD23__Homo_sapiens__NP_659431
auggacuucaucagcauccagcagcugguguccggcgagcgcgucgaggggaaggugcucggcuucgggcacggcgugcccgacccgggggccuggcccagcgacuggcggcgcggcccccaggaggccgucgcgcgggagaagcugaagcuggaggaggagaagaagaagaagcucgagcgcuucaacuccacccgguucaaccuggacaaccuggccgaccucgagaaccuggugcagcgccggaagaagcgccugcggcaccgcgugcccccgcggaagcccgagccccucgucaagccccagagccaggcccagguggagccggugggccuggagauguuccugaaggccgccgcggagaaccaggaguaccucaucgacaaguaccugaccgacgggggcgaccccaacgcccacgacaagcugcaccgcacggcccuccacugggccugccugaaggggcacucccagcuggucaacaagcuccugguggcgggcgccaccguggacgcccgggaccugcucgaccgcacccccgucuucugggccugccgcgggggccaccuggugauccugaagcagcuccugaaccagggcgcccgggugaacgcgcgggacaagaucgggagcacgccccugcacgucgccgugcgcacccggcacccggacugccucgagcaccugaucgagugcggcgcccaccugaacgcccaggacaaggagggggacaccgcccuccacgaggcggugcgccacggcuccuacaaggccaugaagcugcugcuccuguacggcgccgagcuggggguccggaacgccgccagcgugacccccgugcagcucgcgcgcgacuggcagcgcggcauccgggaggcccugcaggcccacgucgcccacccccgcacccggugcuga

SEQ ID NO: 26655 - RNA, 5133 nt, Artificial Sequence
  derived and/or modified sequence opt1 from ANKRD26__Homo_sapiens__NP_055730
augaagaagaucuucagcaagaagggcgaguccccccuggggagcuucgcccgccggcagcgcuccagcgccggcgggggcggggagccgggcgagggcgcguacucccagcccggguaccacgugcgggaccgcgaccucggcaagauccacaaggccgccagcgccgggaacgucgccaaggugcagcagauccugcugcuccggaagaacggccugaacgaccgcgacaagaugaaccggaccgcgcugcaccucgccugcgccaacgggcaccccgagguggucacccugcugguggaccgcaagugccagcucaacgugugcgacaacgagaaccggacggcccugaugaaggcgguccagugccaggaggagaagugcgccaccauccugcucgagcacggcgccgaccccaaccuggccgacgugcacggcaacaccgcccugcacuacgcgguguacaacgaggacaucuccgucgccaccaagcuccugcuguacgacgccaacaucgaggccaagaacaaggacgaccucacgccgcugcugcucgccgugagcgggaagaagcagcagaugguggaguuccugaucaagaagaaggcgaacgucaacgccguggacaagcuggaguccagccaccagcucaucuccgaguacaaggaggagcgcauccccaagcacagcucccagaacagcaacuccguggacgagagcuccgaggacagccugucccggcugagcggcaagcccggggucgacgacagcuggcccaccuccgacgacgaggaccucaacuucgacaccaagaacgugccgaagcccagccuggccaagcugaugaccgccucccagcagagccgcaagaaccucgaggccacguacggcaccgugcggaccggcaaccgcacccuguucgaggaccgggacuccgacagccaggacgaggucgugguggagucccugcccacgaccagcaucaagguccagugcuucucccaccccaccuaccagagcccggaccuccugcccaagcccucccacaagagccuggcgaaccccgggcucaugaaggaggagccgaccaagcccggcaucgccaagaaggagaacgggaucgacaucaucgaguccgccccccuggagcagacgaacaacgacaaccugaccuacguggacgaggugcacaagaacaaccgcagcgacaugauguccgcccucggccuggggcaggaggaggacaucgagagccccugggacuccgagagcaucuccgagaacuucccgcagaaguacgucgacccccuggccggcgcggccgacggcaaggagaagaacaucgggaacgagcaggccgaggacguguucuacauccccagcugcaugagcggcucccggaacuucaagauggccaagcucgaggacacccgcaacgucgggaugcccguggcgcacauggagagcccggagcgguaccugcaccugaagcccaccaucgagaugaaggacuccgugcccaacaaggccggcgggaugaaggacguccagacgagcaaggccgccgagcacgaccucgagguggccuccgaggaggagcaggagcgcgagggcagcgagaacaaccagccccagguggaggaggagcggaagaagcaccgcaacaacgagauggaggucuccgcgaacauccacgacggcgccaccgacgacgccgaggacgacgacgacgacgacgggcugauccagaagcgcaagagcggcgagaccgaccaccagcaguucccgcggaaggagaacaaggaguacgccuccagcgggcccgcccugcagaugaaggaggugaaguccaccgagaaggagaagcgcacgagcaaggaguccgugaacagccccgucuucggcaaggcgucccuccugaccgggggccugcugcagguggacgacgacagcucccucagcgagaucgacgaggacgagggccggccgaccaagaagaccagcaacgagaagaacaaggugaagaaccagauccaguccauggacgacgucgacgaccugacgcagagcuccgagaccgccagcgaggacugcgagcugccccacuccagcuacaagaacuucaugcuccugaucgagcagcuggggauggagugcaaggacuccgugagccuccugaagauccaggacgccgcccuguccugcgagcgccuccuggagcugaagaagaaccacugcgagcuccugaccgugaagaucaagaagauggaggacaaggucaacgugcugcagcgggagcucagcgagaccaaggagaucaagucccagcuggagcaccagaagguggagugggagcgcgagcugugcagccuccgguucucccugaaccaggaggaggagaagcgccggaacgccgacacgcuguacgagaagauccgcgagcagcuccggcgcaaggaggagcaguaccggaaggaggucgaggugaagcagcagcuggagcugagccuccagacccuggagauggagcugcgcaccgugaaguccaaccucaaccaggucgugcaggagcggaacgacgcgcagcgccagcugagccgggagcagaacgcccgcaugcugcaggacggcauccucaccaaccaccuguccaagcagaaggagaucgagauggcccagaagaagaugaacagcgagaacucccacagccacgaggaggagaaggaccugagccacaagaacuccaugcuccaggaggagaucgccaugcugcggcuggagaucgacacgaucaagaaccagaaccaggagaaggagaagaagugcuucgaggaccucaagaucgugaaggagaagaacgaggaccugcagaagaccaucaagcagaacgaggagacccugacccagaccaucagccaguacaacgggcgccucuccguccugacggcggagaacgccaugcugaacagcaagcucgagaacgagaagcaguccaaggagcgccuggaggccgagguggagagcuaccacucccggcuggccgccgcgauccacgaccgcgaccagagcgagaccuccaagcgggagcucgagcuggccuuccagcgcgcccgggacgagugcagccgccugcaggacaagaugaacuucgacguguccaaccucaaggacaacaacgagauccugagccagcagcuguucaagaccgaguccaagcucaacagccuggagaucgaguuccaccacacccgggacgcccugcgcgagaagacgcucggccuggagcggguccagaaggaccugucccagacccagugccagaugaaggagauggagcagaaguaccagaacgagcaggugaaggugaacaaguacaucggcaagcaggagagcgucgaggagcgccucucccagcugcagagcgagaacaugcugcuccggcagcagcuggacgacgcccacaacaaggcggacaacaaggagaagaccgugaucaacauccaggaccaguuccacgccaucgugcagaagcugcaggccgaguccgagaagcagagccuccugcuggaggagcgcaacaaggagcucaucagcgagugcaaccaccugaaggagcggcaguaccaguacgagaacgagaaggccgagcgcgaggucguggugcggcagcugcagcaggagcucgccgacacccugaagaagcaguccaugagcgaggcgucccuggaggucacgagccgcuaccggaucaaccucgaggacgagacccaggaccugaagaagaagcuggggcagauccgcaaccagcuccaggaggcccaggaccggcacaccgaggccgugcgcugcgccgagaagaugcaggaccacaagcagaagcuggagaaggacaacgcgaagcugaaggugaccgucaagaagcagauggacaagaucgaggagcuccagaagaaccugcugaacgccaaccucuccgaggacgagaaggagcagcugaagaagcugauggagcucaagcagagccuggagugcaaccuggaccaggagaugaagaagaacguggagcucgagcgggagaucacgggcuucaagaaccugcugaagaugacccgcaagaagcucaacgaguacgagaacggggaguucuccuuccacggcgaccugaagaccagccaguucgagauggacauccagaucaacaagcugaagcacaagaucgacgaccucaccgccgagcuggagacggccggguccaagugccugcaccuggacaccaagaaccagauccuccaggaggagcugcugagcaugaagaccgugcagaagaagugcgagaagcuccagaagaacaagaagaagcuggagcaggaggucaucaaccugcgcucccacaucgagcggaacaugguggagcucggccaggugaagcaguacaagcaggagaucgaggagcgcgcccggcaggagaucgcggagaagcugaaggaggucaaccuguuccuccaggcccaggccgccagccaggagaaccuggagcaguuccgcgagaacaacuucgccuccaugaagagccagauggagcugcggaucaaggaccucgaguccgagcugagcaagaucaagaccucccaggaggacuucaacaagacggagcuggagaaguacaagcagcucuaccuggaggagcugaaggugcgcaagagccucuccagcaagcugaccaagaccaacgagcggcuggcggaggugaacaccaagcuccuggucgagaagcagcagagccgcucccuguucacgacccucaccacccggcccgugauggagcccccgugcgugggcaaccugaacaacagccuggaccucaaccgcaagcugaucccccgggagaaccuggucaucuccacgagcaacccccgcgccuccaacaacagcauggagaacuaccucuccaagaugcagcaggagcuggagaagaacaucacccgggagcugaaggaggccgccgccgagcucgagagcggguccaucgcgagcccccugggcuccaccgacgagagcaaccugaaccaggaccucguguggaaggccucccgcgaguacguccaggugcugaagaagaacuacaugaucuga

SEQ ID NO: 26656 - RNA, 3162 nt, Artificial Sequence
  derived and/or modified sequence opt1 from ANKRD28__Homo_sapiens__NP_056014
auggccuuccugaagcuccgcgaccagcccagccuggugcaggccaucuucaacggcgacccggacgagguccgggcgcugaucuucaagaaggaggacgugaacuuccaggacaacgagaagcgcaccccgcuccacgccgccgccuaccugggggacgccgagaucaucgagcugcucauccuguccggcgcgcgggugaacgccaaggacagcaaguggcugaccccgcuccaccgcgccgucgccuccugcagcgaggaggcgguccaggugcugcugaagcacuccgccgacgucaacgcccgggacaagaacuggcagacgccccuccacaucgccgccgcgaacaaggccgugaagugcgccgaggcccuggugccccugcucagcaacgucaacguguccgaccgcgccgggcggaccgcgcugcaccacgccgccuucagcggccacggggagauggugaagcugcuccugucccgcggcgccaacaucaacgccuucgacaagaaggaccggcgcgcgauccacugggccgccuacaugggccacaucgaggucgugaagcugcucgugagccacggggccgaggugaccugcaaggacaagaaguccuacaccccgcugcacgccgcggccagcuccggcaugaucagcguggugaaguaccugcucgaccugggggucgacaugaacgagcccaacgccuacggcaacacgccccugcacguggccugcuacaacgggcaggacguggucgugaacgagcucaucgacugcggcgcgaucgugaaccagaagaacgagaagggcuucacgccccugcacuucgccgccgccuccacccacggggcccugugccucgagcugcuggucggcaacggggcggacgugaacaugaaguccaaggacggcaagacgccccuccacaugaccgcccugcacggccgguucucccgcagccagaccaucauccaguccggggccgucaucgacugcgaggacaagaacggcaacacgccccugcacaucgccgcccgguacgggcacgagcuccugaucaacacccugaucaccagcggcgcggacaccgccaagcgcgggauccacggcauguucccccuccaccuggccgcccugagcggcuucuccgacugcugccggaagcuccugagcuccggguucgacaucgacacccccgacgacuucggccggaccugccugcacgccgcggccgccgggggcaaccucgagugccugaaccugcuccugaacaccggggccgacuucaacaagaaggacaaguucggccgcagcccccugcacuacgcggccgccaacugcaacuaccagugccuguucgcccucgugggcuccggggccagcgugaacgaccuggacgagcgcggcugcacgccccugcacuacgcggccaccuccgacaccgacgggaagugccucgaguaccugcugcggaacgacgccaaccccggcauccgcgacaagcagggguacaacgccguccacuacagcgccgcguacggccaccggcucugccugcagcugaucgccuccgagaccccgcucgacgugcugauggagaccagcggcaccgacaugcuguccgacagcgacaaccgcgccaccaucagcccccuccaccuggccgccuaccacgggcaccaccaggcgcuggaggugcucguccagagccugcuggaccucgacgugcgcaacuccagcggccggacgccccuggaccuggccgccuucaaggggcacguggagugcgucgacgugcucaucaaccagggcgccuccauccuggugaaggacuacauccugaagcgcacccccauccacgcggccgccaccaacggccacagcgagugccuccggcugcugaucgggaacgccgagccgcagaacgccgucgacauccaggacggcaacgggcagacgccccucaugcuguccgugcugaacggccacaccgacugcguguacagccuccugaacaagggggcgaacgucgacgccaaggacaaguggggccgcaccgcccugcaccggggcgccgugaccgggcacgaggagugcguggacgcccuccugcagcacggcgcgaagugccugcuccgcgacagccgggggcgcacccccauccaccuguccgccgccugcggccacaucgggguccugggcgcccuccugcagagcgccgcguccauggacgccaaccccgccacggccgacaaccacggcuacaccgcccugcacugggcgugcuacaacgggcacgagaccugcguggagcuccugcuggagcaggagguguuccagaagaccgagggcaacgccuucagcccgcuccacugcgccgucaucaacgacaacgagggggccgcggagaugcugaucgacacgcugggcgccuccaucgugaacgccaccgacagcaaggggcggaccccgcuccacgccgccgcguucaccgaccacguggagugccugcagcugcuccugucccacaacgcccaggucaacagcguggacuccaccggcaagacgccccugaugauggccgccgagaacggccagaccaacaccguggagaugcucgucagcuccgccagcgcggagcugacccugcaggacaacuccaagaacacggcccuccaccuggccugcagcaaggggcacgagaccuccgcccugcucauccuggagaagaucaccgaccgcaaccugaucaacgccaccaacgcggcccuccagacgccccugcacguggccgcccggaacggccugaccauggugguccaggagcuccuggggaagggcgcgagcgugcuggccguggacgagaacggguacacccccgcccucgccugcgcccccaacaaggacgucgcggacugccuggcccugauccucgccaccaugaugcccguguccagcagcuccccgcugagcucccugacguucaacgccaucaaccgcuacaccaacaccagcaagaccguguccuucgaggcccuccccaucaugcggaacgagcccagcuccuacugcagcuucaacaacaucggcggcgagcaggaguaccuguacacggacgucgacgagcugaacgacuccgacagcgagaccuacuga

SEQ ID NO: 26657 - RNA, 984 nt, Artificial Sequence
  derived and/or modified sequence opt1 from ANKRD2__Homo_sapiens__NP_001123453
auggccaaggcccccagcugggcgggcgugggggcccuggccuacaaggccccggaggcccucuggcccgcggaggccgucauggacggcaccauggaggacuccgaggccgugcagcgcgccaccgcgcugaucgagcagcggcuggcccaggaggaggagaacgagaagcuccgcggggacgcccggcagaagcugcccauggaccugcucgugcuggaggacgagaagcaccacggcgcccagagcgccgcgcugcagaaggucaaggggcaggagcgcgugcggaagacgucccucgaccugcgccgggagaucaucgacgugggcggcauccagaaccugaucgagcuccgcaagaagcggaagcagaagaagcgcgacgcccuggccgccagccacgagcccccgcccgagcccgaggagaucaccgggcccgucgacgaggagaccuuccugaaggccgcgguggagggcaagaugaaggugaucgagaaguuccucgccgacgggggcuccgccgacacgugcgaccaguuccggcgcaccgcccugcaccgggccagccuggaggggcacauggagauccucgagaagcugcuggacaacggcgcgaccgucgacuuccaggaccgccucgacugcaccgccaugcacugggccugccggggcgggcaccuggagguggugaagcugcuccagucccacggcgccgacaccaacguccgcgacaaggagggggacacggcccugcacgacgcggugcggcugaaccgcuacaagaucaucaagcuccugcugcuccacggcgccgacaugaugaccaagaaccuggccggcaagaccccgaccgaccuggugcagcucuggcaggccgacacgcggcacgcgcuggagcaccccgagcccggggccgagcacaacggccuggaggggcccaacgacagcggccgcgagaccccgcagcccguccccgcccaguga

SEQ ID NO: 26658 - RNA, 4026 nt, Artificial Sequence
  derived and/or modified sequence opt1 from ANKRD30A__Homo_sapiens__NP_443723
augaccaagcgcaagaagaccaucaaccugaacauccaggacgcccagaagcggacggcccuccacugggcgugcgugaacggccacgaggaggucgugaccuuccugguggaccgcaagugccagcuggacguccucgacggggagcaccggacgccccugaugaaggcccugcagugccaccaggaggccugcgccaacauccucaucgacagcggcgccgacaucaaccugguggacguguacgggaacaccgcgcugcacuacgccgucuacuccgagauccucagcgugguggccaagcugcugucccacggcgccgucaucgaggugcacaacaaggcgagccucaccccgcugcugcucuccaucaccaagcgcagcgagcagaucguggaguuccugcugaucaagaacgccaacgccaacgccgucaacaaguacaagugcaccgcccucaugcuggcggugugccacggguccagcgagaucgugggcaugcugcuccagcagaacgucgacguguucgccgccgacaucugcggcgugaccgccgagcacuacgccgucacgugcggguuccaccacauccacgagcagaucauggaguacauccggaagcuguccaagaaccaccagaacaccaaccccgagggcaccagcgcggggacccccgacgaggccgcgccccuggccgagcgcacgccggacaccgccgagucccucguggagaagacccccgacgaggccgcgccccugguggagcggacccccgacacggccgagagccuggucgagaagaccccggacgaggccgccucccucguggagggcaccagcgacaagauccagugccuggagaaggccaccuccgggaaguucgagcagagcgccgaggagacgccccgcgagaucaccucccccgccaaggagaccagcgagaaguucaccuggcccgccaagggccggccgcgcaagaucgcgugggagaagaaggaggacacgccccgggagaucaugucccccgccaaggagaccagcgagaaguucaccugggccgccaagggccgcccccggaagaucgccugggagaagaaggagaccccggugaagacggggugcgucgcgcgcgugaccagcaacaagaccaagguccuggagaagggccgguccaagaugaucgccugccccaccaaggagagcuccacgaaggccagcgccaacgaccagcgcuuccccuccgagagcaagcaggaggaggacgaggaguacuccugcgacagccggucccucuucgagagcuccgccaagauccaggugugcauccccgagagcaucuaccagaaggugauggagaucaaccgcgaggucgaggagccgcccaagaagcccuccgcguucaagcccgccaucgagaugcagaacagcgugccgaacaaggccuucgagcugaagaacgagcagacccugcgggccgaccccauguucccgcccgaguccaagcagaaggacuacgaggagaacagcugggacuccgagagccucugcgagaccgugucccagaaggacgucugccugcccaaggccacccaccagaaggagaucgacaagaucaacgggaagcuggaggagagccccaacaaggacggccuccugaaggcgacgugcggcaugaaggugagcauccccaccaaggcccuggagcucaaggacaugcagaccuucaaggccgagccgcccgggaagcccuccgccuucgagcccgcgaccgagaugcagaaguccgugccgaacaaggcccuggagcugaagaacgagcagacccuccgcgccgacgagauccugcccagcgagagcaagcagaaggacuacgaggagaacuccugggacacggagagccugugcgagaccgucucccagaaggacgugugccuccccaaggccgcccaccagaaggagaucgacaagaucaacggcaagcuggaggggagccccgugaaggacggccugcucaaggcgaacugcgggaugaaggucuccaucccgaccaaggcccuggagcugauggacaugcagaccuucaaggccgagccgcccgagaagcccagcgccuucgagcccgccaucgagaugcagaaguccgugcccaacaaggcgcuggagcucaagaacgagcagacgcugcgggccgacgagauccugcccagcgaguccaagcagaaggacuacgaggagagcuccugggacagcgagucccucugcgagaccgugagccagaaggacgucugccugcccaaggccacccaccagaaggagaucgacaagaucaacggcaagcuggaggagagcccggacaacgacggcuuccucaaggcccccugccgcaugaagguguccauccccaccaaggcccuggagcugauggacaugcagacguucaaggcggagcccccggagaagcccagcgccuucgagcccgccaucgagaugcagaaguccgugcccaacaaggcccucgagcugaagaacgagcagacccugcgcgcggaccagauguucccgagcgaguccaagcagaagaaggucgaggagaacagcugggacuccgagagccuccgggagaccgugucccagaaggacgugugcguccccaaggccacccaccagaaggagauggacaagaucagcgggaagcuggaggacuccacgagccuguccaagauccucgacaccgugcacagcugcgagcgcgcccgggagcugcagaaggaccacugcgagcagcgcaccggcaagauggagcagaugaagaagaaguucugcgugcugaagaagaagcucuccgaggccaaggagaucaagagccagcuggagaaccagaaggucaagugggagcaggagcugugcuccgugcggcucacccugaaccaggaggaggagaagcgccggaacgccgacauccugaacgagaagauccgcgaggagcucgggcggaucgaggagcagcaccgcaaggagcuggaggugaagcagcagcuggagcaggcgcuccggauccaggacaucgagcucaagagcgucgaguccaaccugaaccaggugagccacacgcacgagaacgagaacuaccugcugcacgagaacugcaugcugaagaaggagaucgccaugcucaagcuggagaucgccacccugaagcaccaguaccaggagaaggagaacaaguacuucgaggacaucaagauccucaaggagaagaacgccgagcugcagaugacccugaagcucaaggaggagagccugaccaagcgcgccucccaguacagcggccagcugaaggugcucaucgcggagaacacgaugcugaccuccaagcugaaggagaagcaggacaaggagauccucgaggccgagaucgagagccaccacccccggcuggccuccgccguccaggaccacgaccagaucgugaccagccgcaagucccaggagccggccuuccacaucgcgggggacgccugccugcagcggaagaugaacguggacgucagcuccaccaucuacaacaacgaggugcuccaccagccccugagcgaggcccagcgcaaguccaagagccugaagaucaaccucaacuacgccggcgacgcccugcgggagaacacgcugguguccgagcacgcgcagcgcgaccagcgggagacccagugccagaugaaggaggccgagcacauguaccagaacgagcaggacaacgucaacaagcacaccgagcagcaggagagccucgaccagaagcuguuccagcugcaguccaagaacauguggcuccagcagcagcuggugcacgcccacaagaaggccgacaacaagagcaagaucaccaucgacauccacuuccuggagcgcaagaugcagcaccaccuccugaaggagaagaacgaggagaucuucaacuacaacaaccaccugaagaaccgcaucuaccaguacgagaaggagaaggcggagacggagaacuccuga

SEQ ID NO: 26659 - RNA, 4062 nt, Artificial Sequence
  derived and/or modified sequence opt1 from ANKRD36B__Homo_sapiens__NP_079466
auggagcgccugugcagcgacggcuucgccuucccccacuacuacaucaagccguaccaccugaagcggauccaccgcgccgugcugcgggggaaccuggagaagcucaaguaccugcugcucaccuacuacgacgcgaacaagcgcgaccggaaggagcgcaccgcccugcaccuggccugcgccacgggccagcccgagaugguccaccuccuggugucccggcgcugcgagcugaaccucugcgaccgggaggaccgcacgccccugaucaaggccgugcagcugcggcaggaggcgugcgccacccuccugcugcagaacggggccgaccccaacaucaccgacgucuucggccgcaccgcccuccacuacgcgguguacaacgaggacaccagcaugaucgagaagcugcugucccacgggaccaacaucgaggagugcagcaagaacgaguaccagccgcuccugcuggccgugucccggcgcaaggucaagaugguggaguuccuccugaagaagaaggccaacgugaacgccaucgacuaccugggccggagcgcccucauccuggcggucacccugggcgagaaggacaucgugauccuccugcugcagcacaacaucgacguguucucccgcgacgucuacgggaagcucgccgaggacuacgccagcgaggccgagaaccgggugaucuucgaccugaucuacgaguacaagcgcaagcgguacgaggaccugcccaucaacuccaaccccgugagcccccagaagcagcgcgccgagaaggcgacguccgacgacaaggacagcgucuccaacaucgccaccgagaucaaggagggcccgaucagcgggaccguguccagccagaagcagcccgccgagaaggccaccuccgacgagaaggacagcguguccaacaucgccacggagaucaaggagggccagcagagcgggaccgucagcccccagaagcaguccgcgcagaaggugaucuucaagaagaaggugagccuccugaacaucgccacccggaucaugggcggcgggaaguccggcaccgucagcucccagaagcagcccgccagcaagacggccuccgacaagaccgacagcgcccugaacaccgcgaccgagaucaaggacgggcuccagugcggcacgguguccagccagaagcagcaggcccugaaggccaccaccgacgaggagggcuccgugagcaacaucgccaccgagaucaaggacggggagaaguccggcacggucagcucccagaagaagccggcgcugaaggccaccagcgacgagaaggacuccuucagcaacaucacccgcgagaagaaggacggggagaucucccgcaccgugagcagccagaagccgcccgcccucaaggccacguccgucaaggaggacagcgugcugaacaucgcccgggagaagaaggacggcgagaagucccgcaccgugagcuucgagcagccgcccgggcugaaggcgacccgggacgagaaggacucccuccugaacaucgcccgcggcaagaaggacggcgagaagacccggcgcgucagcucccacaagcagcccagccugaaggccacguccgacaaggaggacagcgugcccaacauggccaccgagaccaaggacgagcagaucuccgggaccgugagcugccagaagcagcccgcccucaaggcgacguccgacaagaaggacagcgucuccaacauccccaccgagaucaaggacggccagcagagcgggaccguguccagccagaagcagcccgccuggaaggccaccagcgugaagaaggacuccgucagcaacaucgccaccgagaucaaggacggccagauccgggggacgguguccagccagcgccggcccgcccugaagaccaccggcgacgagaaggacuccgugagcaacaucgcgcgcgagaucaaggacggcgagaaguccgggaccgucagcccccagaagcaguccgcccagaaggugaucuucaagaagaaggugagccugcugaacaucgccacgcggaucaccggcgggggcaaguccgggaccgaguacccggagaaccuccgcacccugaaggccacgaucgagaacaaggacagcguccugaacaccgcgaccaagaugaaggaggugcagaccuccacgcccgccgagcaggaccucgagauggccagcgagggcgagcagaagcggcuggaggaguacgagaacaaccagccccaggugaagaaccagauccacucccgcgacgaccuggacgacaucauccagagcucccagaccgucagcgaggacggcgacucccucugcugcaacugcaagaacgugauccugcugaucgaccagcacgagaugaagugcaaggacugcgugcaccuccugaagaucaagaacaccuucugccuguggaagcggcucaucaagcugaaggacaaccacugcgagcagcugcgcgucaagauccggaagcucaagaacaaggccagcgugcugcagaagcgcaucagcgagaaggaggagaucaagucccagcugaagcacgagauccucgagcuggagaaggagcugugcagccuccgguucgccauccagcaggagaagaagaagcgccgcaacguggaggagcugcaccagaagguccgggagaagcugcgcaucaccgaggagcaguaccggaucgaggcggacgugacgaagcccaucaagccggcccucaaguccgccgagguggagcugaagaccgggggcaacaacagcaaccaggucuccgagaccgacgagaaggaggaccugcuccacgagaaccgccugaugcaggacgagaucgcccggcugcgccucgagaaggacaccaucaagaaccagaaccuggagaagaaguaccugaaggacuucgagaucgugaagcggaagcacgaggaccuccagaaggcccugaagcgcaacggggagacgcuggcgaagaccaucgccugcuacagcggccagcucgccgcccugaccgacgagaacaccacgcugcgguccaagcucgagaagcagcgcgagagccggcagcgccuggagaccgagaugcaguccuaccggugccgccugaacgccgcgcggugcgaccacgaccagagccacuccagcaagcgcgaccaggagcucgccuuccagggcaccguggacaagugccggcaccuccaggagaaccugaacucccacguccugauccugagccugcagcucuccaaggccgagagcaagucccgcgugcugaagaccgagcugcacuacacgggggaggcccucaaggagaaggcgcugguguucgagcacguccagagcgagcugaagcagaagcagucccagaugaaggacaucgagaagauguacaagagcggcuacaacaccauggagaagugcaucgagaagcaggagcgguucugccagcucaagaagcagaacaugcugcugcagcagcagcucgacgacgcccgcaacaaggccgacaaccaggagaaggccauccugaacauccaggcccggugcgacgcgcgcgugcagaaccugcaggccgagugccgcaagcaccggcuccugcuggaggaggacaacaagaugcucgugaacgagcugaaccacagcaaggagaaggagugccaguacgagaaggagaaggccgagcgcgaggucgccgugcggcagcugcagcagaagcgcgacgacgugcucaacaagggguccgccaccaaggcgcugcuggacgccagcucccggcacugcaccuaccucgagaacggcaugcaggacagccgcaagaagcuggaccagaugcggucccaguuccaggagauccaggaccagcugacggccaccauccgcugcaccaaggagauggagggggacacccagaagcucgaggucgagcacgugaugaugcggaagaucaucaagaagcaggacgaccagaucgagcgccuggagaagauccugcagcacagcucccucaugcuccagguguucgagagcuga

SEQ ID NO: 26660 - RNA, 5826 nt, Artificial Sequence
  derived and/or modified sequence opt1 from ANKRD36__Homo_sapiens__NP_001157787
auggaggacggcaagcgcgagcgguggcccacgcugauggagcgccugugcagcgacggguucgccuucccccaguaccccaucaagcccuaccaccugaagcggauccaccgcgccgugcugcacggcaaccuggagaagcugaaguaccugcugcugaccuacuacgacgcgaacaagcgggaccgcaaggagcggacggcccugcaccucgccugcgccaccgggcagcccgagaugguccaccuccuggugagccgccggugcgagcucaaccugugcgaccgcgaggaccggaccccgcugaucaaggccgugcagcuccgccaggaggcgugcgccacccugcugcuccagaacggcgccaaccccaacaucacggacuucuucgggcggaccgcccugcacuacgcggucuacaacgaggacaccagcaugaucgagaagcugcucagccacggcaccaacaucgaggagugcagcaagugcgaguaccagccccugcuguucgccgugagccgccggaaggugaagauggucgaguuccuccugaagaagaaggccaacgugaacgccaucgacuaccugggccgcagcgcccucauccacgcggugacgcugggggagaaggacaucgucauccugcuccugcagcacaacaucgacgugcugagccgggacgccuuccgcaagaucgccggcgacuacgccaucgaggccaagaaccgggugaucuucgaccucaucuacgaguacgagcgcaagcgguacgaggaccugcccaucaacagcaacccggucagcagccagaagcagcccgcgcugaaggccaccuccgggaaggaggacagcaucuccaacaucgccaccgagaucaaggacggccagaaguccgggaccguguccagccagaagcagcccgcccucaaggacacguccgacaaggacgacagcguguccaacaccgccaccgagaucaaggacgagcagaaguccggcaccguccugcccgcgguggagcagugccugaaccgcagccucuaccgcccggacgccguggcccagcccgucacggagaacgaguucucccuggagagcgagaucaucuccaagcuguacauccccaagcggaagaucaucagcccccgcuccaucaaggacgugcucccgcccguggaggaggccgucgaccggugccuguaccugcucgaccgcuucgcccagcccgugaccaaggacaaguucgcgcuggagagcgagaacaucuccgagcccuacuucaccaaccggcgcaccaucagccagcaguccgccgagaaccuggacgccgccugcggcaucgacaagacggagaacgggaacauguucgaggaccagaacguggacaaggagggcaaggcgcucccggccaccgggcagaaggccaacgucagccccgagcagccgccccuguucacccacaccgugaaggaccgggaccacaucuccacgcgcuuccugggcggcauggacagccugaccuccagcgaggaguccagcgagcggccgccccucuccacccugacccugaaggaggccgaccccagcuccaaggccgcgaugcgccggaaggacagcccgccgcccgggaaggucagcucccagaagcagcccgccgagaaggccacgagcgacgacaaggacuccgugagcaacaucgccaccgagaucaaggagggccccaucuccgggaccgugagcucccagaagcagcccgccgagaaggcgaccagcgacgagaaggacuccgucagcaacaucgccacggagaucaagaagggccagcaguccgggaccgugagcccccagaagcaguccgccuggaaggugaucuucaagaagaaggucagccuccugaacaucgccacccgcaucaugggcggcgggaaguccggcaccgugagcucccagaagcagcccgccagcaaggcgacgagcgacaagaccgacuccgcccugaacaucgccaccgagaucaaggacgggcuccagugcggcaccgugagcucccagaagcagcccgcccugaaggcgaccacggacgaggaggacagcgucuccaacaucgccaccgagaucaaggacggggagaaguccggcaccguguccagccagaagcagcccgcccugaaggccaccacggacgaggaggacuccgugagcaacaucgccaccgagaucaaggacggcgagaaguccgggaccgucagcucccagaagcagcccgcgcucaaggccaccacggacgagaaggacagcguguccaacaucgccaccgagaucaaggacggcgagaaguccgggaccguguccagccagaagcccccggcccugaccgccacguccgacgaggagggcagcguccugagcaucgcgcgggagaacaaggacggggagaagucccgcaccgugagcucccggaagaagcccgcccucaaggccaccagcgacgagaaggacuccuucagcaacaucacccgcggcaagaaggacggcgagaucucccggaaggugagcucccagaagccgcccacgcugaaggggaccagcgacgaggaggacuccguccugggcaucgcccgcgagaacaaggacggggagaagucccggaccgugagcagcgagaagccgcccggccucaaggccuccagcgcggagaaggacuccgugcugaacaucgcccgcggcaagaaggacggggagaagaccaagcgcgucagcucccggaagaagcccagccuggaggccacgagcgacgagaaggacuccuucagcaacaucacccgcgagaagaaggacggcgagaucucccggaaggugagcucccagaagcccccggcccucaaggggaccagcgacgaggaggacuccgugcugggcaucgcgcgcgagaacaaggacggggagaagucccggaccgucagcagcgagaagccgcccggccugaaggccacguccgacgagaaggacagcgugcucaacaucgcccgcggcaagaaggacggggagaagacccggaccguguccagccagaagccgcccacccugaaggccacguccgacgaggaggacagcguccuguccaucgcccgcgagaacaaggacggcgagaagucccggaccguguccagcgagaagcccagcgggcucaaggcgaccuccgccgagaaggacagcgugcugaacaucgcccgcggcaagaaguacggggagaagaccaagcgggucuccagccgcaagaagcccgcccugaaggccacguccgacgagaaggacagcgugcucuacaucgcgcgggagaagaaggacggcgagaagucccgcaccgugagcucccccaagcagcccgcccugaaggccaucugcgacaaggaggacagcguccccaacauggccaccgagaagaaggacgagcagaucuccggcaccgugagcugccagaagcagcccgcccugaaggcgacguccgacaagaaggacagcguguccaacaucccgaccgagaucaaggacgggcagcagagcggcaccgucuccagccagaagcagcccgccuggaaggccaccuccgugaagaaggacagcgugagcaacaucgccaccgagaucaaggacgggcagauccggggcacggggauccucgaguacaccuucaacgucauguucgaccagaucgaggagaaguucaccucccugaacaagagcgccggcgugagcccccagaagcagagcgcgcagaaggugaucuucaagaagaaggucucccugcucaacaucgccacccgcaucacgggcggguggaaguccggcaccgaguaccccgagaaccugccgacccugaaggccaccaucgagaacaagaacuccgugcucaacacggccaccaagaugaaggacgugcagaccagcacccccgcggagcaggaccuggagauggccuccgagggggagcagaagcggcuggaggaguacgagaacaaccagccccaggucaagaaccagauccacagccgcgacgaccucgacgacaucauccaguccagccagacgguguccgaggacggcgacagccugugcugcaacugcaagaacgugauccugcucaucgaccagcacgagaugaagugcaaggacugcguccaccuccugaagaucaagaacaccuucugccucuggaagcggcugaucaagcugaaggacaaccacugcgagcagcuccgcgugaagauccggaagcugaagaacaaggccuccgugcugcagaagcgcaucagcgagaaggaggagaucaagucccagcucaagcacgagauccuggagcuggagaaggagcucugcagccugcgcuucgccauccagcaggagaagaagaagcggcgcaacgucgaggaggugcaccagaagguccgggagaagcugcgcaucaccgaggagcaguaccggaucgaggccgacgugaccaagcccaucaagccggcgcucaaguccgccgagguggagcugaagaccgggggcaacaacagcaaccaggucagcgagaccgacgagaaggaggaccugcuccacgagaaccgccugaugcaggacgagaucgcccggcugcgccucgagaaggacaccaucaagaaccagaaccuggagaagaaguaccugaaggacuucgagaucgugaagcggaagcacgaggaccuccagaaggcccugaagcgcaacggcgagacccuggccaagacgaucgcgugcuacuccgggcagcucgccgcccugaccgacgagaacaccacccugcggagcaagcucgagaagcagcgcgagucccggcagcgccuggagacggagaugcagagcuaccacugccggcugaacgccgcccgcugcgaccacgaccagucccacagcuccaagcgggaccaggagcucgcguuccagggcaccguggacaagugccgccaccuccaggagaaccugaacagccacguccucauccugucccugcagcucagcaaggccgaguccaagagccgggugcugaagaccgagcugcacuacaccggggaggcccucaaggagaaggcccugguguucgagcacguccaguccgagcugaagcagaagcagagccagaugaaggacaucgagaagauguacaaguccggcuacaacacgauggagaagugcaucgagaagcaggagcgcuucugccagcucaagaagcagaacaugcugcugcagcagcagcucgacgacgcgcgcaacaaggccgacaaccaggagaaggccauccugaacauccaggcccggugcgacgcccgcgugcagaaccugcaggcggagugccggaagcaccgccuccugcuggaggaggacaacaagaugcuggugaacgagcucaaccacagcaaggagaaggagugccaguacgagaaggagaaggccgagcgggaggucgccgugcgccagcugcagcagaagcgggacgacgugcugaacaagggcuccgccaccaaggcccuccuggacgcgagcagccgccacugcaccuaccuggagaacgggaugcaggacucccggaagaagcucgaccagaugcgcagccaguuccaggagauccaggaccagcugaccgccacgauccggugcaccaaggagauggagggcgacacccagaagcuggaggucgagcacgugaugaugcgcaagaucaucaagaagcaggacgaccagaucgagcggcucgagaagauccugcagcacuccagccugaugcuccagguguucgaguccuga

SEQ ID NO: 26661 - RNA, 477 nt, Artificial Sequence
  derived and/or modified sequence opt1 from ANKRD37__Homo_sapiens__NP_859077
augcugcuccuggacugcaaccccgagguggacggccugaagcaccuccuggagaccggggccagcgucaacgccccgcccgaccccugcaagcagucccccgugcaccuggcggccggcagcgggcucgccugcuuccugcuguggcagcuccagaccggcgccgaccugaaccagcaggacgugcugggggaggccccgcuccacaaggcggccaaggucggcucccuggagugccugagccuccugguggccuccgacgcccagaucgaccugugcaacaagaacggccagacggcggaggaccucgccuggagcugcggguuccccgacugcgccaaguuccugaccaccaucaagugcaugcagaccaucaaggccuccgagcaccccgaccgcaacgacugcguggccguccugcggcagaagcgcagccucggcuccguggagaacacgagcgggaagcggaagugcuga

SEQ ID NO: 26662 - RNA, 2982 nt, Artificial Sequence
  derived and/or modified sequence opt1 from ANKRD44__Homo_sapiens__NP_001182073
auggccgugcugaagcucaccgaccagcccccgcugguccaggccaucuucagcggcgaccccgaggagauccgcaugcugauccacaagaccgaggacgugaacacccucgacuccgagaagcggacgccccugcacguggcggccuuccugggggacgccgagaucaucgagcuccugauccugagcggcgcccgcgucaacgccaaggacaacauguggcucacgccccugcaccgggcgguggccucccgcagcgaggaggccgugcagguccugaucaagcacuccgccgacgugaacgcgcgggacaagaacuggcagaccccgcuccacguggccgccgccaacaaggccgucaagugcgcggaggugaucaucccccugcugagcuccgugaacgucagcgaccgcgggggccggaccgcccuccaccacgccgcccugaacgggcacguggagauggugaaccugcuccuggccaagggcgcgaacaucaacgccuucgacaagaaggaccgccgggcccugcacugggccgccuacaugggccaccucgacgucguggcgcugcugaucaaccacggggccgaggugaccugcaaggacaagaagggcuacacgccccuccacgccgccgccuccaacgggcagaucaacgucgugaagcaccuccugaaccugggcguggagaucgacgagaucaacgucuacgggaacaccgcgcugcacaucgccugcuacaacggccaggacgccguggugaacgagcugaucgacuacggcgccaacgucaaccagcccaacaacaacggguucaccccgcuccacuucgcggccgccagcacccacggcgcccugugccuggagcuccuggugaacaacggggccgacgucaacauccaguccaaggacggcaagagcccccugcacaugaccgcggugcacggccgcuucacccggucccagacccucauccagaacgggggcgagaucgacugcguggacaaggacgggaacacgccccugcacgucgccgcccgcuacggccacgagcugcucaucaacacccugaucaccagcggggccgacaccgccaagugcggcauccacuccauguucccccugcaccucgcggcccugaacgcccacagcgacugcugccggaagcugcucuccagcggcuucgagaucgacaccccggacaaguucgggcggaccugccugcacgccgccgcggccggcgggaacguggagugcaucaagcugcuccaguccagcggcgccgacuuccacaagaaggacaagugcgggcgcacgccccugcacuacgccgcggccaacugccacuuccacugcaucgagacccuggugaccaccggcgccaacgucaacgagaccgacgacuggggccgcacggcccugcacuacgccgcggccagcgacauggaccggaacaagaccauccucgggaacgcccacgacaacuccgaggagcuggagcgcgcccgggagcugaaggagaaggaggccacccucugccuggaguuccugcuccagaacgacgcgaaccccagcauccgcgacaaggagggcuacaacuccauccacuacgccgccgccuacgggcaccggcagugccuggagcugcuccuggagcgcaccaacagcggcuucgaggaguccgacagcggggccacgaaguccccgcugcaccucgcggccuacaacggccaccaccaggcccuggaggugcugcuccagagccugguggaccuggacauccgcgacgagaagggccggaccgcccucgaccuggcggccuucaaggggcacaccgagugcgucgaggcccugaucaaccagggcgccuccaucuucgugaaggacaacgugaccaagcgcacgccccuccacgccagcgucaucaacgggcacacccugugccugcggcuccugcuggagaucgcggacaaccccgaggccguggacgugaaggacgccaagggccagacgccccucaugcuggccgucgccuacggccacaucgacgcggugucccugcuccuggagaaggaggccaacguggacaccgucgacauccuggggugcaccgcccuccaccgcggcaucaugaccgggcacgaggagugcgugcagaugcugcuggagcaggaggugagcauccucugcaaggacucccggggccgcacgccccugcacuacgccgccgcgcgggggcacgccaccuggcugagcgagcuccugcagauggcccuguccgaggaggacugcugcuucaaggacaaccagggcuacaccccgcuccacugggccugcuacaacggcaacgagaacugcaucgagguccugcuggagcagaagugcuuccgcaaguucaucgggaaccccuucacgccccuccacugcgccaucaucaacgaccacggcaacugcgcgagccugcugcucggggccaucgacuccagcaucguguccugccgggacgacaagggccgcaccccgcugcacgccgccgcguucgccgaccacguggagugccugcagcuccugcugcggcacagcgcccccgucaacgccguggacaacagcgggaagaccgcccucaugauggcggccgagaacggccaggccggcgccguggacauccuggucaacuccgcccaggcggaccugaccgugaaggacaaggaccucaacaccccgcugcaccuggccugcagcaaggggcacgagaagugcgcccuccugauccuggacaagauccaggacgagucccucaucaacgagaagaacaacgcccugcagacgccccugcacguggccgcgcgcaacggccucaaggucgugguggaggagcugcuggccaagggggccugcguccucgccguggacgagaacgcgagccgguccaacggcccccgcagcacccccgggaccgccgugcagaaggaggaguga

SEQ ID NO: 26663 - RNA, 801 nt, Artificial Sequence
  derived and/or modified sequence opt1 from ANKRD45__Homo_sapiens__XP_011507772
auggagagcgaggggcccccggaguccgagagcuccgaguucuucagccagcaggaggaggagaacgaggaggaggaggcccaggagcccgaggagaccggccccaagaacccccugcuccagccggcccugaccggcgacguggaggggcugcagaagaucuucgaggaccccgagaacccccaccacgagcaggcgaugcagcuccugcuggaggaggacaucgucggccgcaaccuccuguacgccgccugcauggccgggcaguccgacgugauccgggcccuggcgaaguacggcgugaaccucaacgagaagacgacccgcggcuacacccugcugcacugcgccgccgccugggggcggcucgagacccugaaggcgcuggucgagcucgacguggacaucgaggcccugaacuuccgcgaggagcgggcccgcgacguggccgcccgguacagccagacggagugcgucgaguuccuggacugggcggacgcccgccucacccugaagaaguacaucgccaaggugucccuggccgugaccgacaccgagaagggcagcgggaagcuccugaaggaggacaagaacacgauccuguccgccugccgggcgaagaacgaguggcucgagacccacaccgaggccagcaucaacgagcuguucgagcagcgccagcagcuggaggacaucgucacccccaucuucacgaagaugaccaccccgugccaggugaaguccgccaagagcgugaccucccacgaccagaagcggagccaggacgacacguccaacuga

SEQ ID NO: 26664 - RNA, 699 nt, Artificial Sequence
  derived and/or modified sequence opt1 from ANKRD46__Homo_sapiens__NP_001257308
augagcuacguguucgucaacgacuccagccagaccaacgugccccugcuccaggccugcaucgacggcgacuucaacuacuccaagcgccugcuggagagcggguucgacccgaacauccgggacucccgcggccggaccgggcuccaccuggccgcggcccgcggcaacguggacaucugccagcugcuccacaaguucggggccgaccugcuggccacggacuaccagggcaacaccgcccuccaccugugcggccacgucgacaccauccaguuccuggugagcaacgggcucaagaucgacaucugcaaccaccagggcgcgacgccccuggugcuggccaagcggcgcggggucaacaaggacgugauccggcuccuggagucccuggaggagcaggaggugaagggcuucaaccgcgggacccacagcaagcucgagaccaugcagaccgccgaguccgagagcgccauggagucccacagccugcugaaccccaaccuccagcagggcgagggcguccuguccagcuuccggaccacguggcaggaguucguggaggaccugggguucuggcgcgugcuccugcugaucuucgucaucgcgcuccugucccugggcaucgccuacuaccggcgcacccuccggcuggggagcuucgcccgccaggaccggucccgcauccaggccaucuga

SEQ ID NO: 26665 - RNA, 3753 nt, Artificial Sequence
  derived and/or modified sequence opt1 from ANKRD50__Homo_sapiens__NP_001161354
augaagcccccgcagcagagccuguaccuccugguggacuccgucgacgagggcugcaacaucaccgagggggagcagaccagcaccucccugagcggcaccguggccgcccuccuggcggggcaccacgaguucuucccgcccuggcugcuccugcugugcuccgcccgcaagcagagcaaggccgugaccaagauguucaccggcuuccggaagaucucccucgacgaccugcgcaaggccuacaucgucaaggacgugcagcaguacauccugcaccggcucgaccaggaggaggcccugcgccagcaccugacgaaggagaccgcggagaugcucaaccagcugcacaucaagagcuccgggugcuuccuguaccucgagcgggugcuggacggcgucguggagaacuucaucaugcugcgcgagauccgggacauccccggcacccucaacgggcuguaccuguggcucugccagcgccuguucgugcggaagcaguucgccaagguccagcccauccugaacgugauccucgccgccugccgcccccugaccaucacggagcuguaccacgcgguguggaccaagaacaugagccucacccuggaggacuuccagcggaagcuggacauccucuccaagcugcuggucgacggccucgggaacaccaagauccuguuccacuacagcuucgccgaguggcugcucgacgugaagcacugcacgcagaaguaccugugcaacgccgccgagggccaccgcaugcuggccauguccuacacgugccaggcgaagaaccucacgccccuggaggcccaggaguucgcccugcaccucaucaacagcaaccugcagcuggagaccgccgagcucgcccuguggaugaucuggaacgggacccccgugcgggacucccugagcacccugaucccgaaggagcaggagguccuccagcugcuggugaaggcgggcgcccacgugaacuccgaggacgaccgcaccagcugcaucguccggcaggcccucgagcgcgaggacuccauccggacccugcuggacaacggcgccagcgugaaccagugcgacagcaacgggcgcacgcuccuggccaacgcggccuacuccggcagccuggacguggucaaccuccuggugucccgcggggccgaccuggagaucgaggacgcccacggccacacgccccucacccuggccgcgcggcagggccacaccaagguggucaacugccugaucgggugcggcgccaacaucaaccacaccgaccaggacggguggaccgcccuccggagcgccgcguggggcgggcacaccgagguggucuccgcccugcuguacgccggcgugaagguggacugcgccgacgccgacagccgcaccgcgcuccgcgccgccgccuggggcgggcacgaggacaucguccugaaccugcuccagcacggcgccgaggugaacaaggcggacaacgaggggcggaccgcccugaucgccgccgccuacaugggccaccgcgagaucguggagcaccuccuggaccacggggcggaggucaaccacgaggacguggacggccggaccgcccuguccguggccgcccugugcguccccgcgagcaagggccacgccuccguggugagccuccugaucgaccgcggggccgaggucgaccacugcgacaaggacggcaugacgccccugcucguggccgccuacgaggggcacguggacgucguggaccugcugcucgagggcggggcggacguggaccacaccgacaacaacggccggaccccgcugcuggccgccgccuccaugggccacgccagcgucgugaacacccuccuguucuggggcgcggccguggacuccaucgacagcgaggggcgcaccguccuguccaucgccagcgcccaggggaacguggaggugguccggacccuccuggaccgcggccuggacgagaaccaccgggacgacgccggcuggacgccccuccacauggcggccuucgaggggcaccgccugaucugcgaggcccugaucgagcagggcgcccggaccaacgagaucgacaacgacgggcgcauccccuucauccucgcgucccaggagggccacuacgacugcgugcagauccugcuggagaacaagagcaacaucgaccagcggggguacgacggccgcaacgcccuccggguggccgcccuggagggccaccgcgacaucgucgagcuccuguucucccacggggccgacgugaacugcaaggacgcggacggccggcccacccuguacauccuggcccucgagaaccagcugaccauggccgaguacuuccuggagaacggggccaacguggaggccagcgacgcggagggccgcaccgcccuccacgucagcugcuggcaggggcacauggagaugguccaggugcugaucgccuaccacgccgacgugaacgccgcggacaacgagaagcgguccgcccugcagagcgccgccuggcagggccacgugaaggugguccagcuccugaucgagcacggcgccgugguggaccacacgugcaaccagggggcgaccgcccugugcaucgccgcccaggagggccacaucgacgucguccaggugcuccuggagcacggggcggacccgaaccacgccgaccaguucggccgcaccgccaugcgcguggccgccaagaacgggcacucccagaucaucaagcugcucgagaaguacggcgcgagcucccugaacggcugcagccccucccccgugcacaccauggagcagaagccccugcagagccucuccagcaaggugcagucccugacgaucaagagcaacuccagcggguccaccggcgggggcgacaugcagccgagccugcgggggcuccccaacggccccacccacgccuucuccagccccagcgaguccccggacagcaccgucgaccgccagaaguccagccuguccaacaacagccugaaguccagcaagaacuccagccuccggacgaccuccagcaccgccaccgcccagacggugcccaucgacuccuuccacaaccugagcuucaccgagcagauccagcagcacucccugccccgcagccggucccgccagagcaucgugucccccagcagcaccacccagucccucggccagagccacaacuccccgagcuccgaguucgaguggagccaggucaagcccucccucaagagcacgaaggccuccaagggcggcaagagcgagaacuccgccaagagcggguccgcggggaagaaggccaagcagagcaacuccagccagcccaaggugcuggaguacgagaugacccaguucgaccggcgcggcccgaucgccaaguccgggaccgccgcgccgcccaagcagaugcccgccgagagccagugcaagaucaugauccccuccgcccagcaggagaucggccggagccagcagcaguuccugauccaccagcagagcggggagcagaagaagcgcaacggcaucaugaccaaccccaacuaccaccuccaguccaaccagguguuccuggggcgggucagcgugccccgcacgaugcaggaccggggccaccaggagguccuggagggcuaccccuccagcgagaccgagcugucccugaagcaggcccucaagcugcagaucgaggggagcgacccguccuucaacuacaagaaggagacgccccuguga

SEQ ID NO: 26666 - RNA, 1845 nt, Artificial Sequence
  derived and/or modified sequence opt1 from ANKRD55__Homo_sapiens__NP_078945
augaugcgccaggccaccauggacuucagcacccccuccguguucgaccagcagcggggcgacagcuccgaggaggucgaccugacgaugguguaccaggccgcgagcaacggggacgugaacgcccucaccgccgucauccgcgaggacccguccauccuggagugcugcgacagcgagggcugcacgccccugaugcacgccguguccgggcggcaggccgacaccgugaagcuccugcugaagaugggcgcgaacaucaacaugcaggacgccuacgggcgcaccagccucugccuggccaccuaccugggcuggcucgagggcugcgucucccugcugcggaacggggccaagcacaacauccccgacaagaacggccgccucccccugcacgcggccaccgccgagccggacaugcggcugcucaccgugcugcugcagcagagcaacaucuccgagaucaaccaccaggacaacgaggggaugacgccccuccacugggccgccuuccacaaccagccccagcacacccagaugcugcugaagaagggcgcggaccccacccucguggacaaggacuucaagaccgcccugcacugggccguccagagcgggaaccgcauccugugcuccaucauccucagccaccaccagggcccguccaucaucaacuacgacgacgagagcggcaagacgugcgugcacaucgccgccgcggccggguucuccgacaucauccacgagcuggcccgggugcccgagugcaaccugcaggcccucgacgucgacgaccgcacgccccugcacugggccgcggccgccggcaaggccgagugcgugcagagccugcucgagcuggggauggacuccaaccugcgggacaucaacgagagcacgccccucgccuacgcgcuguacugcggccacaccgccugcgugaagcugcucagccaggagucccgcaccgagccgacccggcccccgcccagccaguccagccgcccccagaagaaggagcggcgcuucaacguccugaaccagaucuucugcaagaacaagaaggaggagcagcgggcccaccagaaggaccccucccgcgaccgguaccgcgaggaggacaccagcgaggugaacgacaucaucaccaccuucgacuccaucgugggcaccaacugccaggagcagcccggggaccaggucgccaugguggaguucaagaagaagaccagcgacaacuccaaguaccugcuccccgagaagaagccgcuggcgcggaagggccugccgcccauccgcacccagagccugccgcccaucacgcuggggaacaacuuccugaccgccucccaccgcgccaccagccacgccggccucuccagcgcgccccaccacauggcccagcggucccagaagucccgcagcgagcaggaccugcugaacaaccggaccgggugccagaugcuccuggacaaccccuggaaguccgacagcaaccagguguucagcuacaaggucuggacggugagcuccagcgacaagcugcuggaccgccuccuguccgugcggcccggccaccaggaggucagcgugccgccccaccuccgccaccuccacaaccccuccagcggccagaacuuccagcaccugucccccaaccggcacaagauccgcgaccugcccuucacccggaacaaccucgcgccccugcccgaccagaaguuccugagcggggagccgcuccgcaccaaccggguccugcccgccauccccucccagcgccggcacagcaccgccgccgaggaguccgagcacagcgccaaccccacguccgacgagaacuga

SEQ ID NO: 26667 - RNA, 2184 nt, Artificial Sequence
  derived and/or modified sequence opt1 from ANKRD6__Homo_sapiens__NP_001229738
augagccagcaggacgccguggccgcgcuguccgagcgccuccuggucgccgccuacaagggccagaccgagaacguggugcagcugaucaacaagggggcccgggucgccgugaccaagcacggccgcacgccccuccaccuggcggccaacaaggggcaccuccccgugguccagauccugcugaaggccggcugcgaccuggacgugcaggacgacggggaccagaccgcccuccaccgggcgaccguggucggcaacaccgagaucaucgccgcccugauccacgagggcugcgcccuggaccgccaggacaaggacgggaacacggcccuccacgaggcgagcuggcacggcuucucccagagcgccaagcugcugaucaaggccggggccaacgugcucgccaagaacaaggcgggcaacaccgcccugcaccuggccugccagaacucccacagccaguccacccgggugcuccugcuggccgggagccgcgccgaccucaagaacaacgcgggcgacacgugccugcacgucgccgcccgguacaaccaccuguccaucauccgccuccugcugaccgccuucugcagcgugcacgagaagaaccaggccggcgacaccgcgcuccacguggccgccgcccugaaccacaagaaggucgcgaagauccugcucgaggccggggccgacaccaccaucgugaacaacgccggccagacgccccuggagaccgcccgguaccacaacaaccccgagguggcgcugcuccugaccaaggcgccccagguccugcgcuucucccgggggcgcagccuccggaagaagcgcgagcggcugaaggaggagcgccgggcccaguccgugccccgcgacgagguggcccagagcaagggcuccgucagcgccggcgacacccccuccagcgagcaggccguggcccggaaggaggaggcccgcgaggaguuccuguccgccagccccgagccccgggccaaggacgaccgccgccgcaagagccggcccaagguguccgcguucagcgaccccacgccgcccgccgaccagcagccggggcaccagaagaaccuccacgcccacaaccaccccaagaagcggaaccgccaccggugcuccagcccgcccccgccccacgaguuccgcgccuaccagcuguacacccuguaccggggcaaggacgggaaggucaugcaggcgcccaucaacggcugccgcugcgagccccucaucaacaagcuggagaaccagcuggaggccaccguggaggagaucaaggccgagcucggguccguccaggacaagaugaacaccaagcugggccagauggagaacaagacgcagcaccagaugcgggugcuggacaagcucaugguggagcgccugagcgccgagcggaccgagugccugaaccgccugcagcagcacuccgacaccgagaagcacgagggcgagaagcggcagaucagccucgucgacgagcugaagaccuggugcaugcugaagauccagaaccucgagcagaagcuguccggggacagccgcgccugccgggcgaaguccacgccguccacgugcgagagcagcaccggcguggaccagcugguggucaccgccgggcccgccgccgccuccgacagcuccccgcccguggugcgccccaaggagaaggcgcucaacagcaccgccacccagcggcugcagcaggagcuguccagcagcgacugcaccggcucccgccuccggaacgucaaggugcagaccgcccugcugcccaugaacgaggccgcccgcagcgaccagcaggcggggcccugcgugaaccgcggcacgcagaccaagaaguccggcaagagcgggcccacccggcaccgcgcccagcagccggccgccuccuccacgugcggccagccgccgcccgcgaccgggagcgagcagaccggcccccacauccgggacaccagccaggcccucgagcugacccaguacuucuucgaggccgucuccacccagauggagaagugguacgagcgcaagaucgaggaggcccggagccaggccaaccagaaggcgcagcaggacaaggccacgcugaaggagcacaucaagucccucgaggaggagcuggccaagcugcgcacccgggugcagaaggagaacuga

SEQ ID NO: 26668 - RNA, 765 nt, Artificial Sequence
  derived and/or modified sequence opt1 from ANKRD7__Homo_sapiens__NP_062618
augaacaagcuguucagcuucuggaagcgcaagaacgagacccggucccagggcuacaaccuccgcgagaaggaccugaagaagcugcaccgggccgccagcgugggggaccucaagaagcugaaggaguaccugcagaucaagaaguacgacgucaacaugcaggacaagaaguaccgcacgccccuccaccuggcgugcgccaacggccacaccgacguggugcuguuccucaucgagcagcagugcaagaucaacguccgggacuccgagaacaagagcccgcugaucaaggccgugcagugccagaacgaggacugcgccaccauccugcucaacuucggggccgaccccgaccugcgcgacauccgguacaacaccgugcugcacuacgcggucugcggccagucccucagccugguggagaagcugcucgaguacgaggccgaccuggaggccaagaacaaggacggguacacgccccugcucguggccgucaucaacaacaaccccaagauggugaaguuccugcuggagaagggcgcggacgugaacgccuccgacaacuaccagcgcaccgcccucauccuggccgucagcggcgagccgcccugccuggugaagcuccugcugcagcaggggguggagcucugcuacgagggcaucgucgacucccagcugcggaacauguucaucagcauggugcugcuccaccgcuacccccaguucaccgccucccacgggaagaagaagcacgcgaaguga

SEQ ID NO: 26669 - RNA, 3405 nt, Artificial Sequence
  derived and/or modified sequence opt1 from ANKS1A__Homo_sapiens__NP_056060
augggcaaggagcaggagcugcucgaggccgcccgcaccgggcaccuccccgcgguggagaagcugcucagcggcaagcggcuguccagcggguucggcgggggcggcgggggcggguccggcgggggcggcgggggcagcgggggcggcgggggcgggcugggcuccagcucccacccgcucagcucccugcugagcauguggcgcgggcccaacgucaacugcguggacuccaccggcuacacgccccuccaccacgccgcccugaacggccacaaggacguggucgaggugcugcuccggaacgacgcccugaccaacguggccgacagcaaggggugcuacccccugcaccucgcggccuggaagggcgacgcccagaucguccgccugcugauccaccaggggccgucccacacccgggugaacgagcagaacaacgacaacgagaccgcccuccacugcgcggcccaguacggccacacggagguggucaaggugcugcuggaggagcucaccgaccccaccaugcgcaacaacaaguucgagacgccccuggaccuggccgcccucuacgggcggcuggagguggucaagaugcugcucaacgcccaccccaaccugcugagcugcaacaccaagaagcacaccccgcuccaccuggcggcccgcaacggccacaaggccguggugcagguccugcucgacgccggcauggacuccaacuaccagaccgagauggggagcgcccugcacgaggcggcccuguucggcaagaccgacguggugcagauccuccuggccgccgggacggacgucaacaucaaggacaaccacggccugaccgcccucgacaccgugcgggagcugcccucccagaagucccagcagaucgcggcccugaucgaggaccacaugaccgggaagcgcuccacgaaggagguggacaagaccccgccgccccagccgccccucaucagcagcauggacuccaucagccagaagucccagggcgacgucgagaaggccgugaccgagcugaucaucgacuucgacgccaacgccgaggaggagggccccuacgaggcgcuguacaacgccaucagcugccacucccucgacagcauggccuccgggcggagcagcgaccaggacagcaccaacaaggaggccgaggcggccggcgugaagcccgccgggguccgcccccgggagcgcccgccgccgcccgccaagcccccgcccgacgaggaggaggaggaccacaucgacaagaaguacuucccccugacggccuccgaggugcugagcaugcggccccgcauccacggcuccgcggcccgggaggaggacgagcaccccuacgagcugcugcugaccgccgagaccaagaaggucgugcugguggacggcaagaccaaggaccaccgccggagcuccagcucccgcagccaggacuccgccgaggggcaggacggccagguccccgagcaguucagcgggcuccugcacggcagcucccccgugugcgagguggggcaggaccccuuccagcugcucugcacggccggccagagccaccccgacggcagcccccagcagggggcgugccacaaggccuccaugcagcuggaggagaccggcguccacgcccccggggccucccagcccagcgcccuggaccaguccaagcgggugggcuaccucaccgggcugcccaccacgaacagccgcucccaccccgagacccugacccacaccgcgagcccccaccccggcggcgccgaggagggggaccgcuccggcgcccggagccgcgccccgcccacguccaagcccaaggcggagcucaagcugagccggucccugagcaaguccgacagcgaccuccugaccugcagccccaccgaggacgccaccauggggucccgcagcgagucccugagcaacugcuccaucggcaagaagcggcucgagaaguccccgagcuucgccagcgagugggacgagaucgagaagaucauguccagcaucggggagggcaucgacuucucccaggagcgccagaagaucagcggccugcggacgcuggagcaguccgugggggaguggcucgagagcaucggccugcagcaguacgaguccaagcugcuccugaacggguucgacgacguccacuuccugggcagcaacgugauggaggagcaggaccuccgcgacaucgggaucuccgacccccagcaccggcgcaagcugcugcaggccgcccggagccuccccaaggugaaggcgcugggcuacgacggcaacagcccgcccuccguccccagcuggcuggacucccucgggcugcaggacuacgugcacagcuuccuguccagcggcuacuccagcaucgacaccgugaagaaccucugggagcuggagcuggucaacgugcucaaggugcagcugcuggggcaccgcaagcggaucaucgccucccucgccgaccgccccuacgaggagcccccgcagaagccgccccgguucagccagcugcgcugccaggaccugcucucccagaccagcagcccccugucccagaacgacuccugcaccggccggagcgccgaccugcuccugccgcccggcgacaccgggcgccggcgccacgacucccugcacgaccccgccgcgcccagccgcgccgagcgguuccgcauccaggaggagcaccgggaggccaagcucacgcugcgcccgcccucccuggccgcccccuacgcgcccguccagagcuggcagcaccagcccgagaagcucaucuucgaguccugcggcuacgaggccaacuaccuggggagcaugcugaucaaggaccuccggggcaccgagagcacccaggacgccugcgccaagaugcgcaaguccaccgagcacaugaagaagauccccacgaucauccugagcaucaccuacaagggggugaaguucaucgacgcguccaacaagaacgugaucgccgagcacgagauccggaacaucagcugcgccgcccaggaccccgaggaccugugcaccuucgccuacaucaccaaggaccuccagacgucccaccacuacugccacgucuucagcaccguggacgugaaccugaccuacgagaucauccugacccucggccaggcguucgaggucgccuaccagcuggcccugcaggcccagaagucccgcgccacgggcgcgagcgccgccgagaugaucgagaccaaguccagcaagccggugcccaagccccggguggggguccgcaaguccgcccucgagcccccggacauggaccaggacgcccagagccacgcguccgugagcuggguggucgaccccaagcccgacuccaagcggagccuguccaccaacuga

SEQ ID NO: 26670 - RNA, 1074 nt, Artificial Sequence
  derived and/or modified sequence opt1 from ANKS1B__Homo_sapiens__NP_001190995
auggccaacggcuucgacaacgugcaguucauggggagcaacgucauggaggaccaggaccugcucgagaucggcauccugaacuccgggcaccgccagcggauccugcaggccauccagcuccugcccaagaugcgcccgaucggccacgacggguaccaccccaccagcguggcggaguggcuggacuccaucgagcucggcgacuacaccaaggccuuccugaucaacggcuacacgagcauggaccugcucaagaagaucugggagguggagcugaucaaccaguccagcgucugcgagaucuggaccaaccagaacgccggguuccccuucuccgccauccaccaggugcacaacaccggcgacuggggcgagcccagcaucacccugcggccgcccaacgaggccacggcguccacccccgugcaguacuggcagcaccaccccgagaagcucaucuuccagagcugcgacuacaaggccuucuaccugggguccaugcugaucaaggagcuccgcgggaccgagagcacccaggacgccugcgccaagaugcgggcgaacugccagaaguccacggagcagaugaagaaggucccgaccaucauccugagcguguccuacaagggcgugaaguucaucgacgccaccaacaagaacaucaucgccgagcacgagauccgcaacaucagcugcgccgcccaggaccccgaggaccuguccaccuucgcguacaucacgaaggaccucaagagcaaccaccacuacugccacgucuucaccgccuucgacgugaaccuggccuacgagaucauccugacccucggccaggccuucgagguggccuaccagcuggcgcugcaggcccggaagggcgggcacuccagcacccuccccgagagcuucgagaacaagcccuccaagccgauccccaagccccgcgucagcauccggaaguccgugaucgaccccagcgagcagaagacgcuggccaaccugccguggaucguggagcccgggcaggaggccaagcgcggcaucaacaccaaguacgagaccaccaucuucuga

SEQ ID NO: 26671 - RNA, 1254 nt, Artificial Sequence
  derived and/or modified sequence opt1 from ANKS4B__Homo_sapiens__NP_665872
augagcacccgcuaccaccaggccgccuccgacagcuaccuggagcuccugaaggaggcgaccaagcgggaccugaaccucuccgacgaggacggcaugacgcccacccugcuggccgccuaccacgggaaccucgaggcccuggagaucaucugcagccgcggcggggacccggaccggugcgacaucuggggcaacacgccccugcacuucgccgcguccaacgggcacgcccacugcgugagcuuccucgugaacuucggcgccaacaucuucgcccuggacaacgaccugcagacgccccucgacgcggccgccucccgcgagcagaacgagugcguggcccugcuggacaaggccgcgaccgcccagaacaucaugaaccccaagaaggugacccggcucaaggagcaggcccagaagaacgcccgccggcagaucaaggagugcgagcgccugcaggagaagcaccagaacaagauggcccacaccuacagcaaggaggaguccggcacccugagcuccagcaaggggaccuucucccggagcuccccgagcaacgcguccgcccccggcaccuucgggagccucuccaagggcaucaaggacaccuucaagaucaaguucaagaagaacaaggacaccgccgagcaggucgggaaggagggccgcagcggccagcggaacgugauggagguguuccgcgaggaggaggaggacagcuucuccggggacuucaaggagaagcugcagcugagcgccgaggaggacggcuccguccaccacgagagcauccucaaccggcccgggcugggcuccaucguguuccgccggaaccgcaucagcucccccgaggacaucagcgacuccaagcgggaguucggcuucaagcugccgagcgagcuccugcagcgccagggggccuccgaggcggacgagggcgccgccgacgaggagggggaggagaacggccugaaggacgaccuccccugggacgacgacgagguggagugggaggaggacgucguggacgccacgccccuggagguguuccugcucagccagcaccuggaggaguuccugcccaucuucaagcgggagcagaucgaccucgaggcccugcugcucugcuccgacgaggaccugcagagcauccagaugcagcuggggccgcgcaagaagguccucaacgcgaucaaccggcgcaagcagguccugcagcagcccggccagcugguggacaccucccucuga

SEQ ID NO: 26672 - RNA, 2616 nt, Artificial Sequence
  derived and/or modified sequence opt1 from ANKS6__Homo_sapiens__NP_775822
augggcgagggcgggcugcccccggccuuccagcuccugcugcgcgccugcgaccagggggacaccgagaccgcgcggcgccuccuggagcccggcgccgccgagcccgccgagcgcggggccgagcccgaggcgggcgccgagccggccggcgccgagguggcggggcccggcgccgccgccgccggggcggucggcgcccccgugcccguggacugcagcgacgaggccgggaacacggcccugcaguucgccgcggccggcggccacgagccgcucguccgguuccugcugcggcgcggggccuccgugaacagccggaaccacuacggcugguccgcccucaugcaggccgcgcgcuucgggcacgugagcgucgcccaccuccugcucgaccacggcgccgacgugaacgcccagaaccggcugggcgccuccgugcugaccgucgcgagccgcgggggccaccucgggguggugaagcugcugcucgaggccggcgccuucgucgaccaccaccaccccuccggggagcagcugggccugggcgggagccgggacgagccccucgacaucaccgcccugauggcggccauccagcacggccacgaggccguggugcgccugcucauggaguggggcgccgaccccaaccacgccgcgcggaccgucgggugguccccgcugaugcuggccgcccucacggggcgccugggcguggcccagcagcugguggagaagggcgccaaccccgaccaccucagcguccuggagaagaccgcguucgagguggcccuggacugcaagcaccgggaccucguggacuaccuggacccccugaccaccguccgccccaagacggacgaggagaagcggcgcccggacaucuuccacgcccugaagauggggaacuuccagcuggugaaggagaucgccgacgaggaccccucccacgugaaccuggucaacggcgacggggccacgccccucaugcuggcggccgugaccggccagcuggcccucguccagcugcugguggagcggcacgccgacguggacaagcaggacagcguccacggguggaccgcgcucaugcaggccaccuaccacggcaacaaggagaucgugaaguaccugcugaaccagggcgccgacgugacccuccgcgccaagaacggguacaccgccuucgaccuggucaugcugcugaacgaccccgacaccgagcucgugcggcugcuggcguccgugugcaugcaggucaacaaggacaagggccgcccgagccaccagccgccccucccccacuccaaggugcgccagcccuggagcauccccgugcugcccgacgacaagggcgggcugaaguccugguggaaccggaugagcaaccgcuuccggaagcucaagcugaugcagacgcugccccgcggccucuccagcaaccagccgcugcccuucagcgacgagcccgagccggcccuggacuccaccaugcgggccgcgccccaggacaagaccagccgcuccgcccuccccgacgccgcccccgucaccaaggacaacgggccgggcagcacgcgcggggagaaggaggacacccugcugaccaccaugcuccggaacggcgcgccccugacgcggcugcccuccgacaagcucaaggccgugaucccgcccuuccugccgcccagcuccuucgagcuguggagcuccgaccgcagccggacccgccacaacgggaaggccgaccccaugaagaccgcccucccccagcgggccucccgcggccaccccgugggcgggggcgggaccgacacgacccccguccggcccgugaaguucccgagccugccccgcucccccgccagcuccgccaacagcggcaacuucaaccacagcccccacuccuccgggggcagcagcggcgugggggucucccggcacggcggggagcugcucaaccgcagcggcggguccaucgacaacgugcugagccagaucgcggcccagcggaagaaggccgccggccugcucgagcagaagccgucccaccgcagcucccccgugggccccgcccccgggagcuccccgagcgagcugcccgcgucccccgccggcgggagcgccccggucggcaagaagcuggagaccuccaagcgcccgcccagcgggaccuccacgaccagcaaguccaccagccccacccucacgcccagccccucccccaagggccacaccgccgagagcuccgugagcuccagcuccagccaccggcaguccaagagcuccggcgggagcuccagcggcaccaucaccgacgaggacgagcugaccgggauccugaagaagcucucccuggagaaguaccagcccaucuucgaggagcaggagguggacauggaggccuuccugacgcucaccgacggcgaccugaaggagcugggcaucaagaccgacgggagccgccagcagauccucgcggccaucuccgagcugaacgccggcaaggggcgggagcgccagauccugcaggagaccauccacaacuuccacagcuccuucgagagcagcgccuccaacacgcgggccccgggcaacagccccugcgcguga

SEQ ID NO: 26673 - RNA, 3264 nt, Artificial Sequence
  derived and/or modified sequence opt1 from ANLN__Homo_sapiens__NP_001271230
auggaccccuucaccgagaagcugcucgagcgcacccgggcccgccgggagaaccugcagcgcaagauggccgagcggccgacggcggcgccccgcagcaugacccacgccaagcgggcccgccagccccuguccgaggccagcaaccagcagccccucuccggcggggaggagaaguccugcaccaagccgucccccagcaagaagcggugcuccgacaacaccgagguggaggucagcaaccuggagaacaagcagcccguggaguccacgagcgcgaaguccugcagccccuccccggugagcccccagguccagccccaggccgccgacaccaucuccgacagcguggccgugcccgcgucccugcucggcaugcgccgggggcugaacagccgccuggaggccaccgccgccuccagcgucaagacccggaugcagaagcucgccgagcagcgccggcgcugggacaacgacgacaugacggacgacaucccggagagcucccuguucagccccaugcccuccgaggagaaggcggccagcccgccccggccccugcucuccaacgccagcgccacccccgugggccgccgggggcgccuggccaaccuggcggccaccaucugcuccugggaggacgacgugaaccacagcuucgccaagcagaacuccguccaggagcagcccggcaccgccugccucagcaaguucuccagcgccuccggcgcgagcgcccggaucaacuccagcuccgugaagcaggaggccacguucugcagccagcgcgacggggacgccucccugaacaaggcccugagcagcuccgcggacgacgccagccucgugaacgccuccaucagcuccagcgucaaggccaccuccccggucaagagcaccaccuccaucacggacgccaagagcugcgagggccagaaccccgagcugcugcccaagacccccaucuccccgcucaagaccggggugagcaagcccaucgugaaguccacccugagccagacggugcccuccaagggcgagcugagccgcgagaucugccuccagucccagagcaaggacaagagcaccacccccgggggcaccggcaucaagccguuccuggagcgguucggggagcgcugccaggagcacuccaaggagagccccgcccgguccacgccccaccgcaccccgaucaucacccccaacaccaaggccauccaggagcggcuguucaagcaggacacgagcuccagcaccacccaccucgcccagcagcugaagcaggagcgccagaaggagcuggccugccuccggggccgcuucgacaaggggaacaucugguccgcggagaagggcggcaacagcaaguccaagcagcuggagaccaagcaggagacgcacugccagagcacgccccugaagaagcaccaggggguguccaagacccagagccuccccgucaccgagaaggugaccgagaaccagaucccggccaagaacuccagcaccgagcccaaggaggugauccgggagaucgagauguccgucgacgacgacgacaucaacagcuccaaggugaucaacgaccuguucagcgacgugcuggaggagggcgagcucgacauggagaagucccaggaggagauggaccaggcccuggccgagagcagcgaggagcaggaggacgcccugaacaucuccagcaugucccuccuggcgccccuggcccagaccgucgggguggucagccccgagucccucgugagcaccccgcgccuggagcugaaggacaccucccggagcgacgagucccccaagcccggcaaguuccagcgcacgcgggugccccgcgccgagagcggggacucccucggcagcgaggaccgggaccugcuguacuccaucgacgccuaccgcagccagcgguucaaggagaccgagcgcccguccaucaagcaggucaucgugcggaaggaggacgugaccagcaagcucgacgagaagaacaacgccuuccccugccaggucaacaucaagcagaagaugcaggagcugaacaacgagaucaacaugcagcagaccgugaucuaccaggcgucccaggcccugaacugcugcguggacgaggagcacggcaaggggagccuggaggaggccgaggccgagcgccuccugcugaucgcgacgggcaagcgcacccuccugaucgacgagcugaacaagcucaagaacgaggggccccagcggaagaacaaggccagcccccagagcgaguucaugccgagcaagggcuccgucacccugagcgagauccgccugccccucaaggccgacuucgugugcuccaccgugcagaagcccgacgccgccaacuacuacuaccugaucauccugaaggcgggggccgagaacauggucgccacgccccucgccagcaccuccaacagccugaacggcgacgcccugaccuucaccacgaccuucacccuccaggacguguccaacgacuucgagaucaacaucgagguguacagccugguccagaagaaggacccguccggccuggacaagaagaagaagaccagcaaguccaaggcgaucacgcccaagcggcuccugaccagcaucaccaccaaguccaacauccacagcuccgugauggccagccccgggggccuguccgccgugcgcacgagcaacuucgcccucgucggguccuacacccugagccugagcuccgugggcaacaccaaguucgugcucgacaagguccccuuccugagcucccuggaggggcacaucuaccucaagaucaagugccaggugaacagcuccguggaggagcggggcuuccugaccaucuucgaggacgucagcggcuucggggccuggcaccgccgguggugcgugcuguccggcaacugcaucagcuacuggacguacccggacgacgagaagcgcaagaaccccaucgggcggaucaaccucgcgaacugcaccucccgccagaucgagcccgccaaccgggaguucugcgcccgccggaacaccuucgagcugaucaccgugcgcccgcagcgggaggacgaccgcgagacgcuggucagccagugccgggacacccucugcgugaccaagaacuggcuguccgccgacaccaaggaggagcgcgaccuguggaugcagaagcucaaccaggugcuggucgacauccggcuguggcagcccgacgcgugcuacaagcccaucggcaagcccuga

SEQ ID NO: 26674 - RNA, 1884 nt, Artificial Sequence
  derived and/or modified sequence opt1 from ANO10__Homo_sapiens__NP_001191760
augaaggugacccugagcgcccucgacaccuccgagagcuccuucacgccccuggucgugaucgagcuggcccaggacgugaaggaggagaccaaggaguggcucaagaaccgcaucaucgcgaagaagaaggacggcggggcccagcugcuguuccggccgcuccugaacaaguacgagcaggagacccuggagaaccagaaccucuaccuggucggcgccagcaagauccgcaugcugcucggggccgaggccgugggccuggugaaggagugcaacgacaacaccaugcgggcguucacguaccgcacccggcagaacuucaagggguucgacgacaacaacgacgacuuccugaccauggccgagugccaguucaucaucaagcacgagcucgagaaccugcgcgccaaggacgagaagaugauccccggcuacccccaggccaagcuguaccccggcaagucccuccugcggcgccugcucaccagcgggaucgucauccagguguucccgcugcacgacuccgaggcgcugaagaagcucgaggacacgugguacacccgguucgcccugaaguaccagcccaucgacagcauccgcggcuacuucggggagaccaucgcccuguacuucggcuuccucgaguacuucaccuucgcccugauccccauggccgugaucgggcugcccuacuaccucuucgucugggaggacuacgacaaguacgugaucuucgcguccuucaaccugaucuggagcacggugauccuggagcucuggaagcggggcugcgccaacaugaccuaccgcuggggcacccugcugaugaagcggaaguucgaggagccgcgccccggguuccacggcguccucgggaucaacuccaucaccggcaaggaggagccccuguaccccagcuacaagcggcagcugcgcaucuaccucgugucccugccguucgugugccugugccucuacuucagccuguacgucaugaugaucuacuucgacauggaggugugggcccugggccuccacgagaacuccgggagcgaguggacguccgugcugcuguacguccccagcaucaucuacgccaucgugaucgagaucaugaaccggcucuaccgcuacgccgcggaguuccugaccuccugggagaaccaccggcuggagagcgccuaccagaaccaccugauccucaaggugcuggucuucaacuuccugaacugcuucgccagccucuucuacaucgccuucgugcugaaggacaugaagcugcuccgccagucccuggccacccugcucaucaccagccagauccugaaccagaucauggaguccuuccugcccuacuggcuccagcggaagcacggcgugcgcgucaagcgcaaggugcaggcgcugaaggccgacaucgacgccacgcuguacgagcaggucauccucgagaaggagauggggaccuaccugggcaccuucgacgacuaccuggagcuguuccuccaguucggguacgugagccuguucuccugcguguacccccucgccgccgcguucgccguccugaacaacuucaccgaggugaacagcgacgcccugaagaugugccggguguucaagcgcccguucuccgagcccagcgccaacaucggcgucuggcagcucgcguucgagacgauguccgugaucagcguggucaccaacugcgcccugaucggcaugagcccccaggugaacgccguguuccccgaguccaaggccgaccugauccucaucgucguggccguggaggcggccuccugcaagcuggucagccugccgcgguacuccuggagcaccaacuccgugcccgggaccgugaucggccccggggucuga

SEQ ID NO: 26675 - RNA, 2961 nt, Artificial Sequence
  derived and/or modified sequence opt1 from ANO1__Homo_sapiens__NP_060513
augcgcgugaacgagaaguacagcacccugcccgccgaggaccgguccguccacaucaucaacaucugcgccaucgaggacaucggcuaccucccgagcgaggggacccugcugaacucccucagcguggaccccgacgcggagugcaaguacggccuguacuuccgcgacgggcggcgcaagguggacuacauccuggucuaccaccacaagcggcccuccggcaaccgcacgcucgugcggcgcgugcagcacagcgacacccccuccggggcccggagcgucaagcaggaccacccgcugcccggcaagggcgccucccuggacgccgggagcggcgagccgcccauggacuaccacgaggacgacaagcgcuuccggcgcgaggaguacgaggggaaccuccuggaggccggccuggagcucgagcgggacgaggacaccaagauccacggggugggcuucgugaagauccacgcgcccuggaacguccugugccgcgaggccgaguuccugaagcucaagaugcccaccaagaagauguaccacaucaacgagacgcggggccugcugaagaagaucaacuccgugcuccagaagaucaccgaccccauccagcccaagguggccgagcaccgcccgcagaccaugaagcggcugagcuaccccuucucccgcgagaagcagcaccuguucgaccucagcgacaaggacuccuucuucgacagcaagacccgguccacgaucgucuacgagauccugaagcgcacgaccugcaccaaggccaaguacagcauggggaucaccucccugcucgcgaacggcguguacgccgccgccuacccccugcacgacggggacuacaacggcgagaacguggaguucaacgaccggaagcugcucuacgaggagugggcccgcuacggcgucuucuacaaguaccagcccaucgaccuggugcgcaaguacuucggggagaagaucggccuguacuucgcguggcucgggguguacacccagaugcugaucccggccagcaucgucggcaucaucguguuccuguacgggugcgccaccauggacgagaacauccccagcauggagaugugcgaccagcggcacaacaucaccaugugcccccucugcgacaagacgugcuccuacuggaagaugagcuccgccugcgccaccgcgcgcgccagccaccuguucgacaaccccgccaccguguucuucuccgucuucauggcccugugggccgcgaccuucauggagcacuggaagcggaagcagaugcgccucaacuaccggugggaccugacgggcuucgaggaggaggaggaggccgugaaggaccacccgcgcgccgaguacgaggcccgggugcuggagaagucccucaagaaggagagccgcaacaaggagaagcggcgccacauccccgaggagagcaccaacaaguggaagcagcgggucaagaccgccauggcgggcgugaagcugaccgacaaggucaagcugacguggcgcgaccgguuccccgccuaccucaccaaccugguguccaucaucuucaugaucgccgugaccuucgccaucguccugggggugaucaucuaccgcaucagcauggcggccgcccucgccaugaacuccagccccuccgugcggagcaacauccgcgucaccgugacggccaccgcggugaucaucaaccuggucgugaucauccugcucgacgagguguacggcugcaucgcccgguggcugaccaagaucgaggucccgaagaccgagaaguccuucgaggagcgccugaucuucaaggccuuccugcucaaguucgugaacagcuacacgcccaucuucuacguggccuucuucaaggggcgguucgucggccgccccggggacuacguguacaucuuccgcuccuuccggauggaggagugcgcccccggcggcugccugauggagcugugcauccagcucagcaucaucaugcuggggaagcagcugauccagaacaaccucuucgagaucggcaucccgaagaugaagaagcugauccgcuaccugaagcucaagcagcaguccccgcccgaccacgaggagugcgugaagcggaagcagcgcuacgaggucgacuacaaccuggagcccuucgcggggcugacccccgaguacauggagaugaucauccaguucggcuucgugacccucuucguggccagcuucccccuggcgccccuguucgcccuccugaacaacaucaucgagauccggcuggacgccaagaaguucgucaccgagcuccgccggccgguggccgugcgcgccaaggacaucgggaucugguacaacauccugcggggcaucggcaagcuggccgucaucaucaacgccuucgugaucagcuucacguccgacuucaucccccgccucguguaccuguacauguacagcaagaacgggaccaugcacggcuucgucaaccacacccuguccagcuucaacguguccgacuuccagaacgggaccgcgcccaacgacccccucgaccugggcuacgaggugcagaucugccgguacaaggacuaccgcgagccgcccuggagcgagaacaaguacgacaucuccaaggacuucugggccguccuggccgcccggcucgccuucgugaucguguuccagaaccuggucauguucaugagcgacuucguggacugggugauccccgacauccccaaggacaucucccagcagauccacaaggagaagguccugaugguggagcuguucaugcgcgaggagcaggacaagcagcagcuccuggagaccuggauggagaaggagcggcagaaggacgagccgcccugcaaccaccacaacacgaaggcgugccccgacagccucggcucccccgccccgagccacgccuaccacgggggcgugcuguga

SEQ ID NO: 26676 - RNA, 3012 nt, Artificial Sequence
  derived and/or modified sequence opt1 from ANO2__Homo_sapiens__NP_001265525
auggccacccccggcccgcgcgacaucccccugcuccccgggagcccccggcgccuguccccgcaggccggcagccgcgggggccaggggcccaagcacggccagcagugccugaagaugcccggcccccgggcgccggggcuccagggcggguccaaccgggaccccggccagcccugcgggggcgagagcacccgcuccagcuccgugaucaacaacuaccuggacgccaacgagcccgucagccuggaggcccggcucucccgcaugcacuuccacgacagccagcggaagguggacuacgugcuggccuaccacuaccgcaagcggggcguccaccuggcccagggguucccgggccacucccucgcgaucgugagcaacggggagacgggcaaggagccccacgccggcgggcccggcgacaucgagcuggggccccuggacgcccucgaggaggagcgcaaggagcagcgggaggaguucgagcacaaccugauggaggccggccuggagcucgagaaggaccuggagaacaagucccaggggagcaucuucgugcgcauccacgcgccguggcagguccuggcccgggaggccgaguuccucaagaucaaggugcccaccaagaaggagauguacgagaucaaggccggcggcuccaucgccaagaaguucagcgcggcccugcagaagcuguccagccaccuccagccccgcgugcccgagcacuccaacaacaagaugaagaaccugagcuacccguucagccgggagaagauguaccuguacaacauccaggagaaggacaccuucuucgacaacgccacccgcucccggaucguccacgagauccucaagcgcacggccugcagccgggccaacaacaccauggggaucaacucccugaucgcgaacaacaucuacgaggccgccuacccccugcacgacggcgaguacgacagccccgaggacgacaugaacgaccgcaagcuccuguaccaggagugggcccgcuacgggguguucuacaaguuccagcccaucgaccugauccggaaguacuucggcgagaagaucgggcucuacuucgccuggcugggccuguacaccuccuuccucaucccgagcuccgugaucggcgucaucguguuccuguacgggugcgcgaccaucgaggaggacauccccagccgcgagaugugcgaccagcagaacgccuucacgaugugcccccugugcgacaaguccugcgacuacuggaaccucagcuccgccugcggcaccgcccaggccagccaccuguucgacaaccccgcgaccguguucuucuccaucuucauggcccugugggccaccauguuccucgagaacuggaagcggcugcagaugcgccugggguacuucugggaccucacgggcaucgaggaggaggaggagcgggcccaggagcacagccgcccggaguacgagaccaagguccgggagaagaugcugaaggaguccaaccagagcgcggugcagaagcuggagaccaacaccacggagugcggggacgaggacgacgaggacaagcucaccuggaaggaccgcuuccccggcuaccugaugaacuucgccuccauccuguucaugaucgcccucaccuucagcaucguguucggcgucaucguguaccggaucaccacggccgccgcgcugucccugaacaaggccacccgcagcaacgugcgggucaccgugaccgccacggccgugaucaucaaccuggucgugauccucauccuggacgagaucuacggggccgucgcgaaguggcugaccaagaucgaggugcccaagaccgagcagaccuucgaggagcgccucauccugaaggccuuccugcucaaguucgugaacgccuacagcccgaucuucuacgucgccuucuucaagggccgguucguggggcgccccggcuccuacguguacgucuucgacggcuaccggauggaggagugcgcccccgggggcugccugauggagcugugcauccagcucagcaucaucaugcuggggaagcagcugauccagaacaacaucuucgagaucggcgugcccaagcucaagaagcuguuccgcaagcugaaggacgagacggaggcgggggagaccgacuccgcccacagcaagcacccggagcagugggaccucgacuacucccuggagcccuacaccggccugacccccgaguacauggagaugaucauccaguucggcuucgugacccucuucgucgccagcuucccccuggccccgguguucgcgcugcucaacaacgugaucgagguccggcuggacgccaagaaguucgugacggagcugcgccggcccgacgccgugcgcaccaaggacaucgggaucugguucgacauccucuccggcaucgggaaguucagcgucaucuccaacgccuucgugaucgccaucaccagcgacuucaucccccgccugguguaccaguacuccuacagccacaacggcacgcugcacggguucgucaaccacacccucuccuucuucaacgugagccagcugaaggagggcacccagcccgagaacucccaguucgaccaggaggugcaguucugccgguucaaggacuaccgcgagccgcccugggcgcccaaccccuacgaguucagcaagcaguacugguucauccuguccgcccggcucgccuucgucaucaucuuccagaaccuggugauguuccugagcgugcucgucgacuggaugaucccggacauccccaccgacaucagcgaccagaucaagaaggagaagucccugcugguggacuucuuccucaaggaggagcacgagaagcugaagcugauggacgagcccgcccuccgcagccccggcgggggcgaccggucccgcagccgggccgcguccagcgccccguccgggcagagccagcugggcuccaugaugagcuccgggagccagcacaccaacguguga

SEQ ID NO: 26677 - RNA, 2946 nt, Artificial Sequence
  derived and/or modified sequence opt1 from ANO3__Homo_sapiens__NP_113606
auggugcaccacagcggcuccauccagagcuucaagcagcagaaggggaugaacaucuccaagagcgagaucaccaaggagaccucccugaagcccagccgccggucccugccgugccuggcccagagcuacgccuacuccaagagccugucccagagcacgucccucuuccagagcaccgaguccgagagccaggcgcccaccuccaucacccugaucagcacggacaaggccgagcaggucaacaccgaggagaacaagaacgacuccgugcugcgcugcagcuucgccgaccucagcgacuucugccuggcccugggcaaggacaaggacuacaccgacgaguccgagcacgccaccuacgaccggagccgccucaucaacgacuucgugaucaaggacaaguccgaguucaagacgaagcugagcaagaacgacaugaacuacaucgcguccagcgggccccuguucaaggacggcaagaagcggaucgacuacauccucgucuaccgcaagaccaacauccaguacgacaagcggaacaccuucgagaagaaccugcgcgccgaggggcugaugcucgagaaggagcccgccaucgccuccccggacaucauguucaucaagauccacauccccugggacacccugugcaaguacgcggagcggcugaacauccgcaugcccuuccggaagaagugcuacuacacggacggccgcagcaaguccaugggccggaugcagaccuacuuccgccggaucaagaacuggauggcccagaaccccauggugcucgacaagagcgccuucccggaccuggaggaguccgacugcuacaccgggcccuucagccgcgcccggauccaccacuucaucaucaacaacaaggacaccuucuucuccaacgccacgcgcagccggaucguguaccacaugcuggagcgcaccaaguacgagaacggcaucuccaaggucgggauccggaagcucaucaacaacggcagcuacaucgcggccuucccgccccacgagggggccuacaaguccagccagcccaucaagacccacggcccccagaacaaccgccaccuccuguacgagcgcugggcccgguggggcaugugguacaagcaccagccccuggaccugauccgccuguacuucggggagaagaucggccucuacuucgccuggcuggggugguacaccggcaugcugauccccgcggccaucgugggccucugcguguucuucuacgggcuguucacgaugaacaacucccaggucagccaggagaucugcaaggccaccgagguguucaugugcccgcugugcgacaagaacugcagccuccagcggcugaacgacuccugcaucuacgccaaggugaccuaccuguucgacaacggcgggaccgucuucuucgccaucuucauggcgaucugggccacgguguuccucgaguucuggaagcgccggcgcagcauccugaccuacaccugggaccugaucgagugggaggaggaggaggagacccuccggccccaguucgaggccaaguacuacaagauggagaucgugaaccccaucacgggcaagcccgagccgcaccagcccuccagcgacaaggucacccgccugcugguguccgugagcgggaucuucuucaugaucucccucgucaucaccgccguguucggcguggucguguaccggcugguggucauggagcaguucgccagcuucaaguggaacuucaucaagcaguacuggcaguucgcgaccuccgccgccgccgugugcaucaacuucaucaucaucaugcugcucaaccuggcguacgagaagaucgccuaccugcucacgaaccuggaguacccccgcaccgagagcgagugggagaacuccuucgcccugaagauguuccuguuccaguucgucaaccucaacagcuccaucuucuacaucgccuucuuccugggccgguucguggggcaccccggcaaguacaacaagcuguucgaccgcuggcggcucgaggagugccacccgagcgggugccugaucgaccugugccuccagaugggcgugaucauguuccugaagcagaucuggaacaacuucauggagcugggguacccccucauccagaacugguggucccgccacaagaucaagcggggcauccacgacgccagcaucccccagugggagaacgacuggaaccugcagcccaugaaccugcacggccucauggacgaguaccuggagaugguccugcaguucggguucaccaccaucuucguggcggccuucccgcucgcgccccugcuggcccuccugaacaacaucaucgagauccgccuggacgccuacaaguucgugacgcaguggcggcgcccccucccggcccgggccaccgacaucggcaucuggcuggggauccuggagggcaucgggauccucgccgucaucaccaacgccuucgugaucgccaucaccuccgacuacaucccccgcuucguguacgaguacaaguacggccccugcgcgaaccacgucgagcccagcgagaacugccugaagggcuacgugaacaacagccuguccuucuucgaccucagcgagcuggggaugggcaaguccggguacugccgcuaccgggacuaccgcggcccgcccuggagcuccaagcccuacgaguucacccugcaguacuggcacauccucgccgcccggcuggccuucaucaucguguucgagcaccuggucuucggcaucaagagcuucaucgcguaccucauccccgacgugccgaaggggcugcacgaccgcauccggcgcgagaaguaccuggugcaggagaugauguacgaggccgagcucgagcaccuccagcagcagcggcgcaaguccggccagcccguccaccacgaguggcccuga

SEQ ID NO: 26678 - RNA, 2868 nt, Artificial Sequence
  derived and/or modified sequence opt1 from ANO4__Homo_sapiens__NP_001273545
auggaggccagcuccagcggcaucaccaacgggaagaccaagguguuccaccccgagggcggggucgaccugcagggcuaccagcucgacaugcagauccugccggacgggcccaaguccgacguggacuucagcgagauccugaacgccauccaggagauggcgaaggacgugaacauccucuucgacgagcuggaggccgucuccagccccugcaaggacgacgacucccugcuccaccccggcaaccugacgagcaccuccgacgacgccagccgccuggaggccggcggggagaccgugccggagcggaacaaguccaacggccucuacuuccgcgacgggaagugccggaucgacuacauccugguguaccgcaagagcaacccccagaccgagaagcgggaggucuucgagcgcaacauccgggccgagggccugcagauggagaaggaguccagccucaucaacuccgacaucaucuucgugaagcugcacgcgcccugggaggugcuggggcgcuacgccgagcagaugaacguccggaugcccuuccgccggaagaucuacuaccucccgcgccgguacaaguucaugagccgcaucgacaagcagaucucccgguuccgccgguggcugcccaagaagcccaugcgccuggacaaggagacgcuccccgaccuggaggagaacgacugcuacaccgccccguucagccagcagcggauccaccacuucaucauccacaacaaggagaccuucuucaacaacgccacccgcucccggaucgugcaccacauccugcagcgcaucaaguacgaggagggcaagaacaagaucggccucaaccgccugcugacgaacgggagcuacgaggcggccuucccccuccacgagggcagcuaccgguccaagaacagcauccgcacccacggggccgagaaccaccggcaccuccuguacgagugcugggccuccuggggcgugugguacaaguaccagccccuggaccugguccgccgguacuucggcgagaagaucgggcuguacuucgccuggcucggcugguacaccgggaugcuguuccccgcggccuucaucggccuguucguguuccucuacggggugaccacgcuggaccacagccaggucuccaaggaggugugccaggccaccgacaucaucaugugcccggugugcgacaaguacugccccuucaugcgccugagcgacuccugcgucuacgccaaggugacccaccucuucgacaacggcgccaccguguucuucgcggucuucauggccgugugggccacgguguuccuggaguucuggaagcggcgccgggccgucaucgccuacgacugggaccugaucgacugggaggaggaggaggaggagauccgcccccaguucgaggcgaaguacagcaagaaggagcggaugaaccccaucuccggcaagccggagcccuaccaggccuucaccgacaagugcagccgccucaucguguccgccagcgggaucuucuucaugaucugcgucgugaucgccgccguguucggcaucgucaucuaccggguggugaccgucuccaccuucgcggccuucaagugggcccugauccgcaacaacagccagguggccacgaccgggaccgcggugugcaucaacuucugcaucaucaugcugcucaacguccuguacgagaagguggcccugcuccugaccaaccuggagcagccccggacggaguccgagugggagaacagcuucacccucaagauguuccuguuccaguucgugaaccugaacuccagcaccuucuacaucgccuucuuccugggccgcuucaccgggcaccccggcgccuaccuccggcugaucaaccgcuggcggcuggaggagugccacccguccggcugccucaucgaccugugcaugcagauggggaucaucaugguccugaagcagacguggaacaacuucauggagcucggcuacccccugauccagaacugguggacccgccgcaaggugcggcaggagcacgggcccgagcgcaagaucagcuucccccagugggagaaggacuacaaccugcagccgaugaacgccuacggccucuucgacgaguaccuggagaugauccugcaguucggguucaccaccaucuucguggcggccuucccccucgcgccccugcuggcccuccugaacaacaucaucgagauccggcuggacgccuacaaguucgucacgcaguggcgccggccgcucgccagccgcgccaaggacaucggcaucugguacggcauccuggaggggaucggcauccuguccgugaucaccaacgccuucgugaucgccaucaccagcgacuucaucccccggcucgucuacgccuacaaguacgggcccugcgcgggccagggcgaggccgggcagaagugcauggugggcuacgugaacgccucccugagcgucuuccgcaucuccgacuucgagaaccggagcgagcccgaguccgacgggagcgaguucuccggcaccccgcugaaguacugccgcuaccgggacuaccgcgacccgccccacagccucgugcccuacggguacacgcugcaguucuggcacgugcuggccgcgcggcucgccuucaucaucgucuucgagcaccugguguucugcaucaagcaccugaucuccuaccucauccccgaccugcccaaggaccugcgcgaccggaugcgccgggagaaguaccucauccaggagaugauguacgaggccgagcuggagcgccugcagaaggagcggaaggagcgcaagaagaacggcaaggcccaccacaacgaguggcccuga

SEQ ID NO: 26679 - RNA, 2742 nt, Artificial Sequence
  derived and/or modified sequence opt1 from ANO5__Homo_sapiens__NP_998764
augggcgaccccgaccugcucgaggugcuggccgaggagggggagaaggucaacaagcacaucgacuacagcuuccagauguccgagcagagccuguccagccgcgagaccuccuuccucaucaacgaggagaccaugccggccaagcgguucaaccuguuccugcgccggcgccucauguuccagaagaaccagcagagcaaggacuccaucuucuuccgggacggcauccgccagaucgacuucgugcugagcuacguggacgacgucaagaaggacgcggagcugaaggccgagcggcgcaaggaguucgagacgaaccuccggaagaccgggcuggagcuggagaucgaggacaagcgcgacuccgaggacggccggaccuacuucgugaagauccacgcccccugggaggugcucgucaccuacgccgaggugcuggggaucaagaugcccaucaaggagagcgacaucccccgcccgaagcacacgcccaucuccuacgugcugggccccguccggcucccccugagcgugaaguacccgcaccccgaguacuucaccgcccaguucucccgccaccggcaggagcuguuccucaucgaggaccaggcgaccuucuuccccagcuccagccgcaaccggaucguguacuacauccugucccgcugccccuucggcaucgaggacgggaagaagcgguucggcaucgagcgccugcucaacagcaacaccuacuccagcgccuacccgcugcacgacgggcaguacuggaagcccagcgagccgcccaaccccacgaacgagcgguacacccugcaccagaacugggcccgcuucuccuacuucuacaaggagcagccccucgaccugaucaagaacuacuacggcgagaagaucgggaucuacuucgucuuccugggcuucuacaccgagaugcuguucuucgccgcgguggugggccucgccugcuucaucuacgggcugcucagcauggagcacaacaccuccagcacggagaucugcgaccccgagaucggcgggcagaugaucaugugcccccugugcgaccaggucugcgacuacuggcgccugaacuccacgugccucgccagcaaguucucccaccuguucgacaacgagagcaccguguucuucgccaucuucaugggcaucugggugacccuguuccucgaguucuggaagcagcggcaggcccgccuggaguacgagugggaccuggucgacuucgaggaggagcagcagcagcuccagcugcggccggaguucgaggcgaugugcaagcaccgcaagcugaacgccgugaccaaggagauggagcccuacaugccccucuacacccggauccccugguacuuccuguccggcgccaccgugacccuguggaugagccucgucgugacguccaugguggccgucaucguguaccgccugagcgucuucgccaccuucgcguccuucauggagagcgacgccucccugaagcaggucaagagcuuccucaccccgcagaucaccacgucccugaccgggagcugccugaacuucaucgugauccugauccucaacuucuucuacgagaagaucuccgccuggaucaccaagauggagaucccccggaccuaccaggaguacgagagcagccugacgcugaagauguuccucuuccaguucgugaacuucuacuccagcugcuucuacguggccuucuucaagggcaaguucgugggguaccccggcaaguacaccuaccuguucaacgaguggcgcuccgaggagugcgaccccgggggcugccugaucgagcucaccacccagcugacgaucaucaugaccggcaagcagaucuucgggaacaucaaggaggccaucuacccgcuggcgcucaacugguggcggcgccggaaggcccgcaccaacagcgagaagcuguacucccggugggagcaggaccacgaccuggagagcuucggcccccucgggcuguucuacgaguaccuggagaccgucacgcaguucggcuucgugacccucuucguggccuccuucccccuggccccgcugcucgcccugaucaacaacaucgucgagauccgcguggacgcguggaagcugaccacccaguaccggcgcaccguggccagcaaggcccacuccaucggggucuggcaggacauccucuacggcauggccgugcugagcguggcgacgaacgccuucaucgucgccuucaccuccgacaucaucccccggcugguguacuacuacgccuacagcaccaacgccacccagcccaugacgggcuacgugaacaacucccucagcgucuuccugaucgcggacuuccccaaccacaccgccccguccgagaagcgcgacuucaucacgugccgguaccgcgacuaccgcuacccgcccgacgacgagaacaaguacuuccacaacaugcaguucuggcacgugcuggccgccaagaugaccuucaucaucgugauggagcacgucguguuccucgugaaguuccugcuggccuggaugauccccgacguccccaaggacgugguggagcggaucaagcgcgagaagcucaugaccaucaagauccugcacgacuucgagcugaacaagcucaaggagaaccuggggaucaacagcaacgaguucgcgaagcacgucaugaucgaggagaacaaggcccagcuggccaaguccacccucuga

SEQ ID NO: 26680 - RNA, 2733 nt, Artificial Sequence
  derived and/or modified sequence opt1 from ANO6__Homo_sapiens__NP_001020527
augaagaagaugagccgcaacgugcugcuccagauggaggaggaggaggacgacgacgacggcgacaucguccuggagaaccuggggcagaccaucgugcccgaccucggcucccuggagagccagcacgacuuccggaccccggaguucgaggaguucaacgggaagcccgacucccuguucuucaacgacggccagcgccggaucgacuucgugcucgucuacgaggacgagagccgcaaggagacgaacaagaaggggaccaacgagaagcagcggcgcaagcggcaggccuacgaguccaaccugaucugccacggccugcagcucgaggccacccgcagcgugcuggacgacaagcugguguucgucaaggugcacgcgcccugggaggugcucugcaccuacgccgagaucaugcacaucaagcugccccugaagccgaacgaccucaagaaccgguccagcgccuucggcacgcugaacugguucaccaagguccuguccguggacgagagcaucaucaagcccgagcaggaguucuucaccgcccccuucgagaagaaccgcaugaacgacuucuacaucguggaccgggacgccuucuucaaccccgcgacccgcucccggaucgucuacuucauccucagccgcgugaaguaccaggugaucaacaacgucuccaaguucgggaucaaccggcuggugaacagcggcaucuacaaggccgccuucccgcugcacgacugcaaguuccgccggcaguccgaggaccccagcugccccaacgagcgcuaccuccuguaccgggagugggcccacccccgcuccaucuacaagaagcagccgcuggaccucauccggaaguacuacggggagaagaucggcaucuacuucgcguggcugggguacuacacgcagaugcugcuccuggccgccguggucggcguggccugcuuccuguacggcuaccucaaccaggacaacugcaccuggagcaaggaggugugccaccccgacaucgggggcaagaucaucaugugcccccagugcgaccgccugugccccuucuggaagcugaacaucacgugcgaguccagcaagaagcucugcaucuucgacagcuucgggacccuggucuucgccguguucaugggcgugugggucacgcuguuccucgaguucuggaagcgccggcaggcggagcuggaguacgagugggacaccguggagcugcagcaggaggagcaggcccgcccggaguacgaggcccggugcacccacgucgugaucaacgagaucacccaggaggaggagcgcauccccuucacggccuggggcaagugcauccggaucacccucugcgccuccgcgguguucuucuggauccugcugaucaucgccagcgucaucgggaucaucguguaccgccucuccguguucaucgucuucagcgccaagcugcccaagaacaucaacggcaccgaccccauccagaaguaccugaccccgcagacggccaccuccaucaccgccagcaucaucuccuucaucaucaucaugauccucaacaccaucuacgagaagguggcgaucaugaucacgaacuucgagcugccccggacccagaccgacuacgagaacagccugaccaugaagauguuccucuuccaguucgugaacuacuacuccagcugcuucuacaucgccuucuucaaggggaaguucgucggcuaccccggggaccccguguacuggcugggcaaguaccgcaacgaggagugcgacccgggcgggugccugcuggagcucacgacccagcugaccaucaucaugggcgggaaggccaucuggaacaacauccaggaggugcugcuccccuggaucaugaaccugaucggccgguuccaccgcgucuccgggagcgagaagaucacgccccggugggagcaggacuaccaccuccagcccaugggcaagcugggccuguucuacgaguaccuggagaugaucauccaguucggguucgugacccucuucguggccuccuucccgcuggcgccccugcucgcccuggucaacaacauccuggagauccgcguggacgccuggaagcucaccacccaguuccggcgccuggugcccgagaaggcccaggacaucggcgccuggcagccgaucaugcaggggaucgcgauccuggccgucgugaccaacgccaugaucaucgccuucaccagcgacaugaucccccggcucguguacuacugguccuucagcgucccgcccuacggcgaccacaccuccuacaccauggagggguacaucaacaacacccugagcaucuucaagguggccgacuucaagaacaaguccaagggcaaccccuacagcgaccugggcaaccacaccacgugccgcuaccgggacuuccgcuacccgcccgggcacccccaggaguacaagcacaacaucuacuacuggcacgugaucgcggccaagcucgccuucaucaucgucauggagcacgugaucuacagcgugaaguucuucaucuccuacgccauccccgacgucagcaagcggaccaaguccaagauccagcgcgagaaguaccugacccagaagcugcuccacgagaaccaccugaaggacaugaccaagaacaugggcgugaucgccgagcgcaugaucgaggcgguggacaacaaccugcggcccaagagcgaguga

SEQ ID NO: 26681 - RNA, 540 nt, Artificial Sequence
  derived and/or modified sequence opt1 from ANO7__Homo_sapiens__NP_001001666
augcgcauggccgccaccgcgugggccggccugcaggggcccccgcuccccacccugugccccgccgugcggacgggccuguacugccgcgaccaggcccacgccgagcggugggcgaugaccagcgagaccuccagcgggucccacugcgcccgcagccggaugcuccgccggcgcgcccaggaggaggacuccaccguccugaucgacgugagcccgcccgaggccgagaagcggggcuccuacgggagcacggcgcacgccuccgagcccggcggccagcaggccgccgccugccgcgcggggagccccgccaagccccggaucgacuucgugcuggucugggaggaggaccucaagcuggaccgccagcaggacuccgccgcccgggaccgcaccgacaugcaccggaccuggcgcgagaccuuccuggacaaccuccgggccgcgggccugugcguggaccaggugcgcgggggcugccacgggcagggcccgcggcccugcauccacagcgucacgcacgaccuggccgccuga

SEQ ID NO: 26682 - RNA, 750 nt, Artificial Sequence
  derived and/or modified sequence opt1 from ANP32A__Homo_sapiens__NP_006296
auggagaugggccgccggauccaccuggagcuccgcaaccggacccccagcgacgugaaggagcugguccuggacaacucccgcagcaacgaggggaagcucgagggccugaccgacgaguucgaggagcuggaguuccucuccacgaucaacguggggcugaccagcaucgccaaccugccgaagcucaacaagcugaagaagcuggagcucuccgacaaccgggugagcggcgggcuggagguccuggccgagaagugccccaaccucacccaccugaaccuguccggcaacaagaucaaggaccucagcaccaucgagccccugaagaagcuggagaaccucaagucccuggaccuguucaacugcgaggugacgaaccucaacgacuaccgcgagaacguguucaagcugcugccccagcucaccuaccuggacggcuacgaccgggacgacaaggaggcgccggacagcgacgccgagggguacgucgagggccuggacgacgaggaggaggacgaggacgaggaggaguacgacgaggacgcccaggugguggaggacgaggaggacgaggacgaggaggaggagggggaggaggaggacgucuccggcgaggaggaggaggacgaggagggguacaacgacggcgagguggacgacgaggaggacgaggaggagcucggcgaggaggagcgcgggcagaagcggaagcgcgagcccgaggacgagggcgaggacgacgacuga

SEQ ID NO: 26683 - RNA, 756 nt, Artificial Sequence
  derived and/or modified sequence opt1 from ANP32B__Homo_sapiens__NP_006392
auggacaugaagcgccggauccaccuggagcuccgcaaccggacccccgccgccgugcgcgagcugguccuggacaacugcaagagcaacgacggcaagaucgaggggcucaccgcggaguucgugaaccuggaguuccugucccucaucaacgugggccugaucagcgucuccaaccugccgaagcuccccaagcugaagaagcuggagcucagcgagaaccggaucuucgggggccuggacaugcuggccgagaagcuccccaaccugacgcaccugaaccucuccgggaacaagcugaaggacaucagcacccuggagccccucaagaagcuggagugccugaagucccucgaccuguucaacugcgaggugaccaaccugaacgacuaccgcgagagcguguucaagcuccugccgcagcugaccuaccucgacggcuacgaccgggaggaccaggaggcccccgacuccgacgccgaggucgacggcguggacgaggaggaggaggacgaggagggggaggacgaggaggacgaggacgacgaggacggcgaggaggaggaguucgacgaggaggacgacgaggacgaggacguggagggggacgaggacgacgacgaggucagcgaggaggaggaggaguucggccuggacgaggaggacgaggacgaggacgaggacgaggaggaggaggagggcgggaagggcgagaagcgcaagcgggagacggacgacgagggggaggacgacuga

SEQ ID NO: 26684 - RNA, 396 nt, Artificial Sequence
  derived and/or modified sequence opt1 from ANP32D__Homo_sapiens__NP_036536
auggagaugggcaaguggauccaccuggagcuccgcaaccggacccccagcgacgugaaggagcuguuccuggacaacucccagagcaacgaggggaagcucgagggccugaccgacgaguucgaggagcuggagcuccugaacacgaucaacaucgggcugaccuccaucgccaaccucccgaagcugaacaagcugaagaagcucgagcugagcuccaaccgcgccagcgucggccuggaggugcucgcggagaagugccccaaccugauccaccugaaccucuccgggaacaagaucaaggaccugagcaccaucgagccccugaagaagcucgagaaccuggagucccuggaccucuucacgugcgaggugaccaaccugaacaacuacuga

SEQ ID NO: 26685 - RNA, 2904 nt, Artificial Sequence
  derived and/or modified sequence opt1 from ANPEP__Homo_sapiens__NP_001141
auggccaagggcuucuacaucagcaagucccuggggauccucggcauccugcuggggguggccgcggucugcaccaucaucgcccucagcgugguguacucccaggagaagaacaagaacgccaacagcucccccgucgccagcaccacgccguccgccagcgcgaccaccaaccccgccuccgccaccacgcuggaccagagcaaggccuggaaccgcuaccggcugcccaacacccucaagcccgacuccuaccgcgugacccugcggccguaccugacccccaacgaccgcggccucuacguguucaaggggagcuccacgguccgguucacgugcaaggaggcgaccgacgugaucaucauccacagcaagaagcugaacuacacccugucccagggccaccgcgugguccuccggggcgucgggggcagccagccgcccgacaucgacaagaccgagcugguggagcccaccgaguaccugguggugcaccucaaggggucccuggugaaggacagccaguacgagauggacuccgaguucgagggcgagcuggccgacgaccucgccggguucuaccgcagcgaguacauggagggcaacguccggaaggugguggccaccacccagaugcaggccgcggacgcccgcaagagcuuccccugcuucgacgagcccgccaugaaggccgaguucaacaucacgcugauccaccccaaggaccugaccgcccucuccaacaugcugccgaagggccccagcacgccccugcccgaggacccgaacuggaacgucaccgaguuccacaccacccccaagauguccaccuaccuccuggcguucaucgugagcgaguucgacuacguggagaagcaggccuccaacgggguccugauccggaucugggcccgccccagcgccaucgccgcgggccacggggacuacgcccucaacgugaccggccccauccugaacuucuucgccggccacuacgacacgccguacccccugcccaaguccgaccagaucgggcuccccgacuucaacgccggcgccauggagaacugggggcuggugaccuaccgggagaacagccuccucuucgacccgcuguccagcuccagcuccaacaaggagcgcgucgugaccgucaucgcgcacgagcuggcccaccagugguucggcaaccucgugaccaucgagugguggaacgaccuguggcugaacgagggguucgccagcuacguggaguaccucggcgccgacuacgcggagcccacguggaaccugaaggaccugaugguccucaacgacguguaccgggugauggccgucgacgcccuggccuccagccacccccuguccacccccgccagcgagaucaacaccccggcgcagaucuccgagcuguucgacgccaucagcuacagcaagggcgccuccgugcugcgcaugcugagcuccuuccucagcgaggacguguucaagcaggggcuggccuccuaccugcacaccuucgccuaccagaacacgaucuaccugaaccucugggaccaccuccaggaggcggucaacaaccggagcauccagcugcccaccaccgugcgcgacaucaugaaccgguggacccugcagaugggcuuccccgugaucacggucgacaccuccaccgggacccugagccaggagcacuuccugcucgacccggacuccaacgugacccgccccagcgaguucaacuacguguggaucguccccaucacguccauccgggacggccgccagcagcaggacuacuggcugaucgacgugcgcgcccagaacgaccuguucagcaccuccgggaacgagugggugcuccugaaccugaacgucaccggcuacuaccgggugaacuacgacgaggagaacuggcgcaagauccagacccagcuccagcgggaccacagcgccauccccgugaucaaccgcgcccagaucaucaacgacgccuucaaccuggcguccgcccacaaggucccggugacgcuggcccucaacaacacccuguuccugaucgaggagcggcaguacaugcccugggaggccgcgcucagcucccugagcuacuucaagcugauguucgaccgcagcgagguguacggccccaugaagaacuaccucaagaagcaggucacgccccuguucauccacuuccggaacaacaccaacaacuggcgcgagaucccggagaaccugauggaccaguacuccgaggugaacgccaucagcaccgccugcuccaacggggugcccgagugcgaggagauggucagcggccucuucaagcaguggauggagaaccccaacaacaaccccauccacccgaaccugcgguccaccguguacugcaacgccaucgcccagggcggggaggaggagugggacuucgcgugggagcaguuccgcaacgccacccuggugaacgaggccgacaagcuccgggccgcccuggcgugcagcaaggagcuguggauccucaaccgcuaccuguccuacacccugaaccccgaccucauccggaagcaggacgccacgagcaccaucaucuccaucaccaacaacgucaucgggcagggccuggugugggacuucgugcagagcaacuggaagaagcuguucaacgacuacggcgggggcuccuucagcuucuccaaccucauccaggccgucacccgccgguucagcacggaguacgagcugcagcagcuggagcaguucaagaaggacaacgaggagaccggguucggcuccggcacccgcgcccucgagcaggcccuggagaagaccaaggcgaacaucaagugggugaaggagaacaaggaggugguccugcagugguucacggagaacagcaaguga

SEQ ID NO: 26686 - RNA, 1002 nt, Artificial Sequence
  derived and/or modified sequence opt1 from ANTXR1__Homo_sapiens__NP_060623
auggccaccgccgagcgccgggcgcugggcaucggguuccaguggcucagccuggccacccuggugcucaucugcgccggccagggcgggcgccgggaggacgggggccccgccugcuacggcggguucgaccuguacuucauccuggacaaguccggcagcguccuccaccacuggaacgagaucuacuacuucguggagcagcuggcccacaaguucaucuccccgcagcugcgcaugagcuucaucguguucuccacgcgggggaccacccucaugaagcugaccgaggaccgcgagcagauccggcagggccuggaggagcuccagaagguccugcccgggggcgacacguacaugcacgagggcuucgagcgcgcgagcgagcagaucuacuacgagaaccggcagggguaccgcaccgccuccgugaucaucgcccugaccgacggcgagcuccacgaggaccuguucuucuacagcgagcgggaggccaaccgcucccgggaccugggggcgaucguguacugcgucggcgugaaggacuucaacgagacccagcucgcccgcaucgccgacagcaaggaccacguguuccccgucaacgacggcuuccaggcccugcaggggaucauccacuccauccugaagaaguccugcaucgagauccucgccgcggagcccagcacgaucugcgccggcgagagcuuccagguggugguccgggggaacggcuuccgccacgcccggaacguggaccgcgugcugugcuccuucaagaucaacgacagcgucacccugaacgagaagccguucuccguggaggacaccuaccuccugugccccgcccccauccugaaggagguggggaugaaggccgcgcuccaggucagcaugaacgacggccuguccuucaucagcagcuccgugaucaucaccacgacccacugcagccugcacaagaucgccuccggccccaccaccgccgccugcauggaguga

SEQ ID NO: 26687 - RNA, 1470 nt, Artificial Sequence
  derived and/or modified sequence opt1 from ANTXR2__Homo_sapiens__NP_001139266
augguggccgagcgcagccccgcccgguccccgggcagcuggcuguuccccgggcucuggcugcugguccucuccggccccgggggccugcugcgcgcgcaggagcagcccagcugccggcgcgccuucgaccucuacuucgugcuggacaaguccgggagcguggccaacaacuggaucgagaucuacaacuucguccagcagcuggccgagcgguucguguccccggagaugcgccucagcuucaucguguucuccagccaggccaccaucauccugccccugaccggcgaccggggcaagaucuccaaggggcucgaggaccugaagcgcgucagccccgugggcgagacguacauccacgaggggcugaagcucgcgaacgagcagauccagaaggccggcgggcugaagaccuccagcaucaucaucgcccugaccgacggcaagcucgacggccuggugcccuccuacgccgagaaggaggcgaagaucagccggucccugggggccagcgucuacugcgugggcgugcucgacuucgagcaggcccagcuggagcgcaucgccgacuccaaggagcaggucuucccggugaagggcggguuccaggcccugaagggcaucaucaacagcauccucgcgcagagcugcaccgagauccuggagcugcagcccuccagcgugugcgucggggaggaguuccagaucgugcucuccggccggggguucaugcugggcagccgcaacggguccgugcugugcacguacaccgucaacgagaccuacaccacgagcgugaagcccguguccguccagcucaacagcaugcugugccccgccccgauccugaacaaggccggcgagacccucgacguguccgugagcuucaacggcgggaaguccgucaucagcggcucccugaucgugaccgccaccgagugcagcaacgggaucgccgcgaucaucgucauccuggugcuccugcugcuccugggcaucgggcugauguggugguucuggccccucugcugcaagguggucaucaaggacccgccgcccccgcccgcccccgcccccaaggaggaggaggaggagccccugcccacgaagaaguggcccaccguggacgccuccuacuacggcggccgcggggugggcgggaucaagcgcauggagguccgguggggcgacaaggggagcaccgaggagggcgcccgccuggagaaggcgaagaacgccguggugaagauccccgaggagaccgaggagcccauccggccccggcccccgcggcccaagcccacgcaccagccgccccagaccaagugguacacccccaucaagggccgccucgacgcccugugggcccugcuccggcgccaguacgaccgcgucucccugaugcggccccaggagggggacgaggugugcaucugggagugcaucgagaaggagcugaccgccuga

SEQ ID NO: 26688 - RNA, 975 nt, Artificial Sequence
  derived and/or modified sequence opt1 from ANXA10__Homo_sapiens__NP_009124
auguucugcggcgacuacgugcaggggaccaucuuccccgcccccaacuucaaccccaucauggacgcccagaugcugggcggggcgcuccagggcuucgacugcgacaaggacaugcugaucaacauccugacccagcgcugcaacgcccagcggaugaugaucgccgaggccuaccagagcauguacgggcgcgaccucaucggcgacaugcgggagcagcuguccgaccacuucaaggacgucauggccggccugauguacccgccgccccucuacgacgcgcacgagcuguggcacgccaugaagggggugggcacggacgagaacugccugaucgagauccucgccagccgcaccaacggggagaucuuccagaugcgggaggccuacugccugcaguacuccaacaaccugcaggaggacaucuacagcgagaccuccggccacuuccgcgacacccucaugaaccuggugcaggggacgcgggaggagggcuacaccgaccccgcgauggccgcccaggacgccaugguccugugggaggccugccagcagaagaccggcgagcacaagaccaugcuccagaugauccugugcaacaagagcuaccagcagcugcgccucguguuccaggaguuccagaacaucuccgggcaggacaugguggacgcgaucaacgagugcuacgacggcuacuuccaggagcugcuggucgccaucgugcucugcgugcgggacaagcccgccuacuucgccuaccgccuguacagcgccauccacgacuucggguuccacaacaagacggucauccggauccugaucgcgcgcuccgagaucgaccuccugaccauccggaagcgcuacaaggagcgguacggcaagagccuguuccacgacauccgcaacuucgccuccggccacuacaagaaggcccuccuggccaucugcgccggggacgcggaggacuacuga

SEQ ID NO: 26689 - RNA, 1518 nt, Artificial Sequence
  derived and/or modified sequence opt1 from ANXA11__Homo_sapiens__NP_001265336
augagcuaccccggcuacccgcccccccccgggggcuacccgcccgccgcccccgggggcgggcccuggggcggcgcggccuacccgcccccccccuccaugccgcccaucgggcuggacaacguggccaccuacgccggccaguucaaccaggacuaccucagcgggauggccgcgaacauguccggcaccuucgggggcgccaacaugcccaaccuguaccccggcgccccgggggccggcuacccccccguccccccggggggcuucggccagccccccagcgcgcagcagcccgugccgcccuacgggauguacccccccccgggcgggaacccccccucccgcaugccgagcuacccccccuaccccggcgccccggugcccgggcagcccaugcccccgcccggccagcagccccccggcgccuacccggggcagccccccgucacguaccccggccagccgcccgugccccugcccgggcagcagcagccggugcccuccuaccccggcuaccccgggagcggcaccgucaccccggccgugccccccacccaguucggcucccgggggacgaucaccgacgccccgggcuucgacccccuccgcgacgcggaggugcugcggaaggccaugaagggguucggcaccgacgagcaggccaucaucgacugccuggggagccgcuccaacaagcagcggcagcagauccuccugagcuucaagaccgccuacggcaaggaccugaucaaggaccucaaguccgagcugagcggcaacuucgagaagacgauccuggcccucaugaagacccccguccuguucgacaucuacgagaucaaggaggcgaucaagggggugggcaccgacgaggccugccugaucgagauccucgccucccgcagcaacgagcacauccgggagcugaaccgcgccuacaaggccgaguucaagaagacccuggaggaggcgauccgguccgacacgagcgggcacuuccagcgccuccugaucucccugagccagggcaaccgggacgagagcaccaacguggacaugucccucgcccagcgcgacgcccaggagcuguacgccgccggcgagaaccggcuggggaccgacgagagcaaguucaacgcgguccucugcucccgcagccgggcccaccugguggccguguucaacgaguaccagcgcaugaccggccgggacaucgagaaguccaucugccgcgagaugagcggggaccuggaggagggcaugcucgccgucgugaagugccugaagaacacgcccgcguucuucgccgagcggcugaacaaggccaugcgcggggccggcaccaaggaccggacccucauccgcaucauggugucccgcagcgagaccgaccugcuggacauccgguccgaguacaagcgcauguacggcaagagccucuaccacgacaucuccggggacacgagcggcgacuaccggaagauccugcugaagaucugcgggggcaacgacuga

SEQ ID NO: 26690 - RNA, 1074 nt, Artificial Sequence
  derived and/or modified sequence opt1 from ANXA13__Homo_sapiens__NP_001003954
augggcaaccgccacagccaguccuacacccugagcgaggggucccagcagcuccccaagggcgacagccagccguccaccgugguccagccccugagccaccccucccggaacggggagcccgaggccccgcagcccgccaaggcgagcagcccccagggcuucgacguggaccgcgacgccaagaagcugaacaaggccugcaaggggaugggcacgaacgaggccgccaucaucgagauccucagcggccggaccuccgacgagcgccagcagaucaagcagaaguacaaggcgaccuacgggaaggagcuggaggaggugcucaagagcgagcuguccggcaacuucgagaagaccgcccuggcccugcucgaccggcccagcgaguacgccgcgcgccagcugcagaaggccaugaaggggcugggcacggacgaguccguccucaucgaggugcugugcacccggaccaacaaggagaucaucgccaucaaggaggccuaccagcgccuguucgaccggagccucgaguccgacgugaagggggacaccagcggcaaccugaagaagauccuggucucccuccugcaggccaaccgcaacgagggcgacgacguggacaaggaccuggcggggcaggacgccaaggaccucuacgacgccggcgaggggcgguggggcacggacgagcuggccuucaacgaggugcuggccaagcgcagcuacaagcagcuccgggcgaccuuccaggccuaccagauccugaucggcaaggacaucgaggaggccaucgaggaggagaccagcggggaccugcagaaggccuaccucacccugguccgcugcgcccaggacugcgaggacuacuucgcggagcggcuguacaaguccaugaagggcgccgggacggacgaggagacccucauccgcaucguggugacccgggccgaggucgaccugcagggcaucaaggccaaguuccaggagaaguaccagaagucccuguccgacauggugcgcagcgacaccuccggggacuuccggaagcuccugguggcccugcuccacuga

SEQ ID NO: 26691 - RNA, 1074 nt, Artificial Sequence
  derived and/or modified sequence opt1 from ANXA1__Homo_sapiens__XP_011516910
augaaccugauccuccgcuacaccuucagcaagauggccaugguguccgaguuccugaagcaggccugguucaucgagaacgaggagcaggaguacguccagaccgucaagagcuccaagggcgggcccggcagcgcgguguccccguaccccacguucaaccccagcuccgacguggccgcccugcacaaggccaucauggugaaggggguggacgaggccaccaucaucgacauccucaccaagcggaacaacgcgcagcgccagcagaucaaggccgccuaccugcaggagaccggcaagccccuggacgagacgcucaagaaggcccugaccgggcaccuggaggaggucgugcucgcgcugcugaagaccccggcccaguucgacgccgacgagcuccgggccgccaugaagggccugggcaccgacgaggacacgcugaucgagauccucgcgagccgcaccaacaaggagauccgggacaucaaccgcguguaccgggaggagcugaagcgcgaccuggccaaggacaucaccuccgacaccagcggggacuuccggaacgcccuccugucccuggccaagggcgaccgcagcgaggacuucggggucaacgaggaccucgccgacuccgacgcgcgggcccuguacgaggccggcgagcgccggaaggggacggacgugaacguguucaacaccauccugaccacccgcagcuacccccagcuccggcgcgucuuccagaaguacacgaaguacuccaagcacgacaugaacaaggugcuggaccuggagcucaagggcgacaucgagaagugccugaccgccaucgugaagugcgccaccagcaagcccgcguucuucgccgagaagcugcaccaggccaugaagggcgucgggacccggcacaaggcccucauccgcaucauggugucccggagcgagaucgacaugaacgacaucaaggccuucuaccagaagauguacggcaucucccugugccaggcgauccuggacgagacgaagggggacuacgagaagauccucguggcccugugcggcggcaacuga

SEQ ID NO: 26692 - RNA, 1074 nt, Artificial Sequence
  derived and/or modified sequence opt1 from ANXA2__Homo_sapiens__NP_001002858
augggccgccagcuggccgggugcggcgacgccgggaagaaggcgagcuucaagauguccaccgugcacgagauccucugcaagcugagccuggagggcgaccacuccacgcccccgagcgccuacggguccgucaaggccuacaccaacuucgacgccgagcgggacgcccucaacaucgagaccgcgaucaagaccaagggcguggacgaggugaccaucgucaacauccugacgaaccgcagcaacgcccagcggcaggacaucgccuucgccuaccagcgccggaccaagaaggagcuggcguccgcccucaagagcgcccuguccggccaccuggagaccgugauccucgggcugcugaagacccccgcccaguacgacgccagcgagcucaaggcguccaugaagggccuggggacggacgaggacagccugaucgagaucaucugcucccgcaccaaccaggagcuccaggagaucaaccggguguacaaggagauguacaagaccgaccuggagaaggacaucaucagcgacaccuccggcgacuuccgcaagcugauggucgcccucgccaaggggcggcgcgccgaggacggcagcgugaucgacuacgagcugaucgaccaggacgcccgggaccuguacgacgcgggcgugaagcgcaaggggacggacguccccaaguggaucuccaucaugaccgagcggagcgugccccaccuccagaagguguucgaccgcuacaaguccuacagcccguacgacaugcuggagagcauccggaaggaggucaagggcgaccuggagaacgccuuccucaaccuggugcagugcauccagaacaagccccuguacuucgccgaccgccucuacgacuccaugaaggggaagggcacccgggacaaggugcugauccgcaucauggucagccgguccgagguggacaugcugaagauccgcagcgaguucaagcggaaguacggcaagucccucuacuacuacauccagcaggacaccaagggggacuaccagaaggcccugcuguaccucugcggcggggacgacuga

SEQ ID NO: 26693 - RNA, 582 nt, Artificial Sequence
  derived and/or modified sequence opt1 from ANXA2R__Homo_sapiens__NP_001014301
auggagcagcacuuccugggcugcgugaagcgcgccugggacagcgccgaggucgcgcccgagccgcagcccccgcccaucguguccagcgaggaccgggggcccuggccccucccccuguaccccgugcugggcgaguacucccucgacagcugcgaccuggggcugcucuccagcccgugcuggcgccugcccggcgucuacuggcagaacgggcugucccccggcgugcagagcacccucgagcccuccaccgccaagccgacggaguucagcuggcccggcacccagaagcagcaggaggcccccguggaggaggucgggcaggccgaggagcccgaccggcugcgccugcagcagcucccgugguccagcccccugcaccccugggaccggcagcaggacaccgaggugugcgacuccggcugccugcucgagcgccggcacccgcccgcccugcagcccuggcgccaccuccccggguucagcgacugccuggaguggauccugcgggugggcuucgcggccuucuccguccugugggccugcugcagccgcaucugcggggccaagcagcccuga

SEQ ID NO: 26694 - RNA, 972 nt, Artificial Sequence
  derived and/or modified sequence opt1 from ANXA3__Homo_sapiens__NP_005130
auggccagcaucugggugggccaccgcgggaccguccgggacuaccccgacuucuccccgagcguggacgccgaggcgauccagaaggccauccgcggcaucgggaccgacgagaagaugcugaucuccauccucacggagcggagcaacgcccagcgccagcugaucgugaaggaguaccaggccgccuacggcaaggagcugaaggacgaccucaagggggaccuguccggccacuucgagcaccugauggucgcgcucgugaccccgcccgccguguucgacgccaagcagcugaagaaguccaugaagggcgccgggaccaacgaggacgcgcugaucgagauccucaccacgcggaccagccgccagaugaaggacaucagccaggccuacuacaccgucuacaagaagucccugggcgacgacaucagcuccgagaccagcggggacuuccggaaggcccugcucacgcuggccgacggccgccgggacgagucccugaagguggacgagcaccucgccaagcaggacgcgcagauccuguacaaggccggggagaaccgcuggggcaccgacgaggacaaguucaccgagauccugugccuccggagcuucccccagcugaagcugaccuucgacgaguaccgcaacaucucccagaaggacaucguggacagcaucaagggcgagcucuccgggcacuucgaggaccugcugcucgccaucgucaacugcgugcggaacacgcccgccuuccuggccgagcgccugcaccgggcgcucaagggcaucgggaccgacgaguucacccugaaccgcaucauggugagccgguccgagaucgaccugcucgacauccgcaccgaguucaagaagcacuacggcuacagccuguacagcgccaucaaguccgacacgagcggcgacuacgagaucacccugcucaagaucugcgggggcgacgacuga

SEQ ID NO: 26695 - RNA, 966 nt, Artificial Sequence
  derived and/or modified sequence opt1 from ANXA4__Homo_sapiens__NP_001307627
auggccauggccaccaagggcgggaccgugaaggcggccagcggcuucaacgccauggaggacgcccagacgcugcgcaaggccaugaaggggcucggcaccgacgaggacgcgaucaucuccguccuggccuaccggaacaccgcccagcgccaggagauccggaccgccuacaagagcacgaucgggcgcgaccugaucgacgaccucaaguccgagcugagcggcaacuucgagcaggucaucgugggcaugaugacccccaccgugcuguacgacgugcaggagcuccggcgcgcgaugaagggggccggcaccgacgaggggugccugaucgagauccuggccucccggacgccggaggagauccgccggaucagccagaccuaccagcagcaguacggccgcucccucgaggacgacauccggagcgacaccuccuucauguuccagcgcgugcuggucagccuguccgccgggggccgggacgagggcaacuaccucgacgacgcccuggugcgccaggacgcgcaggaccuguacgaggccggggagaagaaguggggcaccgacgaggugaaguuccucacgguccugugcagccggaaccgcaaccaccuccugcacguguucgacgaguacaagcggaucucccagaaggacaucgagcagagcaucaaguccgagaccagcggguccuucgaggacgcccugcuggccaucgugaagugcaugcgcaacaagagcgccuacuucgcggagaagcucuacaaguccaugaagggccugggcaccgacgacaacacccugauccgggucauggugagccgcgccgagaucgacaugcucgacauccgggcccacuucaagcgccuguacggcaagagccuguacuccuucaucaagggggacacgagcggggacuaccgcaaggugcuccugguccugugcggcggggacgacuga

SEQ ID NO: 26696 - RNA, 963 nt, Artificial Sequence
  derived and/or modified sequence opt1 from ANXA5__Homo_sapiens__NP_001145
auggcccaggugcugcgcggcaccgucaccgacuuccccggguucgacgagcgggccgacgcggagacgcuccgcaaggccaugaagggccuggggaccgacgaggagagcauccugacccuccugaccucccggagcaacgcccagcgccaggagaucuccgccgccuucaagacgcuguucggccgggaccuccuggacgaccucaagagcgagcugaccgggaaguucgagaagcugaucguggcgcugaugaagccgucccgccucuacgacgccuacgagcugaagcacgcccugaagggcgccggcaccaacgagaaggugcucaccgagaucaucgcgagccggacgcccgaggagcugcgcgccaucaagcaggucuacgaggaggaguacggguccagccuggaggacgacguggugggcgacaccuccggguacuaccagcggaugcucgucgugcugcugcaggccaaccgcgaccccgacgccggcaucgacgaggcccagguggagcaggacgcgcaggcccucuuccaggccggggagcugaaguggggcaccgacgaggagaaguucaucaccaucuucggcacgcggagcgucucccaccuccgcaagguguucgacaaguacaugaccaucagcggguuccagaucgaggagaccaucgaccgggagaccuccggcaaccuggagcagcugcugcucgccguggucaagagcauccgcuccauccccgccuaccuggcggagacgcuguacuacgccaugaagggggccggcaccgacgaccacacccucauccgggugauggugagccgcuccgagaucgaccuguucaacauccggaaggaguuccgcaagaacuucgccaccagccuguacuccaugaucaagggcgacacgagcggggacuacaagaaggcccuccugcugcucugcggcgaggacgacuga

SEQ ID NO: 26697 - RNA, 2022 nt, Artificial Sequence
  derived and/or modified sequence opt1 from ANXA6__Homo_sapiens__NP_001146
auggccaagcccgcccagggcgcgaaguaccgcgggagcauccacgacuucccgggcuucgaccccaaccaggacgccgaggcccuguacaccgccaugaagggguucggcuccgacaaggaggccauccucgacaucaucaccagccgguccaaccgccagcggcaggaggugugccagagcuacaagucccuguacgggaaggaccugaucgcggaccucaaguacgagcugacgggcaaguucgagcgccugaucgucggccucaugcggccgcccgccuacugcgacgccaaggagaucaaggacgccaucagcgggaucggcaccgacgagaagugccugaucgagauccuggcgucccgcaccaacgagcagaugcaccagcucguggccgccuacaaggacgccuacgagcgggaccuggaggccgacaucaucggggacaccagcggccacuuccagaagaugcuggugguccuccugcaggggacgcgcgaggaggacgacgugguguccgaggaccugguccagcaggacgugcaggaccucuacgaggcgggcgagcugaaguggggcaccgacgaggcccaguucaucuacauccuggggaaccggagcaagcagcaccuccgccugguguucgacgaguaccugaagaccaccggcaagcccaucgaggccuccauccgcggggagcucagcggcgacuucgagaagcugaugcuggccgucgugaagugcauccgguccacgcccgaguacuucgccgagcggcuguucaaggcgaugaagggccuggggacccgcgacaacacccugauccggaucauggugagccgcuccgagcucgacaugcuggacauccgggagaucuuccgcaccaaguacgagaagucccuguacagcaugaucaagaacgacacgagcggcgaguacaagaagacccuccugaagcuguccgggggcgacgacgacgccgccgggcaguucuuccccgaggccgcccaggucgcguaccagaugugggagcucagcgccguggcccggguggagcugaagggcaccguccgccccgccaacgacuucaacccggacgccgacgcgaaggcccugcggaaggccaugaagggccucgggaccgacgaggacacgaucaucgacaucaucacccaccgcagcaacgugcagcgccagcagauccggcagaccuucaagucccacuucggccgcgaccugaugaccgaccucaagagcgagaucuccggggaccucgcccggcugauccugggccucaugaugccgcccgcgcacuacgacgccaagcagcugaagaaggccauggagggggccggcacggacgagaaggcccugaucgagauccucgcgacccgcaccaacgccgagauccgggccaucaacgaggccuacaaggaggacuaccacaagagccuggaggacgcccuguccagcgacaccuccggccacuuccgccggauccucaucagccuggcgacggggcaccgcgaggagggcggggagaaccuggaccaggcccgggaggacgcccagguggccgccgagauccuggagaucgcggacacccccuccggcgacaagaccagccucgagacccgcuucaugacgauccugugcacccgguccuacccccaccuccgccgggucuuccaggaguucaucaagaugaccaacuacgacguggagcacaccaucaagaaggagaugagcggggacgugcgcgacgccuucgucgccaucgugcaguccgugaagaacaagccccuguucuucgccgacaagcuguacaagagcaugaagggcgcgggcacggacgagaagacccugacccggaucauggucucccgcagcgagaucgaccuccugaacauccggcgcgaguucaucgagaaguacgacaagucccugcaccaggccaucgagggggacaccagcggcgacuuccucaaggcccugcuggcccucugcgggggcgaggacuga

SEQ ID NO: 26698 - RNA, 1401 nt, Artificial Sequence
  derived and/or modified sequence opt1 from ANXA7__Homo_sapiens__NP_001147
augagcuaccccggcuacccgcccaccggguacccgcccuuccccggcuacccgcccgccgggcaggaguccagcuucccgcccuccggccaguaccccuaccccagcggguucccgcccaugggcggcggggccuacccccaggugcccuccagcggcuaccccggggcgggcggguaccccgcccccggcggcuaccccgcccccgggggcuacccgggggcgccccagcccggcggcgcccccuccuacccgggggucccgcccggccagggguucggcgugccgcccggcggggccggcuucagcggguacccccagccgcccucccagagcuacggcgggggccccgcccaggugccccugcccgggggcuuccccggcgggcagaugcccucccaguaccccggcgggcagcccaccuacccgagccagcccgccacggucacccaggugacccagggcaccauccgccccgccgcgaacuucgacgccauccgggacgccgagauccuccgcaaggccaugaagggguucggcacggacgagcaggccaucguggacgucguggcgaaccgguccaacgaccagcgccagaagaucaaggccgccuucaagaccagcuacggcaaggaccugaucaaggaccugaaguccgagcucagcgggaacauggaggagcugauccuggcccucuucaugcccccgaccuacuacgacgccuggucccugcggaaggcgaugcagggcgccgggacccaggagcgcgugcugaucgagauccucugcacgcggaccaaccaggagauccgcgagaucguccggugcuaccagagcgaguucggccgcgaccuggagaaggacauccgguccgacaccagcggccacuucgagcgccugcucgugagcaugugccaggggaaccgggacgagaaccaguccaucaaccaccagauggcccaggaggacgcccagcgccuguaccaggccggcgaggggcggcugggcaccgacgagagcugcuucaacaugauccucgcgacgcgcuccuucccccagcugcgggccaccauggaggccuacagccgcauggccaaccgggaccugcucuccagcgugucccgcgaguucagcggguacgucgaguccggccugaagaccauccugcagugcgcccucaaccggcccgcguucuucgccgagcgccuguacuacgccaugaagggcgccgggaccgacgacagcacgcuggugcgcaucguggucacccgguccgagaucgaccucgugcagaucaagcagauguucgcgcagauguaccagaagacccugggcaccaugaucgccggggacacgagcggcgacuaccgccggcugcuccuggccaucguggggcaguga

SEQ ID NO: 26699 - RNA, 984 nt, Artificial Sequence
  derived and/or modified sequence opt1 from ANXA8__Homo_sapiens__NP_001035173
auggccugguggaaguccuggaucgagcaggagggcgugaccgucaagagcagcucccacuucaaccccgacccggacgccgagacccuguacaaggcgaugaaggggaucggcacgaacgagcaggccaucaucgacgugcucaccaagcgcagcaacacccagcggcagcagaucgccaaguccuucaaggcccaguucgggaaggaccugaccgagacgcucaagagcgagcuguccggcaaguucgagcgccugaucguggcccugauguacccgcccuaccgguacgaggcgaaggagcuccacgacgccaugaaggggcugggcaccaaggagggcgucaucaucgagauccuggccagccgcaccaagaaccagcuccgggagaucaugaaggccuacgaggaggacuacggguccagccuggaggaggacauccaggcggacaccuccggcuaccuggagcgcauccucgugugccugcugcaggggagccgggacgacguguccagcuucgucgaccccggccucgcccugcaggacgcccaggaccuguacgccgccggggagaagauccgcggcacggacgagaugaaguucaucaccauccucugcacccgguccgcgacccaccuccugcgcguguucgaggaguacgagaagaucgccaacaagagcaucgaggacuccaucaagagcgagacgcacggcucccuggaggaggccaugcugaccguggucaagugcacccagaaccugcacagcuacuucgccgagcggcucuacuacgccaugaagggggcgggcacccgcgacgggacgcugauccggaacaucgugagccgcuccgagaucgaccugaaccucaucaagugccacuucaagaagauguacggcaagacccugagcuccaugaucauggaggacaccagcggcgacuacaagaacgcccugcucucccugguggggagcgaccccuga

SEQ ID NO: 26700 - RNA, 984 nt, Artificial Sequence
  derived and/or modified sequence opt1 from ANXA8L1__Homo_sapiens__NP_001092315
auggccugguggaaggccuggaucgagcaggagggcgugaccgucaagagcuccagccacuucaaccccgacccggacgcggagacccuguacaaggccaugaaggggaucggcacgaacgagcaggccaucaucgacgugcucaccaagcgcuccaacacccagcggcagcagaucgccaagagcuucaaggcccaguucgggaaggaccugaccgagacgcugaaguccgagcucagcggcaaguucgagcgccugaucguggcgcugauguacccgcccuaccgguacgaggccaaggagcuccacgacgccaugaaggggcugggcaccaaggagggcgucaucaucgagauccuggccucccgcaccaagaaccagcuccgggagaucaugaaggcguacgaggaggacuacgggagcucccuggaggaggacauccaggccgacaccagcggcuaccuggagcgcauccucgugugccugcugcaggggucccgggacgacgugagcuccuucgucgaccccgcccucgcccugcaggacgcccaggaccuguacgcggccggcgagaagauccgcgggacggacgagaugaaguucaucaccauccucugcacccggagcgccacccaccuccugcgcguguucgaggaguacgagaagaucgccaacaaguccaucgaggacagcaucaaguccgagacgcacggcagccuggaggaggccaugcugaccguggucaagugcacccagaaccugcacuccuacuucgcggagcggcucuacuacgccaugaagggcgccgggacccgcgacggcacgcugauccggaacaucgugagccgcagcgagaucgaccugaaccucaucaagugccacuucaagaagauguacgggaagacccuguccagcaugaucauggaggacaccuccggcgacuacaagaacgcccugcucagccuggugggcuccgaccccuga

SEQ ID NO: 26701 - RNA, 2067 nt, Artificial Sequence
  derived and/or modified sequence opt1 from AOAH__Homo_sapiens__NP_001170977
augcagagccccuggaagauccugaccguggccccgcucuuccugcugcucucccugcagagcuccgccagccccgcgaacgacgaccagucccgccccagccuguccaacggccacaccugcgucgggugcgugcucguggucagcgugaucgagcagcuggcccaggugcacaacuccacgguccaggccagcauggagcggcugugcuccuaccuccccgagaagcuguuccugaagaccaccugcuaccucgugaucgacaaguucggcagcgacaucaucaagcugcuguccgccgacaugaacgccgacguggucugccacacccucgaguucugcaagcagaacacggggcagccgcugugccaccuguacccccuccccaaggagaccuggaaguucacccugcagaaggcgcgccagaucgugaagaagagccccauccugaaguacucccggagcggcuccgacaucugcagccucccggugcuggccaagaucugccagaagaucaagcuggccauggagcaguccguccccuucaaggacguggacagcgacaaguacagcguguuccccacccuccgcggguaccacuggcggggccgcgacugcaacgacuccgacgagagcgucuaccccggccggcgcccgaacaacugggacgugcaccaggacuccaacugcaacgggaucuggggcguggaccccaaggacgggguccccuacgagaagaaguucugcgagggcagccagccccgggggaucauccugcugggcgacuccgccggcgcgcacuuccacaucagcccggaguggaucacggccucccagaugagccucaacuccuucaucaaccugcccaccgcccugaccaacgagcucgacuggccccagcugagcggggccaccggcuuccuggacuccacgguggggaucaaggagaagagcaucuaccuccgccuguggaagcggaaccacugcaaccaccgcgacuaccagaacaucucccggaacggcgccagcucccgcaaccugaagaaguucaucgagagccucucccggaacaaggugcuggacuaccccgcgaucgucaucuacgccaugaucggcaacgacgugugcagcgggaaguccgacccggugcccgccaugaccacccccgagaagcuguacagcaacgucaugcagacccucaagcaccugaacagccaccugcccaacggcucccacgugauccucuacgggcugccggacggcacguuccugugggacaaccuccacaaccgcuaccacccccuggggcagcugaacaaggacaugaccuacgcccagcucuacagcuuccugaacugccugcaggucucccccugccacggcuggaugagcuccaacaagacccugcggacccucacgagcgagcgcgccgagcagcuguccaacacccugaagaagaucgcggccagcgagaaguucaccaacuucaaccucuucuacauggacuucgccuuccacgagaucauccaggaguggcagaagcggggcgggcagcccuggcagcugaucgagccgguggacggcuuccaccccaacgagcgcaaguccauccugcucaaggggauccugaugaccagccagacgcuggacaaccaggaguggacccagcucaccuccuggaucaagggcaaccugaccugcgacagccggacgcgcgaguggcugugcugcugcuggcgcaucaucuccgggaagcggugcagcuccagcggccccaaguccugggagcgccggauccgcagcaccccgcggcucaaccgcugccuggagaccaaggccggcaccgagccccugcggagcaugcaccccuggggggcccagggcgggcgcggccucgggaagcugaucccccagacgcuguggggccucccgcggcaccgccccaagggccuguucuucuccagcaucuucgcgaagugccugucccucaacgaggagcacaucuggaccaccgugcagugcugcguccugcccgggagcgugacccugccccucuuccugaaguga

SEQ ID NO: 26702 - RNA, 2313 nt, Artificial Sequence
  derived and/or modified sequence opt1 from AOC1__Homo_sapiens__XP_011514310
augcccgcccugggcugggccguggcggccauccucaugcugcagaccgccauggccgagccgagccccgggacccugccccgcaaggccggcgucuucuccgaccucagcaaccaggagcugaaggcggugcacuccuuccuguggagcaagaaggagcuccggcugcagcccuccagcacgaccaccauggccaagaacaccguguuccugaucgagaugcuccugccgaagaaguaccacguccugcgcuuccucgacaagggggagcggcaccccgugcgcgaggcccgggccgugaucuucuucggcgaccaggagcaccccaacgucacggaguucgcgguggggccccugccgggccccugcuacaugcgcgcccugagcccccggcccggcuaccaguccuccugggccagccgcccgaucuccaccgccgaguacgcccuccuguaccacacccugcaggaggcgaccaagccccuccaccaguucuuccugaacacgaccggguucagcuuccaggacugccacgaccggugccuggccuucaccgacguggcgccccgcggcgucgccuccgggcagcggcgcagcuggcucaucauccagcgguacguggagggcuacuuccugcaccccaccgggcuggagcuccugguggaccacggcuccacggacgccggccacugggccgucgagcaggucugguacaacgggaaguucuacggcagcccggaggagcuggcccgcaaguacgccgacggggagguggacgugguggugcucgaggacccccugcccggcggcaaggggcacgacuccaccgaggagcccccgcuguucagcucccacaagccccggggcgacuuccccagccccauccacgucagcgggccgcgccucgugcagccccacggcccccgguuccgccuggaggggaacgccgugcuguacggcggcugguccuucgccuuccggcuccgcagcuccagcgggcugcagguccugaacgugcacuucggcggggagcggaucgcguacgagguguccguccaggaggccguggcccucuacggcgggcacacccccgccggcaugcagaccaaguaccuggacgucggcugggggcugggcagcgugacgcacgagcucgccccggggaucgacugccccgagaccgcgaccuuccuggacaccuuccacuacuacgacgccgacgaccccgugcacuacccgcgcgcccugugccucuucgagaugcccacgggcgucccccugcgccggcacuucaacuccaacuucaagggcggguucaacuucuacgccggccugaagggccaggugcucgugcugcgcaccaccagcaccgucuacaacuacgacuacaucugggacuucaucuucuaccccaacggggugauggaggcgaagaugcacgccacgggguacgugcacgccaccuucuacaccccggagggccugcggcacggcacccgccuccacacgcaccugaucgggaacauccacacccaccugguccacuaccggguggaccuggacguggccggcaccaagaacuccuuccagacccuccagaugaagcuggagaacaucacgaaccccuggagcccccgccaccgggucgugcagcccacccuggagcagacccaguacuccugggagcgccaggccgcguuccgguucaagcgcaagcucccgaaguaccugcuguucaccagcccccaggagaaccccugggggcacaagcggacguaccgccuccagauccacuccauggccgaccaggugcugcccccgggcuggcaggaggagcaggccaucaccugggcccggaccgagggcgggcagccccgcgcccugagccaggcggccucccccguccccggccgguacccgcucgccgugaccaaguaccgcgagagcgagcugugcuccagcuccaucuaccaccagaacgaccccuggcacccgcccguggucuucgagcaguuccugcacaacaacgagaacaucgagaacgaggaccucguggccugggugaccgucggguuccugcacaucccccacagcgaggacauccccaacacggccacccccggcaacagcgugggguuccugcuccggcccuucaacuucuucccggaggaccccucccuggcgagccgcgacaccgugaucgucuggccccgggacaacggcccgaacuacgugcagcgcuggauccccgaggaccgcgacugcuccaugcccccgcccuucagcuacaacgggaccuaccggcccguguga

SEQ ID NO: 26703 - RNA, 2190 nt, Artificial Sequence
  derived and/or modified sequence opt1 from AOC2__Homo_sapiens__NP_001149
augcaccugaagaucgugcucgccuuccuggcccugagccucaucaccaucuucgcgcuggccuacguccugcucaccucccccggcgggagcucccagccgccccacugccccagcgugucccaccgcgcccagcccuggccgcaccccggccagagccagcuguucgccgaccugucccgggaggagcucacggccgugaugcgcuuccugacccagcggcuggggcccggccucgucgacgcggcccaggcccagcccagcgacaacugcaucuucuccguggagcugcagcugccgcccaaggccgcggcccucgcccaccuggaccgcgggagcccgccgcccgcccgggaggcccuggcgaucguccucuucggcggccagccccagcccaacguguccgagcuggugguggggccccugccccaccccagcuacaugcgcgacgucaccguggagcggcacggcgggccccuccccuaccaccgccggccggugcugcgcgccgaguucacccagauguggcggcaccugaaggaggucgagcuccccaaggcccccaucuuccuguccagcacguucaacuacaacggcuccacccuggccgccgugcacgcgacgccccgcgggcuccggagcggcgaccgcgccaccuggauggcccuguaccacaacaucuccggcguggggcuguuccuccacccggucggccuggagcugcuccuggaccaccgggcccuggaccccgcccacuggaccgugcagcaggucuucuaccucgggcacuacuacgcggaccugggccagcuggagcgcgaguucaagagcggccggcucgagguggugcgcgugccccugcccccgcccaacggggccuccagccugcggagccgcaacucccccggcccgcucccgccccugcaguucagcccccaggggucccaguacagcguccagggcaaccuggugguguccagccucugguccuucaccuucgggcacggcgucuucagcggccugcggaucuucgacgugcgcuuccagggggagcgcaucgccuacgaggucuccgugcaggagugcgugagcaucuacggcgccgacucccccaagaccaugcugacccgguaccucgacagcuccuucgggcugggccgcaacagccgggggcugguccgcggcguggacugccccuaccaggccacgaugguggacauccacauccuggucggcaagggggcggugcagcuccugcccggcgccgugugcgucuucgaggaggcccaggggcugccccuccggcgccaccacaacuaccugcagaaccacuucuacggcgggcuggccuccagcgcgcucguggugcgguccgucagcuccgugggcaacuacgacuacaucugggacuucgugcuguacccgaacggcgcccuggaggggcgcguccacgccaccggcuacaucaacaccgccuuccucaagggcggggaggagggccugcuguucgggaaccgggugggcgagcgcgugcucgggaccguccacacgcacgccuuccacuucaagcuggaccuggacguggcgggccucaagaacuggguggucgccgaggacgugguguucaagcccgucgccgcccccuggaaccccgagcacuggcugcagcggccgcagcugacccgccaggugcucgggaaggaggaccugaccgccuucagccugggcagcccccucccccgguaccuguaccuggcguccaaccagaccaacgccuggggccaccagcgcggguaccagcucguggucacgcagcggaaggaggaggagagccaguccagcuccaucuaccaccagaacgacaucuggacccccaccgugaccuucgccgacuucaucaacaacgagacgcugcugggcgaggaccucguggccugggucaccgccagcuuccugcacaucccgcacgcggaggacauccccaacaccgugacccuggggaaccgcgugggcuuccuccugcggcccuacaacuucuucgacgaggaccccuccaucuucagcccgggguccgucuacuucgagaagggccaggacgccggccugugcagcaucaaccccguggccugccuccccgaccuggccgcgugcgugcccgaccugccgcccuucuccuaccacggguucuga

SEQ ID NO: 26704 - RNA, 2292 nt, Artificial Sequence
  derived and/or modified sequence opt1 from AOC3__Homo_sapiens__NP_003725
augaaccagaagaccauccuggugcuccugauccuggccgucaucaccaucuucgcccucgugugcgugcugcuggucggccgcgggggcgacgggggcgagcccagccagcucccgcacugccccuccgugagccccuccgcgcagcccuggacgcacccggggcagagccagcuguucgccgaccugucccgggaggagcucaccgccgugaugcgcuuccugacccagcggcugggccccggccucgucgacgccgcccaggcgcgccccagcgacaacugcguguucuccguggagcugcagcugcccccgaaggccgccgcccucgcgcaccuggaccgggggagcccgccgcccgcccgcgaggcccuggccaucgucuucuucggccggcagccccagcccaacguguccgagcucguggucgggccccugccccaccccagcuacaugcgcgacgugaccguggagcggcacggcgggccccugcccuaccaccgccggcccguccucuuccaggaguaccuggacaucgaccagaugaucuucaaccgcgagcugccgcaggccuccggccuccugcaccacugcugcuucuacaagcaccggggccgcaaccuggugacgaugaccaccgcgccccgggggcuccagagcggcgaccgcgccaccugguucgggcuguacuacaacaucuccggcgccggcuucuuccugcaccacguggggcucgagcugcuggucaaccacaaggcccucgaccccgcccgguggacgauccagaagguguucuaccagggccgcuacuacgacagccuggcgcagcuggaggcccaguucgaggccgggcucgugaacgucgugcugauccccgacaacggcaccgggggcuccuggagccugaaguccccggugccgcccggccccgccccgccccuccaguucuacccccaggggccccgguucagcguccagggcucccgcguggccagcagccuguggaccuucuccuucgggcugggcgcguucagcgggccccggaucuucgacguccgcuuccagggcgagcgccucguguacgagaucucccugcaggaggcccuggccaucuacggcgggaacagccccgccgccaugaccacgcgguacguggacggcggguucggcauggggaaguacaccacgccccucacccgcggcgucgacugcccguaccuggcgaccuacguggacuggcacuuccugcucgagucccaggcccccaagaccauccgggacgccuucugcguguucgagcagaaccagggccugccccugcgccggcaccacagcgaccuguacucccacuacuucgggggccucgccgagaccguccugguggugcgcagcauguccacccugcucaacuacgacuacgucugggacacgguguuccaccccagcggggcgaucgagauccgguucuacgccaccggcuacaucuccagcgccuuccuguucggcgccaccgggaaguacggcaaccagguguccgagcacacccuggggacgguccacacccacagcgcccacuucaagguggaccucgacguggcgggccuggagaacugggucugggccgaggacaugguguucgugccgauggccguccccuggucccccgagcaccagcugcagcgccuccaggugacccggaagcugcuggagauggaggagcaggccgccuuccucguggggagcgcgacgccccgcuaccuguaccuggccuccaaccacagcaacaaguggggccacccgcggggcuaccgcauccagaugcucuccuucgccggggagccccugccccagaacagcagcauggcccggggcuucuccugggagcgcuaccagcuggccgucacccagcggaaggaggaggagcccagcuccagcuccguguucaaccagaacgacccgugggcgcccaccguggacuucagcgacuucaucaacaacgagaccaucgccgggaaggaccucgucgccugggugaccgccggcuuccugcacaucccccacgcggaggacauccccaacacggugaccgucgggaacggcgugggcuucuuccugcgcccguacaacuucuucgacgaggaccccuccuucuacagcgccgacuccaucuacuuccggggcgaccaggacgccggggccugcgaggugaacccccucgccugccugccccaggcggccgccugcgccccggaccugcccgccuucagccacgggggcuucucccacaacuga

SEQ ID NO: 26705 - RNA, 4017 nt, Artificial Sequence
  derived and/or modified sequence opt1 from AOX1__Homo_sapiens__NP_001150
auggaccgcgccagcgagcugcuguucuacgugaacggccggaaggucaucgagaagaacguggaccccgagaccaugcugcugccguaccuccgcaagaagcugcggcugaccgggacgaaguacggcugcgggggcgggggcugcggcgccugcaccgugaugaucucccgcuacaaccccaucaccaagcggauccgccaccaccccgcgaacgccugccucauccccaucugcagccuguacggggccgccgucaccacgguggagggcaucggguccacccacacccggauccacccggugcaggagcgcaucgccaagugccacggcacccagugcggguucugcacgcccggcauggucaugagcaucuacacccugcuccggaaccaccccgagcccacccuggaccagcugaccgacgcgcucggcgggaaccugugccgcugcacgggcuaccggccgaucaucgacgccugcaagaccuucugcaagaccuccgggugcugccagagcaaggagaacggcgugugcugccuggaccagggcaucaacgggcuccccgaguucgaggagggcuccaagaccagccccaagcuguucgccgaggaggaguuccugccccucgacccgacgcaggagcugaucuucccgcccgagcugaugaucauggccgagaagcagucccagcgcacccggguguucgggagcgagcgcaugaugugguucucccccgucacccucaaggagcugcuggaguucaaguucaaguacccccaggcgcccgugaucaugggcaacaccagcguggggcccgaggucaaguucaagggcguguuccaccccgugaucaucuccccggaccggaucgaggagcucagcgucgugaaccacgccuacaacggccugacgcugggggccggccucucccuggcccaggugaaggacauccuggccgacgucgugcagaagcuccccgaggagaagacccagauguaccacgcgcugcugaagcaccucgggacccuggccggcagccagauccgcaacauggccucccucgggggccacaucaucagccggcaccccgacuccgaccucaaccccauccuggccgugggcaacugcacccugaaccuccugagcaaggaggggaagcgccagaucccgcugaacgagcaguuccucagcaagugccccaacgccgaccugaagccccaggagauccuggucuccgugaacauccccuacagccggaagugggaguucguguccgcguuccgccaggcccagcggcaggagaacgcccucgccaucgucaacagcggcaugcgcguguucuucggggagggcgacgggaucauccgcgagcugugcaucuccuacggcggcgucgggccggccacgaucugcgcgaagaacagcugccagaagcugaucggccggcacuggaacgagcagaugcucgacaucgccugccgccugauccugaacgaggugucccugcucgggagcgcccccggcggcaagguggaguucaagcggacccugaucaucuccuuccuguucaaguucuaccucgaggucagccagauccugaagaagauggaccccgugcacuacccgucccuggccgacaaguacgagagcgcccucgaggaccugcacuccaagcaccacugcagcacccugaaguaccagaacaucgggcccaagcagcaccccgaggaccccaucggccacccgaucaugcaccucuccggggugaagcacgcgaccggcgaggccaucuacugcgacgacaugccccuggucgaccaggagcuguuccucacguucgugaccagcucccgcgcccacgccaagaucgugagcaucgaccuguccgaggcgcugagcaugcccggggucguggacaucaugaccgccgagcaccucagcgacgugaacuccuucugcuucuucaccgaggccgagaaguuccuggccacggacaaggucuucugcgugggccagcuggugugcgccguccucgcggacagcgaggugcaggccaagcgggccgccaagcgcgugaagaucgucuaccaggaccuggagccccugauccucaccaucgaggaguccauccagcacaacagcuccuucaagccggagcggaagcuggaguacggcaacguggacgaggccuucaagguggucgaccagauccuggagggggagauccacaugggcgggcaggagcacuucuacauggagacccagagcaugcucguggugcccaagggcgaggaccaggagauggacgucuacguguccacccaguuccccaaguacauccaggacaucguggcgagcacgcugaagcugcccgccaacaaggucaugugccacgugcgccgggucgggggcgccuucggcgggaaggugcucaagaccggcaucaucgccgccgugaccgcguucgccgccaacaagcacgggcgcgccgugcggugcguccuggagcgcggcgaggacaugcugaucaccgggggccggcacccguaccucggcaaguacaaggcgggguucaugaacgacggccgcauccuggcccuggacauggagcacuacuccaacgccggggccagccucgacgagucccuguucgugaucgagaugggccugcucaagauggacaacgccuacaaguuccccaaccugcggugccgcgggugggcgugccggaccaaccugcccagcaacacggccuuccgcggcuucggcuucccccaggccgcccucaucaccgaguccugcaucaccgagguggccgcgaagugcgggcugagcccggagaagguccggaucaucaacauguacaaggagaucgaccagacccccuacaagcaggagaucaacgccaagaaccugauccagugcuggcgcgagugcauggccauguccagcuacucccuccgcaagguggccguggagaaguucaacgccgagaacuacuggaagaagaagggccuggcgauggucccccugaaguuccccguggggcucggcagccgggccgccggccaggccgcggcccuggugcacaucuaccuggacgggagcguccucgugacgcacggcgggaucgagaugggccagggggugcacaccaagaugauccaggucgugucccgcgagcugcggaugccgaugagcaacgugcaccuccgcggcaccuccaccgagacgguccccaacgccaacaucagcggcggguccgugguggccgaccucaacggccuggccgucaaggacgcgugccagacccugcucaagcggcuggagcccaucaucagcaagaaccccaaggggaccuggaaggacugggcccagaccgccuucgacgaguccaucaaccugagcgccgugggcuacuuccgcggguacgaguccgacaugaacugggagaagggcgagggccagccguucgaguacuucgucuacggggccgcgugcagcgagguggagaucgacugccucacgggcgaccacaagaacauccggaccgacaucgugauggacgucgggugcuccaucaaccccgccaucgacaucggccagaucgagggggccuucauccagggcaugggccuguacaccaucgaggagcugaacuacagcccccaggggauccuccacacccgcggcccggaccaguacaagauccccgccaucugcgacaugcccacggagcugcacaucgcccugcugcccccgucccagaacagcaacacccuguacuccagcaaggggcugggcgaguccggcguguuccucgggugcagcguguucuucgcgauccacgacgccgucuccgccgcccggcaggagcgcggccugcacgggccccugacccucaacagcccccugacccccgagaagauccggauggccugcgaggacaaguucacgaagaugaucccgcgcgacgagcccggcagcuacgugcccuggaacgugcccaucuga

SEQ ID NO: 26706 - RNA, 810 nt, Artificial Sequence
  derived and/or modified sequence opt1 from AP1AR__Homo_sapiens__NP_001121898
augggcaacugcugcuggacccagugcuucgggcugcuccgcaaggaggccggccggcugcagcgcgucgggggcgggggcggcagcaaguacuuccggaccugcucccgcggggagcaccugacgaucgaguucgagaaccucguggagagcgacgagggcgagucccccgggagcucccaccggccgcugaccgaggaggagaucguggaccugcgcgagcggcacuacgacagcaucgccgagaagcagaaggaccucgacaagaagauccagaaggagcaggagcgccagcggaucgugcagcaguaccaccccuccaacaacggcgaguaccagagcuccgggcccgaggacgacuucgagagcugccugcgcaacaugaagucccaguacgaggucuuccggagcucccgccugagcuccgacgcgaccgugcucacccccaacacggagagcuccugcgaccugaugaccaagaccaagagcaccuccggcaacgacgacagcacgagccuggaccucgagugggaggacgaggagggcaugaaccggaugcugccgaugcgcgagcgguccaagaccgaggaggacauccugcgcgccgcccucaaguacagcaacaagaagaccggguccaaccccaccagcgccuccgacgacagcaacggccuggagugggagaacgacuucguguccgccgagauggacgacaacgggaacagcgaguacuccggcuucgucaaccccgugcuggagcucagcgacuccggcauccggcacagcgacacggaccagcagacccgcuga

SEQ ID NO: 26707 - RNA, 2760 nt, Artificial Sequence
  derived and/or modified sequence opt1 from AP1B1__Homo_sapiens__NP_001159491
augaccgacagcaaguacuucaccacgaccaagaagggcgagaucuucgagcugaaggccgagcucaacuccgacaagaaggagaagaagaaggaggccgugaagaaggucaucgcgagcaugaccguggggaaggacguguccgcccuguuccccgacgucgugaacugcaugcagaccgacaaccuggagcucaagaagcugguguaccuguaccucaugaacuacgccaagagccagccggacauggccaucauggccgucaacacguucgugaaggacugcgaggaccccaacccccugauccgcgcgcuggccgugcggaccaugggcugcauccgcgucgacaagaucaccgaguaccucugcgagccccugcggaagugccugaaggacgaggacccguacgugcgcaagaccgccgccgugugcgucgcgaagcuccacgacaucaacgcccagcugguggaggaccagggguuccuggacacgcucaaggaccugaucuccgacagcaaccccaugguggucgccaacgccguggccgcgcuguccgagaucgccgagagccaccccuccagcaaccuccuggaccugaacccccaguccaucaacaagcuccugaccgcccugaacgagugcaccgaguggggccagaucuucauccucgacugccuggccaacuacaugccgaaggacgaccgggaggcccagagcaucugcgagcgcgugacgccccggcugucccacgcgaacagcgccgucgugcucuccgccgugaagguccugaugaaguucauggagaugcugagcaaggaccucgacuacuacgggacccugcugaagaagcucgccccgccccuggugacccugcucuccgccgagcccgagcugcaguacguggcgcugcgcaacaucaaccucaucguccagaagcggcccgagauccugaagcacgagaugaagguguucuucgucaaguacaacgaccccaucuacgugaagcuggagaagcucgacaucaugauccgccuggccagccaggccaacaucgcccaggugcuggccgagcucaaggaguacgcgaccgaggucgacguggacuucgugcggaaggccguccgcgccaucggccggugcgccaucaagguggagcaguccgcggagcgcugcgugagcacccugcuggaccucauccagacgaaggucaacuacguggugcaggaggccaucgucgugaucaaggacaucuuccggaaguaccccaacaaguacgagagcgugaucgccacccugugcgagaaccuggacucccuggacgagccggaggcccgcgccgcgaugaucuggaucgucggcgaguacgccgagcggaucgacaacgccgacgagcuccuggagagcuuccuggagggguuccacgacgaguccacccaggugcagcuccagcugcugaccgccaucgugaagcuguuccugaagaagcccacggagacccaggagcugguccagcagguccucagccuggccacccaggacuccgacaaccccgaccugcgcgaccggggcuacaucuacuggcgccuccugagcaccgaccccguggcggccaaggagguggugcuggccgagaagccgcucaucuccgaggagacggaccugaucgagcccacccugcucgacgagcugaucugcuacaucgggacccuggccagcguguaccacaagccgcccuccgccuucgucgagggcgggcggggcguggugcacaagagccucccgccccgcaccgcguccagcgaguccgccgagagccccgagacggcccccaccggcgccccgcccggggagcagcccgacgucauccccgcgcagggcgaccugcugggggaccuccugaaccuggaccucggcccgcccguguccggcccgccccuggccaccagcuccgugcagaugggggccgucgaccugcucggcgggggccuggacagccugaucgggggcaccaacuucguggccccgcccacggccgcggugcccgccaaccucggcgcccccaucggguccggccugagcgaccuguucgaccucaccagcggggucggcacccuguccgggagcuacguggcccccaaggccgugggcuccaucagcauggaccugcagcucaccaacaaggcgcugcaggucaugacggacuucgccauccaguucaaccgcaacuccuucggccuggcccccgccgccccgcuccaggugcacgcgccccugagccccaaccagaccguggagaucucccugccccucagcaccgucggguccgugaugaagauggagccccugaacaaccuccagguggccgucaagaacaacaucgacguguucuacuucagcacccucuacccccugcacauccuguucguggaggacggcaagauggaccggcagauguuccucgccaccuggaaggacauccccaacgagaacgaggcccaguuccagauccgcgacugcccccugaacgcggaggccgccuccagcaagcugcaguccagcaacaucuucacggucgccaagcggaacguggaggggcaggacaugcucuaccagucccugaagcugaccaacggcaucugggugcucgccgagcugcgcauccagcccgggaacccgagcugcacccugucccucaagugccgggcgcccgaggucagccagcacguguaccaggccuacgagaccauccugaagaacuga

SEQ ID NO: 26708 - RNA, 2478 nt, Artificial Sequence
  derived and/or modified sequence opt1 from AP1G1__Homo_sapiens__NP_001025178
augcccgccccgauccgccugcgggagcucauccgcaccauccggaccgcccgcacgcaggcggaggagcgggagaugauccagaaggagugcgccgccauccgcagcuccuuccgggaggaggacaacaccuaccgcugccggaacguggccaagcugcuguacaugcacaugcucggcuaccccgcccacuucgggcagcuggagugccugaagcucaucgcgagccagaaguucaccgacaagcgcaucggcuaccugggggccaugcugcuccuggacgagcggcaggacguccaccuccugaugaccaacugcaucaagaacgaccugaaccacuccacgcaguucgugcagggccuggcccucugcacccuggggugcaugggcagcuccgagaugugccgcgaccuggccggcgagguggagaagcuccugaagaccagcaacuccuaccugcggaagaaggcggcccucugcgccguccacgugauccgcaaggugcccgagcugauggagauguuccugcccgccaccaagaaccuccugaacgagaagaaccacgggguccugcacacgagcguggugcuccugaccgagaugugcgagcgguccccggacaugcuggcccacuuccgcaagaacgagaagcucgucccccagcuggugcggauccugaagaaccucaucaugagcggcuacucccccgagcacgacgugagcgggaucuccgaccccuuccugcagguccgcauccugcggcuccugcgcauccugggccggaacgacgacgacagcuccgaggcgaugaacgacauccucgcccagguggccaccaacaccgagacgagcaagaacguggggaacgccauccuguacgagaccguccugaccaucauggacaucaaguccgagagcggccuccgcgugcuggccaucaacauccugggccgcuuccuccugaacaacgacaagaacauccgguacguggcgcugaccucccuccugaagacgguccagaccgaccacaacgccgugcagcgccaccggagcaccaucguggacugccugaaggaccuggacgucagcaucaagcgccgggccauggagcucuccuucgcccuggugaacgggaacaacauccgcggcaugaugaaggagcugcucuacuuccuggacagcugcgagccggaguucaaggccgacugcgcguccgggaucuuccuggccgccgagaaguacgcccccagcaagcgguggcacaucgacaccaucaugcgcgugcucacgaccgccggcuccuacguccgggacgacgcggugcccaaccugauccagcugaucaccaacagcgucgagaugcacgccuacaccgugcagcgccucuacaaggccauccugggcgacuacucccagcagccccuggugcaggucgccgcguggugcaucggggaguacggcgaccuccuggugagcgggcagugcgaggaggaggagccgauccaggugacggaggacgagguccuggacauccucgaguccgugcugaucagcaacauguccaccagcgugacccggggcuacgcccugaccgccaucaugaagcucuccacgcgcuucacgugcaccgucaaccggaucaagaagguggugagcaucuacggguccagcaucgacgucgagcugcagcagcgcgccguggaguacaacgcccuguucaagaaguacgaccacaugcgguccgcgcuccuggagcgcaugcccgugauggagaaggucaccaccaacggccccaccgagaucgugcagaccaacggcgagaccgagcccgccccgcuggagacgaagcccccgcccagcgggccccagcccaccucccaggccaacgaccuccuggaccugcucggcgggaacgacaucacccccgugauccccaccgccccgaccagcaagcccagcuccgccggcggggagcugcuggaccuccugggcgacaucaaccugacgggcgcgcccgccgccgcccccgccccggcgagcgucccccagaucucccagcccccguuccuccuggacgggcugagcucccagccccucuucaacgacaucgccgccggcauccccagcaucaccgccuacuccaagaacgggcugaagaucgaguucaccuucgagcggagcaacaccaaccccuccgugacggugaucaccauccaggcgagcaacuccaccgagcuggacaugaccgacuucgucuuccaggccgccgugccgaagacguuccagcuccagcugcugagccccuccagcuccaucgugcccgccuucaacaccggcaccaucacccaggucaucaaggugcucaacccccagaagcagcagcugcgcaugcggaucaagcugacguacaaccacaaggggagcgccaugcaggaccucgcggaggugaacaacuucccgccccaguccuggcaguga

SEQ ID NO: 26709 - RNA, 1308 nt, Artificial Sequence
  derived and/or modified sequence opt1 from AP1M1__Homo_sapiens__NP_001123996
augagcgccagcgccguguacguccuggaccucaagggcaaggugcugaucugccgcaacuaccgcggggacguggacaugagcgaggucgagcacuucaugcccauccugauggagaaggaggaggagggcaugcucuccccgauccuggcgcacgggggcgugcgcuucauguggaucaagcacaacaaccuguaccucguggccaccagcaagaagaacgccugcgucucccugguguucagcuuccuguacaaggugguccagguguucuccgaguacuucaaggagcucgaggaggagagcauccgggacaacuucgugaucaucuacgagcugcuggacgagcucauggacuucggguacccccagaccacggacuccaagauccugcaggaguacaucacccaggagggccacaagcuggagaccggcgcgccccggcccccggccaccgucacgaacgccgugagcuggcgguccgaggggaucaaguaccgcaagaacgagguguuccucgacgucaucgagagcgugaaccugcugggcaaguaccccggggugggcuggcucgggcacaccgucuccgccaacggcaacgugcugcggagcgagaucgugggcuccaucaagaugcgcgucuuccugagcgggaugcccgagcuccggcugggccugaacgacaagguccucuucgacaacaccgggcgcggcaaguccaagagcguggagcuggaggacgugaaguuccaccagugcgugcggcugucccgcuucgagaacgaccggaccaucagcuucaucccgcccgacggcgaguucgagcucaugagcuaccgccugaacacgcacgucaagccccugaucuggaucgaguccgugaucgagaagcacagccacucccggaucgaguacaugaucaaggccaagagccaguucaagcgccgguccaccgccaacaacguggagauccacauccccguccccaacgacgcggacagcccgaaguucaagaccaccgugggguccgugaaguggguccccgagaacagcgagaucgugugguccaucaagagcuuccccggcgggaaggaguaccucaugcgcgcccacuucggccugcccuccguggaggccgaggacaaggaggggaagccgcccaucagcgucaaguucgagauccccuacuucacgaccuccggcauccaggugcgguaccugaagaucaucgagaaguccggcuaccaggcccuccccugggugcgcuacaucacccagaacggggacuaccagcugcggacccaguga

SEQ ID NO: 26710 - RNA, 1272 nt, Artificial Sequence
  derived and/or modified sequence opt1 from AP1M2__Homo_sapiens__NP_005489
augagcgccuccgccguguucauccuggacgucaagggcaagccccucaucagccgcaacuacaagggggacguggcgauguccaagaucgagcacuucaugccgcugcuggugcagcgggaggaggagggcgcccucgcgccccugcugagccacgggcagguccacuuccucuggaucaagcacuccaaccuguaccugguggccaccaccagcaagaacgccaacgccucccucguguacagcuuccuguacaagacgaucgaggucuucugcgaguacuucaaggagcuggaggaggaguccauccgcgacaacuucgugaucguguacgagcuccuggacgagcugauggacuucggcuucccccagaccaccgacagcaagauccuccaggaguacaucacccagcaguccaacaagcuggagacgggcaagagccgggugcccccgaccgucaccaacgccguguccuggcgcagcgaggggaucaaguacaagaagaacgaggucuucaucgacgugaucgaguccgugaaccugcucgucaacgccaacggcagcgugcugcuguccgagaucguggggaccaucaagcucaaggucuuccugagcggcaugcccgagcugcggcucgggcugaacgaccgcgugcuguucgagcucacgggccgguccaagaacaagagcguggagcuggaggacgucaaguuccaccagugcgugcgccugagccgguucgacaacgaccgcaccaucuccuucaucccgcccgacggggacuucgagcucaugagcuaccggcuguccacccaggugaagccccugaucuggaucgagagcgucaucgagaaguucucccacagccgcguggagaucauggucaaggccaagggccaguucaagaagcaguccguggcgaacggcguggagaucagcguccccgugcccuccgacgccgacagcccccgguucaagaccuccguggggagcgccaaguacgucccggagcgcaacguggugaucugguccaucaagagcuuccccggcgggaaggaguaccucaugcgggcccacuucggccugcccuccgucgagaaggaggagguggagggccggcccccgaucggggugaaguucgagauccccuacuucacggucagcggcauccaggugcgcuacaugaagaucaucgagaaguccggguaccaggcccugcccugggugcgcuacaucacccagagcggcgacuaccagcuccggaccuccuga

SEQ ID NO: 26711 - RNA, 477 nt, Artificial Sequence
  derived and/or modified sequence opt1 from AP1S1__Homo_sapiens__NP_001274
augaugcgcuucaugcuccuguucagccggcagggcaagcugcgccugcagaagugguaccucgccaccuccgacaaggagcggaagaagauggugcgcgagcugaugcaggucgugcuggcccggaagcccaagaugugcagcuuccucgaguggcgcgaccugaagguggucuacaagcgguacgcgucccuguacuucugcugcgccaucgaggggcaggacaacgagcucaucacccuggagcugauccaccgcuacguggagcuccuggacaaguacuucggcagcgugugcgagcuggacaucaucuucaacuucgagaaggccuacuucauccucgacgaguuccugaugggcggggacguccaggacacguccaagaaguccgugcugaaggccaucgagcaggccgaccuccugcaggaggaggacgagagcccgcggagcgugcuggaggagauggggcucgcguga

SEQ ID NO: 26712 - RNA, 483 nt, Artificial Sequence
  derived and/or modified sequence opt1 from AP1S2__Homo_sapiens__NP_001259000
augcaguucaugcuccuguucagccgccagggcaagcugcggcugcagaagugguacgugccccucuccgacaaggagaagaagaagaucacccgcgagcugguccagaccgugcuggcccggaagccgaagaugugcagcuuccucgaguggcgcgaccugaagaucguguacaagcgguacgccucccuguacuucugcugcgcgaucgaggaccaggacaacgagcucaucacccuggagaucauccaccgcuacgucgagcugcucgacaaguacuucgggagcgugugcgagcuggacaucaucuucaacuucgagaaggccuacuucauccuggacgaguuccuccugggcggggaggugcaggagaccuccaagaagaacguccugaaggccaucgagcaggccgaccuccugcaggaggacgccaaggaggcggagacgccccggagcgugcuggaggagaucggccucaccuga

SEQ ID NO: 26713 - RNA, 465 nt, Artificial Sequence
  derived and/or modified sequence opt1 from AP1S3__Homo_sapiens__NP_001034658
augauccacuucauccuccuguucagccgccagggcaagcugcggcugcagaagugguacaucacccuccccgacaaggagcgcaagaagaucacccgggagaucgugcagaucauccugucccgcgggcaccggacgagcuccuucgucgacuggaaggagcugaagcucguguacaagcgcuacgccagccuguacuucugcugcgccaucgagaaccaggacaacgagcugcucacccuggagaucgugcaccgguacgucgagcugcucgacaaguacuucggcaacgugugcgagcuggacaucaucuucaacuucgagaaggcguacuucauccuggacgaguucaucaucgggggcgagauccaggagaccuccaagaagaucgccgugaaggccaucgaggacagcgacaugcuccaggagaccauggaggaguacaugaacaagccgacguucuga

SEQ ID NO: 26714 - RNA, 2934 nt, Artificial Sequence
  derived and/or modified sequence opt1 from AP2A1__Homo_sapiens__NP_055018
augcccgccgugagcaagggcgacgggaugcgcggccuggccgucuucaucuccgacauccggaacugcaagagcaaggaggcggagaucaagcgcaucaacaaggagcucgccaacauccgguccaaguucaagggggacaaggcccuggacggcuacagcaagaagaaguacgugugcaagcuccuguucaucuuccugcuggggcacgacaucgacuucggccacauggaggccgugaaccuccuguccagcaacaaguacaccgagaagcagaucggcuaccuguucaucuccguccucgugaacagcaacuccgagcugauccgccugaucaacaacgccaucaagaacgaccucgcgagccggaacccgaccuucaugugccuggcccugcacugcaucgccaacguggggucccgcgagaugggcgaggccuucgcggccgacaucccccggauccucgucgccggggacagcauggacuccgugaagcagagcgccgcccugugccugcuccgccuguacaaggcgucccccgaccuggugcccaugggcgaguggacggcccgggucgugcaccuccugaacgaccagcacauggggguggucaccgccgccgugagccugaucacgugccucugcaagaagaacccggacgacuucaagaccugcgugucccuggccgucagccgccugucccggaucgugagcagcgcguccaccgaccuccaggacuacaccuacuacuucgugcccgcccccuggcugagcgucaagcugcuccgccugcugcagugcuacccgccgcccgaggacgccgccgugaagggccggcucguggagugccuggagaccguccugaacaaggcccaggagccgcccaaguccaagaaggugcagcacagcaacgcgaagaacgccauccucuucgagaccaucucccugaucauccacuacgacagcgagcccaaccugcucgugcgcgccugcaaccagcugggccaguuccugcagcaccgggagacgaaccuccgcuaccuggcccuggaguccaugugcacccucgccagcuccgaguucagccacgaggcggucaagacccacaucgacaccgugaucaacgcccugaagacggagcgggacgucuccgugcgccagcgggccgccgaccugcucuacgcgaugugcgaccgcagcaacgccaagcagaucguguccgagaugcugcgguaccuggagaccgccgacuacgccauccgcgaggagaucguccugaagguggccauccucgcggagaaguacgccguggacuacagcugguacgucgacaccauccugaaccugauccgcaucgccggggacuacguguccgaggaggugugguaccggguccuccagaucgugaccaaccgcgacgacgugcagggcuacgccgccaagacggucuucgaggcgcugcaggcccccgccugccacgagaacauggugaaggucgggggcuacauccugggcgaguucgggaaccucaucgccggcgacccccggagcuccccgcccgugcaguucagccugcugcacuccaaguuccaccucugcagcguggccacccgcgcgcugcugcucagcaccuacaucaaguucaucaaccuguuccccgagaccaaggccacgauccagggggugcugcgggccggcucccagcuccgcaacgccgacgucgagcugcagcagcgggcgguggaguaccugacccucagcuccguggccagcaccgacguccuggccaccgugcuggaggagaugccgcccuuccccgagcgcgaguccagcauccucgccaagcugaagcggaagaaggggcccggcgccggcuccgcgcuggacgacgggcgccgggaccccagcuccaacgacaucaacggcgggauggagcccacgcccagcaccguguccacccccagccccuccgccgaccuccugggccugcgcgccgccccgccgcccgccgcgccgcccgccagcgccggggccggcaaccuccuggucgacguguucgacggccccgccgcgcagcccucccuggggcccacccccgaggaggccuuccucagcgagcuggagccgcccgcccccgagucccccauggcccugcucgcggaccccgcccccgccgccgaccccggcccggaggacaucgggccgcccauccccgaggccgacgagcugcugaacaaguucgugugcaagaacaacggcguccucuucgagaaccagcugcugcagaucggggucaagagcgaguuccggcagaaccucggccgcauguaccuguucuacggcaacaagacgagcgugcaguuccagaacuucucccccaccguggugcaccccggggaccugcagacccagcucgcggugcagaccaagcgggucgccgcccagguggacggcggggcccaggugcagcagguccugaacaucgagugccugcgcgacuuccucacgccgccccugcugagcgugcgguuccgcuacggcggcgcgccccaggcccucacccugaagcugcccgugaccaucaacaaguucuuccagcccaccgagauggccgcccaggacuucuuccagcgguggaagcagcucucccugccccagcaggaggcccagaagaucuucaaggccaaccacccgauggacgcggaggucacgaaggccaagcugcucggguucggcagcgcccugcuggacaacguggaccccaaccccgagaacuucgugggggccggcaucauccagaccaaggcccuccaggucgggugccugcugcgccucgagccgaacgcgcaggcccagauguaccgccugacccugcggaccuccaaggagcccgugagccgccaccucugcgagcugcuggcccagcaguucuga

SEQ ID NO: 26715 - RNA, 2856 nt, Artificial Sequence
  derived and/or modified sequence opt1 from AP2B1__Homo_sapiens__NP_001025177
augaccgacagcaaguacuucaccacgaacaagaagggcgagaucuucgagcugaaggccgagcucaacaacgagaagaaggagaagcgcaaggaggccgugaagaaggucaucgcggccaugaccguggggaaggacguguccagccuguuccccgacgucgugaacugcaugcagaccgacaaccuggagcucaagaagcugguguaccuguaccucaugaacuacgccaagucccagccggacauggccaucauggccgucaacagcuucgugaaggacugcgaggaccccaacccccugauccgggcgcuggccgugcgcaccaugggcugcauccgggucgacaagaucacggaguaccucugcgagccccugcgcaagugccugaaggacgaggacccguacgugcggaagaccgccgccgugugcgucgcgaagcuccacgacaucaacgcccagaugguggaggaccagggguuccuggacucccugcgcgaccucaucgccgacagcaaccccaugguggucgccaacgccguggcggcccuguccgagaucagcgagucccaccccaacagcaaccugcucgaccugaacccccagaacaucaacaagcugcucaccgcccugaacgagugcaccgaguggggccagaucuucauccuggacugccucuccaacuacaacccgaaggacgaccgggaggcccagagcaucugcgagcgcgugacgccccggcugucccacgccaacagcgcggucgugcuguccgccgugaagguccucaugaaguuccuggagcugcuccccaaggacagcgacuacuacaacaugcugcugaagaagcucgcgcccccgcuggugacccugcucuccggggagcccgaggugcaguacgucgcccugcgcaacaucaaccugaucgugcagaagcggcccgagauccucaagcaggagaucaaggucuucuucgugaaguacaacgaccccaucuacgugaagcuggagaagcuggacaucaugauccgccucgccagccaggccaacaucgcccagguccuggccgagcugaaggaguacgccaccgagguggacguggacuucguccggaaggccgugcgcgcgaucggccggugcgccaucaagguggagcaguccgccgagcgcugcgucagcacccuccuggaccugauccagacgaaggugaacuacgugguccaggaggccaucguggugauccgggacaucuuccgcaaguacccgaacaaguacgagagcaucaucgcgacccucugcgagaaccuggacucccuggacgagcccgacgcccgggccgccaugaucuggaucgucggcgaguacgccgagcgcaucgacaacgcggacgagcugcucgagagcuuccuggagggguuccacgacgaguccacccaggugcagcugacccuccugacggccaucgugaagcuguuccucaagaagcccagcgagacccaggagcugguccagcagguccugucccucgccacccaggacagcgacaaccccgaccugcgggaccgcggcuacaucuacuggcgccugcucuccaccgacccggugacggccaaggagguggugcugagcgagaagccccugaucuccgaggagaccgaccucaucgagcccacccugcuggacgagcucaucugccacaucgggagccuggccuccguguaccacaagcccccgaacgcguucgucgagggcagccacgggauccaccggaagcaccuccccauccaccacggcuccaccgacgccggcgacagccccguggggacgaccaccgccaccaaccuggagcagccccaggugaucccgucccagggcgaccugcugggggaccuccugaaccuggaccucggcccgcccgucaacgugccccaggugagcuccaugcagaugggcgccgucgaccugcucgggggcgggcuggacagccugcugggcuccgaccucgggggcggcaucgggggcagccccgccguggggcagagcuucauccccuccagcgugcccgcgacguucgccccgucccccacccccgccgucgugagcuccggccugaacgaccuguucgagcucagcaccgggaucggcauggcccccggcggguacguggcgccgaaggccgucuggcugcccgccgugaaggccaagggccuggagaucuccgggaccuucacgcaccgccagggccacaucuacauggagaugaacuucaccaacaaggcccuccagcacaugaccgacuucgcgauccaguucaacaagaacagcuucggggugauccccuccacgccccuggccauccacaccccgcugaugcccaaccagagcaucgacgucucccucccccugaacacccugggccccgugaugaagauggagccgcucaacaaccuccagguggccgucaagaacaacaucgacguguucuacuucagcugccugaucccccugaacgugcuguucgucgaggacggcaagauggagcgccagguguuccuggccaccuggaaggacauccccaacgagaacgagcuccaguuccagaucaaggagugccaccugaacgccgacaccguguccagcaagcugcagaacaacaacgucuacaccaucgcgaagcggaacguggaggggcaggacaugcucuaccagucccugaagcugacgaacggcaucuggauccucgccgagcugcggauccagcccgggaacccgaacuacacccugagccucaagugccgcgcccccgaggugucccaguacaucuaccaggucuacgacagcauccugaagaacuga

SEQ ID NO: 26716 - RNA, 1302 nt, Artificial Sequence
  derived and/or modified sequence opt1 from AP2M1__Homo_sapiens__NP_001020376
augaucggcgggcuguucaucuacaaccacaagggcgaggugcucaucagccgcgucuaccgggacgacaucgggcgcaacgccguggacgccuuccgggugaacgucauccacgcgcgccagcagguccggucccccgugaccaacaucgcccgcaccagcuucuuccacgugaagcgguccaacaucuggcuggccgccgugacgaagcagaacgugaacgccgcgauggucuucgaguuccuguacaagaugugcgacgugauggccgccuacuucggcaagaucagcgaggagaacaucaagaacaacuucgugcucaucuacgagcugcuggacgagauccucgacuucggguacccgcagaacuccgagaccggcgcccugaagaccuucaucacccagcagggcaucaagagccagacgaaggaggagcagucccagaucaccagccaggucaccgggcagaucggcuggcgccgggaggggaucaaguaccgccggaacgagcuguuccucgacgugcuggaguccgugaaccugcucaugagcccccagggccagguccuguccgcgcacgugagcgggcgcguggucaugaaguccuaccugagcggcaugcccgagugcaaguucggcaugaacgacaagaucgugaucgagaagcaggggaagggcaccgccgacgagacguccaagagcgggaagcaguccaucgccaucgacgacugcaccuuccaccagugcgugcggcucagcaaguucgacuccgagcgcagcaucagcuucaucccgcccgacggcgaguucgagcugaugcgguaccgcaccaccaaggacaucauccugcccuuccgggucaucccccucgugcgcgaggugggccggacgaagcuggaggucaagguggucaucaaguccaacuucaagcccagccugcucgcccagaagaucgaggugcgcaucccgacgccccugaacaccuccggggugcaggucaucugcaugaagggcaaggccaaguacaaggcgagcgagaacgccaucguguggaagaucaagcggauggccgggaugaaggagucccagaucagcgccgagaucgagcugcuccccaccaacgacaagaagaagugggcccggcccccgaucuccaugaacuucgaggugcccuucgcgcccagcggccugaagguccgcuaccugaagguguucgagcccaagcucaacuacuccgaccacgacgugaucaaguggguccgcuacaucgggcgcagcggcaucuacgagacccggugcuga

SEQ ID NO: 26717 - RNA, 429 nt, Artificial Sequence
  derived and/or modified sequence opt1 from AP2S1__Homo_sapiens__NP_004060
augauccgcuucauccugauccagaaccgggccggcaagacccgccucgccaagugguacaugcaguucgacgacgacgagaagcagaagcugaucgaggaggugcacgcggucgugaccgugcgggacgccaagcacacgaacuucgucgaguuccgcaacuucaagaucaucuaccggcgcuacgccgggcuguacuucugcaucugcguggacgugaacgacaacaaccucgccuaccuggaggccauccacaacuucgucgaggugcugaacgaguacuuccacaacgugugcgagcucgaccuggucuucaacuucuacaagguguacaccguggucgacgagauguuccuggcgggcgagauccgggagaccagccagaccaaggugcucaagcagcugcugaugcuccagucccuggaguga

SEQ ID NO: 26718 - RNA, 3138 nt, Artificial Sequence
  derived and/or modified sequence opt1 from AP3B1__Homo_sapiens__NP_001258698
augcuggagagcaacaaggacuccgccaagcucgacgccaugaagcgcaucgugggcaugaucgcgaaggggaagaacgccagcgagcuguuccccgccgucgugaagaacguggccuccaagaacaucgagaucaagaagcuggucuacguguaccucgugcgguacgccgaggagcagcaggaccuggcgcugcucagcaucuccaccuuccagcgcgcccugaaggacccgaaccagcugauccgggccagcgcccuccgcguccuguccagcauccgggugcccaucaucgugcccaucaugaugcuggcgaucaaggaggccuccgccgaccucagccccuacguccgcaagaacgccgcccacgcgauccagaagcuguacucccuggacccggagcagaaggagaugcucaucgaggugaucgagaagcugcugaaggacaagagcacccucguggccggcuccgucgugauggccuucgaggaggugugccccgaccggaucgaccugauccacaagaacuaccgcaagcugugcaaccuccuggucgacguggaggaguggggccagguggucaucauccacaugcugacgcgguacgcccgcacccaguucgugagccccuggaaggagggggacgagcucgaggacaacgggaagaacuucuacgaguccgacgacgaccagaaggagaagaccgacaagaagaagaagcccuacaccauggacccggaccaccggcugcugauccgcaacacgaagccccuccugcagagccggaacgccgcgguggucauggccguggcccagcuguacuggcacaucucccccaagagcgaggccggcaucaucuccaagagccucgugcgccugcugcggagcaaccgcgagguccaguacaucgugcuccagaacaucgccaccauguccauccagcggaagggcauguucgagcccuaccucaagagcuucuacguccgcuccaccgacccgaccaugaucaagacgcugaagcuggagauccugaccaaccuggcgaacgaggccaacaucagcacccuccugcgggaguuccagaccuacgugaagucccaggacaagcaguucgccgccgccacgauccagaccaucgggcgcugcgcgaccaacauccuggaggugaccgacacgugccucaacggccuggucugccugcucagcaaccgggacgagaucgugguggccgaguccgucguggugaucaagaagcugcugcagaugcagcccgcccagcacggggagaucaucaagcacauggccaagcuccuggacagcaucaccguccccguggcgcgcgccuccauccuguggcugaucggcgagaacugcgagcgcgugcccaagaucgccccggacguccuccggaagauggccaagagcuucaccuccgaggacgaccuggugaagcugcagauccucaaccugggggccaagcuguaccucaccaacagcaagcagacgaagcugcugacccaguacauccucaaccugggcaaguacgaccagaacuacgacauccgcgaccggacccgcuucauccggcagcugaucgugcccaacgucaaguccggcgcgcucagcaaguacgccaagaagaucuuccuggcccagaagcccgcgccccugcucgaguccccguucaaggaccgcgaccacuuccagcuggggacccugagccacacgcucaacaucaaggccaccggcuaccuggagcuguccaacuggcccgagguggcccccgaccccagcgugcggaacgucgaggugaucgagcucgccaaggaguggaccccggccgggaaggccaagcaggagaacuccgccaagaaguucuacagcgagagcgaggaggaggaggacuccagcgacuccagcuccgacagcgaguccgagagcggcuccgagagcggcgagcagggggaguccggcgaggagggggacagcaacgaggacuccagcgaggacuccagcuccgagcaggacagcgagagcggccgcgaguccgggcuggagaacaagcggaccgcgaagcgcaacagcaaggccaagggcaaguccgacagcgaggacggcgagaaggagaacgagaaguccaagacgagcgacuccagcaacgacgaguccagcuccaucgaggacagcuccagcgacuccgagagcgaguccgagcccgagagcgaguccgagagccggcgcgugaccaaggagaaggagaagaagaccaagcaggaccggacgccccugaccaaggacgucagccuccuggaccuggacgacuucaaccccguguccaccccgguggcccuccccacccccgcccugagcccgucccugauggcggaccucgaggggcugcaccugagcaccuccagcuccgucaucagcguguccacgcccgccuucgugcccaccaagacccacguccuccugcaccgcaugagcggcaaggggcuggccgcccacuacuucuucccccggcagccgugcaucuucggcgacaagaugguguccauccagaucacccucaacaacaccacggaccgcaagaucgagaacauccacaucggggagaagaagcugcccaucggcaugaagaugcacguguucaaccccaucgacagccuggagcccgagggcuccaucaccgucagcauggggaucgacuucugcgacuccacccagaccgccagcuuccagcucugcacgaaggacgacugcuucaacgugaacauccagccgcccgugggcgagcugcugcuccccgucgcgauguccgagaaggacuucaagaaggagcagggggugcugaccggcaugaacgagaccagcgccgugaucaucgccgcgccccagaacuucaccccguccgucaucuuccagaagguggugaacgucgccaacgugggggccgugcccagcggccaggacaacauccaccgguucgccgccaagacgguccacagcggcucccugaugcucgugaccguggagcugaaggaggggagcaccgcccagcugaucaucaacaccgagaagacggucaucggcuccgugcuccugcgcgagcugaagcccgugcucagccagggguga

SEQ ID NO: 26719 - RNA, 3648 nt, Artificial Sequence
  derived and/or modified sequence opt1 from AP3D1__Homo_sapiens__NP_001248755
auggcccugaagauggugaagggcagcaucgaccgcauguucgacaagaaccuccaggaccugguccgggggauccgcaaccacaaggaggacgaggccaaguacaucucccagugcaucgacgagaucaagcaggagcugaagcaggacaacaucgcggugaaggccaacgccgugugcaagcucaccuaccugcagaugcugggcuacgacaucagcugggccgccuucaacaucaucgaggucauguccgcgagcaaguucaccuucaagcggaucggguaccucgccgccucccagagcuuccacgagggcacggacgugaucaugcugaccaccaaccagauccgcaaggaccuguccagccccucccaguacgacaccgggguggcccucacgggccugagcugcuucgucaccccggaccuggcgcgggaccucgccaacgacaucaugacccugaugucccacaccaagcccuacauccgcaagaaggccgugcugaucauguacaagguguuccucaaguaccccgagagccugcggcccgccuucccgcgccugaaggagaagcucgaggaccccgaccccggcguccaguccgccgcggugaacgugaucugcgagcuggcccggcgcaaccccaagaacuaccugagccucgccccgcuguucuucaagcugaugacguccagcaccaacaacuggguccucaucaagaucaucaagcuguucggggcccugacgccccucgagccccggcugggcaagaagcugaucgagccccucaccaaccugauccacuccaccagcgccaugucccugcucuacgagugcgugaacaccgugaucgcgguccugaucagccugagcuccgggaugccgaaccacagcgccuccauccagcucugcgugcagaagcugcgcauccugaucgaggacagcgaccagaaccucaaguaccugggccugcucgccauguccaagauccugaagacccaccccaagagcgugcagucccacaaggaccugauccuccagugccuggacgacaaggacgagagcauccggcugcgcgcccucgaccugcuguacgggauggucuccaagaagaaccugauggagaucgugaagaagcucaugacccacguggacaaggccgagggcacgaccuaccgggacgagcugcugaccaagaucaucgacaucugcagccaguccaacuaccaguacaucaccaacuucgagugguacaucagcauccucgucgagcugacgcgccuggagggcacccggcacgggcaccucaucgcggcccagaugcuggacguggccauccgcgugaaggccauccggaaguucgccgucucccagaugagcgcgcugcucgacuccgcccaccuccuggccagcuccacccagcgcaacggcaucugcgaggugcucuacgccgcggccuggaucugcggggaguucagcgagcaccuccaggagccccaccacacccuggaggccaugcugcggccccgcgucacgacccugccgggccacauccaggccguguacgugcagaacgucgugaagcuguacgccuccauccuccagcagaaggagcaggcgggcgaggccgagggggcccaggccgugacccagcugauggucgaccgccugccccaguucgugcagagcgccgaccucgaggugcaggagcgggcgagcugcauccugcagcuggucaagcacauccagaagcuccaggccaaggacgugcccguggccgaggaggucuccgcccuguucgccggcgagcugaaccccguggcgccgaaggcccagaagaaggugcccguccccgaggggcucgaccuggacgccuggaucaacgagccccugagcgacuccgagagcgaggacgagcgcccgcgggccguguuccacgaggaggagcagcgccggcccaagcaccgccccuccgaggcggacgaggaggagcucgcccggcgccgggaggcccgcaagcaggagcaggccaacaaccccuucuacaucaagagcuccccgagcccccagaagcgguaccaggacacccccggcguggagcacaucccggucgugcagaucgaccuguccgugccccugaagguccccgggcuccccaugagcgaccaguacgugaagcuggaggaggagcgccggcaccgccagaagcuggagaaggacaagcggcgcaagaagcggaaggagaaggagaagaagggcaagcgccggcacuccagccucccgacggaguccgacgaggacaucgcccccgcgcagcaggucgacaucgugaccgaggagaugcccgagaacgcccugcccagcgacgaggacgacaaggacccgaacgaccccuaccgcgcccuggacaucgaccucgacaagccccuggccgacuccgagaagcugcccauccagaagcaccgcaacaccgagaccagcaaguccccggagaaggacgugcccaugguggagaagaaguccaagaagcccaagaagaaggagaagaagcacaaggagaaggagcgggacaaggagaagaagaaggagaaggagaagaaggccgaggaccucgacuucuggcugagcacgacgcccccgcccgcgcccgcccccgccccggcccccguccccagcaccggcgagcugagcgugaacaccgugaccacccccaaggacgagugcgaggacgccaagaccgaggcgcagggggaggaggacgacgccgagggccaggaccaggacaagaaguccccgaagcccaagaagaagaagcaccgcaaggagaaggaggagcggaccaaggggaagaagaaguccaagaagcagcccccgggcagcgaggaggccgccggggagcccguccagaacggcgcgcccgaggaggagcagcugcccccggagagcuccuacagccugcuggccgagaacuccuacgugaagaugaccugcgacauccgcggcagccuccaggaggacucccaggugacggucgccaucgugcuggagaaccggagcuccagcauccugaaggggauggagcucuccgugcuggacagccugaacgcccgcauggcccggccccagggcuccagcguccacgacggggugcccgugcccuuccagcucccgcccggcgucuccaacgaggcgcaguacguguucaccauccagagcaucgugauggcccagaagcugaaggggacccugagcuucaucgccaagaacgacgagggcgccacccacgagaagcucgacuuccgccugcacuucuccugcagcuccuaccugaucacgacccccugcuacagcgacgccuucgcgaagcuccuggaguccggcgaccugagcauguccagcaucaaggucgacgggauccggauguccuuccagaaccuccuggccaagaucugcuuccaccaccacuucagcgugguggagcgcgucgacuccugcgccagcauguacucccggagcauccagggccaccacgugugccugcucgugaagaagggggagaacuccgucagcguggacggcaagugcuccgacagcacccugcuguccaaccuccuggaggagaugaaggccacccuggccaagugcuga

SEQ ID NO: 26720 - RNA, 1257 nt, Artificial Sequence
  derived and/or modified sequence opt1 from AP3M2__Homo_sapiens__NP_006794
augauccacagccuguuccucaucaacuccagcggcgacaucuuccuggagaagcacuggaaguccguggucagccgcuccgugugcgacuacuucuucgaggcccaggagcgggccaccgaggcggagaacgugcccccggucauccccacgccccaccacuaccugcucagcguguaccgccacaagaucuucuucguggccgucauccagaccgaggugcccccgcuguucgugaucgaguuccugcaccgggucguggacaccuuccaggacuacuucggggugugcuccgagcccgucaucaaggacaacgugguggucguguacgaggugcucgaggagaugcuggacaacggcuucccccuggccaccgagagcaacauccucaaggagcugaucaagcccccgaccauccugcgcacggucgugaacaccaucaccggguccaccaacgugggcgaccagcuccccacggggcagcugagcgucgugcccuggcggcgcaccggcgugaaguacaccaacaacgaggccuacuucgacgucaucgaggagaucgacgccaucaucgacaaguccggcagcaccaucacggcggagauccagggggugaucgacgccugcgucaagcugaccggcaugcccgaccucacccuguccuucaugaacccgcggcugcucgacgacgugagcuuccaccccugcgugcgcuucaagcggugggaguccgagcgcauccugagcuucaucccgcccgacgggaacuuccggcugcucuccuaccacgucagcgcccagaaccugguggccauccccguguacgucaagcacaacaucuccuuccgcgacagcagcucccugggccgguucgagaucaccguggggcccaagcagacgaugggcaagaccaucgagggcgugaccgucaccagccagaugcccaagggggugcucaacaugucccugacgcccagccagggcacccacaccuucgacccggugaccaagaugcuguccugggacgucgggaagaucaacccccagaagcuccccagccugaagggcacgaugucccugcaggcgggcgccagcaagcccgacgagaacccgaccaucaaccuccaguucaagauccagcagcuggccaucuccgggcugaaggugaaccgccucgacauguacggcgagaaguacaagcccuucaaggggaucaaguacaugaccaaggccggcaaguuccaggugcggaccuga

SEQ ID NO: 26721 - RNA, 582 nt, Artificial Sequence
  derived and/or modified sequence opt1 from AP3S1__Homo_sapiens__NP_001275
augaucaaggccauccugaucuucaacaaccacggcaagccccgccucagcaaguucuaccagccguacuccgaggacacccagcagcagaucauccgggagaccuuccaccuggugagcaagcgcgacgagaacgucugcaacuuccuggagggcgggcuccugaucgggggcuccgacaacaagcugaucuaccggcacuacgccacgcucuacuucguguucugcguggacagcuccgagagcgagcuggggauccuggaccucauccaggucuucguggagacccuggacaagugcuucgagaacgugugcgagcuggaccucaucuuccacgucgacaaggugcacaacauccuggcggagauggugaugggcggcaugguccuggagaccaacaugaacgagaucgugacccagaucgacgcccagaacaagcucgagaaguccgaggccgggcuggccggcgcccccgcgcgcgccgugagcgccgucaagaacaugaaccugcccgagaucccccggaacaucaacaucggggacaucuccaucaaggugccgaaccuccccagcuucaaguga

SEQ ID NO: 26722 - RNA, 582 nt, Artificial Sequence
  derived and/or modified sequence opt1 from AP3S2__Homo_sapiens__NP_005820
augauccaggccauccugguguucaacaaccacggcaagccccgccucguccgguucuaccagcgcuucccggaggagauccagcagcagaucgugcgggagaccuuccaccuggugcugaagcgcgacgacaacaucugcaacuuccucgagggcgggagccugaucgggggcuccgacuacaagcugaucuaccggcacuacgccacccucuacuucgucuucugcguggacagcuccgagagcgagcuggggauccuggaccucauccagguguucgucgagacgcuggacaagugcuucgagaacgugugcgagcuggaccucaucuuccacauggacaaggugcacuacauccugcaggaggucgugaugggcggcauggugcuggagaccaacaugaacgagaucgucgcgcagaucgaggcccagaaccgccucgagaaguccgagggcgggcugagcgccgcccccgcccgggcgguguccgccgugaagaacaucaaccugcccgagaucccccgcaacaucaacaucggggaccucaacaucaaggucccgaaccugagccaguucguguga

SEQ ID NO: 26723 - RNA, 1995 nt, Artificial Sequence
  derived and/or modified sequence opt1 from AP4B1__Homo_sapiens__XP_011538826
augcccuaccugggcagcgaggacguggucaaggagcucaagaaggcccugugcaacccgcacauccaggccgaccgccugcgguaccgcaacgugauccagcgggugauccgcaugcccgggguccaggaguacauccagcagcccauccucaacggccugcgggacaaggcguccuacgugcgccggguggccguccuggggugcgccaagaugcacaaccuccacggcgacagcgagguggacggggcccuggugaacgagcuguacucccuccugcgcgaccaggaccccaucgucguggugaacugccugcggagccucgaggagauccugaagcaggagggcggcgucgugaucaacaagccgaucgcccaccaccuccucaaccgcauguccaagcuggaccagugggggcaggcggaggugcugaacuuccuccugcgguaccagccccgcagcgaggaggagcuguucgacauccucaaccugcuggacuccuuccucaagagcuccagccccggcgucgugaugggggccaccaagcuguuccugauccucgccaagauguucccccacgugcagaccgacguccuggugcgggugaagggcccgcugcucgccgcgugcuccagcgagucccgcgagcugugcuucgucgcccugugccacgugcggcagauccuccacagccugcccgggcacuucuccagccacuacaagaaguucuucugcuccuacagcgagccccacuacaucaagcugcagaagguggagguccucugcgagcuggugaacgacgagaacguccagcagguccuggaggagcuccgcggcuacugcacggacguguccgccgacuucgcccaggccgcgaucuucgccaucggcgggaucgcccggaccuacaccgaccagugcgugcagauccugaccgagcugcucggccugcgccaggagcacaucacgaccguggugguccagaccuuccgggaccugguguggcucugcccccagugcaccgaggccgugugccaggcccugccggggugcgaggagaacauccaggacagcgagggcaagcaggcgcugaucuggcuccugggcguccacggggagcgcauccccaacgcccccuacgugcuggaggacuucguggagaacgucaagagcgagacguuccccgccgugaagauggagcugcucaccgcccugcugcggcuguuccugucccgcccggccgagugccaggacaugcugggccgccuccuguacuacugcaucgaggaggagaaggacauggcggugcgggaccgcgggcuguucuacuaccggcuccugcuggucggcaucgacgaggugaagcgcauccucugcagccccaaguccgaccccacccuggggcugcucgaggaccccgccgagcggccggugaacagcugggccuccgacuucaacacccugguccccguguacggcaaggcccacugggccacgaucagcaagugccagggcgcggagcgcugcgaccccgagcugcccaagaccuccagcuucgccgccuccgggccgcucauccccgaggagaacaaggagcgggugcaggagcugcccgacagcggcgcccugaugcucguccccaaccgccagcugaccgcggacuacuucgagaagaccuggcugucccucaagguggcccaccagcagguccugccguggcgcggggaguuccaccccgacacgcugcagauggcccuccagguggugaacauccagaccaucgccaugagccgggccggcucccggcccuggaaggcguaccugagcgcccaggacgacaccgggugccuguuccucaccgagcugcugcucgagccgggcaacuccgagaugcagaucagcgugaagcagaacgaggcccgcacggagacccugaacuccuucaucagcguccuggagaccgugaucggcaccaucgaggagaucaaguccuga

SEQ ID NO: 26724 - RNA, 3414 nt, Artificial Sequence
  derived and/or modified sequence opt1 from AP4E1__Homo_sapiens__NP_031373
augagcgacaucguggagaagacccugaccgcccuccccggccuguuccugcagaaccagcccgggggcgggcccgccgcggccaaggccuccuucagcucccgccucggcagccugguccgggggaucacggcccugaccuccaagcacgaggaggagaagcucauccagcaggagcugagcucccugaaggccaccgugagcgcgcccaccacgacccucaagaugaugaaggagugcauggugcgccugaucuacugcgagaugcugggcuacgacgccuccuucggcuacauccacgccaucaagcucgcccagcaggggaaccugcuggagaagcgggucggcuaccucgcggugagccuguuccugcacgagucccacgagcuccugcugcuccuggugaacaccgucgugaaggaccugcagagcaccaaccucguggaggucugcauggcccugacgguggugucccagaucuuccccugcgagaugaucccggccguccugccccucaucgaggacaagcugcagcacagcaaggagaucgugcgccggaaggccgugcuggcccucuacaaguuccaccugaucgcgcccaaccagguccagcacauccacaucaaguuccgcaaggcccugugcgaccgggacgugggggugauggccgccucccuccacaucuaccugcgcaugaucaaggagaacagcuccggcuacaaggaccugaccgggagcuucgucaccauccucaagcaggucgugggcggcaagcugcccguggaguucaacuaccacuccgugccggcccccuggcugcagauccagcuccugcggauccuggggcuccugggcaaggacgaccagcgcaccagcgagcugauguacgacgugcucgacgagagccugcggcgcgcggagcugaaccacaacgucacguacgccauccucuucgagugcgugcacaccgucuacuccaucuaccccaagagcgagcugcuggagaaggccgccaagugcaucgggaaguucgugcugucccccaagaucaaccucaaguaccugggccugaaggcccucaccuacgugauccagcaggacccgacccuggcgcugcagcaccagaugacgaucaucgagugccucgaccaccccgaccccaucaucaagcgggagacccuggagcugcucuaccgcaucaccaacgcccagaacaucaccgucaucgugcagaagaugcuggaguaccugcaccagagcaaggaggaguacgugaucgucaaccucgugggcaagaucgccgagcuggccgagaaguacgcccccgacaacgcgugguucauccagacgaugaacgccguguucuccgucgggggcgacgugaugcacccggacauccccaacaacuuccugcggcuccuggccgagggguucgacgacgagaccgaggaccagcagcugcgccucuacgccgugcagagcuaccugacccugcucgacauggagaacgucuucuacccccagcgguuccuccaggugauguccugggugcugggcgaguacagcuaccugcuggacaaggagacccccgaggaggucaucgcgaagcuguacaagcuccugaugaacgacuccgugagcuccgagacgaaggccuggcugaucgccgccgugaccaagcucaccagccaggcccacuccagcaacaccgucgagcgccugauccacgaguucacgaucucccuggacacgugcaugcggcagcacgcguucgagcucaagcaccuccacgagaacguggagcugaugaagucccugcugccgguggaccgcagcugcgaggaccuggucguggacgccagccucuccuuccuggacggguucguggccgagggccugagccagggcgccgcccccuacaagccgccccaccagcggcaggaggagaagcucagccaggagaagguccugaacuucgagccguacgggcuguccuucagcuccagcggcuucaccgggcgccagucccccgcgggcaucagccucggguccgacgugagcggcaacuccgccgagaccggccugaaggagacgaacagccugaagcucgaggggaucaagaagcuguggggcaaggagggguaccugcccaagaaggaguccaagaccggcgacgagagcggggcccuccccgugccgcaggaguccaucauggagaacgucgaccaggccaucaccaagaaggaccagagccaggugcugacccaguccaaggaggagaaggagaagcagcugcucgccagcucccuguucgugggccugggcagcgagagcacgaucaaccuccuggggaaggcggacaccgucucccacaaguuccgccgcaagagcaaggugaaggaggccaaguccggcgagaccaccagcacccacaacaugacgugcuccagcuucuccagccuguccaacguggccuacgaggacgacuacuacagcaacacccuccacgacaccggggacaaggagcugaagaaguucucccugaccagcgagcuccuggacuccgagagccugacggagcucccccuggucgagaaguucuccuacugcagccuguccacccccagccucuucgccaacaacaacauggagaucuuccacccgccccaguccaccgcggccagcguggccaaggagagcucccuggccagcuccuuccuggaggagaccacggaguacauccacagcaacgccauggaggugugcaacaacgagaccaucuccgucagcuccuacaagaucuggaaggacgacugccuccugaugguguggagcgugaccaacaaguccggccuggagcucaagagcgcggaccuggagaucuuccccgccgagaacuucaaggucaccgagcagcccggcugcugccugccggugauggaggccgaguccaccaagagcuuccaguacuccgugcagaucgagaagcccuucaccgaggggaaccucaccggcuucaucagcuaccacaugauggacacccacuccgcccagcuggaguucagcgucaaccugucccuccuggacuucauccggccccugaagaucagcuccgacgacuucgggaagcucuggcugagcuucgccaacgacgugaagcagaacgugaagaugagcgagucccaggcggcccugcccagcgcccucaagacgcugcagcagaagcugcggcuccacaucaucgagaucaucggcaacgaggggcugcuggccugccagcuccugccguccauccccugccugcugcacugccgcguccacgccgacgugcucgcgcugugguuccggagcuccugcagcacccugcccgacuaccuccuguaccagugccagaaggugauggagggcuccuga

SEQ ID NO: 26725 - RNA, 1362 nt, Artificial Sequence
  derived and/or modified sequence opt1 from AP4M1__Homo_sapiens__NP_004713
augaucagccaguucuucauccuguccagcaagggcgacccccucaucuacaaggacuuccgcggggacuccggcgggcgggacguggccgagcuguucuaccgcaagcugaccggccucccgggggacgagagccccgucgugaugcaccaccacggccggcacuucauccacauccgccacuccggccuguaccugguggucaccaccagcgagaacgugucccccuucagccuccuggagcugcucucccggcuggccacccugcucggggacuacugcggcagccugggggagggcaccaucucccgcaacguggcgcuggucuacgagcuccuggacgaggugcuggacuacggguacgugcagaccacgagcaccgagaugcuccggaacuucauccagaccgaggccgucguguccaagcccuucagccuguucgaccuguccagcgugggccucuucggcgccgagacccagcaguccaaggucgccccgagcuccgccgcgagccgccccgugcugagcucccggagcgaccagucccagaagaacgagguguuccuggacgucguggagcgccucagcgugcugaucgccuccaacgggagccugcucaaggucgacgugcagggcgagauccggcugaaguccuuccugcccagcggguccgagaugcgcaucggccucacggaggaguucugcgugggcaagagcgagcugcggggguacggccccgggauccgcgucgacgagguguccuuccacagcuccgugaaccuggacgaguucgagagccaccggauccuccgccugcagccgccccagggcgagcugaccgucaugcgguaccagcucuccgacgaccugcccagcccccugccguuccgccucuuccccuccgugcagugggaccgggggagcggccgccugcaggucuaccugaagcuccggugcgaccugcuguccaagagccaggcccucaacgugcgccugcaccucccccugccccgcggcguggucagccugucccaggagcugagcuccccggagcagaaggccgagcuggcggagggggcccuccggugggaccugccccgcgugcagggcgggagccagcuguccggccucuuccagauggacgugcccgggcccccgggcccgcccagccacggccuguccaccagcgccagcccccuggggcucggccccgccucccuguccuucgagcugccccggcacacgugcagcgggcuccagguccgcuuccugcggcuggccuuccgccccugcggcaacgcgaacccccacaagugggugcggcaccucucccacagcgacgccuacgugauccgcaucuga

SEQ ID NO: 26726 - RNA, 435 nt, Artificial Sequence
  derived and/or modified sequence opt1 from AP4S1__Homo_sapiens__NP_001121598
augaucaaguucuuccugauggugaacaagcagggccagacccgccucagcaaguacuacgagcacgucgacaucaacaagcggacccugcuggagacggaggugaucaaguccugccucagccgcuccaacgagcagugcagcuucaucgaguacaaggacuucaagcugaucuaccggcaguacgccgcccuguucaucguggucggggugaacgacaccgagaacgagauggccaucuacgaguucauccacaacuucguggagguccucgacgaguacuucucccgcgugagcgagcuggacaucauguucaaccuggacaaggugcacaucauccucgacgagaugguccugaacggcugcaucguggagaccaaccgggcccgcauccuggcgccccuccugauccuggacaagauguccgagagcuga

SEQ ID NO: 26727 - RNA, 1473 nt, Artificial Sequence
  derived and/or modified sequence opt1 from AP5M1__Homo_sapiens__NP_060699
auggcccagcgcgccguguggcugaucagccacgagcccggcaccccgcucugcgggaccguccgguucucccgccgguaccccacgguggagaagcgcgcgcggguguucaacggcgccagcuacguccccgugcccgaggacgggccguuccugaaggcccuccuguucgagcugcgccugcucgacgacgacaaggacuucguggagucccgggacagcugcucccgcaucaacaagaccagcaucuacggccugcugaucgggggcgaggagcucuggcccgucguggccuuccugaagaacgacaugaucuacgccugcgugccccuggucgagcagacccucagcccccggccgccccugaucagcguguccggcgugagccagggguucgaguuccuguucggcauccaggacuuccucuacuccgggcagaagaacgacagcgagcugaacaccaagcugucccagcuccccgaccugcugcuccaggcgugccccuucggcacgcugcuggacgccaaccuccagaacagccuggacaacaccaacuucgccuccgucacccagccgcagaagcagcccgccuggaagaccgggacguacaagggcaagccccaggugagcaucuccaucaccgagaaggugaaguccaugcaguacgacaagcagggcaucgcggacaccuggcaggucguggggaccgugacgugcaagugcgaccuggagggcaucaugcccaacgucaccaucucccucagccugccgaccaacgggagcccccugcaggacauccucgugcaccccugcgugaccucccuggacagcgccauccugacguccagcuccaucgacgccauggacgacagcgccuucuccggccccuacaaguucccguucaccccgccgcucgagagcuucaaccugugcuucuacaccucccagguccccgugccgcccauccugggcuucuaccagaugaaggaggaggaggugcagcuccgcaucaccaucaaccugaagcugcacgagagcgucaagaacaacuucgaguucugcgaggcccacauccccuucuacaaccgggggcccaucacgcaccucgaguacaagaccuccuucggccagcuggagguguuccgcgagaagucccugcucaucuggaucaucgggcagaaguuccccaagagcauggagaucagccuguccggcaccgucaccuucggggccaagagccacgagaagcagcccuucgaccccaucugcacgggcgagaccgcguaccugaagcuccacuuccggauccuggacuacacccugaccggcugcuacgccgaccagcacuccguccagguguucgccagcgggaagcccaagaucuccgcccaccgcaagcucaucagcagcgacuacuacaucuggaacuccaaggcgcccgcccccgugacguacggcagccugcugcuguga

SEQ ID NO: 26728 - RNA, 2424 nt, Artificial Sequence
  derived and/or modified sequence opt1 from AP5Z1__Homo_sapiens__NP_055670
auguucagcgccggcgccgagucccugcuccaccaggcgcgcgagauccaggacgaggagcugaagaaguucugcagccggaucugcaagcugcuccaggccgaggaccuggggcccgacacccuggacucccuccagcgccuguuccugaucaucagcgccaccaaguacucccggcgccucgagaagacgugcguggaccugcugcaggccacccucggccugccggccugccccgagcagcugcagguccucugcgcggccauccugcgggagaugagccccuccgacagccugucccucgccugggaccacacccagaacagccgccagcugucccugguggccagcgugcuccuggcgcagggggaccggaacgaggagguccgcgccgugggccagggggugcugcgggcccucgagucccgccagcccgagggcccgagccugcggcaccuccugcccgucauggccaagguggugguccugucccccggcacccugcaggaggaccaggccacgcuccugagcaagcgccugguggacuggcuccgguacgcgucccugcagcaggggcugccccacagcggcggguucuucuccaccccgcgcgcccggcagcccggccccgugaccgaggucgacggggccguggccaccgacuucuucacggugcucagcagcggccaccgcuucaccgacgaccaguggcugaacguccaggccuucuccaugcugcgggcguggcuccugcacagcggccccgaggggccgggcacccuggacaccgacgaccgcuccgagcaggaggggagcacgcucuccgugaucagcgccaccuccagcgccggccggcugcugccgccccgcgagcggcuccgcgagguggccuucgaguacugccagcgccugaucgagcaguccaaccggcgcgcccugcggaagggcgacagcgaccuccagaaggcgugccuggucgaggccgugcuggugcuggacguccucugccgccaggaccccuccuuccuguaccggagccuguccugccucaaggcccugcacgggcgcgugcggggcgacccggccagcgugcgcguccugcucccccuggcccacuucuuccugucccacggggaggcggccgccguggacagcgaggccgucuaccagcaccucuucacccggauccccguggagcaguuccacucccccaugcuggcguucgaguucauccaguucugccgcgacaaccugcaccucuucagcggccaccuguccacccugcggcucagcuucccgaaccuguucaaguuccuggccuggaacagcccgccccucacguccgaguucguggcccugcugcccgcccucgucgacgccgggaccgcgcuggagaugcugcacgcccuccuggaccugcccugccucaccgccgugcuggaccugcagcuccgcagcgcccccgccgcguccgagcggccccugugggacaccagccugcgcgcccccuccugccucgaggccuuccgggacccgcaguuccagggccuguuccaguaccugcuccgccccaaggccagcggcgccacggagcggcuggcgccccugcaccagcuccugcagccgauggccgggugcgcccgcguggcccagugcgcgcaggccguccccacccugcuccaggccuucuucuccgccgugacccagguggccgacggcagccugaucaaccagcuggcgcuccugcugcucgggcgguccgacagccuguaccccgcccccggcuacgccgccgggguccacuccgugcugagcucccaguuccucgcccugugcacccugaagccgagccucguggucgagcuggcgcgcgaccugcucgaguuccugggcuccgugaacggccugugcagccgcgccucccucgugacgagcgucgugugggccaucggggaguaccugagcgugaccuacgaccggcgcugcaccgucgagcagaucaacaaguucuucgaggcccuggaggcccuccuguucgaggugacccagugccggcccuccgcggcccugccccgcugcccgccccagguggucacggugcucaugaccacccugaccaagcuggccagccggucccaggaccucaucccccgcgccagccugcugcucuccaagaugcggacgcuggcgcacagccccgccaccuccagcacccacuccgaggagggcgccgaggccauccgcacccgggccacggagcugcucacccugcugaagaugcccagcguggcgcaguucguccucacccccuccaccgaggugugcagcccccgcuaccaccgggacgccaacaccgcccugccccuggcccuccgcacggugucccggcuggucgagcgcgaggccgggcugaugcccggcuga

SEQ ID NO: 26729 - RNA, 3585 nt, Artificial Sequence
  derived and/or modified sequence opt1 from APAF1__Homo_sapiens__NP_001151
auggacgccaaggcccgcaacugccugcuccagcaccgggaggcgcuggagaaggacaucaagaccagcuacaucauggaccacaugaucuccgacggcuuccugaccaucagcgaggaggagaaggugcgcaacgagcccacgcagcagcagcgggccgccaugcucaucaagaugauccugaagaaggacaacgacuccuacgucagcuucuacaacgcccugcuccacgagggguacaaggaccuggccgcgcugcuccacgacggcaucccggugguguccagcuccagcguccgcaccgugcugugcgagggcggggugccccagcggcccgucguguucgugacccgcaagaagcuggucaacgccauccagcagaagcucuccaagcugaagggggagcccggcugggugaccauccacggcauggccgggugcggcaagagcgugcuggccgcggaggccguccgggaccacucccuccuggaggggugcuucccgggcggggugcacugggugagcgucggcaagcaggacaaguccggccugcucaugaagcugcagaaccugugcacgcgccucgaccaggacgagagcuucucccagcggcugccccugaacaucgaggaggccaaggaccgccuccggauccugaugcugcgcaagcacccccggagccuccugauccuggacgacgugugggacuccugggugcucaaggccuucgacagccagugccagauccugcugaccacccgcgacaaguccgucaccgacagcgugauggggcccaaguacguggucccgguggagagcucccucggcaaggagaaggggcuggagauccugagccucuucgugaacaugaagaaggccgaccugcccgagcaggcgcacuccaucaucaaggagugcaagggcagcccccuggucgugucccucaucggcgcccugcugcgggacuuccccaaccgcugggaguacuaccucaagcagcugcagaacaagcaguucaagcggauccgcaagagcuccagcuacgacuacgaggcccuggacgaggccauguccaucagcgucgagaugcuccgggaggacaucaaggacuacuacacggaccuguccauccugcagaaggacgugaaggugccgaccaagguccucugcauccugugggacauggagaccgaggagguggaggacauccugcaggaguucgugaacaagagccugcuguucugcgaccgcaacgggaaguccuuccgguacuaccugcacgaccugcaggucgacuuccucaccgagaagaacugcagccagcugcaggaccugcacaagaagaucaucacgcaguuccagcgcuaccaccagccccacacccucucccccgaccaggaggacugcauguacugguacaacuuccuggccuaccacauggcgagcgccaagaugcacaaggagcugugcgcccucauguucucccuggacuggaucaaggccaagaccgagcuggugggccccgcccaccucauccacgaguucguggaguaccgccacauccuggacgagaaggacugcgcggucagcgagaacuuccaggaguuccugucccucaacgggcaccuccugggccggcagccguuccccaacaucgugcagcucgggcugugcgagcccgagaccagcgagguguaccagcaggccaagcugcaggccaagcaggaggucgacaacggcaugcucuaccuggaguggaucaacaagaagaacaucacgaaccugagccgccucguggugcggccccacaccgacgccgucuaccacgccugcuucuccgaggacggccagcgcaucgcgagcugcggggccgacaagacccuccagguguucaaggccgagaccggcgagaagcugcuggagaucaaggcccacgaggacgaggugcugugcugcgcguucuccacggacgaccgguucaucgcgaccugcagcgucgacaagaaggugaagaucuggaacuccaugaccggggagcuggugcacaccuacgacgagcacagcgagcaggucaacugcugccacuucacgaacuccagccaccaccuccugcuggccaccggcuccagcgacugcuuccucaagcugugggaccugaaccagaaggagugccgcaacaccauguucgggcacaccaacuccgugaaccacugccgguucagcccggacgacaagcuccuggccuccugcagcgccgacggcacgcugaagcucugggacgccaccuccgccaacgagcgcaagagcaucaacgugaagcaguucuuccugaaccuggaggacccccaggaggacauggaggucaucgugaagugcugcuccuggagcgccgacggcgcccggaucaugguggccgcgaagaacaagaucuuccucuggaacaccgacagccgcuccaaggucgccgacugccgggggcaccugagcugggugcacggcgugauguucucccccgacgggagcuccuuccugaccagcuccgacgaccagacgauccgccucugggagaccaagaaggucugcaagaacagcgccgugaugcugaagcaggagguggacgucguguuccaggagaacgaggugaugguccuggccguggaccacauccggcgccuccagcugaucaacggccggaccgggcagaucgacuaccugaccgaggcccagguguccugcugcugccucagcccccaccuccaguacaucgcguucggcgacgagaacggcgccaucgagauccuggagcuggucaacaaccgcaucuuccagucccgguuccagcacaagaagacgguguggcacauccaguucaccgccgacgagaagacccugaucagcuccagcgacgacgccgagauccagguguggaacuggcagcuggacaagugcaucuuccuccgcgggcaccaggagaccgucaaggacuuccggcugcugaagaacucccgccuccugagcugguccuucgacggcaccgugaagguguggaacaucaucacggggaacaaggagaaggacuucgucugccaccagggcaccgugcugagcugcgacaucucccacgacgcgaccaaguucagcagcaccuccgccgacaagacggccaagaucuggagcuucgaccuccugcugccgcuccacgagcugcgcggccacaacgggugcgugcggugcuccgccuucagcgucgacuccacccugcucgccaccggcgacgacaacggggagauccgcaucuggaacgugagcaacggcgagcugcugcaccucugcgcgccccuguccgaggagggggccgccacccacggcggcugggugacggaccugugcuucagccccgacgggaagaugcucaucuccgccggcggguacaucaagugguggaacgucgugaccggcgagagcucccagaccuucuacaccaacgggacgaaccugaagaagauccacgucagccccgacuucaagaccuacgugaccguggacaaccugggcauccucuacauccugcagacccuggaguga

SEQ ID NO: 26730 - RNA, 2514 nt, Artificial Sequence
  derived and/or modified sequence opt1 from APBA1__Homo_sapiens__XP_011516919
augaaccaccuggagggcagcgccgagguggaggucaccgacgaggccgccgggggcgaggugaacgaguccguggaggcggaccucgagcaccccgaggucgaggaggagcagcagcagccgccccagcagcagcacuacguggggcgccaccagcggggccgcgcccuggaggaccugcgggcccagcucgggcaggaggaggaggagcgcggcgagugccuggcccggagcgcguccaccgagagcggcuuccacaaccacacggacaccgccgagggggacgugaucgccgccgcgcgcgacggcuacgacgccgagcgggcccaggaccccgaggacgaguccgccuacgccguccaguaccgccccgaggcggaggaguacaccgagcaggccgaggccgagcacgccgaggccacccaccggcgcgcgcugccgaaccaccuccacuuccacagccuggagcacgaggaggccaugaacgccgccuacuccggguacguguacacgcaccggcuguuccaccgcggcgaggacgagcccuacagcgagcccuacgccgacuacgggggccuccaggagcacguguacgaggagaucggcgacgcgcccgagcuggacgcccgggacgggcugcgccucuacgagcaggagcgggacgaggccgccgccuaccgccaggaggcgcugggcgcccggcugcaccacuacgacgagcgcuccgacggggagagcgacuccccggagaaggaggccgaguucgcccccuacccccggauggacagcuacgagcaggaggaggacaucgaccagaucgucgcggaggugaagcaguccaugagcucccagagccucgacaaggccgccgaggacaugcccgaggccgagcaggaccuggagcgcccgcccacccccgccggcggccggcccgacuccccggggcugcaggcgcccgccggccagcagcgcgccguggggcccgccggcgggggcgaggccggccagcgcuacagcaaggagaagcgggacgcgaucucccucgccaucaaggacaucaaggaggccaucgaggaggucaagacccgcaccauccggagccccuacacgccggacgagcccaaggagcccaucugggugaugcgccaggacaucagccccacccgggacugcgacgaccagcgcccgauggacggggacucccccagccccggcuccagcagcccccugggggccgaguccuccagcaccucccugcacccgagcgaccccguggaggccuccaccaacaaggagagccggaagucccucgcgagcuuccccacguacgucgaggugccgggccccugcgaccccgaggaccugaucgacgggaucaucuucgccgccaacuaccugggcuccacccagcuccugagcgacaagacccccuccaagaacgugcgcaugaugcaggcccaggaggcggucagccggaucaagauggcccagaagcuggccaagucccgcaagaaggccccggagggcgagagccagcccaugaccgagguggaccucuucaucagcacgcagcggaucaaggugcugaacgccgacacccaggagaccaugauggaccacccccugcgcaccaucuccuacaucgcggacaucgggaacaucgucgugcucauggcccggcgccggaugccccgcagcaacucccaggagaacguggaggccagccacccgucccaggacggcaagcggcaguacaagaugaucugccacgucuucgagagcgaggacgcccagcugaucgcccaguccaucgggcaggcguucagcguggccuaccaggaguuccugcgcgccaacggcaucaaccccgaggaccucucccagaaggaguacagcgaccugcugaacacgcaggacauguacaacgacgaccucauccacuucuccaagagcgagaacugcaaggacgucuucaucgagaagcagaagggggagauccugggcguggugaucgucgaguccggcugggggagcauccugcccaccgugaucaucgccaacaugaugcacggcgggcccgccgagaaguccggcaagcucaacaucggcgaccagaucaugagcaucaacgggaccucccuggugggccugccgcucagcacgugccagagcaucaucaaggggcugaagaaccagucccgggucaagcugaacaucgugcgcugcccgcccgugaccaccguccucauccgccggcccgaccugcgcuaccagcugggcuucagcgugcagaacgggaucaucugcucccucaugcggggcggcaucgcggagcgcgggggcgugcgggucgggcaccgcaucaucgagaucaacggccagagcgugguggccacgccccacgagaagaucguccacauccuguccaacgccgugggggagauccacaugaagaccaugcccgccgcgauguaccggcugcugaccgcccaggagcagcccguguacaucuga

SEQ ID NO: 26731 - RNA, 2214 nt, Artificial Sequence
  derived and/or modified sequence opt1 from APBA2__Homo_sapiens__XP_006725606
auggcccaccgcaagcuggagagcgugggcuccgggaugcucgaccaccggguccgccccggcccggugccccacagccaggagcccgaguccgaggacauggagcugccccuggagggguacgugccggagggccucgagcuggccgcgcugcggcccgagagccccgcccccgaggagcaggagugccacaaccacuccccggacggggacagcuccagcgacuacgucaacaacaccuccgaggaggaggacuacgacgagggccuccccgaggaggaggagggcaucaccuacuacauccgcuacugccccgaggacgacagcuaccuggaggggauggacugcaacggcgaggaguaccuggcccacuccgcccaccccguggacaccgacgagugccaggaggccguggaggaguggaccgacagcgcggggccgcacccccacggccacgaggccgaggggucccaggacuaccccgacggccagcuccccaucccggaggacgagcccagcguccuggaggcccacgaccaggaggaggacggccacuacugcgccuccaaggagggguaccaggacuacuaccccgaggaggcgaacggcaacaccggggccagccccuaccggcugcgccggggcgacggcgaccucgaggaccaggaggaggacaucgaccagaucguggccgagaucaagaugucccugagcaugaccuccaucacgagcgccagcgaggccuccccggagcacgggcccgagcccggccccgaggacagcguggaggcgugcccgcccaucaaggccuccugcagccccucccgccacgaggcccggcccaagagccugaaccuccugccggaggccaagcaccccggggacccccagcgcggcuucaagccgaagacccggacccccgaggagcgccugaaguggccccacgagcaggucugcaacgggcucgagcagccccggaagcagcagcgcuccgaccugaacggcccgguggacaacaacaacauccccgagaccaagaagguggccagcuuccccuccuucgucgcggugcccggcccgugcgagcccgaggaccugaucgacgggaucaucuucgccgccaacuaccucggcagcacgcagcugcuguccgagcggaaccccagcaagaacauccgcaugaugcaggcccaggaggccgugucccgggucaagaacagcgagggggacgcgcagacccucaccgagguggaccuguucaucuccacccagcgcaucaaggugcugaacgccgacacgcaggagaccaugauggaccacgcccuccggaccaucagcuacaucgccgacaucggcaacaucgucgugcugauggcccgccggcgcaugccccgcuccgcgagccaggacugcaucgagaccacgccgggggcccaggagggcaagaagcaguacaagaugaucugccacguguucgaguccgaggacgcccagcugaucgcccagagcaucggccaggcguucagcgucgccuaccaggaguuccuccgggccaacgggaucaaccccgaggaccugucccagaaggaguacagcgacaucaucaacacccaggagauguacaacgacgaccugauccacuucuccaacagcgagaacugcaaggagcuccagcuggagaagcacaagggcgagauccugggggugguggucguggaguccggcugggggagcauccuccccaccgucauccuggccaacaugaugaacggcggccccgccgcgcgcuccgggaagcugagcaucggcgaccagaucauguccaucaacgggaccagccucgugggccugccgcuggccacgugccagggcaucaucaaggggcucaagaaccagacccaggugaagcugaacaucgucuccugcccgcccgugaccaccgugcugaucaagcggcccgaccucaaguaccagcugggcuucagcguccagaacgggaucaucugcucccugaugcgcggcgggaucgccgagcggggcggcgugcgcguggggcaccggaucaucgagaucaacggccagagcgucguggccacggcccacgagaagaucgugcaggcgcucuccaacagcgucggggagauccacaugaagaccaugcccgccgccauguuccgccugcugaccggccaggagacgccccuguacaucuga

SEQ ID NO: 26732 - RNA, 1728 nt, Artificial Sequence
  derived and/or modified sequence opt1 from APBA3__Homo_sapiens__NP_004877
auggacuuccccaccaucagccgcuccccgagcggcccgcccgccauggaccuggaggggccccgggacauccucgugcccuccgaggaccugacccccgacagccagugggaccccaugcccggcgggccgggcucccugagccgcauggagcucgacgaguccagccugcaggagcugguccagcaguucgaggcccuccccggggaccuggugggccccucccccggcggggcgccgugcccccugcacaucgccacgggccacgggcucgccagccaggagaucgccgacgcccacggccugcuguccgcggaggccgggcgggacgaccuccugggccugcuccacugcgaggagugcccgcccagccagaccggccccgaggagccccuggagcccgcgccccgccugcuccagccgcccgaggaccccgacgaggacuccgacagccccgaguggguggagggggccuccgccgagcaggagggcagccgguccagcuccagcagcccggagcccuggcuggagaccgucccccuggugacccccgaggagccgcccgccggggcccagucccccgagacgcucgccagcuacccggcgccccaggaggugcccggccccugcgaccacgaggaccugcuggacggcgucaucuucggggcccgcuaccucggcuccacccagcuggugagcgagcggaacccgcccaccuccacccgcauggcccaggcccgggaggccauggaccgcgugaaggcccccgacggggagacgcagcccaugaccgaggucgaccuguucgugagcaccaagcggaucaaggugcucaccgcggacucccaggaggccaugauggaccacgcccugcacacgaucagcuacaccgccgacaucggcugcguccuggugcucauggcccgccggcgccuggcgcggcgcccggcgccccaggaccacgggcggcgccuguacaagaugcucugccacguguucuacgccgaggacgcccagcugaucgcccaggccaucggccaggccuucgccgccgcguacucccaguuccugcgggagagcggcaucgaccccucccaggucggggugcaccccagcccgggcgccugccaccuccacaacggggaccuggaccacuucuccaacagcgacaacugccgcgaggugcaccuggagaagcggcgcggcgaggggcucggcgucgcccugguggaguccggcugggggagccugcuccccaccgccgugaucgccaaccugcugcacggcgggcccgcggagcgcuccggcgcccucagcaucggggaccggcugaccgccaucaacggcacgucccuggucggccucccccuggccgccugccaggcggccgugcgcgagaccaagagccagaccagcgugacccuguccaucguccacugcccgcccgugacgaccgccaucauccaccggccccacgcccgcgagcagcugggguucugcgucgaggacggcaucaucugcagccuccugcgcgggggcaucgccgagcggggcgggauccgggugggccaccgcaucaucgagaucaacgggcaguccguggucgcgacgccccacgcccggaucaucgagcugcucaccgaggccuacggcgaggugcacaucaagaccaugccggccgcgaccuaccgccugcugaccgggcaggagcagcccguguaccucuga

SEQ ID NO: 26733 - RNA, 1473 nt, Artificial Sequence
  derived and/or modified sequence opt1 from APBB1__Homo_sapiens__NP_001244248
augagcgccauguucucccaggacuucuuccuggccaucauccuccaggacagcuccgcggacagcuucuggaaccccaacgccuucgagaccgacuccgaccugccggccggcuggaugcgcgugcaggacaccagcgggacguacuacuggcacauccccaccggcaccacccagugggagccgcccgggcgggccucccccagccagggcuccagcccccaggaggagucccagcugacguggaccggguucgcccacggcgagggcuucgaggacggggaguucuggaaggacgagcccagcgacgaggcgcccauggagcucggccugaaggagccggaggaggggacccugaccuuccccgcccagucccucagccccgagccccugccgcaggaggaggagaagcugccgccccgcaacacgaaccccggcaucaagugcuucgccguccggucccucggguggguggagaugaccgaggaggagcuggcccccggccgcagcuccguggcggucaacaacugcauccggcagcugagcuaccacaagaacaaccuccacgaccccauguccggcggguggggcgaggggaaggaccugcugcuccagcuggaggacgagacccugaagcucguggagccccagagccaggcccugcugcacgcccagcccaucaucagcauccgcguguggggcgucggccgggacuccgggcgcgagcgggacuucgccuacguggcccgcgacaagcucacccagaugcugaagugccacguguuccggugcgaggcgccggccaagaacaucgccacgagccugcacgagaucugcuccaagaucauggccgagcgccggaacgcccgcugccucgucaacggccugagccuggaccacuccaagcucguggacgugcccuuccaggucgaguuccccgcgcccaagaacgagcuggugcagaaguuccagguguacuaccuggggaacgucccgguggccaagcccgugggcgucgacgugaucaacggggcccucgagagcgugcuguccagcuccagccgggagcaguggacccccucccacgucagcguggcccccgccacccugaccauccuccaccagcagacggaggcggugcugggcgagugccgcguccgguuccuguccuuccucgccgugggccgcgacguccacaccuucgccuucaucauggccgccgggccggcgagcuucugcugccacauguucuggugcgagcccaacgccgccucccugagcgaggccgugcaggcggccugcaugcugcgguaccagaagugccucgacgcccgcucccaggccagcaccuccugccugcccgccccgcccgcggagagcguggcccggcgcgucggcuggaccgugcgccgcggggugcagagccuguggggcucccucaagcccaagcggcugggggcccacacgcccuga

SEQ ID NO: 26734 - RNA, 2001 nt, Artificial Sequence
  derived and/or modified sequence opt1 from APBB1IP__Homo_sapiens__XP_006717514
augggcgagagcuccgaggacaucgaccagauguucagcacccugcucggggagauggaccugcugacccagucccucggcguggacacgcugcccccgcccgaccccaaccccccgcgcgccgaguucaacuacagcgucggguucaaggaccugaacgagucccucaacgcccuggaggaccaggaccuggacgcgcucauggccgaccugguggccgacaucagcgaggccgagcagcggaccauccaggcccagaaggagucccugcagaaccagcaccacagcgcgucccuccaggccagcaucuucuccggcgccgccagccugggguacggcaccaacguggcggccaccggcaucucccaguacgaggacgaccugcccccccccccggccgaccccguccucgaccugccccugcccccgcccccccccgagccgcucagccaggaggaggaggaggcccaggccaaggcggacaagaucaagcuggcccuggagaagcucaaggaggccaaggugaagaagcugguggucaaggugcacaugaacgacaacuccacgaagagccugaugguggacgagcgccagcucgcccgggacguccuggacaaccuguucgagaagacccacugcgacugcaacguggacuggugccucuacgagaucuaccccgagcugcagaucgagcgcuucuucgaggaccacgagaacguggucgaggugcuguccgacuggacccgggacaccgagaacaagauccucuuccuggagaaggaggagaaguacgccguguucaagaacccccagaacuucuaccuggacaaccgcgggaagaaggagagcaaggagacgaacgagaagaugaacgcgaagaacaaggagucccuccuggaggagagcuucugcggcaccagcaucaucguccccgagcuggagggggcccucuaccugaaggaggacggcaagaaguccuggaagcggcgcuacuuccugcuccgggccagcgggaucuacuacgugccgaagggcaagaccaagaccucccgcgaccuggccugcuucauccaguucgagaacgugaacaucuacuacggcacgcagcacaagaugaaguacaaggcccccaccgacuacugcuucguccugaagcacccccagauccagaaggagagccaguacaucaaguaccucugcugcgacgacacccggacccugaaccagugggugauggggauccgcaucgcgaaguacggcaagacgcuguacgacaacuaccagcgggccguggccaaggccgggcucgccucccgcuggaccaaccugggcaccgucaacgcggccgcccccgcccagccgagcaccggccccaagacggggaccacccagcccaacggccagaucccccaggcgacccacuccgugagcgccgugcugcaggaggcccagcggcacgccgagacguccaaggacaagaagccggcccucgggaaccaccacgaccccgcggucccccgcgccccgcacgcccccaagagcucccugccccccccgccccccgugcggcgcagcuccgacaccagcggcucccccgccaccccgcugaaggccaaggggaccggcggcgggggccugcccgcgccccccgacgacuuccucccgcccccccccccgccccccccccuggacgacccggagcugcccccccccccgcccgacuucauggagcccccgcccgacuucgucccccccccgccccccagcuacgccgggaucgccggcuccgagcuccccccgcccccccccccgccccccgcccccgccccggcgcccgugcccgacagcgcccggcccccgcccgccguggccaagcgcccccccgucccgcccaagcggcaggagaaccccgggcaccccggcggcgcggggggcggggagcaggacuucauguccgaccugaugaaggcccugcagaagaagcgcggcaacgugagcuga

SEQ ID NO: 26735 - RNA, 2277 nt, Artificial Sequence
  derived and/or modified sequence opt1 from APBB2__Homo_sapiens__NP_001159522
augagcgaggugcugcccgccgacuccggcgucgacacccucgccguguucauggcgagcuccgggaccacggacgugaccaaccgcaacagcccggccaccccgcccaacacccugaaccugcgguccagccacaacgagcuccugaacgccgagaucaagcacacggagaccaagaacuccaccccgcccaagugccgcaagaaguacgcccugaccaacauccaggccgcgaugggccucagcgaccccgccgcccagccccugcuggggaacggcuccgccaacaucaagcucgucaagaacggggagaaccagcugcggaaggcggccgagcagggccagcaggaccccaacaagaaccugagccccacggccgugaucaacaucaccuccgagaagcucgagggcaaggagccccacccccaggacagcuccagcugcgagauccugcccucccagccgcgccggaccaagagcuuccugaacuacuacgccgaccucgagaccuccgcccgcgagcuggagcagaaccgggggaaccaccacggcacggcggaggagaagucccagcccgugcaggggcaggccagcaccaucaucggcaacggggaccugcuccugcagaagcccaaccgcccccagagcagcccggaggacggccaggucgccaccguguccagcucccccgagaccaagaaggaccaccccaagacgggcgccaagaccgacugcgcccugcaccggauccagaaccucgcgcccagcgacgaggaguccagcuggaccacccugucccaggacagcgccuccccgagcucccccgacgagacggacaucuggagcgaccacuccuuccagaccgaccccgaccugcccccgggguggaagcgcgugagcgacaucgccggcaccuacuacuggcacauccccaccgggacgacccagugggagcggcccgucuccauccccgccgaccuccagggcagccgcaagggcucccugagcuccgugaccccgagccccacccccgagaacgagaagcagccguggagcgacuucgccgugcugaacgggggcaagaucaacuccgacaucuggaaggaccuccacgcggccacggucaaccccgaccccagccugaaggaguucgagggggccacccugcgguacgccucccucaagcugcgcaacgcgccccacccggacgacgacgacagcugcuccaucaacagcgaccccgaggccaagugcuucgccgugcggucccugggcuggguggagauggccgaggaggaccucgcccccggcaagagcuccgucgcggugaacaacugcauccgccagcugagcuacugcaagaacgacauccgggacaccguggggaucuggggcgaggggaaggacauguaccugauccucgagaacgacaugcugucccuggucgaccccauggaccgcagcgugcuccacucccagccgaucgugagcauccgggucuggggcguggggcgcgacaacggccgggacuucgccuacguggcccgcgacaaggacacccgcauccugaagugccacgucuuccggugcgacacgcccgccaaggccaucgcgaccucccugcacgagaucugcagcaagaucauggccgagcgcaagaacgccaaggcccucgccugcuccagccugcaggagcgggcgaacgugaaccuggacgucccccuccagguggacuuccccaccccgaagaccgagcuggugcagaaguuccacguccaguaccuggggaugcuccccguggacaagcccgugggcauggacauccugaacagcgccaucgagaaccugaugacguccagcaacaaggaggacuggcuguccgucaacaugaacguggccgacgccaccgugaccgucaucagcgagaagaacgaggaggaggugcucguggagugccgcguccgguuccuguccuucaugggcguggggaaggacgugcacaccuucgccuucaucauggacaccggcaaccagcgcuucgagugccacgucuucuggugcgagcccaacgcggggaacgugagcgaggccgugcaggccgccugcaugcugcgguaccagaagugccucgucgcgcgcccgcccucccagaaggugcggcccccgcccccgcccgccgacagcgugacgcgccgggucaccaccaacgugaagcgcggcgugcugucccugaucgacacccucaagcagaagcggcccgucacggagaugcccuga

SEQ ID NO: 26736 - RNA, 1482 nt, Artificial Sequence
  derived and/or modified sequence opt1 from APBB3__Homo_sapiens__NP_006042
augcugggcaaggacuacaugcucgccaucauccuggugaacugcgacgacgaccuguggggcgaccacagccucgagguggaggccgggcugcccccgggguggcgcaagauccacgacgcggccggcaccuacuacuggcacgugcccuccgggagcacccaguggcagcggcccacgugggagcugggcgacgccgaggaccccggcaccgggaccgagggcaucugggggcuccgcccgcccaagggccgguccuucagcucccuggagagcucccuggaccgcagcaacucccucagcugguacgggggcgaguccuacauccagagcauggagcccggcgccaagugcuucgccgugcggucccuggggugggucgaggugcccgaggaggaccuggcgccgggcaagagcuccaucgccgugaacaacugcauccagcagcucgcccagacccgcagccggucccagccgcccgacggggccuggggcgagggccagaacaugcugaugauccugaagaaggacgcgaugagccucgucaacccccuggaccacucccugauccacugccagccccucgugcacauccgcguguggggcgucgggagcagcaaggggcgggacucccccaucagcgcccccgcccgcgacuucgccuucguggccuccgacaaggacagcugcaugcugaagugccacguguucugcugcgacguccccgcgaaggccaucgccuccgcccugcacggccucugcgcccagauccugagcgagcggguggagguguccggggacgcgagcugcugcuccccggaccccaucagccccgaggaccugccccgccaggucgagcuccuggacgccgugucccaggccgcccagaaguacgaggcccuguacaugggcacgcucccggugaccaaggcgaugggcauggacguccugaacgaggccaucgggacccugaccgcccggggcgaccgcaacgccugggugcccacgaugcucagcguguccgacagccugaugaccgcccaccccauccaggcggaggccuccaccgaggaggagccccuguggcagugcccgguccggcucgugaccuucaucggggugggccgcgacccccacacguucgggcugaucgccgaccugggccggcagagcuuccagugcgccgcguucuggugccagccccacgccggcgggcucuccgaggccguccaggccgccugcauggugcaguaccagaagugccuggucgcgagcgccgcccgcggcaaggccuggggcgcccaggcgcgggcccgccugcggcucaagcgcaccuccagcauggacagccccggcgggccgcugccccugccccuccugaagggcggggucgggggcgccggggccaccccgcgcaagcggggcguguucuccuuccuggacgccuuccgccucaagcccagccugcugcacaugcccuga

SEQ ID NO: 26737 - RNA, 6984 nt, Artificial Sequence
  derived and/or modified sequence opt1 from APC2__Homo_sapiens__XP_005259532
augggccugcuggggcugcugagccugcugcacuccgccuucuucggcgaccagacccugcaggagcucaagauggccagcuccguggcccccuacgagcagcuggugcgccagguggaggcccugaaggccgagaacagccaccuccggcaggagcugcgggacaacuccagccaccuguccaagcucgagaccgagaccagcgggaugaaggaggugcugaagcaccuccagggcaagcucgagcaggaggcccgggugcugguguccagcgggcagaccgaggugcuggagcagcucaaggcccugcagauggacaucaccucccuguacaaccucaaguuccagccgcccacccugggccccgagcccgccgcccgcacccccgagggcagccccguccacggguccggccccagcaaggacuccuucggggagcugagccgggccaccauccgccuccuggaggagcuggaccgggagcgcugcuuccuccugaacgagaucgagaaggaggagaaggagaagcugugguacuacucccagcuccagggccugagcaagcggcuggacgagcucccccacguggagacccaguucuccaugcagauggaccugauccgccagcagcuggaguucgaggcccagcacauccggagccucauggaggagcgcuucgggaccagcgacgagauggugcagcgggcccagauccgcgccucccggcuggagcagaucgacaaggagcugcucgaggcccaggaccgcguccagcagaccgagccccaggcccugcuggccgucaagagcgugcccgucgacgaggaccccgagaccgaggugcccacccaccccgaggacggcacgccccagcccggcaacuccaagguggaggucguguucuggcuccugagcaugcuggccacccgggaccaggaggacaccgcccgcacccuccuggccauguccagcucccccgagagcugcguggccaugcggcgcuccgggugccugccccuccugcugcagauccugcacggcaccgaggccgccgccgggggccgggccggcgcccccggggcccccggcgccaaggacgcccgcaugcgcgccaacgccgcccuccacaacaucgucuucagccagcccgaccaggggcuggcccggaaggagaugcgcgugcugcacgugcucgagcagauccgggccuacugcgagaccugcugggacuggcugcaggcccgcgacggcgggcccgagggcggcggggccggcuccgcccccauccccaucgagccccagaucugccaggcgaccugcgccgucaugaagcugagcuucgacgaggaguaccggcgcgccaugaacgagcucgggggccugcaggccguggcggagcugcuccagguggacuacgagaugcacaagaugacccgggacccccugaaccuggcccuccgccgguacgccgggaugacccugacgaaccugaccuucggcgacgucgccaacaaggccacccucugcgcgcgccggggcugcauggaggccaucguggcccagcuggccuccgacagcgaggagcugcaccaggucguguccagcauccuccgcaaccuguccuggcgggccgacaucaacagcaagaaggugcugcgcgaggcgggguccgucaccgcccucgugcagugcgugcugcgggccacgaaggagagcacccucaagagcguccucuccgcccuguggaaccugagcgcgcacuccaccgagaacaaggccgccaucugccagguggacggcgcccucggguuccuggugagcacccugacguacaagugccaguccaacagccucgccaucaucgaguccggcgggggcauccugcgcaacgucagcucccugguggcgacccgggaggacuaccgccaggugcuccgggaccacaacugccugcagacccugcuccagcaccugaccagccacucccugacgaucgucagcaacgccugcggcacccucuggaaccuguccgcccgcagcgcccgcgaccaggagcugcucugggaccugggggccgugggcaugcugcggaaccucgugcacuccaagcacaagaugaucgcgauggggagcgccgccgcccugcgcaaccugcucgcccaccggcccgcgaagcaccaggccgccgccaccgcggucucccccggcagcugcgugcccagccuguacgugcgcaagcagcgggcccuggaggccgagcucgacgcccgccaccuggcccaggcgcuggagcaccucgagaagcagggcccgcccgccgccgaggccgccaccaagaagccccugccgccccugcggcaccucgacgggcuggcgcaggacuacgccuccgacagcggcugcuucgacgacgacgacgcccccuccagccuggccgccgcggccgccacgggggagcccgccucccccgccgcgcucagccuguuccugggcucccccuuccuccaggggcaggcccuggcccgcacgccgcccacccggcgcggcggcaaggaggccgagaaggacaccagcggggaggcggccgucgccgccaaggccaaggcgaagcuggcccucgccguggcccggaucgaccagcugguggaggacaucuccgcccugcacaccagcuccgacgacagcuucucccucagcuccggcgaccccgggcaggaggcgccccgcgagggccgggcccagagcugcucccccugccgcgggcccgagggcggccggcgcgaggccgggagccgggcccacccccugcugcgccucaaggccgcgcacgccucccugagcaacgacagccugaacuccggcagcgccuccgacggguacugcccccgggagcacaugcuccccugcccccuggccgcgcuggccagccgccgggaggacccccgcugcggccagccccgccccucccggcucgaccuggaccugcccgggugccaggccgagccgcccgcccgcgaggccacgagcgcggacgcccggguccgcaccaucaagcucucccccaccuaccagcacgugccccugcuggagggcgccagccgggccggcgccgagccccucgcggggcccggcaucucccccggggcccgcaagcaggccuggcugccggccgaccaccugagcaaggugcccgagaagcucgccgcggcgccccuguccgucgccagcaaggcccugcagaagcucgcggcccaggagggcccccugucccugagccggugcuccagccucuccagccuguccagcgccgggcgcccgggccccagcgagggcggggaccuggacgacuccgacagcucccuggagggccucgaggaggccgggcccagcgaggccgagcuggacuccaccuggcgggcgcccggcgccacgagccugccgguggccauccccgcgccccgccggaaccgcggccgggggcucggcguggaggacgccacccccuccagcuccagcgagaacuacguccaggagaccccgcuggugcugucccgcugcagcuccgugagcucccucgggagcuucgagucccccagcaucgcguccagcauccccagcgagcccugcuccggccaggggagcggcaccaucuccccgagcgagcugcccgacucccccggccagacgaugcccccgagccgguccaagacgccgccccuggcccccgccccgcaggggccgcccgaggccacccaguucagccuccagugggaguccuacgucaagcgcuuccuggacaucgccgacugccgggagcgcugccggcugcccagcgagcucgacgcgggcuccgugcgcuucaccguggagaagccggacgagaacuucagcugcgccuccagccuguccgcccuggcccuccacgagcacuacguccagcaggacguggagcugcgccugcuccccagcgccugccccgagcgcgggggcggggcgggcggcgccgggcugcacuucgccggccaccgccggcgcgaggaggggccggcccccacgggcucccggccccgcggggcggccgaccaggagcuggagcuccugcgggagugccugggcgccgccgugcccgcccgccuccggaaggucgcgagcgcccuggugccgggccgccgggcccugcccgugcccgucuacaugcucgugcccgccccggcccccgcgcaggaggacgacuccugcaccgacagcgccgaggggacccccgugaacuucagcuccgccgccagccuguccgacgagacccugcagggcccgccccgcgaccagcccgggggccccgccggccggcagcgccccacggggcggcccaccagcgcgcgccaggccaugggccaccggcacaaggccgggggcgccgggcgcuccgcggagcagagccggggcgccggcaagaaccgcgccgggcucgagcugccccugggccggccgcccuccgccccggccgacaaggacgggagcaagcccggccgcacccgcggggacggcgcgcuccagucccugugccugaccacgcccaccgaggaggccgucuacugcuucuacggcaacgacagcgacgaggagcccccggccgccgcccccacccccacccaccggcgcacguccgcgaucccccgggccuucacccgcgagcggccgcaggggcgcaaggaggcccccgcccccagcaaggccgcgccggccgcgccgccgcccgcccggacccagccgucccucaucgcggacgagacgccgcccugcuacagccuguccagcuccgccagcucccugagcgagcccgagccgagcgagccgcccgccgugcacccccgcggccgggagccggccgugacgaaggaccccgggcccggcgggggccgcgacuccagccccuccccgcgggccgcggaggagcuccugcagcgcugcaucagcuccgcccugccccggcgccggccgcccgucagcggccuccgccggcgcaagccgcgggccacccgccuggacgagcgccccgccgaggggucccgggagcgcggcgaggaggccgcggggagcgaccgggccuccgaccuggacagcguggaguggcgcgccauccaggagggcgccaacuccaucgugaccuggcuccaccaggccgcggccgccacccgggaggccagcuccgagagcgacuccauccugagcuucgucuccgggcugagcgugggcagcacgcuccagccgcccaagcaccgcaagggccggcaggccgagggggagaugggcuccgcgcgccggccggagaagcgcggggccgccagcgugaagaccuccggcagcccccggucccccgccggcccggagaagccccgcgggacccagaagaccacgcccggcguccccgcggugcugcgggggcgcaccgucaucuacgugccgagccccgcgccccgggcccagcccaagggcaccccggggccccgcgccacgccccggaagguggcgccgcccugccuggcgcagcccgccgcccccgccaagguccccucccccggccagcagcgcagccggucccuccaccgccccgccaagaccagcgagcuggcgacgcugucccagccgccccggagcgccaccccgcccgcccgccucgccaagacccccuccagcuccagcucccagaccagccccgccucccagccgcugccccgcaagcggccgcccgugacgcaggcggccggcgcccugccggggcccggcgccagccccgugccgaagacccccgcgcgcacccuccuggccaagcagcacaagacccagcggagccccguccgcauccccuucaugcagcggccggcccgccgggggccgccgccccuggcccgcgccgugccggagcccggcccccgggggcgcgcgggcacggaggccggccccggggcccggggcgggcgccucggccuggugcgggucgccuccgcccugagcuccgggagcgaguccagcgaccgcuccggcuuccggcgccagcucaccuucaucaaggagagcccgggccugcggcgccggcgcuccgagcugagcuccgcggagagcgccgccuccgcgccccagggggccagcccccgccggggccgccccgcgcucccggccguguuccugugcuccagccggugcgaggagcugcgcgccgcgccccggcaggggcccgcccccgcgcgccagcggccgcccgccgcccgccccucccccggcgagcggccggcccgccggaccaccagcgagucccccagccgccuccccgugcgggcgcccgccgcccgcccggagacggucaagcgguacgccagccugccccacaucuccguggcccgccggcccgacggggcggugccggccgcccccgccagcgccgacgcggcccgccgguccagcgacggcgagccccgcccccugccgcgggucgccgcccccggcaccaccuggcgccgcauccgggacgaggacgugccccacauccuccgcuccacccugcccgccacggcgcugccgcuccgggggagcacccccgaggacgcccccgccggcccgccgccccgcaagaccuccgacgccgugguccagaccgaggagguggcggcccccaagacgaacagcuccaccagccccucccuggagacccgggagccgcccggggcccccgccggcggccagcugagccuccugggguccgacguggacggccccagccuggccaaggcgcccaucuccgcccccuucguccacgaggggcucggcguggccgucgggggcuuccccgccagccgccacggcucccccagccgguccgcccgcgucccgcccuucaacuacgugcccagccccaugguggucgcggccaccacggacagcgccgccgagaaggcccccgcgaccgccuccgccacccugcuggaguga

SEQ ID NO: 26738 - RNA, 1545 nt, Artificial Sequence
  derived and/or modified sequence opt1 from APCDD1__Homo_sapiens__NP_694545
augagcuggccccgccggcugcuccugcgcuaccuguucccggcccuccugcugcacggccucggggagggcuccgcccugcugcaccccgacagccggucccacccccgcagccucgagaaguccgcguggcgggccuucaaggagagccagugccaccacaugcugaagcaccuccacaacggggcccgcaucaccgugcagaugcccccgaccaucgagggccacugggucuccacggggugcgaggugcggagcggccccgaguucaucacccgcuccuaccgguucuaccacaacaacaccuucaaggccuaccaguucuacuacggcagcaaccgcugcaccaaccccacguacacccugaucauccgggggaagauccgccugcggcaggccuccuggaucauccgcggcgggaccgaggcggacuaccagcugcacaacgugcaggucaucugccacaccgaggccguggccgagaagcucggccagcaggucaaccggacgugccccggguuccuggccgacggcggcccgugggugcaggacguggcguacgaccuguggcgcgaggagaacgggugcgagugcaccaaggccgugaacuucgccaugcacgagcuccagcugauccgggucgagaagcaguaccugcaccacaaccucgaccaccugguggaggagcuguuccucggcgacauccacaccgacgccacccagcgcauguucuaccggcccagcuccuaccagccgccccugcagaacgccaagaaccacgaccacgcgugcaucgccugccgcaucaucuaccggagcgacgagcaccacccgcccauccugccgcccaaggccgaccucacgaucgggcugcacggcgagugggugucccagcgcugcgagguccgccccgaggugcuguuccucacccggcacuucaucuuccacgacaacaacaacaccugggagggccacuacuaccacuacagcgaccccgugugcaagcaccccaccuucuccaucuacgcccgcgggcgguacagccgcggcguccuguccagccgggugaugggcgggacggaguucguguucaaggucaaccacaugaaggugacccccauggacgccgcgaccgccagccugcucaacguguucaacgggaacgagugcggcgccgagggcuccuggcaggucgggauccagcaggacgugacccacacgaacggcugcguggcccuggggaucaagcugccccacaccgaguacgagaucuucaagauggagcaggacgcccgcggccgguaccuccuguucaacgggcagcgccccagcgacggcuccagccccgaccggcccgagaagcgcgcgaccuccuaccagaugccgcugguccagugcgccagcuccagcccccgggccgaggaccucgccgaggacuccggcagcucccuguacgggcgcgcccccggccggcacaccuggagccugcuccuggcggcccuggccugccucgugccccugcugcacuggaacauccgccgguga

SEQ ID NO: 26739 - RNA, 1539 nt, Artificial Sequence
  derived and/or modified sequence opt1 from APCDD1L__Homo_sapiens__NP_001291716
auggccgagaacagcggccccggggugcgcccgcccggcugggaggcccagaucaacaucaucuccacccggcuggcgcucgcccacaccgcccccgccgccggggaggcgggcgggagcugccugcgcugggagccccacugccagcagccgcugcccgaccggguccccuccacggccauccugcccccgcgccugaacggccccuggaucagcaccggcugcgaggugcggcccgggcccgaguuccugacccgcgccuacaccuucuacccgucccgccucuuccgggcccaccaguucuacuacgaggaccccuucugcggcgagcccgcgcacagccugcuggugaaggggaagguccggcuccgccgggccuccugggugacgcgcggcgccaccgaggccgacuaccaccuccacaagguggggaucgucuuccacagccggcgcgcccugguggacgugaccggccggcucaaccagacccgcgcgggccgggacugcgcccgccggcugcccccggcccgcgccuggcugcccggggcccucuacgagcugcgguccgcgcgcgcccagggcgacugccuggaggcccucgggcugacgaugcacgagcugagccucguccgcgugcagcggcgccugcagccccagccccgggccuccccgcgccugguggaggagcucuaccugggcgacauccacaccgaccccgccgagcggcgccacuaccggcccaccggcuaccagcgcccccugcagagcgcgcuccaccacguccagccgugccccgccugcgggcugaucgcccgguccgacgugcaccacccgcccgugcugcccccgccccucgcccugccccugcaccucggcggguggugggucagcuccggcugcgaggugcgccccgccgugcuguuccugacccgccucuucacguuccacgggcacagccgguccugggagggcuacuaccaccacuucagcgaccccgcgugccggcagcccaccuucaccgucuacgccgccggccgcuacacccgggggacgccguccacccgcgugcggggcgggaccgagcugguguucgaggucacccgcgcccacgugacgcccauggaccaggugaccaccgcgaugcugaacuucagcgagcccagcuccugcggcggggccggcgccuggagcaugggcaccgagcgggacgucacggccaccaacgggugccucccccugggcauccgccugccgcacguggaguacgagcuguucaagauggagcaggacccccuggggcagucccuccucuucaucggccagcgccccaccgacgggagcucccccgacaccccggagaagcggcccacgagcuaccaggcgccccugguccugugccacggcgaggcccccgacuucucccgcccgccccagcaccggcccagccuccagaagcaccccuccaccggcgggcugcacaucgccccguucccccugcugccccucgugcugggccuggccuuccuccacuggcuguga

SEQ ID NO: 26740 - RNA, 8532 nt, Artificial Sequence
  derived and/or modified sequence opt1 from APC__Homo_sapiens__NP_001120982
auggccgccgcgagcuacgaccagcugcugaagcaggucgaggcccugaagauggagaacagcaaccugcgccaggagcucgaggacaacagcaaccaccugaccaagcuggagaccgaggccuccaacaugaaggaggugcucaagcagcugcagggcagcaucgaggacgaggccauggccuccagcgggcagaucgaccugcucgagcggcugaaggagcugaaccucgacuccagcaacuuccccggcgugaagcugcgguccaagaugagccugcgguccuacgggagccgcgagggcuccgugagcucccggagcggggagugcucccccgugcccaugggcagcuucccccgccggggcuucgugaacgggucccgcgagagcaccggcuaccucgaggagcuggagaaggagcggagccugcuccuggcggaccuggacaaggaggagaaggagaaggacugguacuacgcccagcuccagaaccugaccaagcgcaucgacucccugccccucaccgagaacuucagccugcagaccgacaugacgcggcgccagcuggaguacgaggcccggcagauccgcguggccauggaggagcagcucgggaccugccaggacauggagaagcgggcgcagcgccggaucgcccgcauccagcagaucgagaaggacauccugcggauccgccagcugcuccagucccaggccaccgaggccgagcggagcucccagaacaagcacgagaccggcagccacgacgccgagcgccagaacgaggggcagggcgucggcgagaucaacauggcgacguccgggaacggccaggggagcaccacccgcauggaccacgagaccgccuccgugcugagcuccagcuccacgcacagcgcgccccggcgccugaccucccaccucggcaccaagguggagauggucuacagccugcuguccaugcucggcacccacgacaaggacgacaugagccggacgcugcuggccauguccagcagccaggacuccugcaucagcaugcgccaguccgggugccucccccugcugauccagcuccugcacggcaacgacaaggacagcgugcugcucgggaacucccggggcagcaaggaggcccgcgcccgggccuccgccgcccugcacaacaucauccacagccagcccgacgacaagcgcgggcggcgcgagauccgggugcugcaccuccuggagcagauccgcgccuacugcgagaccugcugggaguggcaggaggcgcacgagcccggcauggaccaggacaagaaccccaugcccgcccccgucgagcaccagaucugccccgccgugugcgugcugaugaagcuguccuucgacgaggagcaccggcacgccaugaacgagcucggcgggcugcaggccaucgcggagcugcuccaggucgacugcgagauguacggccugaccaacgaccacuacagcaucacccugcgccgguacgccgggauggcccucacgaaccugaccuucggcgacguggccaacaaggcgacccugugcuccaugaaggggugcaugcgcgcccucguggcccagcugaaguccgaguccgaggaccugcagcaggucaucgccagcgugcuccggaaccuguccuggcgcgccgacgugaacagcaagaagacccugcgggaggucggcuccgugaaggcgcucauggagugcgcccuggaggugaagaaggagagcacgcucaagagcguccucuccgcccuguggaaccugagcgcccacugcaccgagaacaaggccgacaucugcgcgguggacggcgcccucgccuuccuggucgggacccugaccuaccgcucccagacgaacacccucgccaucaucgagagcggcgggggcauccugcgcaacguguccagccugaucgccaccaacgaggaccaccggcagauccuccgcgagaacaacugccugcagacccugcuccagcaccugaagucccacagccugacgaucguguccaacgcgugcgggacccucuggaaccugagcgcccggaaccccaaggaccaggaggcccugugggacaugggcgccgucuccaugcucaagaaccugauccacagcaagcacaagaugaucgcgaugggcuccgccgccgcccugcgcaaccucauggccaaccggcccgcgaaguacaaggacgccaacaucaugagccccggguccagccugcccucccugcacgugcgcaagcagaaggcccucgaggccgagcuggacgcccagcaccugagcgagaccuucgacaacaucgacaaccucucccccaaggcgagccaccggagcaagcagcgccacaagcagucccuguacggcgacuacguguucgacaccaaccggcacgacgacaaccgcagcgacaacuucaacacggggaacaugaccguccugucccccuaccucaacaccaccgugcugcccagcuccagcuccagccggggcucccuggacagcucccgcagcgagaaggaccggucccucgagcgcgagcggggcaucgggcugggcaacuaccaccccgccaccgagaacccggggacgagcuccaagcgcggccugcagaucagcaccaccgccgcccagaucgccaaggugauggaggaggucuccgcgauccacaccagccaggaggaccgguccagcgggagcacgaccgagcuccacugcgugaccgacgagcgcaacgcccugcggcgcuccagcgccgcccacacccacuccaacacguacaacuucaccaagagcgagaacuccaaccggaccugcagcaugcccuacgcgaagcuggaguacaagcgcuccagcaacgacucccucaacagcguguccagcuccgacggcuacggcaagcgcgggcagaugaagcccagcaucgaguccuacagcgaggacgacgaguccaaguucugcagcuacggccaguaccccgccgaccuggcccacaagauccacuccgccaaccacauggacgacaacgacggggagcuggacaccccgaucaacuacagccucaaguacagcgacgagcagcugaacuccggccggcagagccccucccagaacgagcgcugggcccggcccaagcacaucaucgaggacgagaucaagcagagcgagcagcgccagucccggaaccagagcacgaccuaccccgucuacaccgaguccaccgacgacaagcaccugaaguuccagccgcacuucgggcagcaggagugcgugagccccuaccgcucccggggcgcgaacggcagcgagacgaaccgcgugggguccaaccacggcaucaaccagaacgucagccagucccucugccaggaggacgacuacgaggacgacaagcccaccaacuacagcgagcgguacuccgaggaggagcagcacgaggaggaggagcgcccgaccaacuacagcaucaaguacaacgaggagaagcggcacguggaccagcccaucgacuacucccugaaguacgccaccgacauccccagcucccagaagcagagcuucagcuucuccaagagcuccagcgggcaguccagcaagacggagcacauguccagcuccagcgagaacaccuccacccccagcuccaacgccaagcgccagaaccagcugcacccgagcuccgcccagagccgguccggccagccccagaaggccgcgaccugcaaggugagcuccaucaaccaggagacgauccagaccuacugcgucgaggacacccccaucugcuucagccgcugcagcucccucagcucccugagcuccgccgaggacgagaucgggugcaaccagaccacgcaggaggccgacagcgccaacacccugcagaucgccgagaucaaggagaagaucggcacccgguccgcggaggaccccgugagcgaggugccggccgucucccagcacccccgcaccaagagcucccggcuccagggcagcucccugagcuccgagagcgcccgccacaaggccguggaguucuccagcggggccaagagccccuccaagagcggcgcgcagacgcccaaguccccgcccgagcacuacgugcaggagacgccccugauguucagccggugcaccuccgucagcucccucgacagcuucgagucccgcagcaucgccuccagcgugcaguccgagcccugcagcgggaugguguccggcaucaucagcccguccgaccugcccgacagccccgggcagaccaugcccccgucccgcagcaagacgccgccgcccccgccccagaccgcccagaccaagcgggagguccccaagaacaaggcccccaccgcggagaagcgcgagagcggccccaagcaggccgccgugaacgccgccgugcagcggguccaggugcugcccgacgcggacacccuccugcacuucgccacggaguccacccccgacggcuucagcugcuccagcucccugagcgcccucucccuggacgagccguucauccagaaggacguggagcugcgcaucaugccgcccguccaggagaacgacaacgggaacgagaccgagagcgagcagcccaaggaguccaacgagaaccaggagaaggaggccgagaagaccaucgacagcgagaaggaccuccuggacgacuccgacgacgacgacaucgagauccuggaggagugcaucaucagcgccaugccgacgaaguccagccggaaggcgaagaagcccgcccagaccgccuccaagcucccgccgcccguggcccgcaagcccagccagcugcccguguacaagcugcuccccucccagaaccggcugcagccccagaagcacgucagcuucacccccggcgacgacaugccccgcguguacugcguggaggggacccccaucaacuucuccacggccaccagccugagcgaccucaccaucgaguccccgcccaacgagcuggcggccggcgagggcguccgcggcggggcccagagcggggaguucgagaagcgcgacaccauccccacggaggggcgguccaccgacgaggcccagggcgggaagaccagcuccgugaccauccccgagcuggacgacaacaaggcggaggagggcgacauccucgccgagugcaucaacagcgccaugccgaaggggaagucccacaagcccuuccgcgugaagaagaucauggaccagguccagcaggccagcgccuccagcuccgcgcccaacaagaaccagcuggacggcaagaagaagaagcccacgagcccggugaagcccaucccccagaacaccgaguaccggacccgcgugcggaagaacgccgacuccaagaacaaccugaacgccgagcgcgucuucagcgacaacaaggacuccaagaagcagaaccugaagaacaacagcaagguguucaacgacaagcucccgaacaacgaggaccgggugcgcggguccuucgccuucgacagcccccaccacuacacccccaucgagggcacgcccuacugcuucucccggaacgacagccugagcucccuggacuucgacgacgacgacgucgaccucagccgcgagaaggccgagcugcggaaggcgaaggagaacaaggaguccgaggccaaggugaccagccacaccgagcugaccuccaaccagcagagcgccaacaagacgcaggccaucgccaagcagccgaucaaccgcgggcagcccaagcccauccuccagaagcaguccaccuucccccagagcuccaaggacaucccggaccgcggcgcggccaccgacgagaagcugcagaacuucgccaucgagaacacccccgugugcuucagccacaacuccagccuguccagccucuccgacaucgaccaggagaacaacaacaaggagaacgagcccaucaaggagacggagcccccggacagccagggcgagcccuccaagccccaggccagcggguacgcgcccaaguccuuccacgucgaggacaccccggugugcuucagccggaacagcucccugagcucccugagcaucgacuccgaggacgaccuccugcaggagugcaucagcuccgccaugcccaagaagaagaagcccagccgccugaagggcgacaacgagaagcacagcccccggaacaugggcgggauccucggggaggaccugacccuggaccucaaggacauccagcgcccggacagcgagcacggccugucccccgacagcgagaacuucgacuggaaggccauccaggagggcgccaacuccaucgucagcucccugcaccaggccgcggccgccgccugccucagccggcaggccuccagcgacuccgacagcauccugagccugaaguccgggaucagccucggcucccccuuccaccugacccccgaccaggaggagaagccguucacgagcaacaaggggccccgcauccugaagcccggcgagaaguccacccucgagaccaagaagaucgagagcgaguccaagggcaucaagggcggcaagaagguguacaagagccugaucaccgggaaggugcgguccaacagcgagaucuccggccagaugaagcagccccugcaggcgaacaugccgagcaucucccgcgggcggacgaugauccacauccccggcguccgcaacagcuccagcuccaccagccccgugagcaagaagggcccgccccucaagacccccgccuccaagagccccuccgaggggcagaccgccaccacgagcccgcggggcgccaagcccuccgucaagagcgagcugucccccgucgcccgccagaccagccagaucgggggcuccagcaaggcgcccucccggagcgggucccgcgacagcaccccgucccggcccgcccagcagccccugagccgccccauccaguccccgggccggaacagcaucucccccggccgcaacgggaucuccccgcccaacaagcucagccagcugccgcggaccuccagccccuccacggccagcaccaaguccagcggcuccgggaagaugagcuacaccucccccggccgccagaugagccagcagaaccugaccaagcagacggggcucuccaagaacgccagcuccaucccccgcagcgaguccgccagcaagggccugaaccagaugaacaacggcaacggggcgaacaagaagguggagcugucccggaugagcuccaccaagagcagcggcuccgagagcgaccgcuccgagcggccggugcucguccgccagagcaccuucaucaaggaggcccccucccccacccugcggcgcaagcuggaggagagcgccuccuucgagagccucucccccagcucccggccggccagccccacgcgcucccaggcgcagacccccgugcugagcccgucccugcccgacaugagccucuccacccacagcuccgugcaggccgggggcuggcggaagcugccgcccaaccugagcccgaccaucgaguacaacgacgggcgccccgccaagcggcacgacaucgcccgcagccacuccgagagccccucccggcuccccaucaaccgcagcggcacguggaagcgggagcacuccaagcacagcuccagccugccgcgcgucuccaccuggcggcgcaccggcagcuccagcuccauccugagcgccuccagcgaguccagcgagaaggcgaaguccgaggacgagaagcacgugaacagcaucagcgggaccaagcaguccaaggagaaccaggugagcgccaagggcacguggcggaagaucaaggagaacgaguucucccccaccaacagcaccucccagaccgucagcuccggggccacgaacggcgccgagagcaagacccucaucuaccagauggcccccgcgguguccaagaccgaggacguguggguccgcaucgaggacugccccaucaacaacccgcggagcggccgcucccccaccgggaacacgccgcccgugaucgacagcguguccgagaaggccaacccgaacaucaaggacagcaaggacaaccaggccaagcagaacgucggcaacggguccgugcccaugcgcaccgugggccuggagaaccggcugaacagcuucauccaggucgacgcccccgaccagaaggggaccgagaucaagcccggccagaacaacccggugcccguguccgagaccaacgagagcuccaucgucgagcgcacgcccuucagcagcuccagcuccagcaagcacuccagccccuccggcaccguggccgcgcgggugaccccguucaacuacaaccccagcccccgcaaguccagcgccgacuccaccagcgcccggcccucccagaucccgacgcccgucaacaacaacaccaagaagcgcgacagcaagaccgacuccaccgagagcuccgggacgcagagccccaagcggcacagcggcuccuaccucgugaccagcguguga

SEQ ID NO: 26741 - RNA, 672 nt, Artificial Sequence
  derived and/or modified sequence opt1 from APCS__Homo_sapiens__NP_001630
augaacaagccccugcucuggaucagcgugcugaccucccugcucgaggccuucgcccacaccgaccugagcggcaaggucuucguguucccgcgcgaguccgugaccgaccacgucaaccugaucaccccgcucgagaagccccugcagaacuucacccugugcuuccgggcguacagcgaccucucccgcgccuacagccuguucuccuacaacacccaggggcgggacaacgagcugcucguguacaaggagcgcgugggcgaguacagccuguacaucgggcggcacaaggucaccuccaaggugaucgagaaguuccccgcccccgugcacaucugcgucagcugggaguccagcuccggcaucgccgaguucuggaucaacgggacgccccuggugaagaagggccuccgccagggcuacuucguggaggcccagcccaagaucguccuggggcaggagcaggacagcuacggcgggaaguucgaccggucccagagcuucgugggcgagaucggggaccuguacaugugggacuccgugcugcccccggagaacauccucagcgcguaccagggcacgccccugcccgccaacauccucgacuggcaggcccugaacuacgagauccgcggcuacgucaucaucaagccccugguguggguguga

SEQ ID NO: 26742 - RNA, 2199 nt, Artificial Sequence
  derived and/or modified sequence opt1 from APEH__Homo_sapiens__NP_001631
auggagcgccaggugcugcucagcgagcccgaggaggccgccgcgcuguaccggggccugucccgccagccggcccucagcgccgccugccuggggcccgaggucaccacccaguacggcgggcaguaccggacggugcacaccgaguggacccagcgcgaccuggagcggauggagaacauccgcuucugccggcaguaccucguguuccacgacggcgacuccgucguguucgccgggcccgcgggcaacagcguggagacccgcggcgagcugcugucccgggagagccccuccgggacgaugaaggccguccuccgcaaggccggcgggaccggcccgggggaggagaagcaguuccuggaggugugggagaagaaccggaagcucaagagcuucaaccuguccgcccuggagaagcacggccccguguacgaggacgacugcuucggcugccugagcuggucccacagcgagacccaccuccuguacgucgcggagaagaagcgccccaaggccgaguccuucuuccagaccaaggcccuggacgugagcgccuccgacgacgagaucgcccggcucaagaagcccgaccaggcgaucaagggggaccaguucguguucuacgaggacuggggcgagaacauggucagcaaguccaucccggugcugugcgugcuggacgucgagagcgggaacaucuccgugcucgagggcgugcccgagaacgucagccccggccaggccuucugggcccccggggacgccggcgugguguucgucgggugguggcacgagccguuccgccugggcauccgguucugcacgaaccgccggagcgcccuguacuacguggaccucaucgggggcaagugcgagcugcuguccgacgacagccucgcgguguccagcccccgccugucccccgaccagugccggaucgucuaccugcaguaccccagccucaucccgcaccaccagugcucccagcugugccuguacgacugguacaccaaggugaccagcgucgugguggacgucgugccccgccagcucggcgagaacuucuccgggaucuacugcagccugcugccccucggcugcugguccgccgacagccagcggguggucuucgacuccgcccagcgcagccgccaggaccuguucgccguggacacccagguggggacggucaccucccugaccgccggcgggagcggcggcuccuggaagcuccugaccaucgaccaggaccugaugguggcgcaguucagcacgcccucccucccgcccacccugaaggugggguuccugcccagcgccggcaaggagcagagcguccucugggugucccuggaggaggccgagcccaucccggacauccacugggggauccgggugcugcagcccccgcccgagcaggagaacguccaguacgccggccucgacuucgaggccauccugcugcagcccgggagcccgcccgacaagacccaggugcccaugguggucaugccccacggcggcccccacuccagcuucgugaccgcguggaugcuguuccccgccaugcucugcaagaugggguucgccgugcugcuggucaacuaccgcggcuccacgggguucggccaggacagcauccucucccugccgggcaacguggggcaccaggacgugaaggacguccaguucgccguggagcagguccugcaggaggagcacuucgacgcgagccacguggcccucaugggcgggucccacggcggguucaucagcugccaccugaucggccaguaccccgagaccuaccgggccugcguggcccgcaaccccgugaucaacaucgccuccaugcugggcagcaccgacauccccgacuggugcgucguggaggcgggguucccguucuccagcgacugccuccccgaccuguccgugugggccgagaugcuggacaagagccccauccgguacaucccccaggucaagaccccgcuccugcugaugcucggccaggaggaccgccgggugcccuucaagcaggggauggaguacuaccgcgcccugaagacgcggaacgugcccguccgccugcuccuguaccccaaguccacccacgcccugagcgagguggagguggagagcgacuccuucaugaacgccguccucuggcugcggacccaccugggcagcuga

SEQ ID NO: 26743 - RNA, 957 nt, Artificial Sequence
  derived and/or modified sequence opt1 from APEX1__Homo_sapiens__XP_005267638
augcccaagcgcggcaagaagggggccguggccgaggacggcgacgagcugcggaccgagccggaggcgaagaaguccaagaccgccgccaagaagaacgacaaggaggccgccggggagggccccgcgcucuacgaggacccgcccgaccagaagacgagccccagcgggaagcccgccacccugaagaucugcuccuggaacgucgacggccugcgcgccuggaucaagaagaagggccucgacugggugaaggaggaggcccccgacauccugugccugcaggagaccaagugcagcgagaacaagcuccccgcggagcugcaggagcugccggggcucucccaccaguacuggagcgcccccuccgacaaggagggcuacagcggggugggccugcugucccggcagugcccccucaaggucagcuacgggaucggcgacgaggagcacgaccaggagggccgcgugaucguggccgaguucgacuccuucguccuggugaccgccuacgugcccaacgccgggcggggccugguccgccucgaguaccggcagcgcugggacgaggcguuccggaaguuccugaaggggcuggccagccgcaagccgcucgugcugugcggcgaccugaacguggcccacgaggagaucgaccuccggaaccccaagggcaacaagaagaacgccggguucacgccccaggagcgccagggcuucggggagcugcugcaggccgucccccucgcggacuccuuccggcaccuguacccgaacacccccuacgccuacaccuucuggaccuacaugaugaacgcccgcagcaagaacgugggcuggcggcuggacuacuuccuccugucccacagccugcuccccgcccugugcgacuccaagauccgcagcaaggcccugggguccgaccacugccccaucacgcucuaccuggcgcuguga

SEQ ID NO: 26744 - RNA, 1557 nt, Artificial Sequence
  derived and/or modified sequence opt1 from APEX2__Homo_sapiens__NP_055296
augcugcgcguggucagcuggaacaucaacggcauccggcgcccccuccaggggguggccaaccaggagccguccaacugcgccgcgguggccgucggccggauccuggacgagcuggacgccgacaucgugugccuccaggagaccaaggugacccgcgacgcccugacggagccccuggccaucgucgagggguacaacagcuacuucuccuucagccggaaccgcuccggcuacagcgggguggcgaccuucugcaaggacaacgccacccccguggccgccgaggagggccucuccggccuguucgcgacccagaacggggacgucggcugcuacgggaacauggacgaguucacgcaggaggagcugcgggcccucgacagcgagggccgcgcccugcugacccagcacaagauccggaccugggaggggaaggagaagacccucacgcugaucaacguguacugcccccacgccgacccgggccgccccgagcggcugguguucaagaugcgcuucuaccggcuccugcagauccgcgccgaggcgcugcucgccgccggcucccacgucaucauccugggggaccugaacaccgcccaccggcccaucgaccacugggacgccgugaaccucgagugcuucgaggaggaccccggccgcaaguggauggacagccugcuguccaaccucgggugccagagcgcgucccacgugggcccguucaucgacagcuaccggugcuuccagcccaagcaggagggcgccuucacgugcugguccgccgucaccggggcccgccaccugaacuacggcagccggcuggacuacgugcucggggaccgcacccuggugaucgacaccuuccaggccuccuuccugcuccccgaggucaugggcagcgaccacugccccgugggggcggugcuguccgucagcagcgugccggccaagcagugcccgccccugugcacccgguuccuccccgaguucgccggcacccagcugaagauccugcgcuuccucgugccccuggagcagucccccguccuggagcagagcacgcuccagcacaacaaccagacccgcgugcagaccugccagaacaaggcccagguccgguccacccgcccccagcccagccaggugggcuccagccgggggcagaagaaccugaaguccuacuuccagccgagccccuccugcccccaggccagccccgacaucgagcugccgucccucccccugaugagcgcgcugaugacgcccaagacccccgaggagaaggccguggccaaggucgugaagggccaggccaagaccuccgaggcgaaggacgagaaggagcuccgcaccagcuucuggaaguccgugcuggccgggccgcugcggacgccccucugcggcgggcaccgcgagcccugcgucaugcggaccgugaagaagccgggccccaaccugggccgccgguucuacaugugcgcccgcccccgggggcccccgaccgaccccagcucccgcugcaacuucuuccuguggagccggcccuccuga

SEQ ID NO: 26745 - RNA, 651 nt, Artificial Sequence
  derived and/or modified sequence opt1 from APH1B__Homo_sapiens__NP_001139118
augaccgcggccguguucuucggcugcgcguucaucgccuucgggcccgcccuggcccucuacgucuucaccaucgccacggagccgcugcgcaucaucuuccugaucgcgggcgccuucuucuggcucgugagccugcugaucuccagccucgugugguucauggcccgggucaucaucgacaacaaggacgggcccacccagaaguaccugcugaucuucggcgccuucguguccguguacauccaggagauguuccgcuucgcguacuacaagcuccugaagaaggccagcgaggggcugaaguccaucaaccccggcgagaccgcccccagcaugcggcuccuggccuacgccuucaugacccuggucaucauccuccugcacguguucuggggcaucguguucuucgacgggugcgagaagaagaaguggggcauccugcucaucguccugcugacgcaccuccugguguccgcgcagaccuucaucagcuccuacuacgggaucaaccuggccagcgccuucaucauccucgugcugaugggcaccugggccuuccuggccgccgggggcuccugccgcagccucaagcugugccugcucugccaggacaagaacuuccugcuguacaaccagcggucccgcuga

SEQ ID NO: 26746 - RNA, 1575 nt, Artificial Sequence
  derived and/or modified sequence opt1 from API5__Homo_sapiens__NP_001136402
augcccaccguggaggagcuguaccgcaacuacggcauccucgccgacgccaccgagcaggucgggcagcacaaggacgcguaccaggugauccuggacggcgugaagggcgggacgaaggagaagcggcuggccgcccaguucauccccaaguucuucaagcacuuccccgagcucgccgacagcgccaucaacgcgcagcuggaccugugcgaggacgaggacgucuccauccgccggcaggccaucaaggagcucccccaguucgccaccggggagaaccugccccgcguggccgacauccugacccagcuccugcagaccgacgacagcgcggaguucaaccuggugaacaacgcccuccuguccaucuucaagauggacgccaagggcacgcugggcgggcuguucagccagauccugcagggcgaggacaucguccgggagcgcgccaucaaguuccuguccaccaagcucaagacccugccggacgaggugcugaccaaggagguggaggagcucauccugacggagagcaagaagguccuggaggacgugaccggggaggaguucgugcuguucaugaagauccuguccggccucaagagccuccagaccgucuccgggcggcagcagcugguggagcugguggccgagcaggcggaccucgagcagaccuucaaccccagcgaccccgacugcgucgaccgccugcugcagugcacgcggcaggccgugccccucuucuccaagaacgugcacagcacccgcuucgucaccuacuucugcgagcagguccugccgaaccugggcacccucacgacccccguggagggccuggacauccagcuggaggugcucaagcugcuggccgagauguccagcuucugcggggacauggagaagcucgagaccaaccugcggaagcuguucgacaagcuccuggaguacaugccccugcccccggaggaggccgagaacggcgagaacgccgggaacgaggagcccaagcuccaguucuccuacguggagugccugcuguacagcuuccaccagcugggccgcaagcuccccgacuuccugaccgcgaagcugaacgccgagaagcucaaggacuucaagauccggcugcaguacuucgcccgcggccuccagguguacauccggcagcuccgccuggcccugcaggggaagacgggcgaggcccucaagaccgaggagaacaagaucaaggucguggcgcugaagaucaccaacaacaucaacguccugaucaaggaccucuuccacaucccgcccuccuacaagagcaccgugacgcuguccuggaagcccgugcagaaggucgagaucgggcagaagcgggccagcgaggacaccaccagcggcuccccgcccaagaaguccagcgccgggcccaagcgcgacgcccggcagaucuacaacccgcccagcggcaaguacuccagcaaccugggcaacuucaacuacgagcagcgcggggccuuccggggcucccgcgggggccgcggguggggcacccggggcaaccgcagccgggggcgccucuacuga

SEQ ID NO: 26747 - RNA, 729 nt, Artificial Sequence
  derived and/or modified sequence opt1 from APIP__Homo_sapiens__NP_057041
augagcggcugcgacgcccgcgagggggacugcugcucccggcgcugcggcgcccaggacaaggagcacccccgguaccugaucccggagcucugcaagcaguucuaccaccuggggugggugaccggcaccgggggcggcaucagccugaagcacggggacgagaucuacaucgcgcccuccggcguccagaaggagcgcauccagcccgaggacauguucgugugcgacaucaacgagaaggacaucagcgggcccuccccgagcaagaagcucaagaagucccagugcacgccccuguucaugaacgccuacaccaugcggggcgccggggccgugauccacacccacagcaaggccgcggucauggccacccuccuguuccccggccgcgaguucaagaucacgcaccaggagaugaucaagggcaucaagaagugcaccuccgggggcuacuaccgguacgacgacaugcugguggugcccaucaucgagaacaccccggaggagaaggaccugaaggaccgcauggcccacgccaugaacgaguaccccgacagcugcgcgguccucgugcggcgccacgggguguacgucuggggcgagaccugggagaaggccaagacgaugugcgagugcuacgacuaccuguucgacaucgccguguccaugaagaaggugggccuggaccccagccagcuccccgucggggagaacggcaucguguga

SEQ ID NO: 26748 - RNA, 234 nt, Artificial Sequence
  derived and/or modified sequence opt1 from APLN__Homo_sapiens__NP_059109
augaaccugcgccucugcgugcaggcccugcugcuccuguggcugagccucaccgccgucugcggcgggucccugaugccccugccggacggcaacgggcucgaggacggcaacgugcggcaccuggugcagccccgcgggagccggaacggccccggccccuggcagggcgggcgccggaaguuccgccggcagcgcccgcggcugucccacaaggggcccaugcccuucuga

SEQ ID NO: 26749 - RNA, 1143 nt, Artificial Sequence
  derived and/or modified sequence opt1 from APLNR__Homo_sapiens__NP_005152
auggaggagggcggggacuucgacaacuacuacggcgccgacaaccagagcgagugcgaguacaccgacuggaaguccagcggggcccugauccccgcgaucuacaugcucguguuccugcugggcaccacggggaacggccucguccuguggaccguguuccgcuccagccgggagaagcgccgguccgccgacaucuucaucgccagccuggccguggccgaccucaccuucgucgugacccugccgcugugggcgacguacaccuaccgcgacuacgacuggcccuucggcaccuucuucugcaagcucuccagcuaccugaucuucgugaacauguacgccuccgucuucugccugaccgggcucagcuucgaccgguaccuggccaucgugcgccccguggccaacgcgcggcugcgccuccgggucuccggcgccguggccacggccgugcuguggguccuggccgcgcuccuggccaugcccgugauggugcugcgcaccaccggggaccucgagaacaccacgaagguccagugcuacauggacuacagcaugguggccaccguguccagcgagugggccugggaggucggccuggggguguccagcaccaccgugggcuucgucgugccguucacgaucaugcugaccugcuacuucuucaucgcccagaccaucgcgggccacuuccggaaggagcgcaucgaggggcuccggaagcgccggcgccugcuguccaucaucgugguccucguggucaccuucgcccugugcuggaugcccuaccaccuggugaagacgcucuacaugcugggcagccugcuccacuggcccugcgacuucgaccuguuccugaugaacaucuuccccuacugcacgugcaucuccuacgugaacagcugccucaacccguuccuguacgccuucuucgacccccgguuccgccaggccugcaccagcaugcugugcugcgggcagucccggugcgccggcaccagccacuccagcuccggcgagaaguccgcgagcuacagcuccgggcacagccagggccccgggcccaacaugggcaagggcggggagcagaugcacgagaaguccaucccguacagccaggagacccucgucguggacuga

SEQ ID NO: 26750 - RNA, 1956 nt, Artificial Sequence
  derived and/or modified sequence opt1 from APLP1__Homo_sapiens__NP_001019978
augggccccgccagcccggccgcgcgcgggcugucccggcgccccggccagccgccccucccccugcugcucccccugcugcuccugcugcuccgggcccagcccgccaucgggagccuggccggcgggucccccggcgccgcggaggccccgggcagcgcccagguggccgggcugugcggccgccucacccugcaccgggaccugcgcaccgggcggugggagcccgacccccagcgcucccggcgcugccuccgggacccccagcgcguccuggaguacugccggcagauguacccggagcugcagaucgcgcgcguggagcaggccacgcaggccauccccauggagcgguggugcggcgggagccgcuccggcagcugcgcccacccccaccaccaggugguccccuuccggugccucccgggcgaguucguguccgaggcccugcuggugcccgaggggugccgcuuccuccaccaggagcggauggaccagugcgagagcuccacccgccggcaccaggaggcgcaggaggccugcagcucccagggccugauccugcacgggagcggcaugcuccugcccugcggcuccgaccgcuuccgcggggucgaguacgugugcugcccgccgcccggcacccccgaccccagcgggaccgccgugggcgaccccuccacgcggagcuggccgcccgggucccgcgucgagggcgccgaggacgaggaggaggaggagagcuucccccagcccguggacgacuacuucguggagccgccccaggccgaggaggaggaggagaccgugcccccgcccagcucccacacccuggcggucgugggcaaggucacccccacgccccggcccaccgacgggguggacaucuacuucggcaugcccggggagaucagcgagcacgagggcuuccuccgcgccaagauggaccuggaggagcggcgcaugcggcagaucaacgaggugaugcgcgagugggccauggccgacaaccaguccaagaaccugcccaaggccgaccggcaggcgcucaacgagcacuuccagagcauccugcagacccuggaggagcaggucuccggggagcgccagcggcucguggagacccacgccacgcgcgugaucgcccugaucaacgaccagcggcgcgccgcccuggagggcuuccucgcggcccugcaggccgacccgccccaggccgagcggguccugcucgcgcugcgccgguaccugcgcgccgagcagaaggagcagcggcacacccuccgccacuaccagcacguggccgccguggaccccgagaaggcccagcagaugcgcuuccagguccacacccaccuccaggugaucgaggagcgggucaaccagagccugggccugcuggaccagaacccccaccuggcgcaggagcuccgcccgcagauccaggagcugcugcacuccgagcaccuggggcccagcgagcucgaggcccccgcccccggcggguccagcgaggacaagggcgggcugcagccgcccgacuccaaggacgccgacacccccaugacgcugcccaagggcagcaccgagcaggacgccgcguccccggagaaggagaagaugaacccccucgagcaguacgagcggaaggugaacgccagcgugccccgcggcuuccccuuccacuccagcgagauccagcgggacgagcuggccccggccgggaccggcgucucccgcgaggccgugagcgggcugcucaucaugggcgcgggcgggggcucccugaucgugcugagcaugcuccugcugcggcgcaagaagcccuacggggccaucagccacggcgucguggagguggaccccaugcucacccuggaggagcagcagcugcgggagcuccagcgccacggguacgagaacccgacguaccgguuccuggaggagcgccccuga

SEQ ID NO: 26751 - RNA, 2256 nt, Artificial Sequence
  derived and/or modified sequence opt1 from APLP2__Homo_sapiens__NP_001135748
auggccgccaccggcaccgcggccgccgccgccacggggcgccugcuccugcugcuccuggugggccugaccgcgcccgcccucgcccuggccggguacaucgaggcgcuggccgccaacgccggcaccggguucgccgucgcggagccgcagaucgccauguucugcggcaagcucaacaugcacgugaacauccagaccggcaagugggagcccgaccccacggggaccaagagcugcuucgagaccaaggaggaggugcugcaguacugccaggagauguaccccgagcugcagaucaccaacgucauggaggccaaccagcggguguccaucgacaacuggugccgccgggacaagaagcagugcaagagccgcuucgugacgccguucaagugccucgucggcgaguucguguccgacgugcugcugguccccgagaagugccaguucuuccacaaggagcggauggaggugugcgagaaccaccagcacuggcacaccguggucaaggaggccugccucacccaggggaugacccuguacagcuacggcaugcugcuccccugcgggguggaccaguuccacggcacggaguacgugugcugcccccagaccaagaucaucggcuccgucagcaaggaggaggaggaggaggacgaggaggaggaggaggaggaggacgaggaggaggacuacgacguguacaaguccgaguucccgaccgaggccgaccuggaggacuucaccgaggcggccguggacgaggacgacgaggacgaggaggagggggaggaggucguggaggaccgcgacuacuacuacgacacguucaagggcgacgacuacaacgaggagaaccccaccgagcccgggagcgacggcaccauguccgacaaggagaucacccacgacgugaaggccgucugcagccaggaggccaugacgggccccugccgggccgugaugccgcgcugguacuucgaccuguccaaggggaagugcgugcgguucaucuacggcgggugcggcgggaaccgcaacaacuucgagagcgaggacuacugcauggcggucugcaaggccaugaucccgcccacgccccuccccaccaacgacguggacgucuacuucgagaccuccgccgacgacaacgagcacgcccgguuccagaaggccaaggagcagcuggagauccgccaccggaaccgcauggaccgggugaagaaggagugggaggaggcggagcugcaggccaagaaccuccccaaggccgagcgccagacccugauccagcacuuccaggccauggugaaggcgcuggagaaggaggccgccagcgagaagcagcagcucgucgagacccaccuggcccggguggaggccaugcugaacgaccgccggcgcauggcgcucgagaacuaccuggccgcccugcaguccgacccgccccggccccaccgcauccuccaggcccugcgccgguacgugcgcgccgagaacaaggaccggcugcacaccauccgccacuaccagcacguccucgcgguggaccccgagaaggccgcccagaugaagucccaggugaugacccaccuccacgucaucgaggagcggcgcaaccagagccugagccugcuguacaaggugcccuacguggcccaggagauccaggaggagaucgacgagcugcuccaggagcagcgggccgacauggaccaguucacggcguccaucagcgagacccccgucgacgugcgcgugagcuccgaggagagcgaggagaucccgcccuuccaccccuuccaccccuucccggcccugcccgagaacgagggcuccggcgucggggagcaggacggcgggcugaucggcgccgaggagaaggugaucaacagcaagaacaagguggacgagaacauggucaucgacgagacccucgacgugaaggagaugaucuucaacgccgagcgggucgggggccuggaggaggagcgcgaguccgugggcccccugcgggaggacuucagccucuccagcuccgcgcugaucgggcugcuggugaucgccguggccaucgccaccgucaucgugaucagccucgugaugcugcgcaagcggcaguacggcacgaucucccacgggaucgucgagguggacccgaugcugacccccgaggagcgccaccucaacaagaugcagaaccacggcuacgagaaccccaccuacaaguaccuggagcagaugcagaucuga

SEQ ID NO: 26752 - RNA, 867 nt, Artificial Sequence
  derived and/or modified sequence opt1 from APOA1BP__Homo_sapiens__NP_658985
augagccgccugcgggcccuccugggccuggggcuccugguggccggcucccgcgucccccggaucaagagccagaccaucgcgugccgcuccgggcccaccugguggggcccccagcggcugaacagcgggggccgcugggacuccgaggugauggccagcacgguggucaaguaccucucccaggaggaggcccaggccguggaccaggagcuguucaacgaguaccaguucagcguggaccagcugauggagcucgccggccuguccugcgcgaccgccaucgccaaggccuacccgcccaccagcaugucccggagcccgcccaccguccuggugaucugcgggcccggcaacaacgggggcgacgggcucgugugcgcgcgccaccugaagcuguucggcuacgagcccacgaucuacuaccccaagcggcccaacaagccccucuucaccgcccuggucacccagugccagaagauggacauccccuuccugggcgagaugccggccgagcccaugaccaucgacgagcucuacgagcuggugguggacgccaucuucggguucuccuucaagggcgacguccgcgagcccuuccacagcauccuguccgugcucaaggggcugacggugcccaucgccagcaucgacaucccguccggcugggacgucgagaagggcaacgccgggggcauccagcccgaccugcucaucagccugaccgcgcccaagaaguccgccacccaguucaccgggcgguaccacuaccugggcgggcgcuucgugcccccggcccucgagaagaaguaccagcugaaccugccgcccuaccccgacacggagugcguguaccggcuccaguga

SEQ ID NO: 26753 - RNA, 303 nt, Artificial Sequence
  derived and/or modified sequence opt1 from APOA2__Homo_sapiens__NP_001634
augaagcugcucgccgccaccgugcugcugcucaccaucugcagccuggagggcgcgcugguccgccggcaggccaaggagcccugcguggagucccucgugagccaguacuuccagacggucaccgacuacgggaaggaccugauggagaaggugaaguccccggagcugcaggccgaggccaagagcuacuucgagaaguccaaggagcagcucacgccccugaucaagaaggccggcaccgagcuggugaacuuccucagcuacuucgucgagcuggggacccagcccgcgacccaguga

SEQ ID NO: 26754 - RNA, 1191 nt, Artificial Sequence
  derived and/or modified sequence opt1 from APOA4__Homo_sapiens__NP_000473
auguuccugaaggccgugguccucacccuggcccugguggcgguggccggcgcccgcgccgaggucagcgccgaccagguggcgaccgugaugugggacuacuucucccagcucagcaacaacgccaaggaggccgucgagcaccuccagaaguccgagcugacgcagcagcugaacgcccuguuccaggacaagcugggggaggugaacaccuacgcgggcgaccuccagaagaagcuggugcccuucgccaccgagcugcacgagcggcucgccaaggacagcgagaagcugaaggaggagaucgggaaggagcuggaggagcuccgcgcccggcugcugccgcacgccaacgaggucucccagaagaucggcgacaaccuccgcgagcugcagcagcggcuggagcccuacgcggaccagcuccgcacccaggugagcacgcaggccgagcagcugcggcgccagcugacccccuacgcccagcggauggagcgcgugcuccgggagaacgccgacucccugcaggccagccugcgcccccacgcggacgagcucaaggccaagaucgaccagaacgucgaggagcugaaggggcggcugaccccguacgccgacgaguucaaggugaagaucgaccagaccguggaggagcuccgccggucccuggcccccuacgcccaggacacgcaggagaagcugaaccaccagcucgagggccugaccuuccagaugaagaagaacgcggaggagcugaaggcccgcaucagcgccuccgccgaggagcuccggcagcgccuggcgccccuggccgaggacguccggggcaaccuccgcgggaacaccgagggccugcagaagucccuggccgagcucgggggccaccuggaccagcaggucgaggaguuccggcgccgcguggagcccuacggggagaacuucaacaaggcccuggugcagcagauggagcagcuccggcagaagcugggcccgcacgccggcgacguggaggggcaccugagcuuccucgagaaggaccugcgcgacaaggugaacagcuucuucuccaccuucaaggagaaggagagccaggacaagacgcugucccugcccgagcucgagcagcagcaggagcagcagcaggagcagcagcaggagcagguccagaugcuggcgccccuggagagcuga

SEQ ID NO: 26755 - RNA, 1101 nt, Artificial Sequence
  derived and/or modified sequence opt1 from APOA5__Homo_sapiens__NP_001160070
auggccagcauggccgcggugcugaccugggcccucgcccugcuguccgccuucagcgccacccaggcgcgcaagggcuucugggacuacuucucccagacgagcggggacaagggccgggucgagcagauccaccagcagaagauggcccgcgagcccgccacccucaaggacucccuggagcaggaccugaacaacaugaacaaguuccucgagaagcugcggccgcugagcggguccgaggcgccccgccucccccaggaccccgugggcaugcggcgccagcugcaggaggagcuggaggaggugaaggcccggcuccagccguacauggccgaggcccacgagcuggucggguggaaccuggagggccuccgccagcagcugaagcccuacaccauggaccugauggagcaggucgcccuccgggugcaggagcugcaggagcagcugcgcguggugggcgaggacaccaaggcccagcuccucgggggcguggacgaggcgugggcccugcugcaggggcugcagagccgggucgugcaccacacgggccgcuucaaggagcuguuccaccccuacgccgagucccucgugagcgggaucggccggcacguccaggagcugcaccgcuccguggcgccccacgccccggccagccccgcccggcugucccgcugcgugcagguccucagccggaagcugacccugaaggccaaggcccuccacgcccgcauccagcagaaccuggaccagcugcgggaggagcucucccgcgcguucgccggcaccgggaccgaggagggcgccgggcccgacccccagaugcugagcgaggaggugcggcagcgccugcaggccuuccgccaggacacguaccuccagaucgccgcguucacccgggccaucgaccaggagaccgaggaggugcagcagcagcuggccccgcccccgcccggccacuccgccuucgcgcccgaguuccagcagaccgacagcggcaagguccuguccaagcuccaggcccgccuggacgaccugugggaggacaucacgcacagccuccacgaccaggggcacagccaccugggcgaccccuga

SEQ ID NO: 26756 - RNA, 711 nt, Artificial Sequence
  derived and/or modified sequence opt1 from APOBEC1__Homo_sapiens__NP_001291495
augaccagcgagaagggccccuccaccggggaccccacgcugcgccggcgcaucgagcccugggaguucgacguguucuacgacccccgggagcuccgcaaggaggccugccugcuguacgagaucaaguggggcaugagccggaagaucuggcgcuccagcgggaagaacaccaccaaccacgucgaggugaacuucaucaagaaguucaccuccgagcgggacuuccaccccagcauguccugcagcaucacgugguuccucuccuggagccccugcugggagugcucccaggccauccgcgaguuccugagccggcaccccggcgugacccuggucaucuacguggcgcgccucuucuggcacauggaccagcagaaccggcaggggcugcgcgaccuggugaacuccggcgucaccauccagaucaugcgggccagcgaguacuaccacugcuggcgcaacuucgugaacuacccgcccggcgacgaggcccacuggccccaguacccgccccucuggaugaugcuguacgcccuggagcuccacugcaucauccugucccugccgcccugccucaagaucagccggcgcuggcagaaccaccugaccuucuuccggcugcaccuccagaacugccacuaccagacgaucccgccccacauccugcuggccaccgggcucauccaccccuccguggcguggcgcuga

SEQ ID NO: 26757 - RNA, 675 nt, Artificial Sequence
  derived and/or modified sequence opt1 from APOBEC2__Homo_sapiens__NP_006780
auggcccagaaggaggaggccgcgguggccaccgaggccgccagccagaacggcgaggaccuggagaaccucgacgaccccgagaagcugaaggagcugaucgagcucccgcccuucgagaucgucaccggggagcgccugcccgccaacuucuucaaguuccaguuccggaacguggaguacuccagcggccgcaacaagacguuccugugcuacguggucgaggcgcaggggaagggcggccaggugcaggccucccggggguaccucgaggacgagcacgccgccgcgcacgccgaggaggccuucuucaacaccauccugcccgccuucgacccggcccugcgcuacaacgugaccugguacgucagcuccagccccugcgcggccugcgccgaccggaucaucaagacccucuccaagacgaagaaccugcgccugcucauccuggugggccggcuguucaugugggaggagcccgagauccaggccgcccucaagaagcugaaggaggcggggugcaagcugcgcaucaugaagccccaggacuucgaguacguguggcagaacuucgucgagcaggaggagggcgagagcaaggccuuccagccgugggaggacauccaggagaacuuccucuacuacgaggagaagcuggccgacauccugaaguga

SEQ ID NO: 26758 - RNA, 600 nt, Artificial Sequence
  derived and/or modified sequence opt1 from APOBEC3A_B__Homo_sapiens__XP_011545347
auggaggccagccccgccuccggcccgcgccaccugauggacccccacaucuucaccagcaacuucaacaacgggaucggccggcacaagaccuaccucugcuacgagguggagcgccuggacaacgggacguccgucaagauggaccagcaccggggcuuccugcacaaccaggcgaagaaccuccugugcggguucuacggccgccacgccgagcugcgguuccucgaccuggugcccagccugcagcucgaccccgcccagaucuaccgcgugaccugguucaucuccuggagcccgugcuucuccuggggcugcgccggggagguccgggccuuccugcaggagaacacccacgugcgccugcggaucuucgcggcccgcaucuacgacuacgacccccucuacaaggaggcccugcagaugcugcgggacgccggcgcccaggugagcaucaugaccuacgacgaguucaagcacugcugggacacguucgucgaccaccaggggugccccuuccagcccugggacggccucgacgagcacucccaggcgcugagcgggcgccugcgggccauccuccagaaccagggcaacuga

SEQ ID NO: 26759 - RNA, 1074 nt, Artificial Sequence
  derived and/or modified sequence opt1 from APOBEC3B__Homo_sapiens__NP_001257340
augaacccccagauccgcaacccgauggagcggauguaccgcgacaccuucuacgacaacuucgagaacgagcccauccuguacggccggagcuacaccuggcucugcuacgaggugaagaucaagcgcgggcgguccaaccugcugugggacacgggcgucuuccgcggccagguguacuucaagccccaguaccacgccgagaugugcuuccucagcugguucugcgggaaccagcugcccgccuacaagugcuuccagaucaccugguucguguccuggaccccgugccccgacugcgucgcgaagcuggccgaguuccucagcgagcaccccaacgugacccugacgaucuccgccgcccggcuguacuacuacugggagcgcgacuaccggcgcgcccucugccggcugagccaggcgggggcccgcgugaagaucauggacuacgaggaguucgccuacugcugggagaacuucgucuacaacgagggccagcaguucaugcccugguacaaguucgacgagaacuacgccuuccugcaccggacccucaaggagauccugcgcuaccugauggacccggacaccuucaccuucaacuucaacaacgacccccucgugcugcggcgccggcagacguaccugugcuacgagguggagcgccucgacaacggcaccuggguccugauggaccagcacaugggguuccugugcaacgagcucgaccccgcgcagaucuaccgggugaccugguucaucuccuggagccccugcuucuccuggggcugcgccggggaggugcgcgccuuccugcaggagaacacccacguccggcugcgcaucuucgccgcccgcaucuacgacuacgacccgcucuacaaggaggcgcugcagaugcugcgggacgccggcgcccaggugagcaucaugacguacgacgaguucgaguacugcugggacaccuucguguaccgccaggggugccccuuccagcccugggacggccucgaggagcacucccaggcccugagcggccggcugcgcgccauccuccagaaccaggggaacuga

SEQ ID NO: 26760 - RNA, 573 nt, Artificial Sequence
  derived and/or modified sequence opt1 from APOBEC3C__Homo_sapiens__NP_055323
augaacccccagauccgcaacccgaugaaggccauguaccccggcaccuucuacuuccaguucaagaaccugugggaggccaacgaccggaacgagaccuggcucugcuucacgguggaggggaucaagcgccggagcgucguguccuggaagaccggcguguuccgcaaccaggucgacagcgagacccacugccacgcggagcggugcuuccuguccugguucugcgacgacauccugagccccaacaccaaguaccaggugacgugguacaccuccuggagccccugcccggacugcgccggggagguggccgaguuccucgcccgccacuccaacgucaaccugaccaucuucaccgcccggcuguacuacuuccaguaccccugcuaccaggagggccuccgcagccugucccaggaggggguggcgguggagaucauggacuacgaggacuucaaguacugcugggagaacuucgucuacaacgacaacgagcccuucaagcccuggaagggccugaagacgaacuuccggcuccugaagcgccggcugcgcgagagccuccaguga

SEQ ID NO: 26761 - RNA, 306 nt, Artificial Sequence
  derived and/or modified sequence opt1 from APOBEC3F__Homo_sapiens__NP_001006667
augaagccccacuuccgcaacaccguggagcggauguaccgcgacaccuucagcuacaacuucuacaaccggcccauccugucccgccggaacacggucuggcucugcuacgaggugaagaccaagggccccagccgcccccggcuggacgccaagaucuuccgcggccaggugccccgguccuucauccgcgccccguuccagguccugagcucccccuucgggcagugcgcgccgccccacgggaccgcccaggugcaguggccgccccagcucaccgccggccgggagcaggggcgccccuga

SEQ ID NO: 26762 - RNA, 1155 nt, Artificial Sequence
  derived and/or modified sequence opt1 from APOBEC3G__Homo_sapiens__NP_068594
augaagccccacuuccgcaacaccguggagcggauguaccgcgacaccuucagcuacaacuucuacaaccggccgauccugucccgccggaacacggucuggcucugcuacgaggugaagaccaagggccccagccgcccgccccuggacgccaagaucuuccggggccagguguacuccgagcugaaguaccaccccgagaugcgcuucuuccacugguucagcaaguggcggaagcuccaccgcgaccaggaguacgaggucaccugguacaucuccuggagccccugcaccaagugcacgcgggacauggccaccuuccuggcggaggaccccaaggugacccugaccaucuucguggcccgccucuacuacuucugggaccccgacuaccaggaggcccugcggucccugugccagaagcgcgacgggccgcgggccacgaugaagaucaugaacuacgacgaguuccagcacugcuggagcaaguucgucuacucccagcgcgagcuguucgagcccuggaacaaccuccccaaguacuacauccugcuccacaucaugcugggggagauccugcggcacagcauggacccgcccaccuucaccuucaacuucaacaacgagcccugggugcgcggccggcacgagaccuaccucugcuacgagguggagcgcaugcacaacgacacguggguccugcugaaccagcggcgcggguuccucugcaaccaggcgccccacaagcacggcuuccuggagggccgccacgccgagcugugcuuccucgacgugauccccuucuggaagcuggaccuggaccaggacuaccgggugaccugcuucaccuccuggagcccgugcuucuccugcgcccaggagauggccaaguucaucagcaagaacaagcacgucucccucugcaucuucaccgcccgcaucuacgacgaccaggggcggugccaggagggccugcgcacgcuggcggaggccggggccaagaucagcaucaugaccuacuccgaguucaagcacugcugggacaccuucguggaccaccagggcugccccuuccagcccugggacgggcucgacgagcacagccaggaccuguccggccggcugcgcgccauccuccagaaccaggagaacuga

SEQ ID NO: 26763 - RNA, 549 nt, Artificial Sequence
  derived and/or modified sequence opt1 from APOBEC3H__Homo_sapiens__NP_001159474
auggcccugcucaccgccgagaccuuccgccugcaguucaacaacaagcggcgccugcggcgccccuacuacccgcggaaggcgcuccugugcuaccagcugacgccccagaacggcagcacccccacccgcggguacuucgagaacaagaagaagugccacgccgagaucugcuucaucaacgagaucaaguccaugggccucgacgagacccagugcuaccaggugacgugcuaccugaccuggagccccugcuccagcugcgccugggagcuggucgacuucaucaaggcccacgaccaccucaaccuggggaucuucgccucccggcuguacuaccacuggugcaagccgcagcagaagggccuccgccugcugugcgggagccaggugcccguggaggucaugggcuuccccgaguucgcggacugcugggagaacuucguggaccacgagaagccccucuccuucaacccguacaagaugcuggaggagcuggacaagaacagccgggccaucaagcgccggcucgagcgcaucaaguccuga

SEQ ID NO: 26764 - RNA, 13692 nt, Artificial Sequence
  derived and/or modified sequence opt1 from APOB__Homo_sapiens__NP_000375
auggacccgccccgccccgcccugcucgcccugcuggcgcugcccgcccugcugcugcugcugcuggccggcgcccgggccgaggaggagaugcuggagaacgugagccuggugugccccaaggacgcgacccgcuucaagcaccuccggaaguacaccuacaacuacgaggccgagagcagcuccggggugcccggcaccgccgacagccgcuccgccacccggaucaacugcaagguggagcuggaggugccccagcugugcagcuucauccugaagaccucccagugcacccugaaggagguguacggguucaaccccgagggcaaggcgcugcugaagaagacgaagaacagcgaggaguucgccgccgccaugucccgcuacgagcugaagcuggccauccccgaggggaagcaggucuuccuguacccggagaaggacgagcccaccuacauccugaacaucaagcggggcaucaucagcgcgcugcuggugccgcccgagaccgaggaggccaagcagguccuguuccuggacaccguguacggcaacugcuccacgcacuucaccgugaagacccgcaaggggaacguggccaccgagaucagcacggagcgggaccugggccagugcgaccgcuucaagccgauccggaccgggaucagcccccuggcccugaucaagggcaugacccgcccccucagcacccugaucuccagcucccagagcugccaguacacgcuggacgccaagcggaagcacguggcggaggccaucugcaaggagcagcaccucuuccugcccuucuccuacaagaacaaguacgggaugguggcccaggugacccagacccugaagcucgaggacaccccgaagaucaacagccgcuucuucggcgagggcacgaagaagauggggcuggccuucgagagcaccaaguccaccuccccgcccaagcaggccgaggcggugcugaagacccuccaggagcugaagaagcugacgaucuccgagcagaacauccagcgggccaaccucuucaacaagcuggugaccgagcugcgcggccucagcgacgaggccgugaccucccugcugccccagcucaucgaggugagcuccccgaucacccugcaggcccugguccagugcgggcagccccagugcagcacgcacauccugcaguggcucaagcgggugcacgccaacccccugcugaucgacguggucaccuaccucguggcgcugauccccgagccguccgcccagcagcugcgcgagaucuucaacauggcccgggaccagcgcagccgggccacccucuacgcgcugucccacgccgugaacaacuaccacaagaccaaccccacgggcacccaggagcugcucgacaucgccaacuaccugauggagcagauccaggacgacugcaccggcgacgaggacuacaccuaccugauccuccgcgucaucgggaacaugggccagacgauggagcagcugacccccgagcucaaguccuccauccucaagugcgugcagagcaccaagcccucccugaugauccagaaggccgccauccaggcgcugcgcaagauggagccgaaggacaaggaccaggagguccuccugcagaccuuccuggacgacgccagccccggggacaagcggcucgccgccuaccugaugcugaugcgcucccccagccaggccgacaucaacaagaucgugcagauccucccgugggagcagaacgagcaggucaagaacuucgucgcgucccacaucgccaacauccugaacagcgaggagcuggacauccaggaccucaagaagcuggugaaggaggcccugaaggagagccagcuccccaccgugauggacuuccggaaguucucccgcaacuaccagcuguacaagagcgucucccugcccagccucgaccccgccuccgccaagaucgagggcaaccugaucuucgacccgaacaacuaccugcccaaggagagcaugcucaagacgacccugaccgcguucggguucgccuccgccgaccugaucgagaucggccucgagggcaagggguucgagcccacccuggaggcccuguucggcaagcagggguucuuccccgacagcgugaacaaggcgcucuacugggugaacggccaggucccggacgggguguccaaggugcuggucgaccacuucggcuacacgaaggacgacaagcacgagcaggacauggugaacggcaucaugcugagcguggagaagcucaucaaggaccugaaguccaaggagguccccgaggcccgggccuaccugcgcauccucggggaggagcugggcuucgccagccugcacgaccuccagcugcuggggaagcuccugcugaugggcgcccggacccuccaggggaucccccagaugaucggcgaggugauccgcaagggcuccaagaacgacuucuuccugcacuacaucuucauggagaacgcguucgagcugcccaccggggccggccuccagcugcagaucagcuccagcggggugaucgccccgggcgccaaggccggcgucaagcuggagguggcgaacaugcaggccgagcucguggccaagcccuccgucagcguggaguucgugaccaacauggggaucaucauccccgacuucgcccggagcggcguccagaugaacacgaacuucuuccacgaguccgggcuggaggcccacguggcgcugaaggccggcaagcucaaguucaucauccccagcccgaagcgccccgugaagcugcuguccgggggcaacacccuccaccuggucagcaccaccaagacggaggugaucccgccccugaucgagaaccggcaguccuggagcgugugcaagcaggucuuccccggccucaacuacugcaccuccggggccuacagcaacgccuccagcaccgacuccgcgagcuacuacccccugaccggcgacacgcgccuggagcucgagcugcggcccaccggggagaucgagcaguacuccgugagcgccaccuacgagcugcagcgcgaggaccgggcccucguggacacccugaaguucgucacgcaggccgagggcgccaagcagaccgaggcgaccaugaccuucaaguacaaccgccaguccaugacgcugagcuccgaggugcagauccccgacuucgacguggaccucgggaccauccugcgggucaacgacgagagcaccgagggcaagaccuccuaccgccugacgcucgacauccagaacaagaagaucaccgagguggcccugaugggccaccugagcugcgacaccaaggaggagcggaagaucaagggggugaucagcaucccgcgccuccaggccgaggcccgcuccgagauccuggcccacuggagccccgcgaagcugcuccugcagauggacuccagcgccaccgccuacggcuccacggucagcaagcggguggccuggcacuacgacgaggagaagaucgaguucgaguggaacaccgggaccaacguggacaccaagaagaugacguccaacuuccccgucgaccugagcgacuacccgaagucccuccacauguacgccaaccgccugcuggaccaccgggugccccagaccgacaugaccuuccgccacgugggcagcaagcugaucgucgcgauguccagcuggcuccagaaggccuccgggagccugcccuacacccagacccugcaggaccaccucaacucccugaaggaguucaaccugcagaacaugggccuccccgacuuccacaucccggagaaccuguuccucaagagcgacggccgggugaaguacacgcucaacaagaacucccugaagaucgagaucccccugcccuucgggggcaagagcucccgcgaccucaagaugcuggagaccgugcggacccccgcccugcacuucaagagcgucggguuccaccucccgagccgcgaguuccaggugcccaccuucacgauccccaagcuguaccagcuccaggugccccuccugggcguccuggaccucuccaccaacguguacagcaaccuguacaacugguccgccagcuacuccgggggcaacaccagcaccgaccacuucucccugcgggcccgcuaccacaugaaggcggacagcgucguggaccuccuguccuacaacgugcagggcagcggggagacgaccuacgaccacaagaacaccuucacccuguccugcgacggcagccuccggcacaaguuccuggacuccaacaucaaguucagccacgucgagaagcuggggaacaacccgguguccaagggccuccugaucuucgacgccagcuccagcuggggcccccagauguccgccagcgugcaccuggacagcaagaagaagcagcaccucuucgucaaggaggugaagaucgacgggcaguuccgcguguccagcuucuacgccaagggcacguacgggcuguccugccagcgggaccccaacaccggccgccugaacggggagagcaaccuccgguucaacuccagcuaccugcagggcaccaaccagaucaccggccgcuacgaggacgggacgcugucccucaccagcaccuccgaccugcagagcggcaucaucaagaacaccgcgucccugaaguacgagaacuacgagcucacgcucaagagcgacaccaacgggaaguacaagaacuucgccaccuccaacaagauggacaugaccuucagcaagcagaacgcccugcuccgguccgaguaccaggccgacuacgagagccugcgcuucuucucccugcucagcggcucccugaacagccacgggcuggagcucaacgccgacauccugggcacggacaagaucaacagcggcgcgcacaaggccacccugcggaucgggcaggacggcaucuccaccagcgccaccacgaaccucaagugcucccugcugguccucgagaacgagcugaacgccgagcuggggcucagcggcgccuccaugaagcugaccaccaacgggcgcuuccgggagcacaacgcgaaguucagccuggacggcaaggccgcccucaccgagcugucccugggcagcgccuaccaggccaugauccucgggguggacuccaagaacaucuucaacuucaaggugagccaggagggccugaagcuguccaacgacaugauggggagcuacgcggagaugaaguucgaccacacgaacucccucaacaucgccggccugagccuggacuucuccagcaagcucgacaacaucuacuccagcgacaaguucuacaagcagaccgucaaccugcagcugcagcccuacucccucgugaccacccugaacagcgaccugaaguacaacgcccucgaccugacgaacaacggcaagcugcgccucgagccgcugaagcugcacguggccgggaaccucaagggcgcguaccagaacaacgagaucaagcacaucuacgccaucagcuccgccgcccugagcgccuccuacaaggcggacaccgucgccaaggugcaggggguggaguucagccaccgccugaacaccgacaucgccggccucgccuccgccaucgacaugagcaccaacuacaacuccgacagccugcacuucuccaacgucuuccggagcgugauggcgcccuucaccaugacgaucgacgcccacaccaacgggaacggcaagcuggcccucuggggcgagcacaccgggcagcuguacuccaaguuccugcucaaggccgagccccuggccuucaccuucagccacgacuacaagggcuccacgagccaccaccuggugucccgcaagagcaucuccgcggcccucgagcacaaggucagcgcccugcugacccccgccgagcagaccgggaccuggaagcucaagacgcaguucaacaacaacgaguacagccaggaccuggacgcguacaacaccaaggacaagaucggcguggagcugaccgggcggacccuggccgaccucacgcugcuggacuccccgaucaaggugccccuccugcugagcgagcccaucaacaucaucgacgcccucgagaugcgcgacgccgucgagaagccccaggaguucaccaucguggccuucgugaaguacgacaagaaccaggacguccacuccaucaaccugccguucuucgagacccugcaggaguacuucgagcggaaccgccagaccaucaucguggugcucgagaacguccagcggaaccugaagcacaucaacaucgaccaguucgugcgcaaguaccgggcggcccugggcaagcucccccagcaggccaacgacuaccugaacagcuucaacugggagcgccaggugucccacgccaaggagaagcugacggcccucaccaagaaguaccggaucaccgagaacgacauccagaucgcgcuggacgacgccaagaucaacuucaacgagaagcugagccagcuccagaccuacaugauccaguucgaccaguacaucaaggacuccuacgaccugcacgaccugaagaucgccaucgccaacaucaucgacgagaucaucgagaagcucaagagccuggacgagcacuaccacauccgcgucaaccuggugaagacgauccacgaccuccaccuguucaucgagaacaucgacuucaacaaguccggcagcuccaccgccagcuggauccagaacguggacaccaaguaccagauccggauccagauccaggagaagcugcagcagcucaagcgccacauccagaacaucgacauccagcaccuggcggggaagcugaagcagcacaucgaggccaucgacguccgggugcuccuggaccagcugggcaccacgaucuccuucgagcgcaucaacgacgugcucgagcacgucaagcacuucgugaucaaccugaucggggacuucgagguggccgagaagaucaacgccuuccgggccaagguccacgagcugaucgagcgcuacgagguggaccagcagauccaggugcucauggacaagcuggucgagcuggcgcaccaguacaagcucaaggagaccauccagaagcugagcaacgugcugcagcaggucaagaucaaggacuacuucgagaagcucgucggcuucaucgacgacgccgugaagaagcugaacgagcuguccuucaagaccuucaucgaggacgugaacaaguuccucgacaugcugaucaagaagcucaagagcuucgacuaccaccaguucgucgacgagaccaacgacaagauccgggaggugacgcagcgccucaacggggagauccaggcccuggagcugccccagaaggccgaggcgcucaagcuguuccuggaggagaccaaggccaccgucgccguguaccucgagucccugcaggacaccaagaucacgcugaucaucaacuggcuccaggaggcccugagcuccgccagccuggcgcacaugaaggccaaguuccgcgagacccucgaggacacccgggaccgcauguaccagauggacauccagcaggagcugcagcgguaccugagccucgugggccaggucuacuccacccuggugacguacaucagcgacugguggacccuggccgccaagaaccucaccgacuucgccgagcaguacuccauccaggacugggcgaagcgcaugaaggcccugguggagcagggcuucaccguccccgagaucaagacgauccuggggaccaugccggccuucgaggugagccuccaggcccugcagaaggccaccuuccagacccccgacuucaucgugccccugaccgaccuccggaucccguccguccagaucaacuucaaggaccugaagaacaucaagauccccagccgcuucuccacgcccgaguucaccauccugaacaccuuccacauccccagcuucaccaucgacuucguggagaugaaggugaagaucauccggacgaucgaccagaugcucaacuccgagcugcaguggccgguccccgacaucuaccugcgcgaccucaagguggaggacaucccccuggcgcggaucacccugcccgacuuccgccucccggagaucgccauccccgaguucaucauccccacccugaaccugaacgacuuccaggugcccgaccuccacaucccggaguuccagcugccccacaucagccacaccaucgagguccccacguucggcaagcuguacuccauccucaagauccagagcccccuguucacccuggacgccaacgccgacaucgggaacggcaccaccuccgcgaacgaggccgggaucgccgccagcaucacggccaagggcgaguccaagcucgaggugcugaacuucgacuuccaggcgaacgcccagcugagcaacccgaagaucaacccccucgcccugaaggaguccgugaaguucagcuccaaguaccugcggaccgagcacggcagcgagaugcuguucuucgggaacgccaucgagggcaagagcaacaccgucgccucccugcacaccgagaagaacacgcuggagcugagcaacggggugaucgugaagaucaacaaccagcucacccuggacuccaacaccaaguacuuccacaagcugaacauccccaagcucgacuucagcucccaggcggaccugcgcaacgagaucaagacccugcucaaggccggccacaucgccuggacgagcuccggcaaggggagcuggaagugggccugcccccgguucuccgacgagggcacccacgagagccagaucuccuucaccaucgaggggccgcugaccagcuucggccuguccaacaagaucaacagcaagcaccuccgcgucaaccagaaccugguguacgaguccgggagccugaacuucuccaagcucgagauccagagccagguggacucccagcacgucggccacagcgugcugacggccaagggcauggcgcuguucggggagggcaaggccgaguucaccgggcggcacgacgcccaccucaacggcaaggugaucgggacccugaagaacagccuguucuucuccgcccagcccuucgagaucaccgcgagcacgaacaacgagggcaaccucaagguccgcuucccccugcggcugaccggcaagaucgacuuccucaacaacuacgcccuguuccugucccccagcgcccagcaggccuccuggcaggucagcgcccgcuucaaccaguacaaguacaaccagaacuucuccgcggggaacaacgagaacaucauggaggcccacgugggcaucaacggggaggccaaccucgacuuccugaacaucccgcugaccauccccgagaugcggcuccccuacaccaucaucacgacgccgccccugaaggacuucagccugugggagaagaccggccucaaggaguuccugaagaccacgaagcaguccuucgaccugagcgucaaggcccaguacaagaagaacaagcaccgccacuccaucaccaacccccucgccgugcugugcgaguucaucagccaguccaucaagagcuucgaccggcacuucgagaagaaccgcaacaacgcgcuggacuucgugaccaaguccuacaacgagaccaagaucaaguucgacaaguacaaggccgagaagucccacgacgagcucccccgcaccuuccagauccccggguacacgguccccguggugaacgucgaggugucccccuucaccaucgagaugagcgccuucggcuacguguuccccaaggccgucuccaugccgagcuucagcauccugggcuccgacgugcgggugcccagcuacacccugauccuccccucccuggagcugcccguccuccacgugccgcgcaaccugaagcugagccuccccgacuucaaggagcugugcaccaucucccacaucuucauccccgccauggggaacaucacguacgacuucagcuucaaguccagcgugaucacccugaacaccaacgcggagcuguucaaccaguccgacaucgucgcccaccuccugagcuccagcuccagcgugaucgacgcccuccaguacaagcuggagggcaccacgcggcugacccgcaagcgggggcucaagcuggccaccgcccugucccucagcaacaaguucguggagggcucccacaacagcaccgucucccugacgaccaagaacauggaggugagcguggcgaccaccacgaaggcccagauccccauccugcgcaugaacuucaagcaggagcucaacgggaacaccaagagcaagccgaccgucuccagcuccauggaguucaaguacgacuucaacagcuccaugcuguacagcaccgccaagggcgccguggaccacaagcugucccucgagagccugacguccuacuucagcaucgaguccagcaccaagggcgacgucaagggguccgugcugagccgggaguacuccggcaccaucgcgagcgaggccaacaccuaccucaacuccaagagcacgcgcagcuccgugaagcugcaggggaccagcaagaucgacgacaucuggaaccuggaggucaaggagaacuucgccggcgaggccacccuccagcggaucuacucccugugggagcacagcaccaagaaccaccuccagcucgagggccuguucuucacgaacggggagcacaccuccaaggccacccuggagcucagccccuggcagauguccgcgcugguccaggugcacgccagccagcccuccagcuuccacgacuuccccgaccugggccaggaggucgcccucaacgccaacaccaagaaccagaagauccgcuggaagaacgaggugcggauccacuccgggagcuuccagucccagguggagcugagcaacgaccaggagaaggcccaccuggacaucgcgggcucccucgaggggcaccuccgcuuccugaagaacaucauccucccggucuacgacaagagccugugggacuuccugaagcucgacgugacgaccuccaucggccggcgccagcaccuccgggugagcaccgccuucgucuacaccaagaaccccaacggcuacuccuucagcauccccgugaaggugcuggccgacaaguucaucauccccgggcucaagcugaacgaccugaacagcguccucgugaugccgacguuccacgugcccuucaccgaccugcagguccccuccugcaagcuggacuuccgcgagauccagaucuacaagaagcugcggaccagcuccuucgcccucaaccugcccacccugccggaggugaaguuccccgagguggacguccucaccaaguacagccagcccgaggacucccugaucccguucuucgagaucacggugcccgagagccagcugaccgugucccaguucacccuccccaagagcgucuccgacggcaucgccgcgcuggaccugaacgccguggccaacaagaucgccgacuucgagcuccccaccaucaucgugccggagcagacgaucgagauccccagcaucaaguucuccguccccgcggggaucgugauccccagcuuccaggcccugaccgcccgcuucgagguggacuccccggucuacaacgccaccuggagcgccucccugaagaacaaggcggacuacguggagaccgugcucgacagcacgugcuccagcaccguccaguuccuggaguacgagcugaacgugcucggcacccacaagaucgaggacgggacccuggccuccaagacgaagggcaccuucgcccaccgggacuucagcgccgaguacgaggaggacggcaaguacgaggggcugcaggagugggagggcaaggcccaccucaacaucaagagccccgcguucaccgaccugcaccuccgcuaccagaaggacaagaaggggaucuccaccagcgccgccucccccgccgugggcacggucgggauggacauggacgaggacgacgacuucagcaaguggaacuucuacuacagcccccagagcuccccggacaagaagcucaccaucuucaagaccgagcugcgcgugcgggagagcgacgaggagacccagaucaaggugaacugggaggaggaggccgcguccggccugcucacgagccugaaggacaacguccccaaggccaccggcgugcuguacgacuacgugaacaaguaccacugggagcacaccgggcucacccugcgcgaggucuccagcaagcugcggcgcaaccuccagaacaacgccgaguggguguaccagggcgccauccggcagaucgacgacaucgacgugcgcuuccagaaggccgcguccgggacgaccggcaccuaccaggaguggaaggacaaggcccagaaccuguaccaggagcugcucacccaggagggccaggccagcuuccaggggcugaaggacaacgucuucgacggccuggugcgggugacgcaggaguuccacaugaaggucaagcaccucaucgacucccugaucgacuuccugaacuucccccgcuuccaguuccccgggaagccgggcaucuacacccgggaggagcucugcaccauguucauccgcgagguggggaccgugcugagccaggucuacuccaaggugcacaacggcagcgagauccuguucuccuacuuccaggaccucgucaucacgcugcccuucgagcugcggaagcacaagcucaucgacgugaucagcauguaccgcgagcugcugaaggaccucagcaaggaggcccaggagguguucaaggcgauccagucccugaagaccaccgagguccugcggaaccuccaggaccugcugcaguucaucuuccagcucaucgaggacaacaucaagcagcugaaggagaugaaguucaccuaccugaucaacuacauccaggacgagaucaacacgaucuucagcgacuacauccccuacguguucaagcuccugaaggagaaccugugccucaaccugcacaaguucaacgaguucauccagaacgagcugcaggaggccucccaggagcuccagcagauccaccaguacaucauggcccugcgcgaggaguacuucgaccccagcaucgugggcuggaccgucaaguacuacgagcuggaggagaagaucgugucccucaucaagaaccugcugguggcccucaaggacuuccacagcgaguacaucgucuccgccagcaacuucaccucccagcugagcucccagguggagcaguuccugcaccggaacauccaggaguaccucagcauccugaccgacccggacgggaagggcaaggagaagaucgcggagcuguccgccaccgcccaggagaucaucaagagccaggccaucgccacgaagaagaucaucuccgacuaccaccagcaguuccgcuacaagcuccaggacuucagcgaccagcuguccgacuacuacgagaaguucaucgcggagagcaagcggcugaucgaccucuccauccagaacuaccacaccuuccugaucuacaucaccgagcugcucaagaagcugcagagcaccacggugaugaaccccuacaugaagcuggcccccggggagcucaccaucauccuguga

SEQ ID NO: 26765 - RNA, 3294 nt, Artificial Sequence
  derived and/or modified sequence opt1 from APOBR__Homo_sapiens__NP_061160
auggacuuccugcgccucuaccugcccggccugcaccaggcccuccgcggggcccuggacagccugggcaccuucguguccuaccuccugggggacgcggucccgaccguggagcgggaggcccaggccgccgaggagcugggcguggucgccguggggaagacgggcaagaucguggaggaggaggcgcaggaggaccucgagggccugcgggggagccagaacgagggcgccgggcgccugcggggccccggggacgaccgccggcacgaggucggcuccagcgccguggagcagaccuggggcuggggcgacggguccagccacgggucccaggccgagcgccaggacagcggcgcgggcgagaccgccaaggccgcccggugccaggagcccuccgcccaccucgaggcgcgcaagaaguccaaggccgggagcggcgccugccaggaccggagcgggcaggcccaggagcgccaggagucccacgagcaggaggugaaccgggaggagcgccugcggagcugggagcaggaggaggaggaggaggagguccgcgcccgggagcccggcauggcgcgcggggccgaguccgaguggaccuggcacggcgagacggagggcaaggccggggccgugggcccgaaggccgcgggggacaaccgggagauggagcagggcgugcgcgaggccgacgccggggagaccgaggagcccggcgccgagggcgccgggaagggcgaggaggucgugguggucgagaaggcgugcgagagcacccgggccugggggaccuggggccccggggccgagcccgaggacuggggcauccugggccgcgaggaggcccgcacgaccccggggcgggaggaggcgcgcgccauccucgacggcgaggaggcccggaccaucuccgggggcgaggaggccgagaccgccagcggcggggaggaggcggagacggccuccggcggggaggaggccggcaccgccagcgggggcgaggaggccggcaucgcgagcgggggcgaggccgggaccgccuccggcggggaggaggccggcaccgccagcggcggggaggaggcgggcacggccuccgggggcgacgaggccuggaccaccagcgggaaggaggaggccgaccugcugggcgugcgccagaccgaguacggcgcggugcccggggagcggcuccuggaggccacgggcaaggucugggugcuggaggaggagggggacgaggagcgcgaggccgaggugucccccuuccccaagcagccgcagguccucggcaccgagcggaccgaggaggccgccgagagccagaccgcggggcgcgaggccgugggcggccaggaggccggggaguccuucgagggccagguggaccugcgggggaaggaggccgagaugcgccaggaccugggcauccgggccgaccgcgcgcggauggaggagcucguccaggccgaggaggcccaggaggagcgcggcagcucccgggaccccguggccgagcugcccagcgacggggaggccgagggcacggcggaccuggaggccacccccgaggcccgcccggaggaggagcucaccggggaggaguccgaggccgcgcagaccagcugcggccugcugggggucgaguggggcggccucacgcacuccgugaccaaggggcagggccccgagcugaugggcggggcccagacccccaccaagcagcccgaggagcgggaggccggggagguggagcugaugggcguccucgcccugagcaaggaggagcaggagcgcucccuggaggccggcccgcggcacgcggggagcgugaagcccgaggccuccgaggccuuccccggcgccugggagaaccgcacgcgcaaggacauggagcgggggaacacccaggaggacgccgcggacggcgagcagcgcgaggaggaggagaccgccgggggccagacccucgccgccgaggccgagggcgaccgggagagcgagcuguccgaggugcccgaggccgggggcgaggggcugacgacccaggacgcgggcugcggcaccgaggagggggaggccagcgucagcgagaaccaggagcucgacggcuccaccggggccgacgccggcccgugccccagccugggggaggcguacgcccgcgagaccgaggacgaggaggccgaggccgaccggacgucccgccggggcuggcgccugcaggcgguggccgugggccuccccgaccgggaggacgcccagaccgggagcgucgccgccggcaucaugggcggggacguggugccccacaucuccgcggccggggccggcgaggcccuggagggcguccuggggcagggcugggacagcaaggagaaggaggaggccgcggccggggagcacgccggcgggcaggaguucggccucgagggcuccgccgaggaggaggugaccgggcgcggcagccagguggaggccuucgagucccgggagggcgggccguggggcgggcgcgucgaggcggaggagagcgccggcgccgaggacuccugcgggcuggaccccgccggcagccagaccgcgcgggccgaggggaugggcgccaugguggaggccggcgggcugcucgagaaguggacgcugcuggaggaggaggccgugggcuggcaggagcgcgagcagcgggaggacuccgaggggcgcugcggcgacuaccaccccgagggggaggcgccgcggcugcucgacgccgagggccugauggucaccggcgggcgccgggccgaggccaaggagaccgagcccgagagccuggagcacgugcgcggccaggaggagcagcccacccaccaggcccccgcggaggccgccccggaguccgugggggaggccgagacggccgaggcgaugggcagcgcccgcgggggcgccgccaacuccuggagcgaggcgccccuccccggcagccugcuggacgucuccgugccccggagccgcgugcaccucucccggagcuccagccagcgccggucccgcccgagcuuccggcgcacccccgccugggagcagcaggaggagccgcccgcccccaacccgcccgaggaggagcuguccgcccccgagcagcggccccugcagcucgaggagccccuggagcccagcccccugcgccacgacgggaccccgguccccgcccggcgccggccccucggccacggguucggccuggcgcaccccgggaugaugcaggagcugcaggcccgccucggccggccgaagccccaguga

SEQ ID NO: 26766 - RNA, 252 nt, Artificial Sequence
  derived and/or modified sequence opt1 from APOC1__Homo_sapiens__NP_001636
augcgccuguuccucagccugcccgugcuggucguggugcucuccaucguccuggagggcccggcccccgcccaggggacccccgacgugagcuccgcgcuggacaagcucaaggaguucggcaacacccuggaggacaaggcccgggagcugaucagccgcaucaagcaguccgagcucagcgccaagaugcgggagugguucuccgagacguuccagaaggugaaggagaagcugaagaucgacagcuga

SEQ ID NO: 26767 - RNA, 306 nt, Artificial Sequence
  derived and/or modified sequence opt1 from APOC2__Homo_sapiens__NP_000474
augggcacccgccugcuccccgcccuguuccuggugcuccugguccugggguucgaggugcagggcacccagcagccgcagcaggacgagaugcccagccccacguuccucacccaggugaaggagucccugagcuccuacugggagagcgccaagaccgcggcccagaaccuguacgagaagaccuaccuccccgccgucgacgagaagcugcgggaccuguacuccaagagcacggccgccauguccaccuacaccgggaucuucaccgaccaggugcucagcgugcugaagggcgaggaguga

SEQ ID NO: 26768 - RNA, 300 nt, Artificial Sequence
  derived and/or modified sequence opt1 from APOC3__Homo_sapiens__NP_000031
augcagccccgcgugcugcucgucguggcccugcuggcccuccuggcgagcgcccgggccuccgaggccgaggacgccagccugcucuccuucaugcagggcuacaugaagcacgcgaccaagaccgccaaggacgcccugagcuccgugcaggagagccaggucgcccagcaggcgcgcgggugggugacggacggcuucuccagccugaaggacuacugguccaccgugaaggacaaguucagcgaguucugggaccucgacccggagguccggcccaccuccgccguggccgccuga

SEQ ID NO: 26769 - RNA, 384 nt, Artificial Sequence
  derived and/or modified sequence opt1 from APOC4__Homo_sapiens__NP_001637
augagccugcuccgcaaccggcugcaggcccugcccgcccucugccugugcgugcugguccucgcgugcaucggcgccugccagcccgaggcccaggaggggacccuguccccgccgcccaagcugaagaugagccgcuggucccucgugcggggccgcaugaaggagcugcuggagaccguggucaaccggacgcgcgacggguggcagugguucuggagccccuccaccuuccggggcuucaugcagaccuacuacgacgaccaccuccgcgaccuggggccccugaccaaggccugguuccucgagagcaaggacucccugcugaagaagacgcacagccucugcccccggcuggugugcggcgacaaggaccagggcuga

SEQ ID NO: 26770 - RNA, 570 nt, Artificial Sequence
  derived and/or modified sequence opt1 from APOD__Homo_sapiens__NP_001638
auggugaugcugcuccugcugcucagcgcccuggccggccuguucggggcggccgagggccaggccuuccaccucgggaagugccccaacccgcccguccaggagaacuucgacgugaacaaguaccugggccgcugguacgagaucgagaagauccccaccaccuucgagaacgggcggugcauccaggccaacuacucccugauggagaacggcaagaucaaggugcucaaccaggagcugcgcgccgacggcacggucaaccagaucgagggggaggcgacccccgugaaccugaccgagccggccaagcucgaggugaaguucagcugguucaugcccuccgcccccuacuggauccuggccaccgacuacgagaacuacgcgcuggucuacagcugcacgugcaucauccagcuguuccacguggacuucgccuggauccucgcccggaaccccaaccugccgcccgagaccguggacucccucaagaacauccugaccagcaacaacaucgacgucaagaagaugaccgugacggaccaggugaacugccccaagcuguccuga

SEQ ID NO: 26771 - RNA, 1032 nt, Artificial Sequence
  derived and/or modified sequence opt1 from APOE__Homo_sapiens__NP_001289617
augagcuccggcgccagccgcaaguccugggaccccgggaacccguggccgcccgacuggcccaucaccggccggaagaugaaggugcugugggccgcgcuccuggucaccuuccuggccgggugccaggccaagguggagcaggccguggagacggagcccgagcccgagcuccgccagcagaccgaguggcagagcggccagcggugggagcuggcccuggggcgcuucugggacuaccuccgguggguccagacccuguccgagcagguccaggaggagcugcucagcucccaggugacccaggagcugcgcgcgcugauggacgagacgaugaaggagcucaaggccuacaagagcgagcuggaggagcagcugacccccguggccgaggagacccgggcccgccucuccaaggagcugcaggcggcccaggcccggcugggcgccgacauggaggacgugugcggccgccucgugcaguaccgcggggagguccaggccaugcugggccagagcaccgaggagcugcgggugcggcucgcgucccaccuccgcaagcugcggaagcgccugcugcgggacgccgacgaccugcagaagcgccucgccguguaccaggccggggcccgggagggcgcggagcgcgggcugagcgccauccgggagcgccugggcccccucgucgagcagggccgcgugcgggccgccacgguggggucccuggccggccagccgcugcaggagcgcgcgcaggccuggggcgagcggcuccgcgcccggauggaggagauggggagccgcacccgggaccgccuggacgaggucaaggagcaggucgccgaggugcgggccaagcuggaggagcaggcgcagcagauccgccuccaggccgaggccuuccaggcccggcugaaguccugguucgagccccugguggaggacaugcagcgccagugggcgggccucguggagaaggugcaggccgccgucgggaccagcgccgcccccgugcccuccgacaaccacuga

SEQ ID NO: 26772 - RNA, 981 nt, Artificial Sequence
  derived and/or modified sequence opt1 from APOF__Homo_sapiens__NP_001629
augaccggccugugcggguacagcgcccccgacaugcgcggccuccggcugaucaugaucccgguggagcugcuccugugcuaccugcuccugcaccccgucgacgccaccuccuacgggaagcagacgaacgugcugaugcacuucccccucagccuggagucccagacccccagcuccgacccgcugagcugccaguuccuccaccccaagucccugcccggcuucagccacauggcgccccugccgaaguuccucgugucccuggcccugcgcaacgcccucgaggaggccgggugccaggccgacgucugggcgcugcagcugcagcucuaccggcagggcggcgugaacgccacccaggugcugauccagcaccuccgcgggcugcagaagggccggagcaccgagcgcaacgucuccguggaggcccuggccagcgcgcugcagcuccuggcccgggagcagcaguccacggggcgcgugggccggagccugcccaccgaggacugcgagaacgagaaggagcaggccguccacaacguggugcagcuccugcccggggucggcaccuucuacaaccugggcaccgcccucuacuacgccacgcagaacugccuggggaaggcgcgcgagcggggccgcgacggggccaucgaccugggcuacgaccuccugaugaccauggccggcauguccgggggccccauggggcuggccaucagcgccgcgcucaagccggcccugcgguccggcgugcagcagcugauccaguacuaccaggaccagaaggacgccaacaucagccagcccgagaccaccaaggaggggcuccgcgccaucuccgacgugagcgaccuggaggagacgaccacccuggccagcuucaucuccgaggucgugagcuccgcgcccuacuggggcugggccaucaucaagagcuacgaccucgaccccggcgccgggucccuggagaucuga

SEQ ID NO: 26773 - RNA, 1038 nt, Artificial Sequence
  derived and/or modified sequence opt1 from APOH__Homo_sapiens__NP_000033
augaucagccccgugcugauccucuucuccagcuuccugugccacgucgccaucgccggccggaccugcccgaagcccgacgaccugcccuucuccaccguggugccccucaagacguucuacgagccgggggaggagaucaccuacagcugcaagcccggcuacgucucccgcgggggcaugcgcaaguucaucugcccccugaccgggcuguggcccaucaacacccucaagugcacgccgcgggugugccccuucgcgggcauccuggagaacggcgccgugcgcuacaccaccuucgaguaccccaacaccaucagcuucuccugcaacacgggguucuaccugaacggcgccgacagcgccaagugcaccgaggaggggaaguggucccccgagcucccggucugcgcccccaucaucugcccgccgcccagcauccccaccuucgcgacccugcggguguacaagcccuccgccggcaacaacagccuguaccgcgacacggccguguucgagugccucccccagcacgccauguucgggaacgacaccaucacgugcaccacccacggcaacuggaccaagcugcccgagugccgggaggucaagugccccuuccccucccgccccgacaacggcuucgugaacuacccggcgaagcccacccuguacuacaaggacaaggccaccuucgggugccacgacggcuacagccucgacgggcccgaggagaucgagugcacgaagcugggcaacugguccgccaugcccagcugcaaggccuccugcaaggugccggucaagaaggccaccgugguguaccagggcgagcgggucaagauccaggagaaguucaagaacgggaugcugcacggcgacaaggugagcuucuucugcaagaacaaggagaagaagugcuccuacaccgaggacgcgcagugcaucgacgggaccaucgaggugcccaagugcuucaaggagcacagcagccucgccuucuggaagacggacgccuccgacgucaagcccugcuga

SEQ ID NO: 26774 - RNA, 1143 nt, Artificial Sequence
  derived and/or modified sequence opt1 from APOL1__Homo_sapiens__NP_001130013
auggagggcgccgcccugcuccgcgugagcguccugugcaucugggugcagcagaacgugcccuccgggaccgacaccggcgacccgcagagcaagccccugggggacugggcggccggcacgauggaccccgaguccagcaucuucaucgaggacgccaucaaguacuucaaggagaaggucuccacccagaaccuccugcugcuccugaccgacaacgaggccuggaacggguucguggccgcggccgagcugccccggaacgaggccgacgagcuccgcaaggcccuggacaaccuggcgcggcagaugaucaugaaggacaagaacuggcacgacaagggccagcaguaccgcaacugguuccucaaggaguucccgcggcucaagagcgagcuggaggacaacauccgccggcugcgcgcccuggccgacggcgugcagaagguccacaaggggaccacgaucgccaacgugguguccggcagccuguccaucagcuccgggauccucacccuggucggcauggggcuggcccccuucaccgagggcggcagccucgugcugcuggagcccgggauggagcucggcaucaccgcggcccugacggggaucaccuccagcaccauggacuacggcaagaagugguggacccaggcccaggcccacgaccuggugaucaagucccucgacaagcugaaggagguccgggaguuccugggcgagaacaucagcaacuuccucucccuggccgggaacacguaccagcugacccgcggcaucgggaaggacauccgggcgcuccgccgggcccgcgccaaccugcagagcgugccccacgccuccgccagccggccgcgcgugaccgagcccaucagcgcggaguccggcgagcaggucgagcgggugaacgagcccagcauccuggagaugucccgcggggugaagcucaccgacgucgcccccgugagcuucuuccuggugcuggacgucguguaccucguguacgaguccaagcaccuccacgagggcgccaagagcgagacggccgaggagcugaagaaggucgcccaggagcuggaggagaagcugaacauccugaacaacaacuacaagauccuccaggcggaccaggagcuguga

SEQ ID NO: 26775 - RNA, 1014 nt, Artificial Sequence
  derived and/or modified sequence opt1 from APOL2__Homo_sapiens__NP_663612
augaaccccgagagcuccaucuucaucgaggacuaccugaaguacuuccaggaccaggugagccgcgagaaccuccugcagcugcucaccgacgacgaggccuggaacggcuucgucgccgcggccgagcugccgcgggacgaggccgacgagcugcgcaaggcccucaacaagcuggccucccacauggugaugaaggacaagaaccggcacgacaaggaccagcagcaccgccagugguuccugaaggaguucccccggcucaagcgcgagcuggaggaccacauccggaagcugcgcgcgcucgccgaggagguggagcagguccaccgggggaccacgaucgccaacguggugagcaacuccgucggcaccaccagcgggauccugacccugcucggccuggggcuggcccccuucacggagggcaucuccuucgugcuccuggacaccggcauggggcugggcgcggccgccgccguggccgggaucacgugcagcgucguggagcucgugaacaagcugcgcgcgcgggcccaggcccgcaaccuggaccaguccggcaccaacgucgccaaggugaugaaggaguucgucgggggcaacacccccaacgugcucacccugguggacaacugguaccaggugacccagggcaucgggcggaacauccgcgccauccggcgcgcgcgggccaacccgcagcugggcgccuacgcgcccccgccccacgucaucgggcgcaucagcgccgagggcggcgagcaggucgagcgggugguggaggggcccgcgcaggccaugucccgcggcaccaugaucgugggggccgccacgggcgggauccuccugcugcucgacguggucagccuggccuacgaguccaagcaccuccuggagggcgccaagagcgaguccgccgaggagcugaagaagcgggcccaggagcuggagggcaagcucaacuuccugaccaagauccacgagaugcugcagcccgggcaggaccaguga

SEQ ID NO: 26776 - RNA, 1209 nt, Artificial Sequence
  derived and/or modified sequence opt1 from APOL3__Homo_sapiens__NP_663615
augggccuggggcagggcugggggugggaggccagcugcuucgccugccucauccgcuccugcugccagguggucaccuucaccuuccccuucggcuuccaggggaucagccagucccuggagaacgugagcggcuacuacgcggacgcccggcuggaggugggcuccacgcagcuccgcaccgccgggagcugcucccacagcuucaagcgguccuuccuggagaagaagcgcuucaccgaggaggccaccaaguacuuccgggagcgcgucagcccggugcaccuccagauccugcugacgaacaacgaggccuggaagcgguucgugaccgcggccgagcugccccgcgacgaggccgacgcccucuacgaggcgcugaagaagcugcggaccuacgccgccaucgaggacgaguacguccagcagaaggacgagcaguuccgcgagugguuccucaaggaguucccccaggugaagcggaagauccaggaguccaucgagaagcugcgcgcccuggccaacggcaucgaggaggugcaccgggggugcaccaucagcaacgucguguccagcuccacgggcgcggccagcgggaucaugucccucgccggccuggugcuggcccccuucaccgccggcaccagccucgcgcugaccgccgccggggucggccugggggccgccuccgcggugacgggcaucaccaccagcaucguggagcacagcuacaccuccagcgccgaggccgaggccucccgccucacggccaccagcaucgaccggcugaaggucuucaaggaggugaugcgcgacaucaccccgaaccugcucucccugcugaacaacuacuacgaggcgacccagacgaucggcagcgagauccgggccauccgccaggcccgggcccgcgcgcggcuccccgugaccaccuggcgcaucuccgccgggagcggcgggcaggccgagcgcaccaucgccggcacgacccgggccgucucccgcggggcgcggauccugagcgccaccaccuccggcaucuuccuggcccucgacguggugaaccuggucuacgagagcaagcaccuccacgagggcgccaaguccgccagcgcggaggagcugcgccggcaggcccaggagcuggaggagaaccugauggagcucacgcagaucuaccagcgccugaaccccugccacacccacuga

SEQ ID NO: 26777 - RNA, 1047 nt, Artificial Sequence
  derived and/or modified sequence opt1 from APOL4__Homo_sapiens__NP_085146
augggcagcugggugcagcugaucaccuccgucggggugcagcagaaccaccccggcuggaccguggccgggcaguuccaggagaagaagcgcuucacggaggaggucaucgaguacuuccagaagaaggugagcccggugcaccucaagauccugcugaccuccgacgaggccuggaagcgguucguccgcguggcggagcucccccgggaggaggccgacgcccuguacgaggcccugaagaaccucacccccuacguggccaucgaggacaaggacaugcagcagaaggagcagcaguuccgcgagugguuccugaaggaguucccccagauccgguggaagauccaggagagcaucgagcgccugcgggucaucgcgaacgagaucgagaaggugcaccgcggcugcgugaucgccaacgucguguccgggagcaccggcauccucuccgugaucggcgucaugcuggccccguucacggccgggcugagccucuccaucaccgcggccggcguggggcugggcaucgccagcgccaccgccgggaucgcguccagcaucguggagaacaccuacacgcgguccgccgagcugaccgccagccgccucaccgccaccuccacggaccagcuggaggcccugcgggacauccuccgcgacaucacccccaacguccugagcuucgcgcuggacuucgacgaggccaccaagaugaucgccaacgacgugcacacccuccggcgcuccaaggccacggugggccggccccugaucgccuggcgcuacguccccaucaacgugguggagacccugcggacccgcggcgcgccgacccggaucguccgcaagguggcccggaaccucgggaaggccacgagcggcguccugguggugcuggacgucgugaaccucgugcaggacucccuggaccugcacaagggggccaagagcgagagcgccgagucccuccgccagugggcgcaggagcuggaggagaaccugaacgagcucacccacauccaccagagccugaaggccggcuga

SEQ ID NO: 26778 - RNA, 1032 nt, Artificial Sequence
  derived and/or modified sequence opt1 from APOL6__Homo_sapiens__NP_085144
auggacaaccaggccgagcgcgagagcgaggccggcguggggcugcagcgggacgaggacgacgcgccccucugcgaggacgucgagcugcaggacggcgaccuguccccggaggagaagaucuuccuccgcgaguucccccggcugaaggaggaccugaaggggaacaucgacaagcuccgcgcccuggccgacgacaucgacaagacccacaagaaguucaccaaggccaacaugguggccacgagcaccgcggugaucuccggcgucaugagccugcucgggcuggcccuggcccccgccaccggcggcgggucccuccugcugagcaccgcgggccaggggcucgccacggccgccggcgugaccuccaucgugagcgggacccuggagcgguccaagaacaaggaggcccaggcgcgcgccgaggacauccugcccaccuacgaccaggaggaccgggaggacgaggaggagaaggccgacuacgucacggccgccggcaagaucaucuacaaccuccgcaacacccugaaguacgcgaagaagaacgugcgggccuucuggaagcugcgcgccaacccgcggcucgccaacgccaccaagcgccugcugaccacgggccaggugagcucccggagccgcguccaggugcagaaggcguucgccgggaccacccucgccaugaccaagaacgcccgggugcugggcggggucauguccgccuucagccugggcuacgaccucgcgacgcuguccaaggaguggaagcaccugaaggagggcgcccgcaccaaguucgccgaggagcuccgggccaaggcgcuggagcuggagcgcaagcucaccgagcugacccagcuguacaagagccuccagcagaaggugcggucccgcgcccgcggggugggcaaggaccugacggggaccugcgagaccgaggccuacuggaaggagcugcgggagcacgucuggauguggcucuggcugugcgugugccugugcgugugcgucuacgugcaguucaccuga

SEQ ID NO: 26779 - RNA, 840 nt, Artificial Sequence
  derived and/or modified sequence opt1 from APOLD1__Homo_sapiens__NP_001123887
auguuccgcgcccccugccaccggcugcgcgcccggggcacccgcaaggcgcgggccggggccuggcgcggcugcaccuucccgugccucgggaagggcauggagcggcccgccgcccgcgagccccacgggcccgacgcgcugcggcgcuuccagggccugcuccuggaccggcgcggccggcugcacggccaggugcuccgccugcgggaggucgcccgccggcuggagcgccuccggcgccggagccugguggccaacguggccggguccagccuguccgcgacgggggcccucgccgccaucgucggccugagccuguccccggugacccucgggaccagccugcugguguccgccgucggccucggcguggcgaccgccgggggcgccgugacgaucaccagcgaccugucccugaucuucugcaacagccgcgagcuccgccggguccaggagaucgccgcgaccugccaggaccagaugcgcgagauccuguccugccuggaguucuucugccgguggcaggggugcggcgaccgccagcuccugcagugcggccggaacgccagcaucgcccuguacaacuccguguacuucaucguguucuucgggagccgcggcuuccucaucccccggcgcgccgagggggacaccaaggucucccaggccgugcugaaggccaagauccagaagcuggcggagagccucgaguccugcacgggcgcccuggacgagcugagcgagcagcucgagucccgggugcagcugugcaccaagagcagccgcgggcacgaccugaagaucuccgccgaccagcgggccggccucuucuucuga

SEQ ID NO: 26780 - RNA, 351 nt, Artificial Sequence
  derived and/or modified sequence opt1 from APOM__Homo_sapiens__NP_001243098
auggccgccggcagcgcgcccaugcagcugcaccuccgcgccaccauccggaugaaggacgggcugugcgugccgcgcaaguggaucuaccaccugaccgagggcuccaccgaccuccggaccgaggggcgccccgacaugaagaccgagcuguucagcuccagcugccccggcgggaucaugcugaacgagaccggccagggcuaccagcgguuccuccuguacaaccgcagcccccacccgcccgagaagugcgucgaggaguucaagucccugacguccugccucgacagcaaggccuuccugcugacgccccggaaccaggaggccugcgagcucuccaacaacuga

SEQ ID NO: 26781 - RNA, 597 nt, Artificial Sequence
  derived and/or modified sequence opt1 from APOO__Homo_sapiens__NP_077027
auguucaaggugauccagcgcagcgucggccccgccucccugagccuccugaccuucaagguguacgccgcgccgaagaaggacuccccgcccaagaacagcgugaaggucgacgagcugucccucuacagcgugcccgaggggcaguccaaguacguggaggaggcccggagccagcuggaggaguccaucagccagcugcgccacuacugcgagcccuacaccacguggugccaggagaccuacucccagaccaagcccaagaugcagagccucguccaguggggccuggacuccuacgacuaccugcagaacgccccgcccggguucuucccccggcucggcgugaucggguucgccggccugaucggccugcuccuggcccgcgggagcaagaucaagaagcugguguacccgcccggcuucauggggcucgcggccucccuguacuacccccagcaggccaucgucuucgcccaggugagcggcgagcggcuguacgacugggggcuccgcggcuacaucgugaucgaggaccuguggaaggagaacuuccagaagcccggcaacgucaagaacucccccgggaccaaguga

SEQ ID NO: 26782 - RNA, 621 nt, Artificial Sequence
  derived and/or modified sequence opt1 from APOPT1__Homo_sapiens__NP_115750
augcugcccugcgccgccggcgcgcgcgggcggggcgccauggugguccuccgcgccgggaagaagaccuuccugccgccccugugccgggccuucgccugccgcggcugccagcucgcgcccgagcgcggggccgagcggcgggacaccgcccccagcggcgugucccgcuucugcccgccccgcaagagcugccacgacuggaucggcccgcccgacaaguacuccaaccugcggcccgugcacuucuacauccccgagaacgagagcccccuggagcagaagcuccggaagcugcgccaggagacgcaggaguggaaccagcaguucugggccaaccagaaccugaccuucuccaaggagaaggaggaguucauccacagccggcucaagaccaaggggcugggccugcgcaccgaguccgggcagaaggcgacgcucaacgccgaggagauggccgacuucuacaaggaguuccugagcaagaacuuccagaagcacauguacuacaaccgggacugguacaagcgcaacuucgccaucaccuucuucaugggcaaggucgcccuggagcggaucuggaacaagcucaagcagaagcagaagaagcgcuccaacuga

SEQ ID NO: 26783 - RNA, 1758 nt, Artificial Sequence
  derived and/or modified sequence opt1 from APPBP2__Homo_sapiens__NP_006371
auggccgccguggagcuggaguggauccccgagacccucuacaacaccgcgaucagcgccgucguggacaacuacauccgcucccggcgcgacauccggagccugccggagaacauccaguucgacguguacuacaagcuguaccagcagggccgccucugccagcugggguccgaguucugcgagcuggaggucuucgccaaggugcuccgggcccuggacaagcgccaccuccuccaccacugcuuccaggcccugauggaccacggcgugaaggucgcgagcgugcuggccuacuccuucagccggcgcugcuccuacaucgccgagagcgacgccgcggugaaggagaaggccauccaggucggguucgugcucggcggguuccuguccgacgccggcugguacagcgacgccgagaagguguuccuguccugccuccagcugugcacgcugcacgacgagaugcuccacugguuccgggccgucgagugcugcgugcgccugcugcacgugcggaacggcaacugcaaguaccaccucggggaggagaccuucaagcuggcgcagaccuacauggacaagcugagcaagcacggccagcaggccaacaaggccgcccucuacggggagcugugcgcccugcuguucgcgaagucccacuacgacgaggccuacaaguggugcaucgaggccaugaaggagaucaccgccggccugcccgucaaggugguggucgacgugcugcgccaggccagcaaggcgugcguggucaagcgggaguucaagaaggccgagcagcucaucaagcacgccguguaccuggcccgcgaccacuucggguccaagcaccccaaguacagcgacacgcugcucgacuacggcuucuaccugcugaacguggacaacaucugccaguccgucgccaucuaccaggcggcccucgacauccggcagagcguguucggcgggaagaacauccacgucgccaccgcccacgaggaccuggcguacuccagcuacgugcaccaguacagcuccggcaaguucgacaacgcccuguuccacgccgagcgcgccaucgggaucaucacccacauccuccccgaggaccaccuccugcuggccagcuccaagcgggugaaggcgcugauccuggaggagaucgccaucgacugccacaacaaggagaccgagcagcgccuccugcaggaggcccacgaccugcaccucagcucccugcagcuggccaagaaggccuucggcgaguucaacguccagacggcgaagcacuacggcaaccuggggcggcucuaccagagcaugcgcaaguucaaggaggccgaggagaugcacaucaaggccauccagaucaaggagcagcugcugggccaggaggacuacgagguggcccucuccguggggcaccuggccagccuguacaacuacgacaugaaccaguacgagaacgcggagaagcucuaccugcgguccaucgccaucggcaagaagcuguucggggagggcuacagcggccucgaguacgacuaccgcgggcugaucaagcuguacaacuccaucggcaacuacgagaaggucuucgaguaccacaacgugcucagcaacuggaaccgccugcgggaccgccaguacuccgugaccgacgcccuggaggacgucagcaccuccccgcagagcaccgaggagguggugcaguccuuccucaucagccagaacgucgaggggcccuccugcuga

SEQ ID NO: 26784 - RNA, 2313 nt, Artificial Sequence
  derived and/or modified sequence opt1 from APP__Homo_sapiens__NP_000475
augcugcccggccucgcccugcugcuccuggccgcguggaccgcccgcgcccuggaggugccgaccgacgggaacgccggccuccuggccgagccccagaucgcgauguucugcgggcggcugaacaugcacaugaacguccagaacggcaagugggacagcgaccccuccgggacgaagaccugcaucgacaccaaggagggcauccuccaguacugccaggagguguaccccgagcugcagaucaccaacguggucgaggccaaccagccggugacgauccagaacuggugcaagcgcggccggaagcagugcaagacccacccccacuucgugauccccuaccgcugccuggucggggaguucgugagcgacgcccuccuggugcccgacaagugcaaguuccugcaccaggagcggauggacgucugcgagacccaccuccacuggcacaccguggccaaggagacgugcuccgagaaguccaccaaccugcacgacuacggcaugcugcucccgugcgggaucgacaaguuccgcggcguggaguucgucugcugcccccuggcggaggagagcgacaacguggacagcgccgacgccgaggaggacgacuccgacgugugguggggcggggccgacaccgacuacgccgacggcagcgaggacaaggucguggagguggcggaggaggaggaggucgccgagguggaggaggaggaggccgacgacgacgaggacgacgaggacggggacgagguggaggaggaggccgaggagcccuacgaggaggccaccgagcggacgaccuccaucgcgaccaccacgaccaccaccacggagagcgucgaggagguggugcgcgaggucugcuccgagcaggccgagaccggccccugccgggccaugaucagccgcugguacuucgacgugaccgaggggaagugcgccccguucuucuacggcggcugcgggggcaaccggaacaacuucgacaccgaggaguacugcauggccgucugcggguccgcgaugagccagucccugcucaagacgacccaggagccccuggcccgcgaccccgugaagcugcccaccaccgccgccagcacgccggacgccguggacaaguaccucgagacccccggcgacgagaacgagcacgcgcacuuccagaaggccaaggagcggcuggaggccaagcaccgcgagcggaugucccaggucaugcgcgagugggaggaggccgagcggcaggcgaagaaccugcccaaggccgacaagaaggccgugauccagcacuuccaggagaagguggagagccucgagcaggaggccgccaacgagcgccagcagcuggucgagacccacauggcgcggguggaggccaugcugaacgaccgccggcgccucgcccuggagaacuacaucaccgcccugcaggccgugcccccgcgcccccggcacgucuucaacaugcucaagaaguacgugcgcgcggagcagaaggaccggcagcacacgcugaagcacuucgagcacgugcgcauggucgaccccaagaaggccgcccagauccggucccaggugaugacccaccuccgcgugaucuacgagcggaugaaccagagccugagccugcuguacaacguccccgccguggccgaggagauccaggacgagguggacgagcuccugcagaaggagcagaacuacuccgacgacguccuggcgaacaugaucagcgagccgcgcaucuccuacgggaacgacgcccucaugcccagccugaccgagaccaagacgaccguggagcugcuccccgugaacggcgaguucucccuggacgaccugcagcccuggcacagcuucggcgccgacuccgucccggccaacaccgagaacgagguggagcccguggacgcgcggcccgccgccgaccgcgggcucaccacccggccgggcagcgggcugacgaacaucaagaccgaggagaucuccgaggucaagauggacgccgaguuccgccacgacagcggcuacgaggugcaccaccagaagcugguguucuucgccgaggacgucggguccaacaagggcgcgaucaucggccugauggucgggggcguggugaucgccaccgugaucgugaucacccucgucaugcugaagaagaagcaguacacgagcauccaccacggggugguggaggucgacgccgccgugacccccgaggagcggcaccuguccaagaugcagcagaacggcuacgagaaccccaccuacaaguucuucgagcagaugcagaacuga

SEQ ID NO: 26785 - RNA, 2130 nt, Artificial Sequence
  derived and/or modified sequence opt1 from APPL1__Homo_sapiens__NP_036228
augcccggcaucgacaagcugccgaucgaggagacccucgaggacagcccccagacccgcucccugcuggggguguucgaggaggacgccacggccaucagcaacuacaugaaccagcucuaccaggcgaugcaccggaucuacgacgcccagaacgagcuguccgccgccacccaccugaccagcaagcuccugaaggaguacgagaagcagcgcuucccccugggcggggacgacgaggucauguccagcacccuccagcaguucuccaaggugaucgacgagcugagcuccugccacgccgugcugagcacgcagcucgcggacgccaugauguuccccaucacccaguucaaggagcgggaccugaaggagauccugacccucaaggaggucuuccagaucgccuccaacgaccacgacgccgcgaucaaccgcuacagccggcuguccaagaagcgcgagaacgacaaggugaaguacgaggugaccgaggacgucuacacgagccggaagaagcagcaccagaccaugaugcacuacuucugcgcccugaacacccuccaguacaagaagaagaucgcccugcuggagccgcuccugggcuacaugcaggcccagaucuccuucuucaagauggggagcgagaaccugaacgagcagcucgaggaguuccuggccaacaucggcaccuccgugcagaacgugcgccgggagauggacagcgacaucgagacgaugcagcagaccaucgaggaccuggaggucgcguccgacccccucuacgugcccgaccccgacccgaccaaguuccccgugaaccgcaaccugacccggaaggccggcuaccugaacgcccgcaacaagacggggcucgucagcagcaccugggaccggcaguucuacuucacccagggcgggaaccugaugucccaggcccgcggcgacguggccgggggccuggcgauggacaucgacaacugcagcgugauggccgucgacugcgaggaccggcgcuacugcuuccagaucaccuccuucgacggcaagaaguccagcauccuccaggccgagagcaagaaggaccacgaggaguggaucugcacgaucaacaacaucuccaagcagaucuaccugagcgagaaccccgaggagaccgccgcccgggugaaccaguccgcgcuggaggccgugacccccagcccguccuuccagcagcgccacgagagccuccggcccgccgccgggcagucccgcccgcccaccgcccggacgagcuccagcggcucccuggggagcgaguccaccaaccuggcggcccucagccuggacagccuggucgcccccgacacccccauccaguucgacaucaucucccccgugugcgaggaccagcccggccaggccaaggcguucggccagggcgggcgccgcaccaacccguucggggagagcggcggguccaccaagagcgagacggaggacuccauccuccaccagcuguucaucgugcgguuccugggcagcauggaggucaaguccgacgaccaccccgacgugguguacgagaccaugcgccagauccucgccgcccgggccauccacaacaucuuccgcaugaccgagagccaccuccuggucacgugcgacugccugaagcugaucgacccccagacccaggugacccggcugaccuucccccugccgugcgucgugcucuacgccacgcaccaggagaacaagcgccuguucggcuucgugcugcggaccuccagcgggcgcuccgagagcaaccucuccagcgucugcuacaucuucgaguccaacaacgagggcgagaagaucugcgacagcguggggcuggcgaagcagaucgcccugcacgccgagcucgaccggcgcgccuccgagaagcagaaggagaucgagcgggugaaggagaagcagcagaaggagcugaacaagcagaagcagaucgagaaggaccuggaggagcagagccgccucaucgccgcgagcucccggcccaaccaggccagcuccgagggccaguucgucgugcugagcuccagccaguccgaggagagcgaccugggggagggcggcaagaagcgcgaguccgaggccuga

SEQ ID NO: 26786 - RNA, 2013 nt, Artificial Sequence
  derived and/or modified sequence opt1 from APPL2__Homo_sapiens__NP_001238833
augcccgccguggacaagcugcuccuggaggaggcccugcaggacagcccgcagacccggucccuccugagcgucuucgaggaggacgcgggcacccugacggacuacaccaaccagcuccugcaggccaugcagcggguguacggggcccagaacgagaugugccuggccacccagcagcucuccaagcagcugcuggccuacgagaagcagaacuucgcgcucggcaagggggacgaggaggugaucagcacccugcacuacuucuccaaggucguggacgagcugaaccuccugcacacggagcuggccaagcagcucgccgacaccauggugcugcccaucauccaguuccgcgagaaggaccugaccgaggucagcacccucaaggaccuguucggccuggccuccaacgacgugugccucuuccuggagcacgaccugagcauggcgaaguacucccggcuccccaagaagaaggagaacgagaaggugaagacggaggucgggaaggagguggccgccgcccgccggaagcagcaccugagcucccugcaguacuacugcgcccucaacgcgcugcaguaccgcaagcagauggccaugauggagcccaugaucggcuucgcccacggccagaucaacuucuucaagaagggggccgagauguucagcaagcggauggacuccuuccugagcuccguggccgacaugguccagagcauccagguggagcucgaggcggaggccgagaagaugcgcgugucccagcaggagcugcugagcgucgacgaguccguguacaccccggacagcgacguggccgcgccccagaucaaccggaaccucauccagaaggccggcuaccugaaccugcgcaacaagaccgggcucgucaccacgaccugggagcggcuguacuucuucacccagggcgggaaccugaugugccagccccgcggcgccguggccggcgggcucauccaggaccuggacaacugcagcgugauggccgucgacugcgaggaccggcgcuacugcuuccagaucaccacgcccaacggcaaguccgggaucauccugcaggccgagagccggaaggagaacgaggaguggaucugcgccaucaacaacaucucccgccagaucuaccucaccgacaacccggaggcgguggccaucaagcugaaccagaccgcccugcaggccgugacccccaucacgagcuucggcaagaagcaggaguccagcugccccucccagaaccucaagaacagcgagauggagaacgagaacgacaagaucguccccaaggcgaccgccucccugccggaggccgaggagcugaucgcccccggcacccccauccaguucgacaucgugcugcccgccaccgaguuccucgaccagaaccgggggagccgccggacgaacccguucggcgagaccgaggacgaguccuuccccgaggcggaggacagccugcugcagcagauguucaucguccgcuuccucggguccauggccgugaagaccgacagcaccacggaggugaucuacgaggccaugcggcagguccuggccgcccgcgcgauccacaacaucuuccgcaugaccgagucccaccugauggugaccagccagucccuccggcugaucgacccccagacccaggugagccgcgccaacuucgagcugacguccgucacccaguucgccgcccaccaggagaacaagcggcucgugggcuucgugauccgcguccccgagagcaccggggaggagagccuguccaccuacaucuucgagagcaacuccgagggcgagaagaucugcuacgccaucaaccugggcaaggagaucaucgaggugcagaaggacccggaggcgcucgcccagcugaugcugagcaucccccucacgaacgacgggaaguacgugcugcugaacgaccagcccgacgacgacgacggcaaccccaacgagcaccgcggggccgaguccgaggccuga

SEQ ID NO: 26787 - RNA, 543 nt, Artificial Sequence
  derived and/or modified sequence opt1 from APRT__Homo_sapiens__NP_000476
auggccgacagcgagcugcagcucguggagcagcgcauccgguccuuccccgacuucccgacccccggcgucguguuccgcgacaucagccccgugcugaaggaccccgccuccuuccgggcggccaucgggcugcucgcccgccaccugaaggccacccacggcgggcggaucgacuacaucgccggccuggacagccgcggguuccucuucggcccgucccuggcgcaggagcugggccucgggugcguccugauccggaagcgcggcaagcugcccgggcccacgcucugggccagcuacucccuggaguacggcaaggccgagcuggagauccagaaggacgcccucgagcccgggcagcgggugguggucguggacgaccugcuggcgaccggcggcaccaugaacgccgccugcgagcuccuggggcgccugcaggccgaggugcucgagugcgucagccugguggagcugaccucccucaagggccgggagaagcuggccccggugcccuucuucagccugcuccaguacgaguga

SEQ ID NO: 26788 - RNA, 1071 nt, Artificial Sequence
  derived and/or modified sequence opt1 from APTX__Homo_sapiens__NP_001182177
augagcaacgugaaccuguccgucagcgacuucuggcgcgugaugaugcgggugugcuggcucguccgccaggacucccggcaccagcgcauccggcugccccaccuggaggccguggugaucggccgcgggccggagaccaagaucaccgacaagaagugcagccggcagcagguccagcucaaggccgagugcaacaagggcuacgugaaggugaagcaggucggggugaaccccacguccaucgacagcguggucaucggcaaggaccaggaggugaagcugcagcccggccaggugcugcacauggucaacgagcucuaccccuacaucguggaguucgaggaggaggcgaagaacccggggcuggagacccaccgcaagcggaagcgcuccggcaacagcgacuccaucgagcgggacgccgcccaggaggccgaggccgggaccggccuggagcccgggagcaacuccggccagugcagcgugccccucaagaaggggaaggacgcgcccaucaagaaggagucccugggccacuggagccagggccugaagaucuccaugcaggacccgaagaugcaggucuacaaggacgagcaggucguggugaucaaggacaaguaccccaaggcccgcuaccacuggcucgugcugcccuggaccagcaucuccagccugaaggccguggcccgggagcaccucgagcugcugaagcacaugcacacggucggggagaaggugaucgucgacuucgcgggcuccagcaagcuccgcuuccggcugggguaccacgccauccccagcaugucccacgugcaccuccacgugaucagccaggacuucgacuccccgugccugaagaacaagaagcacuggaacagcuucaacaccgaguacuuccuggagucccaggccgucaucgagauggugcaggaggccggccgcgugaccguccgggacggcaugcccgagcugcucaagcugccccugcgcugccacgagugccagcagcuccugcccagcaucccgcagcugaaggagcaccuccggaagcacuggacccaguga

SEQ ID NO: 26789 - RNA, 906 nt, Artificial Sequence
  derived and/or modified sequence opt1 from AQP10__Homo_sapiens__NP_536354
augguguucacccaggcccccgccgagaucaugggccaccuccgcauccggagccugcuggcgcgccagugccuggccgaguuccucggggucuucgugcugaugcugcucacccagggcgccguggcccaggccgucacguccggggagaccaagggcaacuucuucaccauguuccuggcggggagccuggccgugaccaucgccaucuacgugggcggcaacgucuccggggcccaccucaacccggcguucagccuggccaugugcaucgugggccggcugcccugggugaagcuccccaucuacauccugguccagcugcucuccgccuucugcgccagcggggccacguacgugcuguaccacgacgcgcugcagaacuacaccggcgggaaccucaccgugaccggccccaaggagacggccuccaucuucgccaccuacccggcccccuaccugagccugaacaacggcuuccucgaccagguccuggggaccggcaugcugaucguggggcuccuggccauccuggaccgccggaacaagggcgugcccgcgggccucgagcccgucgugguggggaugcugauccuggcccucggccuguccaugggggccaacugcggcaucccgcugaaccccgcccgcgaccucgggccccggcuguucaccuacgucgccggcuggggccccgagguguucagcgcggggaacggcugguggugggugccggucguggcgccccuggugggggccacggucggcaccgccaccuaccagcuccugguggcccugcaccaccccgaggggcccgagccggcccaggaccucgucuccgcccagcacaaggccagcgagcuggagacccccgccuccgcgcagaugcuggagugcaagcucuga

SEQ ID NO: 26790 - RNA, 561 nt, Artificial Sequence
  derived and/or modified sequence opt1 from AQP1__Homo_sapiens__NP_001171989
augcccggcgcccgcccgcugccccucgugcuggucccccagaacacccuggccuggaugcagcucgacgcgaaggcccccgcccacccgcggccccugcagcugcucgggcgcgugggccccgggagccggcagcuggccgacggcgugaacuccgggcagggccugggcaucgagaucaucgggacccuccagcugguccugugcgugcucgccacgaccgaccgccggcgccgggaccugggcgggagcgcgccccuggccaucggccucuccguggcccuggggcaccuccuggccaucgacuacaccggcugcggcaucaacccggcgcgcagcuucggguccgccgucaucacccacaacuucagcaaccacuggaucuucugggugggccccuucaucgggggcgcccuggccgugcugaucuacgacuucauccucgcgccccgguccagcgaccugacggaccgcgucaagguguggaccuccggccagguggaggaguacgaccuggacgccgacgacaucaacagccgggucgagaugaagcccaaguga

SEQ ID NO: 26791 - RNA, 816 nt, Artificial Sequence
  derived and/or modified sequence opt1 from AQP2__Homo_sapiens__NP_000477
augugggagcugcgcagcaucgccuucucccgggccguguucgcggaguuccucgccacccugcuguucgucuucuucggccucgggagcgcccugaacuggccccaggcccugccguccgugcuccagaucgccauggcguucggccuggggaucggcacccuggugcaggcccucgggcacaucagcggcgcccacaucaaccccgccgucacgguggcgugccuggugggcugccacgucuccgugcugcgcgccgccuucuacguggccgcccagcuccugggggcggucgccggcgccgcccugcuccacgagaucacccccgccgacauccgcggggaccuggcggugaacgcccugagcaacuccaccaccgccggccaggccgugacggucgagcuguuccugacccugcagcucgugcugugcaucuucgccagcaccgacgagcggcgcggggagaaccccggcaccccggcgcuguccaucggcuucagcguggcccucgggcaccuccugggcauccacuacacggggugcuccaugaaccccgcccggagccucgcccccgccgucgugaccggcaaguucgacgaccacuggguguucuggaucggcccccuggucggggcgauccugggcucccuccuguacaacuacgugcuguucccgcccgccaagagccucuccgagcggcuggccgugcugaaggggcucgagcccgacaccgacugggaggagcgcgagguccggcgccggcagagcguggagcugcacagcccccagucccugccgcgcggcaccaaggccuga

SEQ ID NO: 26792 - RNA, 879 nt, Artificial Sequence
  derived and/or modified sequence opt1 from AQP3__Homo_sapiens__NP_004916
augggccgccagaaggagcuggugagccggugcggggagaugcuccacauccgcuaccggcugcugcgccaggcccucgccgagugccugggcacccugauccucgucauguucgggugcggcuccguggcccaggugguccugagccgggggacccacggcggcuuccugacgaucaaccucgcguucggguucgccgugacccugggcauccugaucgccggccagguguccggggcccaccucaaccccgcggucaccuucgccaugugcuuccuggcccgcgagccguggaucaagcugcccaucuacacccucgcccagacgcugggggcguuccugggcgccggcaucguguucgggcucuacuacgacgccaucuggcacuucgccgacaaccagcuguucgugagcggccccaacgggaccgccggcaucuucgcgaccuaccccuccggccaccuggacaugaucaacggguucuucgaccaguucaucggcaccgccagccucaucgucugcgugcuggccaucguggacccguacaacaaccccgucccccgggggcuggaggccuucacggugggccucgugguccuggugaucgggaccuccaugggcuucaacagcggcuacgccgugaaccccgcgcgcgacuucgggccgcggcuguucaccgcccucgccggcuggggguccgccgucuucaccacgggccagcacugguggugggugcccaucgugagcccccugcugggguccaucgccggcgucuucguguaccagcucaugaucggcugccaccuggagcagcccccgcccagcaacgaggaggagaacgugaagcuggcgcacgucaagcacaaggagcagaucuga

SEQ ID NO: 26793 - RNA, 972 nt, Artificial Sequence
  derived and/or modified sequence opt1 from AQP4__Homo_sapiens__NP_001641
augagcgaccgccccaccgcccggcgcuggggcaagugcgggccgcugugcacccgggagaacaucaugguggccuucaagggcgucuggacgcaggcguucuggaaggccgugaccgccgaguuccucgccaugcugaucuucgugcugcucucccuggggagcaccaucaacuggggcgggaccgagaagccccugcccgucgacauggugcucaucucccugugcuucggccugagcaucgccacgauggugcagugcuucggccacaucuccgggggccacaucaaccccgcggucaccguggccauggugugcacccgcaagaucagcaucgccaaguccgucuucuacaucgccgcgcagugccucggggccaucaucggcgccgggauccuguaccuggugaccccgcccagcguggucggcggccucggggugacgauggugcacggcaaccugaccgccgggcacggccugcucgucgagcugaucaucaccuuccagcugguguucaccaucuucgccuccugcgacagcaagcggacggacgugaccggcuccaucgcgcucgccaucggguucagcgucgccaucggccaccuguucgccaucaacuacaccggggccuccaugaaccccgcgcgcagcuucggccccgccgugaucauggggaacugggagaaccacuggaucuacugggugggcccgaucaucggcgccguccuggccgggggccucuacgaguacguguucugccccgacguggaguucaagcggcgcuucaaggaggccuucuccaaggcggcccagcagaccaaggggagcuacauggaggucgaggacaaccggucccagguggagacggacgaccugauccugaagcccggcgucgugcacgugaucgacgucgaccgcggggaggagaagaagggcaaggaccagagcggcgaggugcucuccagcguguga

SEQ ID NO: 26794 - RNA, 798 nt, Artificial Sequence
  derived and/or modified sequence opt1 from AQP5__Homo_sapiens__NP_001642
augaagaaggaggugugcagcgucgccuuccugaaggccguguucgcggaguuccucgccacccugaucuucguguucuucggccugggguccgcccucaaguggcccagcgcccugccgaccauccugcagaucgcccucgcguucggccuggccaucgggacgcuggcccaggcccucggccccgucuccgggggccacaucaaccccgcgaucacccuggcccugcucgugggcaaccagaucagccugcugcgcgccuucuucuacguggccgcccagcucgucggggcgaucgccggcgccgggauccuguacggcguggcgccccugaacgcccgggggaaccucgccgugaacgcccugaacaacaacaccacccagggccaggccauggucguggagcugauccucacguuccagcuggcccugugcaucuucgccuccaccgacagccgccggaccuccccggugggcagccccgcgcucuccaucgggcugagcgucacccugggccaccucguggggaucuacuucacgggcugcuccaugaaccccgcccgcagcuucggccccgccguggucaugaaccgguucuccccggcccacuggguguucuggguggggcccaucgucggcgccgugcuggcggccauccuguacuucuaccuccuguuccccaacagccugucccucagcgagcgcguggccaucaucaaggggaccuacgagcccgacgaggacugggaggagcagcgggaggagcgcaagaagaccauggagcugaccacgcgguga

SEQ ID NO: 26795 - RNA, 849 nt, Artificial Sequence
  derived and/or modified sequence opt1 from AQP6__Homo_sapiens__NP_001643
auggacgccguggagcccggcgggcgcggcugggccagcaugcuggcgugccggcucuggaaggccaucucccgcgcccuguucgccgaguuccuggccaccgggcucuacgucuucuucggcguggggagcgugaugcgguggccgaccgcgcugcccuccguccugcagaucgccaucacguucaaccucgugaccgccauggccgugcaggucaccuggaaggcgagcggcgcccacgccaaccccgccgugacccuggccuuccuggugggcucccacaucagccucccccgcgcggucgccuacguggccgcccagcuggugggggccacggucggcgcggcccugcucuacggggugaugccgggcgacauccgggagacccuggggaucaacgugguccgcaacuccgugagcaccggccaggccguggccgucgagcugcuccugacccugcagcucgugcugugcguguucgccuccacggacagccggcagaccuccggcagccccgcgaccaugaucgggaucuccgucgcccugggccaccucaucgggauccacuucaccggcugcagcaugaaccccgcccgcuccuucggccccgccaucaucaucgggaaguucacggugcacuggguguucugggucggcccgcugaugggggcccugcucgcgagccugaucuacaacuucgugcuguuccccgacaccaagacccucgcccagcggcuggccauccugaccggcacggucgagguggggaccggcgccggcgcgggggccgagccccucaagaaggagucccagcccggcagcggggccguggagauggaguccgucuga

SEQ ID NO: 26796 - RNA, 1029 nt, Artificial Sequence
  derived and/or modified sequence opt1 from AQP7__Homo_sapiens__NP_001161
auggugcaggccagcggccaccgccgguccacccgcgggagcaagauggucuccuggagcgugaucgccaagauccaggagauccugcagcggaagauggugcgcgaguuccucgcggaguucauguccaccuacgucaugaugguguucggccuggggagcguggcccacaugguccugaacaagaaguacggcuccuaccucggggugaaccugggcuucggcuucggggugacgaugggcguccacguggccgggcggaucagcggcgcccacaugaacgccgcggugaccuucgccaacugcgcccuggggcgcguccccuggcggaaguuccccguguacgugcucggccaguuccugggcuccuuccuggccgcggccaccaucuacagccucuucuacaccgccauccugcacuucuccgggggccagcugauggucacggggcccguggccaccgccggcaucuucgcgaccuaccuccccgaccacaugacccuguggcgcggcuuccugaacgaggccuggcucacggggaugcugcagcugugccucuucgccaucaccgaccaggagaacaaccccgcccugccgggcaccgaggcccuggugaucgggauccucgucgugaucaucggcgugagccuggggaugaacaccggcuacgcgaucaaccccucccgggaccugccgccccgcaucuucacguucaucgccggcugggggaagcaggucuucagcaacggcgagaacugguggugggugcccguggucgcgccccuccugggggccuaccugggcgggaucaucuaccucguguucaucggcuccaccaucccccgggagccccugaagcuggaggacagcgucgccuacgaggaccacggcaucaccgugcucccgaagauggggucccacgagcccaccaucagcccccugacgcccguguccgucagcccggccaaccgcagcuccgugcaccccgccccgccccugcacgagagcauggcccucgagcacuucuga

SEQ ID NO: 26797 - RNA, 786 nt, Artificial Sequence
  derived and/or modified sequence opt1 from AQP8__Homo_sapiens__NP_001160
augagcggcgagaucgccaugugcgagcccgaguucgggaacgacaaggcccgcgagccguccgugggcgggcgguggcgcgucagcugguacgagcgguucgugcagcccugccugguggagcuccugggcuccgcgcuguucaucuucaucgggugccucagcgucaucgagaacggcaccgacaccggccugcugcagcccgcccucgcccacgggcuggcccugggccucgugaucgccacgcuggggaacaucuccggcgggcacuucaaccccgcggugagccuggccgccaugcucaucggcggccugaaccuggucaugcuccugccguacugggugucccagcugcucgggggcaugcugggggccgcgcuggccaaggccgugagccccgaggagcgcuucuggaacgccuccggcgccgcguucgucaccgugcaggagcagggccagguggccggggcccucgucgccgagaucauccugaccacccugcucgcccuggcggugugcaugggcgccaucaacgagaagacgaaggggccccuggcccccuucagcaucggcuucgccgugaccgucgacauccucgccgggggcccgguguccggcgggugcaugaaccccgcgcgggccuucggccccgccguggucgccaaccacuggaacuuccacuggaucuacuggcuggggccccugcucgccggccugcugguggggcuccugauccgcugcuucaucggcgacggcaagacccggcugauccucaaggcgcgcuga

SEQ ID NO: 26798 - RNA, 888 nt, Artificial Sequence
  derived and/or modified sequence opt1 from AQP9__Homo_sapiens__NP_066190
augcagcccgagggcgccgagaagggcaagagcuucaagcagcgccuggugcucaaguccagccuggccaaggagacccuguccgaguuccucgggaccuucauccugaucguccuggggugcggcugcguggcgcaggccauccucagccgggggcgcuucggcggcgugaucacgaucaacgucggguucuccauggccguggccauggccaucuacguggcgggcggggucagcggcgggcacaucaacccggccgugucccuggccaugugccuguucggccggaugaagugguucaagcuccccuucuacgugggcgcccaguuccugggggcguucgucggcgccgccaccguguucgggaucuacuacgacggccugaugagcuucgccggcgggaagcuccugaucgugggcgagaacgccaccgcgcacaucuucgccaccuaccccgcccccuaccugucccucgccaacgccuucgcggaccaggucguggccacgaugauccugcugaucaucguguucgccaucuucgacagccgcaaccucggggccccgcggggccuggagcccaucgccaucgggcugcucaucaucgucaucgcguccagccugggccugaacuccggcugcgccaugaaccccgcccgcgaccucagcccccggcuguucaccgcccuggccggguggggcuucgagguguuccgcgcggggaacaacuucugguggaucccgguggucggcccccucgugggggccgugaucggcggccugaucuacguccuggugaucgagauccaccaccccgagcccgacuccguguucaagaccgagcagagcgaggacaagccggagaaguacgagcucuccgucaucauguga

SEQ ID NO: 26799 - RNA, 561 nt, Artificial Sequence
  derived and/or modified sequence opt1 from ARAF__Homo_sapiens__NP_001243126
auggagcccccgcgcggcccgcccgccaacggggccgagcccagccgggcggugggcaccgucaagguguaccugcccaacaagcagcgcaccguggucaccgugcgggacgggauguccguguacgacagccucgacaaggcccugaagguccgcggccugaaccaggacugcugcgugguguaccggcucaucaaggggcgcaagaccgucaccgccugggacaccgccaucgcgccccuggacggcgaggagcugaucguggaggugcucgaggacgucccccugacgaugcacaacuucgugcggaagaccuucuucucccuggccuucugcgacuucugccucaaguuccuguuccacggcuuccgcugccagaccugcggguacaaguuccaccagcacugcagcuccaaggugcccaccgucugcguggacaugagcacgaaccggcagcaguucuaccacuccgugcaggaccugagcggcgggucccgccagcacgaggccccgagcaaccggccccucaacgagcugcugacgccccagggcccccgcuga

SEQ ID NO: 26800 - RNA, 4353 nt, Artificial Sequence
  derived and/or modified sequence opt1 from ARAP1__Homo_sapiens__NP_001035207
auggccgaggccggcgacgcggcccugagcguggccgaguggcuccgcgcccugcaccuggagcaguacaccgggcucuucgagcagcacggccuggucugggccaccgagugccaggggcuguccgacacgcggcucauggacaugggcaugcugcugcccgggcaccgccggcgcauccucgcgggccugcugcgggcccacaccagcccggcccccgccccccgccccaccccgcggcccgugcccaugaagcgccacaucuuccggucccccccggugcccgcgaccccccccgagccgcuccccacgaccaccgaggacgagggccugcccgccgcccccccgauccccccccgccggagcugccugcccccgaccugcuucacgacccccuccaccgccgcccccgaccccguccucccgccccugcccgcgaagcgccaccuggccgagcucagcgugcccccggugcccccccggaccgggccgccccgccugcuggucucccuccccacgaaggaggaggagagccugcugcccucccucagcuccccgccccagccccagagcgaggagccccuguccacccugccgcagggccccccccagcccccgagccccccccccugcccgcccgagaucccccccaagccggugcggcucuuccccgaguucgacgacuccgacuacgacgaggugcccgaggaggggcccggcgccccggcccgcgucaugaccaagaaggaggagccccccccgagccgggugccccgcgccgugcgggucgcgucccugcugagcgagggggaggagcucuccggcgacgaccagggcgacgaggaggaggacgaccacgccuacgagggggugcccaacggcggguggcacaccagcagccugucccugagccuccccuccacgaucgccgccccgcaccccauggacggcccccccggcgggagcaccccggugacccccgucaucaaggccggcuggcuggacaagaaccccccccagggguccuacaucuaccagaagcgcugggugcggcuggacaccgaccaccuccgcuacuucgacagcaacaaggacgcguacuccaagcgcuucaucagcguggccugcaucucccacgucgccgccaucggcgaccagaaguucgaggugaucacgaacaaccggaccuucgccuuccgcgcggagagcgacguggagcggaaggaguggaugcaggcccugcagcaggccauggccgagcagcgcgcgcgggcccgccuguccagcgccuaccuccugggggucccgggcuccgagcagcccgaccgggccggcagccuggagcuccgcggguucaagaacaagcuguacguggccguggucggcgacaaggugcagcuguacaagaaccucgaggaguaccaccuggggaucggcaucaccuucaucgacauguccgucgggaacgugaaggagguggaccggcgcagcuucgaccugaccacgcccuaccggaucuucuccuucagcgcggacuccgagcucgagaaggagcaguggcuggaggccaugcagggcgccaucgccgaggcccugagcaccagcgaggucgcggagcgcaucugggccgccgcccccaaccgguucugcgccgacugcggcgcgccgcagcccgacugggccuccaucaaccugugcguggugaucugcaagcgcugcgccggggagcaccggggccucggggccggcgucagcaaggugcgcucccugaagauggaccggaagguguggaccgagacccugaucgagcucuuccugcagcuggggaacggcgcgggcaaccgcuucugggccgccaacgucccccccagcgaggcccuccagccguccagcucccccagcacgcggcgcugccaccuggaggccaaguaccgcgaggggaaguaccggcgcuaccacccccuguucggcaaccaggaggagcucgacaaggcgcugugcgccgccgugaccaccaccgaccuggccgagacgcaggcccuccuggggugcggcgcgggcaucaacugcuucuccggggaccccgaggccccgaccccccuggcccucgccgagcaggccggccagacccugcagauggaguuccugcggaacaaccgcaccacggaggugccccggcucgacagcaugaagccccuggagaagcacuacuccgucgugcugccgaccgugagccacuccggguuccucuacaagaccgcgagcgccggcaagcugcugcaggaccgccgggcccgcgaggaguucucccggcgcuggugcguccucggggacggcgugcugagcuacuucgagaacgagcgggccgugacccccaacggcgagauccgcgcguccgagaucgucugccuggccgugcccccgcccgacacccacggguucgagcacacguucgagguguacaccgagggcgagcggcucuaccuguucgggcuggagagcgccgagcaggcccacgagugggucaagugcaucgccaaggcguucgugcccccccucgccgaggaccugcuggcccgcgacuucgagcggcucggccgccugccguacaaggccgggcugagccuccagcgggcccaggagggcugguucucccugagcggcuccgagcugcgcgcgguguuccccgaggggcccugcgaggagccccuccagcugcggaagcugcaggagcucagcauccagggcgacuccgagaaccagguccuggugcugguggagcgccggcgcacccucuacauccagggggagcgccggcuggacuucaugggcuggcugggggccauccagaaggccgccgccagcaugggcgacacccucuccgagcagcagcugggcgacagcgacaucccggucaucguguaccgcugcguggacuacaucacgcagugcgggcugaccuccgagggcaucuaccggaagugcgggcagaccagcaagacccagcgccuccuggagucccugcggcaggacgcgcgcagcguccaccucaaggagggcgagcagcacguggacgacguguccagcgcccugaagcgguuccugcgcgaccuccccgacgggcuguucacgcgggcccagcgccugaccuggcucgaggccuccgagaucgaggacgaggaggagaaggucagccgguaccgcgagcugcuggugcggcucccccccgugaaccgcgccaccgucaaggcgcugaucucccaccuguacugcgugcagugcuucagcgacaccaaccagaugaacgugcacaaccucgccaucgucuucggcccgacgcuguuccagaccgacggccaggacuacaaggccgggcgggugguggaggaccugaucaaccacuacgucgugguguucuccgucgacgaggaggagcuccgcaagcagcgggaggagaucaccgccaucgugaagaugcgcguggcgggcaccgccagcgggacgcagcacgccggcgacuucaucugcaccgucuaccuggaggagaagaaggccgagaccgagcagcacaucaaggugcccgccagcaugaccgcggaggagcugacgcucgagauccuggaccggcgcaacgugggcauccgcgagaaggacuacuggaccugcuucgaggucaacgagcgggaggaggccgagcgcccccugcacuucgccgagaaggugcuccccauccugcacgggcugggcaccgacucccaccucgucgugaagaagcaccaggccauggaggccaugcugcuguaccucgcgagccgggugggggacaccaagcacggcaugaugaaguuccgcgaggaccggucccugcuggggcucggccugccgagcggcggguuccacgaccgcuacuucauccugaacuccagcugccuccggcuguacaaggagguccgcucccagcggcccuggagcggcgcccccgagacgucccaccgccccgagaaggaguggccgaucaagagccugaagguguaccucggggugaagaagaagcugcggccccccaccugcuggggcuucaccgucgugcacgagaccgagaagcacgagaagcagcagugguaccugugcugcgacacgcagauggagcuccgcgagugguucgccaccuuccuguucgugcagcacgacgggcuggucuggcccuccgagccgagccgggugucccgcgccgugcccgagguccggcugggcagcgugucccucaucccccugcgcggcagcgagaacgagaugcggcgcuccguggccgcguucaccgccgacccccugagccuccugcggaacgucuga

SEQ ID NO: 26801 - RNA, 4635 nt, Artificial Sequence
  derived and/or modified sequence opt1 from ARAP3__Homo_sapiens__NP_071926
auggccgccccccaggaccuggacaucgcgguguggcucgccaccguccaccuggagcaguacgccgacaccuuccgccggcacggccuggccacggccggggcggcccgcggccucgggcacgaggagcugaagcagcugggcaucagcgccaccgggcaccggaagcgcauccuccggcugcugcagaccggcaccgaggagggcucccucgacccgaagagcgacuccgccauggagcccagccccucccccgcgccgcaggcccagccccccaagcccgugccgaagccccgcacgguguucgggggccugagcgggcccgccaccacccagcggcccggccuguccccggcccucgggggccccggcgucagccgcucccccgagcccagcccgcggccccccccccugccgaccuccagcuccgagcagagcuccgcccugaacacgguggagaugaugcccaacagcaucuacuucgggcucgacucccgcggccgggcgcaggccgcccaggacaaggcccccgacagcucccagaucagcgcccccaccccggcgcugcgccccaccaccgggacggugcacaucauggaccccggcugccuguacuacggcguccagcccguggggaccccgggcgcccccgaccggcgcgagagccggggggugugccagggccgcgccgagcaccggcucucccgccaggaccuggaggcccgggaggacgccggguacgcgagccuggagcuccccggcgacuccacccugcugagcccgacccucgagacggaggagaccuccgacgaccugaucagccccuacgccuccuucagcuucaccgccgaccgccugaccccccuccuguccggcuggcuggacaagcucagcccccaggggaacuacgucuuccagcggcgcuucgugcaguucaacggccgcucccugauguacuucgggagcgacaaggacccguuccccaagggcgugaucccccugacggccaucgagaugacccgguccagcaaggacaacaaguuccaggucaucaccgggcagcgcguguucguguuccggaccgaguccgaggcccagcgcgacauguggugcagcacgcuccaguccugccugaaggagcagcggcugcucggccacccccgcccgccccagcccccccggccgcugcgcaccggcaugcuggagcuccgggggcacaaggcgaaggucuucgccgcccugagccccggcgagcuggcccucuacaaguccgagcaggcguucagccuggggaucggcaucugcuucaucgagcugcaggggugcagcgugcgcgagaccaagucccggagcuucgaccuccugaccccccaccgcugcuucuccuucacggccgagagcggcggcgcccggcaguccugggccgccgcgcugcaggaggccgugaccgagacccucagcgacuacgaggucgccgagaagaucugguccaaccgcgccaaccggcagugcgccgacugcgggagcucccgccccgacugggcggccgugaaccugggcguggucaucugcaagcagugcgccgggcagcaccgggcccugggcagcggcaucuccaaggugcagagccugaagcucgacaccuccguguggagcaacgagaucguccagcuguucaucgugcuggggaacgaccgcgccaaccgguucugggcgggcacgcucccgcccggggagggccugcaccccgacgccacccccgggccgcgcggcgaguucaucucccgcaaguaccggcugggccucuuccgcaagccccacccccaguaccccgaccacagccagcugcugcaggcccucugcgccgcggucgcccggccgaaccugcugaagaacaugacccagcuccugugcguggaggccuucgagggggaggagcccugguuccccccggcccccgacggcuccugccccgggcugcuccccagcgacccgagccccggcguguacaacgaggucguggugcgcgccaccuacuccggguuccuguacugcagccccgucuccaacaaggcgggccccagcccgccccggcgcggccgggacgcccccccccgccuguggugcgugcucggggccgcccuggagauguucgccuccgagaacagcccggagccccugucccucauccagccccaggacaucgugugccugggcgucagccccccgcccacggaccccggggaccgguuccccuucuccuucgagcugauccucgcgggcgggcgcauccagcacuucggcaccgacggcgccgacagccuggaggccuggaccuccgccguggggaagugguucagcccgcuguccugccaccagcuccugggccccgggcugcuccggcugggccgccuguggcuccggagccccucccacaccgcccccgcgccggggcuguggcugagcggcuucggccuccugcgcggggaccaccuguuccucugcuccgcccccggccccgggcccccggcccccgaggacauggugcaccugcggcgccugcaggagaucagcgucguguccgccgcggacacccccgacaagaaggagcaccucgugcuggucgagacgggccggacccuguaccuccagggcgaggggcgccuggacuucaccgccuggaacgccgccaucggcggggccgcgggcgggggcggcaccgggcugcaggagcagcagaugagccggggcgacaucccgaucaucguggacgccugcaucagcuucgugacgcagcacgggcuccgccuggagggcgucuaccggaaggggggcgcccgcgcccgcucccugcggcuccuggccgaguuccgccgggacgcgcgcagcgugaagcugcggcccggcgagcacuucguggaggacgucaccgacacccucaagcgcuucuuccgggagcuggacgaccccgugaccuccgcccgccugcucccccgguggcgcgaggccgccgagcugccgcagaagaaccagcggcuggagaaguacaaggacgugaucgggugccucccccgcgucaaccggcgcacgcuggccacccugaucggccaccucuaccgggugcagaagugcgcggcccugaaccagaugugcacccgcaaccuggcccuccuguucgcccccagcguguuccagaccgacgggcggggcgagcacgagguccgcgugcugcaggagcucaucgacggguacaucuccguguucgacaucgacagcgaccaggucgcccagaucgaccuggaggugucccugaucacgaccuggaaggacgugcagcucagccaggcgggcgaccugaucauggaggucuacaucgagcagcagcugcccgacaacugcgugacccucaagguguccccgacccugacggccgaggagcugaccaaccagguccucgagaugcggggcaccgccgccgggauggaccugugggugaccuucgagauccgcgagcacggcgagcuggagcgcccccuccaccccaaggagaaggugcuggagcaggcgcugcaguggugccagcuccccgagccgugcagcgccucccugcugcucaagaaggucccccuggcccaggccgggugccuguucacgggcauccggcgcgagagcccccgggugggccuccugcgcugccgggaggagcccccgcgccugcucgggucccgguuccaggagcgcuucuuccugcugcggggccgcugccugcuccugcugaaggagaagaagagcuccaagcccgagcgggaguggccccucgagggggccaagguguaccugggcauccgcaagaagcugaagcccccgacccccuggggguucacccucauccuggagaagaugcaccuguaccucagcugcaccgacgaggacgagaugugggacuggacgaccuccauccugaaggcgcagcacgacgaccagcagcccgucgugcugcggcgccacagcuccagcgaccucgcccggcagaaguucggcaccaugccccugcugccgauccgcggcgacgacagcggggccacccuccuguccgccaaccagacgcugcggcgccuccacaaccggcgcacccugagcauguucuuccccaugaaguccagccagggcuccguggaggagcaggaggagcuggaggagcccgucuacgaggagcccguguacgaggaggugggggccuucccggagcucauccaggacaccagcaccuccuucagcacgacccgggaguggaccgucaagcccgagaacccccugaccucccagaagagccuggaccagccguuccucuccaagagcuccacgcugggccaggaggagcgcccccccgagcccccgcccgggccccccagcaaguccagcccgcaggcgcgcggcucccuggaggagcagcuccugcaggagcugagcucccucauccugcggaagggcgagaccaccgccgggcugggcagccccagccagcccuccagcccccaguccccgagccccaccgggcuccccacccagacgcccggcuucccgacccagccccccugcaccuccagccccccguccagccagccccugaccuga

SEQ ID NO: 26802 - RNA, 1191 nt, Artificial Sequence
  derived and/or modified sequence opt1 from ARC__Homo_sapiens__NP_056008
auggagcuggaccaccgcaccagcggcgggcuccacgccuaccccggcccgcgcgggggccagguggccaagcccaacgucauccugcagaucgggaagugccgggcggagaugcuggagcacgugcggcgcacccaccggcaccuccuggccgagguguccaagcaggucgagcgcgagcugaagggccuccaccggagcgugggcaagcuggaguccaaccuggacggguacgugcccacgagcgacucccagcgcuggaagaaguccaucaaggccugccucugccggugccaggagaccaucgccaaccuggagcgcugggucaagcgggagaugcacguguggcgcgagguguucuaccggcuggagcgcugggccgaccggcucgagagcaccggcgggaaguaccccgucggcagcgaguccgcgcgccacaccgugagcgugggggucggcggcccggaguccuacugccacgaggccgacggguacgacuacacggugagccccuacgccaucaccccgccgcccgccgcgggcgagcugcccgggcaggagcccgccgaggcccagcaguaccagcccugggugcccggcgaggacggccagcccucccccggggucgacacccagaucuucgaggacccccgggaguuccugagccaccucgaggaguaccugcgccaggugggcggguccgaggaguacuggcugagccagauccagaaccacaugaacggcccggccaagaaguggugggaguucaagcagggguccgugaagaacugggucgaguucaagaaggaguuccuccaguacagcgagggcacccugucccgggaggccauccagcgcgagcuggaccucccccagaagcagggcgagccccuggaccaguuccuguggcggaagcgcgaccucuaccagacgcuguacguggacgcggacgaggaggagaucauccaguacguggucgggacccugcagcccaagcucaagcgcuuccugcggcacccgcugcccaagacccucgagcagcugauccagcgcggcauggaggugcaggacgaccuggagcaggccgccgagcccgccgggccccaccucccgguggaggacgaggccgagacccugacgcccgcgcccaacagcgagagcgucgccuccgaccggacccagcccgaguga

SEQ ID NO: 26803 - RNA, 1272 nt, Artificial Sequence
  derived and/or modified sequence opt1 from ARCN1__Homo_sapiens__NP_001135753
augauccccgaguacugccgcgcccuggaggagaacgagaucagcgagcacugcuucgaccucaucuucgccuucgacgagaucguggcgcugggcuaccgggagaacgucaaccuggcccagauccgcaccuucaccgagauggacucccacgaggagaagguguuccgggccgugcgcgagacgcaggagcgggaggccaaggccgagaugcgccggaaggcgaaggagcuccagcaggcccgccgggacgccgagcgccaggggaagaaggccccgggcuucgggggcuucgggagcuccgcggucagcggcggcuccaccgccgccaugaucaccgagaccaucaucgagacggacaagcccaagguggcccccgcccccgcgcggccgagcgggcccuccaaggcccugaagcugggcgccaaggggaaggagguggacaacuucgucgacaagcucaagagcgagggcgagaccaucauguccagcuccauggggaagcgcaccagcgaggccaccaagaugcacgccccgcccaucaacauggaguccgugcacaugaagaucgaggagaagaucacgcugaccugcggccgggacggcgggcugcagaacauggagcuccacggcaugaucaugcugcgcaucagcgacgacaaguacgggcggauccgccugcacguggagaacgaggacaagaagggcguccagcuccagacccaccccaacguggacaagaagcuguucaccgcggagucccugaucggccucaagaaccccgagaaguccuuccccgugaacagcgacgucggggugcugaaguggcggcugcagacgaccgaggagagcuucaucccccucaccaucaacugcuggccguccgagagcggcaacgggugcgacgugaacaucgaguacgagcugcaggaggacaaccuggagcucaacgacgucgugaucaccaucccccugcccagcggcgugggggcccccgucaucggcgagaucgacggcgaguaccgccacgacucccggcgcaacacgcuggaguggugccucccggugaucgacgccaagaacaagagcgggucccuggaguucagcaucgccggccagcccaacgacuucuuccccgugcaggucuccuucgugagcaagaagaacuacugcaacauccaggugaccaaggucacccagguggacgggaacucccccguccgguucagcaccgagacgaccuuccugguggacaaguacgagauccucuga

SEQ ID NO: 26804 - RNA, 759 nt, Artificial Sequence
  derived and/or modified sequence opt1 from AREG__Homo_sapiens__NP_001648
augcgcgcgccccugcucccgcccgcccccgugguccugagccugcucauccugggcuccgggcacuacgccgccggccuggaccucaacgacaccuacagcgggaagcgggagcccuucuccggcgaccacagcgccgacggguucgaggugaccucccgcagcgagauguccagcggcuccgagaucagcccgguguccgagaugcccagcuccagcgagcccuccagcggcgccgacuacgacuacuccgaggaguacgacaacgagccccagaucccgggguacaucgucgacgacagcgugcggguggagcaggucgugaagccgccccagaacaagacggaguccgagaacaccagcgacaagcccaagcgcaagaagaagggcgggaagaacggcaagaaccggcgcaaccggaagaagaagaaccccugcaacgccgaguuccagaacuucugcauccacggggagugcaaguacaucgagcaccuggaggcggugaccugcaagugccagcaggaguacuucggcgagcgcugcggcgagaaguccaugaagacccacagcaugaucgacagcucccugagcaagaucgcccucgccgccaucgcggccuucauguccgccgucauccugacggccguggccgugaucaccguccagcugcggcgccaguacgugcggaaguacgagggggaggcggaggagcgcaagaagcuccggcaggagaacggcaacgugcacgccaucgccuga

SEQ ID NO: 26805 - RNA, 546 nt, Artificial Sequence
  derived and/or modified sequence opt1 from ARF1__Homo_sapiens__NP_001019398
augggcaacaucuucgccaaccuguucaagggccucuucgggaagaaggagaugcgcauccugaugguggggcuggacgccgcgggcaagaccaccauccucuacaagcugaagcugggggagaucgucacgaccauccccaccaucggcuucaacguggagaccguggaguacaagaacaucagcuucacggucugggacgugggcgggcaggacaagauccggccgcucuggcgccacuacuuccagaacacccagggccugaucuucguggucgacuccaacgaccgggagcgcgugaacgaggcccgggaggagcugaugcgcaugcucgccgaggacgagcugcgggacgccgugcugcucgucuucgccaacaagcaggaccugcccaacgcgaugaacgccgccgagaucaccgacaagcuggggcuccacagccugcgccaccggaacugguacauccaggcgaccugcgccacguccggcgacgggcuguacgagggccucgacuggcugagcaaccagcugcgcaaccagaaguga

SEQ ID NO: 26806 - RNA, 546 nt, Artificial Sequence
  derived and/or modified sequence opt1 from ARF3__Homo_sapiens__NP_001650
augggcaacaucuucgggaaccugcucaagagccugaucggcaagaaggagaugcgcauccugaugguggggcucgacgccgccggcaagaccaccauccuguacaagcugaagcucggggagaucgucacgaccauccccaccaucggcuucaacguggagaccguggaguacaagaacaucuccuucacggucugggacgugggcgggcaggacaagauccggccgcuguggcgccacuacuuccagaacacccagggccugaucuucguggucgacagcaacgaccgggagcgcgugaacgaggcgcgggaggagcucaugcgcaugcuggccgaggacgagcugcgggacgccgugcuccuggucuucgccaacaagcaggaccugcccaacgccaugaacgcggccgagaucaccgacaagcucgggcugcacucccugcgccaccggaacugguacauccaggcgaccugcgccacgagcggcgacgggcucuacgagggccuggacuggcuggccaaccagcucaagaacaagaaguga

SEQ ID NO: 26807 - RNA, 543 nt, Artificial Sequence
  derived and/or modified sequence opt1 from ARF4__Homo_sapiens__NP_001651
augggccugaccaucagcucccucuucagccgccuguucgggaagaagcagaugcggauccugauggugggccucgacgccgccgggaagaccacgauccuguacaagcugaagcucggcgagaucgucaccaccauccccaccaucggguucaacguggagacgguggaguacaagaacaucugcuucaccgucugggacgugggcggccaggaccgcauccggccgcuguggaagcacuacuuccagaacacccaggggcugaucuucguggucgacuccaacgaccgcgagcggauccaggagguggcggacgagcuccagaagaugcugcugguggacgagcuccgcgacgccguccugcuccuguucgccaacaagcaggaccugcccaacgccauggccaucagcgagaugaccgacaagcugggccuccagucccugcggaaccgcacgugguacgugcaggcgaccugcgccacccaggggaccggccuguacgaggggcucgacuggcugagcaacgagcuguccaagcgguga

SEQ ID NO: 26808 - RNA, 528 nt, Artificial Sequence
  derived and/or modified sequence opt1 from ARF6__Homo_sapiens__NP_001654
augggcaaggugcugagcaagaucuucgggaacaaggagaugcgcauccucaugcugggccuggacgccgccgggaagaccaccauccucuacaagcugaagcugggccaguccgucacgaccauccccaccgugggguucaacguggagaccgucacguacaagaacgugaaguucaacgugugggacgucggcggccaggacaagauccggccgcucuggcgccacuacuacaccgggacccagggccugaucuucgugguggacugcgcggaccgggaccgcaucgacgaggcccggcaggagcugcaccgcaucaucaacgaccgggagaugcgcgacgccaucauccucaucuucgccaacaagcaggaccugcccgacgccaugaagccccacgagauccaggagaagcuggggcucacccggauccgcgaccggaacugguacguccagcccagcugcgcgacguccggcgacgggcuguacgagggccugaccuggcucaccagcaacuacaaguccuga

SEQ ID NO: 26809 - RNA, 1212 nt, Artificial Sequence
  derived and/or modified sequence opt1 from ARFGAP1__Homo_sapiens__NP_001268411
auggccagcccccgcacccggaaggugcugaaggagguccgcgugcaggacgagaacaacgugugcuucgagugcggcgccuucaacccgcagugggucuccgugaccuacgggaucuggaucugccucgagugcagcggccggcaccgcgggcugggcgugcaccuguccuucguccggagcgugacgauggacaaguggaaggacaucgagcucgagaagaugaaggccgggggcaacgccaaguuccgcgaguuccuggagucccaggaggacuacgaccccugcuggagccugcaggagaaguacaacucccgggccgccgcccucuuccgcgacaagguggucgcgcuggccgagggccgggaguggagccuggaguccagccccgcccagaacuggacgcccccgcagccccgcacccuccccuccauggugcaccgggugagcgggcagccccaguccgucaccgccagcuccgacaaggcguucgaggacuggcugaacgacgaccugggcagcuaccagggggcccagggcaaccgcuacgugggguucggcaacaccccgccgccccagaagaaggaggacgacuuccucaacaacgccauguccagccuguacuccggcuggagcagcuucaccaccggggccucccgguucgccagcgcggccaaggagggcgccaccaaguucgggucccaggccagccagaaggccuccgagcugggccacagccucaacgagaacgugcugaagcccgcgcaggagaaggucaaggagggcaagaucuucgacgacguguccagcggggugucccagcuggccagcaagugccagcgccggcucugcugccaccagucccacugcagcgccggccaccuggggcgcgccuucugccccgucuccuggcacgaggcccugugcggccagacggggcgggaggagcaggcgagccuccugccgcccaagcacguggugggcgcccuggaggucugcgcccgcggcugcccccggugccacgugccccacacccccgggaccgccgccgaguggcccggccgccucugccugucccgggagagcgugguccgcgacgggggcaccuccccgcccuucuuccgcgggaagcagcgggcgcccuggacggcgccccgccgggccaccgugauccgcaccgccgucuggaccacgagcaagaccgcgaccuga

SEQ ID NO: 26810 - RNA, 1482 nt, Artificial Sequence
  derived and/or modified sequence opt1 from ARFGAP2__Homo_sapiens__NP_001229761
auggccgccgagcccaacaagaccgagauccagacccuguucaagcgccuccgggcggugccgacgaacaaggccugcuucgacugcggcgccaagaaccccagcugggccuccaucaccuacggggucuuccugugcaucgacugcagcggcgugcaccgcucccugggggugcaccucagcuucauccgguccaccgagcuggacagcaacuggaacugguuccagcugcgcugcaugcaggucggcgggaacgccaacgcgaccgccuucuuccggcagcacggcugcacggccaacgacgccaacaccaaguacaacucccgcgcggcccagauguaccgggagaagauccgccagcucggcagcgccgcccuggcccggcacgggaccgacccgcccgcgugggacgcccccgccaccgagcccuccggcacgcagcagcccgcccccagcaccgaguccagcgggcuggcccagccggagcacggccccaacaccgaccuccuggggaccucccccaaggcgagccuggagcucaaguccagcaucaucggcaagaagaagcccgccgccgccaagaagggccugggggccaagaagggccugggggcgcagaagguguccagccaguccuucagcgagaucgagcgccaggcccagguggccgagaagcuccgggagcagcaggccgccgacgcgaagaagcaggccgaggagagcauggucgccuccaugcgccuggccuaccaggagcugcagaucgaccggaagaaggaggagaagaagcuccagaaccuggagggcaagaagcgcgagcaggcggagcggcugggcauggggcucgugagccgcuccagcgugucccacagcguccuguccgagaugcaggucaucgagcaggagacgccggugagcgccaaguccagccggucccagcuggaccucuucgacgacgugggcaccuucgccagcgggccgcccaaguacaaggacaaccccuucucccugggcgagagcuucgggucccgcugggacaccgacgccgccuggggcauggaccggguggaggagaaggagcccgaggugaccaucagcuccauccgccccaucagcgagcgggcgacgaaccgccgcgaggucgagucccggagcagcggccuggaguccagcgaggcccgccagaaguucgccggggccaaggccaucuccagcgacauguucuucggccgggagguggacgcggaguacgaggcccgcucccggcuccagcagcugagcggguccagcgccaucuccagcuccgaccuguucggcgacauggacggggcccacggcgccggcagcgugucccucgggaacguccugcccaccgcggacaucgcccaguucaagcagggcgucaagagcguggccgggaagauggccgugcuggcgaacggcgugaugaacucccuccaggaccgcuacgggagcuacuga

SEQ ID NO: 26811 - RNA, 1419 nt, Artificial Sequence
  derived and/or modified sequence opt1 from ARFGAP3__Homo_sapiens__NP_001135765
augggcgaccccagcaagcaggacauccugaccaucuucaagcgccuccgguccgugccgaccaacaaggucugcuucgacugcggggccaagaaccccagcugggccuccaucacguacggcguguuccugugcaucgacugcagcgggucccaccgcagccugggcgugcaccucuccuucauccggagcaccgagcuggacuccaacuggagcugguuccagcugcgcugcaugcaggucgggggcaacgcguccgcccucuggcuggacagcugcguggugccgccccugagcccgccgcccaaggaggaggacuucuucgccucccacgucucccccgaggugagcgacaccgccugggccuccgcgaucgccgagcccagcucccucaccagccggcccguggagacgacccuggagaacaacgagggcgggcaggagcagggccccagcgucgaggggcugaacgugcccaccaaggccacccucgagguguccagcaucaucaagaagaagcccaaccaggccaagaagggccugggggcgaagaagggcucccugggcgcccagaagcucgccaacacgugcuucaacgagaucgagaagcaggcccaggccgcggacaagaugaaggagcaggaggaccuggccaaggucgugagcaaggaggaguccaucgugagcucccugcgccucgccuacaaggaccuggagauccagaugaagaaggacgagaagaugaacaucagcgggaagaagaacgucgacuccgaccggcugggcaugggguucggcaacugccgcagcgugaucucccacagcgugaccuccgacaugcagaccaucgagcaggagagccccaucauggccaagccccggaagaaguacaacgacgacuccgacgacagcuacuucaccuccagcuccagcuacuucgacgagcccgucgagcuccgcagcuccagcuucuccagcugggacgacuccagcgacuccuacuggaagaaggagacgagcaaggacaccgagaccgugcugaagaccacgggcuacuccgaccggccgaccgcccgccggaagcccgacuacgagcccguggagaacaccgacgaggcgcagaagaaguucgggaacgucaaggccaucagcuccgacauguacuucggccgccagagccaggccgacuacgagacccgggcccgccuggagcggcucuccgccagcuccagcaucuccagcgcggaccuguucgaggagccccgcaagcagccggccgggaacuacagccuguccagcgugcuccccaacgcccccgacauggcccaguucaagcagggcgugcgguccgucgccgggaagcugagcguguucgcgaacggcgucgugacguccauccaggaccgcuacggcagcuga

SEQ ID NO: 26812 - RNA, 5550 nt, Artificial Sequence
  derived and/or modified sequence opt1 from ARFGEF1__Homo_sapiens__NP_006412
auguacgagggcaagaagaccaagaacauguuccucacccgcgcccucgagaagauccuggccgacaaggaggugaagaaggcgcaccacucccagcugcggaaggccugcgaggucgcccucgaggagaucaaggccgagacggagaagcagagcccgccccacggggaggccaaggccggcagcuccacccugccgcccgugaaguccaagaccaacuucaucgaggccgacaaguacuuccugcccuucgagcucgccugccaguccaagugcccccgcaucgugagcaccucccuggacugccugcagaagcucaucgccuacgggcaccugacgggcaacgcgcccgacagcaccacccccgggaagaagcugaucgaccggaucaucgagaccaucugcggcugcuuccagggcccccagacggacgaggggguccagcuccagaucaucaaggcccugcugaccgccgugaccucccagcacaucgagauccacgagggcaccgugcuccaggccguccgcacgugcuacaacaucuaccuggccagcaagaaccugaucaaccagaccaccgcgaaggccacccucacgcagaugcugaacgugaucuucgcccggauggagaaccaggcccugcaggaggccaagcagauggagaaggagcgccaccggcagcaccaccaccuccugcaguccccggugagccaccacgagcccgagagcccccagcugcgcuaccugccgccccagaccgucgaccacaucagccaggagcacgagggggaccuggaccugcacaccaacgacguggacaagucccuccaggacgacaccgagcccgagaacggcagcgacaucuccagcgcggagaacgagcagacggaggccgaccaggccaccgccgccgagacccuguccaagaacgaggugcuguacgacggggagaaccacgacugcgaggagaagccccaggacaucguccagaacaucguggaggagauggugaacaucgucgugggcgacaugggcgaggggaccacgaucaacgcgagcgccgacggcaacaucgggaccaucgaggacggcagcgacuccgagaacauccaggccaacggcauccccgggacccccaucagcguggccuacacccccucccuccccgacgaccggcugagcgucuccagcaacgacacgcaggaguccggcaacagcuccgggcccagcccgggcgccaaguucucccacauccugcagaaggacgcguuccucguguuccgcagccugugcaagcuguccaugaagccccucagcgacgggccgcccgacccgaagucccacgagcugcggagcaagauccugucccuccagcugcugcucagcauccugcagaacgccggccccaucuuccgcaccaacgagauguucaucaacgccaucaagcaguaccugugcguggcccucuccaagaacggcgucagcagcgugcccgagguguucgagcugucccugagcaucuuccucacccugcuguccaacuucaagacccaccugaagaugcagaucgaggucuucuucaaggagaucuuccucuacauccuggagacgagcaccuccagcuucgaccacaaguggauggugauccagacccugacccggaucugcgcggacgcccaguccgucguggacaucuacgugaacuacgacugcgaccucaacgccgccaacaucuucgagcgccuggucaacgaccugagcaagaucgcccaggggcggggcucccaggagcucgggaugagcaacgugcaggagcugucccugcgcaagaagggccucgagugccuggugagcauccugaagugcauggucgagugguccaaggaccaguacgugaaccccaacagccagacgacccucgggcaggagaagccguccgagcaggagaugagcgagaucaagcaccccgagaccaucaaccgguacggcucccugaacagccuggagagcaccuccagcuccggcaucgggagcuacuccacccagaugagcggcacggacaaccccgagcaguucgaggugcucaagcagcagaaggagaucaucgagcaggggaucgaccuguucaacaagaagccgaagcgcggcauccaguaccugcaggagcaggggaugcucggcaccacccccgaggacaucgcgcaguuccugcaccaggaggagcggcuggacuccacccaggucggcgaguuccucggggacaacgacaaguucaacaaggaggugauguacgccuacguggaccagcacgacuucagcggcaaggacuucgucuccgcccugcgcauguuccuggagggguuccggcuccccggcgaggcccagaagaucgaccgccugauggagaaguucgccgcgcgcuaccuggagugcaaccagggccagacccucuucgccagcgccgacaccgccuacgugcuggccuacuccaucaucaugcugaccaccgaccuccacagcccccaggugaagaacaagaugacgaaggagcaguacaucaagaugaaccgggggaucaacgacuccaaggaccugccggaggaguaccugagcgcgaucuacaacgagaucgccggcaagaagaucuccaugaaggagaccaaggagcucaccauccccaccaagagcuccaagcagaacgucgccagcgagaagcagcgccggcugcuguacaaccucgagauggagcagauggccaagacggcgaaggcccugauggaggccgugucccacgugcaggcccccuucaccagcgccacccaccuggagcacguccgccccauguucaagcucgcguggaccccguuccuggccgccuucagcguggggcugcaggacugcgacgacacggagguggccucccucugccuggagggcauccggugcgccauccgcaucgcgugcaucuucagcauccagcuggagcgggacgccuacguccaggcccucgcccgcuucacccugcugaccguguccagcgggaucaccgagaugaagcagaagaacaucgacacgaucaagacccucaucaccguggcccacaccgacggcaacuaccugggcaacuccuggcacgagauccugaagugcaucagccagcucgagcuggcgcagcugaucgggacgggcgucaagccccgguacaucuccgggaccgugcgcggccgggaggggagccucaccggcaccaaggaccaggcccccgacgaguucgugggccuggggcuggucggcgggaacguggacuggaagcagaucgccuccauccaggagagcaucggcgagacguccagccaguccguggucguggccguggaccgcaucuucaccgggagcacccggcucgacggcaacgcgaucgucgacuucgugcgcuggcugugcgccguguccauggacgagcugcucagcaccacgcacccccggauguucucccugcagaagaucgucgagaucagcuacuacaacaugggccgcauccggcugcaguggucccgcaucugggaggugaucggggaccacuucaacaaggugggcugcaacccgaacgaggacgucgccaucuucgccguggacagccuccggcagcugagcaugaaguuccuggagaagggggagcucgccaacuuccgcuuccagaaggacuuccugcgccccuucgagcacaucaugaagcggaaccgcucccccaccauccgggacauggugguccgcugcaucgcgcagauggugaacagccaggccgccaacauccgguccggcuggaagaacaucuucagcguguuccaccuggccgccuccgaccaggacgagagcaucgucgagcucgcguuccagaccaccgggcacaucgugacgcugguguucgagaagcacuuccccgccaccaucgacuccuuccaggacgccgucaagugccugagcgaguucgccugcaacgccgcguucccggacaccuccauggaggccauccgccucauccggcacugcgccaaguacgugagcgaccgcccccaggccuucaaggaguacaccuccgacgacaugaacguggcccccgaggaccgggucugggugcgcggcugguuccccauccuguucgagcugagcugcaucaucaaccggugcaagcucgacguccgcacccggggccugacggugauguucgagaucaugaagaccuacgggcacaccuacgagaagcacugguggcaggaccuguuccgcaucguguuccggaucuucgacaacaugaagcucccggagcagcagaccgagaaggcggaguggaugacgacgaccugcaaccacgcccuguacgccaucugcgacgucuucacccaguaccuggaggugcucuccgacgugcugcuggacgacaucuucgcccagcucuacuggugcguccagcaggacaacgagcagcuggcgcgcagcggcacgaacugccuggagaacguggugauccucaacggggagaaguucacccuggagaucugggacaagaccugcaacugcacccuggacaucuucaagacgaccaucccccacgcccuccugaccuggcggcccaacuccggcgagaccgcgcccccgccgcccagccccgucuccgagaagccccuggacacgaucagccagaaguccguggacauccacgacagcauccagccccgcagcguggacaaccggccccaggcgccccucgucuccgccagcgccgugaacgaggagguguccaagaucaagagcaccgccaaguuccccgagcagaagcuguucgccgcccugcugaucaagugcgucgugcagcucgagcugauccagaccaucgacaacaucguguucuuccccgccaccuccaagaaggaggacgcggagaaccuggccgccgcccagcgcgacgccgucgacuucgacgugcggguggacacgcaggaccagggcauguaccgcuuccucaccagccagcagcuguucaagcugcucgacugccugcuggagucccaccgcuucgcgaaggccuucaacagcaacaacgagcagcggaccgcccucuggaaggccggguucaagggcaaguccaagcccaaccugcugaagcaggagaccagcucccucgcgugcgggcugcgcauccuguuccggauguacauggacgagagccgcgucuccgccugggaggaggugcagcagcggcuccugaacgugugcagcgaggcccuguccuacuuccucacgcugaccagcgagucccaccgcgaggccuggaccaaccugcuccugcuguuccucaccaagguccugaagaucagcgacaaccgguucaaggcccacgcguccuucuacuacccgcugcucugcgagaucaugcaguucgaccugauccccgagcugcgcgccgugcuccggcgcuucuuccugcggaucggcguggucuuccagaucagccagccgcccgagcaggagcuggggaucaacaagcaguga

SEQ ID NO: 26813 - RNA, 5358 nt, Artificial Sequence
  derived and/or modified sequence opt1 from ARFGEF2__Homo_sapiens__NP_006411
augcaggagagccagaccaaguccauguucgugagccgcgcccuggagaagauccucgccgacaaggaggucaagcggccccagcacucccagcugcgccgggcgugccagguggcccuggacgagaucaaggccgagaucgagaagcagcgccucggcaccgccgccccgcccaaggcgaacuucaucgaggccgacaaguacuuccugcccuucgagcuggccugccagagcaaguccccccggguggucagcacgucccucgacugccugcagaagcugaucgccuacgggcacaucaccggcaacgcgccggacagcggggcccccggcaagcgccucaucgaccggaucguggagaccaucugcuccugcuuccaggggccccagaccgacgagggcgugcagcugcagaucaucaaggcccugcucacggccgucaccagcccccacaucgagauccacgagggcaccauccugcagaccgugcgcacgugcuacaacaucuaccuggccuccaagaaccucaucaaccagaccaccgcgaaggccacccugacgcagaugcugaacgugaucuucacccggauggagaaccagguccuccaggaggcccgcgagcuggagaagccgauccagagcaagccccagucccccgugauccaggccgccgcggugagccccaaguucguccggcugaagcacucccaggcccagagcaagccgaccacccccgagaagacggaccucaccaacggggagcacgcccgcuccgacagcggcaagguguccaccgagaacggggacgccccccgggagcgcggcagcagccuguccgggaccgacgacggcgcccaggagguggucaaggacauccuggaggacguggugacgagcgcgaucaaggaggccgccgagaagcacggccucaccgagcccgagcggguccugggggagcuggagugccaggagugcgccaucccgcccggcguggacgagaacucccagaccaacgggaucgccgacgaccgccagagccucuccagcgcggacaaccuggaguccgacgcccagggccaccagguggccgcccgguucagccacguccugcagaaggacgcguuccucguguuccgcucccugugcaagcugagcaugaagccccucggcgaggggcccccggaccccaagucccacgagcugcggagcaagguggucucccugcagcuccugcugagcgugcuccagaacgccggccccgucuuccgcacccacgagauguucaucaacgccaucaagcaguaccugugcguggcccuguccaagaacggggugagcuccguccccgacguguucgagcucagccuggccaucuuccugacgcuccuguccaacuucaagaugcaccugaagaugcagaucgagguguucuucaaggagaucuuccucaacauccuggagaccagcaccagcuccuucgagcaccgguggauggucauccagacccugacgcgcaucugcgcggacgcccagugcgugguggacaucuacgucaacuacgacugcgaccugaacgccgccaacaucuucgagcgccucgugaacgaccugagcaagaucgcccagggccgguccgggcacgagcugggcaugaccccgcuccaggagcugagccugcgcaagaagggccucgagugccugguguccauccugaagugcauggucgaguggagcaaggaccucuacgugaaccccaaccaccagaccucccuggggcaggagcggcugaccgaccaggagaucggcgacgggaagggccucgacauggcgcgccggugcagcgugacguccauggagagcaccgucuccagcgggacccagaccacggugcaggacgaccccgagcaguucgaggugaucaagcagcagaaggagaucaucgagcacggcaucgagcuguucaacaagaagcccaagcgcggcauccaguuccugcaggagcaggggaugcucggcaccuccgucgaggacaucgcccaguuccugcaccaggaggagcggcuggacagcacccaggugggggacuuccucggcgacuccgcccgcuucaacaaggaggugauguacgccuacgucgaccagcuggacuucugcgagaaggaguucgugagcgcccugcggaccuuccucgagggguuccgccugccgggcgaggcgcagaagaucgaccggcugauggagaaguucgccgcccgcuacaucgagugcaaccagggccagacccucuucgccuccgcggacacggccuacgugcuggccuacagcaucaucaugcugaccaccgaccuccacagcccccaggucaagaacaagaugaccaaggagcaguacaucaagaugaaccgggggaucaacgacuccaaggaccugcccgaggaguaccugagcuccaucuacgaggagaucgagggcaagaagaucgccaugaaggagacgaaggagcucaccaucgccaccaagagcaccaagcagaacguggcguccgagaagcagcgccggcugcuguacaaccucgagauggagcagauggccaagacggccaaggcccugauggaggccgugagccacgcgaaggccccguucaccuccgccacccaccuggaccacguccgccccauguucaagcucguguggaccccccugcuggccgccuacagcaucgggcuccagaacugcgacgacacggagguggcgucccugugccuggagggcauccggugcgccauccgcaucgccugcaucuucggcaugcagcucgagcgggacgccuacguccaggcgcuggcccgcuucagccugcucaccgccuccagcuccaucaccgagaugaagcagaagaacaucgacaccaucaagacgcugaucaccguggcccacaccgacgggaacuaccugggcaacagcuggcacgagauccucaagugcaucucccagcuggagcuggcccagcucaucgggaccggcgugaagacgcgcuaccugagcggguccggccgggagcgcgagggcagccugaaggggcacacccucgcgggcgaggaguucauggggcugggccuggggaaccucgucuccggcggcguggacaagcggcagauggccagcuuccaggagagcgugggggagaccuccagccaguccgucgugguggccgucgaccgcaucuucaccggcagcacgcggcuggacgggaacgccaucguggacuucgugcgcuggcugugcgccgucuccauggacgagcucgcgagcccccaccacccgcggauguucucccugcagaagaucguggagaucagcuacuacaacaugaaccgcauccggcugcaguggucccgcaucuggcacgugaucggcgaccacuucaacaaggucgggugcaaccccaacgaggacguggccaucuucgccguggacagccuccggcagcuguccaugaaguuccuggagaagggcgagcucgccaacuuccgcuuccagaaggacuuccugcggcccuucgagcacaucaugaagaagaaccgcagccccaccauccgggacauggccauccgcugcaucgcgcagauggucaacucccaggccgccaacauccggagcggcuggaagaacaucuucgccguguuccaccaggccgcguccgaccacgacgggaacaucguggagcuggccuuccagaccaccugccacaucgucacgaccaucuuccagcaccacuucccggccgccaucgacagcuuccaggacgcggugaagugccucuccgaguucgccugcaacgccgccuuccccgacaccagcauggaggccauccgccugauccgguucugcggcaaguacgucuccgagcgcccccgggugcugcaggaguacaccagcgacgacaugaacguggcgcccggggaccgcgucugggugcgcggcugguucccgauccucuucgagcugagcugcaucaucaaccggugcaagcuggacgugcgcacgcgggggcucaccgucauguucgagaucaugaaguccuacggccacaccuucgagaagcacugguggcaggaccuguuccgcaucguguuccggaucuucgacaacaugaagcugcccgagcagcucagcgagaaguccgaguggaugaccacgaccugcaaccacgcccuguacgccaucugcgacguguucacccaguucuacgaggcccugaacgagguccuccugagcgacguguucgcccagcugcaguggugcgugaagcaggacaacgagcagcucgcgcgcuccggcaccaacugccuggagaaccuggucaucagcaacggggagaaguucucccccgaggugugggacgagaccugcaacugcaugcucgacaucuucaagacgaccaucccccacgugcugcugaccuggcggccggucggcauggaggaggacagcuccgagaagcaccucgacguggaccuggaccgccagagccuguccagcaucgacaagaaccccuccgagcgggggcagagccagcucuccaaccccaccgacgacagcuggaagggccgccccuacgccaaccagaagcuguucgccucccugcugaucaagugcgugguccagcucgagcugauccagacgaucgacaacaucguguucuacccggccaccagcaagaaggaggacgccgagcacaugguggcggcccagcaggacacccuggacgccgacauccacaucgagaccgaggaccagggcauguacaaguacauguccagccagcaccucuucaagcugcuggacugccuccaggagagccacuccuucagcaaggccuucaacuccaacuacgagcagcggacgguccuguggcgcgcgggguucaagggcaagagcaagcccaaccugcucaagcaggagaccuccagccuggccugcugccugcggauccucuuccgcauguacguggacgagaaccggcgcgacuccugggaggagauccagcagcggcugcugaccgugugcagcgaggcccucgccuacuucaucaccgucaacuccgagagccaccgcgaggccuggacgucccugcugcuccugcugcucaccaagacccugaagaucaacgacgagaaguucaaggcgcacgccagcauguacuaccccuaccugugcgagaucaugcaguucgaccucauccccgagcugcgggccgugcugcgcaaguucuuccuccgcaucgggguggucuacaagaucuggaucccggaggagcccucccaggugcccgccgcccugagcccggugugguga

SEQ ID NO: 26814 - RNA, 6534 nt, Artificial Sequence
  derived and/or modified sequence opt1 from ARFGEF3__Homo_sapiens__NP_065073
auggaggagauccugcggaagcuccagaaggaggccagcggcuccaaguacaaggccaucaaggaguccugcaccugggcgcuggagacccucggcgggcucgacaccaucgugaagaucccgccccacgugcugcgggagaagugccugcucccccugcagcuggcccucgaguccaagaacgugaagcuggcccagcacgcccuggccgggaugcagaagcuccugagcgaggagcgcuucguguccauggagaccgacagcgacgagaagcagcugcucaaccagauccugaacgcggugaaggugacccccucccugaacgaggaccuccagguggaggucaugaaggugcugcugugcaucaccuacacgcccaccuucgaccucaacgggagcgccgugcugaagaucgccgaggucugcaucgagaccuacaucuccagcugccaccagcgguccaucaacaccgccgugcgcgcgacgcugagccagaugcucuccgaccugacccugcagcuccggcagcgccaggagaacaccaucaucgagaaccccgacgugccccaggacuucgggaaccagggcagcaccgucgagucccugugcgacgacguggugagcguccugacggugcucugcgagaagcugcaggccgccaucaacgacucccagcagcugcagcuccuguaccuggagugcauccucagcgugcuguccagcagcuccagcuccaugcaccuccaccggcgcuucaccgaccucaucuggaagaaccugugccccgcccugaucgucauccucggcaaccccauccacgacaagaccaucaccagcgcccacacguccagcaccuccaccagccuggaguccgacagcgcgucccccggggugagcgaccacggccggggguccggcugcagcugcaccgcccccgcccuguccgggcccguggcccgcacgaucuacuacaucgccgcggagcucguccggcuggugggcagcguggacuccaugaagcccguccugcagagccucuaccaccgcgugcugcuguacccgccgccccagcaccgggucgaggccaucaagaucaugaaggagauccugggcagcccccagcgccucugcgaccuggccgggcccagcagcaccgaguccgagagccggaagcgcuccaucagcaagcggaagucccaccuggaccuccugaagcugaucauggacggcaugaccgaggccugcaucaagggcggcaucgaggccugcuacgcggccgugagcugcgugugcacccuccugggcgcccuggacgagcucucccaggggaagggccugagcgaggggcagguccagcugcuccugcugcgccucgaggagcugaaggacggcgccgaguggucccgggacagcauggagaucaacgaggccgacuuccgcuggcagcggcgcgugcuguccagcgagcacacgcccugggaguccgggaacgagcgcagccucgacaucuccaucagcgugaccaccgacaccggccagacgacccuggagggcgagcuggggcagaccacccccgaggaccacuccggcaaccacaagaacagccucaagagccccgcgauccccgaggggaaggagacgcuguccaagguccuggagaccgaggccguggaccagcccgacgugguccagcggagccacaccgugcccuaccccgacaucaccaacuuccucuccguggacugccgcacgcggagcuacggcucccgcuacagcgaguccaacuucagcgucgacgaccaggaccugucccggaccgaguucgacagcugcgaccaguacuccauggccgccgagaaggacagcgggcgcuccgacgugagcgacaucggcuccgacaacugcagccuggcggacgaggagcagaccccgcgggacugccucggccaccgcucccugcggaccgccgcccugagccucaagcugcugaagaaccaggaggccgaccagcacuccgcccgccucuucauccagagccuggaggggcugcucccccggcugcugagccucuccaacguggaggaggucgacaccgcgcugcagaacuucgccagcacguucugcuccggcaugaugcacagccccggguucgacggcaacuccagccuguccuuccagaugcucaugaacgccgacagccuguacaccgccgcccacugcgcgcugcuccugaaccugaagcucucccacggggacuacuaccgcaagcggcccacccuggccccgggcgugaugaaggacuucaugaagcagguccagaccagcggcguccugaugguguucucccaggccuggaucgaggagcucuaccaccaggugcuggaccgcaacaugcugggggaggccggcuacugggggagccccgaggacaacucccucccccugaucacgaugcugaccgacaucgacggccucgagagcuccgccaucggcgggcagcugauggcgagcgccgccaccgaguccccguucgcccagagccggcgcaucgacgacuccaccgucgcgggcguggccuucgcccgguacauccugguggggugcuggaagaaccucaucgacacgcugagcacgccccugaccggccgcauggccgggagcuccaagggccucgccuucauccugggcgcggaggggaucaaggagcagaaccagaaggagcgggacgccaucugcaugagccuggacggccuccgcaaggccgcccgccuguccugcgcccugggggucgcggccaacugcgccagcgcccucgcccagauggcggccgccuccugcgugcaggaggagaaggaggagcgggaggcccaggagcccagcgacgcgaucacccaggugaagcugaaggucgagcagaagcuggagcagaucggcaaggugcaggggguguggcuccacacggcccacguccugugcauggaggccauccuguccgugggccucgagaugggcagccacaaccccgacugcuggccgcacguguuccgcgucugcgaguacguggggacccuggagcacaaccacuucuccgacggcgccagccagccgccccugaccaucucccagccccagaaggccaccgggagcgcgggccuccugggggacccggagugcgagggcuccccgcccgagcacagccccgagcagggccggucccugagcacggcccccgugguccagccccucuccauccaggaccuggugcgcgaggggagccggggccgcgccuccgacuuccgcgggggcagccugaugagcggguccagcgccgccaaggugguccucacccuguccacccaggcggaccgccuguucgaggacgccaccgacaagcucaaccugauggcccugggcggcuuccucuaccagcugaagaaggccagccagucccagcuguuccacagcgugacggacaccguggacuacucccucgccaugcccggggaggucaagagcacccaggaccggaaguccgcgcugcaccuguuccgccugggcaacgccaugcuccggaucgugcgcagcaaggcccggccccugcugcacgugaugcgcugcuggucccucgucgccccgcaccugguggaggccgcgugccacaaggagcggcacgugagccagaaggccgucuccuucauccacgacauccugaccgaggugcucacggacuggaacgagccgccccacuuccacuucaacgaggcccuguuccgccccuucgagcggaucaugcagcuggagcucugcgacgaggacgugcaggaccaggucgugaccagcaucggggagcuggucgaggugugcuccacccagauccagagcggcuggcgcccccuguucuccgcccucgagaccgugcacggcgggaacaagagcgagaugaaggaguaccuggucggcgacuacuccauggggaagggccaggcgcccguguucgacguguucgaggccuuccugaacacggacaacauccaggucuucgccaacgccgccaccagcuacaucaugugccucaugaaguucgugaaggggcugggcgagguggacugcaaggagaucggcgacugcgcgcccgcccccggggccccgagcaccgaccugugccuccccgcccuggacuaccugcggcgcugcucccagcuccuggccaagaucuacaagaugccccugaagccgaucuuccucagcggccggcuggcggggcugccccgccgccuccaggagcaguccgccagcuccgaggacggcaucgagagcguccuguccgacuucgacgacgacaccgggcugaucgagguguggaucauccuccuggagcagcugacggccgccgugagcaacugcccccggcagcaccagcccccgacccucgaccugcuguucgagcuccugcgcgacgucaccaagacccccggccccggcuucgggaucuacgccguggugcaccuccugcugcccgucauguccguguggcugcggcgcagccacaaggaccacuccuacugggacauggcgagcgccaacuucaagcacgccaucggccuguccugcgagcugguggucgagcacauccagagcuuccugcacuccgacauccgguacgagagcaugaucaacacgaugcucaaggaccuguucgagcugcucguggccugcguggcgaagccgaccgagaccaucucccgcgucgggugcagcugcauccgguacgugcuggugaccgccggccccgucuucaccgaggagauguggcgccuggccugcugcgcccuccaggacgccuucuccgcgacgcugaagcccgugaaggaccugcucgggugcuuccacagcggcaccgagagcuucuccggcgaggggugccaggugcgggucgccgcccccagcuccagcccguccgccgaggccgaguacuggcgcauccgggcgauggcccagcaggucuucaugcuggacacccagugcagccccaagacccccaacaacuucgaccacgcccaguccugccagcugaucaucgagcugccgcccgacgagaagcccaacggccacacgaagaaguccguguccuuccgcgagaucgucgugagccugcugucccaccaggugcuccugcagaaccuguacgacauccuccuggaggaguucgucaaggggcccagccccggcgaggagaagaccauccaggugcccgaggccaagcuggccggcuuccuccgguacaucuccaugcagaaccuggcggugaucuucgaccugcuccuggacagcuaccgcaccgcccgggaguucgacaccucccccgggcugaagugccuccugaagaaggucagcggcaucgggggcgccgccaaccuguaccgccaguccgcgaugagcuucaacaucuacuuccacgcccucgugugcgccgugcugacgaaccaggagaccaucaccgccgagcaggucaagaaggugcuguucgaggacgacgagcggagcaccgacuccagccagcagugcuccagcgaggacgaggacaucuucgaggagacggcccaggugagcccgccccgcgggaaggagaagcggcaguggcgcgcgcgcaugccgcuccugagcguccagcccguguccaacgccgacuggguguggcuggucaagcggcuccacaagcugugcauggagcugugcaacaacuacauccagaugcaccucgaccuggagaacugcauggaggagccgcccaucuucaagggcgacccguucuucauccugcccagcuuccaguccgagagcuccacccccagcaccggcggguucuccggcaaggagaccccgagcgaggacgaccgcucccagagccgggagcacaugggggagucccucagccugaaggccggcgggggcgaccugcuccugccgcccucccccaagguggagaagaaggacccgagccgcaagaaggaguggugggagaacgccggcaacaagaucuacacgauggccgcggacaagaccaucagcaagcugaugaccgaguacaagaagcggaagcagcagcacaaccucuccgccuuccccaaggaggugaaggucgagaagaagggggagccccugggcccccgcgggcaggacagcccgcugcuccagcggccccagcaccugauggaccagggccagaugcgccacuccuucagcgccgggcccgagcugcuccggcaggacaagcgcccccgguccggcagcaccggcuccagccuguccgugagcgugcgcgacgccgaggcccagauccaggcguggacgaacaugguccugaccgugcugaaccagauccagauccucccggaccagaccuucaccgcccugcagcccgccgucuuccccugcaucucccagcugacgugccacgugaccgacauccgggugcgccaggccguccgggaguggcucgggcgcgugggccggguguacgacaucaucgucuga

SEQ ID NO: 26815 - RNA, 1122 nt, Artificial Sequence
  derived and/or modified sequence opt1 from ARFIP1__Homo_sapiens__NP_001020766
auggcccaggagagccccaagaacuccgccgcggagaucccggugaccagcaacggcgaggucgacgacucccgcgagcacagcuucaaccgggaccugaagcacucccuccccagcgggcugggccuguccgagacccagaucacgagccacggguucgacaacaccaaggagggcgugaucgaggccggggccuuccagggcucccccgcgcccccgcuccccagcgugaugucccccagccgcgucgccgccucccggcuggcccagcagggcagcgaccugaucgugcccgccgggggccagcgcacccagaccaaguccgggccggugauccucgccgacgagaucaagaaccccgcgauggagaagcuggagcugguccggaaguggagccucaacacguacaagugcacccgccagaucaucuccgagaagcugggccgggggagccgcaccguggaccuggagcucgaggcccagaucgacauccugcgggacaacaagaagaaguacgagaacauccugaagcucgcccagacccuguccacgcagcuguuccagauggugcacacccagcgccagcucggcgacgccuucgccgaccugagccucaagagccuggagcugcacgaggaguucggcuacaacgcggacacccagaagcugcucgccaagaacggggagacccugcugggcgccaucaacuucuucaucgccuccgucaacacgcucgugaacaagaccaucgaggacacccugaugaccgugaagcaguacgagagcgcccggaucgaguacgacgcguaccgcacggaccuggaggagcucaaccuggggccccgggacgccaacacccugcccaagaucgagcagucccagcaccucuuccaggcccacaaggagaaguacgacaagaugcgcaacgacgucagcgugaagcugaaguuccuggaggagaacaaggugaagguccuccacaaccagcuggugcuguuccacaacgccaucgccgcguacuucgccggcaaccagaagcagcucgagcagacccugaagcaguuccacaucaagcugaagaccccgggcguggacgcccccuccuggcucgaggagcaguga

SEQ ID NO: 26816 - RNA, 522 nt, Artificial Sequence
  derived and/or modified sequence opt1 from ARFRP1__Homo_sapiens__NP_001128230
auguacacccugcucagcggccuguacaaguacauguuccagaaggacgaguacugcauccugauccucgggcuggacaacgccggcaagaccacguuccuggagcaguccaagacccgcuucaacaagaacuacaaggggaugagccucuccaagaucaccaccacggugggccugaacaucgggaccgucgacgugggcaaggcccggcugauguucugggaccucggcgggcaggaggagcugcagagccugugggacaaguacuacgcggagugccacggcgugaucuacgucaucgacuccaccgacgaggagcgccucgccgagagcaagcaggccuucgagaagguggugaccuccgaggcccugugcgggguccccgugcuggugcucgccaacaagcaggacgucgagacgugccugagcaucccggacaucaagaccgcguucuccgacugcaccagcaagaucggccggcgcgacugccugacccaggccugcuccgcccucacgggguga

SEQ ID NO: 26817 - RNA, 969 nt, Artificial Sequence
  derived and/or modified sequence opt1 from ARG1__Homo_sapiens__NP_000036
augagcgccaagucccgcaccaucggcaucaucggggcccccuucagcaagggccagccgcgcgggggcguggaggaggggcccaccguccugcggaaggcgggccuccuggagaagcugaaggagcaggagugcgacgugaaggacuacggcgaccuccccuucgccgacauccccaacgacuccccguuccagaucgugaagaacccccggagcgucgggaaggccuccgagcagcuggccggcaagguggccgaggugaagaagaacgggcgcaucagccugguccucggcggggaccacucccuggcgaucggcagcaucuccggccacgcccgggugcaccccgaccugggggugaucugggucgacgcccacacggacaucaacacgccccucaccaccaccagcggcaaccugcacgggcagccgguguccuuccugcucaaggagcugaagggcaagauccccgacgugcccggcuucagcugggucacccccugcaucuccgccaaggacaucguguacaucgggcugcgcgacguggacccgggcgagcacuacauccucaagacccuggggaucaaguacuucagcaugaccgaggucgaccggcugggcaucgggaaggugauggaggagacgcucuccuaccugcugggccgcaagaagcggcccauccaccucagcuucgacguggacggccuggaccccuccuucacccccgcgaccgggaccccggucgugggcgggcugacguaccgcgagggccucuacaucaccgaggagaucuacaagaccgggcugcugagcggccucgacaucauggaggugaaccccucccugggcaagacccccgaggaggucacgcggaccgugaacaccgccguggccaucacccuggccugcuucgggcucgcccgcgagggcaaccacaagcccaucgacuaccugaacccgcccaaguga

SEQ ID NO: 26818 - RNA, 822 nt, Artificial Sequence
  derived and/or modified sequence opt1 from ARGLU1__Homo_sapiens__NP_060481
auggggcgcagccggucccgcagcuccagccgguccaagcacaccaagagcuccaagcacaacaagaagcgcagccggucccgcagccggucccgcgacaaggagcgggugcgcaagcggagcaagucccgcgagagcaagcggaaccgccggcgcgagucccggagccgcucccggagcaccaacacggccgucucccgccgggagcgcgaccgcgagcgggccagcagcccgcccgaccgcaucgacaucuucgggcggaccguguccaagcgcagcucccuggacgagaagcagaagcgggaggaggaggagaagaaggcggaguucgagcgccagcggaagauccgccagcaggagaucgaggagaagcucaucgaggaggagaccgcccggcgcguggaggagcuggucgccaagcggguggaggaggagcuggagaagcgcaaggacgagaucgagcgggaggugcuccgccgggucgaggaggccaagcgcaucauggagaagcagcugcuggaggagcucgagcggcagcgccaggccgagcuggcggcccagaaggcccgggaggaggaggagcgcgccaagcgcgaggagcuggagcggauccucgaggagaacaaccgcaagaucgcggaggcccaggccaagcuggccgaggagcagcugcggaucguggaggagcagcgcaagauccacgaggagcggaugaagcucgagcaggagcgccagcggcagcagaaggaggagcagaagaucauccugggcaagggcaagagccgccccaagcuguccuucagccucaagacccaggacuga

SEQ ID NO: 26819 - RNA, 2361 nt, Artificial Sequence
  derived and/or modified sequence opt1 from ARHGAP10__Homo_sapiens__NP_078881
augggccugcagccccucgaguucagcgacugcuaccuggacuccccgugguuccgcgagcggauccgcgcccacgaggccgagcuggagcggaccaacaaguucaucaaggagcucaucaaggacgggaagaaccugaucgcggccaccaagagccuguccguggcccagcgcaaguucgcccacagccuccgggacuucaaguucgaguucaucggcgacgccgucacggacgacgagcgcugcaucgacgcgucccugcgggaguucagcaacuuccugaagaaccucgaggagcagcgcgagaucauggcccuguccgugaccgagacccugaucaagccccucgagaaguuccggaaggagcagcugggggccgugaaggaggagaagaagaaguucgacaaggagaccgagaagaacuacagccugaucgacaagcaccucaaccuguccgccaagaagaaggacagccaccuccaggaggcggacauccaggucgagcagaaccgccagcacuucuacgagcugucccuggaguacgugugcaagcugcaggagauccaggagcggaagaaguucgaguucguggagcccaugcucagcuucuuccagggcauguucacguucuaccaccaggggcacgagcuggccaaggacuucaaccacuacaagauggagcugcagaucaacauccagaacacccgcaaccgguucgagggcacccgcuccgaggucgaggagcucaugaacaagauccggcagaaccccaaggaccacaagcgcgccagccaguucaccgccgagggcuaccuguacgugcaggagaagcggccggcccccuucggguccagcugggugaagcacuacugcauguaccgcaaggcggccaagaaguucaacaugauccccuucgagcaccgguccggcgggaagcugggcgacggggaggucuucuuccucaaggagugcacgaagcgccacaccgacagcaucgaccggcgcuucugcuucgacaucgaggccgccgaccgccccggcgugucccugaccaugcaggccuucagcgaggaggagcggaagcaguggcuggaggcgcucggcgggaaggaggcccugagccacuccuucaacaccgccaucaucccgcgccccgagggcaacgcccagcuggacaagaugggguucacgaucauccggaagugcaucagcgccguggagacccgcggcaucaacgaccagggccucuaccgggucguggggguguccagcaagguccagcgccugcuguccaugcucauggacgugaagaccugcaacgagguggaccuggagaacagcgcggacugggaggucaagaccaucacguccgcccugaagcaguaccuccggagccugcccgagccccugaugaccuacgagcuccacggcgacuucaucgugccggccaaguccgggagccccgagucccgcgugaacgccauccacuuccugguccacaagcugcccgagaagaacaaggagaugcucgacauccuggugaagcaccugaccaacgugagcaaccacuccaagcagaaccucaugaccgucgccaaccugggcguggucuucgggcccacgcugaugcggccgcaggaggagaccguggcggcccugauggaccucaaguuccagaacaucguggucgagauccugaucgagaaccacgagaagaucuuccgcaccccgcccgacaccacguuccccgagccgaccugccugagcgccuccccgcccaacgccccgccccggcagagcaagcgccagggccagcggaccaagcgccccguggcgguguacaaccucugccuggagcuggaggacggcgacaaccccuaccccuccaaggaggacacccccacgagcucccucgacagccugagcucccccagccccgucaccaccgccgugcccgggccgcccggccccgacaagaaccaccuccuggccgacgggggcuccuucggggacugggccagcaccauccccggccagacgcgguccagcauggugcaguggcugaacccccagucccccaccaccaccagcuccaacagcgccgucacgccccuguccccgggcagcucccccuuccccuucagcccgcccgcgaccguggccgacaagccgcccgaguccauccgcagccggaaggcccgcgccguguaccccugcgaggccgagcacuccagcgagcucagcuucgagaucggggcgaucuucgaggacguccagaccucccgggagcccggcuggcuggaggggacccugaacggcaagcgcgggcucaucccccagaacuacgugaagcugcuguga

SEQ ID NO: 26820 - RNA, 2505 nt, Artificial Sequence
  derived and/or modified sequence opt1 from ARHGAP11A__Homo_sapiens__NP_001273408
auggacagcuccaaccuggccgugaucuucgcccccaaccuccugcagaccagcgagggccacgagaagauguccagcaacaccgagaagaagcugcgccuccaggcggccgucgugcagacgcugaucgacuacgccuccgacaucgggcgggugccggacuucauccuggagaagauccccgccaugcucggcaucgacgggcugugcgccacccccagccuggagggcuucgaggagggggaguacgagacccccggcgaguacaagcgcaagcggcgccaguccgucggcgacuucgugagcggggcgcucaacaaguucaagccgaaccggacccccuccaucacgccccaggaggagcgcaucgcccagcugagcgagucccccgugauccugaccccgaacgccaagcggacccuccccgucgacagcucccacggcuucagcuccaagaagcgcaagagcaucaagcacaacuucaacuucgagcugcugcccuccaaccucuucaacagcuccagcacccccgugagcgugcacaucgacacguccagcgagggguccagccaguccagccuguccccgguccugaucggcgggaaccaccucaucaccgccggcgugccccggcgcagcaagcggaucgcgggcaagaaggugugccgcgucgaguccgggaaggccggcugcuucagccccaagaucucccacaaggagaaggugcggcgcagccugcggcugaaguucaaccucgggaagaacggccgcgaggugaacggcugcuccggggucaaccgguacgagagcgugggcuggcgccuggccaaccagcagucccugaagaaccggaucgagagcgugaagaccgggcuccuguucucccccgacgucgacgagaagcugccgaagaagggcagcgagaagaucuccaagagcgaggagacccuccugacgcccgagcgccugguggggaccaacuaccggaugagcuggaccggccccaacaacuccagcuuccaggagguggacgccaacgaggccuccagcauggucgagaaccucgagguggagaacucccuggagcccgacaucaugguggagaaguccccggcgaccuccugcgagcugacgcccagcaaccucaacaacaagcacaacuccaacaucaccagcagcccccugagcggcgacgagaacaacaugaccaaggagacccuggucaaggugcagaaggccuucuccgagagcggguccaaccuccacgcccugaugaaccagcgccagagcuccgucacgaacgugggcaaggugaagcugaccgagcccagcuaccucgaggacagcccggaggagaaccuguucgagaccaacgaccugaccaucgucgaguccaaggagaaguacgagcaccacacggggaagggcgagaagugcuucagcgagcgcgacuucagcccccuccagacccagaccuucaaccgggagaccacgaucaagugcuacuccacccagaugaagauggagcacgagaaggacauccacuccaacaugcccaaggacuaccugagcaagcaggaguucuccagcgacgaggagaucaagaagcagcagucccccaaggacaagcugaacaacaagcucaaggagaacgagaacaugauggaggggaaccugccgaagugcgccgcccacagcaaggacgaggcgcgcuccagcuucucccagcagagcacgugcguggugaccaaccuguccaagccccggcccaugcgcaucgccaagcagcagagccucgagaccugcgagaagaccgucuccgagagcucccagaugaccgagcaccggaaggugagcgaccacauccagugguucaacaagcugagccugaacgagccgaaccgcaucaaggugaaguccccgcugaaguuccagcggacccccguccgccagagcgugcggcgcaucaacucccuccuggaguacagccggcagcccacgggccacaagcuggccucccucggcgacaccgccagcccccuggugaaguccgucagcugcgacggggcccuguccagcugcaucgaguccgcgagcaaggacuccagcguguccugcaucaagagcggccccaaggagcagaaguccaugagcugcgaggaguccaacaucggggccaucagcaagagcuccauggagcuccccagcaaguccuuccugaagaugcgcaagcaccccgacagcgugaacgccucccugcggagcaccaccgucuacaagcagaagauccucuccgacggccaggugaaggugccgcuggacgaccugaccaaccacgacaucgucaagcccguggugaacaacaacauggggaucagcuccggcaucaacaaccgcguccuccggcgccccagcgagcggggccgcgccugguacaaggggucccccaagcacccgaucggcaagacgcagcugcugcccaccagcaagcccguggaccucuga

SEQ ID NO: 26821 - RNA, 804 nt, Artificial Sequence
  derived and/or modified sequence opt1 from ARHGAP11B__Homo_sapiens__NP_001034930
augugggaccagcgccuggugaagcucgcccugcugcagcaccuccgggccuucuacggcaucaaggucaagggggugcgcggccagugcgaccggcgccggcacgagaccgcggccaccgagaucgggggcaagaucuucggggugcccuucaacgcccugccgcacagcgccguccccgaguacggccacauccccuccuuccugguggacgccugcacgagccucgaggagcacauccacaccgagggccuguuccgcaaguccgggagcgugauccggcugaaggcgcucaagaacaaggucgaccacggcgaggggugccuguccagcgcgcccccgugcgacaucgccggccugcucaagcaguucuuccgcgagcugcccgagcccauccugcccgccgaccuccacgaggcccugcugaaggcccagcagcucgggaccgaggagaagaacaaggccauccugcugcucuccugccugcuggccgaccacaccgugcacgugcuccgguacuucuucaacuuccugcgcaacgucagccugcgguccagcgagaacaagauggacuccagcaaccucgccgugaucuucgcgccgaaccugcugcagacguccgagggccacgagaagaugagcuccaacgccgagaagaagggcguguaccagacccucagcuggaagcgcuaccagcccugcuggguccugaugguguccgugcugcuccaccacuggaaggcccugaagaaggucaacaugaagcugcucgugaacauccgggagcgcgaggacaacguguga

SEQ ID NO: 26822 - RNA, 1428 nt, Artificial Sequence
  derived and/or modified sequence opt1 from ARHGAP15__Homo_sapiens__NP_060930
augcagaaguccaccaacagcgacaccagcguggagacgcugaacuccacccgccagggcaccggggccguccagaugcggaucaagaacgccaacagccaccacgaccgccucucccagagcaaguccaugauccugaccgacgugggcaaggugacggagcccaucagccggcaccgccggaaccacucccagcacauccugaaggacgucaucccgccccucgagcagcugaugguggagaaggagggguaccugcagaaggcgaagaucgccgacggcgggaagaagcuccgcaagaacuggagcaccuccuggaucgugcugagcucccggcgcaucgaguucuacaaggagagcaagcagcaggcccuguccaacaugaagaccggccacaagcccgagagcgucgaccucugcggcgcccacaucgagugggccaaggagaaguccagccggaagaacguguuccagaucaccacgguguccgggaacgaguuccugcugcagagcgacaucgacuucaucauccucgacugguuccacgcgaucaagaacgccaucgaccgccugcccaaggacagcuccugcccgagccggaaccuggagcuguucaagauccagcgcuccagcuccaccgagcuccugagccacuacgacuccgacaucaaggagcagaagcccgagcaccgcaagagccucauguuccggcugcaccacuccgccagcgacaccuccgacaagaaccgggucaagagccgccugaagaaguucaucacccggcgccccucccucaagacgcugcaggagaagggccugaucaaggaccagaucuucgggagccaccuccacaaggugugcgagcgggagaacuccaccgugcccugguucgucaagcagugcaucgaggccguggagaagcgcggccuggacguggacgggaucuaccgggucagcggcaaccuggcgaccauccagaagcuccgcuucaucgugaaccaggaggagaagcugaaccuggacgacucccagugggaggacauccacguggucaccggcgcccucaagauguucuuccgcgagcugccggagccccuguuccccuacagcuucuucgagcaguucguggaggccaucaagaagcaggacaacaacacgcggaucgaggccgugaagucccucguccagaagcugcccccgcccaaccgcgacaccaugaaggugcuguucgggcaccucaccaagaucguggccaaggcgagcaagaaccugaugagcacccagucccugggcaucgucuucgggcccacgcuccugcgggccgagaacgagaccggcaacauggccauccacaugguguaccagaaccagaucgccgagcugaugcucagcgaguacuccaagaucuucggcagcgaggaggacuga

SEQ ID NO: 26823 - RNA, 1992 nt, Artificial Sequence
  derived and/or modified sequence opt1 from ARHGAP18__Homo_sapiens__NP_277050
augagcuggcuguccagcucccagggcgugguccucaccgccuaccaccccagcgggaaggaccagaccgugggcaacucccacgccaaggcgggggaggaggccacgagcucccgccgguacggccaguacaccaugaaccaggagagcaccaccaucaaggugauggagaagccgcccuucgaccgcuccaucagccaggacucccuggacgagcugagcauggaggacuacuggaucgagcucgagaacaucaagaaguccagcgagaacucccaggaggaccaggaggucgugguggucaaggagcccgacgagggggagcuggaggaggaguggcugaaggaggccggccucagcaaccuguucggcgaguccgccggggacccccaggagagcaucguguuccuguccacgcucacccggacccaggccgcggccgugcagaagcgcgucgagaccgugagccagacgcugcggaagaagaacaagcaguaccagaucccggacgugcgcgacaucuucgcccagcagcgggagagcaaggagaccgcccccggcgggaccgagucccagagccugcgcaccaacgagaacaaguaccagggccgggacgacgaggcguccaaccucgucggggaggagaagcugaucccgcccgaggagacgcccgcccccgagaccgacaucaaccuggaggugagcuucgccgagcaggcccucaaccagaaggaguccagcaaggagaagauccagaaguccaagggcgacgacgccacccugcccagcuuccgccugcccaaggacaagaccggcacgacccggaucggggaccucgcgccgcaggacaugaagaaggugugccaccuggcccugaucgagcucaccgcccuguacgacguccugggcaucgagcucaagcagcagaaggccgugaagaucaagaccaaggacuccgggcuguucugcgugccccugacggcccuccuggagcaggaccagcgcaagguccccggcaugcggaucccccugaucuuccagaagcucaucagccgcaucgaggagcggggccuggagaccgaggggcugcuccgcaucccgggcgcggccauccggaucaagaaccugugccaggagcuggaggccaaguucuacgaggggaccuucaacugggaguccgugaagcagcacgacgccgccagccuccugaagcuguucauccgcgagcucccccagccccugcuguccguggaguaccucaaggcguuccaggccguccagaaccugcccaccaagaagcagcagcugcaggcccucaaccugcuggugauccuccugccggacgccaaccgggacacgcugaaggcccugcucgaguuccugcagcgcgugaucgacaacaaggagaagaacaagaugaccgucaugaacguggcgauggucauggcccccaaccuguucaugugccacgcccucggccucaagagcuccgagcagcgggaguucgugauggccgcggggaccgccaacaccaugcaccuccugaucaaguaccagaagcugcuguggacgauccccaaguucaucgugaaccagguccgcaagcagaacaccgagaaccacaagaaggacaagcgcgccaugaagaagcugcugaagaagauggccuacgaccgggagaaguacgagaagcaggacaagagcaccaacgacgccgacgugccccagggcgugauccgcguccaggcgccgcaccuguccaaggugagcauggccauccagcucaccgaggagcugaaggccuccgacgugcuggcccgguuccucagccaggagagcggcgucgcccagacgcugaagaagggggagguguuccuguacgagaucggcgggaacaucggcgagcgcugccucgacgacgacaccuacaugaaggaccuguaccagcugaaccccaacgcggagugggugaucaaguccaagccccucuga

SEQ ID NO: 26824 - RNA, 1320 nt, Artificial Sequence
  derived and/or modified sequence opt1 from ARHGAP1__Homo_sapiens__XP_011518397
auggacccccugagcgagcuccaggacgaccugacccuggacgacaccuccgaggcccucaaccagcugaagcuggccagcaucgacgagaagaacuggccguccgacgagaugcccgacuuccccaagagcgacgacuccaagagcuccagccccgagcucgugacgcaccugaagugggacgacccguacuacgacaucgcgcgccaccagaucgucgagguggccggcgacgacaaguacgggcggaagaucaucguguucuccgccugccgcaugccgcccagccaccagcuggaccacuccaagcuccugggcuaccugaagcacacccucgaccaguacgucgagagcgacuacacccugcuguaccuccaccacgggcugaccuccgacaacaagcccagccuguccuggcuccgggacgccuaccgcgaguucgaccggaaguacaagaagaacaucaaggcccuguacaucgugcaccccacgauguucaucaagacccugcucauccuguucaagccccugaucagcuucaaguucggccagaagaucuucuacgugaacuaccucuccgagcugagcgagcacgucaagcuggagcagcucgggaucccccgccaggugcugaaguacgacgacuuccugaaguccacccagaagucccccgcgaccgccccgaagcccaugccgccccggccgccccuccccaaccagcaguucggcgugagccugcagcaccuccaggagaagaaccccgagcaggagcccauccccaucguccuccgcgagacgguggccuaccugcaggcccacgcgcugaccaccgagggcaucuuccggcgcagcgccaacacccaggugguccgggaggugcagcagaaguacaacauggggcuccccguggacuucgaccaguacaacgagcugcaccuccccgccgucauccugaagacguuccugcgcgagcugccggagccccuccugaccuucgaccuguacccccacguggugggcuuccucaacaucgacgagagccagcggguccccgccacccuccaggugcugcagacccugccggaggagaacuaccaggugcugcgcuuccugacggccuuccugguccagaucuccgcgcacagcgaccagaacaagaugaccaacaccaaccucgccgugguguucgggcccaaccugcugugggccaaggacgccgccaucacccucaaggcgaucaaccccaucaacacguucaccaaguuccugcuggaccaccagggcgagcuguucccgucccccgaccccagcgggcuguga

SEQ ID NO: 26825 - RNA, 3507 nt, Artificial Sequence
  derived and/or modified sequence opt1 from ARHGAP20__Homo_sapiens__NP_001245344
augagcgcccgcgagcggcagcccgcccugaagaagaagaugaagacccucgcggagcgccggcgcuccgccccgagccugauccuggacaaggcccuccagaagcggcccaccacgcgcgacucccccagcgccuccguggacacgugcaccuuccugagcucccuggucugcagcaaccggacccuccugaucgacggccgcgccgagcugaagcgggggcuccagcgccaggagcggcaccuguuccuguucaacgaccucuucgugguggcgaagaucaaguacaacaacaacuucaagaucaagaacaagaucaagcugaccgacauguggaccgccuccugcgucgacgaggugggcgaggggaacaccaacgccaugaaguccuucgugcugggcuggcccaccgucaacuucguggccacguucagcagcccggagcagaaggacaaguggcucucccugcugcagcgcuacaucaaccucgagaaggagaaggacuaccccaagagcaucccccugaagaucuucgcgaaggacaucgggaacugcgccuacuccaagaccaucaccgugaugaacagcgacaccgccaacgaggucaucaacaugucccugcccaugcucggcaucacgggcagcgagcgggacuaccagcugugggugaacuccgggaaggaggaggccccguacccccugaucggccacgaguaccccuacgggaucaagaugagccaccuccgcgacagcgcccugcugacccccggcuccaaggacagcaccaccccguucaaccuccaggagcccuuccugauggagcagcugccccgggagaugcagugccaguucauccucaagcccucccgccuggcggccgcccagcagcugagcgacuccgggcacaagacguucaagcggcgccggagcaucaucaacugggccuucuggcgcggcuccagcacccaccucgacaaccugccguccagccccaccucccccaugcccggccagcuguucgggaucagccucccgaacaucugcgagaacgacaaccugcccaagcccgugcuggacaugcuguucuuccucaaccagaagggcccccugaccaaggggaucuuccggcaguccgccaacgucaagagcugccgcgagcucaaggagaagcugaacuccggcguggaggugcaccuggacugcgagagcaucuucgucaucgcguccgugcucaaggacuuccugcgcaacaucccgggcagcaucuucuccagcgaccuguacgaccacugggugagcgucauggaccaggggaacgacgaggagaagaucaacacggugcagcggcuccuggaccagcugccccgcgccaacgugguccugcuccgguaccuguucggcgugcugcacaacaucgagcagcacuccagcuccaaccagaugaccgccuucaaccucgccgugugcgucgcccccagcauccuguggcccccggcguccagcucccccgagcuggagaacgaguucaccaagaaggugagccuccugauccaguuccugaucgagaacugccuccgcaucuucggggaggagaucaccucccuguuccgggaggucagcgugcgcugcgacacgcgggagaacgccuccgacaucagcugcuuccagcugaacgacuccagcuacgacucccucgagaacgagcugaacgaggacguggacgcccccugcagcgaccuggucaagaagcucggccaggggucccgcagcauggacagcgugcugacccuguccgacuacgaccucgaccagccggagguggagggccugcugacccucagcgacuucgaccuggcccacuccaaggacgaggacguccagaugaagcggccccuggagagcaagcccgugaacauccucguguacaccaagaucccccugcgcgaccacgcccgggcgccguccgccaugugcacgcccagcuaccuguccaccgccgccgcgaacgccgccaagagccuccgccggcaccgccggugcuccgagcccagcaucgacuaccuggacuccaagcugagcuaccuccgcgaguucuaccagaagaagcugcggaaguccagcugcgacgccauccugucccagaaggacgaggacuaccucaagcagaaccagccccugcaggaggagggcaagaccugcuucaagcagagccuggucaccgggacggacguguccaagaagaacgccaccacccagaacaccaagaagaagucccucagcggcagcgaggggaaccacgugaagcuguuccccaagagcaagcccgucgcgaucuccguggccagcuacucccccaugagcucccaggaccacagcaagaaccagcccuucgacgugaacacguccggcuacagcccgccccacaccgccgacgcccugaaggggccccgcacccaccggcgcugcuccgagcccaacaucgaggaccagaaccgcaagcucaccuaccugcggggcaucuacagcaagaagcagcacaagaccuccugcgaggccggccugcuccacggggaggaggacuaccugaagcgccacaagagccugcagauggagggccagaagcucaucaaccagucccuggucauggggaucgaggugggcaagagcuccgcgacgaaccagaacaccgagaaggugcugccgccccggcucaaccugugcccccgcaccagcuacuccagccuguccagccccgggaccagcccguccggcagcuccgucagcucccaggacagcgccuucucccagaucagcgagcacuccguguucacgcccaccgagaccagcucccccaucgacugcaccuuccaggcccagcggaagcgcgaggaccucagccccgacuucuccaacgccagccacguguccggcaugccggggcccagcuccggccaggccugcagccggcccgcguacacgaagaaggacaccauggaguggcacucccagaugcacagcgucacccugcacccgagcaccuggcugcgcaacgggguggccucccucaagaacuggagccugaagaagaaggccaaggccgcgcggcccgaggaggagaagaucgccucccccaagggcccccuggagccgccgccccacgccagcggcgugcccgaggccaacucccuccaggaggagcagaaggaccugccgcugcgcgccgcggaggggcucagccccguccaguccgcccagcggugcagcuccagccccuuccaggacuccgagcgccacugcagcucccccuucagccugguggagucccggcugaagcucugcaugaagucccacgaggagaucgagccgggcagccagagcuccagcgggagccugcccugggagcgcgccuccgccagcuccuggacgcuggaggacgccaccagccccgacuccggccccaccguggucugcgacaucgaggaccgguaccucaccaaggacaucuga

SEQ ID NO: 26826 - RNA, 5877 nt, Artificial Sequence
  derived and/or modified sequence opt1 from ARHGAP21__Homo_sapiens__XP_005252599
augauggccacccgccggaccggccuguccgagggggacggcgacaagcucaaggccugcgagguguccaagaacaaggacgggaaggagcaguccgagaccgugucccugagcgaggacgagaccuucuccuggcccggcccgaagaccgugacccugaagcgcaccagccagggguucggcuucacccuccggcacuucaucguguacccgccggaguccgccauccaguucagcuacaaggacgaggagaacggcaaccgcgggggcaagcagcggaaccgccuggagcccauggacaccaucuucgucaagcaggucaaggagggcgggccggccuucgaggccgggcugugcaccggcgaccggaucaucaaggugaacggcgaguccgucaucgggaagaccuacagccaggugaucgcccucauccagaacuccgacaccacccuggagcugagcgugaugcccaaggacgaggacauccuccagguccugcaguucaccaaggacgugaccgcccuggccuacucccaggacgccuaccucaagggcaacgaggccuacagcgggaacgcccgcaacauccccgagcccccgcccaucugcuaccccuggcugcccuccgcgccgagcgccauggcccagcccguggagaucagcccgcccgacagcucccugagcaagcagcagaccagcaccccgguccucacccagcccggccgggccuaccgcauggagauccaggugccgcccuccccgacggacguggccaagagcaacaccgcggucugcgugugcaacgaguccgugcggaccgucaucgugcccagcgagaagguggucgaccugcuguccaaccgcaacaaccacaccggccccagccaccggacggaggaggugcgcuacgggguguccgagcagaccagccucaagaccgucucccggaccacgagcccgccccuguccauccccaccacccaccugauccaccagcccgccggcagccgcucccucgagcccagcgggauccugcugaaguccggcaacuacagcgggcacuccgacggcaucagcuccagccggagccaggccguggaggccccguccgucagcgugaaccacuacucccccaacagccaccagcacaucgacuggaagaacuacaagaccuacaaggaguacaucgacaaccgccggcuccacaucggcugccgcacgauccaggagcggcuggacucccugcgcgccgcgagccaguccaccaccgacuacaaccaggugguccccaaccgcaccacgcuccaggggcggcgccggagcaccucccacgaccgcgugccgcagagcgugcagauccggcagcgcuccgucagccaggagcggcuggaggacuccgugcugaugaaguacugcccccgcagcgccucccagggcgcccucaccagccccuccgugagcuucagcaaccaccggacccgcuccugggacuacaucgaggggcaggacgagacgcuggagaacgucaacagcggcacccccaucccggacuccaacggggagaagaagcagaccuacaaguggagcggcuucaccgagcaggacgaccggcgcggcaucugcgagcggccccgccagcaggagauccacaaguccuuccgggggagcaacuucaccguggcccccuccguggucaacagcgacaaccgccggauguccggccgcggggugggcagcgugucccaguucaagaagaucccgcccgaccugaagacgcuccagagcaaccggaacuuccagacgaccugcgggaugucccugccccgcggcaucagccaggaccgcagcccccucgucaaggugcggagcaacucccucaaggcccccagcacccacgugacgaagcccuccuucagccagaaguccuucgucuccaucaaggaccagcgccccgugaaccaccuccaccagaacagccugcugaaccagcagaccugggugcggaccgacuccgcgcccgaccagcaggucgagaccggcaagagccccucccugagcggggccuccgccaagccggcgccccagagcuccgagaacgccggcacgagcgaccuggagcuccccgugucccagcgcaaccaggaccugagccugcaggaggcggagaccgagcaguccgacacccucgacaacaaggaggccgugauccugcgggagaagcccccgagcgggcgccagacgccccagccccugcggcaccaguccuacauccucgccgucaacgaccaggagaccggcagcgacacgaccugcuggcugcccaacgacgcccgccgggaggugcacaucaagcgcauggaggagcggaaggcguccagcaccuccccgcccggcgacagccuggccagcauccccuucaucgacgagccgacgucccccagcaucgaccacgacaucgcccacauccccgccuccgccgugaucagcgcguccaccagccagguccccuccaucgccaccgugccgcccugccugaccacgagcgcgccccugauccgccggcagcugucccacgaccacgagagcguggggcccccgucccuggacgcccagcccaacagcaagaccgagcgcuccaagagcuacgacgagggccucgacgacuaccgggaggacgccaagcuguccuucaagcacgucagcucccugaaggggaucaagaucgcggacagccagaaguccagcgaggacagcggcucccgcaaggacagcuccagcgagguguucuccgacgccgccaaggagggguggcuccacuuccggccccuggugaccgacaagggcaagcgcgucggcgggagcauccggcccuggaagcagauguacguggugcugcgcggccacucccucuaccuguacaaggacaagcgggagcagaccacgccgagcgaggaggagcagcccaucuccgucaacgccugccugaucgacaucagcuacuccgagaccaagcgcaagaacguguuccgccucaccaccagcgacugcgagugccuguuccaggccgaggaccgggacgacaugcuggcguggaucaagacgauccaggaguccagcaaccucaacgaggaggacaccggggugaccaaccgcgaccugaucucccggcgcaucaaggaguacaacaaccugaugagcaaggccgagcagcuccccaagacgccccggcagucccugagcauccgccagacgcugcucggcgccaaguccgagccgaagacccagagcccccacagccccaaggaggaguccgagcggaagcugcugagcaaggacgacaccagcccgcccaaggacaaggggaccuggcgcaagggcauccccagcaucaugcggaagacguucgagaagaagcccaccgccaccggcaccuucgggguccgccucgacgacugcccgcccgcgcacaccaaccgguacaucccccugaucguggacaucugcugcaagcugguggaggagcgcggccucgaguacacggggaucuaccggguccccggcaacaacgccgccaucuccagcaugcaggaggagcugaacaaggggauggccgacaucgacauccaggacgacaaguggcgcgaccugaacgugaucuccagccuccugaaguccuucuuccggaagcugcccgagccccucuucaccaacgacaaguacgccgacuucaucgaggcgaaccgcaaggaggacccccuggaccggcugaagacccucaagcgccugauccacgaccugcccgagcaccacuacgagacccucaaguuccugagcgcccaccugaagacgguggccgagaacuccgagaagaacaagauggagccccggaaccucgccaucgucuucggccccacccuggugcgcaccagcgaggacaacaugacccacauggugacgcacaugcccgaccaguacaagaucgucgagacccugauccagcaccacgacugguucuucaccgaggagggcgccgaggagccccucaccacggugcaggaggaguccaccguggacagccagcccguccccaacaucgaccaccuccugaccaacaucgggcgcaccggcgugucccccggggacgucagcgacuccgcgacgagcgacuccaccaagagcaagggcagcuggggguccggcaaggaccaguacagccgggagcuccugguguccagcaucuucgccgccgccucccgcaagcggaagaagcccaaggagaaggcccagccgagcuccagcgaggacgagcuggacaacguguucuucaagaaggagaacgucgagcagugccacaacgacaccaaggaggaguccaagaaggagagcgagacccucggccgcaagcagaagaucaucaucgcgaaggagaacuccacgcggaaggaccccagcaccaccaaggacgagaagaucucccuggggaaggagagcacccccuccgaggagcccagcccgccccacaacuccaagcacaacaagagccccacgcugagcugccgcuucgccauccucaaggagagcccccggagccugcuggcccagaaguccagccaccucgaggagaccggcuccgacagcgggacccugcuguccaccagcucccaggccagccucgcgcgcuucuccaugaagaaguccacguccccggagaccaagcacagcgaguuccuggccaacguguccaccaucaccagcgacuacuccacgaccagcuccgccaccuaccugaccagccucgacagcucccggcugagccccgaggugcaguccgucgccgagagcaagggcgacgaggccgacgacgagcgcuccgagcugaucagcgagggccggcccguggagacggacuccgagagcgaguuccccguguucccgaccgcgcucaccuccgagcgccuguuccgggggaagcugcaggaggucaccaagagcucccgccggaacagcgagggcuccgagcucagcugcaccgaggggucccugacgagcucccuggacagccgccggcagcuguucuccagccacaagcugaucgagugcgacacccugagccgcaagaaguccgcccgguucaagagcgacuccggcagccucggggacgccaagaacgagaaggaggcccccucccugaccaagguguucgacgugaugaagaagggcaagagcaccggcucccugcucacgcccacccgcggggagagcgagaagcaggagcccaccuggaagaccaagaucgccgaccggcugaagcugcgcccgcgcgcgcccgccgacgacauguucggcgucgggaaccacaaggugaacgccgagacggccaagcggaaguccauccgccggcgccacacccucggcgggcaccgggacgccaccgagaucagcgugcugaacuucuggaagguccacgagcaguccggcgagcgcgagagcgagcuguccgcggugaaccggcucaagcccaagugcagcgcccaggaccuguccaucagcgacuggcuggcccgcgagcggcuccgcaccuccacgagcgaccugucccggggcgagaucggggacccccagaccgagaacccgagcacccgcgagaucgccaccacggacacgccccugagccuccacugcaacaccggcuccagcuccagcacccuggccuccacgaaccggccccugcucagcaucccgccccagucccccgaccagaucaacggggagagcuuccagaacguguccaagaacgcgagcuccgccgccaacgcccagccccacaagcugagcgagaccccgggcuccaaggcggaguuccaccccugccuguga

SEQ ID NO: 26827 - RNA, 2145 nt, Artificial Sequence
  derived and/or modified sequence opt1 from ARHGAP22__Homo_sapiens__NP_001242953
augcugagccccaagauccgccaggcccggcgcgcccgguccaagagccucgugaugggcgagcagucccgcagcccggggcggaugcccugcccccaccgccugggccccguccugaaggcgggguggcucaagaagcagcgguccaucaugaagaacuggcagcagcgcugguucgugcugcggggcgaccagcuguucuacuacaaggacaaggacgagaucaagccgcagggguucaucagccuccagggcacccaggugaccgagcugccgcccggccccgaggaccccgggaagcaccuguucgagaucucccccggcggggccggcgagcgcgagaagguccccgccaaccccgaggcccuccugcugauggccagcucccagcgggacauggaggacugggugcaggcgauccgccgggugaucugggccccgcucgggggcggcacggcccgccggagccacgcccacccccuggagccccugcccccggggaucuucggccagcgccucgaggagaccguccaccacgagcggaaguacgggccccgccuggcgccccugcucguggagcagugcguggacuucauccgggagcgcggccugaccgaggagggccuguuccggaugcccgggcaggccaaccucguccgcgaccugcaggacuccuucgacugcggcgagaagccgcuguucgacagcaccacggacgugcacaccguggccucccuccugaagcuguaccuccgcgagcugcccgagcccgucgugcccuucgcccgguacgaggacuuccugagcugcgcccagcuccugaccaaggacgagggggagggcacccuggagcucgcgaagcaggucuccaaccugccgcaggccaacuacaaccugcuccgcuacaucugcaaguuccuggacgaggugcaggccuacagcaacgugaacaagauguccgugcagaaccuggccacggucuucgggcccaacauccuccggccccagguggaggaccccgugaccaucauggagggcaccagccugguccagcaccugaugaccgugcucauccgcaagcacucccagcuguucacggccccggugcccgagggccccaccagcccgcgcgggggccugcagugcgcggucggguggggcagcgaggaggugacccgggacucccagggggagcccggcggccccgggcuccccgcccaccggaccagcucccuggacggcgccgccgucgccgugcugagccgcacggcgccgaccgggcccggcucccggugcagccccgggaagaaggugcagacccuccccuccuggaaguccagcuuccgccagccgcggagccuguccggcagccccaagggcgggggcuccagccuggagguccccaucaucuccagcgggggcaacuggcugaugaacggccucuccagccugcgcgggcaccggcgcgccuccagcggcgaccggcugaaggacagcggguccgugcagcgccucagcaccuacgacaacgugcccgccccgggccugguccccgggauccccuccguggccagcauggccugguccggcgcgagcuccagcgaguccagcgugggcgggucccugagcuccugcacggccugccgggccagcgacuccagcgcccgcuccagccuccacaccgacugggcgcuggagcccagcccgcugcccuccagcuccgaggaccccaagagccucgaccuggaccacuccauggacgaggccggcgccggggccagcaacuccgagcccagcgagccggacucccccacccgggagcacgcccgccgcagcgaggcgcugcagggccucgucaccgagcugcgggccgagcugugccgccagcggacggaguacgagcgcuccgugaagcggaucgaggaggggagcgccgaccuccgcaagcggaugucccgccuggaggaggagcuggaccaggagaagaagaaguacaucaugcucgagaucaagcugcggaacagcgagcgcgcccgggaggacgccgagcgccggaaccagcugcuccagcgcgagauggaggaguucuucuccacccugggcagccugaccgugggcgcgaagggggcccgggcccccaaguga

SEQ ID NO: 26828 - RNA, 4476 nt, Artificial Sequence
  derived and/or modified sequence opt1 from ARHGAP23__Homo_sapiens__NP_001186346
augaacggcguggccuucugccuggucgggaucccgccccgccccgagccccggcccccgcagcucccccugggcccccgcgacgggugcagcccccggcgcccguuccccuggcagggcccccggacccugcuccuguacaagagcccccaggacggguucggcuucacccugcgccacuucaucguguacccgcccgaguccgccgugcacugcucccucaaggaggaggagaacggcgggcggggcgggggccccagcccccgcuaccggcuggagccgauggacacgaucuucgucaagaacgugaaggaggacgggcccgcgcaccgcgccggccugcggaccggcgaccgccucgugaaggucaacggggaguccgugaucggcaagaccuacagccaggugaucgcccugauccagaacuccgacgacacccuggagcucagcaucaugcccaaggacgaggacauccugcagcuggccuacucccaggacgccuaccucaaggggaacgagcccuacagcggcgaggcgcgguccaucccggagcccccgcccaucugcuacccccgcaagacguacgccccgcccgcccgggccagcacccgcgcgaccaugguccccgagcccaccuccgcccugcccagcgacccccgguccccggccgccuggagcgaccccggccugcgcgugccgcccgccgcgcgggcccaccucgacaacuccagccuggggaugucccagccccgccccagccccggcgccuucccccaccugagcuccgagccgcggacgccccgcgccuuccccgagcccgggagccgcgugccgcccucccggcucgagugccagcaggcccugagccacuggcuguccaaccaggucccccgccgggcgggcgagcgccggugccccgccauggccccgcgcgcccggagcgccucccaggaccgccucgaggagguggcggcgccccggcccuggcccugcagcaccucccaggacgcccugagccagcuggggcaggagggcuggcaccgcgcccgguccgacgacuaccucagccgcgccacccgguccgccgaggcccugggcccgggggcccuggugagcccccgcuucgagcggugcggcugggccucccagcgcagcuccgcgcggacccccgccugccccacgcgcgaccucccggggccccaggcgcccccgcccagcggccugcaggggcuggacgaccucggcuacaucggcuaccgguccuacagccccagcuuccagcgccgcaccgggcugcugcacgcccucuccuuccgggacagccccuucggcgggcugccgaccuucaaccuggcccagucccccgccagcuucccgcccgaggccuccgagccgccccgcgucgugcggcccgagcccagcacccgcgcccucgagccgcccgccgaggaccggggcgacgaggugguccugcgccagaagccgcccacggggcggaaggugcagcugacccccgcccgccagaugaaccucggcuucggcgacgagucccccgagcccgaggcgagcgggcggggcgagcgccuggggcggaagguggcgccccuggccaccaccgaggacucccucgccagcauccccuucaucgacgagcccacgucccccagcaucgaccugcaggccaagcacguccccgccuccgccguggugagcuccgccaugaacagcgccccgguccugggcaccucccccagcagccccaccuucaccuucacgcucggccgccacuacucccaggacugcagcuccaucaaggcggggcggcgcagcuccuaccugcuggccaucaccaccgagcggagcaaguccugcgacgacggccugaacaccuuccgcgacgaggggcgggugcuccgccggcugcccaaccgcaucccgagccugcggaugcuccgcuccuucuucacggacggcagccuggacuccugggggaccagcgaggacgccgacgcccccuccaagcgccacagcaccuccgaccugagcgacgccaccuucuccgacauccggcgcgagggcuggcucuacuacaagcagauccugacgaagaagggcaagaaggcggggagcggccugcggcaguggaagcgcgucuacgccgcccuccgggcccgcucccugagccugagcaaggagcggcgcgagcccgggccggccgcggccggcgccgccgccgcgggggccggcgaggacgaggccgcccccgugugcaucggcuccugccucguggacaucagcuacuccgagaccaagcggcgccacgucuuccggcugaccaccgcggacuucugcgaguaccuguuccaggccgaggaccgcgacgacaugcucggguggauccgggccauccgcgagaacagccgggccgagggcgaggaccccgggugcgccaaccaggcgcugaucuccaagaagcugaacgacuaccgcaaggugagccacuccagcggccccaaggccgacuccagcccgaaggggucccggggccucggcgggcucaagagcgaguuccugaagcaguccgccgcccgcggccugcggacgcaggaccugcccgccgggagcaaggacgacuccgcggccgcccccaagacccccuggggcaucaacaucaucaagaagaacaagaaggccgccccgcgcgcguucggggugcgccuggaggagugccagcccgccaccgagaaccagcgggucccccucaucguggccgccugcugccgcaucguggaggcccggggccuggagagcaccggcaucuaccgcguccccgggaacaacgcggugguguccagccugcaggagcagcucaaccggggcccgggggacaucaaccugcaggacgagcgcuggcaggaccugaacgucaucuccagccuccucaagagcuucuuccggaagcugcccgagccccuguucaccgacgacaaguacaacgacuucaucgaggccaaccgcaucgaggacgcccgggagcgcaugcggacgcugcgcaagcugauccgggaccuccccggccacuacuacgagacccugaaguuccuggugggccaccucaagaccaucgccgaccacuccgagaagaacaagauggagccgcgcaaccuggcgcugguguucgggcccacccucguccggacgagcgaggacaacaugaccgacauggugacccacaugcccgaccgcuacaagaucguggagacccugauccagcacuccgacugguucuucagcgacgaggaggacaagggcgagcggacgcccgucggggacaaggagccgcaggccgugcccaacaucgaguaccugcuccccaacaucggccgcaccgugcccccgggggaccccggcuccgacagcacgaccugcuccagcgccaaguccaagggcagcugggcccccaagaaggagcccuacgcccgggagaugcuggcgaucuccuucaucagcgccgucaaccgcaagcggaagaagcgccgcgaggcccgggggcugggcuccagcaccgacgacgacuccgagcaggaggcccacaagccgggggccggcgcgaccgcccccgggacccaggagcgcccccagggcccgcuccccggcgccguggcccccgaggcccccgggcggcugagcccgcccgcggcccccgaggagcgccccgccgccgacacccgguccaucgugagcggcuacuccacgcugagcaccauggaccgcagcgucugcuccggggcgagcggccggcgcgccggggccggcgacgaggccgacgacgagcgguccgagcucagccacguggagaccgacaccgagggcgccgcgggggccggccccgggggccgccugacgcggcgccccuccuucagcucccaccaccugaugcccugcgacacccucgcccggcgccggcuggcccgcggccggcccgacggggagggcgccgggcgcggcgggccgcgggcgcccgagccgcccggcagcgccuccagcuccagccaggagucccugcgcccgcccgccgccgcccucgcgagccgccccucccggauggaggcccugcgccugcggcuccgcggcaccgccgacgacaugcuggccgugcggcugcgccggccccucagccccgagacccgccggcgccgguccagcuggcgccggcacacggucguggugcagagcccccugaccgaccugaacuucaacgaguggaaggagcucgggggcgggggcccgcccgagcccgcgggggcccgcgcccacuccgacaacaaggacagcggccuguccagccuggaguccaccaaggcccgggcccccagcuccgcggccagccagcccccggcccccggcgacaccgggucccuccagagccagccgccccgccgguccgccgccagccgccugcaccagugccuguga

SEQ ID NO: 26829 - RNA, 1968 nt, Artificial Sequence
  derived and/or modified sequence opt1 from ARHGAP24__Homo_sapiens__NP_112595
augcccgaggaccgcaacagcggcgggugcccggccggcgcccuggcguccacccccuucauccccaagaccacguaccggcgcaucaagcggugcuucagcuuccgcaaggggaucuucggccagaagcucgaggacaccgugcgguacgagaagcgcuacgggaaccggcuggcccccaugcuggucgagcagugcguggacuucauccgccagcggggccucaaggaggagggccuguuccgccugccggggcaggccaaccucgugaaggagcugcaggacgccuucgacugcggcgagaagcccuccuucgacagcaacaccgacguccacaccguggccucccugcucaagcuguaccugcgggagcuccccgagcccgugaucccguacgcgaaguacgaggacuuccugagcugcgccaagcugcucuccaaggaggaggaggccggggucaaggagcuggccaagcaggucaagagccugcccguggugaacuacaaccuccugaaguacaucugccgcuuccuggacgaggugcaguccuacagcggcgugaacaagauguccguccagaaccucgcgacgguguucgggcccaacauccugcggcccaagguggaggacccgcugaccaucauggagggcaccgucguggugcagcagcucaugagcgucaugaucuccaagcacgacugccuguuccccaaggacgccgagcugcagagcaagccccaggacggcguguccaacaacaacgagauccagaagaaggccaccauggggcagcuccagaacaaggagaacaacaacacgaaggacagccccucccgccagugcagcugggacaaguccgagagcccgcagcggagcuccaugaacaacggcagccccaccgcccuguccgggagcaagaccaacucccccaagaacagcgugcacaagcuggacgucucccgcagcccgccccucauggugaagaagaaccccgccuucaacaagggcuccggcaucgugaccaacgggagcuucuccagcuccaacgcggagggccuggagaagacgcagaccacccccaacgggagccugcaggcccggcgcuccagcucccucaaggucagcggcaccaagauggggacgcacuccgugcagaacggcaccguccggaugggcauccugaacagcgacacccuggggaaccccaccaacgugcgcaacaugagcuggcucccgaacggcuacgugacgcugcgggacaacaagcagaaggagcaggccggggagcugggccagcacaaccgccucuccaccuacgacaacguccaccagcaguucagcaugaugaaccuggacgacaagcaguccaucgacagcgccaccugguccaccagcuccugcgagaucagccugcccgagaacuccaacagcugccgcuccagcacgacgaccugccccgagcaggacuucuucgggggcaacuucgaggaccccgugcucgacggcccgccccaggacgaccugucccacccccgggacuacgagagcaaguccgaccaccgcagcgucgggggccgguccagccgcgccaccagcuccagcgacaacuccgagaccuucguggggaacagcuccagcaaccacuccgcgcugcacagccucguguccagccugaagcaggagaugaccaagcagaagaucgaguacgagucccggaucaagagccuggagcagcgcaaccucacccuggagaccgagaugaugucccugcacgacgagcuggaccaggagcggaagaaguucacgaugaucgagaucaagaugcgcaacgccgagcgggccaaggaggacgccgagaagcgcaacgacaugcuccagaaggagauggagcaguucuucagcaccuucggcgagcugaccguggagccgcggcgcaccgagcgggggaacacgaucuggauccaguga

SEQ ID NO: 26830 - RNA, 1941 nt, Artificial Sequence
  derived and/or modified sequence opt1 from ARHGAP25__Homo_sapiens__NP_001007232
augagccugaagcucccccgcaacugggacuucaaccugaagguggaggccgccaagaucgcgcggucccgcagcgugaugaccggcgagcagauggccgccuuccacccguccagcacccccaacccccuggagcggcccaucaagaugggguggcucaagaagcagcgcuccaucgugaagaacuggcagcagcgguacuucgugcugcgcgcccagcagcuguacuacuacaaggacgaggaggacacgaagccgcagggcugcauguaccuccccgggugcaccaucaaggagaucgccaccaaccccgaggaggcgggcaaguucgucuucgagaucauccccgccagcugggaccagaaccggauggggcaggacuccuacgugcugauggccagcucccaggccgagauggaggagugggugaaguuccugcgccgggucgcgggcaccccgugcggcgccguguucgggcagcgccucgacgagacgguggccuacgagcagaaguucggcccccaccugguccccauccugguggagaagugcgccgaguucauccucgagcacgggcggaacgaggagggcaucuuccgccugcccgggcaggacaaccuggugaagcagcuccgggacgccuucgacgcgggcgagcgcccgagcuucgaccgggacaccgacguccacaccguggccucccugcugaagcucuaccugcgcgaccugcccgagcccgugguccccuggagccaguacgagggcuuccuccugugcgggcagcugaccaacgccgacgaggccaaggcccagcaggagcucaugaagcagcuguccauccugccgcgggacaacuacagccuccuguccuacaucugccgcuuccugcacgagauccagcucaacugcgcggugaacaagaugagcguggacaaccuggccacggucaucggcgugaaccugauccgguccaagguggaggaccccgccgucaucaugcgcgggacgccccagauccagcgggugaugaccaugaugauccgcgaccacgagguccucuuccccaagagcaaggacaucccgcuguccccgcccgcccagaagaacgaccccaagaaggcccccguggcgcgcagcagcgugggcugggacgccaccgaggaccugcggaucucccgcaccgacagcuucuccagcaugaccuccgacagcgacaccaccucccccacgggccagcagcccagcgacgccuuccccgaggacuccagcaaggucccgcgggagaagcccggggacuggaagaugcagucccgcaagcggacccagacccuccccaaccgcaagugcuuccugaccagcgccuuccagggcgccaacuccagcaagauggagaucuucaagaacgaguucugguccccgagcuccgaggcgaaggccggggagggccaccggcgcacgaugagccaggaccugcggcagcucuccgacagccagcgcaccagcaccuacgacaacgugcccucccugcccgggagccccggcgaggaggccuccgcccugagcucccaggcgugcgacagcaagggcgacacccucgccuccccgaacagcgagacggggcccggcaagaagaacuccggggaggaggagaucgacagccugcagcggauggugcaggagcugcgcaaggagaucgagacccagaagcagauguacgaggagcagaucaagaaccucgagaaggagaacuacgacgucugggccaagguggugcggcugaacgaggagcuggagaaggagaagaagaaguccgccgcccucgagaucagccugcgcaacauggagcggucccgcgaggacgucgagaagcggaacaaggcgcuggaggaggaggugaaggaguucgucaagagcaugaaggagcccaagaccgaggccuga

SEQ ID NO: 26831 - RNA, 2280 nt, Artificial Sequence
  derived and/or modified sequence opt1 from ARHGAP26__Homo_sapiens__NP_001129080
augggccugcccgcccucgaguucagcgacugcugccuggacuccccgcacuuccgcgagacccucaagagccacgaggccgagcuggacaagaccaacaaguucaucaaggagcugaucaaggacgggaagucccugaucagcgcgcucaagaaccuguccagcgccaagcggaaguucgccgacucccugaacgaguucaaguuccagugcaucggcgacgccgagacggacgacgagaugugcaucgcccgcagccuccaggaguucgcgaccgugcugcggaaccuggaggacgagcgcauccggaugaucgagaacgccuccgagguccucaucacgccccuggagaaguuccgcaaggagcagaucggggccgccaaggaggcgaagaagaaguacgacaaggagaccgagaaguacugcggcauccuggagaagcaccucaaccugagcuccaagaagaaggagagccagcugcaggaggccgacucccagguggaccucgugcggcagcacuucuacgaggucagccuggaguacguguucaaggugcaggagguccaggagcgcaagauguucgaguucguggagccccugcucgccuuccugcaggggcuguucaccuucuaccaccacggcuacgagcucgccaaggacuucggcgacuucaagacccagcugaccaucuccauccagaacacccggaaccgcuucgaggggacgcggagcgagguggagucccugaugaagaagaugaaggagaacccccucgagcacaagaccaucagcccguacaccauggagggcuaccuguacguccaggagaagcgccacuucgggaccuccugggugaagcacuacugcacguaccagcgggacagcaagcagaucaccauggugcccuucgaccagaaguccggcgggaagggcggcgaggacgagagcgucauccucaagagcugcacccgccggaagaccgacuccaucgagaagcgcuucugcuucgacguggaggccguggaccggcccggggucaucacgaugcaggcgcugagcgaggaggaccgccggcuguggauggaggccauggacggccgcgagcccguguacaacuccaacaaggacagccaguccgaggggaccgcccagcuggacagcaucggcuucuccaucauccggaagugcauccacgccguggagacccgcggcaucaacgagcaggggcucuaccgcaucgucggcgugaacagccgggugcagaagcugcuguccguccucauggacccgaagaccgccagcgagacggagaccgacaucugcgcggagugggagaucaagaccaucaccuccgcccugaagacguaccugcgcaugcuccccgggccccugaugauguaccaguuccagcggagcuucaucaaggccgccaagcuggagaaccaggagucccgcgugagcgagauccacucccucgugcaccggcugcccgagaagaaccgccagaugcugcagcuccugaugaaccaccuggccaacgucgcgaacaaccacaagcagaaccucaugaccguggccaaccugggcgucguguucgggccgacccugcugcggccccaggaggagaccguggccgccaucauggacaucaaguuccagaacaucgucaucgagauccucaucgagaaccacgagaagaucuucaacacggugcccgacaugccccugaccaacgcccagcugcaccucagccgcaagaaguccagcgacagcaagccgcccuccugcagcgagcggccccugacccuguuccacaccgugcaguccacggagaagcaggagcagcgcaacagcaucaucaacuccagccucgaguccgucagcuccaaccccaacagcauccugaacuccagcuccagccugcagccgaacaugaacuccagcgaccccgaccucgcgguggugaagcccacccggcccaacucccugccgcccaaccccagccccaccagcccgcugucccccagcuggcccauguucuccgccccgagcucccccaugcccaccagcuccacgagcuccgacagcucccccgucagcaccccguuccgcaaggccaaggcccucuacgcgugcaaggccgagcacgacuccgagcugagcuucaccgccggcaccguguucgacaacgugcaccccucccaggagcccggcuggcuggaggggacccucaacggcaagacggggcugauccccgagaacuacgucgaguuccuguga

SEQ ID NO: 26832 - RNA, 792 nt, Artificial Sequence
  derived and/or modified sequence opt1 from ARHGAP27__Homo_sapiens__NP_777579
auggccgccgacguggucggcgacguguacgugcuggucgagcaccccuucgaguacaccgggaaggacggccgccggguggcgauccgccccaacgagcgguaccgccuccugcggcgcagcaccgagcacugguggcacgugcggcgcgagcccgggggccggcccuucuaccugcccgcccaguacguccgcgagcucccggcccuggggaaccccgccgccgcggccccgcccggcccccaccccucccccgccgcccccgagccgcuggcguacgacuaccgguucgugagcgccgccgccacggccggccccgacggggcgcccgaggaguccggcgggcgcgccagcucccucugcggccccgcccagcgcggggccgccacccagcggagcucccuggcgccgggccugcccgccugccucuaccugcggcccgccgcccccgugcgcccggcccagagccugaacgaccucgcgugcgccgccgucuccccgcccgccggccugcuggggagcuccggcagcuucaaggccugcuccguggcggggagcugggugugcccccggccccucgcccgcuccgacagcgagaacgucuacgaggugauccaggaccugcacgugcccccgcccgaggaguccgccgagcaggucccgccccgggcccugggccgcggcgggggcuggcgggcgcgcgaccgcgcccggaccgagcccgggcgcaaggagacccggagcgcccagcgccgggcccgccggccgccccucuccgaggacuucggcuga

SEQ ID NO: 26833 - RNA, 1713 nt, Artificial Sequence
  derived and/or modified sequence opt1 from ARHGAP28__Homo_sapiens__NP_001010000
augcgcaagaaggacaagcagagcauccgggacgugcgcgacaucuucggcgucuccgagagcccgccccgggacacgugcgggaaccacaccaaccagcuggacggcaccaaggaggagcgcgagcucccccgggugaucaagaccuccgggagcaugcccgacgacgccucccugaacagcaccacccuguccgacgccagccaggacaaggagggcuccuucgcggugccccgcagcgacuccgucgccauccucgagacgaucccggugcugcccgugcacagcaacgggucccccgagcccggccagccgguccagaacgccaucagcgacgacgacuuccuggagaagaacaucccgcccgaggccgaggagcucuccuucgaggugagcuacuccgagauggugaccgaggcccugaagcggaacaagcugaagaaguccgagaucaagaaggaggacuacguccucaccaaguucaacgugcagaagacccgcuucggccugacggaggcgggggaccugagcgccgaggacaugaagaagauccggcaccucagccugaucgagcugaccgccuucuucgacgccuucggcauccagcucaagcgcaacaagaccgagaaggugaaggggcgggacaacggcaucuucggggucccccugaccgugcugcucgacggcgaccgcaagaaggaccccggcgugaaggucccccuggugcugcagaaguucuucgagaagguggaggagagcgggcucgaguccgagggcaucuuccggcugagcgggugcacggcgaaggucaagcaguaccgcgaggagcuggacgccaaguucaacgccgacaaguucaagugggacaagaugugccaccgggaggccgccgugaugcucaaggcguucuuccgcgagcugcccaccucccuguuccccguggaguacaucccggccuucaucagccucauggagcggggcccccacgucaaggugcaguuccaggcccugcaccugauggugauggcccuccccgacgccaaccgcgacgcggcccaggcccugaugaccuucuucaacaaggucaucgccaacgaguccaagaaccggaugagccuguggaacaucuccaccgugauggcccccaaccucuucuucagccgcuccaagcacagcgacuacgaggagcugcugcucgcgaacacggccgcccacaucauccggcugaugcugaaguaccagaagauccucuggaaggucccguccuuccugaucacccaggugcgccgcaugaacgaggccaccaugcugcucaagaagcagcugcccagcgugcggaagcugcuccgccggaagacccuggagcgcgagacggccucccccaagaccagcaagguccugcagaagucccccagcgcgcggcgcauguccgacgugccggagggcgugauccggguccacgcgccccuccugagcaagguguccauggccauccagcugaacaaccagaccaaggccaaggacauccuggccaaguuccaguacgagaacagccacgggagcuccgagugcaucaagauccagaaccagcgccucuacgagaucggcgggaacaucggcgagcacugccuggaccccgacgccuacauccuggacguguaccggaucaacccccaggccgagugggucaucaagccgcagcagagcuccuga

SEQ ID NO: 26834 - RNA, 3306 nt, Artificial Sequence
  derived and/or modified sequence opt1 from ARHGAP30__Homo_sapiens__NP_001020769
augaagucccgccagaagggcaagaagaagggguccgccaaggagcggguguucggcugcgaccugcaggagcaccuccagcacagcgggcaggaggucccccaggugcugaaguccugcgccgaguucguggaggaguacggcgucguggacgggaucuaccgccugagcggcguguccagcaacauccagaagcuccggcaggaguucgaguccgagcgcaagccggaccugcggcgcgacgucuaccugcaggacauccacugcgugagcucccucugcaaggcguacuuccgggagcugcccgacccccugcucaccuaccgccuguacgacaaguucgccgaggccgugggcguccagcuggagcccgagcggcucgugaagauccuggaggugcugcgcgagcucccgguccccaacuaccggacccuggaguuccugaugcgccaccucgugcacauggccagcuucuccgcccagacgaacaugcacgcgcggaaccuggccaucgugugggcccccaaccugcuccgcagcaaggacaucgaggccuccggguucaacggcaccgcggccuucauggagguccgggugcagagcaucguggucgaguucauccugacccacguggaccagcuguucgggggcgccgcccucuccgggggcgagguggagagcggcuggcgcucccugcccgggacccgggccagcggcuccccggaggaccugaugccccgcccccuccccuaccaccucccgagcauccugcaggcgggggacggcccgccccagaugcggcccuaccacacgaucaucgagaucgccgagcacaagcgcaagggcagccucaagguccggaaguggcgcuccaucuucaaccuggggcgcagcggccacgagaccaagcggaagcugccccgcggggccgaggaccgggaggacaaguccaacaagggcacccuccgccccgccaagagcauggacucccugagcgccgcggccggggccuccgacgagcccgagggccuggugggccccagcuccccgcggcccagcccccuccugcccgagucccuggagaacgacagcaucgaggccgccgagggggagcaggagccggaggcggaggcccugggcgggaccaacagcgagcccggcacgccccgcgccgggcggagcgccauccgcgccggcggcuccagccgggcggagcgcugcgccggggugcacaucuccgaccccuacaacgucaaccugccgcugcacaucaccagcauccucuccgugccgcccaacaucaucagcaacgucagccuggcccggcugacccgcggccucgagugccccgcccugcagcaccggcccucccccgcgagcgggcccggcccggggcccggccugggccccgggcccccggacgagaagcucgaggccucccccgccagcagcccccuggccgacuccggccccgacgaccuggccccggcgcuggaggacucccucagccaggaggugcaggacuccuucagcuuccuggaggacuccagcuccagcgagcccgagugggugggggccgaggacggcgaggucgcccaggccgaggccgcgggcgccgccuucucccccggggaggacgaccccggcaugggguaccuggaggagcuccugggcguggggccccagguggaggaguucagcgucgagccgccccuggacgaccucucccuggacgaggcccaguucgugcuggcccccagcugcugcagccucgacuccgcgggcccgcgccccgagguggaggaggagaacggcgaggaggucuuccugagcgccuacgacgaccugagcccccuccuggggcccaagccgcccaucuggaagggcuccgggucccuggagggcgaggccgccgggugcggccggcaggcgcucggccagggcggggaggagcaggccugcugggaggugggggaggacaagcaggccgagcccggcgggcgccuggacauccgggaggaggccgagggcagcccggagaccaagguggaggccggcaaggcguccgaggaccgcggggaggccggcgggagccaggagacgaagguccggcugcgcgagggcucccgcgaggagaccgaggccaaggaggagaaguccaaggggcagaagaaggccgacagcauggaggccaagggcguggaggagcccggcggggacgaguacaccgacgagaaggagaaggagaucgagcgggaggaggacgagcagcgcgaggaggcccagguggaggcgggccgggaccucgagcagggggcccaggaggaccaggucgccgaggagaagugggagguggugcagaagcaggaggccgagggcguccgcgaggacgaggacaagggccagcgggagaagggguaccacgaggcgcgcaaggaccagggcgacggggaggacagccggucccccgaggccgccaccgagggcggggccggcgaggugagcaaggagcgcgaguccggcgacggggaggcggagggcgaccagcgggccgggggcuacuaccuggaggaggacacgcugagcgagggguccggcguggccagccucgaggucgacugcgccaaggagggcaacccccacuccagcgagauggaggagguggccccgcagccgccccagcccgaggagauggagcccgaggggcagcccagccccgacggcugccugugccccugcucccuggggcucggcggggugggcaugcgccuggcgagcacccugguccaggugcagcagguccgguccgugccgguggugccgcccaagccccaguucgccaagaugcccagcgccaugugcuccaagauccacgucgcccccgccaaccccugcccccgcccgggccggcucgacgggacccccggcgagcgcgcgugggggagccgggccucccgcagcuccuggcggaacggcggcagccuguccuucgacgccgccguggcccuggcgcgcgaccggcagcgcaccgaggcccagggggugcggcgcacgcagaccugcaccgagggcggggacuacugccucaucccccgcaccagccccugcuccaugaucagcgcccacuccccgcggccccugagcugccuggagcuccccuccgagggcgccgaggggagcggcucccgcagccggcugagccugcccccgcgcgagccccagguccccgacccgcuccuguccagccagcggcgcuccuacgccuucgagacgcaggcgaaccccggcaagggggagggccuguga

SEQ ID NO: 26835 - RNA, 4335 nt, Artificial Sequence
  derived and/or modified sequence opt1 from ARHGAP31__Homo_sapiens__NP_065805
augaagaacaagggcgccaagcagaagcugaagcgcaagggggccgcgagcgccuucggcugcgaccucaccgaguaccuggaguccagcgggcaggacgugcccuacguccugaaguccugcgccgaguucaucgagacccacggcaucguggacgggaucuaccggcucagcggcgugacguccaacauccagcgccugcggcaggaguucggcagcgaccagugcccggaccugacccgcgaggucuaccuccaggacauccacugcguggggucccugugcaagcuguacuuccgggagcuccccaacccccugcugaccuacgagcucuacgagaaguucaccgaggccgugagccacugccccgaggagggccagcuggcccgcauccagaacgucauccaggagcugccgcccucccacuaccggacgcucgaguaccugauccgccaccuggcgcacaucgccagcuucuccagcaagaccaacaugcacgcccggaaccucgcccuggugugggcgcccaaccugcuccgcuccaaggagaucgaggccaccgggugcaacggcgacgccgccuuccuggccgugcggguccagcagguggugaucgaguucauccugaaccacgucgaccagaucuucaacaacggggcgcccggcagccucgagaacgacgagaaccgcccgaucaugaagucccugacccugcccgcccucagccugcccaugaagcuggugucccucgaggaggcccaggcccggagccuggccacgaaccaccccgcgcgcaaggagcggcgcgagaacucccugccggagaucgugccccccaugggcacccucuuccacaccguccuggagcugcccgacaacaagcggaagcucagcagcaaguccaagaaguggaagagcaucuucaaccuggggcgcuccggcagcgacuccaagagcaagcugucccggaacgggagcguguucgugcgcggccagcggcucuccgucgagaaggccaccauccgcccggccaagagcauggacucccugugcagcgugcccguggagggcaaggagacgaaggggaacuucaaccgcaccgucaccaccggcggguucuucauccccgccacgaagaugcacuccaccggcaccgggagcuccugcgaccugaccaagcaggagggcgaguggggccaggaggggaugcccccgggcgccgaggggggcuucgacgugagcuccgaccggagccaccuccagggggcgcaggcccgccccccccccgagcagcugaagguguuccggccggucgaggaccccgaguccgagcagacggcccccaagaugcugggcauguucuacaccagcaacgacagccccuccaagagcguguucaccuccagccucuuccagauggagccguccccccgcaaccagcggaaggcccugaacaucagcgagcccuucgccgucuccgugccgcugcgcgugagcgcggucaucuccaccaacagcacgcccugccggaccccccccaaggagcuccagucccugagcucccuggaggaguucagcuuccacggcuccgagagcgggggcuggccggaggaggagaagccccugggggccgagaccuccgccgccagcgugcccaagaaggcgggccucgaggacgccaaggccgugcccgaggccccggggaccgucgagugcagcaagggccugucccaggagcccggcgcccaccuggaggagaagaagacgcccgagagcucccucagcucccagcaccugaacgagcuggagaagcgccccaacccggagaaggugguggaggaggggcgggaggcgggcgagauggagagcuccacccuccaggagagcccccgcgcccgggccgaggccguccugcugcacgagauggacgaggacgaccucgccaacgcgcugaucuggcccgagauccagcaggagcugaagaucaucgaguccgaggaggagcucagcucccugcccccgcccgcccugaagaccagccccauccagcccauccucgaguccagccuggggccguucauccccuccgagccccccggcagccugccgugcggcuccuuccccgcccccgugagcaccccgcucgagguguggacgcgcgaccccgccaaccaguccacccagggggccagcaccgcggccagccgggagaagcccgagcccgagcagggccugcacccggaccuggccucccucgccccccuggagaucguccccuucgagaaggcgagcccccaggccaccguggagguggggggcccggggaaccugucccccccccuccccccggcccccccccccccgacgccccuggaggagagcacccccguccugcucuccaagggcggccccgagcgcgaggacagcucccggaagcugcgcaccgaccuguacaucgaccagcucaagagccaggacuccccggagaucagcucccugugccagggggaggaggccaccccccggcacagcgacaagcagaacuccaagaacgccgcgagcgagggcaaggggugcggcuuccccucccccacccgcgagguggagaucgugagccaggaggaggaggacgucacgcacuccgugcaggagccgagcgacugcgacgaggacgacaccgugaccgacaucgcccagcacgggcuggagauggucgagcccugggaggagccccagugggugaccuccccccuccacagcccgacgcugaaggacgcccacaaggcccaggugcagggccugcagggccaccagcucgagaagcggcugagccaccgccccucccugcgccagagccacucccucgacagcaagcccaccgucaagucccaguggacccuggaggugccgagcuccagcuccugcgccaaccuggagaccgagcggaacagcgacccccuccagccccaggcgccccgccgggagaucacggggugggacgagaaggcccugcgcuccuuccgggaguucagcggccugaagggggccgaggccccgcccaaccagaagggccccuccggggugcagcccaacccggccgagaccagccccaucucccucgcggagggcaaggagcugggcacccaccuggggcacagcuccccccagauccgccagggcgggguccccggcccggagagcuccaaggagagcagccccuccgugcaggacagcaccucccccggggagcaccccgccaagcuccagcugaagagcacggagugcggcccgcccaagggcaagaaccggcccuccagccugaaccucgaccccgccaucccgaucgccgaccuguucugguucgagaacguggcguccuucagcucccccgggaugcaggucagcgagcccggcgaccccaaggugaccuggaugaccuccagcuacugcaaggccgacccguggcgcguguacucccaggacccccaggaccuggacaucgucgcccacgcccucaccgggcggcgcaacagcgcccccguguccgugagcgcgguccggacguccuucauggugaagaugugccaggcccgcgccgugcccgucaucccgcccaagauccaguacacccagaucccccagccgcugcccagccaguccagcggcgagaacggcgugcagccccuggagcggagccaggaggggcccuccagcaccuccggcaccacgcagaagccggccaaggacgacagccccuccagccucgaguccagcaaggaggagaagcccaagcaggaccccggggccaucaaguccagcccgguggacgcgaccgcccccugcaugugcgagggccccacccugucccccgagccggggagcuccaaccugcucagcacccaggacgccgucgugcagugccgcaagcggauguccgagacggagcccagcggcgacaaccugcuguccagcaagcucgagcgccccuccggcgggagcaagcccuuccaccggagccgcccgggccggccccagucccugauccuguucagcccccccuucccgaucauggaccaccucccccccuccagcaccgugaccgacuccaagguccugcugagccccauccgcuccccgacccagacggugagccccgggcuccugugcggcgagcuggccgagaacaccugggugacccccgagggggucacccuccggaacaagaugacgaucccgaagaacggccagcgccuggagaccuccaccagcugcuucuaccagccccagcgccgguccgugauccuggacggccgcagcgggcggcagaucgaguga

SEQ ID NO: 26836 - RNA, 6264 nt, Artificial Sequence
  derived and/or modified sequence opt1 from ARHGAP32__Homo_sapiens__NP_001136157
auggagaccgagagcgagagcagcacccugggcgacgacagcgucuucuggcuggagagcgaggucaucauccaggugacggacugcgaggaggaggagcgcgaggagaaguuccggaagaugaaguccagcgugcacuccgaggaggacgacuucguccccgagcugcaccgcaacgugcacccccgggagcgccccgacugggaggagacccugagcgccauggcccgcggggccgacgugcccgagauccccggcgaccucacccugaagaccugcggguccaccgccagcaugaaggucaagcacgugaagaagcugcccuucaccaagggccacuuccccaagauggccgagugcgcccacuuccacuacgagaacguggaguucggguccauccagcucagccuguccgaggagcagaacgaggucaugaagaacggcugcgagagcaaggagcugguguaccucgugcagaucgccugccagggcaaguccuggaucgucaagcggagcuacgaggacuuccgggugcuggacaagcaccuccaccucugcaucuacgaccgccgguucucccagcugagcgagcugccccgcuccgacacccucaaggacagccccgagagcgugacccagaugcugauggccuaccugucccggcucagcgccaucgccgggaacaagaucaacugcggcccggcccugacguggauggagaucgacaacaaggggaaccaccuccugguccacgaggaguccagcaucaacacccccgccgugggcgccgcccacgugaucaagcgcuacaccgcccgggcccccgacgagcugacccuggaggucggggacaucguguccgugaucgacaugccgcccaagguccucagcacgugguggcgcggcaagcacggcuuccagguggggcuguuccccggccacugcguggagcugaucaaccagaaggucccccaguccgugaccaacagcguccccaagcccguguccaagaagcacgggaagcucaucaccuuccugcggaccuucaugaagucccgccccacgaagcagaagcugaagcagcggggcauccucaaggagcgcguguucggcugcgaccugggggagcaccuccugaacuccggcuucgaggucccccaggugcugcagagcugcaccgcguucaucgagcgguacgggaucguggacggcaucuaccgccuguccggggucgccagcaacauccagcggcuccgccacgaguucgacuccgagcacgugcccgaccugaccaaggagcccuacgugcaggacauccacagcgucggcucccugugcaagcucuacuuccgcgagcugcccaacccccugcucaccuaccagcuguacgagaaguucagcgacgccguguccgccgccacggacgaggagcggcugaucaagauccacgacgugauccagcagcugcccccgccccacuaccgcacccuggaguuccugaugcggcaccucagccugcuggcggacuacugcagcaucaccaacaugcacgccaagaaccuggccaucgucugggcccccaaccuccugcgcuccaagcagaucgagagcgccugcuucuccggcaccgcggccuucauggaggugcggauccagagcguggucguggaguucauccugaaccacguggacguccucuucuccgggcgcaucagcauggccaugcaggagggcgccgccucccugagccggcccaagucccugcucgugagcucccccagcacgaagcugcugacccucgaggaggcgcaggcccgcacccaggcccaggugaacucccccaucgucaccgagaacaaguacaucgaggugggggagggccccgccgcgcugcaggggaaguuccacacgaucaucgaguucccccuggagcggaagcgcccccagaacaagaugaagaagucccccgugggcuccuggcggagcuucuucaaccucggcaaguccagcagcgucuccaagcgcaagcugcagcggaacgagagcgagcccuccgagaugaaggccauggcccugaagggcgggcgcgccgaggggacccuccggagcgccaaguccgaggagagccugaccucccugcacgcgguggacggcgacagcaagcuguuccgcccccggcgcccccgguccagcuccgacgcccugagcgccuccuucaacggggagaugcugggcaaccgcugcaacagcuacgacaaccucccccacgacaacgaguccgaggaggagggcgggcugcugcacauccccgcccucaugagcccccacuccgccgaggacguggaccuguccccgcccgacaucggcgucgcgucccuggacuucgaccccaugagcuuccagugcagcccgcccaaggccgaguccgagugccucgagagcggggccuccuuccuggacagccccggcuacuccaaggacaagcccagcgccaacaagaaggacgccgagaccggcuccagccagugccagacgcccggguccaccgcgagcuccgagcccgugagcccccugcaggagaagcucucccccuucuucacccuggaccugagccccaccgaggacaaguccagcaagcccuccagcuucacggagaagguggucuacgccuucucccccaagaucggccgcaagcucagcaagagccccuccaugagcaucuccgagccgaucagcgugacccugccgccccggguguccgaggucaucgggaccgugagcaacaccaccgcccagaacgccuccagcuccacgugggacaagugcguggaggagcgcgacgcgaccaaccggagcccgacccagaucgucaagaugaagaccaacgagacgguggcccaggaggccuacgaguccgaggugcagccccuggaccaggucgccgccgaggagguggagcuccccggcaaggaggaccagagcguguccagcucccagagcaaggcggucgccuccgggcagacccagaccggcgccgugacccacgacccgccccaggacagcgugcccgucuccagcgugagccugaucccgcccccgccgccgcccaagaacguggcccgcaugcuggcccucgcgcuggccgaguccgcccagcaggccagcacgcagucccugaagcggcccggcaccagccaggccggguacaccaacuacggcgacaucgcggucgccaccacggaggacaaccucuccagcuccuacagcgccguggcccuggacaaggcguacuuccagaccgaccgccccgccgagcaguuccaccuccagaacaacgcccccgggaacugcgaccacccccuccccgagaccaccgccacgggcgaccccacccacuccaacaccaccgagagcggggagcagcaccaccagguggaccugacgggcaaccagccccaccaggccuaccuguccggcgaccccgagaaggcgcggaucaccagcgucccccucgacuccgagaaguccgacgaccacguguccuuccccgaggaccagagcgggaagaacuccaugcccaccgucagcuuccuggaccaggaccagagcccgccccgcuucuacagcggcgaccagccgcccagcuaccugggggccuccguggacaagcuccaccacccccuggaguucgccgacaagagccccacgccgcccaaccugccguccgacaagaucuacccgcccagcggcucccccgaggagaacacgagcaccgccaccaugaccuacaugacgaccaccccggccaccgcgcagauguccacgaaggaggccagcugggacguggccgagcagcccaccaccgccgacuucgccgcggccacccuccagcggacgcaccgcaccaaccggccccugcccccgccgcccucccagcgcagcgccgagcagcccccggucguggggcagguccaggccgccaccaacaucggccugaacaacucccacaagguccagggcguggugcccguccccgagcggcccccggagccccgcgcgauggacgaccccgccagcgccuucaucuccgacagcggggccgcggccgcccagugccccauggccaccgccgugcagccgggccuccccgagaaggugcgggacggggcgcgcgucccccugcugcaccuccgggccgaguccgugcccgcccacccgugcggcuuccccgcgccccugcccccgacccgcaugauggagagcaagaugaucgccgcgauccacuccagcuccgccgacgccacgagcagcuccaacuaccacagcuucgugaccgccuccagcaccuccgucgacgacgcccugccccucccccugccggugccccagcccaagcacgcgagccagaagaccguguacuccagcuucgcccggcccgacgucacgaccgagccguucgggcccgacaacugccugcacuucaacaugacccccaacugccaguaccgcccccaguccgugccgccccaccacaacaagcucgagcagcaccagguguacggcgcccggagcgagccgcccgccuccaugggccugcgcuacaacaccuacgucgcgccggggcgcaacgccagcggccaccacuccaagcccugcagccggguggaguacguguccagccuguccagcagcguccgcaacacgugcuaccccgaggacaucccgcccuaccccaccauccggcgcgugcagucccuccacgcgccgcccagcuccaugauccggagcgugcccaucucccgcaccgaggugccgcccgacgacgagcccgccuacugcccgcggccccuguaccaguacaagcccuaccagagcucccaggcccgcagcgacuaccacgugacccagcugcagccguacuucgagaacgggcgggugcacuaccgcuacucccccuacagcuccagcuccagcuccuacuacagccccgacggcgcgcucugcgacgucgacgccuacggcacggugcagcugcggccccugcaccgccucccgaaccgggacuucgccuucuacaacccccgccugcaggggaagucccuguacagcuacgccggccucgcgccccggccccgcgcgaacgugaccggguacuucuccccgaacgaccacaacgucgugagcaugccgcccgccgccgacgugaagcacaccuacaccagcugggaccuggaggacauggagaaguaccggaugcaguccauccgccgggagagccgcgcccgccagaaggucaagggccccgugaugucccaguacgacaacaugacgccggccgugcaggacgaccucgggggcaucuacgucauccaccuccggagcaaguccgaccccggcaagaccgggcugcugagcguggcggagggcaaggagucccgccacgccgccaaggccaucagccccgagggggaggaccgguucuaccgccggcaccccgaggcggagauggaccgcgcccaccaccacggcgggcacggcuccacccagccggagaagcccagccucccccagaagcaguccagccugcggucccgcaagcugcccgacaugggcugcagccucccggagcaccgggcccaccaggaggccucccaccgccaguucugcgagagcaagaacgggccgcccuacccccagggcgccgggcagcuggacuacggcuccaaggggaucccggacaccagcgagcccguguccuaccacaacagcggcgucaaguacgcggccagcggccaggagucccugcggcucaaccacaaggaggugcgccugagcaaggagauggagcggcccugggugcgccagcccuccgccccggagaagcacagccgggacugcuacaaggaggaggagcaccugacgcaguccaucgugccgccgcccaagcccgagcgcagccacucccucaagcugcaccacacccagaacguggagcgggaccccagcgugcuguaccaguaccagccccacgggaagcgccaguccagcgucaccguggugucccaguacgacaaccuggaggacuaccacagccucccccagcaccagcggggcgucuucgggggcggcgggaugggcaccuacgugccgcccggguucccccacccgcagucccgcacguacgccaccgcccugggccagggggcguuccugcccgccgagcucagccugcagcaccccgagacccagauccacgccgaguga

SEQ ID NO: 26837 - RNA, 4500 nt, Artificial Sequence
  derived and/or modified sequence opt1 from ARHGAP35__Homo_sapiens__NP_004482
augaugauggcccgcaagcaggacgugcggauccccaccuacaacaucagcgucgugggccuguccgggaccgagaaggagaagggccagugcgggaucggcaagagcugccucugcaaccgcuucgugcggcccuccgccgacgaguuccaccuggaccacacgagcguccuguccaccagcgacuucgggggccgcguggugaacaacgaccacuuccucuacuggggcgaggucucccggagccuggaggacugcguggagugcaagaugcacaucguggagcagaccgaguucaucgacgaccagaccuuccagccccaccgcuccacggcgcugcagcccuacaucaagcgggccgccgccaccaagcucgccagcgcggagaagcugauguacuucugcaccgaccagcuggggcucgagcaggacuucgagcagaagcagaugcccgacggcaagcugcuggucgacggguuccuccugggcaucgacgugucccgcgggaugaaccggaacuucgacgaccagcugaaguucgugagcaaccucuacaaccagcuggccaagaccaagaagccgaucgucguggugcugacgaagugcgacgagggcgucgagcgcuacauccgggacgcccacaccuucgcccucuccaagaagaaccuccaggugguggagaccagcgcgcgcuccaacgucaacguggaccuggccuucagcacccucgugcagcugaucgacaagucccggggcaagacgaagaucauccccuacuucgaggcccugaagcagcagagccagcagaucgccaccgccaaggacaaguacgaguggcucgucucccgcaucgugaagaaccacaacgagaacuggcugagcgugagccggaagaugcaggcgucccccgaguaccaggacuacgucuaccuggaggggacccagaaggccaagaagcuguuccugcagcacauccaccgccugaagcacgagcacaucgagcggcgccggaagcucuaccuggccgcccugccccucgccuucgaggcgcugaucccgaaccuggacgagaucgaccaccucagcugcaucaaggccaagaagcugcuggagaccaagcccgaguuccucaagugguucgugguccuggaggagacgcccugggacgccaccucccacaucgacaacauggagaacgagcgcauccccuucgaccugauggacaccgugccggccgagcagcucuacgaggcccaccuggagaagcugcggaacgagcgcaagcgcguggagaugcggcgcgcguucaaggagaaccucgagaccagccccuucaucacgcccggcaagcccugggaggaggcccgguccuucaucaugaacgaggacuucuaccaguggcuggaggagagcgucuacauggacaucuacgggaagcaccagaagcagaucaucgacaaggccaaggaggaguuccaggagcugcuccuggaguacuccgagcuguucuacgagcuggagcucgacgccaagccgagcaaggagaagaugggcgugauccaggacgugcugggcgaggagcagcgcuucaaggcccugcagaagcuccaggcggagcgggacgcccugauccugaagcacauccacuucgucuaccaccccaccaaggagaccugccccuccugccccgccugcguggacgccaagaucgagcaccucaucagcucccgcuucauccggccgagcgaccgcaaccagaagaacucccugagcgaccccaacaucgaccggaucaaccuggugauccucgggaaggacggccuggcgcgcgagcuggccaacgagauccgggcccucugcaccaacgacgacaaguacgucaucgacgggaagauguacgagcugucccugcgccccaucgagggcaacgugcggcuccccgugaacagcuuccagacgccgaccuuccagccccacgggugccugugccuguacaacuccaaggagagccucuccuacgucguggagagcaucgagaagucccgcgaguccacccugggccggcgcgacaaccaccuggugcaccucccccugacccugauccucgucaacaagcggggcgacacgagcggggagacccugcacucccugauccagcagggccagcagaucgccagcaagcuccagugcguguuccuggaccccgccuccgcggggaucggcuacgggcgcaacaucaacgagaagcagaucagccaggugcugaagggccuccuggacuccaagcggaaccugaaccucgucagcuccaccgccagcaucaaggaccuggccgacguggaccugcgcaucgugaugugccucaugugcggcgacccguucuccgccgacgacauccuguuccccguccugcagagccagaccugcaaguccagccacugcggguccaacaacagcgugcuccuggagcugcccaucggccuccacaagaagcgcaucgagcuguccgugcugagcuaccacagcuccuucagcauccggaagucccgccucguccacggguacaucguguucuacagcgccaagcggaaggcgucccuggccaugcugcgcgccuuccucugcgaggugcaggacaucaucccgauccagcuggucgcccugacggacggcgccguggacgugcucgacaacgaccugagccgggagcagcugaccgagggggaggagaucgcgcaggagaucgacggccgcuucaccuccauccccugcagccagccccagcacaagcucgagaucuuccaccccuucuucaaggacgucguggagaagaagaacaucaucgaggccacccacauguacgacaacgccgccgaggcgugcuccacgaccgaggagguguucaacagcccgcgggccggcagcccccugugcaacagcaaccugcaggacuccgaggaggacaucgagcccagcuacucccucuuccgcgaggacaccagccugcccucccugagcaaggaccacuccaagcucagcauggagcuggaggggaacgacggccugagcuucaucauguccaacuucgagagcaagcucaacaacaaggucccgccgcccgugaagcccaagccgcccgugcacuucgagaucaccaagggggaccuguccuaccuggaccagggccaccgggacggccagcgcaagagcgucuccagcucccccuggcucccccaggacggguucgacccgagcgacuacgccgagcccauggacgccguggugaagccccggaacgaggaggagaacaucuacuccgucccccacgacagcacccagggcaagaucaucacgauccgcaacaucaacaaggcccaguccaacgggagcggcaacggguccgacagcgagauggacaccuccagccuggagcggggccgcaagguguccaucgugagcaagccgguccuguaccggacccgcugcacccggcucggccgcuucgcguccuaccggacgagcuucagcgugggguccgacgacgagcugggccccauccgcaagaaggaggaggaccaggccagccagggguacaagggcgacaacgccgugauccccuacgagaccgacgaggacccccggcgccgcaacauccugcggucccuccgccggaacaccaagaagccgaagcccaagccccgcccgagcaucaccaaggccacgugggaguccaacuacuucggggucccccugaccaccguggugacccccgagaagcccaucccgaucuucaucgagcggugcaucgaguacaucgaggccacgggccugagcaccgagggcaucuaccgcgucuccgggaacaagagcgagauggagucccuccagcggcaguucgaccaggaccacaaccuggaccuggcggagaaggacuucaccgugaacaccguggccggcgccaugaaguccuucuucagcgagcuccccgacccccugguccccuacaacaugcagaucgaccugguggaggcccacaagaucaacgaccgcgagcagaagcuccacgcccugaaggagguccugaagaaguucccgaaggagaaccacgagguguucaaguacgugaucagccaccucaacaaggucucccacaacaacaaggugaaccugaugacgagcgagaaccuguccaucugcuucuggcccacccucaugcggcccgacuucagcaccauggacgcgcugaccgccacgcgcaccuaccagaccaucaucgagcuguucauccagcagugccccuucuucuucuacaaccggccgaucaccgagccgcccggggcccgccccuccagccccuccgccguggcgagcacgguccccuuccucaccagcacccccgugaccucccagcccagcccgccccaguccccgccgcccacgccccagagccccaugcagccccugcugcccucccagcuccaggccgagcacacccuguga

SEQ ID NO: 26838 - RNA, 2625 nt, Artificial Sequence
  derived and/or modified sequence opt1 from ARHGAP42__Homo_sapiens__NP_689645
augggccugcccacccucgaguucagcgacuccuaccuggacagcccggacuuccgcgagcggcugcagugccacgagaucgagcucgagcgcaccaacaaguucaucaaggagcugaucaaggacgggucccugcucaucggcgcccugcggaaccugagcauggccgugcagaaguucucccagagccuccaggacuuccaguucgagugcaucggggacgcggagacggacgacgagaucuccaucgcccagagccugaaggaguucgcccgccugcucaucgccgucgaggaggagcggcgccggcugauccagaacgccaacgacgugcugaucgcgccccucgagaaguuccgcaaggagcagaucggcgccgccaaggacgggaagaagaaguucgacaaggaguccgagaaguacuacagcauccuggagaagcaccugaaccucuccgccaagaagaaggagagccaccuccaggaggcggacacccagaucgaccgggagcaccagaacuucuacgaggccucccuggaguacguguucaagauccaggagguccaggagaagaagaaguucgaguucguggagccccugcugagcuuccugcagggccucuucaccuucuaccacgagggcuacgagcuggcccaggaguucgcccccuacaagcagcagcugcaguucaaccuccagaacacccgcaacaacuucgaguccacgcggcaggagguggagcgccugaugcagcggaugaaguccgccaaccaggacuaccgcccgcccagccaguggaccauggagggguaccuguacguccaggagaagcggccccucggcuucaccuggaucaagcacuacugcaccuacgacaaggggagcaagacguucaccauguccgugagcgagaugaaguccagcggcaagaugaacgggcuggugaccagcucccccgagauguucaagcucaagagcugcauccgccggaagaccgacuccaucgacaagcgcuucugcuucgacaucgaggucguggagcggcacggcaucaucacgcugcaggcguucagcgaggccaaccgcaagcuguggcuggaggccauggacggcaaggagccgaucuacacccuccccgccaucaucuccaagaaggaggagauguaccugaacgaggccggguucaacuucgugcggaagugcauccaggcggucgagacccgcggcaucaccauccuggggcucuaccgcaucggcggcgugaacagcaaggugcagaagcugaugaacacgaccuucucccccaagagcccgcccgacaucgacaucgacaucgagcugugggacaacaagaccaucaccuccgggcucaagaacuaccugcggugccuggccgagccccucaugacguacaagcugcacaaggacuucaucaucgccgucaagagcgacgaccagaacuaccgcguggaggccgugcacgcccugguccacaagcuccccgagaagaaccgggagaugcuggacauccugaucaagcaccuggugaaggugucccuccacagccagcagaaccugaugaccgucuccaaccugggcgugaucuucgggcccacccucaugcgcgcgcaggaggagaccguggccgccaugaugaacaucaaguuccagaacaucgucguggagauccugaucgagcacuacgagaagaucuuccacacggccccggaccccagcaucccccugccccagccgcagucccggagcggcucccgccggacccgcgccaucugccucagcaccgggagccggaagccccgcggccgguacacccccugccuggcggagcccgacuccgacagcuacuccagcuccccggacagcacgcccaugggcuccaucgagagccuguccagccacuccagcgagcagaacuccaccaccaagagcgccuccugccagccccgcgagaaguccgggggcauccccuggaucgccaccccgagcagcagcaacgggcagaagucccucggccuguggacgaccagccccgaguccagcucccgggaggacgccaccaagaccgacgcggagagcgacugccaguccgucgccagcgugacgucccccggggacgugagcccgcccaucgaccuggucaagaaggagcccuacggccucuccggccugaagcgcgccagcgccuccagccugcgguccaucagcgccgcggaggggaacaaguccuacagcggcuccauccagagccucaccagcgugggguccaaggagacccccaaggccagcccgaaccccgaccugccgcccaagaugugccgccggcugcgccucgacaccgccuccagcaacggcuaccagcggcccggguccguggucgccgccaaggcgcagcuguucgagaacgugggcagccccaagcccguguccagcggccgccaggccaaggccauguacuccugcaaggccgagcacagccacgagcuguccuucccccagggggccaucuucagcaacgucuacccguccguggagcccggcuggcucaaggcgaccuacgaggggaagacgggccuggugcccgagaacuacgucguguuccuguga

SEQ ID NO: 26839 - RNA, 2961 nt, Artificial Sequence
  derived and/or modified sequence opt1 from ARHGAP4__Homo_sapiens__NP_001158213
auggccgcccacggcaagcugcgccgggagcgcgggcuccaggcggaguacgagacccaggugaaggagaugcgguggcagcugagcgagcagcugcgcugccucgagcugcagggcgagcugcggcgcgagcuccugcaggagcuggccgaguucaugcggcgccgggccgaggucgagcucgaguacucccgcgggcuggagaagcuggccgagcgguucagcucccgcggcgggcggcucggcagcucccgcgagcaccagagcuuccggaaggagcccucccugcugagcccgcuccacugcugggccgugcugcugcagcacacccgccagcagucccgggagagcgcggcccucuccgaggugcuggccggcccccuggcccagcgccucagccacaucgcggaggacgucgggcggcuggugaagaagucccgcgaccuggagcagcagcuccaggacgagcugcuggagguggucagcgagcuccagacggccaagaagaccuaccaggccuaccacauggaguccgugaacgccgaggccaagcugcgggaggcggagcgccaggaggagaagcgcgccggccggagcgugcccaccaccacggccggggccaccgaggccggcccccugcgcaaguccagccucaagaagggcgggcggcuggucgagaagcuguggccgccccagcgccccguggcggccuccagcugcgcccccgugugcuggcuccaggccggcuuccugguccacccgcccugguggggcgccaugugcgcgcccagcacccaccagcggcaggccaaguucauggagcacaagcugaagugcaccaaggcccgcaacgaguaccuccugucccuggccagcgugaacgccgcgguguccaacuacuaccuccacgacguccuggaccugauggacugcugcgacacgggguuccaccucgcccugggccaggugcugcggagcuacaccgccgccgagucccgcacccaggcgagccaggugcaggggcucggcucccuggaggaggccgucgaggcccuggacccgcccggggacaaggccaaggugcucgaggugcacgccaccgucuucugcccgccccugcgguucgacuaccacccccacgacggcgacgagguggcggagaucugcguggagauggagcugcgcgacgagauccugccccgggcccagaacauccagagccgccucgaccggcagacgaucgagaccgaggaggucaacaagacccugaaggccacccugcaggcccuccuggagguggucgccuccgacgacggggacgugcuggacagcuuccagacgucccccagcaccgagucccucaagagcaccuccagcgaccccggcucccgccaggcggggcggcgccggggccagcagcaggagaccgagacguucuaccugaccaagcugcaggaguaccucagcggccgcuccauccuggccaagcugcaggccaagcacgagaagcuccaggaggcccugcagcgcggggacaaggaggagcaggaggugagcuggacccaguacacccagcggaaguuccagaagucccgccagccccggccgagcagccaguacaaccagcgccuguucggcggggacauggagaaguucauccaguccagcggccagcccgucccccucgugguggaguccugcauccgguucaucaaccugaacgggcugcagcacgagggcaucuuccgcgucagcggcgcccagcuccggguguccgagauccgcgacgcguucgagcgcggggaggacccccugguggagggcugcacggcccacgaccuggacagcgucgccggggugcucaagcuguacuuccggucccuggagccgccccucuucccgcccgaccuguucggcgagcugcucgccagcuccgagcuggaggcgaccgccgagcggguggagcacgucagccgccugcucuggcggcugcccgcccccgugcuggugguccuccgcuaccuguucaccuuccugaaccaccucgcccaguacuccgacgagaacaugauggaccccuacaaccuggccgugugcuucgggccgacccugcuccccgugcccgcgggccaggaccccgucgcccugcagggccgggugaaccagcuggugcagacgcucaucguccagccggaccgcguguucccgccccugaccagccugcccgggcccguguacgagaagugcauggccccgcccuccgccagcugccucggcgacgcccagcuggagucccugggggcggacaacgagcccgagcucgaggccgagaugcccgcccaggaggacgaccuggagggcgucguggaggccguggccugcuucgcguacaccggccggaccgcccaggagcugagcuuccgccgcggggacguccuccggcugcacgagcgggccagcuccgacugguggcgcggcgagcacaacgggaugcggggccugaucccccacaaguacaucacgcuccccgccgggaccgagaagcaggucgugggcgcgggccugcagaccgccggggagagcggcuccagccccgaggggcugcucgccuccgagcuggugcaccgcccggagcccugcaccagccccgaggccaugggccccuccgggcaccgccggcgcugccuggugccggccagccccgagcagcacguggaggucgacaaggcgguggcccagaacauggacuccguguucaaggagcuccugggcaagacgagcguccggcagggccuggggcccgccuccaccaccagccccuccccgggcccccgcagccccaaggccccgcccuccagccggcucgggcgcaacaagggcuucucccgggggcccggcgcccccgcgagcccguccgccagccacccccagggccuggacaccacccccaagccccacuga

SEQ ID NO: 26840 - RNA, 4506 nt, Artificial Sequence
  derived and/or modified sequence opt1 from ARHGAP5__Homo_sapiens__NP_001164
augauggccaagaacaaggagccccgcccgcccagcuacaccaucuccaucgugggccugagcgggaccgagaaggacaagggcaacugcggggucggcaaguccugccucugcaaccgguucgugcgcagcaaggccgacgaguacuaccccgagcacacguccgugcugagcaccaucgacuucgggggccgggucgugaacaacgaccacuuccuguacuggggcgacaucauccagaacuccgaggacgggguggagugcaagauccacgucaucgagcagaccgaguucaucgacgaccagaccuuccucccccaccgcagcacgaaccugcagccguacaucaagcgggccgccgccuccaagcugcagagcgccgagaagcucauguacaucugcaccgaccagcugggccuggagcaggacuucgagcagaagcagaugcccgaggggaagcucaacguggacggcuuccugcugugcaucgacgugucccaggggugcaaccgcaaguucgacgaccagcucaaguucgucaacaaccuguucgugcagcugagcaaguccaagaagcccgugaucaucgccgcgaccaagugcgacgagugcgucgaccacuaccuccgggaggugcaggccuucgccagcaacaagaagaaccugcugguggucgagaccuccgcccgcuucaacgugaacaucgagacgugcuucaccgcgcucgugcagaugcuggacaagacccggagcaagcccaagaucaucccguaccuggacgccuacaagacccagcgccagcucgucgugacggccaccgacaaguucgagaagcuggugcagaccguccgggacuaccacgccaccuggaagacgguguccaacaagcugaagaaccaccccgacuacgaggaguacaucaaccucgagggcacccgcaaggcccggaacaccuucagcaagcacaucgagcagcugaagcaggagcacauccgcaagcggcgcgaggaguacaucaacacccugccccgggcguucaacacgcuccugcccaaccuggaggagaucgagcaccucaacugguccgaggcccugaagcugauggagaagcgcgccgacuuccagcucugcuucgugguccuggagaagaccccgugggacgagaccgaccacaucgacaagaucaacgaccggcgcauccccuucgaccugcucagcacccuggaggccgagaagguguaccagaaccacguccagcaccugaucagcgagaagcggcgcguggagaugaaggagaaguucaagaagacgcucgagaagauccaguucaucucccccggccagcccugggaggaggugaugugcuucgucauggaggacgaggccuacaaguacaucaccgaggcggacagcaaggagguguacgggcgccaccagcgggagaucguggagaaggccaaggaggaguuccaggagaugcuguucgagcacuccgagcuguucuacgaccucgaccugaacgccaccccgagcuccgacaagaugagcgagauccacaccguccuguccgaggagccccgcuacaaggcccuccagaagcuggcccccgaccgggagagccugcuccugaagcacaucggcuucguguaccaccccacgaaggagaccugccuguccgggcagaacugcaccgacaucaagguggagcagcugcucgcgagcucccugcugcagcucgaccacggccgccugcggcuguaccacgacagcaccaacaucgacaaggucaaccucuucauccugggcaaggacgggcuggcccaggagcucgccaacgagauccgcacgcaguccaccgacgacgaguacgcccuggacggcaagaucuacgagcuggaccuccggccgguggacgccaagagccccuacuuccugucccagcuguggaccgcggccuucaagccccacgggugcuucugcguguucaacagcaucgagucccucagcuucaucggcgaguucaucgggaagauccgcaccgaggccucccagauccggaaggacaaguacauggccaaccugcccuucacgcugauccucgcgaaccagcgcgacagcaucagcaagaaccugccgauccugcggcaccagggccagcagcucgccaacaagcugcagugccccuucgucgacgugcccgccggcaccuacccccgcaaguucaacgagacccagaucaagcaggcccugcgcggggugcucgaguccgucaagcacaaccuggacguggugagcccgauccccgccaacaaggaccuguccgaggcggaccuccggaucgucaugugcgccaugugcggcgaccccuucagcguggaccugauccuguccccguuccucgacagccacuccugcagcgccgcccaggccgggcagaacaacucccugaugcuggacaagaucaucggcgagaagcggcgccggauccagaucaccauccucagcuaccacuccagcaucggggugcgcaaggacgagcugguccacggcuacauccugguguacuccgcgaagcggaaggccagcaugggcaugcuccgcgccuuccuguccgaggugcaggacaccauccccguccagcugguggccgugacggacagccaggccgacuucuucgagaacgaggcgaucaaggagcucaugaccgagggggagcacaucgccaccgagaucaccgccaaguucacggcccuguacucccugagccaguaccaccgccagaccgaggucuucacccucuucuucagcgacgugcuggagaagaagaacaugaucgagaacuccuaccugagcgacaacacccgggaguccacgcaccagagcgaggacguguuccuccccagcccccgcgacugcuucccguacaacaacuaccccgacuccgacgacgacaccgaggcgcccccgcccuacucccccaucggcgacgacguccagcugcugcccacccccagcgaccggucccgcuaccggcucgaccuggaggggaacgaguacccgauccacagcacccccaacugccacgaccacgagcgcaaccacaaggugcccccgcccaucaagcccaagcccgugguccccaagacgaacgugaagaagcuggacccgaaccuccugaagaccaucgaggccggcaucgggaagaacccccggaagcagaccucccgcgugccccuggcccaccccgaggacauggacccgagcgacaacuacgccgagcccaucgacaccaucuucaagcagaagggcuacuccgacgagaucuacgucgugcccgacgacagccagaaccggaucaagauccgcaacuccuucgugaacaacacgcagggcgacgaggagaacggguucagcgaccggaccuccaagagccacggcgagcgccggccguccaaguacaaguacaagagcaagacccucuucagcaaggccaaguccuacuaccgccggacccacagcgacgcguccgacgacgaggccuucacgaccagcaagaccaagcgcaaggggcggcaccgcggcuccgaggaggacccccugcugagccccgucgagaccuggaagggcgggaucgacaaccccgccaucacguccgaccaggagcucgacgacaagaagaugaagaagaagacccacaaggugaaggaggacaagaagaagaagaagaccaagaacuucaacccgcccacccggcgcaacugggagagcaacuacuucggcaugccccugcaggaccuggugacggccgagaagcccaucccccucuucgucgagaagugcguggaguucaucgaggacaccgggcugugcaccgagggccuguaccggguguccgggaacaagaccgaccaggacaacauccagaagcaguucgaccaggaccacaacaucaaccucgucagcauggaggugacggugaacgccgucgcgggcgcccugaaggccuucuucgccgaccugcccgacccccucauccccuacucccugcacccggagcugcucgaggccgcgaagauccccgacaagaccgagcgccugcacgcccugaaggagaucgugaagaaguuccaccccgugaacuacgacgucuuccgcuacgugaucacccaccucaaccgggucagccagcagcacaagaucaaccugaugaccgccgacaaccuguccaucugcuucuggcccacgcucaugcgcccggacuucgagaaccgggaguuccugagcaccaccaagauccaccaguccgugguggagaccuucauccagcagugccaguucuucuucuacaacggcgagaucgucgagaccacgaacaucguggcgcccccgcccccgagcaaccccgggcagcugguggagcccauggucccccuccagcugccgccgccccugcagccccagcucauccagccccagcugcagaccgacccccugggcaucaucuga

SEQ ID NO: 26841 - RNA, 2385 nt, Artificial Sequence
  derived and/or modified sequence opt1 from ARHGAP6__Homo_sapiens__NP_001274171
augggccaccccguguaccgcggggagaagccgcagcugcacuacgccggcgacuucaccuggaacagcauguccgggcggagcgugcgccuccgguccgugcccauccagagccuguccgagcuggagcgcgcccggcuccaggagguggcguucuaccagcugcagcaggacugcgaccugagcugccagaucaccauccccaaggacggccagaagcgcaagaagucccuccggaagaagcuggacagccuggggaaggagaagaacaaggacaaggaguucaucccccaggccuucggcaugccgcucucccaggucaucgccaacgaccgcgccuacaagcugaagcaggaccugcagcgggacgagcagaaggacgccagcgacuucguggcgucccuccugcccuucggcaacaagcgccagaacaaggagcugagcuccagcaacuccagccucuccagcacguccgagacccccaacgagagcaccagccccaacaccccggagcccgcgccccgggcccgccggcgcggggccauguccguggacagcaucacggaccuggacgacaaccagucccggcugcucgaggcccugcagcugagccuccccgccgaggcccaguccaagaaggagaaggcccgcgacaagaagcugagccugaacccgaucuaccggcaggucccccgccucguggacuccugcugccagcaccuggagaagcacggccugcagaccguggggaucuuccgggucggcagcuccaagaagcgcgugcggcagcuccgcgaggaguucgaccgcgggaucgacgugagccuggaggaggagcacuccguccacgacguggccgcgcugcucaaggaguuccugcgggacaugcccgacccccugcucacccgcgagcuguacaccgccuucaucaacacgcugcuccuggagccggaggagcagcugggcacccuccagcugcugaucuaccuccugccgcccugcaacugcgacacccugcaccggcuccugcaguuccugagcaucguggcccgccacgccgacgacaacaucuccaaggacggccaggaggucaccgggaacaagaugacgagccucaaccuggccaccaucuucggccccaaccugcugcacaagcagaaguccagcgacaaggaguucuccgugcagagcuccgcgcgggccgaggagagcaccgccaucaucgccgugguccagaagaugaucgagaacuacgaggcccucuucauggugccgcccgaccugcagaacgaggugcugaucagccuccuggagaccgaccccgacgucguggacuaccugcuccgccggaaggcgucccagagcuccagccccgacaugcugcaguccgaggugagcuucuccgucgggggccgccacagcuccacggacagcaacaaggccuccagcggcgacaucucccccuacgacaacaacagccccgugcuguccgagcggagccuccuggccaugcaggaggacgccgcccccgggggcuccgagaagcuguaccgcguccccgggcaguucaugcucgugggccaccugagcagcuccaagagccgggaguccagcccggggccccgccugggcaaggaccucuccgaggagcccuucgacaucuggggcaccuggcacagcacccugaaguccgggagcaaggacccgggcaugaccggguccagcggcgacaucuucgaguccagcucccugcgggcggggcccugcagccucucccagggcaaccugagccccaacuggccccgcuggcagggcuccccggccgagcuggacagcgacacgcagggggcccggcgcacccaggccgcggcccccgccaccgagggccgggcccaccccgccgugucccgcgcgugcagcacgccccacguccagguggccgggaaggccgagcggccgaccgcccgcagcgagcaguaccucacccuguccggcgcccacgaccugagcgaguccgagcucgacguggcggggcugcagagccgcgccacgccccagugccagcggccccacggcuccggccgcgacgacaagcggcccccgccgcccuaccccgggcccggcaagcccgccgccgccgcggccuggauccaggggccgcccgagggcgucgagacccccaccgaccagggcgggcaggccgccgagcgcgagcagcaggucacccagaagaagcugagcuccgcgaacagccuccccgccggcgagcaggacagcccccggcugggggacgccggcuggcuggacuggcagcgcgagcgguggcagaucugggagcuccuguccaccgacaaccccgacgcccugccggagacccucguguga

SEQ ID NO: 26842 - RNA, 1644 nt, Artificial Sequence
  derived and/or modified sequence opt1 from ARHGAP9__Homo_sapiens__NP_001073625
augagcgagcccccgguguacugcaaccuggucgaccuccgccggugcccccgcuccccgcccccgggccccgccugcccccugcugcagcggcucgacgccugggagcagcaccuggaccccaacagcgggcgcugcuucuacaucaacucccugaccggcugcaagagcuggaagccgccccggcgcucccggagcgagaccaaccccggguccauggagggcacgcagacccucaagcgcaacaacgacgugcugcagccccaggcgaagggguuccggagcgacaccggcaccccggagccccuggacccccagggcucccucagccugucccagcgcacgagccagcuggacccgcccgcccuccaggcgccccggccccugccccagcugcucgacgacccgcacgagguggagaaguccgggcugcugaacaugaccaagaucgcccagggcgggcgcaagcuccggaagaacuggggccccagcugggucgugcugaccgggaacucccugguguucuaccgcgagcccccgcccaccgcccccagcuccggcuggggccccgccgggagccggcccgaguccagcgucgaccuccgcggcgccgcccuggcccacgggcggcaccugagcucccgccggaacgugcuccacauccgcacgauccccggccacgaguuccugcugcagagcgaccacgagaccgagcuccgggcguggcaccgcgcccugcgcaccgugaucgagcggcuggaccgcgagaacccccucgagcugcggcuguccggcagcgggcccgccgagcucuccgccggcgaggacgaggaggaggagagcgagcuggucuccaagccgcugcuccgccugagcucccggcgcagcuccauccgggggcccgagggcaccgagcagaaccgcgugcggaacaagcugaagcgccucaucgccaagcggccgccccugcagagccugcaggagcgcgggcuccugcgggaccagguguucggcugccagcuggagucccucugccagcgcgagggcgacacgguccccagcuuccugcggcugugcaucgcggccguggacaagcgcgggcucgacguggacggcaucuaccgggucuccgggaaccuggccguggugcagaagcugcgcuuccuggucgaccgggagcgcgccgugaccagcgacggccgcuacguguuccccgagcagcccgggcaggagggccggcucgaccuggacuccaccgagugggacgacauccacgucgugaccggcgcccugaagcuguuccuccgcgagcugccccagccgcucgugccgccccugcugcucccccacuuccgggcggcccuggcccugagcgaguccgagcagugccucagccagauccaggagcugaucgggagcaugcccaagcccaaccacgacacgcugcgcuaccuccuggagcaccugugccgggucaucgcccacuccgacaagaaccgcaugacgccccacaaccucggcaucguguucgggcccacccuguuccggccggagcaggagaccagcgaccccgccgcgcacgcccuguaccccggccagcucguccagcugaugcugaccaacuucaccucccucuuccccuga

SEQ ID NO: 26843 - RNA, 1014 nt, Artificial Sequence
  derived and/or modified sequence opt1 from ARHGDIA__Homo_sapiens__NP_001288171
auggccgagcaggagcccaccgccgagcagcuggcccagaucgccgccgagaacgaggaggacgagcacagcgugaacuacaagccgcccgcccagaaguccauccaggagauccaggagcucgacaaggacgacgagagccugcgcaaguacaaggaggcccugcucggccgggucgcgguguccgccgaccccaacgugcccaacgucguggugaccgggcugacgcuggucugcagcuccgcccccggcccccucgagcuggaccugaccggggaccucgagagcuucaagaagcaguccuucgugcugaaggagggcguggaguaccgcaucaagaucagcuuccgggucaaccgcgagaucguguccgggaugaaguacauccagcacaccuaccggaagggcgugaagaucgacaagaccgacuacaugacgaccacccgccccaccacgugccccggcagcgggaucuccccgagccggcgcaccggccggaccgagcccucccagcgccgggccgggcagaccgacggccgcacgaccgaccggcgcaugugcccgccccagccccugcccagccccuaccaguccgcggaccggcccagcgucccgcucccgcccugguccgccagccuggccuggcugaaccgcgugccgcccacgccccuccugagcccgcccccgcccaccgggcccgccuccagcguguccugccuggucgccgcgagcgccugcgccgugggcgagcggggccgcucccaggccagcgccgcgcucuccgugccgccccgguucuaccugcccgucacccccgaggccuggcugcaggagggggccgagcagcccuucagccgcccccggggcugccccuggaccugcgccuccgccgcgcccggguggagcuggggcgugggcugcaccgccuccugggggcccggccgcccgcccgcgccccuccugcccgggcagccgcccugccgcugccggagccgccugaccaugaugcccuga

SEQ ID NO: 26844 - RNA, 606 nt, Artificial Sequence
  derived and/or modified sequence opt1 from ARHGDIB__Homo_sapiens__XP_011518968
augaccgagaaggcccccgagccgcacguggaggaggacgacgacgacgagcuggacagcaagcucaacuacaagcccccgccccagaagucccugaaggagcugcaggagauggacaaggacgacgagagccucaucaaguacaagaagacccugcugggcgacgggcccgucgugacggaccccaaggcccccaacguggucgugacccgccucacccuggugugcgaguccgcgcccggcccgaucaccauggaccugacgggggaccucgaggcccugaagaaggagaccaucguccugaaggagggcagcgaguaccgggugaagauccacuucaaggugaaccgcgacaucgucuccgggcucaaguacgugcagcacaccuaccggaccggcgugaaggucgacaaggccacguucauggugggcagcuacgggccccgccccgaggaguacgaguuccugacccccguggaggaggccccgaagggcaugcuggcccgggggaccuaccacaacaaguccuucuucaccgacgacgacaagcaggaccaccucagcugggaguggaaccuguccaucaagaaggaguggacggaguga

SEQ ID NO: 26845 - RNA, 4035 nt, Artificial Sequence
  derived and/or modified sequence opt1 from ARHGEF10__Homo_sapiens__NP_055444
auggaccagcgcgagccccugccgcccgcccccgccgagaacgagaugaaguacgacaccaacaacaacgaggaggaggagggcgagcaguucgacuucgacagcggggacgagauccccgaggcggaccggcaggccccguccgcccccgagaccggcggggccggcgccagcgaggcgcccgcccccaccgggggcgaggacggcgccggggccgagacgaccccgguggcggagcccaccaagcucguccugcccaugaaggugaaccccuacuccgugaucgacaucacgccguuccaggaggaccagccgcccacccccguccccagcgccgaggaggagaacgugggccugcacgugcccugcggguaccucguccccgugcccugcggcuacgccgugccguccaaccugccccugcuccugcccgccuacagcucccccgucaucaucugcgccaccagccuggacgaggaggagaccccggaggugacggaggaccgccagcccaacucccucagcuccgaggagccgcccaccagcgaggaccagguggggcgggaggacuccgcgcuggcccgcugggccgccgaccccgccaacaccgcguggauggagaaccccgaggaggccaucuacgacgacgucccccgggagaacagcgacuccgagccggacgagaugaucuacgacgacguggagaacggcgacgagggcgggaacagcucccuggaguacggcuggagcuccagcgaguucgagagcuacgaggagcaguccgacagcgagugcaagaacgggaucccccgcuccuuccuccggagcaaccacaagaagcagcugucccacgaccugacccgccucaaggagcacuacgagaagaagaugcgggaccugauggccagcacggugggcgucguggagauccagcagcugcgccagaagcacgagcucaagaugcagaagcuggugaaggccgccaaggacggcaccaaggacgggcuggagcggacccgcgcggccgucaagcggggccgcuccuucauccggaccaagagccucaucgcccaggaccaccgcuccagccuggaggaggagcagaaccuguucaucgacguggacugcaagcaccccgaggccauccucacgcccaugccggaggggcugucccagcagcaggucgugcggcgcuacauccugggcagcgugguggacuccgagaagaacuacgucgacgcccucaagcggauccuggagcaguacgagaagccccugagcgagauggagcccaaggugcucuccgagcgcaagcugaagaccgucuucuaccgggugaaggagauccugcagugccacagccucuuccagaucgcgcuggccucccgcgugagcgagugggacuccgucgagaugaucggggacguguucguggccagcuucagcaaguccaugguccuggacgccuacagcgaguacgugaacaacuucuccaccgcgguggccguccucaagaagaccugcgccacgaagcccgccuuccuggaguuccugaagcaggagcaggaggccagcccggaccgcaccacccucuacucccugaugaugaagcccauccagcgguucccccaguucauccugcuccugcaggacaugcugaagaacaccagcaagggccaccccgaccgccucccgcugcagauggcgcugacggagcucgagacccuggccgagaagcugaacgagcggaagcgcgacgccgaccagcggugcgaggugaagcagaucgccaaggccaucaacgagcgcuaccugaacaagcuccuguccagcggcucccgguaccugauccgcagcgacgacaugaucgagaccguguacaacgaccgcggggagaucgucaagaccaaggagcggcggguguucaugcucaacgacgugcugaugugcgcgacggucuccagccgccccucccacgacagccgggugauguccagccagcgcuaccugcucaagugguccgugccccugggccacgucgacgccaucgaguacgggagcagcgccggcaccggggagcacucccggcaccuggccgugcacccgcccgagagccucgccguggucgcgaacgccaagcccaacaagguguacaugggccccggccagcuguaccaggaccugcagaaccuccugcacgaccugaacgugaucgggcagaucacccagcucaucggcaaccugaaggggaacuaccagaaccugaaccaguccgucgcccacgacuggaccagcggccuccagcgccugauccugaagaaggaggacgagauccgggccgcggacugcugccgcauccagcuccagcugcccgggaagcaggacaaguccggccggccgacguucuucaccgccguguucaacaccuucacccccgccaucaaggagagcugggugaacucccugcagauggccaagcucgcccuggaggaggagaaccacaugggcugguucugcgucgaggacgacgggaaccacaucaagaaggagaagcacccccugcucgugggccacaugcccgugauggucgcgaagcagcaggaguucaagaucgagugcgccgccuacaacccggagcccuaccugaacaacgagagccagcccgacuccuucagcacggcccacggguuccuguggaucggcuccugcacccaccagaugggccagaucgccaucgugagcuuccagaacuccaccccgaaggugaucgagugcuucaacgucgagagccgcauccucugcaugcuguacgugcccguggaggagaagcgccgggagcccggggcgcccccggaccccgagacccccgccguccgcgccuccgacgugcccaccaucugcgugggcacggaggaggggagcaucuccaucuacaagagcucccagggcagcaagaagguccggcugcagcacuucuucaccccggagaaguccaccgugaugagccucgccugcaccagccagucccuguacgccgggcuggugaacggcgcggucgccagcuacgcccgcgcccccgacggcuccugggacagcgagccccagaaggugaucaagcucggggugcugcccguccggucccugcucaugauggaggacacgcugugggcggccagcggcggccagguguucaucaucuccguggagacccacgccgucgaggggcagcuggaggcccaccaggaggaggggauggugaucagccacauggccguguccggcgucggcaucuggaucgcguucaccagcggguccacccuccgccuguuccacacggagacccugaagcaccuccaggacaucaacaucgccaccccggugcacaacaugcugcccggccaccagcggcugagcgucaccucccuccuggugugccacgggcugcucauggugggcacgagccuggggguccugguggcccuccccgugccccgccugcagggcaucccgaaggucaccggccgggggaugguguccuaccacgcccacaacagccccgugaaguucaucguccuggccaccgcgcuccacgagaaggacaaggacaagucccgcgacagccuggcccccggccccgagccgcaggacgaggaccagaaggacgcccugcccagcgggggcgccggguccagccucucccagggcgaccccgacgccgcgaucuggcugggcgacagccugggguccaugacccagaaguccgaccucagcagcuccagcggcucccugagccugucccacgggagcuccagccucgagcaccgguccgaggacagcacgaucuacgaccugcugaaggaccccgugucccuccgcagcaaggcccggcgcgccaagaaggccaaggccagcuccgcgcugguggucugcggcggccaggggcaccggcgcgugcaccggaaggcccgccagccgcaccaggaggagcuggcccccaccgugauggucuggcagaucccccuccugaacaucuga

SEQ ID NO: 26846 - RNA, 3726 nt, Artificial Sequence
  derived and/or modified sequence opt1 from ARHGEF10L__Homo_sapiens__XP_011539993
auggccagcuccaacccgccgccccagcccgccaucggcgaccagcuggugcccggggucccgggccccagcuccgaggcggaggacgaccccggggaggccuucgaguucgacgacagcgacgacgaggaggacaccuccgccgcccucggcgugcccagccuggccccggagcgcgacaccgacccgccccugauccaccucgacuccauccccgugacggaccccgaccccgcggccgccccgcccgggaccggcguccccgccugggugagcaacggcgacgcggccgacgccgccuucuccggggcccggcacagcuccuggaagcgcaagagcucccggcgcaucgaccgguucaccuuccccgcgcuggaggaggacgugaucuacgacgacguccccugcgagagccccgacgcccaccagccggccggcgccgagcgcaaccugcucuacgaggacgcccaccgggcgggggcgccccgccaggccgaggaccugggcugguccagcuccgaguucgagagcuacuccgaggacagcggggaggaggccaagcccgagguggagguggagcccgccaagcaccgggucagcuuccagccgaagaugacccagcugaugaaggccgccaaguccggcacgaaggacggccucgagaagacccgcauggccgugaugcggaaggugagcuuccugcaccgcaaggacguccugggggacuccgaggaggaggacaugggccuccuggaggugagcguguccgacaucaagccgcccgcccccgagcuggggcccaugcccgagggccucagcccccagcaggucgugcggcgccacauccugggcuccaucgugcagagcgagggguccuacgucgagagccugaagcggauccuccaggacuaccgcaacccgcugauggagauggagcccaaggcccuguccgcgcggaagugccaggugguguucuuccgcgucaaggagauccuccacugccacagcauguuccagaucgcccuguccagccggguggccgagugggacuccaccgagaagaucggcgaccuguucguggccagcuucuccaagagcaugguccucgacguguacuccgacuacgucaacaacuucaccagcgcgaugagcaucaucaagaaggccugccugacgaagcccgccuuccuggaguuccucaagcgccgccaggugugcucccccgaccgggugacccuguacgggcugauggucaagccgauccagcgcuucccccaguucauccuccugcugcaggacaugcucaagaacacgccccggggccaccccgaccgccugagccugcagcucgcccugaccgagcuggagacccucgccgagaagcugaacgagcagaagcggcuggcggaccagguggccgagauccagcagcucaccaaguccgugagcgaccgcuccagccugaacaagcugcucaccuccgggcagcggcagcugcugcucugcgagacccugacggagaccgucuacggcgaccgcggccagcugaucaagagcaaggagcggcgcguguuccugcucaacgacaugcuggugugcgccaacaucaacuucaagccggccaaccaccgggggcagcuggagaucuccagccucgucccccugggccccaaguacguggugaaguggaacaccgcccugccccagguccaggugguggaggucgggcaggacggcgggaccuacgacaaggacaacgugcucauccagcacuccggcgcgaagaaggccagcgccuccggccaggcccagaacaagguguaccuggggccgccccgccuguuccaggagcuccaggaccugcagaaggaccuggccgucguggagcagaucacgcuccugaucagcacccugcacggcaccuaccagaaccucaacaugaccguggcgcaggacuggugccuggcccugcagcggcucaugcgcgucaaggaggaggagauccacuccgccaacaagugccggcugcgccugcuccugcccgggaagcccgacaagagcggccggccgaucuccuucauggugguguucaucacgcccaacccccugagcaagaucagcugggucaaccgccuccaccuggccaagaucgggcugcgggaggagaaccagcccggcuggcucugcccggacgaggacaagaaguccaaggcgcccuucuggugccccauccuggccugcugcauccccgccuucagcucccgcgcccugagccuccagcugggcgcccuggugcacuccccggugaacugcccccuccugggguucagcgcggucuccaccagccugccccagggcuaccucugggucgggggcggccaggagggggccggcggccagguggagaucuucucccugaaccggccgagcccccgcaccgugaaguccuucccccuggccgcccccgugcucugcauggaguacaucccggagcuggaggaggaggccgagagccgcgacgagucccccaccguggcggaccccagcgccacgguccaccccaccaucugccuggggcuccaggacggguccauccugcuguacagcuccguggacaccggcacccagugccucgugagcugccgguccccgggccugcagcccguccugugccuccgccacagccccuuccaccuccuggccgggcugcaggacggcacgcuggccgccuacccccggaccagcgggggcgugcugugggaccucgaguccccgcccgugugccugaccgucgggcccggccccgugcgcacccugcucagccuggaggacgcggugugggccuccugcggcccgcgggucacggugcuggaggccaccacccuccagccccagcagagcuucgaggcccaccaggacgaggcgguguccgucacccacauggugaaggccgggagcggcguguggauggccuucuccagcgggaccuccauccgccuguuccacacggagacccuggagcaccuccaggagaucaacaucgccacccggaccacguuccugcugcccggccagaagcaccucugcgucaccagccugcugaucugccaggggcuccugugggugggcaccgaccagggcgugaucguccugcuccccgugccgcgccuggaggggauccccaagaucaccggcaaggggauggucucccugaacggccacugcgggcccguggccuuccucgcgguggccacgagcauccuggcccccgacauccugcgguccgaccaggaggaggccgagggcccgcgcgccgaggaggacaagcccgacggccaggcgcacgagcccaugcccgacagccacgucgggcgggagcucacccgcaagaagggcauccugcugcaguaccggcuccgcuccaccgcccaccuccccgggccccugcugagcaugcgggagcccgccccggccgacggcgccgcgcuggagcacuccgaggaggacggcagcaucuacgagauggccgacgaccccgacaucugggugcgcucccggcccugcgcccgcgacgcccaccggaaggagaucugcagcguggccaucaucagcgggggccagggguaccgcaacuucggcuccgcgcuggggagcuccggccggcaggcccccugcggcgagaccgacagcacgcuccugaucuggcaggucccgcugaugcucuga

SEQ ID NO: 26847 - RNA, 4569 nt, Artificial Sequence
  derived and/or modified sequence opt1 from ARHGEF11__Homo_sapiens__NP_055599
augagcgugcgccugccccaguccaucgaccggcucagcucccugagcucccugggcgacagcgccccggagcgcaagucccccagccaccaccggcagcccuccgacgccagcgagaccaccgggcucguccagcgcugcgugaucauccagaaggaccagcacggcuucggguucacgguguccggcgaccggaucguccuggugcagagcgugcgccccgggggcgcggccaugaaggccggcgucaaggagggggaccggaucaucaaggugaacggcaccauggugaccaacuccagccaccuggaggucgugaagcucaucaaguccggggccuacguggcccugacccugcucggcagcuccccgagcuccauggggaucagcggccugcagcaggaccccagccccgcgggcgccccccgcaucacguccgucaucccgagccccccccccccgcccccccugcccccgccccagcggaucaccgggcccaagccccuccaggacccggaggugcagaagcacgccacccagauccugcgcaacaugcugcggcaggaggagaaggagcuccaggacauccugccccuguacggcgacaccucccagcgccccagcgaggggcggcucucccuggacagccaggagggcgacuccggccuggacagcgggacggagcgcuuccccucccucagcgagucccugaugaaccggaacagcgugcuguccgacccgggccucgacagcccccgcaccucccccgucaucauggcccggguggcgcagcaccaccgccggcaggggagcgacgccgccgugcccuccaccggcgaccagggggucgaccagagcccgaagccccugaucaucggccccgaggaggacuacgacccgggcuacuucaacaacgaguccgacaucaucuuccaggaccuggagaagcucaagagccgccccgcccaccuggggguguuccugcgguacaucuucagccaggccgaccccuccccccuccuguucuaccugugcgcggagguguaccagcaggccagcccgaaggacucccgcagccucggcaaggacaucuggaacaucuuccuggagaagaacgccccccugcgcgucaagauccccgagaugcuccaggccgagaucgacucccggcugcgcaacagcgaggacgcccggggggugcugugcgaggcgcaggaggccgccaugcccgagauccaggagcagauccacgacuaccgcaccaagcggacgcucggccuggggucccuguacggcgagaacgaccuccuggaccuggacggcgacccgcuccgcgagcggcagguggccgagaagcagcuggccgcgcugggggacauccucagcaaguacgaggaggaccgcuccgcccccauggacuucgcccugaacaccuacaugagccacgccggcauccggcugcgcgaggcccggcccuccaacaccgcggagaaggcccagagcgcccccgacaaggacaaguggcugccguucuuccccaagaccaagaaguccagcaacuccaagaaggagaaggacgcccucgaggacaagaagcgcaaccccauccugaaguacaucgggaagcccaagagcuccagccagagcacguuccacaucccgcugucccccgucgaggugaagcccggcaacguccggaacaucauccagcacuucgagaacaaccagcaguacgacgcgcccgagccggggacccagcgccucagcaccggcuccuuccccgaggaccugcuggagagcgacuccagccgguccgagauccgccucggccggagcgagucccugaaggggcgcgaggagaugaagcggagccgcaaggccgagaacgugccccgcucccggagcgacguggacauggacgccgccgccgaggcgacccgccugcaccaguccgccagcuccagcacguccagccucuccacccggagccuggagaaccccaccccgcccuucacccccaagaugggccgccggagcaucgaguccccgagccugggguucugcacggacacccuccugccccaccugcucgaggacgaccugggccagcuguccgaccucgagcccgagcccgacgcccagaacuggcagcacaccgucggcaaggacgugguggccgggcugacccagcgcgagaucgaccggcaggaggucaucaacgagcuguucgugacggaggccagccaccuccgcacccugcgggugcuggaccucaucuucuaccagcgcaugaagaaggagaaccugaugccgcgggaggagcuggcgcgccucuuccccaaccugcccgagcugaucgagauccacaacuccuggugcgaggccaugaagaagcuccgggaggagggccccaucaucaaggagaucagcgaccugaugcuggcccgcuucgacgggccggcccgggaggagcuccagcaggucgccgcgcaguucugcuccuaccagagcaucgcccuggagcugaucaagaccaagcagcgcaaggagucccgguuccagcucuucaugcaggaggccgagagccacccccagugccgccggcugcagcugcgcgaccucaucaucuccgagaugcagcggcugaccaaguacccccugcuccuggagagcaucaucaagcacacggagggcgggaccuccgagcacgagaagcugugccgcgcccgcgaccagugccgggagauccucaaguacgugaacgaggcggugaagcagaccgagaaccgccaccggcuggagggcuaccagaagcgccuggacgccaccgcccucgagcgggccagcaacccccuggccgcggaguucaagucccuggaccucacgacccgcaagaugauccacgagggcccgcugaccuggcggaucagcaaggacaagacccuggaccuccacguccugcugcucgaggaccugcuggugcuccugcagaagcaggacgagaagcugcuccugaagugccacuccaagaccgccguggggagcuccgacagcaagcagacguucagccccguccugaagcucaacgccgugcugauccgcuccguggccaccgacaagcgggccuucuucaucaucugcaccagcaagcugggccccccccagaucuacgagcucgucgcgcugaccuccagcgacaagaacacguggauggagcugcucgaggaggccgugcgcaacgccacccggcacccgggggccgcccccaugcccgugcaccccccgccccccggcccccgcgagccggcgcagcaggggcccacccccucccgggucgagcuggacgacagcgacguguuccacggcgagcccgagccggaggagcugcccggcgggaccggcucccagcagcgcgugcaggggaagcaccagguccuccuggaggaccccgagcaggagggcagcgccgaggaggaggagcugggggugcucccgugccccuccacgagccuggacggcgagaaccggggcauccgcacccggaaccccauccaccuggccuuccccgggccgcucuucauggagggccuggccgacuccgcgcuggaggacguggagaaccuccgccaccugauccuguggagccuccugcccgggcacaccauggagacccaggccgcccaggagcccgaggacgaccugacgcccaccccguccgucaucagcgugaccucccaccccugggaccccggcagccccgggcaggccccgcccggcggcgagggggacaacacccagcucgccggccuggagggggagcggcccgagcaggaggacaugggccugugcucccucgagcaccugcccccgcgcacgcgcaacagcggcaucugggagucccccgagcuggaccggaaccuggcggaggacgccagcagcaccgaggccgccgggggcuacaaggugguccgcaaggccgagguggcgggguccaaggugguccccgcccuccccgagagcggccaguccgagccggggccccccgagguggagggcggcaccaaggccaccgggaacugcuucuacgugagcaugcccuccggcccgcccgacagcuccacggaccacagcgaggcccccaugucccccccgcagcccgacagccugcccgccgggcagaccgagccgcagccccagcugcagggcgggaacgacgacccccggcgccccucccggagcccgcccucccucgcgcugcgcgacgucggcaugaucuuccacaccaucgagcagcugacccucaagcugaaccggcugaaggacauggagcucgcccaccgcgagcugcugaagagccucggcggggaguccagcggcgggacgacccccgugggcuccuuccacaccgaggccgcccgguggaccgacgggagccugucccccccggccaaggagccccuggcgagcgacagccgcaacucccacgagcucggccccugccccgaggacggcagcgacgccccgcuggaggacuccacggccgacgccgcggccagccccgggcccuga

SEQ ID NO: 26848 - RNA, 4578 nt, Artificial Sequence
  derived and/or modified sequence opt1 from ARHGEF12__Homo_sapiens__NP_001185594
augagcggcacccaguccaccaucacggaccgcuucccccugaagaagccgauccggcacgggagcauccucaaccgcgagucccccaccgacaagaagcagaagguggagcggaucgccagccacgacuucgaccccaccggccugguccagcgcugcgugaucauccagaaggacgacaacggguucggccugaccguguccggggacaaccccgucuucgugcagagcgugaaggaggacggcgccgcgaugcgggccggcguccagacgggggaccgcaucaucaaggugaacggcacccucgugacccacuccaaccaccuggaggucgugaagcugaucaagagcggguccuacguggcccucaccguccagggccggccgcccgggagcccccagaucccccuggccgacuccgagguggagccgagcgugaucggccacaugucccccaucaugacgagcccccacucccccggcgccagcgggaacauggagcgcaucaccuccccgguccugaugggcgaggagaacaacguggugcacaaccagaaggucgagauccuccggaagaugcugcagaaggagcaggagcgccugcagcuccugcaggaggacuacaaccggacccccgcgcagcgccugcucaaggagauccaggaggccaagaagcacaucccccagcugcaggagcagcugagcaaggccaccggguccgcccaggacggcgcgguggugacgcccagccggccgcucggcgacacccugaccgucagcgaggccgagaccgaccccggggacgugcugggccgcacggacugcuccagcggggacgccucccggcccagcuccgacaacgccgacagccccaaguccggcccgaaggagcgcaucuaccucgaggagaaccccgagaagagcgagaccauccaggacaccgacacccagucccugguggggagccccuccacgcggaucgccccccacaucaucggcgcggaggacgacgacuucggcaccgagcacgagcagaucaacgggcagugcagcugcuuccaguccaucgagcugcucaagagccgcccggcccaccuggccgucuuccugcaccacguggucucccaguucgaccccgccacccuccugugcuaccuguacagcgaccucuacaagcacaccaacuccaaggagacgcggcgcaucuuccuggaguuccaccaguucuuccuggaccggagcgcccaccucaagguguccgugcccgacgagaugagcgcggaccuggagaagcgccgccccgagcugaucccggaggaccuccaccggcacuacauccagaccaugcaggagcgcguccaccccgaggugcagcggcaccuggaggacuuccgccagaagcggagcaugggccugacccucgccgaguccgagcugaccaagcuggacgccgagcgcgacaaggaccggcucacgcuggagaaggagcgcaccugcgccgagcagaucguggccaagaucgaggagguccugaugaccgcgcaggccguggaggaggacaagagcuccaccaugcaguacgugauccucauguacaugaagcaccugggggucaaggugaaggagccccggaaccuggagcacaagcgcggccggaucggguuccucccgaagaucaagcagagcaugaagaaggacaaggagggcgaggagaagggcaagcgccggggguuccccuccauccugggccccccccgccggccgagccgccacgacaacuccgccaucgggcgggccauggagcugcagaaggcccgccaccccaagcaccugagcacgcccuccagcgugucccccgagccgcaggacagcgcgaagcuccggcaguccggccuggccaacgaggggaccgacgccggcuaccugcccgccaacagcauguccagcgucgcguccggcgccagcuucagccaggaggggggcaaggagaacgacaccggguccaagcaggugggcgagaccagcgcccccggcgacacgcucgacgggaccccccgcacccugaacaccguguucgacuucccgccccccccccuggaccagguccaggaggaggagugcgagguggagcgcgugaccgagcacggcacgccgaagcccuuccggaaguucgacuccgucgccuucggggagagccaguccgaggacgagcaguucgagaacgaccucgagaccgacccccccaacuggcagcagcuggugagccgcgaggugcugcucggccugaagccgugcgagaucaagcggcaggaggucaucaacgagcuguucuacaccgagcgcgcccacgugcggacccucaaggugcuggaccaggucuucuaccagcgcgugucccgggaggggauccugagccccuccgagcuccgcaagaucuucagcaaccuggaggacauccugcagcuccacaucggccugaacgagcagaugaaggcggugcggaagcgcaacgagacguccgucaucgaccagaucggcgaggaccugcucaccugguucagcgggcccggcgaggagaagcugaagcacgccgccgccaccuucugcuccaaccagcccuucgcccuggagaugaucaagagccggcagaagaaggacucccgcuuccagaccuucgugcaggacgcggagagcaacccgcucugccggcgccugcagcugaaggacaucauccccacgcagaugcagcggcucaccaaguacccccugcugcucgacaacaucgccaaguacaccgaguggccgaccgagcgcgagaaggugaagaaggccgccgaccacugccggcagauccugaacuacgucaaccaggccgugaaggaggcggagaacaagcagcgccuggaggacuaccagcggcgccucgacacguccagccugaagcuguccgaguaccccaacguggaggagcuccggaaccuggaccugaccaagcgcaagaugauccacgaggggccccucgucuggaaggugaaccgcgacaagaccaucgaccuguacacccugcuccuggaggacauccuggugcuccugcagaagcaggacgaccggcugguccuccgcugccacagcaagauccuggccagcacggccgacuccaagcacaccuucagccccgugaucaagcuguccaccgugcucguccggcagguggccaccgacaacaaggcgcuguucgugaucagcauguccgacaacggcgcccagaucuacgagcuggucgcccagacggugagcgagaagaccguguggcaggaccucaucugccgcauggccgccuccgucaaggagcagagcaccaagccgaucccccugccccaguccacccccggggagggcgacaacgacgaggaggacccgagcaagcugaaggaggagcagcacggcaucuccgugacggggcuccagagccccgaccgggaccugggccuggaguccacccucaucagcuccaagccccagagccacucccugagcaccuccgggaagagcgaggugcgcgaccuguucgucgcggagcggcaguucgccaaggagcagcacaccgacggcacgcucaaggaggugggggaggacuaccagaucgccauccccgacagccaccugccgguguccgaggagcgcugggcccuggacgcccuccggaaccugggccugcucaagcagcugcugguccagcagcucggccugaccgagaagagcgugcaggaggacuggcagcacuucccccgcuaccggaccgcgucccaggggccccagaccgacagcgucauccagaacuccgagaacaucaaggccuaccacagcggcgaggggcacaugcccuuccgcacgggcaccggggacaucgccaccugcuacuccccgcggaccagcacggaguccuucgccccccgcgacagcgugggccuggccccccaggacucccaggcgagcaacauccucgugauggaccacaugaucaugacccccgagaugccgaccauggagcccgagggcgggcuggacgacuccggcgagcacuucuucgacgcccgggaggcccacagcgacgagaaccccuccgagggggacggcgccgucaacaaggaggagaaggacgugaaccugcgcaucagcggcaacuaccucauccuggacggguacgaccccgugcaggaguccagcaccgacgaggaggucgcguccagccugacccuccagccgaugacgggcauccccgccguggagagcacccaccagcagcagcacuccccccagaacacccacagcgacggggccaucucccccuucaccccggaguuccuggugcagcagcgguggggcgccauggaguacagcugcuucgagauccagucccccagcuccugcgccgacagccagucccagaucauggaguacauccacaagaucgaggcggaccuggagcaccucaagaaggucgaggagagcuacacgauccugugccagcgccuggccggguccgcccucaccgacaagcacagcgacaaguccuga

SEQ ID NO: 26849 - RNA, 2526 nt, Artificial Sequence
  derived and/or modified sequence opt1 from ARHGEF15__Homo_sapiens__NP_776089
augagcgcccagucccugcccgccgcgaccccgcccacccagaagcccccccgcaucauccggccgcgcccccccagccggucccgcgccgcccagagccccggcccgccccacaacggguccagcccccaggagcucccccggaacuccaacgacgccccgacgcccaugugcacccccaucuucugggagcccccggccgcgagccugaagccccccgcccugcuccccccguccgccagccgcgccucccuggacagccagaccucccccgacagccccuccagcacccccacgccgucccccgugagccggcgcuccgcgagccccgagcccgccccgcggagccccguccccccgcccaagcccuccggcagccccugcaccccgcugcuccccauggccggggugcuggcccagaacggcuccgccagcgcgcccgggaccgugcgccggcuggccggccgcuucgagggcggggccgagggccgggcccaggacgccgacgcgcccgagccggggcuccaggcccgcgccgacgucaacggcgagcgggaggccccccugaccggguccggcagccaggagaacggcgcccccgacgcggggcuggccugccccccgugcugccccugcgugugccacacgacccgccccggccucgagcugcggugggugcccgucgggggcuacgaggaggugccgcgcgugccccggcgcgccuccccccugcggaccagccgcucccgcccccacccgcccagcaucggccaccccgccgucgugcucaccuccuaccggagcacggccgagcgcaagcugcugccccuccugaagccgcccaagcccacccgggugcgccaggacgcgaccaucuucggggacccgccccagcccgaccuggaccuccuguccgaggacggcauccagaccggggacagccccgacgaggccccgcagaacacgccccccgccaccgucgagggccgggaggaggaggggcuggaggugcucaaggagcagaacugggagcugccccugcaggacgagccgcucuaccagaccuaccgcgccgcggugcuguccgaggagcuguggggcgucggcgaggacgggagccccucccccgccaacgccggcgacgcccccaccuucccgcggccccccgggccccgcaacacgcucuggcaggagcugccggccgugcaggcgagcggccugcucgacacccuguccccccaggagcggcgcaugcaggagagccuguucgagguggucaccagcgaggccuccuaccuccggagccugcgccugcucaccgacacguucgugcugucccaggcccugcgggacacccucaccccccgcgaccaccacacccuguucagcaacgugcagcggguccaggggguguccgagcgcuuccuggccacgcuccugagccgggugcgcuccagcccccacaucuccgaccugugcgacgucgugcacgcccacgcggucggcccguucagcguguacguggacuacguccggaaccagcaguaccaggaggagaccuacucccgccucauggacaccaacgugcgcuucagcgccgagcugcggcgccugcagucccugcccaagugcgagcggcucccccugcccagcuuccugcuccugccguuccagcgcaucacccggcugcgcaugcuccugcagaacauccugcggcagacggaggagggcuccagccgccaggagaacgcccagaaggcccucggggccguguccaagaucaucgagcggugcagcgcggaggucggccgcaugaagcagaccgaggagcugauccggcugacccagcgccuccgguuccacaaggugaaggcccugccccuggugagcuggucccgccggcucgaguuccagggggagcugaccgagcugggcugccgccgggggggcguccucuucgccagccgcccccgguucacgccccugugccugcuccuguucuccgaccugcuccugaucacccagccgaagagcggccagcgccugcaggugcucgacuacgcccaccggucccuggugcaggcgcagcagguccccgaccccagcgggccgcccaccuuccgccugucccuccugagcaaccaccagggccgccccacccaccggcugcuccaggccuccagccuguccgacaugcagcgcuggcugggggccuuccccaccccgggcccccuccccugcagccccgacacgaucuacgaggacugcgacugcucccaggagcugugcagcgaguccagcgccccggccaagaccgagggccggucccuggagagccgcgcggcccccaagcaccuccacaagacccccgagggguggcugaagggccugcccggggccuucccggcccagcucgugugcgaggugaccggcgagcacgagcggcgccggcaccugcgccagaaccagcggcugcucgaggccgucggguccagcagcggcacgcccaacgcgccccccccguga

SEQ ID NO: 26850 - RNA, 2295 nt, Artificial Sequence
  derived and/or modified sequence opt1 from ARHGEF16__Homo_sapiens__XP_011539555
auggcccagcgccacagcgacuccagccuggaggagaagcuccugggccaccgguuccacuccgagcugcgccucgacgccgggggcaaccccgcgagcgggcugccgauggugcggggcuccccgcgcguccgggacgacgccgccuuccagccccaggugcccgccccgccccagccccggcccccggggcacgaggagcccuggcccaucgugcugagcaccgagucccccgccgcgcucaagcugggcacccagcagcugauccccaagagccucgccgucgccuccaaggccaagacgcccgcgcggcaccagagcuucggcgccgccgugcugucccgcgaggccgcccggcgcgaccccaagcugcuccccgcgccgagcuucucccuggacgacauggacguggacaaggaccccgggggcaugcugcggcgcaaccuccggaaccagagcuaccgcgccgccaugaaggggcugggcaagcccgggggccagggcgacgccauccagcugucccccaagcuccaggcccuggcggaggagccgagccagccccacacccggucccccgccaagaacaagaagacccuggggcgcaagcggggccacaaggggagcuucaaggacgacccccagcucuaccaggagauccaggagcgcggccugaacaccucccaggagagcgacgacgacauccuggacgagagcuccagcccggagggcacgcagaaggucgacgccaccaucguggugaaguccuaccggcccgcccaggucaccuggagccagcuccccgaggugguggagcuggggauccuggaccagcucuccaccgaggagcgcaagcggcaggaggccauguucgagauccugacgagcgaguucuccuaccagcacagccuguccauccucgucgaggaguuccugcagagcaaggagcugcgcgcgaccgugacccagauggagcaccaccaccucuucuccaacauccuggacgugcugggcgccagccagcgcugccucgucgccgggcccgagcuguggcugcagggccucgagguggagcggcuggacaugcagcugcagccgugcaccggggaggccuggcuccugcgcggcuggcaggcccaguccggccccgugagccgcgggggcgggacgcccgcgcaccuccacgccggcuucuucgaggaccucgagcagcgccacaaggcccagguccugguggaggacaucuccgacauccuggaggagcacgccgagaagcacuuccacccguacaucgcguacugcagcaacgagguguaccagcagcggacccuccagaagcugaucuccagcaacgccgccuuccgcgaggcccugcgggagaucgagcgccggcccgccugcgggggccugcccaugcucuccuuccugauccugcccaugcagcgcgucacccggcucccgcugcugauggacacccucugccugaagacgcagggccacagcgagcgcuacaaggcggccagccgggcccugaaggccaucuccaagcucgugcgccagugcaacgagggggcccaccggauggagcgcauggagcagauguacacccugcacacccagcuggacuucagcaaggugaagucccucccccugaucagcgcgucccgguggcugcucaagcgcggcgagcuguuccuggucgaggagaccgggcuguuccggaagaucgccagccgccccacgugcuaccuguuccuguucaacgacgugcucgucgugaccaagaagaaguccgaggagagcuacauggugcaggacuacgcccagaugaaccacauccaggucgagaagaucgagcccuccgagcugccgcugcccggcgggggcaaccgcagcuccagcgugccccaccccuuccaggugacccuccugcggaacuccgagggccgccaggagcagcugcuccugagcuccgacagcgccuccgaccgggcccgcuggaucgucgcgcugacccacagcgagcggcaguggcaggggcucagcuccaagggcgaccugccccagguggagaucacgaaggccuucuucgccaagcaggccgacgaggugacccugcagcaggcggacgucgugcucgugcugcagcaggaggacggguggcuguacggcgagcgccuccgggacggcgagaccgggugguucccggaggacuucgcccgcuucaucaccagccgggucgccguggagggcaacgugcgccggauggagcgccugcgggucgagacggacguguga

SEQ ID NO: 26851 - RNA, 6192 nt, Artificial Sequence
  derived and/or modified sequence opt1 from ARHGEF17__Homo_sapiens__NP_055601
auggccgacggcgcgccccgcccgcagcuguaccggagcguguccuucaagcuccuggagcgcuggagcgggggccccgggcugcgggaggaggacaccgacacccccggccuccgccggcgcgccagcugccggcccaccaccgccgcccgcgggcagcccagccggcgcguguccaagcuggccagcggcccccuggccgcccccgcccagccccggccccuccgcucccugagccccuccgugcggcagcugagccgccgguucgacgcgccccggcucgacgacggcuccgccgggacccgggacggcggggugcugcccgccgccgccgaggaggccgccgagggccccgcccgcggggccuggcccagcgugaccgagaugcggaagcuguucggcggccccgggucccgccggcccagcgccgacuccgagagccccggcacccccucccccgacggggccgccugggagccgcccgcccgcgagagccgccagccgcccacgcccccgccccggaccugcuucccccucgccggccugcgcuccgcccggccccugaccggccccgagacggaggggcgccuccggcgcccccagcagcagcaggagcgggcccagcgccccgccgacggccugcacagcuggcacaucuucagccagccccaggcgggggcccgggccuccugcagcuccagcuccaucgccgccagcuaccccgugucccgcagccgggcggccuccagcuccgaggaggaggaggaggggccgccccagcugcccggggcccagagccccgccuaccacggcggccacuccagcggguccgacgacgaccgcgacggcgagggcgggcaccgguggggcgggcgccccggccuccggcccgggagcucccugcuggaccaggacugccgccccgacagcgacggccucaaccuguccagcaugaacagcgcggggguguccggcagccccgagccgcccaccagcccccgggcgccccgcgaggaggggcugcgggaguggggcuccggcagcccgcccugcgucccggggccccaggagggccuccgccccaugagcgacuccgucgggggcgccuuccgcguggccaaggucagcuuccccuccuaccuggccagcccggcgggcucccgggggagcucccgcuacagcuccaccgagacccugaaggacgacgaccucuggagcucccggggcagcgggggcuggggcguguaccgcagccccuccuucggcgccggcgaggggcugcugcggagccaggcccgcacccgggccaagggccccgggggcaccucccgcgcccuccgggacgggggcuucgagcccgagaagucccgccagcggaagucccugagcaacccggacaucgcguccgagacccugacccuccugagcuuccugcgcuccgaccucagcgagcugcgggugcgcaagcccggcggguccagcggcgaccggggguccaacccccuggacggccgcgacagcccguccgccgggggccccgucggccagcucgagcccauccccaucccggcccccgccagccccgggacccggcccacccugaaggaccugaccgccacccuccgccgggcgaaguccuucacgugcagcgagaagccgauggcccgccggcugccccgcaccuccgcccugaaguccagcuccagcgagcuccugcugaccggccccggggccgaggaggacccccucccgcugaucgugcaggaccaguacgugcaggaggcgcgccaggucuucgagaagauccagcggaugggcgcccagcaggacgacggguccgacgcgccgcccggcagccccgacugggccggcgacgugacccgcgggcagcggucccaggaggagcugagcggcccggaguccagccugacggacgaggggaucggcgccgaccccgagccgcccguggcggccuucugcggccucgggaccaccggcauguggcgcccgcuguccagcuccagcgcccagaccaaccaccacgggcccggcacggaggacucccucgggggcugggcccucgucagccccgagacgccgcccacccccggcgcccugcggcgccggcgcaaggugccgcccagcgggagcggcggguccgagcugagcaacggcgaggcgggggaggccuaccggucccucagcgaccccaucccccagcgccaccgggccgccaccagcgaggagcccacgggcuucuccguggacagcaaccugcugggcucccucagcccgaagaccgggcugcccgccaccuccgcgauggacgagggccugaccagcgggcacuccgacuggagcgucggcuccgaggagagcaagggguaccaggaggugauccaguccaucgugcagggccccggcacgcucgggcgcgucguggacgaccggaucgccggcaaggcccccaagaagaagucccuguccgacccgagccgccgcggggagcuggccggccccggcuucgaggggcccggcggggagcccauccgcgaggucgagccgaugcucccgcccuccagcuccgagcccauccugguggagcagcgggcggagcccgaggagcccggcgccacccgcagccgggcccaguccgagcgcgcccugcccgaggcccugcccccgcccgcgaccgcccaccgcaacuuccaccuggaccccaagcuggccgacauccucagcccccggcugauccgccgggggagcaagaagcgccccgcccgguccagccaccaggagcugcgccgggacgagggcucccaggaccagaccggcagccucucccgcgcccggcccagcucccgccacgugcggcacgcgagcguccccgccaccuucaugcccaucguggugccggagccgcccacguccgucgggcccccgguggccgugcccgagcccaucggcuucccgacccgcgcccaccccacccugcaggcccccagccuggaggacgucaccaagcaguacaugcucaaccugcacuccggggaggugcccgcgccggugcccgucgacaugcccugccugccccucgccgccccgcccagcgccgaggccaagccgcccgaggcggcccggcccgccgacgagcccacgcccgccuccaagugcugcagcaagccccagguggacaugcgcaagcacguggcgaugacccugcuggacaccgagcaguccuacgucgagagccuccggacccugaugcagggcuacaugcagccgcugaagcagcccgagaacuccgugcucugcgaccccagccugguggacgagaucuucgaccagauccccgagcugcucgagcaccacgagcaguuccuggagcagguccgccacugcaugcagacguggcacgcccagcagaaggugggggcccugcucgugcaguccuucagcaaggacguccuggugaacaucuacagcgccuacaucgacaacuuccugaacgccaaggacgcggugcgggucgccaaggaggcccgcccggccuuccucaaguuccuggagcaguccaugcgggagaacaaggagaagcaggcccugagcgaccucaugaucaagcccgugcagcgcaucccccgguacgagcugcuggugaaggaccuccugaagcacacccccgaggaccacccggaccacccccugcuccuggaggcgcagcgcaacaucaagcaggucgccgagcgcaucaacaagggcgugcgguccgccgaggaggccgagcgccacgcccgggugcugcaggagaucgaggcgcacaucgagggcauggaggaccuccaggcgccccugcgccgguuccugcgccaggagauggucaucgaggugaaggccaucgggggcaagaaggaccggagccucuuccuguucaccgaccugaucgugugcaccacgcucaagcgcaaguccgggagccugcggcgcuccagcaugucccuguacaccgccgcgagcgucaucgacaccgccuccaaguacaagaugcucuggaagcugccgcuggaggacgccgacaucaucaagggcgccagccaggccaccaaccgggagaacauccagaaggcgaucucccgccucgacgaggaccugacgacccuggggcagaugagcaagcucuccgagagccugggcuucccccaccagucccuggacgacgcccuccgggaccugagcgccgccaugcaccgcgaccuguccgagaagcaggcccucugcuacgcgcugagcuucccgcccaccaagcuggagcucugcgccacccggccggagggcacggacagcuacaucuucgaguucccccaccccgacgcccgccugggguucgagcaggccuucgacgaggccaagcggaagcuggcguccagcaaguccugccucgaccccgaguuccugaaggccaucccgaucaugaagacccgcagcggcaugcaguucuccugcgccgcccccacccugaacagcugccccgagcccuccccggaggugugggugugcaacagcgacggguacgucggccaggugugccuccugucccugcgggcggagcccgacguggaggccugcaucgccgucugcagcgcccgcauccucugcaucggggccgugcccggccugcagccccgcugccaccgggagccgccgcccucccugcgcagcccgcccgagaccgcgcccgagcccgccggccccgagcucgacguggaggccgccgccgacgaggaggcggccacgcuggccgagcccgggccccagcccugccugcacaucuccaucgccggcagcgggcuggagaugacccccggccucggcgagggggacccgcggcccgagcugguccccuucgacuccgacagcgacgacgaguccagcccgagccccuccggcacccugcagagccaggccucccgcagcaccaucuccagcuccuucgggaacgaggagacgcccagcuccaaggaggcgaccgccgagaccaccagcuccgaggaggagcaggagcccggcuuccucccgcugagcggguccuucggccccggcgggcccugcggcacgagccccauggacgggcgggcccugcgccgguccagccacggcuccuucacccgcgggagccucgaggaccugcuguccguggacccggaggccuaccagagcagcguguggcucggcaccgaggacggcugcguccacguguaccaguccagcgacuccauccgggaccgccggaacagcaugaagcugcagcacgccgcguccgugaccugcauccuguaccucaacaaccaggucuucgugagccuggccaacggggagcugguggucuaccagcgcgaggccggccacuucugggacccccagaacuucaaguccgugacgcucgggacccagggcagccccaucaccaagauggucuccgucgggggccggcuguggugcggcugccagaaccgcgugcugguccucagccccgacacccugcagcuggagcacauguucuacguggggcaggacuccagccggugcguggccugcauggucgacuccagccucggcgugugggugacccugaagggguccgcgcacgucugccuguaccacccggacacguucgagcagcucgccgagguggacgugacgccgcccguccaccgcaugcuggccggcagcgacgccaucauccggcagcacaaggccgcgugccugcgcaucaccgcccuccuggugugcgaggagcugcucuggguggggaccuccgccggcgucgugcugacgaugcccaccagcccgggcaccguguccugcccccgggcgccccugagccccaccgggcucggccaggggcacacgggccacguccgcuuccuggccgccgugcagcugccggacggcuucaaccuccugugccccacgccgccgcccccgcccgacaccgggcccgagaagcugcccagccucgagcaccgggacucccccuggcaccgcggccccgccccggcccgccccaagaugcuggugaucagcgggggcgacggguacgaggacuuccggcuguccagcggcggcggguccagcuccgagaccgucggccgcgacgacagcacgaaccaccuccugcuguggcggguguga

SEQ ID NO: 26852 - RNA, 2640 nt, Artificial Sequence
  derived and/or modified sequence opt1 from ARHGEF1__Homo_sapiens__NP_945328
auggaggacuucgcccgcggcgccgcgagccccgggccgucccggcccggccuggugcccgucagcaucaucggggccgaggacgaggacuucgagaacgagcucgagaccaacuccgaggagcagaacagccaguuccagucccuggagcaggucaagcgccggcccgcccaccugauggcccuccugcagcacguggcccugcaguucgagccgggcccccucgugcugcgcgugcccgugcccccgaacgucgcguucgagcuggaccggacccgcgccgaccucaucagcgaggacgugcagcggcgcuucgugcaggaggucgugcagucccagcaggucgccguggggcggcagcuggaggacuuccgcagcaagcggcugaugggcaugacgcccugggagcaggagcucgcccagcuggaggcgugggugggccgcgaccgggccuccuacgaggcccgcgagcggcacguggccgagcgccugcucaugcaccuggaggagaugcagcacaccaucagcaccgacgaggagaaguccgccgcggucgugaacgccaucgggcuguacaugcggcaccucggcgugcgcaccaagagcggggacaagaaguccggccggaacuucuuccgcaagaaggucauggggaaccggcgcagcgacgagcccgccaagacgaagaagggccuguccagcauccuggacgccgcccgcuggaaccggggcgagccccaggugccggacuuccgccaccucaaggcggagguggacgccgagaagcccggggccaccgaccggaagggcggggucggcaugcccucccgcgaccggaacaucggcgcccccgggcaggacaccccgggcgugagccugcacccccugucccucgacagccccgaccgcgagcccggggccgacgcgccgcuggagcugggcgacagcagcccccaggggcccaugucccucgagucccuggcgcccccggagagcaccgacgagggcgccgagacggagucccccgagcccggcgacgagggggagcccggccggagcgggcuggagcucgagccggaggagccgcccggcuggcgcgagcuggugccgcccgacacccugcacucccuccccaagagccaggucaagcggcaggaggugaucuccgagcugcuggucaccgaggccgcccacgugcgcaugcuccgggugcugcacgaccuguucuuccagcccauggccgagugccucuucuucccccuggaggagcugcagaacaucuuccccagccucgacgagcugaucgagguccacucccuguuccucgaccgccugaugaagcggcgccaggagagcggguaccugaucgaggagaucggcgacgugcuccuggcccgguucgacggcgccgagggguccugguuccagaagaucagcucccgcuucugcagccggcaguccuucgcccuggagcagcugaaggcgaagcagcgcaaggacccccgguucugcgccuucgugcaggaggccgagagccgcccccgcugccggcgccuccagcugaaggacaugaucccgaccgagaugcagcggcugacgaaguacccccuccugcugcaguccaucggccagaacaccgaggagcccaccgagcgcgagaaggucgagcucgccgccgagugcugccgggagauccugcaccacgugaaccaggcggugcgcgacauggaggaccugcuccggcugaaggacuaccagcgccggcuggaccucagccaccuccgccagagcuccgaccccaugcugagcgaguucaagaaccuggacaucaccaagaagaagcugguccacgaggggccgcugacguggcgggugaccaaggacaaggccguggagguccacgugcuccugcuggacgaccuccugcugcuccugcagcgccaggacgagcggcugcuccugaagucccacagccgcacccugacccccacgcccgacggcaagaccaugcuccggcccgugcugcgccugaccuccgccaugacccgggaggucgccacggaccacaaggccuucuacguccucuucaccugggaccaggaggcgcagaucuacgagcugguggcccagaccgugagcgagcgcaagaacuggugcgcccugaucaccgagacggccgggucccucaaggugccggcccccgcgagccggcccaagccccgcccgucccccagcuccacccgggagccccugcugagcuccagcgagaacggcaacggcgggcgcgagaccucccccgccgacgcccgcaccgagcggauccucagcgaccugcugccguucugccgccccggccccgaggggcagcucgccgcgacggcccugcggaaggugcugucccucaagcagcugcuguucccggccgaggaggacaacggcgccggcccgccccgcgacggggacggcguccccgggggcgggccccucagccccgcccggacccaggagauccaggagaaccugcugagccucgaggagaccaugaagcagcuggaggagcuggaggaggaguucugccgccuccggccccugcugucccagcucggcggcaacagcgugccccagccggggugcaccuga

SEQ ID NO: 26853 - RNA, 1860 nt, Artificial Sequence
  derived and/or modified sequence opt1 from ARHGEF25__Homo_sapiens__NP_001104740
augaagcccccggaccgccccgcccccggccggaccgaccgcauccugggggugaugggcgggaugcuccgggccugcgcgcugcccggccaggaggggccgccccgccggagcccccugggccucgucggcaccgagcccgaguccgagcgcacggagggggaccaccggcgcgaccgggagcacgaggugcuggccggcgcccugcagccggagagcuacuccaucgccgggagcgagggcuccaucagcgccuccgcggccagcgggcucgccgcccccuccggccccagcuccggccugagcuccgggcccugcagcccgggcccgcccgggcccguguccggccugcgccgguggcucgaccacagcaagcacugccuguccgucgagaccgaggcggacagcggccaggccgggcccuacgagaacuggaugcuggagcccgcccucgccaccggcgaggagcugcccgagcugacccuccugacgacccugcucgaggggcccggcgacaagacccagccgcccgaggaggagacccugucccaggcccccgagagcgaggaggagcagaagaagaaggcgcuggagcgcagcauguacgugcucuccgagcugguggagacggagaagauguacgucgacgaccuggggcagaucguggagggcuacauggccaccauggccgcccagggcgugcccgagagccuccgggggcgcgaccggaucgucuucggcaacauccagcagaucuacgaguggcaccgcgacuacuuccugcaggagcugcagcggugccucaaggacccggacuggcuggcccagcuguucaucaagcacgagcgccggcuccacauguacgugguguacugccagaacaagcccaaguccgagcacgucgugagcgaguucggggacuccuacuucgaggagcugcgccagcagcugggccaccggcuccagcugaacgaccugcucaucaagcccgugcagcgcaucaugaaguaccagcugcugcucaaggacuuccugaaguacuacaaccgcgcggggauggacaccgccgaccuggagcaggccgucgaggugaugugcuucgugcccaagcggugcaacgacaugaugacccucggccgccugcggggcuucgaggggaagcugacggcccagggcaagcuccuggggcaggacaccuucugggucaccgagccggaggccggcgggcugcucagcucccgcggccgggagcgccggguguuccuguucgagcagaucaucaucuucagcgaggcgcugggcgggggcgugcgcgggggcacccagcccggcuacgucuacaagaacuccaucaaggugagcugccuggggcucgagggcaaccugcagggggaccccugccgguucgcccugacgucccgcggcccggagggcgggauccagcgguacgugcuccaggccgccgaccccgccaucagccaggcguggaucaagcacgucgcccagauccuggagucccagcgcgacuuccugaacgcccuccagagccccaucgaguaccagcggcgcgagucccagaccaacagccugggccggccccgcgggccgggcguggggucccccggccggauccgccugggggaccaggcccagggcagcacccacacccccaucaacggcucccuccccagccugcugcucagcccgaagggggaggucgcgcgggcccugcugccccucgacaagcaggcccugggcgacaucccccaggcgccccacgacuccccgcccgugagccccacgcccaagaccccgcccugccaggcccgccuggccaagcucgacgaggacgagcuguga

SEQ ID NO: 26854 - RNA, 2376 nt, Artificial Sequence
  derived and/or modified sequence opt1 from ARHGEF26__Homo_sapiens__NP_001238892
auggacggcgagagcgagguggacuucuccagcaacuccaucacgccccuguggcgccggcgcagcaucccgcagccccaccagguccucgggcgguccaagccccgcccccagagcuaccaguccccgaacggccugcugaucaccgacuuccccguggaggacgggggcacccuccuggccgcccagauccccgcccaggugcccaccgcgagcgacucccggaccguccaccgcagcccgcugcuccugggggcccagcggcgcgccguggccaacggcggcaccgcgucccccgaguaccgggccgccagcccccgccugcggcgccccaaguccccgaagcuccccaaggccgugcccgggggcagccccaaguccccggcgaacggggccgucacgcugcccgccccgccgcccccgcccgugcugcggccgccccgcacccccaacgcccccgcccccugcacccccgaggaggaccucaccggccugacggcgagccccgugcccucccccaccgccaacgggcuggccgccaacaacgacagccccggcuccggcagccagagcgggcggaaggccaaggaccccgagcgcggccucuuccccgggccgcagaaguccagcuccgagcagaagcugccccugcagcggcuccccagccaggagaacgagcugcuggagaaccccuccgucgugcucagcaccaacuccccggcggcccugaaggugggcaagcagcagaucauccccaagagccuggccuccgagaucaagaucagcaaguccaacaaccagaacgucgagccccacaagcgccuccugaaggugcggagcaugguggagggccucgggggcccccuggggcacgccggcgaggaguccgaggucgacaacgacguggacagcccggggucccugcgccggggccugcgcagcaccuccuaccgccgggccguggucagcggcuucgacuucgacucccccacgagcagcaagaagaagaaccgcaugucccagcccgugcucaagguggucauggaggacaaggagaaguucagcucccuggggcggaucaagaagaagaugcugaagggccaggggaccuucgacggcgaggagaacgcggugcucuaccagaacuacaaggagaaggcccuggacaucgacagcgacgaggaguccgagcccaaggagcagaaguccgacgagaagaucgugauccaccacaagccgcugcgcagcaccuggagccagcucuccgccgucaagcggaaggggcugagccagaccgugucccaggaggagcgcaagcggcaggaggccaucuucgaggucaucagcuccgagcacagcuaccugcucucccuggagauccugauccgcauguucaagaacagcaaggagcucuccgacacgaugaccaagaccgagcggcaccaccuguucagcaacaucaccgacgugugcgaggccagcaagaaguucuucaucgagcuggaggcgcgccaccagaacaacaucuucaucgacgacaucuccgacaucguggagaagcacacggccagcaccuucgaccccuacgucaaguacugcaccaacgagguguaccagcagcggacccuccagaagcugcuggccacgaaccccuccuucaaggaggugcucagccgcaucgagucccacgaggacugccggaaccugcccaugaucagcuuccugauccugccgaugcagcgcgucacccggcucccccugcugauggacaccaucugccagaagacccccaaggacucccccaaguacgaggugugcaagcgcgcccucaaggaggugagcaagcugguccggcugugcaacgagggcgcgcgcaagauggagcggacggagaugauguacaccaucaacucccagcucgaguucaagaucaagccguucccccuggugagcuccagccgcuggcuggugaagcgcggcgagcucaccgccuacgucgaggacaccgugcuguucucccggcgcacgagcaagcagcaggucuacuucuuccuguucaacgacgugcucaucaucaccaagaagaaguccgaggagagcuacaacgugaacgacuacucccugcgggaccagcugcucguggagagcugcgacaacgaggagcugaacuccagccccgggaagaacagcuccaccaugcuguacagccgccaguccagcgccucccaccucuucacccugacgguccugagcaaccacgccaacgagaagguggagaugcuccugggcgccgagacccaguccgagcgggcgcgcuggaucaccgcccuggggcacagcuccggcaagccgcccgccgaccggaccugcggguga

SEQ ID NO: 26855 - RNA, 5196 nt, Artificial Sequence
  derived and/or modified sequence opt1 from ARHGEF28__Homo_sapiens__NP_001073948
auggagcugagcugcagcgaggcgccccuguacggccagaugaugaucuacgccaaguucgacaagaacguguaccugccggaggacgcggaguucuacuucacguacgacgggagccaccagcgccacgucaugaucgccgagcggaucgaggacaacgugcugcaguccagcgugcccggccacgggcuccaggagaccgucacgguguccgugugccugugcagcgagggcuacucccccgucaccauggggagcggcuccgugaccuacguggacaacauggccugccgccuggcccggcuccuggucacccaggccaaccgccugacggcgugcagccaccagacccuccugacccccuucgcccugaccgccggcgcccuccccgcgcuggacgaggagcuggugcucgcccugacgcaccuggagcucccccuggaguggaccgugcugggguccagcucccucgaggucagcucccaccgggagagccugcugcaccucgccaugcgcuggggccuggccaagcugucccaguucuuccucugccugcccgggggcgugcaggcccuggcgcuccccaacgaggagggggccacgccccuggaccuggcccuccgggagggccacagcaagcugguggaggacgucaccaacuuccagggccgcuggucccccagcuucagccgggugcagcuguccgaggaggccagccuccacuacauccacuccagcgagacccugacccugacccucaaccacaccgccgagcaccuccuggaggcggacaucaagcuguuccgcaaguacuucugggaccgggccuuccuggugaaggccuucgagcccgaggcccgccccgaggagcggacggccaugcccuccagcggggcggagaccgaggaggagaucaagaacuccgucagcucccgcagcgccgccgagaaggaggacaucaagcgggugaagucccuggugguccagcacaacgagcacgaggaccagcacagccucgaccuggaccgcuccuucgacauccugaagaaguccaagccgcccagcacccuccuggccgccggccggcugagcgacaugcugaacgggggcgacgagguguacgcgaacugcauggugaucgaccaggucggcgaccucgacaucuccuacaucaacaucgaggggaucaccgccacgaccagccccgagucccgcggcugcacccuguggccgcagagcagcaagcacacccugcccacggagaccucccccagcguguacccccucuccgagaacgucgaggggaccgcccacaccgaggcccagcagagcuucauguccccgagcuccagcugcgcguccaaccugaaccugagcuucggcuggcacggguucgagaaggagcagucccaccucaagaagcggagcuccagccuggacgcccuggacgccgacuccgagggcgagggccacagcgagcccucccacaucugcuacacgcccgggagccagagcuccagccgcaccggcauccccuccggggacgagcucgacagcuucgagaccaacaccgagccggacuucaacaucucccgggccgagagccugccccuguccagcaaccuccaguccaaggagagccugcuguccggcgugcgcagccgcuccuacagcugcuccagccccaagaucucccucgggaagacgcggcuggugcgcgagcugaccgucugcagcuccagcgaggagcagcgggccuacagccucuccgagcccccgcgcgagaaccggauccaggaggaggagugggacaaguacaucauccccgccaaguccgaguccgagaaguacaaggugagccgcaccuucuccuuccugaugaaccggaugaccagcccccgcaacaaguccaagaccaagagcaaggacgccaaggacaaggagaagcugaaccggcaccaguucgccccgggcaccuucuccggcgugcuccagugccuggucugcgacaagacccugcucgggaaggagagccugcagugcuccaacugcaacgccaacgugcacaagggcugcaaggacgccgcgcccgccugcaccaagaaguuccaggagaaguacaacaagaacaagccccagaccauccuggggaacagcuccuuccgcgacaucccccagccgggccucagccugcaccccuccagcuccgugcccgucgggcugcccacgggccggcgcgagaccgugggccaggugcacccgcucagccgguccguccccgggaccacccuggagagcuuccgccggagcgccacgucccuggagagcgaguccgaccacaacagcugccgcucccggagccacuccgacgagcuccugcagagcaugggcuccagccccuccaccgagagcuucaucauggaggacgugguggacuccagccugugguccgaccucagcuccgacgcccaggaguucgaggccgagagcuggucccuggucguggaccccagcuucugcaaccgccaggagaaggacgugaucaagcggcaggacgucaucuucgagcugaugcagaccgagaugcaccacauccagacccucuucaucaugagcgagaucuuccgcaaggggaugaaggaggagcugcagcuggaccacuccacgguggacaagaucuucccgugccucgacgagcugcuggagauccaccgccacuucuucuacagcaugaaggagcggcgccaggaguccugcgcgggcagcgaccggaacuucgugaucgaccgcaucggcgacauccucguccagcaguucuccgaggagaacgccagcaagaugaagaagaucuacggggaguucugcugccaccacaaggaggccgugaaccuguucaaggagcugcagcagaacaagaaguuccagaacuucaucaagcuccggaacuccaaccugcuggcccgccggcgcggcauccccgagugcauccuccuggugacccagcggaucaccaaguaccccguccugguggagcgcauccuccaguacaccaaggagcggacggaggagcacaaggaccugcgcaaggcgcugugccucaucaaggacaugaucgccaccguggaccugaaggucaacgaguacgagaagaaccagaaguggcuggagauccucaacaagaucgagaacaagaccuacaccaagcugaagaacgggcacguguuccggaagcaggcccugaugagcgaggagcgcacgcuccuguacgacggccugguguacuggaagaccgccaccgggcgguucaaggacauccucgcccugcugcucaccgacguccugcuguuccuccaggagaaggaccagaaguacaucuucgcggccguggaccagaagcccuccgugaucagccugcagaagcugaucgcccgcgaggucgccaacgaggagcggggcauguuccucaucuccgccagcuccgcgggcccggagauguacgagauccacacgaacagcaaggaggagcgcaacaacuggaugcggcgcauccagcaggccguggaguccugccccgaggagaagggcgggcggaccagcgaguccgacgaggacaagcgcaaggccgaggcccgcguggccaagauccagcagugccaggagauccugaccaaccaggaccagcagaucugcgcguaccuggaggagaagcuccacaucuacgccgagcugggggagcugagcggcuucgaggacguccaccucgagccccaccuccugaucaagcccgacccgggggagccgccccaggccgccucccuccuggcggccgcccugaaggaggccgagagccuccagguggccgugaaggcgagccagaugggcgccgucucccagagcugcgaggacuccugcggcgacagcgugcuggccgacacccuguccagccacgacgugcccggguccccgacggccagccucgucaccggcgggcgggagggccgcgggugcuccgacguggaccccggcauccagggcguggucaccgaccuggccgugagcgacgcgggggagaagguggagugccggaacuuccccggcuccagccaguccgagaucauccaggccauccagaaccugacccgccuccuguacagccugcaggccgcccugacgauccaggacucccacaucgagauccaccggcucguccugcagcagcaggaggggcugagccucggccacuccauccugcgcgggggcccgcugcaggaccagaagucccgggacgccgaccgccagcacgaggagcucgcgaacgugcaccagcugcagcaccagcugcagcaggagcagcggcgcuggcuccggcgcugcgagcagcagcagcgggcccaggccacccgcgaguccuggcugcaggagcgggagcgcgagugccagagccaggaggagcugcuccugcggagccgcggcgagcuggaccuccagcugcaggaguaccagcacucccuggagcggcuccgcgaggggcagcgccugguggagcgggagcaggcccgcaugcgggcccagcagagccugcucggccacuggaagcacgggcgccagcggucccugcccgcgguccugcuccccggcggccccgaggugauggagcugaaccgcagcgagucccugugccacgagaacagcuucuucaucaacgaggcccucguccagauguccuucaacaccuucaacaagcugaacccgagcgugauccaccaggacgccaccuaccccacgacccagucccacagcgaccuggugcggaccuccgagcaccaggucgaccucaagguggaccccagccagcccuccaacgugagccacaagcuguggaccgccgcgggguccggccaccagauccugccguuccacgagagcuccaaggacagcugcaagaacgggagcuccaugacgaagugcagcugcacccucaccagcccgcccggccuguggaccgggaccacgagcacccugaaggaccucgacaccucccacaccgagagccccacgccgcacgacuccaacagccaccgcccccagcugcaggccuucaucaccgaggccaagcugaaccuccccacccggaccaugacgcgccaggacggcgagaccggcgacggggccaaggagaacaucgucuaccuguga

SEQ ID NO: 26856 - RNA, 2961 nt, Artificial Sequence
  derived and/or modified sequence opt1 from ARHGEF2__Homo_sapiens__NP_001155855
augagccgcaucgagucccugacccgggcccgcaucgaccggagccgcgagcucgccuccaagacccgggagaaggagaagaugaaggaggcgaaggacgcccgcuacacgaacggccaccuguucaccaccaucagcguguccgggaugaccaugugcuacgccugcaacaagagcaucacggccaaggaggcccugaucugcccgaccugcaacgucaccauccacaaccggugcaaggacacccucgcgaacugcacgaaggugaagcagaagcagcagaaggccgcccugcugaagaacaacaccgcccuccaguccgugagccugcgcuccaagaccaccauccgggagcgccccagcuccgcgaucuaccccagcgacuccuuccggcagagccugcucggcucccgccgggggcgcagcucccugagccuggccaaguccgucagcacgaccaacaucgccggccacuucaacgacgagagcccccucgggcugcggcgcauccugucccagagcaccgacucccucaacaugcggaaccgcacccugagcguggagucccugaucgacgaggccgaggugaucuacagcgagcucauguccgacuucgagauggacgagaaggacuucgccgcggacagcuggucccuggccgucgacagcuccuuccugcagcagcacaagaaggaggugaugaagcagcaggacgugaucuacgagcucauccagacggagcugcaccacguccggacccugaagaucaugacccgccucuuccggaccggcaugcuggaggagcugcaccucgagcccggcguggugcaggggcuguucccgugcgucgacgagcugagcgacauccacacgcgcuuccucucccagcugcuggagcgccggcgccaggcccucugccccggcagcacccggaacuucgugauccaccgccugggggaccugcucaucucccaguucagcggccccuccgccgagcagaugugcaagaccuacagcgaguucugcucccggcacagcaaggcccugaagcuguacaaggagcucuacgcgcgcgacaagcgguuccagcaguucauccgcaaggugacccggcccgccguccugaagcgccacggggugcaggagugcauccugcucgugacgcagcggaucaccaaguacccgcugcugaucagccgcauccuccagcacucccacggcaucgaggaggagcggcaggaccugaccaccgcccugggccucgucaaggagcugcugagcaacguggacgaggggaucuaccagcuggagaagggcgcccgccuccaggagaucuacaaccggauggacccccgcgcccagacgcccgugcccgggaagggcccguucggccgggaggagcugcugcgccggaagcucauccacgacgggugccugcuguggaagaccgcgaccggccgcuucaaggacguccucgugcugcugaugaccgacgugcucgucuuccugcaggagaaggaccagaaguacaucuuccccacgcuggacaagcccuccguggucagccuccagaaccugaucgugcgcgacaucgccaaccaggagaaggggauguuccugaucuccgccgcgcccccggagauguacgaggugcacaccgccagccgggacgaccgcuccaccuggauccgggucauccagcagagcgugcggaccugccccucccgcgaggacuucccccucaucgagacggaggacgaggccuaccugcgccggaucaagauggagcugcagcagaaggaccgcgcccucguggagcugcugcgggagaaggucggccucuucgccgagaugacccacuuccaggccgaggaggacgggggcagcggcauggcgcugcccacccugccgcgcggccucuuccgguccgagagccuggagagcccccgcggggagcggcugcuccaggacgccauccgcgagguggaggggcugaaggaccugcucgugggccccggggucgagcugcugcucacgccccgggagccggcccugccccuggagcccgacuccggcggcaacaccucccccggggugaccgccaacggcgaggcccgcaccuucaacgggagcaucgagcucugccgggcggacuccgacagcagccagcgcgaccggaacggcaaccagcugcgcuccccgcaggaggaggcccugcagcggcucgugaaccuguacgggcugcuccacggccugcaggccgccgucgcccagcaggacacccugauggaggcgcgcuuccccgagggccccgagcgccgggagaagcucugccgcgccaacagccgggacggggaggccggccgcgccggggccgcgccgguggcccccgagaagcaggccaccgagcuggcccugcuccagcggcagcacgcgcugcugcaggaggagcuccgccggugccgccggcugggcgaggagcgcgccacggaggccggcucccuggaggcccggcuccgcgagagcgagcaggcccgggcgcugcuggagcgcgaggccgaggaggcccggcgccagcucgccgcccuggggcagaccgagccccugcccgcggaggccccgugggcccggcgccccguggacccccggcgccgcucccuccccgccggcgacgcccuguaccugagcuucaacccgccccagcccucccgggggaccgaccgccucgaccugcccgucaccacgcggagcgugcaccgcaacuucgaggaccgggagcgccaggagcugggcuccccggaggagcggcuccaggacagcuccgaccccgacaccgggagcgaggaggagggcuccagccgccuguccccgccccacagcccccgggacuucacccgcaugcaggacauccccgaggagaccgagucccgggacggcgaggcgguggccagcgaguccuga

SEQ ID NO: 26857 - RNA, 2334 nt, Artificial Sequence
  derived and/or modified sequence opt1 from ARHGEF38__Homo_sapiens__NP_001229658
auggagcccaaggaggccaccggcaaggagaacauggugaccaagaagaagaaccuggccuuccuccgcagccggcuguacaugcuggagcgccggaagacggacaccgucguggaguccagcguguccggggaccacagcggcacccuccgccggucccagagcgaccgcaccgaguacaaccagaagcugcaggagaagaugacgccgcagggggagugcuccgucgcggagacccugacccccgaggaggagcaccacaugaagcggaugauggccaagcgcgagaagaucaucaaggagcucauccagaccgagaaggacuaccugaacgaccuggagcucugcgugcgggaggugguccagccccugcgcaacaagaagacggaccggcuggacguggacagccucuucuccaacaucgagagcgugcaccagaucuccgccaagcugcugagccuccuggaggaggccaccaccgacgucgagcccgccaugcaggucaucggcgagguguuccugcagaucaaggggccgcucgaggacaucuacaagaucuacugcuaccaccacgacgaggcgcacuccauccuggagagcuacgagaaggaggaggagcugaaggagcaccucucccacugcauccagagccugaagaagaucuacaugcaggagggcaagcccaaccugcucgacaugggcucccugaugaucaagcccauccagcgcgugaugaaguacccccugcuccugugcgagcugcggaacagcaccccgcccucccaccccgacuaccgcgcccucgacgacgccuucgccgcggugaaggacaucaacgugaacaucaacgagcugaagcggcgcaaggaccugguccucaaguacaagaagaacgacgaggacgagagccugaaggacaagcugagcaagcucaacauccacuccaucagcaagaaguccaagcgggugacgaaccaccugaagauccugacccgcggggagagccaggugaaggacaacaccuucaaccgggaggagaagcuguuccgcgcccuggagaagaccguccggcugugcgugaagaacaucucccucugccugcagcacauccaggacgccaugccccuggcccuccagagcgugauggaccugcaggagaucuccuacaacaaggacgacgagauggacuacagcgagacgcuguccaacgcccucaacagcugccacgacuucgcgucccaccuccagcgccugauccugaccccgcucagcgcccugcugucccucuuccccggcccccacaagcugauccagaagcgcuacgacaagcugcucgacugcaacagcuaccugcagcgguccaccggggaggagagcgaccuggccaagaaggaguacgaggcccucaacgcccagcuggucgaggagcugcaggcguucaaccaggccgcccgcaagauccuccugaacugccugugcuccuucaucacccuccugcgggaccugaugcucguggcccagcaggccuacagcacgcuggugcccaugccgcugcucgucuccagcaucagcgagauccagaaccaggugcuggaggagauccagaaccugaacugcgucaaggagaacuccgcgaccuucaucgagcgcaagcucagcuucgagaagaagaagcccgugcagauccugcccgagaugccccaccagaccgacauccaccgguccaagcugcucagcaccuacuccgccgaggagcuguaccaggccaagcgcaagugcaacgccacgcaggaguacgacaucaaccugcucgagggcgaccugguggccgucaucgagcagaaggacccgcuggggagcaccucccgguggcucguggacaccggcaacgugaagggcuacgucuacagcuccuuccugaagcccuacaaccccgcgaagaugcagaagguggacgccgagaaccgcuucugcgacgacgacuucgagaacaucagccuguucguguccagccggcccgccuccgacagcgucaccgggacguccgagagcuccaucggcgacagcagcuccagccucuccgggaccugcggcaaguucgagaccaacggcaccgacguggacagcuuccaggagguggacgagcagaucuucuacgccguccacgcguuccaggcccgcuccgaccacgagcugagccugcaggaguaccagcgggugcacauccuccgcuucugcgaccuguccgggaacaaggagugguggcuggccgaggcccagggccagaagggguacgugccggccaacuaccucggcaagaugacguacgcguga

SEQ ID NO: 26858 - RNA, 1677 nt, Artificial Sequence
  derived and/or modified sequence opt1 from ARHGEF3__Homo_sapiens__NP_001122087
auggacagcuccaccgccaugaaccagugcagcugccgcggcauggaggagaacaaggagcggcccaagcgccagcggcagaacaacuucccgauguuccccucccccaaggccuggaacuuccgcgggcggaagcgcaagcagagcacccaggacgaggacgcggugucccugugcagccucgacaucuccgagcccagcaacaagcgggucaagccgcugucccgcgugacgagccuggccaaccucaucccgcccgugaaggccacgccccugaagcgguucucccagacccugcagcgcagcaucuccuuccggagcgagucccgccccgacauccucgcgccccggcccuggagccgcaacgccgcccccuccagcaccaagcggcgcgacuccaagcuguggagcgagaccuucgacgucugcgugaaccagaugcugaccagcaaggagaucaagcggcaggaggccaucuucgagcucucccagggcgaggaggaccugaucgaggaccugaagcucgccaagaaggccuaccacgacccgaugcugaagcugagcaucaugaccgagcaggagcucaaccagaucuucgggacccuggacucccugaucccccuccacgaggagcugcugagccagcuccgcgacgugcggaagcccgacggcuccacggagcacgucgggcccauccuggugggcuggcugccgugccucagcuccuacgacagcuacugcuccaaccagguggcggccaaggcccugcuggaccacaagaagcaggaccaccgcguccaggacuuccuccagcggugccuggagagccccuucucccgcaagcuggaccucuggaacuuccuggacaucccccgcagccggcuggugaaguacccccuccugcugcgcgagauccuccggcacaccccgaacgacaaccccgaccagcagcaccuggaggaggccaucaacaucauccagggcaucguggccgagaucaacaccaagaccggggaguccgagugccgcuacuacaaggagcggcugcucuaccuggaggagggccagaaggacagccugaucgacuccagccgcguccucugcugccacggggagcugaagaacaaccggggcgugaagcugcacguguuccucuuccaggagguccuggugaucacgcgcgcggugacccacaacgagcagcugugcuaccagcucuaccggcagcccauccccgucaaggaccugcugcuggaggaccuccaggacggggaggugcgccugggcggcucccugcgcggggccuucagcaacaacgagcggaucaagaacuucuuccggguguccuucaagaacggcagccagagccagacccacucccuccaggccaacgacaccuucaacaagcagcaguggcugaacugcauccgccaggccaaggagacgguccugugcgccgcggggcaggccggcgugcucgacagcgagggcuccuuccugaacccgaccaccgggagccgggagcugcagggcgagaccaagcucgagcagauggaccaguccgacagcgaguccgacugcagcauggacacguccgaggugagccuggacugcgagcgcauggagcagaccgacuccagcugcgggaacucccggcacggcgagagcaacgucuga

SEQ ID NO: 26859 - RNA, 2073 nt, Artificial Sequence
  derived and/or modified sequence opt1 from ARHGEF4__Homo_sapiens__NP_056135
augcccugggaggagccggccggcgagaagcccagcugcucccacagccagaaggccuuccacauggagcccgcgcagaagcccugcuucaccaccgacauggugacgugggcccugcucugcaucuccgccgagaccgugcgcggggaggccccgagccagccccggggcaucccccaccgcucccccgugagcguggacgaccuguggcuggagaagacccagcggaagaagcuccagaagcaggcccacguggagcgccggcugcacaucggggcggugcacaaggacggcgugaagugcuggcgcaagaccaucaucacguccccggagagccugaaccucccccggcgcucccacccccugagccaguccgcccccaccgggcugaaccacaugggcuggccggagcacacccccggcaccgccaugcccgacggggcccucgacacggcggucugcgccgacgaggugggcagcgaggaggaccuguacgacgaccugcacuccagcucccaccacuacagccaccccgggggcgggggcgagcagcucgccaucaacgagcugaucuccgacggcagcguggucugcgccgaggcccugugggaccacgugaccauggacgaccaggagcucggguucaaggcgggcgacgugaucgaggucauggacgccaccaaccgggagugguggugggggcgcguggccgacggcgagggcugguucccggccuccuucgugcggcugcgcgucaaccaggacgagcccgccgacgacgacgcgccccuggccgggaacagcggcgccgaggacgggggcgccgaggcccagagcuccaaggaccagaugcggaccaacgugaucaacgagauccucagcacggagcgcgacuacaucaagcaccuccgggacaucugcgagggguacgugcgccagugccggaagcgcgcggacauguucuccgaggagcagcugcggaccaucuucggcaacaucgaggacaucuaccgcugccagaaggccuucgucaaggcccuggagcagcgguucaaccgcgagcgcccccaccugagcgagcugggcgccugcuuccucgagcaccaggccgacuuccagaucuacuccgaguacugcaacaaccacccgaacgcgugcguggagcugagccggcugaccaagcucuccaaguacguguacuucuucgaggccugccgccugcugcagaagaugaucgacaucagccucgacggguuccugcugacccccguccagaagaucugcaaguacccccuccagcuggccgagcugcucaaguacacgcacccccagcaccgggacuucaaggacguggaggccgcgcugcacgccaugaagaacguggcccagcugaucaacgagcgcaagcggcgccucgagaacaucgacaagaucgcccaguggcaguccagcaucgaggacugggagggcgaggaccugcugguccgguccagcgagcucaucuacuccggggagcugacccgcgugacccagccgcaggccaagagccagcagcggauguucuuccuguucgaccaccagcucaucuacugcaagaaggaccugcugcgccgggacguccucuacuacaagggccgccuggacauggacgggcuggaggugguggaccuggaggacggcaaggaccgggaccuccacgucuccaucaagaacgcguuccgccugcaccggggcgccaccggggacagccaccuccugugcacgcgcaagcccgagcagaagcagcgguggcugaaggccuucgcccgcgagcgggagcagguccagcuggaccaggagaccggcuucuccaucaccgagcuccagcgcaagcaggccaugcugaacgcgagcaagcagcaggucaccgggaagcccaaggccgugggccgccccugcuaccugacgcggcagaagcacccggcccuccccuccaaccgcccccagcagcagguccuggugcuggccgagccgcggcgcaagcccagcaccuucuggcacagcaucucccggcucgcccccuuccgcaaguga

SEQ ID NO: 26860 - RNA, 4794 nt, Artificial Sequence
  derived and/or modified sequence opt1 from ARHGEF5__Homo_sapiens__NP_005426
auggaggccgaggaggcccagcgcggcgccuccccgcccaucuccgccaucgaggaguucuccaucauccccgaggcccccaugcgguccagccagguguccgcccuggggcucgaggcccaggaggacgaggaccccagcuacaaguggcgcgaggagcaccggcuguccgccacccagcagagcgagcugcgcgacgugugcgacuacgccaucgagaccaugcccuccuuccccaaggagggcagcgccgacguggagcccaaccaggagucccugguggccgaggcgugcgacacccccgagcacugggaggccgugccccagagccuggccgggcggcaggcccgcacccuggcgccgcccgagcugugggcgugccccauccaguccgagcaccuggacauggcccccuucagcuccgaccugggcagcgaggaggaggagguggaguucuggcccgggcugaccucccugacccugggcagcggccaggccgaggaggaggaggagaccuccagcgacaacagcgggcagacccgguacuacucccccugcgaggagcaccccgccgagaccaaccagaacgagggcagcgaguccgggaccauccgccagggcgaggagcucccgcccgaggagcugcaggagagccaggggcugcuccacccccaggaggugcagguccuggaggagcagggccagcaggaggccggcuuccgcggggagggcacgcugcgcgaggacgugugcgcggacgggcuccugggcgaggagcagaugaucgagcaggucaacgacgagaagggcgagcagaagcagaagcaggagcagguccaggacgugaugcuggggcggcagggcgagcgcauggggcucaccggcgagcccgaggggcugaacgacggcgagugggagcaggaggacauggagcggaaggcccagggccagggcgggcccgagcagggggaggagcgcaagcgggagcuccaggugcccgaggagaaccgcgccgacucccaggacgagaagucccagaccuuccucggcaaguccgaggaggucaccgggaagcaggaggaccacggcaucaaggagaagggcgugcccgugagcgggcaggaggccaaggagcccgaguccugggacggcgggcggcugggcgccgucgggcgcgcgcggagccgcgaggaggagaacgagcaccacggccccuccaugcccgcccugaucgcccccgaggacagcccccacugcgaccucuucccgggcgccuccuaccugaugacgcagauccccgggacccagaccgagagccgggccgaggagcugucccccgcggcccucagcccgucccuggagcccauccgcugcagccaccagcccaucucccugcucggcagcuuccugaccgaggagagccccgacaaggagaucgaccagaacucccagcaggaggagagccgccugcggaaggggacgguguccagccagggcaccgagguggucuucgccuccgccagcgugaccccgccccgcacccccgacuccgcgcccccgagccccgccgaggccuaccccaucacgcccgccuccgugagcgcccggccgcccgucgcguucccccgccgggagaccuccugcgccgcccgcgcccccgagaccgccagcgcgccgcucuccauggacgaccccagccccugcggcaccuccgagaugugccccgccgcccuguacggguucccgagcacgggcaccagcccgccccggcccccggccaacagcaccgggaccgugcagcaccuccgcagcgacuccuuccccggcagccaccggacggagcagacccccgaccucguggggaugcugcuguccuacagccacuccgagcucccgcagcggccgcccaagcccgccaucuacagcuccgucaccccgcggcgcgaccggcgcagcggccgggacuacuccaccgugagcgcgucccccacggcccugagcacccugaagcaggacucccaggagagcaucuccaaccucgagcgccccagcagcccgcccagcauccagcccugggucagcccccacaaccccgccuucgccaccgagagccccgcguacggcagcucccccagcuucguguccauggaggacgugcggauccacgagccccugcccccgcccccgccccagcgccgggacacccacccgagcgucguggagacggacgggcacgcccgcguggucgugcccacccugaagcagcacucccacccgccgccccucgcccugggcagcgggcugcacgcgccccacaagggcccccugccccaggccuccgaccccgcgguggcccgccagcaccggccccuccccagcaccccggacuccagccaccacgcccaggccacgccccgcuggcgguacaacaagccccugcccccgacccccgaccugccccagccccaccucccgcccaucuccgcccccgggagcucccgcaucuaccggccccugccgccccugcccaucaucgacccgcccacggagcccccgccccugccgcccaagagccgcggccggucccgcagcacccggggcgggcacaugaacuccggcgggcacgcgaagacccgccccgccugccaggacuggaccgucccccugccggccagcgccggccggacguccuggccgcccgccaccgcgcgcagcaccgagagcuucaccuccacgagccgguccaagagcgaggugucccccgggauggccuucagcaacaugaccaacuuccugugcccguccagccccaccacccccuggacgccggagcuccagggccccaccuccaaggacgaggccggcgugagcgagcaccccgaggcccccgcgcgcgagccgcugcggcgcaccacgccccagcagggggccuccggccccgggcggagccccgucggccaggcccgccagccggagaagcccucccaccuccaccucgagaaggccagcuccuggccccaccggcgcgacagcgggcggcccccgggcgacuccagcggccaggccguggcgcccuccgagggggccaacaagcacaagggcuggagccgccaggggcugcgccggcccagcauccugcccgagggcuccagcgacucccgcggcccggccguggagaagcaccccgggcccagcgacacggucguguuccgggagaagaagcccaaggaggugaugggcggguucucccgccggugcagcaagcucaucaacuccagccagcugcuguaccaggaguacuccgacgucgugcucaacaaggagauccagagccagcagcgccuggagucccugagcgagaccccgggccccuccagcccccggcagccccgcaaggcccucguguccagcgaguccuaccugcagcggcugagcauggccuccagcgggagccucuggcaggagaucccggucgugcgcaacuccaccgugcugcugagcaugacccacgaggaccagaagcuccaggaggucaaguucgagcugaucguguccgaggcgagcuaccugcggucccucaacaucgccguggaccacuuccagcugagcacgucccugcgcgccacccucagcaaccaggagcaccaguggcuguucucccggcugcaggacguccgcgacgugagcgccaccuuccucuccgaccuggaggagaacuucgagaacaacaucuucagcuuccaggugugcgacgucgugcugaaccacgcccccgacuuccggcgcguguaccuccccuacgucaccaaccagacguaccaggagcggaccuuccagucccugaugaacagcaacuccaacuuccgcgaggugcuggagaagcucgagagcgacccggugugccagcggcugucccugaaguccuuccucauccugcccuuccagcgcaucacccgccugaagcuccugcugcagaacauccucaagcggacccagcccggcuccagcgaggaggcggaggccacgaaggcccaccacgcccuggagcagcugauccgcgacugcaacaacaacguccagagcaugcggcgcaccgaggagcucaucuaccugucccagaagaucgaguucgagugcaagaucuucccccugaucagccagucccgguggcucgugaaguccggcgagcugaccgcccuggaguucuccgcgagcccggggcuccgccggaagcugaacacccgccccgugcaccuccaccucuucaacgacugccugcugcucucccggccccgcgagggcagccgguuccuggucuucgaccacgcccccuucuccagcauccgcggggagaagugcgagaugaagcugcacggcccgcacaagaaccucuuccggcuguuccugcgccagaacacgcagggggcccaggccgaguuccucuuccggaccgagacccaguccgagaagcugcgcuggaucagcgcgcuggccaugccccgggaggagcucgaccugcuggagugcuacaacagcccccaggugcagugccuccgcgccuacaagccccgggagaacgacgagcuggcccuggagaaggccgacguggucauggugacccagcagagcuccgacggcuggcucgagggcgugcgccugagcgacggggagcggggcugguucccgguccagcaggucgaguucaucuccaaccccgaggugcgcgcgcagaaccugaaggaggcccaccgcgucaagacggccaagcuccagcugguggagcagcaggccuga

SEQ ID NO: 26861 - RNA, 2331 nt, Artificial Sequence
  derived and/or modified sequence opt1 from ARHGEF6__Homo_sapiens__NP_004831
augaaccccgaggagcagaucgugaccuggcugaucagccucggcguccuggaguccccgaagaagaccaucugcgaccccgaggaguuccucaagagcucccucaagaacgggguggugcugugcaagcugaucaaccgccucaugcccggcagcgucgagaaguucugccuggacccccagacggaggccgacugcaucaacaacaucaacgacuuccugaaggggugcgccacccuccagguggagaucuucgacccggacgaccuguacuccggcgugaacuucagcaagguccuguccacccuccuggcggugaacaaggccaccgaggaccagcugagcgagcggcccugcgggcgcuccagcucccucagcgccgccaacacgucccagaccaacccccagggcgccgugagcuccaccgucagcggccugcagcggcaguccaagaccguggagaugacggagaacgggagccaccagcugaucgugaaggcgcgcuucaacuucaagcagaccaacgaggacgagcucuccgucugcaagggcgacaucaucuacgugacccggguggaggagggcggguggugggaggggacccugaacggccgcacgggcugguuccccagcaacuacguccgggagaucaagagcuccgagcgcccgcugagccccaaggccgugaagggguucgagaccgcgccccucaccaagaacuacuacaccgugguccugcagaacauccuggacacggagaaggaguacgccaaggagcuccagucccugcuggugaccuaccuccggccccugcagagcaacaacaaccuguccaccguggaggucaccagccuccugggcaacuucgaggaggugugcacguuccagcagacccugugccaggcccucgaggagugcuccaaguucccggagaaccagcacaaggucgggggcugccugcugagccucaugccccacuucaaguccauguaccuggccuacugcgccaaccaccccagcgccgugaacgugcugacccagcacuccgacgagcucgagcaguucauggagaaccagggcgccagcucccccgggauccugauccugaccacgaaccucagcaagccguucaugcgccuggagaaguacgucacccugcuccaggagcuggagcggcacauggaggacacccaccccgaccaccaggacauccugaaggcgaucguggccuucaagacccucaugggccagugccaggaccugcgcaagcggaagcagcuggagcugcagauccucuccgagcccauccaggccugggagggggaggacaucaagaaccugggcaacgugaucuucaugagccaggucauggugcaguacggggccugcgaggagaaggaggagcgcuaccugaugcuguucuccaacgugcugaucaugcugagcgccagcccccggaugagcggcuucaucuaccagggcaagaucccgaucgcggggacggucgugacccgccucgacgagaucgagggcaacgacugcaccuucgagaucaccgggaacacgguggagcggaucgucgugcacugcaacaacaaccaggacuuccaggaguggcuggagcagcugaaccgccucauccggggccccgccagcugcuccagccuguccaagaccagcuccagcuccugcagcgcccacuccagcuucuccagcaccgggcagccccgcggcccccuggagccgccccagaucaucaagcccuggucccucagcugccugcggcccgccccgccccugcgccccuccgccgcgcucggcuacaaggagcgcaugagcuacauccugaaggaguccagcaagagcccgaagaccaugaagaaguuccugcacaagcggaagacggagcgcaagcccuccgaggaggaguacgugauccgcaagagcaccgccgcccucgaggaggacgcccagauccugaaggucaucgaggccuacugcaccuccgcgaacuuccagcaggggcacggcagcuccacccggaaggacagcaucccccaggugcugcuccccgaggaggagaagcugaucaucgaggagacccgguccaacgggcagacgaucauggaggagaagucccugguggacaccgucuacgcccucaaggacgaggugcgcgagcugaagcaggagaacaagcggaugaagcagugccuggaggaggagcucaagucccgccgggaccuggagaagcuggugcgccggcuccugaagcagaccgacgagugcauccgcggcgagagcuccagcaagaccuccauccugccguga

SEQ ID NO: 26862 - RNA, 2412 nt, Artificial Sequence
  derived and/or modified sequence opt1 from ARHGEF7__Homo_sapiens__NP_001106983
augaacagcgccgagcagaccgugaccuggcugaucacgcucggcguccuggagucccccaagaagaccaucagcgacccggagggguuccugcaggccucccucaaggacggcguggugcugugccggcugcucgagcggcugcugcccgggaccaucgagaaggucuaccccgagccccgcagcgaguccgagugccucagcaacauccgggaguuccugcgcggcugcggggcgucccugcggcucgagcugcuguucccgcccagccagccgccccagcaccucgugaccacgauccugcuguccgccagcaccuucgacgccaacgaccucuaccagggccagaacuucaacaaggugcuguccagccuggucacccucaacaaggugaccgccgacaucggccugggguccgacagcgugugcgcccgccccuccagccaccggaucaaguccuucgacagccugggcucccagagccuccacacgcgcaccagcaagcuguuccaggggcaguaccggucccuggacaugaccgacaacagcaacaaccagcucgucgugcgcgcgaaguucaacuuccagcagaccaacgaggacgagcuguccuucagcaagggcgacgugauccacgucacgcggguggaggagggcggguggugggagggcacccugaacgggcgcaccggcugguuccccuccaacuacgugcgggaggucaaggccagcgagaagcccgugucccccaagagcgggacccucaaguccccgcccaagggcuucgacacgaccgccaucaacaagagcuacuacaacgugguccugcagaacauccuggagaccgagaacgaguacuccaaggagcuccagaccgugcugagcacguaccugcgcccccuccagaccuccgagaagcugagcuccgccaacaucagcuaccugaugggcaaccucgaggagaucugcuccuuccagcagaugcuggugcagagccuggaggagugcaccaagcuccccgaggcgcagcagcgggucgggggcugcuuccugaaccugaugccgcagaugaagacccucuaccugacguacugcgccaaccaccccuccgccgugaacgugcugaccgagcacagcgaggagcucggggaguucauggagaccaagggcgccagcucccccgggauccugguccugaccacgggccugagcaagcccuucaugcgccucgacaaguacccgacccugcugaaggagcucgagcggcacauggaggacuaccacaccgaccgccaggacauccagaaguccauggccgcguucaagaaccugagcgcccagugccaggaggugcggaagcgcaaggagcuggagcuccagauccugaccgaggccauccggaacugggagggcgacgacaucaagacgcuggggaacgucaccuacaugucccaggugcucauccagugcgccggcagcgaggagaagaacgagcgcuaccugcugcuguuccccaacgugcugcugaugcucuccgccagcccccgcauguccggguucaucuaccagggcaagcugcccaccaccgggaugacgaucaccaagcuggaggacagcgagaaccaccggaacgcguucgagaucuccggcagcaugaucgagcgcauccucgucuccugcaacaaccagcaggaccugcaggaguggguggagcaccuccagaagcagaccaaggugaccagcgucggcaacccgaccaucaagccccacuccgugcccagccacacgcuccccucccacccggugacccccagcagcaagcacgccgacuccaagcccgccccgcugacccccgccuaccacacccugccccaccccagccaccacgggacgccgcacaccaccaucaacuggggcccccucgagccgcccaagacccccaagcccuggucccugagcugccugcggcccgcgcccccgcuccgccccuccgccgcccugugcuacaaggaggaccugagcaagucccccaagacgaugaagaagcuccugcccaagcggaagccggagcgcaagcccagcgacgaggaguucgccucccgcaagagcaccgccgcccuggaggaggacgcgcagauccucaaggucaucgaggccuacugcaccuccgccaagacccggcagacgcugaacagcaccuggcaggggaccgaccugaugcacaaccacgugcucgccgacgacgaccagcccucccuggacagccugggccggcgcuccagccucucccggcuggagcccagcgaccuguccgaggacagcgacuacgacagcaucuggaccgcgcacuccuaccgcauggggagcacgucccgcaagagcugcugcuccuacaucagccaccagaacuga

SEQ ID NO: 26863 - RNA, 1392 nt, Artificial Sequence
  derived and/or modified sequence opt1 from ARHGEF9__Homo_sapiens__NP_001166950
augcaguggauccgcggcgggagcggcaugcugugggugaaccaggaggacgaggucgaggaggggcccuccgacgugcagaacggccaccucgacccgaacagcgacugccugugccuggggcggccccuccagaaccgcgaccagaugcgggccaacgugaucaacgagaucauguccaccgagcgccacuacaucaagcaccugaaggacaucugcgagggcuaccugaagcagugccggaagcgccgggacauguucagcgacgagcagcucaaggucaucuucggcaacaucgaggacaucuaccgcuuccagaugggguucgugcgggaccuggagaagcaguacaacaacgacgacccccaccuguccgagaucggccccugcuuccucgagcaccaggacggguucuggaucuacagcgaguacugcaacaaccaccuggacgccugcauggagcuguccaagcucaugaaggacagccgcuaccagcacuucuucgaggcgugccggcugcugcagcagaugaucgacaucgccaucgacggcuuccuccugaccccggugcagaagaucugcaaguacccccugcagcucgccgagcugcugaaguacacggcccaggaccacuccgacuaccgcuacgucgccgcggcccucgccgugaugcggaacgugacccagcagaucaacgagcgcaagcggcgccuggagaacaucgacaagaucgcccaguggcaggcgagcguccuggacugggagggggaggacauccucgaccgguccagcgagcugaucuacaccggcgagauggccuggaucuaccagcccuacggccgcaaccagcagcggguguucuuccuguucgaccaccagauggugcucugcaagaaggaccugauccgccgggacauccuguacuacaaggggcgcaucgacauggacaaguacgaggucguggacaucgaggacggccgcgacgacgacuucaacguguccaugaagaacgccuucaagcuccacaacaaggagaccgaggagauccaccuguucuucgccaagaagcuggaggagaagauccgguggcuccgcgccuuccgggaggagcgcaagaugguccaggaggacgagaagaucggguucgagaucagcgagaaccagaagcggcaggcggccaugacggugcgcaaggugcccaagcagaagggcgucaacuccgcccggagcgugccgcccuccuacccgccgccccaggacccccugaaccacggccaguaccuggugcccgacgggaucgcccagagccaggucuucgaguucaccgagcccaagcgcucccagagccccuucuggcagaacuucagccggcucacccccuucaagaaguga

SEQ ID NO: 26864 - RNA, 2763 nt, Artificial Sequence
  derived and/or modified sequence opt1 from AR__Homo_sapiens__NP_000035
auggaggugcagcugggccucgggcgcgucuacccccggccgcccagcaagaccuaccgcggcgccuuccagaaccuguuccaguccgugcgggaggugauccagaaccccgggccccgccacccggaggccgcgagcgccgccccccccggcgccucccugcuccugcugcagcagcagcagcagcagcagcagcagcagcagcagcagcagcagcagcagcagcagcagcagcagcaggagaccagcccccggcagcagcagcagcagcagggggaggacggcuccccgcaggcccaccgccggggccccacgggguaccucguccuggacgaggagcagcagcccagccagccccaguccgcgcuggagugccacccggagcgcggcugcgugcccgagcccggggccgccguggccgcgagcaagggccucccccagcagcugccggccccccccgacgaggacgacuccgccgcccccagcacccugucccuccuggggccgaccuuccccggccugagcuccugcagcgccgaccucaaggacauccuguccgaggcgagcaccaugcagcugcuccagcagcagcagcaggaggccgucuccgagggcagcuccagcgggcgggcccgcgaggccagcggcgcccccacguccagcaaggacaacuaccuggggggcaccuccaccaucagcgacaacgcgaaggagcugugcaaggccguguccgugagcaugggccucggggucgaggcccuggagcaccugucccccggcgagcagcuccggggggacugcauguacgccccgcugcugggcgugccccccgccgugcgccccaccccgugcgcgccccucgccgagugcaaggggagccugcuggacgacuccgccggcaagagcacggaggacaccgccgaguacucccccuucaagggcggguacaccaagggccucgagggggagagccugggcugcuccgggagcgccgcggccggcuccagcggcacccuggagcucccguccacgcugagccuguacaaguccggggcccucgacgaggccgcggccuaccagagccgggacuacuacaacuucccccuggcccuggccggcccccccccgcccccccccccgccccacccccacgcccgcaucaagcucgagaacccccuggacuacgggagcgcgugggccgccgccgccgcgcagugccgguacggcgaccuggccucccuccacggggccggcgccgccggcccggggagcggcucccccagcgcggccgccuccagcuccuggcacacccuguucaccgccgaggaggggcagcuguacggccccugcggcgggggcgggggcgggggcggcgggggcgggggcgggggcggcgggggcgggggcgggggcggcggggaggcgggcgccgucgcccccuacggguacacccgcccgccccagggccucgccgggcaggagagcgacuucacggcccccgacgugugguaccccggcggcauggugucccgggucccguaccccagccccaccugcgugaaguccgagauggggcccuggauggacagcuacuccggcccguacggggacaugcgccuggagaccgcgcgggaccacgugcugcccaucgacuacuacuuccccccgcagaagaccugccucaucugcggcgacgaggccagcggcugccacuacggggcccugacgugcggcuccugcaaggucuucuucaagcgcgccgccgaggggaagcagaaguaccugugcgcgagccggaacgacugcaccaucgacaaguuccgccgcaagaacugccccuccugccggcugcgcaagugcuacgaggccggcaugacccucggggcccggaagcugaagaagcugggcaaccucaagcugcaggaggagggcgaggccagcagcaccacgucccccaccgaggagaccacccagaagcugacggugagccacaucgagggguacgagugccagcccaucuuccucaacgugcuggaggccaucgagccgggcgucgugugcgcggggcacgacaacaaccagcccgacuccuucgccgcccugcucagcucccugaacgagcugggcgagcgccagcucgugcacgucgugaagugggccaaggcgcugcccggguuccggaaccugcacgucgacgaccagauggccgugauccaguacagcuggaugggccucaugguguucgccaugggcuggcgcuccuucaccaacgucaacagccggaugcuguacuucgcccccgaccugguguucaacgaguaccgcaugcacaagucccggauguacagccagugcgugcgcaugcggcaccucucccaggaguucggguggcugcagaucaccccgcaggaguuccugugcaugaaggcccuccugcuguucagcaucauccccgucgacggccucaagaaccagaaguucuucgacgagcugcgcaugaacuacaucaaggagcuggaccggaucaucgcgugcaagcgcaagaaccccaccuccugcagccggcgcuucuaccagcucacgaagcugcuggacuccgugcagcccaucgcccgggagcuccaccaguucaccuucgaccugcugaucaagagccacaugguguccgucgacuucccggagaugauggccgagaucaucagcgugcaggugcccaagauccucuccgggaaggucaagcccaucuacuuccacacccaguga

SEQ ID NO: 26865 - RNA, 6711 nt, Artificial Sequence
  derived and/or modified sequence opt1 from ARID1B__Homo_sapiens__NP_059989
auggcccacaacgccggcgccgccgccgccgccgggacccacuccgccaaguccggcgggagcgaggccgcccugaaggagggcggguccgccgccgcccucagcuccagcuccagcuccagcgccgccgccgcggccgccuccagcuccagcuccagcggccccggcuccgccauggagaccgggcugcugcccaaccacaagcucaagaccgugggcgaggcccccgcggcgccgccccaccagcagcaccaccaccaccaccacgcccaccaccaccaccaccacgcccaccaccuccaccaccaccacgcccugcagcagcagcucaaccaguuccagcagcagcagcagcagcagcagcagcagcagcagcagcagcagcagcagcagcaccccaucagcaacaacaacucccugggcggggccgggggcggcgcgccccagcccgggcccgacauggagcagccccagcacggcggggccaaggacagcgccgccggcggccaggcggacccgcccgggccgccccugcucagcaagcccggcgacgaggacgacgcgccgcccaagaugggggagcccgccggcgggcgcuacgagcaccccggccugggcgcccuggggacccagcagccgcccguggcggugcccggcgggggcgggggccccgccgccgugcccgaguucaacaacuacuacggcuccgccgcccccgcgagcgggggccccgggggccgcgccgggcccugcuucgaccagcacggcggccagcagucccccgggaugggcaugaugcacagcgccuccgccgccgcggccggggcccccggcagcauggacccccuccagaacucccacgagggcuaccccaacagccagugcaaccacuaccccggguacucccgccccggcgccgggggcgggggcggcgggggcgggggcgggggcggcgggagcggcgggggcgggggcggcgggggcgccggggcgggcggggccggcgccggcgccgucgcggccgccgccgccgcggccgccgccgccgccgggggcgggggcggcgggggcuacgggggcuccagcgccggguacggcgugcuguccagcccccggcagcagggcgggggcaugaugauggggcccggcgggggcggcgccgccucccugagcaaggccgcggccggguccgccgccggcggguuccagcgcuucgcgggccagaaccagcaccccagcggggccacccccacccucaaccagcugcugacgucccccagccccaugaugcggagcuacggcggcuccuaccccgaguacagcuccccgagcgcgcccccgcccccgcccucccagccccagagccaggccgccgccgccggggccgccgccggcgggcagcaggcggccgccggcaugggccucgggaaggacaugggcgcccaguacgccgcggccucccccgccugggccgccgcgcagcagcgcagccaccccgccaugucccccgggacccccggccccaccauggggcggagccagggcucccccauggaccccauggugaugaagcgcccccagcuguacggcauggggagcaacccccacucccagccccagcagagcucccccuaccccggcgggagcuacggcccgcccgggccccagcgguaccccaucggcauccagggccgcacccccggggccauggccggcaugcaguacccccagcagcagaugccgccccaguacgggcagcagggcgucuccggguacugccagcagggccagcagcccuacuacagccagcagccccagccgccccaccucccgccccaggcgcaguaccugcccagccagucccagcagcgguaccagccccagcaggacaugagccaggagggcuacgggacgcgcucccagccgccccuggcccccggcaagcccaaccacgaggaccugaaccucauccagcaggagcggcccagcucccugcccgaccugagcggguccaucgacgaccuccccaccggcaccgaggccacccugagcuccgccgugagcgccuccgggagcaccuccagccagggcgaccaguccaaccccgcgcagagccccuucagcccccacgccagcccccaccuguccagcauccccggcgggccgagccccucccccgugggcagcccggucggguccaaccagagccgcuccggccccaucagccccgccuccauccccggcagccagaugccgccccagccgcccgggucccagagcgaguccagcucccacccggcccucagccagucccccaugccccaggagcggggcuucauggccgggacccagcgcaacccccagauggcgcaguacggcccgcagcagaccgggcccagcaugagcccccaccccagcccgggcggccagaugcacgccgggaucuccagcuuccagcagagcaacuccagcggcaccuacgggccccagaugucccaguacggcccccaggggaacuacagccggcccccggccuacuccggcgugcccagcgccuccuacagcggccccgggcccggcauggggaucuccgccaacaaccagaugcacggccaggggccgagccagcccugcggcgcggugccccugggccgcaugcccuccgccgggaugcagaaccggccguuccccggcaacaugagcuccaugacccccagcuccccggggaugagccagcagggcgggcccggcauggggccgcccaugccgaccgucaaccgcaaggcccaggaggccgcggccgccgugaugcaggccgccgcgaacuccgcccagagccggcagggguccuuccccggcaugaaccagagcgggcugauggccagcuccagccccuacucccagcccaugaacaacagcuccagccucaugaacacccaggccccgcccuacuccauggcccccgcgauggugaacagcuccgccgccagcgucggccuggccgacaugaugucccccggcgagagcaagcugccgcucccccugaaggccgacgggaaggaggagggcacgccccagcccgaguccaagagcaagaaguccagcuccagcacgaccaccggggagaagaucaccaagguguacgagcugggcaacgagccggagcgcaagcucuggguggaccgcuaccugaccuucauggaggagcgggggucccccgucagcagccugcccgcggugggcaagaagccccucgaccuguuccgccuguacgugugcgucaaggagaucggcgggcucgcccaggugaacaagaacaagaaguggcgggagcuggccaccaaccugaacgugggcaccuccagcuccgccgcgagcucccucaagaagcaguacauccaguaccuguucgccuucgagugcaagaucgagcgcggggaggagccgccgcccgaggucuucagcaccggcgacacgaagaagcagcccaagcugcagccgcccucccccgccaacagcgggucccugcagggcccgcagacgccccagagcaccggcuccaacagcauggccgaggugcccggggaccucaagcccccgacccccgccuccacgccccacggccagaugacccccaugcagggcggccggagcuccaccaucagcguccacgacccguucuccgacgugagcgacuccagcuuccccaagcgcaacagcaugacccccaacgcgcccuaccagcaggggauguccaugccggacgugaugggccggaugcccuacgagcccaacaaggaccccuucggcgggaugcgcaaggucccgggcagcuccgagcccuucaugacgcaggggcagaugcccaacagcuccaugcaggacauguacaaccagagccccuccggcgccaugagcaaccugggcauggggcagcggcagcaguucccguacggcgccuccuacgaccgccggcacgagcccuacgggcagcaguaccccggccaggggcccccgagcggccagccgcccuacggcgggcaccagcccggccuguacccccagcagcccaacuacaagcgccacauggacgggauguacggcccgcccgccaagcggcacgagggggacauguacaacaugcaguacuccagccagcagcaggagauguacaaccaguacggcggcuccuacagcgggcccgaccgccggcccauccagggccaguaccccuaccccuacucccgcgagcggaugcaggggcccggccagauccagacccacgggaucccgccccagaugaugggcggcccgcuccagagcuccagcagcgaggggccccagcagaacaugugggccgcgcgcaacgacaugcccuaccccuaccagaaccggcagggccccgggggccccacccaggcgccgcccuacccggggaugaaccgcaccgacgacaugauggugcccgaccagcgcaucaaccacgagucccaguggcccagccacgugucccagcggcagcccuacaugagcuccagcgccuccaugcagccgaucacccggccgccccagcccagcuaccagacgccgcccucccugcccaaccacaucagccgggcccccuccccggccagcuuccagcgcucccuggagaaccggaugagccccuccaagagccccuuccucccguccaugaagaugcagaaggucaugcccaccgugcccaccagccaggugaccggcccgccgccccagcccccgcccauccgccgggagaucacguucccgcccggcuccgucgaggcgagccagcccgugcugaagcagcgccggaagaucaccagcaaggacaucgugacccccgaggccuggcgcgucaugaugucccugaaguccgggcuccuggccgaguccaccugggcccuggacacgaucaacauccuccuguacgacgacagcaccguggccaccuucaaccugucccagcucagcggcuuccuggagcugcucguggaguacuuccggaagugccugaucgacaucuucgggauccugauggaguacgaggucggcgaccccucccagaaggcgcucgaccacaacgccgcccgcaaggacgacagccagucccuggccgacgacagcggcaaggaggaggaggacgcggagugcaucgacgacgacgaggaggacgaggaggacgaggaggaggacuccgagaagaccgagagcgacgagaaguccagcaucgcccugacggcccccgacgccgccgcggaccccaaggagaagcccaagcaggccuccaaguucgacaagcuccccaucaagaucgugaagaagaacaaccuguucguggucgaccggagcgacaagcuggggcgcgugcaggaguucaacuccggccuccugcacuggcagcucgggggcggggacaccaccgagcacauccagacccacuucgagagcaagauggagaucccgccccggcgccggcccccgccgccccuguccagcgccggccgcaagaaggagcaggagggcaagggggacagcgaggagcagcaggagaaguccaucaucgccacgaucgacgacgugcugagcgcccggccgggcgcgcugcccgaggacgccaaccccgggccccagaccgaguccagcaaguucccguucggcauccagcaggccaagucccaccgcaacaucaagcuccuggaggacgagccccggagccgcgacgagacgccccugugcaccaucgcccacuggcaggacucccucgccaagcgcugcaucugcgucagcaacaucgugcggucccugagcuucgugccggggaacgacgcggagauguccaagcaccccggccugguccucauccugggcaagcugauccuccugcaccacgagcaccccgagcgcaagcgggcgccccagacguacgagaaggaggaggacgaggacaaggggguggccugcagcaaggacgagugguggugggacugccuggaggugcuccgcgacaacacccuggucacccuggccaacaucuccggccagcucgaccugagcgcguacaccgaguccaucugccugccgauccucgacgggcugcugcacuggauggugugccccagcgccgaggcccaggaccccuuccccacggugggcccgaacuccguccucagcccccagcggcuggugcuggagacccucugcaagcuguccauccaggacaacaacguggaccugauccucgccacgccgcccuucagccgccaggagaaguucuacgccacccugguccgguacgugggggaccgcaagaacccggugugccgggagaugagcauggcgcugcucuccaaccuggcccagggcgacgcccuggccgcccgcgcgaucgccguccagaagggcagcaucgggaaccucaucuccuuccuggaggacggcgugacgauggcccaguaccagcagagccagcacaaccugaugcacaugcagccgccgccccuggagccgcccuccguggacaugaugugccgggccgccaaggcgcugcuggccauggcccgcgucgacgagaaccggagcgaguuccuccugcacgaggggcgccugcucgacaucuccaucagcgccgugcugaacucccugguggcgagcgucaucugcgacguccucuuccagaucggccagcuguga

SEQ ID NO: 26866 - RNA, 5508 nt, Artificial Sequence
  derived and/or modified sequence opt1 from ARID2__Homo_sapiens__NP_689854
auggccaacuccaccggcaaggcgccgcccgacgagcgccggaaggggcuggcguuccucgacgagcugcgccaguuccaccacucccggggcucccccuucaagaagauccccgccgugggcgggaaggagcuggaccugcacgggcuguacacccgcgugaccacccugggcggcuucgccaagguguccgagaagaaccaguggggcgagaucguggaggaguucaacuucccccggagcugcuccaacgccgccuucgcgcucaagcaguacuaccugcgcuaccuggagaaguacgagaaggugcaccacuucggcgaggacgacgacgaggugccgcccgggaaccccaagccccagcuccccaucggcgccauccccagcuccuacaacuaccagcagcacagcguguccgacuaccugcggcagagcuacgggcuguccauggacuucaacagccccaacgacuacaacaagcucgugcugucccugcucagcggccugcccaacgagguggacuucgccaucaacgugugcacccugcucuccaacgagagcaagcacgucaugcagcuggagaaggaccccaagaucaucacccugcuccuggccaacgcgggcguguucgacgacacgcugggguccuucagcaccguguucggcgaggaguggaaggagaagaccgaccgcgacuucgucaaguucuggaaggacaucguggacgacaacgaggugcgggaccucaucuccgaccgcaacaagagccacgaggggaccagcggcgaguggaucugggagucccuguuccacccgccccggaagcugggcaucaacgacaucgaggggcagcgcguccuccagaucgccgugauccugcggaaccugagcuucgaggagggcaacgugaagcuccuggccgccaaccgcacgugccugcgguuccuccugcuguccgcccacagccacuucaucucccuccgccagcuggggcuggacacccucggcaacaucgccgccgagcugcugcucgaccccgucgacuucaagaccacccaccugauguuccacacggugaccaagugccugaugagccgggaccgcuuccucaagaugcgggggauggagauccugggcaaccugugcaaggccgaggacaacggcgugcucaucugcgaguacgucgaccaggacuccuaccgcgagaucaucugccaccugacccugcccgacgugcugcucgugaucagcacccuggagguccuguacaugcucacggagaugggggacguggccugcaccaagaucgccaaggucgagaaguccaucgacaugcuggugugccuggugagcauggacauccagauguucggccccgacgcccucgccgccgucaagcugaucgagcaccccuccagcucccaccagaugcugagcgagauccggccccaggccaucgagcagguccagacccagacccacguggccuccgcccccgccagccgcgccgucguggcccagcacguggcgccgccgcccgggaucgucgagaucgacuccgagaaguucgcgugccaguggcucaacgcccacuucgaggugaaccccgacugcagcgugucccgcgccgagauguacagcgaguaccugagcacgugcuccaagcuggcccggggcgggauccucaccagcaccggcuucuacaagugccugcgcaccgucuuccccaaccacacggugaagcggguggaggacuccagcuccaacggccaggcgcacauccacgucgugggggugaagcgccgggccaucccccugcccauccagauguacuaccagcagcagcccgucagcaccuccguggugcgcgucgacagcgugcccgacgugucccccgcccccagccccgccggcaucccccacgggucccagaccaucggcaaccacuuccagcggacccccgucgccaaccagagcuccaaccucacggcgacccagaugagcuuccccgugcagggggugcacaccgucgcccagaccgugucccgcaucccccagaaccccagcccccacacgcaccagcagcagaacgcccccgugaccgucauccaguccaaggcccccauccccugcgagguggugaaggccaccgucauccagaacagcaucccccagaccggcgugccggugagcaucgcggucggcggcgggccgccccaguccagcguggugcagaaccacuccacggggccccagccggucaccguggugaacagccagacccugcugcaccaccccuccgucaucccccagcagagcccccuccacaccguggugccggggcagauccccuccggcacccccgucacggugauccagcaggccgugccccagagccacauguucgggcggguccagaacaucccggccugcaccuccaccgugagccagggccagcagcugaucaccacgagcccccagcccgugcagaccagcucccagcagaccagcgccgggucccagagccaggacaccgucaucaucgccccgccccaguacgugacgaccuccgcgagcaacaucgucuccgccaccagcgugcagaacuuccagguggccaccggccagauggucacgaucgccggggugcccagcccccaggcgucccgcgugggcuuccagaacaucgccccgaagccccugcccagccagcaggucuccagcaccguggugcagcagcccauccagcagccgcagcagcccacccagcaguccgucgugaucgugagccagcccgcccagcagggccagaccuacgcccccgccauccaccagaucguccucgcgaacccggccgcccugcccgccgggcagacggugcagcugaccggccagcccaacaucacccccuccagcuccccgagccccgugcccgccaccaacaaccagguccccacggcgauguccagcuccagcaccccgcagucccaggggccgccgcccaccgugagccagaugcucuccgugaagcggcagcagcagcagcagcacagcccggcgccgccgccccagcagguccagguccaggugcagcagccgcagcagguccagaugcagguccagccccagcaguccaacgccggcguggggcagcccgccagcggcgagagcucccugaucaagcagcugcuccugccgaagcgcggccccagcacccccgggggcaagcugauccuccccgccccgcagaucccgccgcccaacaacgcgcgggccccgagcccccaggucguguaccagguggccagcaaccaggccgcgggguucggcguccaggggcagacgcccgcccagcagcugcuggugggccagcagaacgugcagcucguccccuccgccaugccgcccagcggcggggugcagaccgugcccaucuccaaccugcagauccugcccggcccgcucaucagcaacucccccgccaccaucuuccaggggaccagcggcaaccaggucacgaucaccguggugcccaacaccuccuucgcccccgcgaccgucagccaggggaacgccacgcagcugaucgccccggccggcaucaccauguccggcacccagaccggggugggccugcccgugcagacgcuccccgccacccaggcgagccccgccgggcaguccagcugcaccaccgccaccccgcccuucaagggcgacaagaucaucugccagaaggaggaggaggccaaggaggccacgggccugcacguccacgagcgcaagaucgaggugauggagaaccccuccugccggcgcggggcgaccaacaccagcaacggcgacaccaaggagaacgagaugcacguggggucccugcucaacggccggaaguacagcgacagcucccugcccccgagcaacuccgggaagauccagagcgagacgaaccagugcucccugaucagcaacggccccucccucgagcugggcgagaacggggccagcggcaagcagaacuccgagcagaucgacaugcaggacaucaagagcgaccugcgcaagccccucgucaacgggaucugcgacuucgacaagggcgacgggucccaccugagcaagaacaucccgaaccacaagaccuccaaccacgugggcaacggcgagaucagccccauggagccccaggggacccuggacaucacccagcaggacacggccaagggcgaccagcucgagcggaucuccaacgggcccgugcugacccugggcgggagcuccgucagcuccauccaggaggccagcaacgccgcgacccagcaguucagcggcaccgaccuccugaacggcccgcuggccuccagccucaacuccgacgugccccagcagcgccccagcguggucgugagcccccacagcacgaccuccgugauccaggggcaccagaucaucgccgucccggacagcggcuccaaggugagccacucccccgcccugagcuccgacguccgcagcaccaacgggaccgcggagugcaagacggugaagcggcccgccgaggacaccgaccgcgagaccguggccggcauccccaacaaggucggcgugcggaucgugaccaucuccgacccgaacaacgccgggugcagcgccacgauggucgcggugcccgccggcgccgaccccuccaccguggccaaggucgccaucgagagcgcggugcagcagaagcagcagcacccgcccaccuacgugcagaacgucgugccccagaacacccccaugccgcccucccccgccgugcagguccaggggcagcccaacagcagccagcccucccccuucagcggcuccagccagcccggggaccccaugcgcaagccgggccagaacuucaugugccuguggcaguccugcaagaagugguuccagacgcccagccagguguucuaccacgccgccaccgagcacggcgggaaggacguguaccccggccagugccucugggaggggugcgagcccuuccagcggcagcgcuucuccuucaucacccaccuccaggacaagcacugcagcaaggacgcccugcucgcgggccugaagcaggacgagccggggcaggccggcucccagaaguccuccaccaagcagcccacggucggcgggaccagcuccacgccccgggcccagaaggccaucgugaaccaccccagcgcggcccugauggcccuccgccggggcucccgcaaccugguguuccgggacuucaccgacgagaaggaggggccgaucacgaagcacauccgccugaccgccgcccucauccugaagaacaucggcaaguacagcgagugcgggcggcgccugcucaagcggcacgagaacaaccuguccguccuggcgaucagcaacauggaggccagcuccacccucgccaagugccuguacgagcugaacuucaccgugcagagcaaggagcaggagaaggacuccgagaugcuccaguga

SEQ ID NO: 26867 - RNA, 1782 nt, Artificial Sequence
  derived and/or modified sequence opt1 from ARID3A__Homo_sapiens__NP_005215
augaagcugcaggccgugauggagacccuccugcagcgccagcagcgggcccgccaggagcuggaggcgcggcagcagcugcccccggacccgcccgccgcgcccccgggccgcgcccgggccgcccccgacgaggaccgcgagcccgagagcgcccggaugcagcgcgcccagauggccgcgcuggccgccaugcgggccgccgcggccgggcugggccaccccgccucccccgggggcagcgaggacgggccgcccggcuccgaggaggaggacgccgcccgcgagggcacccccgggagcccgggccgggggcgcgagggccccggggaggagcacuucgaggacauggcguccgacgaggacaugaagcccaagugggaggaggaggagauggaggaggaccucggcgaggacgaggaggaggaggaggaggacuacgaggacgaggaggaggaggaggacgaggagggccuggggcccccgggccccgccagccuggggacgaccgcccucuucccccggaaggcccagcccccgcaggccuuccgcggcgacggcgucccccgggugcucgggggccaggagcgccccgggcccggcccggcgcaccccgggggcgccgcccacguggcgccccagcugcagcccccggaccacggcgacuggaccuacgaggagcaguucaagcagcucuacgagcuggacggggaccccaagcggaaggaguuccuggacgaccucuucuccuucaugcagaagcgcggcacccccgucaaccggaucccgaucauggccaagcagguccuggaccuguucaugcucuacgugcuggugacggagaagggcgggcugguggaggugaucaacaagaagcucuggcgcgagaucaccaaggggcugaaccugcccaccagcaucaccuccgccgccuucacgcuccggacccaguacaugaaguaccuguaccccuacgagugcgagaagcgcggccugagcaaccccaacgagcuccaggccgccaucgacuccaaccgccgggagggccgccggcagagcuucgggggcucccuguucgcguacagccccgggggcgcccacgggaugcuguccagccccaagcuccccgucuccagccugggccuggccgccuccaccaacggcagcagcaucacccccgccccgaagaucaagaaggaggaggacuccgcgauccccaucacggugcccgggcgccuccccgugagccuggccggccacccggucguggccgcccaggccgcggccgugcaggccgccgccgcgcaggccgccgucgccgcgcaggccgccgcccuggagcagcuccgggagaagcuggaguccgccgagccgcccgagaagaagauggcgcugguggccgacgagcagcagcgccucaugcagcgggcccugcagcagaacuuccuggccauggccgcgcagcuccccaugagcauccgcaucaacucccaggccagcgagucccggcaggacagcgccgugaaccugaccgggaccaacggcuccaacagcaucuccaugagcgucgagaucaacggcaucauguacaccggggugcuguucgcccagccgcccgcccccacgcccaccuccgcgcccaacaagggcgggggcgggggcggcgggagcuccagcaacgccggcgggcgcggcgggaacaccggcaccuccggcgggcaggccggccccgccgggcucagcacgcccuccaccagcaccagcaacaacucccugcccuga

SEQ ID NO: 26868 - RNA, 1683 nt, Artificial Sequence
  derived and/or modified sequence opt1 from ARID3B__Homo_sapiens__NP_006456
auggagccccugcagcagcagcagcagcagcagcagcagcagcagaagcagccgcaccucgcgccccugcagauggacgcccgcgagaagcagggccagcagaugcgggaggcccaguuccuguacgcccagaagcucgugacccagcccacccugcugagcgccacggccgggcgccccuccggcagcaccccgcucgggccccuggcccgggucccgcccaccgccgccguggcccagguguucgagcgcggcaacaugaacuccgagcccgaggaggaggacgggggccuggaggacgaggacggcgacgacgaggucgccgagguggcggagaaggagacccaggccgccagcaaguacuuccacgugcagaaggucgcccggcaggacccccgcguggcccccauguccaaccuccugcccgcgccggggcugccgccccacggccagcaggccaaggaggaccacacgaaggacgccagcaaggccucccccagcguguccaccgccgggcagcccaacuggaaccucgacgagcagcugaagcagaacggcgggcuggcguggagcgacgacgccgacggcggccgggggcgcgagaucucccgggacuucgccaagcucuacgagcuggacggcgaccccgagcgcaaggaguuccuggacgaccucuucgucuucaugcagaagcgggggacccccaucaaccgcauccccaucauggccaagcagauccuggaccuguacaugcucuacaagcuggugaccgagaagggcggccugguggagaucaucaacaagaagaucuggcgggagaucacgaaggggcucaaccugccgaccagcaucaccuccgccgcguucacccugcgcacgcaguacaugaaguaccucuacgccuacgagugcgagaagaaggcccugagcucccccgccgagcugcaggccgcgaucgacggcaaccggcgcgaggggcggcgccccagcuacuccagcucccucuucggcuacagccccgccgccgccaccgcggccgccgccgccggggcgccggcccugcugagcccgcccaagauccgguuccccauccucggccugggcuccagcuccgggaccaacaccagcagcccccgcaucucccccgccacgacccugcggaagggcgacggggcccccgucaccaccgugccggugcccaaccgccucgccguccccgugacgcuggcgucccagcaggccggcacccgcaccgccgcccuggagcagcuccgggagcgccuggagagcggggagcccgccgagaagaaggcgucccggcugagcgaggaggagcagcgccucgugcagcaggccuuccagcggaacuucuucuccauggcccgccagcugccgaugaagauccggaucaacggccgcgaggaccgggccgaggcgagcgccgccgcccugaaccucaccacguccagcaucggcuccaucaacaugagcgucgacaucgacgggaccaccuacgccggcgugcuguucgcgcagaagcccgugguccaccugaucaccggguccgcgccccagagccucggcuccagcgccagcuccagcuccagcucccacugcagccccuccccgacgagcucccgcgggacccccagcgccgagcccuccaccagcuggucccuguga

SEQ ID NO: 26869 - RNA, 3774 nt, Artificial Sequence
  derived and/or modified sequence opt1 from ARID4A__Homo_sapiens__NP_002883
augaaggccgccgacgagcccgcguaccugaccgugggcaccgacgucagcgccaaguaccgcggggccuucugcgaggccaagaucaagacggugaagcggcucgugaaggucaaggugcugcugaagcaggacaacaccacccagcucgugcaggacgaccaggucaagggcccccugcgcgugggggccaucguggagacccggacguccgacggcagcuuccaggaggcgaucaucuccaagcugaccgacgccagcugguacaccgucguguucgacgacggggacgagcgcacccuccggcgcacgucccugugccugaagggcgagcggcacuucgccgagagcgagacccucgaccagcugccccugaccaaccccgagcacuucggcacccccgugaucgccaagaagacgaaccgcgggcggcgcuccagccucccggucaccgaggacgagaaggaggaggaguccagcgaggaggaggacgaggacaagcggcgccugaacgacgagcugcucggcaaggugguguccgucgugagcgcgaccgagcggaccgagugguaccccgcccuggugaucucccccagcugcaacgacgacaucacggucaagaaggaccagugccuggugcgcuccuucaucgacagcaaguucuacuccaucgcccggaaggacaucaaggagguggacauccucaaccugcccgagagcgagcuguccaccaagccggggcuccagaaggccagcaucuuccugaagacccgcgucgugcccgacaacuggaagauggacaucagcgagauccuggaguccagcuccagcgacgacgaggacggccccgccgaggagaacgacgaggagaaggagaaggaggcgaagaagaccgaggaggaggugcccgaggaggagcucgacccggaggagcgggacaacuuccugcagcagcuguacaaguucauggaggaccgcgggacgcccaucaacaagccgcccguccucggcuacaaggaccugaaccuguucaagcuguuccggcugguguaccaccagggcgggugcgacaacaucgacuccggcgccgucuggaagcagaucuacauggaccuggggauccccauccucaacagcgccgccuccuacaacgugaagaccgccuaccgcaaguaccuguacggcuucgaggaguacugccggagcgcgaacauccaguuccgcaccgugcaccaccacgagcccaaggucaaggaggagaagaaggaccucgaggaguccauggaggaggcccucaagcuggaccaggagaugccccugaccgaggucaagagcgagcccgaggagaacaucgacuccaacagcgaguccgagcgcgaggagaucgagcucaagagcccgcggggccgccggcgcaucgcccgggacgugaacuccaucaagaaggagaucgaggaggagaagacggaggacaagcugaaggacaacgacaccgagaacaaggacguggacgacgacuacgagaccgccgagaagaaggagaacgagcugcuccuggggcgcaagaacacccccaagcagaaggagaagaagaucaagaagcaggaggacagcgacaaggacuccgacgaggaggaggagaagucccaggagcgggaggagacggagagcaagugcgacagcgagggcgaggaggacgaggaggacauggagcccugccugaccgggaccaaggugaaggugaaguacggccgcgggaagacccagaagaucuacgaggccagcaucaaguccacggagaucgacgacggcgagguccucuaccuggugcacuacuacggcuggaacgugcgguacgacgagugggucaaggcggaccgcaucaucuggccccuggacaagggcgggccgaagaagaagcagaagaagaaggccaagaacaaggaggacagcgagaaggacgagaagcgggacgaggagcgccagaaguccaagcgggggcgcccgccccucaagagcacccuguccagcaacaugcccuacggccuguccaagaccgccaacagcgaggggaaguccgacagcugcuccagcgacuccgagaccgaggacgcccuggagaagaaccucaucaacgaggagcugagccugaaggacgagcucgagaagaacgagaaccugaacgacgacaagcuggacgaggagaaccccaagaucuccgcccacauccucaaggagaacgaccggacgcagaugcagccccuggagacccugaagcucgaggugggcgagaacgagcagaucgugcagaucuucggcaacaagauggagaagaccgaggaggucaagaaggaggcggagaagucccccaaggggaagggccgccggagcaagaccaaggaccugagccuggagaucaucaagaucagcuccuucgggcagaacgaggccggcagcgagccgcacaucgaggcccacucccucgagcugagcucccuggacaacaagaacuucagcuccgccaccgaggacgagaucgaccagugcgugaaggagaagaagcucaagcgcaagauccuggggcagagcucccccgagaagaagauccggaucgagaacggcauggagaugacgaacaccgugagccaggagcgcaccuccgacugcaucggcagcgaggggaugaagaaccugaacuucgagcagcacuucgagcgcgagaacgagggcaugcccucccucaucgcggagagcaaccagugcauccagcagcugaccuccgagcgguucgacagccccgccgaggagacggucaacaucccgcugaaggaggacgaggacgccaugccccucaucgggcccgagacccuggugugccacgagguggaccuggacgaccucgacgagaaggacaagaccuccaucgaggacgucgccguggagagcuccgagagcaacagccugguguccaucccgcccgcccugccgcccgucgugcagcacaacuucagcguggcgagcccccucacccugucccaggacgagucccgcagcgucaaguccgagagcgacaucacgaucgagguggacuccaucgccgaggagagccaggagggccugugcgagcgggaguccgccaacggcuucgagaccaacguggccagcgggaccugcuccaucaucguccaggagcgcgagagccgggagaagggccagaagcgccccuccgacgggaacagcggccucauggccaagaagcagaagcggacccccaagcgcacguccgcggccgccaagaacgagaagaacgggaccggccagagcuccgacagcgaggaccugcccgugcuggacaacagcuccaagugcacccccgugaagcaccucaacgucagcaagccgcagaagcuggcccggucccccgcccgcaucagcccccacaucaaggacggcgagaaggacaagcaccgggagaagcaccccaacuccagcccgcgcaccuacaagugguccuuccagcugaacgagcucgacaacaugaacagcacggagcggaucuccuuccugcaggagaagcugcaggagauccgcaaguacuacaugagccucaaguccgagguggcgaccaucgaccggcgccggaagcgccugaagaagaaggaccgggaggugagccacgccggggccuccaugagcuccgccagcuccgacaccggcaugagccccuccagcagcuccccgccccagaacguccuggcgguggagugccgcuga

SEQ ID NO: 26870 - RNA, 3939 nt, Artificial Sequence
  derived and/or modified sequence opt1 from ARID4B__Homo_sapiens__NP_057458
augaaggcccuggacgagcccccguaccucaccgugggcaccgacgucagcgccaaguaccgcggggcguucugcgaggccaagaucaagacggccaagcggcuggugaaggugaaggucaccuuccgccacgacuccagcaccguggaggugcaggacgaccacaucaagggcccccugaaggucggggccaucguggaggugaagaaccucgacggcgccuaccaggaggcggucaucaacaagcugaccgacgccuccugguacacggugguguucgacgacggggacgagaagacccugcggcgcagcucccucugccugaagggcgagcggcacuucgccgagagcgagacccuggaccagcucccccugaccaaccccgagcacuucggcacgccggucaucgggaagaagaccaaccgcggccggcgcuccaaccacauccccgaggaggagagcuccagcuccagcuccgacgaggacgaggacgaccggaagcagaucgacgagcugcucgggaagguggugugcgucgacuacaucagccuggacaagaagaaggcccugugguuccccgcgcucguggugugccccgacugcuccgacgagaucgccgucaagaaggacaacauccuggugcgcagcuucaaggacggcaaguucaccuccgugccgcggaaggacguccacgagaucaccagcgacacggcccccaagcccgacgccgugcugaagcaggccuucgagcaggcgcucgaguuccacaagucccgcaccauccccgccaacuggaagaccgagcugaaggaggacagcagcuccagcgaggccgaggaggaggaggaggaggaggacgacgagaaggagaaggaggacaacuccagcgaggaggaggaggagaucgagccguuccccgaggagcgggagaacuuccugcagcagcucuacaaguucauggaggaccgcgggacccccaucaacaagcggcccgugcugggcuaccgcaaccugaaccucuucaagcuguuccggcugguccacaagcucggcggguucgacaacaucgaguccggcgccguguggaagcaggucuaccaggaccuggggaucccggugcugaacagcgccgcgggcuacaacgugaagugcgccuacaagaaguaccucuacggcuucgaggaguacugccgcuccgccaacaucgaguuccagauggcccugcccgagaaggucgugaacaagcagugcaaggagugcgagaacgugaaggagaucaaggucaaggaggagaacgagacggagaucaaggagaucaagauggaggaggagcggaacaucaucccccgcgaggagaagcccaucgaggacgagaucgagcggaaggagaacaucaagccgagccugggguccaagaagaaccuccuggagagcauccccacccacuccgaccaggagaaggaggugaacaucaagaagcccgaggacaacgagaaccuggacgacaaggacgacgacaccacccgcguggacgagagccucaacaucaaggucgaggccgaggaggagaaggcgaaguccggcgacgagacgaacaaggaggaggacgaggacgacgaggaggccgaggaggaggaggaggaggaggaggaggaggaggacgaggacgacgacgacaacaacgaggaggaggaguucgagugcuacccgcccgggaugaagguccaggugcgcuacggccgggggaagaaccagaagauguacgaggccagcaucaaggacuccgacguggagggcggcgaggugcuguaccuggugcacuacugcggguggaacguccgcuacgacgaguggaucaaggccgacaagaucgugcggcccgccgacaagaacgugcccaagaucaagcaccgcaagaagaucaagaacaagcucgacaaggagaaggacaaggacgagaaguacagccccaagaacugcaagcugcggcgccuguccaagccgcccuuccagaccaaccccagcccggagauggucuccaagcucgaccugaccgacgcgaagaacagcgacaccgcccacaucaagagcaucgagaucacguccauccugaacggccuccaggccagcgaguccagcgccgaggacuccgagcaggaggacgagcgcggggcgcaggacauggacaacaacggcaaggaggagagcaagaucgaccaccugaccaacaaccggaacgaccugaucuccaaggaggagcagaacagcuccagccuccuggaggagaacaaggugcacgccgaccuggugaucuccaagcccgucagcaagucccccgagcggcugcgcaaggacaucgaggugcucagcgaggacaccgacuacgaggaggacgaggugaccaagaagcggaaggacgucaagaaggacacgaccgacaaguccagcaagccccagaucaagcgcgggaagcggcgcuacugcaacaccgaggagugccugaagaccggcuccccgggcaagaaggaggagaaggccaagaacaaggagagccugugcauggagaacagcuccaacagcuccagcgacgaggacgaggaggagacgaaggccaagaugacccccaccaagaaguacaacgggcucgaggagaagcggaagucccugcgcaccacgggcuucuacagcggguucuccgagguggccgagaagcggaucaagcugcucaacaacagcgacgagcgccugcagaacucccgggcgaaggaccgcaaggacguguggagcuccauccagggccaguggcccaagaagacccugaaggagcuguucagcgacuccgacaccgaggccgccgccagcccgccccaccccgcccccgaggagggggucgcggaggagucccugcagaccguggccgaggaggagagcugcucccccagcguggagcuggagaagccgccgcccgucaacguggacuccaagcccaucgaggagaagaccguggaggucaacgaccgcaaggccgaguuccccagcagcggcuccaacagcgugcucaacacgccgcccaccacccccgagucccccagcuccgugaccgucacggagggcagccggcagcaguccagcgugaccguguccgagccccuggcccccaaccaggaggagguccgcagcaucaaguccgagaccgacagcaccaucgagguggacuccguggccggggagcugcaggaccuccagagcgagggcaacuccagccccgcgggguucgacgccuccgucagcuccagcagcuccaaccagccggagcccgagcaccccgagaaggccugcacgggccagaagcgggugaaggacgcccagggcgggggcagcuccagcaagaagcagaagcgcucccacaaggcgaccguggucaacaacaagaagaaggggaagggcaccaacagcuccgacagcgaggagcuguccgccggggagagcaucaccaagucccagccggucaagagcguguccacgggcaugaagucccacagcaccaagagccccgcccggacccagucccccggcaagugcgggaagaacggcgacaaggaccccgaccugaaggagccgagcaaccgccuccccaagguguacaagugguccuuccagaugagcgaccuggagaacaugaccagcgccgagcggaucacgauccugcaggagaagcuccaggagauccgcaagcacuaccugucccucaagagcgagguggccuccaucgaccggcgccggaagcgccucaagaagaaggagcgggagagcgcggccaccuccagcuccagcuccagccccuccagcuccagcaucaccgccgccgugaugcugacccuggccgagcccuccaugagcuccgcgagccagaacgggauguccgucgagugccgcuga

SEQ ID NO: 26871 - RNA, 2838 nt, Artificial Sequence
  derived and/or modified sequence opt1 from ARID5B__Homo_sapiens__NP_001231567
auggcccccaaccugaagggccgcccgcggaagaagaagcccugcccccagcgccgggacagcuucuccggggugaaggacagcaacaacaacuccgacggcaaggccgucgcgaaggugaagugcgaggcccgcagcgcccucaccaagcccaagaacaaccacaacugcaagaagguguccaacgaggagaagccgaaggucgccaucggggaggagugccgggccgacgagcaggcguuccugguggcccuguacaaguacaugaaggagcgcaagacccccaucgagcggauccccuaccucggcuucaagcagaucaaccuguggacgauguuccaggccgcccagaagcucgggggcuacgagaccaucaccgcgcgccggcaguggaagcacaucuacgacgagcugggcgggaaccccggcagcaccuccgccgccacgugcacccgccggcacuacgagcgccugauccugccguacgagcgguucaucaagggggaggaggacaagccccucccgcccaucaagccccgcaagcaggagaacagcucccaggagaacgagaacaagaccaaggugagcggcaccaagcggaucaagcacgagauccccaaguccaagaaggagaaggagaacgcccccaagccccaggacgccgcggaggucagcuccgagcaggagaaggagcaggagacgcugaucagccagaaguccaucccggagccccugcccgccgccgacaugaagaagaagaucgagggguaccaggaguucagcgccaagccccucgccucccgcguggacccggagaaggacaacgagaccgaccagggcagcaacuccgagaagguggcggaggaggccggcgagaaggggcccaccccgccccugcccagcgcgccccuggcccccgagaaggacagcgcccucguccccggcgccuccaagcagccgcugaccagccccuccgcccugguggacagcaagcaggaguccaagcucugcugcuucacggagagccccgaguccgagccgcaggaggccagcuuccccuccuuccccaccacccagcccccgcuggccaaccagaacgagaccgaggacgacaagcugcccgccauggcggacuacaucgccaacugcacggugaaggucgaccagcucgggagcgacgacauccacaacgcccugaagcagacccccaaggugcuggugguccaguccuucgacauguucaaggacaaggaccucaccggccccaugaacgagaaccacggccugaacuacaccccgcugcucuacagccgggggaaccccggcaucaugagcccccuggccaagaagaagcugcucucccagguguccggggcgagccuguccagcuccuaccccuacggcagcccgccgccccugaucagcaagaagaagcucaucgcccgcgacgaccugugcuccagccugucccagacgcaccacgggcagagcaccgaccacauggccgugucccggcccagcgucauccagcacgugcaguccuuccgcagcaagcccuccgaggagcggaagaccaucaacgacaucuucaagcacgagaagcucagccgcuccgacccccaccgcugcagcuucuccaagcaccaccugaacccccuggccgacagcuacgugcucaagcaggagauccaggagggcaaggacaagcugcuggagaagcgggcccucccccacucccacaugccgagcuuccuggcggacuucuacuccagcccccaccuccacagccuguaccgccacaccgagcaccaccuccacaacgagcagacguccaaguaccccagccgggacauguaccgcgaguccgagaacagcuccuuccccagccaccggcaccaggagaagcugcacgucaacuaccugaccucccugcaccuccaggacaagaaguccgccgccgccgaggccccgaccgacgaccagcccaccgaccugagccugcccaagaacccgcacaagcccacgggcaaggugcuggggcuggcgcacagcaccaccggcccccaggaguccaaggggaucagccaguuccaggugcucggcucccagagccgcgacugccaccccaaggccugccgggucuccccgaugaccaugagcgggcccaagaaguaccccgagucccugagccgcuccggcaagccccaccacgugcggcuggagaacuuccgcaagauggagggcaugguccacccgauccuccaccggaagaugagcccccagaacaucggggccgcccgccccaucaagcggagccuggaggaccuggaccucgugaucgccggcaagaaggcgcgcgccgugagcccccuggacccguccaaggaggucuccgggaaggagaaggccagcgagcaggaguccgagggcagcaaggccgcgcacgggggccacuccggcgggggcagcgaggggcacaagcugccccucuccagccccaucuuccccggccuguacuccggcagccugugcaacuccgggcucaacagccggcugccggccggcuacucccacagccugcaguaccucaagaaccagacggugcugagcccccugaugcagccccucgccuuccacucccuggugaugcagcgcgggaucuucaccucccccaccaacagccagcagcuguaccggcaccucgccgccgcgaccccggucggcagcuccuacggggaccugcugcacaacagcaucuacccccucgccgccaucaacccccaggccgccuuccccuccagccagcuguccagcgugcacccguccacgaagcuguga

SEQ ID NO: 26872 - RNA, 1674 nt, Artificial Sequence
  derived and/or modified sequence opt1 from ARIH1__Homo_sapiens__NP_005735
auggacagcgacgagggcuacaacuacgaguucgacgaggacgaggagugcuccgaggaggacagcggggccgaggaggaggaggacgaggacgacgacgagcccgacgacgacacccuggaccucggcgagguggagcuggucgagccggggcugggcgucgggggcgagcgcgacggccuccugugcggggagaccggcgggggcgggggcuccgcccugggccccgggggcgggggcggcgggggcgggggcgggggcggcgggggccccgggcacgagcaggaggaggacuaccgguacgaggugcucacggcggagcagauccugcagcacaugguggagugcauccgcgaggugaacgaggugauccagaaccccgccaccaucacccggauccugcucagccacuucaacugggacaaggagaagcugauggagcgcuacuucgacggcaaccuggagaagcuguucgccgagugccacgucaucaacccguccaagaagucccggacccgccagaugaacacgcggagcagcgcccaggacaugcccugccagaucugcuaccucaacuaccccaacuccuacuucaccgggcuggagugcggccacaaguucugcaugcagugcuggagcgaguaccucaccaccaagaucauggaggagggcauggggcagacgaucuccugccccgcccacggcugcgacauccugguggacgacaacaccgugaugcgccugaucaccgacagcaaggucaagcucaaguaccagcaccugaucaccaacuccuucguggagugcaaccggcugcucaaguggugcccggcgcccgacugccaccacguggucaaggugcaguaccccgacgccaagcccgugcgcugcaagugcgggcggcaguucugcuucaacugcggcgagaacuggcacgacccggucaagugcaaguggcugaagaaguggaucaagaagugcgacgacgacagcgagacguccaacuggaucgccgccaacaccaaggagugccccaagugccacgugaccaucgagaaggacgggggcugcaaccacauggugugccgcaaccagaacugcaaggcggaguucugcugggucugccugggccccugggagccccacgggagcgccugguacaacugcaaccgguacaacgaggacgacgccaaggccgcccgcgacgcgcaggagcggucccgcgccgcccuccagcgguaccuguucuacugcaaccgcuacaugaaccacaugcagagccugcgguucgagcacaagcucuacgcccaggugaagcagaagauggaggagaugcagcagcacaacauguccuggaucgaggugcaguuccugaagaaggccgucgacgugcugugccagugccgcgcgacccucauguacacguacguguucgccuucuaccugaagaagaacaaccagagcaucaucuucgagaacaaccaggccgaccuggagaacgccaccgagguccucagcggcuaccuggagcgggacaucucccaggacagccugcaggacaucaagcagaaggugcaggacaaguaccgcuacugcgagucccgccggcgcguccuccugcagcacgugcacgagggguacgagaaggaccugugggaguacaucgaggacuga

SEQ ID NO: 26873 - RNA, 591 nt, Artificial Sequence
  derived and/or modified sequence opt1 from ARL11__Homo_sapiens__NP_612459
augggcagcgugaacucccgcgggcacaaggccgaggcccaggucgugaugaugggccuggacagcgcggggaagaccacccuccuguacaagcugaagggccaccagcucguggagacgcugcccaccgucggguucaacguggagccgcugaaggcccccggccacgugucccucacccugugggacgucggcgggcaggcgccccugcgggccagcuggaaggacuaccucgagggcaccgacauccugguguacgugcuggacuccacggacgaggcccgccuccccgagagcgccgccgagcugaccgagguccugaacgacccgaacauggccggggugcccuuccucgugcuggccaacaagcaggaggcgcccgacgcccugccccuccugaagauccggaaccgccugucccucgagcgguuccaggaccacugcugggagcugcgcggcugcagcgcccugaccggggagggccucccggaggcccugcagucccuguggagccuccugaagucccggagcugcaugugccugcaggcccgcgcgcacggcgccgagcgcggggacuccaagcggagcuga

SEQ ID NO: 26874 - RNA, 771 nt, Artificial Sequence
  derived and/or modified sequence opt1 from ARL13A__Homo_sapiens__NP_001155963
auguuccgccugcucagcuccugcugcagcugccugcggaccaccgaggagacgcgccggaacgugaccauccccaucaucggccugaacaacuccgggaagaccguccucguggaggccuuccagaagcugcugccgagcaagaccgaccacugcaugaaguccgagcucacgacccugcugcucgacgaguacgagcugagcaucuacgaccugaacggcgaccucaaggggcgcgaggccuggcccaacuacuacgcgcaggcccacggccugguguucguccuggacuccagcgacauccggcgcaugcaggaggugaagaucauccucacccaccuccuguccgacaagcggguggccgggaagcccauccugauccuggccaacaagcaggacaagaagaaggcccugaugcccugcgacaucaucgacuaccuccugcugaagaagcucgucaaggagaacaagugcccgugccgcguggagcccugcagcgcgauccggaaccuggagcgccggaaccaccagcccaucguggagggccugcgcuggcuccuggccgucaucgacacgugccagcugcccccgaccuccagcaucuccaucagcaagaacaacaccggcuccggggagcggugcagcucccacagcuucuccacccgcaccggcaugagcaaggagaagcggcagcaccucgagcagugcagcaucgaggccaagccccugaaguccauccugcagcccagcaaccaguccuacacgcacuga

SEQ ID NO: 26875 - RNA, 1287 nt, Artificial Sequence
  derived and/or modified sequence opt1 from ARL13B__Homo_sapiens__NP_001167621
auguucagccugauggccuccugcugcggcugguucaagcgcuggcgggagcccgugcgcaaggucacccuccugaugguggggcuggacaacgccggcaagaccgcgacggccaaggggauccagggcgaguaccccgaggacguggcccccaccgucggguucagcaagaucaaccuccggcagggcaaguucgaggugaccaucuucgaccugggcgggggcauccgcauccgggggaucuggaagaacuacuacgccgaguccuacggcgugaucuucgucguggacagcuccgacgaggagcgcauggaggagaccaaggaggccaugagcgagaugcugcggcacccccgcaucuccgggaagcccauccucgugcuggcgaacaagcaggacaaggagggcgcccugggcgaggccgacgucaucgagugccucagccuggagaagcuggugaacgagcacaagugccucugccagaucgagcccugcuccgccaucagcggguacggcaagaagaucgacaaguccaucaagaaggggcuguacuggcugcuccacgugaucgcgcgggacuucgacgcccugaacgagcgcauccagaaggagacgaccgagcagcgggcccuggaggagcaggagaagcaggagcgcgccgagcggguccgcaagcuccgggaggagcgcaagcagaacgagcaggagcaggccgagcuggacggcaccagcggccuggcggagcucgaccccgagcccaccaaccccuuccagccgaucgccuccgugaucaucgagaacgaggggaagcuggagcgggagaagaagaaccagaagauggagaaggacagcgacggcugccaccugaagcacaagauggagcacgagcagaucgagacgcagggccaggugaaccacaacgggcagaagaacaacgaguucgggcucgucgagaacuacaaggaggcccugacccagcagcugaagaacgaggacgagaccgaccgccccucccucgagagcgccaacggcaagaagaagaccaagaagcugcggaugaagcgcaaccaccggguggagccccugaacaucgacgacugcgcccccgaguccccgacgcccccgccgcccccgccgcccgugggcugggggacccccaaggucacccgccuccccaagcuggagccccugggcgagacccaccacaacgacuucuaccgcaagccccucccgccccuggcggugccccagcggcccaacagcgacgcccacgacgugaucuccuga

SEQ ID NO: 26876 - RNA, 783 nt, Artificial Sequence
  derived and/or modified sequence opt1 from ARL14EP__Homo_sapiens__NP_689529
augauggaccccugcagcgugggcguccagcugcgcaccaccaacgagugccacaagacguacuacacccggcacaccggguucaagacccuccaggagcuguccagcaacgacaugcugcuccugcagcugcgcacgggcaugacccucuccgggaacaacaccaucugcuuccaccacgugaagaucuacaucgaccgguucgaggaccugcagaaguccugcugcgacccguucaacauccacaagaagcuggccaagaagaaccuccacgugaucgaccuggacgacgccaccuuccugagcgcgaaguucggccgccagcucguccccggguggaagcugugccccaagugcacgcagaucaucaacggcagcguggacguggacaccgaggaccggcagaagcgcaagcccgaguccgacggccggaccgccaaggcccugcgcagccuccaguucaccaacccggggcggcagacggaguucgcccccgagaccggcaagcgcgagaagcggcgccugaccaagaacgccaccgcgggguccgaccggcaggucauccccgccaagagcaagguguacgacucccagggccugcucaucuucagcgggauggaccugugcgacugccuggacgaggacugccucggcugcuucuacgccugccccgccugcggcuccacgaagugcggggcggagugccgcugcgaccggaaguggcuguacgagcagaucgagaucgagggcggggagaucauccacaacaagcacgccggcuga

SEQ ID NO: 26877 - RNA, 579 nt, Artificial Sequence
  derived and/or modified sequence opt1 from ARL14__Homo_sapiens__NP_079323
augggcagccugggguccaagaacccccagaccaagcaggcccaggugcuccugcugggccucgacagcgccgggaaguccacccugcuguacaagcucaagcuggcgaaggacaucacgaccaucccgaccaucggcuucaacgucgagaugaucgagcuggagcgcaaccucagccugaccgugugggacgucgggggccaggagaagaugcggacgguguggggcugcuacugcgagaacaccgacgggcugguguacguggucgacuccaccgacaagcagcgccucgaggagagccagcggcaguucgagcacauccugaagaacgagcacaucaagaacgugcccgugguccugcucgccaacaagcaggacaugcccggcgcccugaccgccgaggacaucacgcgcauguucaaggugaagaagcugugcuccgaccggaacugguacgugcagcccugcugcgcccucaccggggagggccuggcgcagggguuccgcaagcugaccggcuucgucaagagccacaugaagucccggggcgacacccucgccuucuucaagcagaacuga

SEQ ID NO: 26878 - RNA, 615 nt, Artificial Sequence
  derived and/or modified sequence opt1 from ARL15__Homo_sapiens__NP_061960
augagcgaccugcgcaucaccgaggccuuccucuacauggacuaccugugcuuccgggcccugugcugcaaggggcccccgcccgcgcgccccgaguacgaccucgugugcaucggccugaccggcuccgggaagacgagccugcucuccaagcugugcagcgagucccccgacaacgucgugagcaccaccggcuucuccaucaaggccgugccguuccagaacgccauccugaacgucaaggagcucgggggcgccgacaacauccggaaguacuggagccgcuacuaccagggcucccagggggugaucuucgugcuggacagcgccuccagcgaggacgaccuggaggcggcccggaacgagcuccacuccgcccugcagcacccccagcugugcacccuccccuuccugauccuggccaaccaccaggacaagcccgcggcccgcagcguccaggagaucaagaaguacuucgagcucgagccgcuggcccggggcaagcgcuggauccugcagcccugcucccucgacgacauggacgcccugaaggacagcuucucccagcugaucaaccuccuggaggagaaggaccacgaggccgugcggauguga

SEQ ID NO: 26879 - RNA, 546 nt, Artificial Sequence
  derived and/or modified sequence opt1 from ARL1__Homo_sapiens__NP_001168
augggcggguucuucagcuccaucuucagcucccuguucggcacccgcgagaugcggauccucauccuggggcuggacggcgccgggaagaccacgauccucuaccgccugcaggucggcgagguggugaccaccauccccaccaucggcuucaacguggagacggucaccuacaagaaccugaaguuccaggugugggaccucgggggccagaccagcauccggccguacuggcgcugcuacuacuccaacaccgacgccgugaucuacgucguggacagcugcgaccgggaccgcaucgggaucuccaagagcgagcugguggcgaugcuggaggaggaggagcuccggaaggccauccuggucguguucgccaacaagcaggacauggagcaggccaugacguccagcgagauggccaacucccugggccuccccgcgcugaaggaccgcaaguggcagaucuucaagaccagcgccaccaaggggaccggccuggacgaggccauggaguggcucguggagacgcugaagucccggcaguga

SEQ ID NO: 26880 - RNA, 492 nt, Artificial Sequence
  derived and/or modified sequence opt1 from ARL2BP__Homo_sapiens__NP_036238
auggacgcccuggagggcgagagcuucgcccucuccuucagcuccgcgagcgacgccgaguucgacgccguggucggguaccuggaggacaucaucauggacgacgaguuccagcugcuccagcgcaacuucauggacaaguacuaccuggaguucgaggacaccgaggagaacaagcugaucuacacccccaucuucaacgaguacaucucccucguggagaaguacaucgaggagcagcugcugcagcggaucccggaguucaacauggccgccuucacgaccacccuccagcaccacaaggacgagguggcgggcgacaucuucgacaugcugcugaccuucacggacuuccucgccuucaaggagauguuccuggacuaccgcgccgagaaggaggggcggggccuggaccucagcuccgggcuggucgugaccagccugugcaaguccagcucccuccccgccagccagaacaaccugcgccacuga

SEQ ID NO: 26881 - RNA, 474 nt, Artificial Sequence
  derived and/or modified sequence opt1 from ARL2__Homo_sapiens__NP_001186674
augggccugcucaccauccugaagaagaugaagcagaaggagcgcgagcugcggcuccugaugcuggggcucgacaacgccggcaagaccacgauccugaagaaguucaacggggaggacaucgacaccaucagccccacccugggcuucaacaucaagacccucgagcaccgcggguucaagcugaacaucugggacgugggcggccagaagucccugcggagcuacuggcgcaacuacuucgaguccacggacgggcucaucugggucguggacagcgccgaccggcagcgcaugcaggacugccagcgggagcugcagucccugcucguggaggagguccuggagcuggacagcauccgcucccaccacuggugcauccagggcugcagcgcggugaccggggagaaccuccugccgggcaucgacuggcugcucgacgacaucuccagccggaucuucaccgccgacuga

SEQ ID NO: 26882 - RNA, 549 nt, Artificial Sequence
  derived and/or modified sequence opt1 from ARL3__Homo_sapiens__NP_004302
augggccugcucagcauccugcgcaagcugaaguccgcccccgaccaggaggugcggauccuccugcuggggcucgacaacgccggcaagaccacccugcugaagcagcucgcgagcgaggacaucucccacaucacgccgacccagggguucaacaucaagagcguccagucccagggcuucaagcugaacgugugggacaucgggggccagcgcaagauccggcccuacuggaagaacuacuucgagaacaccgacauccugaucuacgugaucgacagcgccgaccgcaagcgguucgaggagaccggccaggagcucgccgagcugcuggaggaggagaagcucuccugcguccccgugcugaucuucgccaacaagcaggaccugcucacggccgcgcccgccagcgagaucgccgaggggcugaaccugcacaccauccgcgaccggguguggcagauccaguccugcagcgcccucaccggcgaggggguccaggacggcaugaacugggugugcaagaacgugaacgcgaagaagaaguga

SEQ ID NO: 26883 - RNA, 603 nt, Artificial Sequence
  derived and/or modified sequence opt1 from ARL4A__Homo_sapiens__NP_001182325
augggcaacgggcugagcgaccagaccuccauccucagcaaccugcccuccuuccagagcuuccacaucgugauccugggccucgacugcgccgggaagaccacgguccuguaccgccugcaguucaacgaguucgugaacaccgugccgaccaagggcuucaacaccgagaagaucaaggucacgcucgggaacuccaagaccgugaccuuccacuucugggacgugggcggccaggagaagcugcggccccuguggaaguccuacacccgcugcacggacgggaucgucuucgugguggacagcgucgacguggagcggauggaggaggccaagaccgagcuccacaagaucacccgcaucagcgagaaccagggcgugcccguccugaucguggcgaacaagcaggaccugcggaacucccucagccuguccgagaucgagaagcugcucgccaugggggagcugagcuccagcacccccuggcaccuccagccgacgugcgccaucaucggcgacgggcugaaggagggccuggagaagcugcacgacaugaucaucaagcgccggaagaugcuccgccagcagaagaagaagcgguga

SEQ ID NO: 26884 - RNA, 606 nt, Artificial Sequence
  derived and/or modified sequence opt1 from ARL4C__Homo_sapiens__NP_001269360
augggcaacaucagcuccaacaucagcgccuuccagucccugcacaucgugaugcucgggcuggacagcgccggcaagaccaccguccuguaccgccucaaguucaacgaguucgugaacacggugcccaccaucggguucaacaccgagaagaucaagcuguccaacggcaccgcgaaggggaucagcugccacuucugggacgucggcggccaggagaagcugcggccgcucuggaaguccuacagccgcugcacggacgggaucaucuacgugguggacuccgucgacguggaccggcuggaggaggccaagaccgagcugcacaaggugaccaaguucgccgagaaccagggcacgccccuccuggucaucgccaacaagcaggaccugcccaagagccuccccguggccgagaucgagaagcagcuggcgcugcacgagcucaucccggccaccaccuaccacgugcagcccgccugcgccaucaucggggagggccugaccgaggggauggacaagcuguacgagaugauccucaagcgccggaagucccugaagcagaagaagaagcgcaccggcgaccugcggagcugcgaggucuga

SEQ ID NO: 26885 - RNA, 606 nt, Artificial Sequence
  derived and/or modified sequence opt1 from ARL4D__Homo_sapiens__NP_001652
augggcaaccaccugaccgagauggcccccaccgccagcuccuuccucccgcacuuccaggcgcugcacguggucgugaucgggcuggacagcgccggcaagacgucccuccuguaccgccugaaguucaaggaguucgugcagagcguccccaccaagggguucaacaccgagaagauccgggugccccucggcgggucccgcggcaucaccuuccaggugugggacgucggcgggcaggagaagcugcggccccuguggcgcagcuacacgcggcgcaccgacggccucguguucguggucgacgccgccgaggccgagcggcuggaggaggcgaagguggagcugcaccgcaucucccgggccagcgacaaccagggggugccgguccucgugcuggccaacaagcaggaccagcccggcgcccuguccgcggccgagguggagaagcgccucgccguccgggagcuggccgccgcgacccugacccacgugcaggggugcagcgccguggacggccucggccugcagcaggggcuggagcgccucuacgagaugauccugaagcggaagaaggccgcccgcggcgggaagaagcggcgcuga

SEQ ID NO: 26886 - RNA, 429 nt, Artificial Sequence
  derived and/or modified sequence opt1 from ARL5A__Homo_sapiens__NP_001032251
augaacgaggugguccacaccagccccaccaucggcuccaacguggaggagaucgugaucaacaacacgcgcuuccugaugugggacaucgggggccaggagagccuccgguccagcuggaacaccuacuacaccaacaccgaguucgucaucgugguggucgacuccacggaccgcgagcggaucagcgugacccgcgaggagcuguacaagaugcuggcccacgaggaccuccggaaggccgggcugcugaucuucgcgaacaagcaggacgugaaggagugcaugaccgucgccgagaucucccaguuccucaagcugaccagcaucaaggaccaccaguggcacauccaggccugcugcgcccugacgggcgaggggcucugccagggccuggaguggaugaugucccgccugaagauccgguga

SEQ ID NO: 26887 - RNA, 540 nt, Artificial Sequence
  derived and/or modified sequence opt1 from ARL5B__Homo_sapiens__NP_848930
augggccugaucuucgccaagcucuggagccuguucugcaaccaggagcacaaggugaucaucgucgggcuggacaacgccggcaagaccaccauccucuaccaguuccugaugaacgagguggugcacacgucccccaccaucgggagcaacgucgaggagaucguggugaagaacacccacuuccugaugugggacaucggcgggcaggagucccuccgcagcuccuggaacaccuacuacagcaacacggaguucaucauccuggucguggacuccaucgaccgggagcgccuggcgaucaccaaggaggagcucuaccggaugcuggcccacgaggaccugcgcaaggccgccgugcucaucuucgccaacaagcaggacaugaagggcugcaugaccgcggccgagaucagcaaguaccugacccuguccagcaucaaggaccacccguggcacauccaguccugcugcgcccucacgggcgaggggcugugccagggccuggaguggaugaccagccggaucgggguccgcuga

SEQ ID NO: 26888 - RNA, 561 nt, Artificial Sequence
  derived and/or modified sequence opt1 from ARL6__Homo_sapiens__NP_816931
augggccugcucgaccgccugagcgugcugcucgggcugaagaagaaggagguccacgugcugugccucggccuggacaacuccgggaagaccaccaucaucaacaagcugaagcccagcaacgcccagucccagaacauccucccgacgaucggcuucagcaucgagaaguucaaguccagcucccugagcuucaccguguucgacauguccgggcagggccgguaccgcaaccugugggagcacuacuacaaggagggccaggccaucaucuucgucaucgacagcuccgaccggcuccgcauggugguggcgaaggaggagcuggacacccugcucaaccaccccgacaucaagcaccggcgcauccccauccuguucuucgccaacaagauggaccugcgggacgccgucaccagcgugaaggugucccagcuccugugccuggagaacaucaaggacaagcccuggcacaucugcgccagcgacgccaucaagggggagggccuccaggagggggucgacuggcugcaggaccagauccagacggugaagaccuga

SEQ ID NO: 26889 - RNA, 612 nt, Artificial Sequence
  derived and/or modified sequence opt1 from ARL6IP1__Homo_sapiens__NP_055976
auggccgagggcgacaaccgcagcaccaaccugcucgccgcggagaccgccucccuggaggagcagcugcagggguggggcgaggugaugcucauggccgacaaggugcugcggugggagcgcgccugguucccgcccgccaucauggggguggugagccuggucuuccucaucaucuacuaccuggaccccuccgugcugagcggcguguccugcuucgucauguuccucugccuggcggacuaccuggugcccauccucgcgccccggaucuucgggagcaacaaguggacgaccgagcagcagcagcgcuuccacgagaucugcuccaaccuggugaagacccggcgccgggccgucggcugguggaagcgccuguucacccucaaggaggagaagccgaagauguacuucaugacgaugaucgugagccuggccgccguggccugggucggccagcagguccacaaccugcuccugaccuaccugaucgugaccucccuccugcugcuccccgggcugaaccagcacggcaucauccugaaguacaucgggauggccaagcgggagaucaacaagcuccugaagcagaaggagaagaagaacgaguga

SEQ ID NO: 26890 - RNA, 567 nt, Artificial Sequence
  derived and/or modified sequence opt1 from ARL6IP5__Homo_sapiens__NP_006398
auggacgugaacaucgcgccccugcgcgccugggacgacuucuucccgggcagcgaccgguucgcccgccccgacuuccgggacaucuccaaguggaacaaccgcgucgugagcaaccuccuguacuaccagaccaacuaccugguggucgccgccaugaugaucuccaucgugggguuccucagccccuucaacaugauccugggcgggaucguggucgugcugguguucaccggcuucgucugggccgcccacaacaaggacgugcuccggcgcaugaagaagcgguaccccacgaccuucgugauggucgugaugcuggcguccuacuuccugaucagcauguucgggggcgugauggucuucguguucggcaucaccuucccgcuccugcugauguucauccacgccucccuccgccugcggaaccugaagaacaagcucgagaacaagauggaggggaucggccugaagcgcacccccauggggaucgugcuggacgcccucgagcagcaggaggagggcaucaaccggcugacggacuacaucagcaaggucaaggaguga

SEQ ID NO: 26891 - RNA, 927 nt, Artificial Sequence
  derived and/or modified sequence opt1 from ARMC10__Homo_sapiens__NP_001154481
augggcgggccccgcggcgccggguggguggccgcgggccugcuccugggggccggcgccugcuacugcaucuaccggcugacccgcggccggcgccgcggggaccgggagcucggcauccggagcuccaagagcgccgaggaccugaccgacggguccuacgacgacguccugaacgccgagcagcuccagaagcugcuguaccuccuggagagcacggaggacccggugaucaucgagcgcgcgcugaucacccucggcaacaacgccgccuucuccgugaaccaggccaucauccgggagcucgggggcauccccaucgucgcgaacaagaucaaccacagcaaccaguccaucaaggagaaggcccugaacgcccugaacaaccugagcgugaacguggagaaccagaucaagaucaagaucuacaucucccaggucugcgaggacguguucagcggcccccugaacuccgccgugcagcucgccgggcugacccugcucaccaacaugacggucaccaacgaccaccagcacaugcugcacagcuacaucaccgaccuguuccaggugcuccugaccggcaacgggaacacgaaggugcagguccugaagcuccugcugaaccucuccgagaaccccgcgaugaccgagggccugcugcgcgcccagguggacagcuccuuccucagccuguacgacucccacguggccaaggagauccugcuccggguccugacccuguuccagaacaucaagaacugccucaagaucgagggccaccuggccgugcagccgaccuucacggaggggagccuguucuuccuccugcacggcgaggagugcgcccagaagauccgcgcgcugguggaccaccacgacgccgaggucaaggagaagguggugaccaucauccccaagaucuga

SEQ ID NO: 26892 - RNA, 543 nt, Artificial Sequence
  derived and/or modified sequence opt1 from ARMC1__Homo_sapiens__NP_001273631
augagcgccuggcccuacuucaucuacggcccgucccagcccagcucccgcccccugcgguucgccugcagcuccauccucgggcgcaugcccugcaagcagcggaaggacgagcgccggaccggcuacgacguggagcugaccaagugcuacacggagagccgccggaaccugugcgaggaggcgcuccugaagaucaagggggucaucuccuucaccuuccagauggccgugcagcgcugcgugguccggauccgcagcgaccugaaggccgaggcccucgccuccgcgaucgccagcaccaaggugaugaaggcccagcaggucgugaaguccgagagcggcgaggagaugcuggugccguuccaggacacccccguggaggucgagcagaacacggagcugcccgacuaccuccccgaggacgaguccccgaccaaggagcaggacaaggccgugagccggguggggucccaccccgagggcggcgcgagcuggcuguccaccgccgccaacuuccugagccgcuccuucuacugguga

SEQ ID NO: 26893 - RNA, 2604 nt, Artificial Sequence
  derived and/or modified sequence opt1 from ARMC2__Homo_sapiens__NP_115507
augcugagccccaacgacaagaugcucggcaagcuggacccguucuaccagcccuccgugagcaagcagaagaccuccgccgagaucaucagcgaggcccgcaacgcgcugcggaccguccgcacgcagcggcccuucacgccccaggaggcccagcgcaagcuguucgggccggccuccagccggaccuccgagaaccgcccgcccagcuccuucagccugcacgccuccagcuucgaguccagcgacucccggcccaucagcggcacccgccugagcccccucgagcugaagcccaaggugcccgccucccccacccgggaggaggacuccugcuucagcuucccgaagccgcccguggaccccgcgaagauccgccgggucagcaacgcccgcgcccggcuguuccgcgccgcgucccagcgggcccuccugcccgaccgcagccugccgcccuccgacagcaagaagaccguggaguccaaggagaccgugaugaugggggacagcauggucaagaucaacggcaucuaccucaccaaguccaacgccaucugccaccucaagagccacccccugcagcucacggacgacgggggcuucuccgagaucaaggagcaggagauguucaagggcaccaccagccugcccucccaccugaagaacgggggcgaccaggggaagcggcacgcccgcgccagcuccugccccagcuccagcgaccucucccggcugcagaccaaggcggugcccaaggccgaccugcaggaggaggacgccgagaucgagguggacgaggucuucuggaacacgcgcaucgugcccauccuccgggagcuggagaaggaggagaacaucgagaccgugugcgccgccugcacccagcugcaccacgcgcucgaggagggcaacaugcuggggaacaaguucaagggccgcagcauccugcucaagacccugugcaagcuggucgacgugggcuccgacagccucagccugaagcuggccaagaucauccucgcccugaaggugucccgcaagaaccugcucaacgucugcaagcugaucuucaagaucagccggaacgagaagaacgacucccugauccagaacgacagcauccucgagucccugcuggaggugcuccgcagcgaggaccugcagacgaacauggaggccuuccuguacugcaugggguccaucaaguucaucagcggcaaccucggguuccugaacgagaugaucuccaagggcgccguggagauccugaucaaccucaucaagcagaucaacgagaacaucaagaagugcggcaccuuccugccgaacagcgggcaccuccugguccaggugaccgcgacccugcggaaccugguggacuccagccugguccgcuccaaguuccucaacaucagcgcccugccccagcugugcacggccauggagcaguacaagggcgacaaggacgugugcaccaacaucgcccggaucuucuccaagcucaccagcuaccgcgacugcugcaccgcccuggcguccuacagccggugcuacgcccuguuccucaaccugaucaacaaguaccagaagaagcaggaccuggugguccgcguggucuucauccucgggaaccugacggccaagaacaaccaggcccgggagcaguucagcaaggagaagggcuccauccagacccugcucagccuguuccagaccuuccaccagcuggaccuccacucccagaagcccguggggcagcgcggcgagcagcaccgggcgcagcggcccccgagcgaggccgaggacgugcugaucaagcugacccgcguccucgccaacaucgccauccaccccggcguggggcccgugcuggccgcgaacccgggcaucgucgggcugcuccugacgacccuggaguacaagucccucgacgacugcgaggagcuggugaucaacgccaccgccaccaucaacaaccugagcuacuaccaggugaagaacuccaucauccaggacaagaagcucuacaucgccgagcugcugcucaagcugcuggucagcaacaacauggacggcauccucgaggccgugcgcguguucgggaaccugucccaggaccacgacgucugcgacuucaucgugcagaacaacgugcaccgguucaugauggcgcugcucgacgcccagcaccaggacaucugcuucagcgccugcggcguccugcugaaccucacgguggacaaggacaagcgcgugauccugaaggagggcgggggcaucaagaagcuggucgacugccuccgggaccuggggcccaccgacuggcagcuggccugccucgugugcaagacccuguggaacuucuccgagaacaucaccaacgccagcuccugcuucggcaacgaggacacgaacacccugcuccugcugcucagcuccuuccuggacgaggagcuggcgcucgacgggagcuucgaccccgaccugaagaacuaccacaagcugcacugggagaccgaguucaagcccguggcccagcagcuccugaaccgcauccagcggcaccacaccuuccuggagccgcuccccauccccuccuucuga

SEQ ID NO: 26894 - RNA, 2598 nt, Artificial Sequence
  derived and/or modified sequence opt1 from ARMC3__Homo_sapiens__NP_001269674
augggcaagaagaucaagaaggagguggagcccccgcccaaggacgucuucgacccccugaugaucgagagcaagaaggccgccaccguggugcucaugcugaacucccccgaggaggagauccuggcgaaggccugcgaggccaucuacaaguucgcccucaagggggaggagaacaagaccacgcugcuggagcucggcgccgucgagccgcugaccaagcugcucacccacgaggacaagaucgugcgccggaacgcgaccaugaucuucgggauccuggccagcaacaacgacgugaagaagcugcuccgcgagcuggacgucaugaacuccgugaucgcccagcuggcccccgaggaggagguggucauccacgaguucgcgagccucugccuggccaacauguccgccgaguacacgagcaaggugcagaucuucgagcacggcgggcuggagccccucauccggcugcuguccagccccgacccggacgugaagaagaacuccauggagugcaucuacaaccucguccaggacuuccagugccgcgccaagcugcaggagcugaacgccaucccgcccauccucgaccugcugaaguccgaguaccccgugauccagcuccuggcgcugaagacccucggcgugaucgccaacgacaaggagucccggaccaugcugcgcgacaaccagggccuggaccaccucaucaagauccuggagaccaaggagcugaacgaccuccacaucgaggcccuggccgucaucgccaacugccuggaggacauggacacgauggugcagauccagcagaccgggggccucaagaagcugcugagcuucgcggagaacuccaccauccccgacauccagaagaacgccgccaaggccaucaccaaggccgcguacgaccccgagaaccggaagcuguuccacgagcaggagguggagaagugccuggucgcccugcucgggagcgagaacgacggcacgaagaucgccgccucccaggccaucagcgcgaugugcgagaacuccgggagcaaggacuucuucaacaaccagggcaucccccagcugauccagcugcucaaguccgacaacgaggaggugcgcgaggccgccgcccuggcgcuggccaaccugacgaccugcaaccccgccaacgccaacgccgcggccgaggccgacggcaucgacccgcucaucaaccugcugagcagcaagcgggacggggccaucgccaacgcggccaccgugcucaccaacauggccaugcaggagccccugcgccugaacauccagaaccacgacaucaugcacgccaucaucagcccccuccggagcgccaacaccgucgugcaguccaaggcggcccuggccgugaccgccaccgcgugcgacgucgaggcccgcacggagcugcggaacagcggcgggcucgagccccugguggagcugcuccgcuccaagaacgacgagguccggaagcacgccagcugggccgugauggugugcgccggcgacgagcugaccgcgaacgagcugugccgccucggcgcccuggacauccuggaggaggucaacguguccgggacccggaagaacaaguucagcgaggccgccuacaacaagcuccugaacaacaaccugucccucaaguacagccagaccggcuaccuguccagcuccaacaucaucaacgacggguucuacgacuacggccgcaucaacccggggacgaagcugcucccccugaaggagcugugccuccaggagcccagcgaccugcgggccgugcugcucaucaacuccaagagcuacgucuccccgcccagcuccauggaggacaagagcgacgugggcuacggccgcagcaucuccagcuccagcucccugcggcgcagcuccaaggagaagaacaacgcgggguucggcagccccaucgaggacaaguccgagcccgccagcgggcgcaacaccgugcuguccaagagcgccaccaaggagaagggcuggcggaaguccaaggggaagaaggaggaggagaaggucaaggaggaggaggaggugauggugguccccaaguucgugggcgagggcagcuccgacaaggaguggugcccgcccagcgaccccgacuucuccauguacguguacgaggucaccaagagcauccucccgaucacgaacaucaaggagcagaucgaggaccuggccaaguacguggccgagaagaugggcgggaagauccccaaggagaagcugcccgacuucagcugggagcuccacaucuccgagcugaaguuccagcucaagagcaacgugauccccaucgggcacgucaagaagggcaucuucuaccaccgcgcgcuccuguucaaggcccuggccgaccggaucgggaucggcugcucccucgugcgcggcgaguacgggcgggccuggaacgaggugaugcugcagaacgacagccgcaagggcgucaucgggggccugccggcgcccgagauguacgugaucgaccucauguuccaccccggcgggcugaugaagcugcggucccgcgaggccgaccucuaccgguucaucuga

SEQ ID NO: 26895 - RNA, 1839 nt, Artificial Sequence
  derived and/or modified sequence opt1 from ARMC4__Homo_sapiens__NP_001276950
augcgcgacuucagccuggcccaggagaccugccagcucgccauccgggacgugggcgggcuggagguccugaucaaccuccuggagaccgacgaggugaagugcaagaucggcucccugaagauccucaaggagaucagccacaacccccagauccgccagaacaucguggaccucgggggccugcccaucauggucaacauccuggacagcccccacaagucccugaagugccuggcggccgagacgaucgccaacguggccaaguucaagcgggcccgccgggugguccgccagcacgggggcaucaccaagcucguggcgcugcuggacugcgcccacgacuccaccaagcccgcccagagcucccucuacgaggcccgggacguggaggucgcgcgcugcggcgcccuggcccuguggagcugcuccaagagccacaccaacaaggaggccauccggaaggccgggggcaucccccuccuggcgcgccugcucaagacgucccacgagaacaugcugauccccgugguggggacccugcaggagugcgccagcgaggagaacuaccgggccgccaucaaggccgagcgcaucaucgagaaccucgucaagaaccugaacuccgagaacgagcagcugcaggagcacugcgcgauggccaucuaccagugcgccgaggacaaggagacccgggaccucgugcgccugcacggcgggcugaagccccucgccagccugcugaacaacaccgacaacaaggagcggcucgccgcggugacgggcgccaucuggaagugcuccaucagcaaggagaacgucaccaaguuccgcgaguacaaggccaucgagacccuggugggccugcucaccgaccagcccgaggaggugcuggucaacguggugggggcccugggcgagugcugccaggagcgggagaaccgcgucaucgugcggaagugcgggggcauccagccccucgugaaccugcuggucggcaucaaccaggcccuccuggugaacgucacgaaggcggugggggccugcgccguggagccggaguccaugaugaucaucgaccgccuggacggcguccggcuccuguggagccugcucaagaacccccaccccgacgugaaggccuccgcggccugggcccugugccccugcaucaagaacgccaaggacgccggggagauggugcgcagcuucgucggcgggcuggagcugaucgugaaccuccucaagagcgacaacaaggaggugcuggcguccgucugcgccgccaucaccaacaucgccaaggaccaggagaaccuggccgugaucaccgaccacggcguggucccgcugcugagcaagcucgcgaacaccaacaacaacaagcugcgccaccaccuggccgaggccaucucccggugcugcauguggggccgcaaccggguggccuucggggagcacaaggccguggcgccccucguccgcuaccucaagagcaacgacacgaacgugcaccgggccaccgcccaggcccuguaccagcuguccgaggacgcggacaacugcaucaccaugcacgagaacggcgccgugaagaccgagagccgccacgucgcccggcuggagugcuccgacaacgaccuggggagccuccagccgccgccgcccggcuucaagcgcuucuccugccugagccugcucuccagcugggacuacuccuucuacuggaucuggcuggggccccugacgcggaucagccgcaagcuccagcuggugguguaccccaucuccgccggcuggcugcuccugcagcggcgccaggacacccuggagaucuga

SEQ ID NO: 26896 - RNA, 2808 nt, Artificial Sequence
  derived and/or modified sequence opt1 from ARMC5__Homo_sapiens__NP_001098717
auggccgccgcgaagcccacccugaccgacagccucuccuucugccuggcccagcuggccgccgccgcgggcgaggcccucgggggcgagaaggacccggccacgaacgagacgccccugagccgcgcccugcucgcgcugcggacccgccacaucaaggccgccgggggcaucgagcgguuccgcgcccgcgggggccugcggccccuccuggcccugcuccggcgcgcggccgccgccggcuccgcccccagccaggcggggccgggcuccgcccccagcuccgccgccagcggggccuccagccccgcgcccgccuccggcccggcccccagcgccguguccagcuccagccccacgcccccgguccggcugcgcaagacccuggaccucgcccuguccauccuggcggacugcugcaccgagggggccugccggaccgaggugcgccggcucggcggcauccugccccuggugaccauccuccagugcaugaagaccgacagcauccagaaccgcaccgcccgggcccuggggaaccuggcgauggagcccgaguccugcggcgacauccacugcgccggggccgucccccuccugguggagagccugaccgccugccaggacagccagugccuccaguccgugguccgcgcccugcggaaccuggcggacagcccgcagcaccgccucgcccuggcccagcagggcgccgugcggccccuggccgagcuccuggcgaccgcccccgacgccgcccugacgcucgcccuggugcgcgcgcugcucgagcugucccggggcugcagccgcgccugcgccgagcagcugucccucgggggcgggcugggcccccuggucagccucgccucccacccgaagcgcgcggugcgggaggggaccauccugauccuggccaaccucugcgcccagggccugauccgccccgcccugggcaacgccgggggcguggagguccugguggacgagcuccggcagcgccgggaccccaacggggcgagccccaccucccagcagccgcuggugcgcgccgucugccugcucugccgggaggccaucaaccgcgcccggcugcgcgacgccggcgggcuggaccuccugaugggccugcuccgggacccccgcgcgagcgccuggcacccccggaucguggccgcccuggugggcuuccuguacgacaccggggcccucggccgccugcaggcgcuggggcucgucccccugcuggccggccagcucugcggggaggccggcgaggaggaggaggagggccgggaggccgcguccugggacuucccggaggagcgcacgcccgagcgggcccagggcgggagcuuccgcucccugcggagcuggcugaucuccgagggguacgccaccggccccgacgacaucagcccggacuggucccccgagcagugcccgcccgagcccauggagcccgccagccccgcccccaccccgaccucccuccgcgcgccccgcacgcagcggacccccggccgcagccccgccgccgccaucgaggagccgugggggcgggagggccccgcccugcugcuccugagccgcuucucccaggcgcccgaccccagcggggcccuggugaccggcccggcccucuacgggcugcugaccuacgugacgggcgcccccggcccgcccagcccccgggcccuccgcauccugucccggcugaccugcaaccccgcgugccucgaggccuucguccgcuccuacggggccgcccugcugcgggccuggcucgugcugggcguggcgcccgacgacuggcccgccccgcgcgcccggcccacccugcacagccgccaccgggagcucggggagcgccugcugcagaaccucaccguccaggccgagucccccuucggcgugggggcgcugacgcaccuccugcugagcggcuccccggaggaccgggucgccugcgcccugacccuccccuucaucugccgcaagcccagccuguggcggcgccugcuccuggagcagggcgggcugcggcuccugcuggccgcccucacccgccccgcgccgcacccccuguuccuguucuucgccgccgacucccucagcugccugcaggaccuggugucccccaccgugagccccgccgucccgcaggccgugcccauggaccucgacucccccagccccugccuguacgagccgcugcucggccccgcgcccgugcccgccccggaccugcacuuccugcucgacuccgggcugcagcugcccgcccagcgggccgccagcgcgacggccagccccuucuuccgcgcccuccuguccggcagcuucgccgaggcgcagauggaccuggucccccuccgcgggcuguccccgggcgccgccuggcccgugcugcaccaccuccacggcugccgggggugcggcgccgcccuggggcccgugcccccgcccggccagccccugcucgggagcgaggcggaggaggcccuggaggccgccggccgcuuccugcuccccggccuggaggaggagcuggaggaggccgucgggcggauccaccucggcccgcagggcgggcccgaguccgugggcgagguguuccgccuggggcggccccgccuggcggcccacugcgcccgguggacccucggcagcgagcagugcccgcgcaagcgggggcuggcccuggucggccucguggaggccgcgggggaggaggccggcccccugaccgaggcccugcuggccguggucaugggcaucgagcucggggcgcgcgugcccgccuga

SEQ ID NO: 26897 - RNA, 1929 nt, Artificial Sequence
  derived and/or modified sequence opt1 from ARMC8__Homo_sapiens__NP_001253970
auggccugccugcucgagacccccauccgcaugagcgugcuguccgaggucaccgccagcucccggcacuacguggaccgccuguucgacccggacccccagaaggugcuccagggcgucaucgacaugaagaacgcggugaucgggaacaacaagcagaaggccaaccugaucgugcugggcgccgucccccggcuccuguaccugcuccagcaggagacgagcuccaccgagcugaagaccgagugcgccguggugcuggggagccucgccaugggcaccgagaacaacgucaagucccugcuggacugccacaucauccccgcgcuccugcaggggcugcucagcccggaccugaaguucaucgaggccugccugcgcugccuccggacgaucuucaccucccccgugacccccgaggagcugcuguacaccggccccgaccaccagacgauccucuucaaccacggcgccgugcagaacaucgcccaccuccugaccagccuguccuacaagguccgcaugcaggcgcugaagugcuucagcgugcuggccuucgagaacccccagguguccaugacccucgucaacgugcugguggacggggagcugcucccgcagaucuucgucaagaugcugcagcgggacaagcccaucgagaugcagcugaccagcgccaagugccucacguacaugugccgcgccggcgccauccggaccgacgacaacugcaucgugcugaagacccugcccugccucgugcgcaugugcuccaaggagcggcugcuggaggagcgcgucgagggggcggagacccucgccuaccugaucgagccggacguggagcugcagcggaucgccagcaucacggaccaccucaucgccaugcuggccgacuacuucaaguaccccuccagcguguccgcgaucaccgacaucaagcgccuggaccacgaccucaagcacgcccacgagcugcggcaggccgccuucaagcuguacgccagccugggcgcgaacgacgaggacauccgcaagaagaucaucgagaccgagaacaugauggaccggaucgucaccgggcucagcgaguccagcgugaagguccgccuggccgccgugcggugccugcacucccucagccgcuccgugcagcagcugcggacgagcuuccaggaccacgccgucuggaagccccugaugaaggugcuccagaacgcccccgacgagauccugguggucgcguccagcaugcugugcaaccuccugcuggaguucuccccgagcaaggagcccauccucgaguccggcgccguggagcugcugugcggccucacccagagcgagaaccccgcccugcgcgugaacgggaucugggcccugaugaacauggcguuccaggccgagcagaagaucaaggccgacauccuccgcucccugagcaccgagcagcuguuccggcuccuguccgacagcgaccugaacguccucaugaagacccugggccugcuccgcaaccugcuguccacgcggccccacaucgacaagaucaugagcacccacgggaagcagaucaugcaggccgugacccucauccuggagggcgagcacaacaucgaggugaaggagcagacccugugcauccucgccaacaucgcggacggcacgaccgccaaggaccugaucaugaccaacgacgacauccugcagaagaucaaguacuacauggggcacucccacgucaagcuccagcuggccgccauguucugcaucagcaaccugaucuggaacgaggaggagggcagccaggagcgccaggacaagcuccgggacauggggaucguggacauccugcacaagcugucccagagcccggacuccaaccucugcgacaaggccaagauggcgcugcagcaguaccuggccuga

SEQ ID NO: 26898 - RNA, 2457 nt, Artificial Sequence
  derived and/or modified sequence opt1 from ARMC9__Homo_sapiens__NP_001258395
augggcgacauccuggcccacgagagcgagcuccuggggcuggugaaggaguaccucgacuucgccgaguucgaggacacccugaagaccuucuccaaggagugcaagaucaagggcaagccccugugcaagacggucgggggcagcuuccgcgacuccaagagccucaccauccagaaggaccugguggcggccuucgacaacggggaccagaagguguucuucgaccugugggaggagcacaucuccagcuccauccgggacggcgacagcuucgcccagaagcucgaguucuaccugcacauccacuucgccaucuaccugcucaaguacuccgucggccgcccggacaaggaggagcuggacgagaagaucagcuacuucaagaccuaccuggagaccaagggggccgcgcucucccagacgaccgaguuccugcccuucuacgcccugcccuucgugcccaacccgauggugcaccccagcuucaaggagcuguuccaggacuccuggacccccgagcucaagcugaagcucgagaaguuccuggcccugaucagcaaggccuccaacacccccaagcuccugacgaucuacaaggagaacggccagagcaacaaggagauccugcagcagcuccaccagcagcuggucgaggcggagcggcgcuccgugaccuaccugaagcgguacaacaagauccaggccgacuaccacaaccucaucggggugaccgccgagcuggucgacagccuggaggccaccguguccggcaagaugaucacgccggaguaccuccagagcgugugcguccgccuguucagcaaccagaugcggcagucccuggcccacagcguggacuucacccgccccgggaccgcguccaccaugcuccgggccagccuggcccccgugaagcugaaggacgucccccuccugccgucccuggacuacgagaagcucaagaaggaccugauccugggcagcgaccgccucaaggccuuccugcugcaggcccuccgguggcgccugacgaccucccaccccggcgagcagcgggagaccgugcugcaggcguacaucagcaacgaccugcucgacugcuacucccacaaccagcgcagcgugcugcagcugcuccacuccaccagcgacgucgugcggcaguacauggcccgccugaucaacgccuucgccucccuggccgaggggcggcucuaccuggcgcagaacacgaaggugcugcagaugcucgagggccgccugaaggaggaggacaaggacaucaucacccgggagaacguccugggggcccuccagaaguucagccugcgccggccccugcagaccgccaugauccaggacggccucaucuucuggcugguggacgugcugaaggaccccgacugccucuccgacuacacccuggaguacagcgucgcccugcucaugaaccugugccugcgcuccacgggcaagaacaugugcgccaagguggcggggcucguccugaaggugcugagcgaccuccugggccacgagaaccacgagauccagccguacgugaacggggcccuguacuccauccucagcguccccagcauccgcgaggaggcccgggccaugggcauggaggacauccugcgcugcuucaucaaggaggggaacgcggagaugauccggcagaucgaguucaucaucaagcagcugaacuccgaggagcuccccgacggcgugcuggagagcgacgacgacgaggacgaggacgacgaggaggaccacgacaucauggaggccgaccuggacaaggacgagcucauccagccccagcugggcgagcuguccggggagaagcuccugaccaccgaguaccugggcaucaugaccaacacggggaagacccgccggaagggccucgccaacgugcaguggagcggggacgagccgcugcagcgccccgucacccccggcggccaccggaacggguaccccgugguggaggaccagcacaccccgccccagacggcccagcacgcccgcaacggccacccccaggcgcugcccgccgcccacgaggccgucuaccgggaggggaagccguccacccccgagagcugcguguccagcuccagcgccaucaucgcgaagcccggcgaguggcucccgcgcgggcggcaggaggagccccgccccgcccccaccggcaccccgcggcagccccgcgaggcgccccaggaccccggcaacggggugacgacccgggagugcgccuccgccuucacgugcaagccgcgcgcccccugcacccccgagaugcuggacuggaacccgcccaaggccaaggccagcguccuggcgccccucuucuccagcugcggcccccagcaggccucccggcccgggagcaccgccuccagcacccgcggccugccgagcucccagagccaccggaaguga

SEQ ID NO: 26899 - RNA, 1362 nt, Artificial Sequence
  derived and/or modified sequence opt1 from ARMCX1__Homo_sapiens__NP_057692
augggccgcacccgggaggccgggugcguggccgcgggcgucgugaucggggccggcgccugcuacugcguguaccgccuggccugggggcgggacgagaacgagaagaucugggacgaggacgaggagagcaccgacacguccgagaucggcgucgagaccgugaagggcgccaagaccaacgcgggggccggcagcggggccaagcuccagggcgacuccgaggugaagcccgaggucagccuggggcuggaggacugcccgggcgugaaggagaaggcccacuccggcagccacuccgggggcgggcucgaggcgaaggccaaggcccuguucaacacccugaaggagcaggccagcgccaaggcgggcaagggcgcccgcguggggacgaucuccggcaaccggacccucgcccccagccugcccugccccgggggccgcgggggcggcugccacccgacccgguccgggagccgcgccggcgggcgggccuccggcaagagcaaggggaaggcgcgcuccaagagcacccgggcccccgccacgaccuggcccguccgccggggcaaguucaacuuccccuacaagaucgacgacauccuguccgccccggaccuccagaaggugcugaacauccuggagcgcaccaacgaccccuucauccaggagguggcccucgucacccugggcaacaacgcggccuacagcuucaaccagaacgccauccgggagcucgggggcgugcccaucaucgccaagcugaucaagacgaaggaccccaucauccgcgagaagaccuacaacgcccugaacaaccuguccgugaacgcggagaaccaggggaagaucaagaccuacaucagccaggucugcgacgacaccauggugugccggcucgacagcgccgugcagauggccggccugcgccugcucacgaacaugaccgucaccaaccacuaccagcaccuccuguccuacagcuucccggacuucuucgcccugcuguuccuggggaaccacuucaccaagauccagaucaugaagcucaucaucaacuucacggagaaccccgcgaugacccgggagcugguguccugcaaggugcccagcgagcugaucucccucuucaacaaggagugggaccgcgagauccugcugaacauccucacccuguucgagaacaucaacgacaacaucaagaacgagggccuggccagcucccggaaggaguucagccgcuccagccucuucuuccuguucaaggaguccggcgucugcgugaagaagaucaaggcccuggccaaccacaacgaccucguggucaaggugaagguccugaaggugcugaccaagcucuga

SEQ ID NO: 26900 - RNA, 324 nt, Artificial Sequence
  derived and/or modified sequence opt1 from ARMS2__Homo_sapiens__NP_001093137
augcugcgccucuaccccggcccgauggugaccgaggccgaggggaagggcgggcccgagauggccagccuguccagcuccguggugcccgugagcuucaucuccacccugcgggagagcguccucgaccccggcgucgggggcgagggcgcguccgacaagcagcgcagcaagcugucccugagccacuccaugaucccggccgccaagauccacacggagcucugccugcccgccuucuucagccccgccgggacccagcggcgcuuccagcagccccagcaccaccugacccucuccaucauccacaccgcggcccgguga

SEQ ID NO: 26901 - RNA, 969 nt, Artificial Sequence
  derived and/or modified sequence opt1 from ARMT1__Homo_sapiens__NP_001273491
auguaccgccggauccacgaggccaucauccagagcccgccgaucgacuacuucgacguguucaaggaguccaaggagcagaacuucuacggcagccaggaguccaucaucgcccugugcacccaccuccagcagcugauccgcaccaucgaggaccuggacgagaaccagcucaaggacgaguucuucaagcugcugcagaucagccucugggggaacaagugcgaccugucccugagcggcggggaguccagcucccagaacacgaacguccucaacagccuggaggaccugaagcccuucauccuccugaacgacauggagcaccuguggucccuccugagcaacugcaagaagacccgggagaaggcguccgccacccgcguguacaucgugcuggacaacagcggcuucgagcucgucaccgaccugauccuggccgacuuccuccuguccagcgagcuggccacggaggugcacuucuacgggaagaccauccccugguucguguccgacaccaccauccacgacuucaacuggcucaucgagcaggucaagcacagcaaccacaaguggauguccaagugcggcgccgacugggaggaguacaucaagaugggcaaguggguguaccacaaccacaucuucuggacgcugccccacgaguacugcgcgaugccccagguggcccccgaccuguacgccgagcuccagaaggcccaccugauccuguucaagggggaccucaacuaccggaagcugaccggcgaccgcaagugggaguucagcguccccuuccaccaggcgcugaacggguuccaccccgccccgcucugcaccauccggacccugaaggccgagauccaggugggccugcagcccgggcagggcgagcagcuccuggccagcgagcccuccugguggacgaccggcaaguacgggaucuuccaguacgacggcccccuguga

SEQ ID NO: 26902 - RNA, 2154 nt, Artificial Sequence
  derived and/or modified sequence opt1 from ARNT2__Homo_sapiens__NP_055677
auggccacccccgccgcggugaacccgcccgagauggccagcgacauccccggcuccgucacccugcccguggcccccauggccgccacgggccaggugcgcauggcgggggccaugcccgcccgcgggggcaagcggcggagcgggauggacuucgacgacgaggacggcgagggccccuccaaguucagccgcgagaaccacuccgagaucgagcggcgccggcgcaacaagaugacccaguacaucaccgagcucagcgacauggucccgaccugcuccgcccuggcgcggaagcccgacaagcugacgauccuccgcauggccgugagccacaugaaguccaugcgggggaccggcaacaagagcaccgacggggccuacaagcccuccuuccugaccgagcaggagcugaagcaccucauccuggaggccgccgacggcuuccuguucguggucgcggccgagacggggcgcgugaucuacgugagcgacuccgucacccccgugcucaaccagccccagagcgagugguucggcuccacccuguacgagcagguccacccggacgacguggagaagcugcgggagcagcucugcaccagcgagaacuccaugacgggccgcauccuggaccugaagaccgggaccgugaagaaggagggccagcagagcuccaugcggaugugcauggggagccgccggagcuucaucugccgcaugcggugcggcaacgcgccccucgaccaccucccccugaaccgcaucaccacgaugcggaagcgcuuccgcaacggccuggggcccgugaaggagggcgaggcccaguacgccgucgugcacugcaccggguacaucaaggccuggccgcccgccggcaugaccauccccgaggaggacgccgacguggggcagggcuccaaguacugccuggucgccaucggccggcuccaggugaccagcucccccgugugcauggacaugaacgggaugagcgucccgacggaguuccugucccgccacaacagcgacggcaucaucaccuucguggacccccggugcaucuccgugaucggguaccagccccaggaccugcugggcaaggacauccucgaguucugccaccccgaggaccagagccaccuccgcgaguccuuccagcaggucgugaagcugaaggggcagguccugagcgugauguaccgguuccgcaccaagaaccgggaguggaugcugauccgcaccuccagcuucacguuccagaacccguacuccgacgagaucgaguacaucaucugcaccaacaccaacgugaagcagcugcagcagcagcaggccgagcucgagguccaccagcgggacggccugagcuccuacgaccugagccaggugcccgugcccaaccuccccgcgggcguccacgaggccgggaaguccguggagaaggccgacgccaucuucagccaggagcgcgacccgcgguucgccgagauguucgcgggcaucuccgccagcgagaagaagaugaugagcuccgccagcgccgcggggacccagcagaucuacucccagggcagccccuuccccuccgggcacagcggcaaggccuucuccagcuccgugguccacgugccgggcgugaacgacauccagagcuccagcuccacggggcagaacaugagccagaucucccgccagcugaaccagagccaggucgccuggaccggcucccggccgcccuuccccgggcagcagauccccagccagagcuccaagacccagagcucccccuucggcaucggcaccagccacacguaccccgccgaccccuccagcuacuccccgcugagcucccccgccaccagcucccccagcgggaacgcguacuccagccucgccaaccgcacccccggcuucgccgaguccgggcagagcuccggccaguuccaggggcggccgagcgagguguggucccaguggcagagccagcaccacggccagcagagcggcgagcagcacucccaccagcagcccgggcagaccgagguguuccaggacaugcugcccaugcccggcgacccgacgcaggggaccggcaacuacaacaucgaggacuucgccgaccuggggauguucccgcccuucagcgaguga

SEQ ID NO: 26903 - RNA, 2319 nt, Artificial Sequence
  derived and/or modified sequence opt1 from ARNT__Homo_sapiens__XP_011507849
auguaccaccacugggugcagccccugccgcucgagacccuggaccuggaguucaaggucgaggagccccucagccgcggccugcuguccggggaccaggccggccucaaguaccugcugcucgccuuccugcggcuggacuucgacgacgacggggagggcaacagcaaguuccuccgcugcgacgacgaccagauguccaacgacaaggagcgguucgcgcgcgagaaccacagcgagaucgagcggcgccggcgcaacaagaugaccgccuacaucacggagcuguccgacauggugccgaccugcagcgcccuggcccggaagcccgacaagcucaccauccugcgcauggccgugucccacaugaagucccugcgggggaccggcaacacgagcaccgacggcagcuacaagcccuccuuccucaccgaccaggagcugaagcaccugauccucgaggcggccgacggguuccuguucaucgucagcugcgagaccggccgcgugguguacgucuccgacagcgugacgcccgugcugaaccagccccaguccgagugguucgggagcacccucuacgaccagguccaccccgacgacguggacaagcugcgggagcagcuguccaccagcgagaacgcccucaccggccgcauccuggaccugaagacggggaccgugaagaaggagggccagcaguccagcaugcggaugugcaugggcagccgccgguccuucaucugccgcaugcggugcgggagcuccagcgucgacccgguguccgugaaccgccucagcuucguccggaaccgcugccgcaacggccugggguccgugaaggacggcgagccccacuucguggucgugcacugcaccggcuacaucaaggccuggccgcccgcgggggugagccugcccgacgacgaccccgaggccggccagggguccaaguucugccucgucgccaucggccggcuccaggugaccagcucccccaacugcacggacaugagcaacgugugccagcccaccgaguucaucucccgccacaacaucgaggggaucuucaccuucgucgaccaccggugcguggccaccgucggcuaccagccgcaggagcugcugggcaagaacaucguggaguucugccaccccgaggaccagcagcugcugcgcgacagcuuccagcaggucgugaagcucaagggccaggugcuguccgugauguuccgguuccgcagcaagaaccaggaguggcuguggaugcggacguccagcuucaccuuccagaaccccuacuccgacgagaucgaguacaucaucugcaccaacaccaacgucaagaacagcagccaggagccccgcccgacgcucuccaacaccauccagcggccccagcuggggcccaccgccaaccugccccucgagauggggagcggccagcuggcgccgcgccagcagcagcagcagaccgagcuggacauggugcccgggcgggacggccucgccuccuacaaccacagccaggugguccagcccgugacgaccaccggccccgagcacuccaagccgcuggagaaguccgacgggcuguucgcccaggaccgcgacccccgguucagcgagaucuaccacaacaucaacgccgaccagagcaagggcaucuccagcuccaccgugcccgccacgcagcagcuguucagccaggggaacaccuucccgcccacgccccgccccgcggagaacuuccggaacuccggccucgccccgcccgucaccaucgugcagcccagcgccuccgccgggcagaugcuggcccagaucagccgccacuccaaccccacccagggcgcgaccccgaccuggacccccaccacgcggagcggcuucagcgcccagguggccacccaggccaccgccaagacccgcacgucccaguucggggucggcagcuuccagacccccuccagcuucuccagcaugucccugcccggggcgccgaccgccagccccggcgccgccgcguaccccucccucaccaaccggggcagcaacuucgcccccgagacggggcagaccgccggccaguuccagacccgcaccgccgagggggugggcguguggccgcaguggcaggggcagcagccccaccaccgcuccagcuccagcgagcagcacguccagcagccgcccgcccagcagcccggccagcccgagguguuccaggagaugcuguccaugcugggcgaccagagcaacuccuacaacaacgaggaguuccccgaccucacgauguucccgcccuucagcgaguga

SEQ ID NO: 26904 - RNA, 1869 nt, Artificial Sequence
  derived and/or modified sequence opt1 from ARNTL2__Homo_sapiens__NP_001234931
auggccgccgaggaggaggcggccgccggcgggaaggugcugcgcgaggagaaccagugcaucgcccccgucgugagcucccgggugagcccgggcacccgccccaccgccaugggguccuucagcucccacaugacggaguucccccggaagcgcaagggcagcgacuccgaccccagccaguccgggaucaugaccgagaaggucguggagaagcucagccagaacccgcugaccuaccugcucuccacccggaucgagaucagcgcguccagcggcucccgcgaggcccacagccagacggagaagcggcgccgggacaagaugaacaaccugaucgaggagcuguccgccaugaucccccagugcaaccccauggcccgcaagcucgacaagcugaccgugcugcggauggcgguccagcaccuccgcagccugaagggccugaccaacuccuacguggggagcaacuaccggcccagcuuccuccaggacaacgagcugcgccaccugauccucaagaccgccgagggcuuccuguucguggucgggugcgagcggggcaagauccuguucguguccaagagcguguccaagauccucaacuacgaccaggccagccugacggggcagucccuguucgacuuccuccacccgaaggacgucgccaaggugaaggagcagcugagcuccuucgacaucagcccccgcgagaagcugaucgacgccaagaccggccuccaggugcacuccaaccugcacgcgggccggacccgcgucuacagcgggucccggcgcagcuucuucugccggaucaaguccugcaagaucagcgugaaggaggagcacggcugccugcccaacuccaagaagaaggagcaccgcaaguucuacaccauccacugcacgggguaccuccgcagcuggcccccgaacaucgugggcauggaggaggagcggaacuccaagaaggacaacagcaacuucacgugccuggucgccaucggccgccugcagcccuacaucgugccccagaacuccggggagaucaacgugaagcccaccgaguucaucacccgguucgccgucaacggcaaguucguguacguggaccagcgcgccaccgccauccucggguaccugccgcaggagcugcucggcaccagcugcuacgaguacuuccaccaggacgaccacaacaaccugaccgacaagcacaaggcgguccugcagagcaaggagaagauccucaccgacuccuacaaguuccgggccaaggacgggagcuucgugacgcugaagucccagugguucagcuucaccaaccccuggaccaaggagcuggaguacaucgucuccgugaacacccucgugcugggccacagcgagcccggcgaggccuccuuccugcccugcagcucccagagcuccgaggagagcucccgccagagcugcauguccgucccggggaugagcacgggcaccgugcucggggccggcuccaucgggaccgacaucgccaacgagauccuggaccugcagcggcuccagagcagcuccuaccuggacgacagcucccccaccggccugaugaaggacacgcacaccgugaacugccgcagcauguccaacaaggagcuguucccgcccagccccuccgagaugggcgagcucgaggcgacccggcagaaccagagcaccgucgccgugcacucccacgagccccugcugagcgacggggcccagcucgacuucgacgcccugugcgacaacgacgacacggccauggcggccuucaugaacuaccuggaggccgagggcgggcucggcgaccccggggacuucuccgacauccaguggacccuguga

SEQ ID NO: 26905 - RNA, 1878 nt, Artificial Sequence
  derived and/or modified sequence opt1 from ARNTL__Homo_sapiens__NP_001025443
auggccgaccagcgcauggacaucagcuccaccaucagcgacuucaugucccccggcccgaccgaccugcucagcuccagccuggggacguccggcguggacugcaaccggaagcgcaaggggagcuccaccgacuaccaggagagcauggacaccgacaaggacgacccccacggccggcuggaguacaccgagcaccaggggcgcaucaagaacgcccgggaggcgcacucccagaucgagaagcgccggcgcgacaagaugaacagcuucaucgacgagcucgccucccugguccccacgugcaacgccaugagccggaagcuggacaagcucaccgugcugcgcauggccgugcagcacaugaagacccugcggggcgccaccaaccccuacacggaggcgaacuacaagccgaccuuccucuccgacgacgagcugaagcaccugauccuccgcgccgccgacggcuuccuguucgucguggggugcgaccggggcaagauccuguucgugagcgaguccgucuucaagauccucaacuacagccagaacgaccugaucgggcagucccuguucgacuaccuccaccccaaggacaucgccaaggugaaggagcagcugagcagcuccgacaccgcgccccgcgagcggcugaucgacgccaagaccggccuccccgugaagacggacaucaccccggggcccagccgccugugcuccggcgcccggcgcagcuucuucugccggaugaagugcaaccgccccuccgucaagguggaggacaaggacuuccccagcacgugcuccaagaagaaggaccgcaagagcuucugcaccauccacuccaccggcuaccucaagagcuggccgcccaccaagauggggcuggacgaggacaacgagcccgacaacgagggcugcaaccuguccugccugguggccaucgggcggcuccacagccacgucgugccccagccggugaacggcgagauccgcgucaaguccauggaguacgugagccggcacgccaucgacggcaaguucguguucgucgaccagcgcgcgaccgccauccuggccuaccugccccaggagcuccuggggaccuccugcuacgaguacuuccaccaggacgacaucggccaccuggccgagugccaccgccaggugcuccagacgcgggagaagaucaccaccaacugcuacaaguucaagaucaaggacgggagcuucaucacccugcggucccgcugguucagcuucaugaaccccuggacgaaggagguggaguacaucgucuccaccaacaccguggugcuggccaacguccucgagggcggggaccccaccuucccgcagcugacggcgagcccccacagcauggacuccaugcugcccagcggcgagggcgggcccaagcggacccacccgaccgugcccggcauccccgggggcacccgcgccggggccggcaagaucggccggaugaucgccgaggagaucauggagauccaccgcauccggggguccagccccuccagcugcggcuccagcccgcucaacaucacguccaccccgccgcccgacgccagcucccccgggggcaagaagauccugaacgggggcacccccgacauccccagcuccggccugcucagcgggcaggcgcaggagaaccccggcuaccccuacuccgacagcuccagcauccugggggagaacccccacaucggcaucgacaugaucgacaacgaccagggcagcuccagccccuccaacgacgaggccgccauggccgucaucaugagccugcucgaggccgacgcggggcugggcgggccgguggacuucuccgaccugcccuggccccucuga

SEQ ID NO: 26906 - RNA, 1071 nt, Artificial Sequence
  derived and/or modified sequence opt1 from ARPC1A__Homo_sapiens__NP_001177925
augcccggcaccgggaucgugcugaucgcccucagcccgaacaaccacgagguccacaucuacaagaagaacggcucccagugggugaaggcccacgagcugaaggagcacaacgggcacaucaccggcaucgacugggcgcccaagagcgaccgcaucgugacgugcggggccgaccggaacgccuacgucuggucccagaaggacggcguguggaagcccacccuggugauccuccgcaucaaccgggccgccaccuucgucaaguggagcccccuggagaacaaguucgcggugggcuccggggcccgccugaucagcgugugcuacuucgaguccgagaacgacuggugggucagcaagcacaucaagaagccgauccgguccaccgugcucagccuggacuggcaccccaacaacgugcugcucgccgccggcuccugcgacuucaagugccgcgucuucagcgcguacaucaaggagguggacgagaagcccgccuccacgcccugggggagcaagaugccguucggccagcugauguccgaguucgggggcagcggcaccgggggcugggugcacggggucuccuucagcgccuccggcagccggcuggccugggugagccacgacuccaccgugagcgucgccgacgcguccaagagcguccagguguccacccucaagacggaguuccugccccugcucagcguguccuucgugagcgagaacuccguggucgccgccggccacgacugcugccccaugcuguucaacuacgacgaccgcgggugccugaccuucgugagcaagcucgacauccccaagcaguccauccagcggaacaugagcgccauggagcgcuuccggaacauggacaagcgcgccaccaccgaggaccggaacacggcgcuggagacccugcaccagaacuccaucacccaggucagcaucuacgagguggacaagcaggacugccgcaaguucugcaccacgggcaucgacggggccaugaccaucugggacuucaagacccucgaguccagcauccagggccugcggaucauguga

SEQ ID NO: 26907 - RNA, 1119 nt, Artificial Sequence
  derived and/or modified sequence opt1 from ARPC1B__Homo_sapiens__NP_005711
auggccuaccacagcuuccugguggagcccaucuccugccacgccuggaacaaggaccgcacccagaucgcgaucugcccgaacaaccacgagguccacaucuacgagaaguccggcgccaaguggaccaaggugcacgagcucaaggagcacaacgggcaggucacgggcaucgacugggcccccgagagcaaccggaucgugaccugcgggaccgaccgcaacgccuacguguggacccugaagggccggacguggaagcccacccuggugauccuccgcaucaaccgggccgcgcgcugcguccggugggcccccaacgagaacaaguucgccguggggagcggcucccgcgugaucagcaucugcuacuucgagcaggagaacgacuggugggucugcaagcacaucaagaagccgauccgguccaccgugcugagccuggacuggcaccccaacaacgugcuccuggccgcgggcuccugcgacuucaagugccgcaucuucagcgccuacaucaaggaggucgaggagcggcccgcccccaccccguggggguccaagaugcccuucggcgagcugauguucgagagcuccagcuccugcgggugggugcacggcgugugcuucagcgccuccgggagccgcgucgccugggugucccacgacagcacggugugccucgcggacgccgacaagaagauggccgucgccacccuggccagcgagacccugccccuccuggcgcugaccuucaucacggacaacucccucguggccgccggccacgacugcuuccccgugcuguucaccuacgacgccgccgcgggcaugcugagcuucgggggccggcucgacgucccgaagcaguccagccagcgcgggcugaccgcccgggagcgcuuccagaaccuggacaagaaggccuccagcgagggcggcaccgccgccggggcgggccucgacucccugcacaagaacagcgugucccagaucagcgugcuguccgggggcaaggccaagugcagccaguucugcacgaccgggauggacggcggcauguccaucugggacgucaagagccucgaguccgcccugaaggaccugaagaucaaguga

SEQ ID NO: 26908 - RNA, 903 nt, Artificial Sequence
  derived and/or modified sequence opt1 from ARPC2__Homo_sapiens__NP_005722
augauccugcucgaggugaacaaccgcaucaucgaggagacccuggcccugaaguucgagaacgccgcggccggcaacaagcccgaggccgucgaggugaccuucgccgacuucgacggggugcucuaccacaucagcaacccgaacggcgacaagacgaaggucaugguguccaucagccugaaguucuacaaggagcugcaggcccacggggcggacgagcuccugaagcggguguacggcuccuuccuggucaaccccgagagcggguacaacgugucccuccuguacgaccuggagaaccuccccgccagcaaggacuccaucgugcaccaggccggcaugcugaagcgcaacugcuucgccagcgucuucgagaaguacuuccaguuccaggaggagggcaaggagggggagaaccgggcggugauccacuaccgcgacgacgagaccauguacguggaguccaagaaggaccgggucaccgugguguucagcaccgucuucaaggacgacgacgacguggugaucggcaaggucuucaugcaggaguucaaggaggggcgccgggccucccacacggcgccccaggugcuguucagccaccgcgagccgccccucgagcugaaggacaccgacgccgccgugggcgacaacaucggguacaucaccuucguccuguucccccggcacaccaacgccuccgcccgcgacaacacgaucaaccucauccacaccuuccgggacuaccugcacuaccacaucaagugcagcaaggccuacauccacacccgcaugcgggccaagaccuccgacuuccugaaggugcucaaccgcgcccggcccgacgcggagaagaaggagaugaagacgaucaccggcaagaccuucagcucccgcuga

SEQ ID NO: 26909 - RNA, 537 nt, Artificial Sequence
  derived and/or modified sequence opt1 from ARPC3__Homo_sapiens__NP_001265485
augcccgccuaccacagcucccugauggacccggacaccaagcucaucggcaacauggcccugcugcccauccgcagccaguucaaggggcccgcgccccgggagaccaaggacacggacaucguggacgaggccaucuacuacuucaaggccaacgucuucuucaagaacuacgagaucaagaacgaggccgaccgcacccucaucuacaucacccuguacaucuccgagugccugaagaagcuccagaagugcaacagcaagucccagggcgagaaggagauguacacccuggggaucacgaacuucccgauccccggcgagcccggguucccccugaacgccaucuacgcgaagccggccaacaagcaggaggacgaggugaugcgggccuaccuccagcagcugcgccaggagaccggccugcggcucugcgagaagguguucgacccccagaacgacaagcccagcaagugguggaccugcuucgucaagcgccaguucaugaacaagucccugagcggccccgggcaguga

SEQ ID NO: 26910 - RNA, 465 nt, Artificial Sequence
  derived and/or modified sequence opt1 from ARPC5__Homo_sapiens__NP_001257368
augagcaagaacaccguguccagcgcccgcuuccggaaggucgacguggacgaguacgacgagaacaaguucguggacgaggaggacggcggggacggccaggccgggcccgacgagggcgaggucgacuccugccugcgccacagcaucaccgggaacaugacggcggcccuccaggccgcccugaagaacccgcccaucaacaccaagucccaggccgugaaggaccgggcgggcagcaucgugcugaagguccucaucuccuucaaggccaacgacaucgagaaggccgugcagagccuggacaagaacggcguggaccugcucaugaaguacaucuacaagggguucgagucccccagcgacaacuccagcgccaugcugcugcaguggcacgagaaggcgcucgccgccggcggggucggcuccaucgugcgcgugcugaccgcccggaagaccgucuga

SEQ ID NO: 26911 - RNA, 681 nt, Artificial Sequence
  derived and/or modified sequence opt1 from ARPIN__Homo_sapiens__NP_872422
augagccgcaucuaccacgacggcgcccugcggaacaaggccgugcaguccguccgccuccccggggcgugggacccggccgcccaccagggcgggaacggcgugcugcuggagggggagcucaucgacgugagccggcacuccauccuggacacccacggccgcaaggagcgguacuacguccuguacauccgccccagccacauccaccggcgcaaguucgacgccaagggcaacgagaucgagcccaacuucuccgccacccggaaggugaacacgggguuccucaugagcuccuacaagguggaggcgaagggcgacaccgaccgccugacccccgaggcccugaaggggcucgucaacaagccggagcugcuggcccucaccgagagccugacgcccgaccacaccguggccuucuggaugcccgaguccgagauggaggugauggagcuggagcucggcgcggggguccggcugaagacccgcggcgacggccccuuccuggacagccucgccaagcuggaggccgggaccgugacgaagugcaacuucaccggcgacgggaagaccggcgccuccuggaccgacaacaucauggcccagaagugcagcaagggcgcggccgccgagauccgggagcagggggacggcgccgaggacgaggagugggacgacuga

SEQ ID NO: 26912 - RNA, 270 nt, Artificial Sequence
  derived and/or modified sequence opt1 from ARPP21__Homo_sapiens__NP_001020240
augagcgagcagggcgaccugaaccaggccaucgccgaggagggcgggaccgagcaggagaccgcgacgcccgagaacgggaucgugaaguccgagagccucgacgaggaggagaagcuggagcugcagcgccggcucgaggcccagaaccaggagcgccggaaguccaagagcggcgccgggaagggcaagcugacccgcucccuggccgucugcgaggagagcuccgcccggccgggcggggagagccuccaggaccagacccuguga

SEQ ID NO: 26913 - RNA, 1167 nt, Artificial Sequence
  derived and/or modified sequence opt1 from ARR3__Homo_sapiens__NP_004303
augagcaagguguucaagaagaccuccagcaacggcaagcuguccaucuaccucgggaagcgcgacuucgucgaccacguggacaccguggagcccaucgacggcgucgugcugguggacccggaguaccugaagugccggaagcuguucgucaugcucacgugcgccuuccgcuacgggcgggacgaccuggaggugaucggccucaccuuccgcaaggaccuguacgugcagacccugcaggucgugcccgccgagagcuccagcccccaggggccccucaccgugcugcaggagcggcugcuccacaagcugggcgacaacgcguacccguucacgcugcagauggucaccaaccuccccugcuccgugacccugcagcccggccccgaggacgccgggaagccgugcggcaucgacuucgaggucaagagcuucugcgccgagaaccccgaggagaccguguccaagcgcgacuacgugcggcuggugguccgcaaggugcaguucgccccgcccgaggccgggcccggccccagcgcgcagacgauccggcgcuuccuccuguccgcccagccccugcagcuccaggccuggauggaccgggaggugcacuaccacggggagcccaucagcgucaacguguccaucaacaacugcaccaacaaggugaucaagaagaucaagaucagcgucgaccagaucaccgacgugguccuguacucccuggacaaguacaccaagacgguguucauccaggaguucaccgagaccguggccgcgaacagcuccuucagccaguccuucgccgucaccccgauccucgccgccagcugccagaagcgcggccuggcccuggacggcaagcucaagcacgaggacacgaaccuggcgagcuccaccaucauccggcccgggauggacaaggagcugcucggcauccuggugagcuacaaggugcgcgucaaccugaugguguccugcgggggcauccucggcgaccugaccgccagcgacgugggggucgagcugccccucgugcugauccaccccaagccgucccacgaggccgccagcuccgaggacaucgugaucgaggaguucacccggaagggcgaggaggagagccagaaggccgucgaggcggagggggacgagggcuccuga

SEQ ID NO: 26914 - RNA, 1257 nt, Artificial Sequence
  derived and/or modified sequence opt1 from ARRB1__Homo_sapiens__NP_004032
augggcgacaaggggacccgcguguucaagaaggccagccccaacggcaagcugaccgucuaccucgggaagcgggacuucguggaccacaucgaccugguggacccggucgacggcguggugcuggucgaccccgaguaccucaaggagcgccggguguacgugacgcugaccugcgccuuccgcuacgggcgggaggaccuggacguccucggccugaccuuccgcaaggaccuguucguggcgaacgugcaguccuucccgcccgcccccgaggacaagaagccccucacccggcugcaggagcgccugaucaagaagcucggcgagcacgccuaccccuucacguucgagaucccgcccaaccugcccugcagcgucacccugcagcccgggcccgaggacaccggcaaggccugcgggguggacuacgaggugaaggccuucugcgcggagaaccucgaggagaagauccacaagcggaacuccguccgccuggugauccggaaggugcaguacgccccggagcgccccggcccccagcccaccgccgagacgacccggcaguuccugaugagcgacaagccgcuccaccuggaggccucccuggacaaggagaucuacuaccacggggagcccaucagcgucaacgugcacgugaccaacaacaccaacaagacggucaagaagaucaagaucuccgugcgccaguacgcggacaucugccucuucaacaccgcccaguacaagugccccguggccauggaggaggccgacgacaccgucgcccccagcuccaccuucugcaagguguacacgcugaccccguuccuggcgaacaaccgggagaagcgcggccucgcccuggacggcaagcugaagcacgaggacaccaaccucgccagcuccacccugcugcgggagggggccaaccgcgagauccucggcaucaucgucagcuacaaggugaaggugaagcuggucgugucccgcgggggccugcucggcgaccuggccagcuccgacguggcggucgagcugcccuucacgcucaugcaccccaagcccaaggaggagccgccccaccgggaggugcccgagaacgagacccccguggacaccaaccugaucgagcuggacaccaacgacgacgacaucgucuucgaggacuucgcccggcagcgccucaaggggaugaaggacgacaaggaggaggaggaggacggcacggggagcccgcagcugaacaaccgcuga

SEQ ID NO: 26915 - RNA, 993 nt, Artificial Sequence
  derived and/or modified sequence opt1 from ARRB2__Homo_sapiens__NP_001244258
augggcgagaagcccgggacccgcguguucaagaaguccagccccaacugcaagcugaccgucuaccucggcaagcgggacuucguggaccaccuggacaagguggaccccgucgacgggguggugcuggucgaccccgacuaccucaaggaccgcaagguguucgugacgcugaccugcgccuuccgguacggccgcgaggaccuggacguccucgggcugagcuuccggaaggaccuguucaucgccaccuaccaggccuucccgcccgugcccaacccgccccggccgcccacccgccuccaggaccgccugcugcggaagcucggccagcacgcccaccccuucuucuucacgaucccccagaaccugcccugcuccgugacccugcagcccggccccgaggacaccgggaaggccugcggcgucgacuucgagauccgcgccuucugcgccaagagccucgaggagaagucccacaagcggaacagcgugcgccuggugauccggaagguccaguucgcccccgagaagccggggccccagcccuccgccgagaccacgcgccacuuccugaugagcgaccggucccuccaccuggaggccagccuggacaaggagcucuacuaccacggcgagccccugaacgugaacgugcacgucaccaacaacuccaccaagaccgugaagaagaucaaggugagcguccgccaguacgccgacaucugccuguucuccacggcgcaguacaagugcccgguggcccagcucgagcaggacgaccagcgggagggcgggugccagcagggcggggccggcaaccccggggugcugcagggccagggcgaggccgggggcgucagccgccgggggugccugugcggcgccgcguucugcuccuacgcgccccaggcgccccgcccgcacccgccgccccagacccccgugagccgguccggggaccgcugccccugcggccaccagccccacuga

SEQ ID NO: 26916 - RNA, 1209 nt, Artificial Sequence
  derived and/or modified sequence opt1 from ARRDC2__Homo_sapiens__NP_001020775
augcgcagcggcggggugcgguccuucgcccuggagcucgcccgcggccccgggggcgcguaccgcgggggcgagcgccugugcggccggguccugcucgaggccgccgccccgcugcgcgugcgggcccuggaggugaaggcgcgcgggggcgccgccacccacuggcucgaggggcggagcgucggcgugaacgccguguccagcgacuacgcggccgccgagaccuaccugcgccggcgccagcugcuccugcgggacacgggggagaccaccacccugccgcccggccgccacgaguuccucuucuccuuccagcugccgcccacgcuggucaccagcuucgagggcaagcacggguccgugcgguacugcaucaaggccacccuccaccgccccugggugcccgcccggcgcgcgcggaaggucuucaccgugaucgagcccguggacaucaacacgcccgcccugcuggcgccccaggccggcgcccgcgagaaggucgcccggagcugguacugcaaccgcgggcucgugucccugagcgccaagaucgaccgcaagggcuacacccccggcgaggugauccccgucuucgccgagaucgacaacggguccacccggccggugcugccccgcgccgccgugguccagacccagacguucauggcgcggggcgcccgcaagcagaagcgggccgugguggccagccucgccggggagcccgucggccccgggcagcgcgcgcuguggcagggccgggcccugcgcaucccgcccgugggccccuccauccuccacugccgggugcugcacgucgacuacgcccugaaggugugcgucgacauccccgggaccagcaagcuccugcuggagcucccgcuggugaucggcaccaucccccugcaccccuucgggucccgcagcuccagcgugggcucccacgccagcuuccuccuggacuggcggcugggggcgcuccccgagcgcccggaggccccgcccgaguacagcgaggucguggccgacaccgaggaggccgcccugggccagucccccuucccccugccccaggaccccgacaugagccucgagggcccguucuucgcguacauccaggaguuccgguaccggcccccgccccuguacuccgaggaggaccccaacccccugcucggggacaugcggccccgcugcaugacgugcuga

SEQ ID NO: 26917 - RNA, 1245 nt, Artificial Sequence
  derived and/or modified sequence opt1 from ARRDC3__Homo_sapiens__NP_065852
auggugcugggcaaggucaagagccucaccaucuccuucgacugccugaacgacagcaacgugcccguguacuccagcggggacaccgucuccggccgcgugaaccuggaggugacgggggagauccgggucaagagccucaagauccacgcccgcggccacgccaaggugcgguggaccgagucccgcaacgcggggagcaacaccgccuacacccagaacuacacggaggagguggaguacuucaaccacaaggacauccugaucggccacgagcgggacgacgacaacuccgaggagggcuuccacaccauccacagcgggcgccacgaguacgccuucuccuucgagcugccgcagacgccccucgccaccagcuucgagggccggcacggguccguccgcuacugggugaaggccgagcugcaccggcccuggcugcuccccgugaagcugaagaaggaguucaccgucuucgagcacaucgacaucaacaccccgagccugcucagcccccaggcgggcaccaaggagaagacccugugcugcugguucugcacguccgggcccaucucccugagcgccaagaucgagcgcaagggcuacacccccggcgaguccauccagaucuucgccgagaucgagaacugcagcagccggaugguggugccgaaggccgcgaucuaccagacccaggccuucuacgccaaggggaagaugaaggaggucaagcagcucguggccaaccugcgcggcgagucccugagcuccgggaagaccgagacguggaacggcaagcuccugaagaucccgcccgugagccccuccauccuggacugcagcaucauccgggucgaguacucccucaugguguacguggacauccccggcgccauggaccuguuccugaaccucccccuggucaucgggaccaucccccugcaccccuucggcagccgcaccuccagcguguccagccagugcuccaugaacaugaacuggcucagccugucccugccggagcggcccgaggcgccgcccagcuacgccgagguggucaccgaggagcagcgccggaacaaccucgcccccguguccgccugcgacgacuucgagcgcgcccugcaggggccccuguucgcguacauccaggaguuccgguuccucccgccgccccuguacagcgagaucgaccccaaccccgaccaguccgccgacgaccgccccagcugccccagccgguga

SEQ ID NO: 26918 - RNA, 1257 nt, Artificial Sequence
  derived and/or modified sequence opt1 from ARRDC4__Homo_sapiens__NP_899232
augggcggggaggccggcugcgccgccgccgugggggccgagggccgcgucaagagccuggggcucguguucgaggacgagcggaagggcugcuacuccagcggcgagaccguggccgggcacguccugcuggaggccuccgagcccguggcgcuccgcgcccugcggcuggaggcccagggccgcgccaccgcggccugggggccgagcacgugcccccgggccuccgccagcaccgccgcgcucgccguguucuccgaggucgaguaccugaacgugcgccugagccuccgggagccgcccgccggcgaggggaucauccugcugcagcccggcaagcacgaguuccccuuccgcuuccagcuccccuccgagccccuggugaccagcuucaccggcaaguacggguccauccaguacugcguccgggccgugcuggagcgcccgaaggugcccgaccagagcgucaagcgggagcuccagguggugucccacgucgacgugaacacgcccgcccugcugacccccgugcucaagacccaggagaagauggucggcugcugguucuucaccagcgggccggugucccugagcgcgaagaucgagcgcaagggcuacugcaacggcgaggccauccccaucuacgccgagaucgagaacugcuccagccggcugaucgugcccaaggccgccaucuuccagacgcagaccuaccucgcguccgggaagaccaagaccauccgccacauggucgccaacgugcggggcaaccacaucgccagcgggagcacggacaccuggaacggcaagacccugaagaucccgcccgugacccccuccauccuggacugcugcaucauccgcgucgacuacagccucgccguguacauccacauccccggggccaagaagcugaugcuggagcucccccuggucaucggcacgaucccguacaacggcuucgggucccggaacagcuccaucgcgagccaguucuccauggacaugagcuggcugacccucacccugcccgagcagcccgaggcgcccccgaacuacgccgacgugguguccgaggaggaguucagccgccacaucccgcccuacccccagccgcccaacugcgagggcgaggucugcugccccguguucgccugcauccaggaguuccgguuccagcccccgccccuguacuccgagguggacccccaccccagcgacgucgaggagucccagcccgugagcuucauccucuga

SEQ ID NO: 26919 - RNA, 1530 nt, Artificial Sequence
  derived and/or modified sequence opt1 from ARSA__Homo_sapiens__NP_001078895
augagcaugggcgcgccccgcucccugcuccuggcccuggccgccgggcucgccguggcccggccgcccaacaucguccugaucuucgccgacgaccugggcuacggggaccucggcugcuacgggcaccccagcuccaccacccccaaccuggaccagcuggcggccggcggccuccgcuucaccgacuucuacgugccggugagccugugcacccccucccgggccgcccugcucaccgggcgccugcccguccggaugggcauguaccccggggugcuggugccgagcucccgcggcgggcucccccuggaggaggucaccguggcggaggugcuggccgcccggggcuaccucacgggcauggccgggaaguggcaccugggcgucgggcccgagggcgccuuccugcccccgcaccagggcuuccaccgcuuccucgggauccccuacagccacgaccagggccccugccagaaccugaccugcuucccgcccgcgacccccugcgacgggggcugcgaccaggggcuggugcccaucccccuccuggccaaccuguccguggaggcccagccgcccuggcuccccggccuggaggcccgguacauggccuucgcgcacgaccugauggccgacgcccagcgccaggaccggcccuucuuccucuacuacgccagccaccacacccacuacccgcaguucuccggccagagcuucgccgagcgcuccgggcggggccccuucggggacagccugauggagcuggacgcggccgucggcacgcucaugaccgccaucggggaccugggccugcucgaggagacccuggugaucuucaccgccgacaacggccccgagacgaugcgcaugucccgcgggggcugcagcgggcugcuccggugcggcaaggggaccaccuacgagggcggcgugcgggagcccgcccuggcguucuggccggggcacaucgcccccggcgucacccacgagcuggccuccagccucgaccugcugcccacgcucgccgcgcuggccggggccccgcugcccaacgugacccucgacggcuucgaccuguccccgcugcugcucggcaccggcaagagcccccgccagagccuguucuucuaccccuccuaccccgacgaggugcgcggggucuucgccgugcggaccgggaaguacaaggcccacuucuucacgcagggcagcgcgcacuccgacaccaccgccgaccccgccugccacgccagcuccagccugaccgcccacgagcccccgcuccuguacgaccuguccaaggaccccggggagaacuacaaccuccugggcggcguggcgggggccacgcccgagguccugcaggcccucaagcagcugcagcugcucaaggcccagcuggacgccgcggugaccuucggccccagccagguggcccgcggggaggacccggcccugcagaucugcugccaccccggcugcacgccccggcccgccugcugccacugcccggacccccacgcguga

SEQ ID NO: 26920 - RNA, 1602 nt, Artificial Sequence
  derived and/or modified sequence opt1 from ARSB__Homo_sapiens__NP_000037
augggcccccgcggggccgccagccugccgcggggccccgggccccgccggcuccugcugcccgugguccucccgcugcugcuccugcugcuccuggcgccgcccggcuccggggccggcgccagccgcccgccccaccugguguuccuccuggccgacgaccugggcuggaacgacgugggguuccacggcucccggauccgcacgccccaccucgacgcccuggcggccgggggcguccugcucgacaacuacuacacccagccccugugcacccccagccggucccagcugcucaccgggcgcuaccagauccggaccggccugcagcaccagaucaucuggcccugccagcccagcugcgugccccuggacgagaagcuccugccccagcugcucaaggaggccggcuacaccacgcacaugguggggaaguggcaccugggcauguaccgcaaggagugccugccgacccggcgcggguucgacaccuacuucggcuaccuccugggcuccgaggacuacuacagccacgagcggugcacccugaucgacgcccucaacgucacgcgcugcgcgcuggacuuccgggacggggaggagguggccaccggcuacaagaacauguacuccaccaacaucuucaccaagcgcgccaucgcccugaucacgaaccacccgcccgagaagccccucuuccuguaccuggcccuccagagcgugcacgagccccugcagguccccgaggaguaccugaagcccuacgacuucauccaggacaagaaccggcaccacuacgcggggauggugucccucauggacgaggccgugggcaacgucaccgccgcccucaagagcuccgggcuguggaacaacaccguguucaucuucagcaccgacaacggcggccagacgcucgccgggggcaacaacuggccccugcgcgggcggaaguggucccugugggagggcggggugcgcggcgucggcuucguggcgagcccgcuccugaagcagaagggggugaagaaccgggagcugauccacaucuccgacuggcugcccacccucgucaagcuggcccgcggccacaccaacgggaccaagccccuggacggcuucgacguguggaagacgaucagcgaggggucccccagcccgcgcaucgagcuccugcacaacaucgaccccaacuucguggacagcucccccugcccgcggaacagcauggcccccgccaaggacgacuccagccugcccgaguacuccgccuucaacaccagcguccacgcggccauccgccacggcaacuggaagcuccugaccggcuaccccgggugcggcuacugguucccgccgcccucccaguacaacgugagcgagauccccuccagcgacccgcccaccaagacgcuguggcuguucgacaucgaccgggaccccgaggagcgccacgaccugucccgggaguacccccacaucgugaccaagcugcucagccgccugcaguucuaccacaagcacuccguccccguguacuuccccgcccaggacccccggugcgaccccaaggccaccggggucuggggcccguggauguga

SEQ ID NO: 26921 - RNA, 1782 nt, Artificial Sequence
  derived and/or modified sequence opt1 from ARSD__Homo_sapiens__NP_001660
augcgcagcgccgcccggcgcggccgggcggcccccgccgcccgcgacucccugccggugcuccuguuccugugccuccugcugaagaccugcgagcccaagaccgccaacgcguucaagcccaacauccuccugaucauggccgacgaccuggggacgggcgaccucgggugcuacggcaacaacacccugcggacccccaacaucgaccagcuggccgaggaggggguccgccucacccagcaccuggccgcggccccgcugugcacgcccagccgggccgccuuccucaccggccgccacuccuuccggagcggcauggacgccuccaacggguaccgcgcgcugcaguggaacgccggcagcgggggccugcccgagaacgagaccaccuucgcccggauccuccagcagcacggguacgccacgggccugaucggcaaguggcaccagggggugaacugcgccucccgcggcgaccacugccaccacccccugaaccacggguucgacuacuucuacggcaugccguucacccucaccaacgacugcgaccccggccggccgcccgagguggacgcggcccugcgcgcccagcuguggggguacacccaguuccucgcccugggcauccugacgcucgccgcggggcagaccugcggcuucuucagcgucuccgcccgggccgugaccgggauggccggcgugggcugccuguucuucaucagcugguacuccagcuucggguucguccgccgguggaacugcauccugaugcgcaaccacgacgugaccgagcagcccauggugcucgagaagacggccucccugaugcugaaggaggcggucagcuacaucgagcggcacaagcacggccccuuccuccuguuccugucccuccugcacgugcacaucccccuggugaccaccagcgccuuccucgggaagucccagcacggccuguacggggacaacgucgaggagauggacuggcugaucggcaaggugcucaacgccaucgaggacaacggccugaagaacagcaccuucacguacuucaccuccgaccacgggggccaccuggaggcccgcgacgggcacagccagcucggcggguggaacggcaucuacaagggcgggaagggcaugggcgggugggagggcgggauccgggugcccggcaucuuccacuggccggggguccugcccgcgggccgcgugaucggggagcccaccagccugauggacguguuccccaccgucgugcagcucgugggcggcgaggucccgcaggaccgcgugaucgacgggcacucccuggugccccugcugcagggcgccgaggcccggagcgcccacgaguuccucuuccacuacugcgggcagcaccuccacgccgcgcgcuggcaccagaaggacuccggcagcgucuggaaggugcacuacacgacgccccaguuccaccccgagggggccggcgccugcuacggccgcggggucugcccgugcuccggcgagggggugacccaccaccggccgccccugcuguucgaccugagccgggaccccuccgaggcccgcccccugacccccgacagcgagccccucuaccacgccgugaucgcgcgggucggcgccgccguguccgagcaccgccagacccugagcccggugccccagcaguucuccaugagcaacauccuguggaagcccuggcuccagcccugcugcgggcacuucccguucugcuccugccacgaggacggcgacggcacccccuga

SEQ ID NO: 26922 - RNA, 1845 nt, Artificial Sequence
  derived and/or modified sequence opt1 from ARSE__Homo_sapiens__NP_001269557
augcgccccgugaucaaccggugcgccccgggcagccuggaccucaugcugccccaggccgcguccgaggggaucgucuuccacagccugcagaucucccucugcuuccgcagcuggcugcccgccaugcuggccgugcuccugucccuggcccccagcgccuccagcgacaucuccgcgagccggccgaacauccuccugcugauggccgacgaccucggcaucggggacaucggcugcuacgggaacaacaccaugcgcacccccaacaucgaccggcuggccgaggacggcgugaagcugacgcagcacaucuccgccgcgagccucugcacccccucccgcgccgccuuccugaccggccgguaccccguccgcagcgggaugguguccagcaucggcuaccgggugcugcaguggaccggggccuccggcgggcucccgacgaacgagaccaccuucgccaagauccugaaggagaagggcuacgcgaccggccugaucgggaaguggcaccucggccugaacugcgagagcgccuccgaccacugccaccacccccugcaccacggguucgaccacuucuacggcaugcccuucagccucaugggcgacugcgcccgcugggagcugagcgagaagcgggucaaccuggagcagaagcucaacuuccuguuccaggugcuggcccucguggcccugacgcuggucgcggggaagcucacccaccugauccccguguccuggaugccggugaucuggagcgcccuguccgccguccuccugcuggccagcuccuacuucgugggcgcccucaucgugcacgcggacugcuuccugaugcgcaaccacaccaucaccgagcagcccaugugcuuccagcggacgacgccccugauccuccaggaggucgccagcuuccugaagcgcaacaagcacgggcccuuccuccuguucguguccuuccugcacgugcacaucccgcugaucaccauggagaacuuccucggcaagagccugcacgggcuguacggcgacaacgucgaggagauggacuggauggugggccggauccuggacacccucgacguggaggggcuguccaacagcacccugaucuacuucaccuccgaccacggcgggagccucgagaaccagcugggcaacacccaguacgggggcuggaacggcaucuacaagggcgggaaggggaugggcgggugggagggcggcauccgcguccccgggaucuuccgguggcccggcgugcugcccgccgggcgcgugaucggcgagccgaccucccucauggacgucuuccccacggugguccggcuggccggcggggaggugccccaggaccgcgugaucgacggccaggaccugcucccccugcugcucgggaccgcccagcacagcgaccacgaguuccugaugcacuacugcgagcgguuccugcacgcggcccgcuggcaccagcgcgaccggggcaccauguggaagguccacuucgugaccccgguguuccagcccgagggggccggcgccugcuacggccgcaaggucugccccugcuucggggagaagguggugcaccacgacccgccccuccuguucgaccugucccgggaccccagcgagacgcacauccucacccccgcguccgagccggucuucuaccaggugauggagcgcgugcagcaggccgucugggagcaccagcggacccugagccccgugccccugcagcucgaccgccugggcaacaucuggcggcccuggcugcagccgugcugcgggcccuucccccucugcuggugccugcgcgaggacgacccccaguga

SEQ ID NO: 26923 - RNA, 1773 nt, Artificial Sequence
  derived and/or modified sequence opt1 from ARSF__Homo_sapiens__NP_004033
augcgcccccggcgcccgcugguguucaugagccucgucugcgcccugcugaacacgugccaggcccaccgggugcacgacgacaagcccaacaucgugcucaucauggucgacgaccugggcaucggggaccugggcugcuacgggaacgacaccaugcgcacgccccacaucgaccggcucgcgcgcgagggcgugcggcugacccagcacaucuccgccgccagccugugcucccccagccgcuccgccuuccucaccgggcgguacccgauccgcagcggcaugguguccagcggcaaccggcgcgucauccagaaccuggccgugcccgcggggcugccccucaacgagaccacccuggccgcccugcucaagaagcagggcuacuccaccgggcugaucggcaaguggcaccaggggcugaacugcgacagccgguccgaccagugccaccaccccuacaacuacggcuucgacuacuacuacggcaugccguucacccucguggacagcugcuggcccgaccccucccgcaacaccgagcuggccuucgagagccagcuguggcucugcguccagcugguggcgaucgccauccugacgcucaccuucgggaagcuguccggcugggugagcguccccuggcugcucaucuucuccaugauccuguucaucuuccugcucggguacgccugguucagcucccacaccagcccgcuguacugggacugccugcucaugcggggccacgagaucaccgagcagcccaugaaggccgagcgcgccggcagcaucauggugaaggaggcgaucuccuuccuggagcggcacagcaaggagacguuccuccuguucuucuccuuccugcacgugcacacgccccugcccaccaccgacgacuucaccgggaccagcaagcacggccucuacggggacaacgucgaggagauggacuccauggugggcaagauccuggacgccaucgacgacuucgggcugcgcaacaacacccucguguacuucaccagcgaccacggcggccaccuggaggcccggcgcgggcacgcccagcugggcggguggaacggcaucuacaagggcgggaagggcaugggcgggugggagggcgggauccgggucccggggaucgugcgcuggcccggcaaggugcccgccggccgccucaucaaggagcccacgucccugauggacauccugccgaccgucgcgagcguguccgggggcagccucccccaggaccgggugaucgacgggcgcgaccugaugccccugcugcagggcaacguccggcacuccgagcacgaguuccucuuccacuacugcggcagcuaccugcacgccgugcgcuggauccccaaggacgacuccgggagcgucuggaaggcccacuacgugaccccgguguuccagccgcccgccuccggcgggugcuacgucaccagccugugccggugcuucggcgagcaggucacguaccacaacccgccccuccuguucgaccugucccgcgaccccagcgaguccacgccccucacccccgccaccgagccccugcacgacuucgugaucaagaagguggcgaacgcccugaaggagcaccaggagaccaucgugcccgugaccuaccagcucagcgagcugaaccaggggcggaccuggcugaagcccugcugcggcgucuucccguucugccucugcgacaaggaggaggaggugagccagccccgcggccccaacgagaagcgguga

SEQ ID NO: 26924 - RNA, 1578 nt, Artificial Sequence
  derived and/or modified sequence opt1 from ARSG__Homo_sapiens__NP_055775
augggcuggcuguuccucaaggugcugcuggccggggucagcuucuccggcuuccucuacccccugguggacuucugcaucagcgggaagacccgcggccagaagccgaacuucgugaucauccuggccgacgacaugggguggggcgaccucggcgcgaacugggccgagaccaaggacacggccaaccuggacaagauggccuccgaggggaugcgguucgucgacuuccacgccgcggccagcacgugcucccccagccgcgccucccugcucaccggccggcuggggcugcgcaacggcgugacccggaacuucgccgugaccagcgucgggggccucccccugaacgagaccacccuggcggaggugcuccagcaggccggcuacgugaccgggaucaucggcaaguggcaccuggggcaccacggcuccuaccaccccaacuuccgcggcuucgacuacuacuucgggaucccguacagccacgacaugggcugcacggacacccccggguacaaccacccgcccugccccgccugcccccagggcgacgggcccucccggaaccugcagcgcgacugcuacaccgacgucgcccucccccuguacgagaaccugaacaucguggagcagccggugaaccucagcucccuggcccagaaguacgcggagaaggccacccaguucauccagcgggccagcacguccggccgccccuuccugcucuacgucgcccuggcccacaugcacgugccccugcccgugacccagcucccggcggcgccccggggccgcagccuguacggggccggccugugggagauggacucccucgucgggcagaucaaggacaagguggaccacaccgugaaggagaacaccuuccugugguucacgggcgacaacgggcccugggcccagaagugcgagcuggccggcagcgucggccccuucaccggguucuggcagacccggcagggcggguccccggccaagcagaccacgugggagggcgggcaccgcgugcccgcccucgccuacuggcccggccgggugcccgucaacgugaccagcaccgcccugcugagcgugcucgacaucuucccgaccgucguggcccuggcgcaggccucccugccccagggccgccgguucgacggggucgacgugagcgagguccucuucggccgcucccagcccgggcaccgggugcuguuccaccccaacagcggcgccgccggcgaguucggggcgcugcagacggugcgccucgagcgguacaaggccuucuacaucaccggcggggcccgcgccugcgacggcuccaccgggccggagcugcagcacaaguucccccugaucuucaaccucgaggacgacaccgccgaggcggugccccuggagcgcggcggcgccgaguaccaggccguccugccggaggugcggaaggugcucgccgacguccugcaggacaucgccaacgacaacaucagcuccgcggacuacacgcaggaccccagcgugacccccugcugcaaccccuaccagaucgccugccgcugccaggccgccuga

SEQ ID NO: 26925 - RNA, 1689 nt, Artificial Sequence
  derived and/or modified sequence opt1 from ARSH__Homo_sapiens__NP_001011719
augacccgcaacgcccggcccaacaucgugcugcucauggccgacgaccugggcgucggggaccugugcugcuacggcaacaacagcguguccaccccgaacaucgaccgccucgcgagcgagggggugcggcugacgcagcaccuggccgccgccuccaugugcacccccagccgcgccgcguuccucaccggccgguaccccauccgcuccgggauggucagcgccuacaaccugaaccgggccuucaccuggcugggcggcuccgggggccuccccacgaacgagaccaccuucgccaagcugcugcagcaccgcggguaccggaccggccucaucgggaaguggcaccugggccugagcugcgcgucccgcaacgaccacugcuaccacccgcucaaccacggcuuccacuacuucuacggggugcccuucggccugcugagcgacugccaggccuccaagacgcccgagcuccaccgguggcugcgcaucaagcuguggaucagcaccguggcccucgcccugguccccuuccugcuccugaucccgaaguucgcccggugguucuccgugcccuggaaggugaucuucgucuucgcgcugcucgccuuccuguucuucaccagcugguacuccagcuacggguucacccgccgguggaacugcauccugaugcgcaaccacgagaucauccagcagcccaugaaggaggagaagguggccucccucaugcugaaggaggcccuggccuucaucgagcgguacaagcgcgagcccuuccuccuguucuucagcuuccugcacgugcacacgccgcucaucuccaagaagaaguucgucggccggagcaaguacggccgcuacggggacaacguggaggagauggacuggauggugggcaagauccuggacgcgcuggaccaggagcggcucgccaaccacacccuggucuacuucaccagcgacaacgggggccaccuggagccccucgacggggccgugcagcugggcggcuggaacgggaucuacaagggcgggaagggcaugggcgggugggagggcgggauccgcgugcccggcaucuuccgcuggcccuccguccuggaggccgggcgggugaucaacgagccgaccagccucauggacaucuaccccacgcuguccuacaucggcgggggcauccugagccaggaccgcgugaucgacggccagaaccucaugccccugcuggaggggcgggccucccacagcgaccacgaguuccuguuccacuacugcggcgucuaccuccacaccgugcgcuggcaccagaaggacugcgcgaccguguggaaggcccacuacgucacccccaaguucuacccggaggggacgggcgccugcuacggcuccgggaucugcagcugcuccggcgacgugaccuaccacgacccgccccugcuguucgacaucagccgggaccccuccgaggcccucccccugaaccccgacaacgagccccuguucgacagcgucaucaagaagauggaggccgcgauccgcgagcaccggcgcacccucacccccgugccgcagcaguucuccguguucaacacgaucuggaagcccuggcugcagcccugcugcgggaccuucccguucugcggcugcgacaaggaggacgacauccugcccauggcccccuga

SEQ ID NO: 26926 - RNA, 1710 nt, Artificial Sequence
  derived and/or modified sequence opt1 from ARSI__Homo_sapiens__NP_001012301
augcacacccugaccggcuucagccucgugucccugcugagcuucggguaccucuccugggacugggccaagcccagcuucgucgccgacggcccgggggaggcgggcgagcagcccuccgccgccccgccccagccgccccacaucaucuucauccugacggacgaccagggguaccacgacgugggcuaccacggcagcgacaucgagacccccacccuggaccgccucgccgccaagggggugaagcuggagaacuacuacauccagcccaucugcacccccucccggagccagcugcucacgggccgcuaccagauccacaccgggcugcagcacuccaucauccggccccagcagcccaacugccugccccucgaccaggucacccugccgcagaagcugcaggaggcgggcuacagcacccacaugguggggaaguggcaccucggcuucuaccgcaaggagugccugcccacgcggcgcggcuucgacaccuuccuggggucccucaccggcaacguggacuacuacaccuacgacaacugcgacgggcccggcgucugcggcuucgaccugcacgagggggagaacguggccuggggccugagcgggcaguacuccacgaugcucuacgcccagcgggccagccacauccuggcgucccacagcccccagcgcccgcuguuccucuacguggccuuccaggccguccacacgccccugcagagcccccgggaguaccuguaccgcuaccggaccaugggcaacguggcccgccggaaguacgccgcgauggugaccugcauggacgaggccguccgcaacaucaccugggcccucaagcgguacggguucuacaacaacuccgugaucaucuucuccagcgacaacggcggccagaccuucagcgggggcuccaacuggccccugcgcgggcggaagggcaccuacugggagggcggggugcgcggccugggguucguccacagcccgcuccugaagcggaagcagcgcaccucccgggcccugaugcacaucacggacugguaccccacccucgugggccuggccgggggcaccaccagcgcggccgacgggcuggacggcuacgacguguggcccgccaucuccgagggccgcgccagcccccgcacggagauccuccacaacaucgacccgcuguacaaccacgcccagcacgggucccuggagggcggguucggcaucuggaacaccgcgguccaggccgccauccgggugggcgaguggaagcuccugaccggggaccccggcuacggggacuggaucccgccccagacccuggccacguuccccggcagcugguggaaccucgagcgcauggccuccgugcggcaggcggucuggcuguucaacaucagcgccgaccccuacgagcgcgaggaccuggccgggcagcggcccgacguggugcgcacccuccuggcccggcuggcggaguacaaccgcaccgccaucccgguccgguaccccgccgagaacccccgcgcccaccccgacuucaacggcggcgccugggggccgugggcguccgacgaggaggaggaggaggaggagggccgggcccgcagcuucucccgggggcgccggaagaagaagugcaagaucugcaagcuccgcagcuucuuccggaagcugaacacccgccugaugucccagcggaucuga

SEQ ID NO: 26927 - RNA, 1800 nt, Artificial Sequence
  derived and/or modified sequence opt1 from ARSJ__Homo_sapiens__NP_078866
auggcgccccgcggcugcgccgggcacccgcccccgcccagcccccaggccugcgugugccccggcaagaugcuggccaugggggcccucgccggcuucuggauccugugccugcucaccuacggguaccuguccuggggccaggcccuggaggaggaggaggagggcgcgcuccuggcccaggccggggagaagcuggagcccagcaccacguccaccagccagccccaccucaucuucauccuggccgacgaccagggcuuccgggacgucggguaccacggcuccgagaucaagaccccgacccuggacaagcucgcggccgagggggugaagcuggagaacuacuacgugcagcccaucugcacgcccagccgcucccaguucaucaccggcaaguaccagauccacaccggccugcagcacagcaucauccggcccacccagccgaacugccucccccuggacaacgccacgcugccccagaagcucaaggaggucggguacuccacccacauggugggcaaguggcaccugggguucuaccgcaaggagugcaugcccacccggcgcggcuucgacaccuucuucggcagccugcucggguccggcgacuacuacacgcacuacaagugcgacagcccggggaugugcggcuacgaccuguacgagaacgacaacgccgccugggacuacgacaacgggaucuacuccacccagauguacacccagcgggugcagcagauccuggcgagccacaaccccaccaagcccaucuuccucuacaucgccuaccaggccguccacagcccccugcaggccccgggccgcuacuucgagcacuaccggagcaucaucaacaucaaccgccggcgcuacgccgcgaugcuguccugccucgacgaggccaucaacaacgugacgcuggcccugaagaccuacggcuucuacaacaacagcaucaucaucuacuccagcgacaacgggggccagcccaccgccgggggcagcaacuggccccuccggggguccaagggcaccuacugggagggcgggauccgcgccgugggcuucguccacagcccccugcugaagaacaaggggacggugugcaaggagcucgugcacaucaccgacugguacccgacccugaucucccuggcggagggccagaucgacgaggacauccagcucgacggguacgacaucugggagaccaucagcgagggccugcggagcccccgcgucgacauccugcacaacaucgaccccaucuacacgaaggccaagaacggcuccugggccgccggguacggcaucuggaacaccgccauccaguccgcgauccgggugcagcacuggaagcuccugaccgggaaccccggcuacagcgacugggugccgccccaguccuucagcaaccugggccccaaccgcuggcacaacgagcggaucacccucuccacggggaaguccgucuggcuguucaacaucaccgccgacccguacgagcgcguggaccuguccaaccgguaccccggcaucgugaagaagcuccugcgccgccugagccaguucaacaagaccgccguccccgugcgguacccgcccaaggacccccgcuccaacccccggcucaacgggggcgugugggggcccugguacaaggaggagaccaagaagaagaagccgagcaagaaccaggccgagaagaagcagaagaaguccaagaagaagaagaagaagcagcagaaggcggucagcggcuccacgugccacagcggcgugaccugcggguga

SEQ ID NO: 26928 - RNA, 1611 nt, Artificial Sequence
  derived and/or modified sequence opt1 from ARSK__Homo_sapiens__NP_937793
augcugcuccugugggugagcgucguggccgcccuggcgcucgccgugcuggcccccggcgccggggagcagcgccggcgcgccgcgaaggccccgaacgucgugcugguggucuccgacagcuucgacggccggcucaccuuccaccccgggucccagguggugaagcugcccuucaucaacuucaugaagacccgcggcacgagcuuccugaacgccuacaccaacucccccaucugcugcccgagccgggccgcgaugugguccggccucuucacccaccugaccgagagcuggaacaacuucaaggggcuggaccccaacuacacgaccuggauggacgucauggagcgccacggcuaccggacccagaaguucgggaagcucgacuacaccuccggccaccacagcaucuccaaccgcguggaggccuggacgcgggacguggccuuccugcugcgccaggaggggcggcccauggucaaccucauccgcaaccggaccaaggugcgcgugauggagcgggacuggcagaacaccgacaaggccgucaacuggcugcgcaaggaggccaucaacuacaccgagcccuucgugaucuaccugggccucaaccugccgcaccccuaccccagccccuccagcggggagaacuucggcuccagcacguuccacaccucccuguacuggcucgagaaggugagccacgacgcgaucaagaucccgaaguggagcccccuguccgagaugcaccccgucgacuacuacagcuccuacaccaagaacugcaccggccgguucacgaagaaggagaucaagaacauccgcgccuucuacuacgccaugugcgccgagaccgacgccaugcugggggagaucauccucgcgcugcaccagcuggaccuccugcagaagaccaucgugaucuacagcuccgaccacggcgagcuggccauggagcaccggcaguucuacaagaugagcauguacgaggccuccgcccacgugccccuccugaugauggggccgggcaucaaggccggccugcaggucagcaacguggugucccucgucgacaucuaccccaccaugcuggacaucgcggggaucccccugccccagaaccucagcggcuacucccugcugccgcucagcuccgagacguucaagaacgagcacaaggugaagaaccugcacccgcccuggauccugagcgaguuccacgggugcaacgucaacgccuccaccuacaugcuccgcaccaaccacuggaaguacaucgccuacagcgacggcgccuccauccugccccagcuguucgaccucagcuccgaccccgacgagcugaccaacguggccgugaaguuccccgagaucacguacagccuggaccagaagcuccacuccaucaucaacuaccccaaggucagcgcgagcgugcaccaguacaacaaggagcaguucaucaaguggaagcaguccaucgggcagaacuacagcaacgugaucgccaaccugcgguggcaccaggacuggcagaaggagccccgcaaguacgagaacgccaucgaccaguggcugaagacccacaugaacccgcgcgccgucuga

SEQ ID NO: 26929 - RNA, 984 nt, Artificial Sequence
  derived and/or modified sequence opt1 from ART1__Homo_sapiens__NP_004305
augcagaugcccgccaugaugagccugcuccugguguccgucggccugauggaggcccuccaggcgcagagccaccccaucacccgccgggaccuguucucccaggagauccagcuggacauggcccucgccagcuucgacgaccaguacgccgggugcgccgcggccaugaccgccgcccugcccgaccugaaccacacggaguuccaggcgaaccagguguacgccgacuccuggacccucgccagcucccaguggcaggagcgccaggcccgguggcccgaguggagccugucccccacccgcccguccccgccgccccugggcuuccgggacgagcacgggguggcccuccuggcguacaccgccaacagcccccugcacaaggaguucaacgccgccguccgcgaggccggccggagccgcgcgcacuaccuccaccacuucuccuucaagacgcugcacuuccugcucaccgaggcccugcagcugcucgggagcggccagcggccgccccgcugccaccagguguuccggggcgugcacgggcugcgcuuccggcccgccggcccccgcgccaccguccggcucgggggcuucgccuccgcgagccugaagcacguggccgcccagcaguucggggaggacaccuucuucggcaucuggacgugccugggcgcccccaucaagggguacuccuucuuccccggcgaggaggaggugcugaucccgcccuucgagaccuuccaggucaucaacgccagccgccucgcgcaggggcccgcccggaucuaccugcgcgcccugggcaagcacuccaccuacaacugcgaguacaucaaggacaagaagugcaagagcggccccugccaccucgacaacagcgccauggggcaguccccgcugagcgcgguguggucccugcuccugcugcucugguuccuggugguccgggccuuccccgacggccccgggcugcucuga

SEQ ID NO: 26930 - RNA, 1170 nt, Artificial Sequence
  derived and/or modified sequence opt1 from ART3__Homo_sapiens__NP_001123488
augaagaccggccacuucgagaucgugaccaugcugcucgccacgaugauccuggucgacaucuuccaggugaaggccgaggugcuggacauggcggacaacgccuucgacgacgaguaccucaagugcaccgaccgcauggagaucaaguacgucccccagcugcugaaggaggagaaggccagccaccagcagcucgacaccgugugggagaacgccaaggccaagugggcggcccggaagacccagaucuuccugccgaugaacuucaaggacaaccacgggaucgcccugauggccuacaucuccgaggcgcaggagcagacgcccuucuaccaccucuucagcgaggccgugaagauggccggccagucccgcgaggacuacaucuacggguuccaguucaaggccuuccacuucuaccugacccgggcccugcagcuccugcgcaagcccugcgaggcgagcuccaagaccgucguguaccggaccagccagggcacguccuucaccuucgggggccugaaccaggcccgcuucggccacuucacccucgccuacagcgccaagccccaggccgcgaacgaccagcugaccgugcuguccaucuacacgugccucggggucgacaucgagaacuuccuggacaaggagagcgagcggaucacccugaucccgcucaacgagguguuccaggugucccaggagggcgccgggaacaaccugauccugcagagcaucaacaagaccugcucccacuacgagugcgccuuccucggcgggcugaagaccgagaacugcaucgagaaccuggaguacuuccagcccaucuacgucuacaaccccggcgagaagaaccagaagcucgaggaccacagcgagaagaacuggaagcuggaggaccacggcgagaagaaccagaagcuggaggaccacggggugaagauccucgagcccacgcagaucccgggcaugaagauccccgagcccuucccccugccggaggacaagucccaggggaacaucaacaaccccacccccggccccgugccgguccccggccccaagagccaccccuccgccagcuccgggaagcugcuccugccgcaguucggcauggugaucauccugaucagcgugagcgccaucaaccucuucgucgcgcuguga

SEQ ID NO: 26931 - RNA, 945 nt, Artificial Sequence
  derived and/or modified sequence opt1 from ART4__Homo_sapiens__NP_066549
augggcccccugaucaaccgcugcaagaagauccuccugccgaccaccgugccgcccgccacgaugcggaucuggcugcucgggggccugcugcccuuccuccugcugcucagcgggcugcagcgccccaccgagggcuccgaggucgccaucaagaucgacuucgacuucgcgcccgggagcuucgacgaccaguaccagggcugcuccaagcaggucauggagaagcugacccagggcgacuacuucaccaaggacaucgaggcccagaagaacuacuuccggauguggcagaaggcccaccucgccuggcugaaccaggggaaggugcugccccagaacaugacgaccacccacgccguggcgauccucuucuacacccugaacagcaacgugcacuccgacuucacgcgcgccauggccagcguggcccggacgccccagcaguacgagcgcuccuuccacuucaaguaccugcacuacuaccucaccagcgcgauccagcugcugcggaaggacuccaucauggagaacggcacccucugcuacgagguccacuaccgcaccaaggacgugcacuucaacgccuacaccggggccaccauccgguucggccaguuccugagcaccucccugcucaaggaggaggcccaggaguucgggaaccagacgcuguucaccaucuucacgugccugggcgccccggugcaguacuucagccucaagaaggagguccugaucccgcccuacgagcuguucaaggugaucaacauguccuaccacccccgcggcgacuggcuccagcugcggagcaccgggaaccuguccaccuacaacugccagcuccugaaggcgagcuccaagaagugcauccccgaccccaucgccaucgccagccuguccuuccucaccagcgugaucaucuucagcaagucccgcgucuga

SEQ ID NO: 26932 - RNA, 2871 nt, Artificial Sequence
  derived and/or modified sequence opt1 from ARVCF__Homo_sapiens__XP_005261300
auggaggacugcaacgugcacagcgccgccuccauccuggccagcgucaaggagcaggaggcccgcuucgagcggcucacccgcgcccuggagcaggagcggcgccacguggcccugcagcucgagcgggcccagcagcccggcaugguguccgggggcauggggagcggccagccgcugcccauggcguggcagcagcugguccuccaggagcagucccccgggagccaggccucccuggccaccaugcccgaggccccggacgugcuggaggagacggugaccgucgaggaggaccccggcacccccaccagccacguguccaucgugacgagcgaggacggcaccacccgccggaccgagacgaaggucaccaagaccgugaagaccgugacgacccgcaccguccgccaggugcccguggggccggacggccucccccugcuggacgggggcccgccccucgggccguucgcggacggcgcccuggaccggcacuuccugcuccggggcgggggccccgucgccacccugucccgcgccuaccugagcuccgggggcggcuuccccgaggggcccgagccgcgggacagccccuccuacggcagccucucccgcgggcugggcaugcggccgccccgcgccgggccccugggccccggccccggggacggcugcuucacgcuccccgggcaccgggaggcguucccggugggccccgagcccgggcccccgggcggccgcagccugcccgagcgguuccaggccgagcccuacgggcuggaggacgacacccgcucccucgccgccgacgacgagggcgggccggagcuggagcccgacuacggcaccgccacccggcgccgccccgagugcgggcggggccugcacacgcgcgcguacgaggacaccgccgacgacggcggggagcucgccgacgagcggcccgccuucccgauggugaccgcgccccuggcccagcccgagcgcggcagcauggggagccuggaccggcucguccgccggucccccagcguggacuccgcccgcaaggagccgcgguggcgcgaccccgagcugcccgaggugcuggccaugcuccggcaccccgucgacccggugaaggccaacgccgcggccuaccugcagcaccugugcuucgagaacgagggcgugaagcgccggguccgccagcuccggggccugccccugcucguggcccugcuggaccacccccgcgccgagguccggcgccgggcgugcggggcccuccgcaaccugagcuacggccgcgacaccgacaacaaggccgccauccgggacugcgggggcgugcccgcccuggugcgccuccugcgggcggcccgcgacaacgagguccgggagcuggugacggggacccucuggaaccuguccagcuacgagccgcugaagauggugaucaucgaccacggccugcagacccucacccacgaggucaucgugccccacuccggcugggagcgcgagcccaacgaggacagcaagccccgggacgccgaguggacgaccguguucaagaacaccuccgggugccugcgcaacgucagcuccgacggcgccgaggcccggcgccggcugcgcgagugcgaggggcucguggacgcgcugcugcacgcccuccagagcgccgugggccggaaggacaccgacaacaaguccgucgagaacugcgugugcaucaugcgcaaccugagcuaccacgugcacaaggaggucccgggggccgaccgguaccaggaggccgagcccggcccccugggcuccgcgguggggagccagcgccggcgccgggacgacgccuccugcuucggcgggaagaaggccaagggcaagaaggacggggagauggaccgcaacuucgacacgcucgaccugcccaagcggaccgaggccgcgaagggcuucgagcugcucuaccagccggaggugguccgccuguaccugagccuccugaccgagucccgcaacuucaacacccuggaggccgccgccggcgcccuccagaaccugagcgcggggaacuggaugugggccacguacauccgggccaccgugcgcaaggagcggggccugcccgugcucgucgagcugcugcagagcgagaccgacaagguggugcgcgccgucgccaucgcgcuccggaaccugucccuggaccgccggaacaaggaccucaucgggagcuacgccauggccgagcuggugcgcaacgugcggaacgcccaggcgcccccgcgccccggcgccugccuggaggaggacaccgucguggccgugcucaacaccauccacgagaucgucuccgacagccuggacaacgcccggucccugcuccaggcccgcggggugcccgcgcugguggcccuggucgccagcucccagagcgugcgggaggccaaggccgcgucccacgugcuccagacggucuggagcuacaaggagcugcgcggcacccugcagaaggacggcuggaccaaggcccgguuccaguccgccgccgccaccgcgaaggggcccaagggcgcccucagccccgggggcuucgacgacuccacgcugccccugguggacaagagccucgagggcgagaagaccgggucccgcgacgugauccccauggacgcccugggccccgacggguacagcaccgucgaccggcgcgagcggcgcccgcgcggcgccuccagcgccggggaggcgagcgagaaggagccccugaagcucgaccccucccggaaggcgcccccgcccggccccagccgccccgccgugcggcugguggacgccgucggcgacgccaagccgcagcccguggacuccuggguguga

SEQ ID NO: 26933 - RNA, 1689 nt, Artificial Sequence
  derived and/or modified sequence opt1 from ARX__Homo_sapiens__NP_620689
augagcaaccaguaccaggaggagggcugcuccgagcgccccgagugcaagagcaaguccccgacccugcucagcuccuacugcaucgacagcauccuggggcggcgcucccccugcaagaugcggcugcucggcgccgcccagagccugcccgcgccccugaccucccgcgccgacccggagaaggccgugcaggggagccccaaguccagcuccgcccccuucgaggccgagcuccaccugcccccgaagcugcggcgccucuacggccccgggggcggccggcugcugcagggggcggccgccgccgcggccgccgccgccgcggccgccgccgccgcggccacggccaccgccggcccccgcggggaggcccccccgcccccccccccgaccgcgcggcccggcgagcgccccgacggggccggcgccgccgccgcggccgccgccgcggccgccgccgccugggacacccucaagaucagccaggcgccccaggucuccaucagccgguccaagagcuaccgcgagaacggcgccccguucgugcccccccccccggcccuggacgagcuggggggccccgggggcgugacgcaccccgaggagcggcucggcgucgccgggggccccggguccgccccggcggccggcgggggcaccggcaccgaggacgacgaggaggagcugcuggaggacgaggaggacgaggacgaggaggaggagcuccuggaggacgacgaggaggagcugcucgaggacgacgcccgcgcccugcugaaggagccccggcgcugccccguggccgcgaccggggccguggccgccgcggccgccgccgccgucgcgacggagggcggggagcucagcccgaaggaggagcugcugcuccaccccgaggacgccgagggcaaggacggggaggacagcgugugccuguccgccggcagcgacuccgaggagggccugcucaagcggaagcagcgccgguaccgcaccaccuucaccagcuaccagcuggaggagcuggagcgggccuuccagaagacgcacuaccccgacguguucacccgcgaggagcucgccaugcgccuggaccugaccgaggcgcggguccaggugugguuccagaaccgccgggccaaguggcgcaagcgggagaaggccggggcccagacccaccccccgggccuccccuuccccgggccccuguccgccacgcacccgcugagccccuaccucgacgcgucccccuuccccccgcaccaccccgcccuggacagcgccuggaccgccgcggccgccgccgccgcggccgccuuccccucccugcccccgccccccggcagcgccucccuccccccgagcggggccccccugggccuguccaccuuccucggcgcggccguguuccgccaccccgccuucaucagccccgccuucgggcggcuguucuccaccauggccccgcugacgagcgcguccaccgccgccgcccuccugcgccagcccacccccgccgucgagggcgcgguggccagcggggcccuggccgacccggcgaccgccgccgccgaccggcgcgccuccagcaucgcggcccugcggcucaaggccaaggagcacgccgcccagcugacgcagcugaacauccuccccggcaccagcaccggcaaggaggugugcuga

SEQ ID NO: 26934 - RNA, 1128 nt, Artificial Sequence
  derived and/or modified sequence opt1 from AS3MT__Homo_sapiens__NP_065733
auggccgcccugcgcgacgcggagauccagaaggacgugcagaccuacuacggccagguccucaagcggagcgccgaccugcagaccaacgggugcgugacgaccgcccgccccgugccgaagcacauccgggaggcccugcagaacguccacgaggagguggcccuccgcuacuacggcugcgggcuggugauccccgagcaccuggagaacugcuggauccucgaccugggcagcgggagcggccgggacugcuacguccugucccagcucgugggcgagaaggggcacgugaccggcaucgacaugaccaaggggcaggucgagguggcggagaaguaccuggacuaccacauggagaaguacggcuuccaggccagcaacgugacguucauccacggguacaucgagaagcugggcgaggccggcaucaagaacgagucccacgacaucgucgugagcaacugcgugaucaaccucguccccgacaagcagcagguccugcaggaggccuaccgcgugcugaagcacgggggcgagcucuacuucuccgacguguacaccagccuggagcugcccgaggagauccggacccacaaggugcucuggggcgagugccucgggggcgcgcuguacuggaaggagcuggccgugcuggcccagaagaucggguucugcccgccccgccuggucaccgccaaccucaucacgauccagaacaaggagcuggagcgggugaucggcgacugccgcuucguguccgccaccuuccggcuguucaagcacagcaagaccgggcccaccaagcgcugccaggucaucuacaacggcgggaucacgggccacgagaaggagcucauguucgacgcgaacuucaccuucaaggagggcgagaucguggaggucgacgaggagaccgccgccauccugaagaacucccgguucgcccaggacuuccugauccgccccaucggggagaagcucccgaccagcggcgggugcuccgcccuggagcugaaggacaucaucacggaccccuucaagcucgcggaggagagcgacuccaugaagucccggugcgugcccgacgccgccggcgggugcugcggcaccaagaaguccugcuga

SEQ ID NO: 26935 - RNA, 1170 nt, Artificial Sequence
  derived and/or modified sequence opt1 from ASAH1__Homo_sapiens__NP_001120977
augaacugcugcaucggccugggggagaaggcccgcggcagccaccgggccuccuaccccagccucuccgcgcuguucaccgaggccagcauccugggguucggcuccuucgccgugaaggcccaguggaccgaggacugccgcaagagcacguacccgcccuccgggcccaccgucuuccccgccgugauccgguaccgcggcgcggugccgugguacaccaucaaccucgaccugccgcccuacaagcgguggcacgagcugaugcucgacaaggcccccguccccggccugcuggggaacuuccccggccccuucgaggaggagaugaaggggaucgccgccgugaccgacaucccccucggcgagaucaucagcuucaacaucuucuacgagcuguucacgaucugcaccuccaucguggcggaggacaagaaggggcaccugauccacggccgcaacauggacuucggcgucuuccucggguggaacaucaacaacgacaccugggugaucaccgagcagcugaagccgcugacggugaaccucgacuuccagcggaacaacaagaccgucuucaaggccagcuccuucgccggcuacguggggaugcugaccggcuucaagcccggccuguucagccucacccugaacgagcgcuucuccaucaacgggggcuaccuggggauccucgaguggauccugggcaagaaggacgugauguggaucggguuccugacgcggaccguccucgagaacagcaccuccuacgaggaggccaagaaccugcugaccaagacgaagauccucgcccccgcguacuucauccugggcggcaaccagagcggggagggcugcgugaucacccgcgaccggaaggagucccuggacguguacgagcucgacgccaagcaggggcgcugguacgucgugcagaccaacuacgaccgguggaagcaccccuucuuccuggacgaccgccggaccccggccaagaugugccugaaccgcacgagccaggagaacaucuccuucgagaccauguacgacgugcucagcaccaagcccguccugaacaagcugaccguguacacgacccucaucgacgugaccaagggccaguucgagaccuaccugcgggacugccccgaccccugcaucgggugguga

SEQ ID NO: 26936 - RNA, 2238 nt, Artificial Sequence
  derived and/or modified sequence opt1 from ASAH2__Homo_sapiens__NP_001137446
auggccaagcgcaccuucagcaaccuggagaccuuccucaucuuccugcuggugaugauguccgccaucacggucgcgcuccugagccugcuguucaucaccuccggcaccaucgagaaccacaaggaccucgggggccacuucuucagcaccacgcaguccccgccggccacccaggggagcaccgccgcccagcgguccaccgccacgcagcacagcaccgcgacccaguccagcaccgccacgcagaccucccccgugccccugacccccgagagcccccucuuccagaacuucuccggcuaccacaucggggugggccgcgccgacugcaccggccaggucgccgacaucaaccugaugggguacggcaagagcgggcagaacgcgcagggcauccugacgcggcucuacucccgcgccuucaucauggccgagcccgacgggagcaaccggaccguguucguguccaucgacaucggcauggucagccagcgccugcggcuggaggugcucaaccgccugcaguccaaguacggcagccuguaccggcgcgacaacgugauccucagcgggacccacacccacuccggccccgccggguacuuccaguacacggucuucgugaucgccagcgagggcuucuccaaccagaccuuccagcacauggugaccggcauccucaagagcaucgacaucgcgcacaccaacaugaagcccgggaagaucuucaucaacaagggcaacgucgacggggugcagaucaaccgguccccguacagcuaccugcagaacccccaguccgagcgcgcccgguacagcuccaacacggacaaggagaugaucgugcucaagauggucgaccugaacggcgacgaccuggggcucaucagcugguucgccauccaccccguguccaugaacaacagcaaccaccuggugaacuccgacaacgucggcuacgccagcuaccugcucgagcaggagaagaacaagggcuaccugcccgggcagggcccguucguggccgcguucgccuccagcaaccugggggacgugucccccaacauccucggcccccgcugcaucaacaccggggagagcugcgacaacgccaacuccacgugccccaucggcggcccgagcaugugcaucgccaaggggcccggccaggacauguucgacagcacccagaucaucgggcgggccauguaccagcgcgcgaaguccaagaccugcaagcccgcccugggcuacagcuucgccgccgggaccaucgacggcgucggcgggcugaacuucacccagggcaagaccgagggggaccccuucugggacacgauccgggaccagauccucggcaagccguccgaggagaucaaggagugccacaagcccaagcccauccugcugcacaccggcgagcucagcaagccccacccguggcaccccgacaucguggacgugcagaucaucacccuggggucccuggccaucaccgcgauccccggcgaguucacgaccaugagcgggcgccggcuccgcgaggccguccaggccgaguucgccucccacggcaugcagaacaugaccguggucaucagcgggcugugcaacguguacacccacuacaucaccacguacgaggaguaccaggcgcagcgguacgaggccgccuccaccaucuacggcccccacacccugagcgccuacauccagcuguuccgcaaccuggccaaggcgaucgccaccgacacgguggccaaccugucccgcggcccggagccgcccuucuucaagcagcucaucgucccccugauccccagcaucguggaccgggcccccaaggggcgcaccuucggcgacgugcugcagcccgccaagccggaguaccgggucggggagguggcggaggugaucuucgucggcgccaaccccaagaacuccgugcagaaccagacccaccagaccuuccucacgguggagaaguacgaggccaccagcaccuccuggcagaucgucugcaacgacgccagcugggagacccgcuucuacuggcacaaggggcugcugggccuguccaacgccacgguggaguggcacauccccgacaccgcgcagcccggcaucuaccggauccgcuacuucgggcacaaccggaagcaggacauccucaagccggccgugauccugagcuucgagggcaccagccccgccuucgaggucgugaccaucuga

SEQ ID NO: 26937 - RNA, 3390 nt, Artificial Sequence
  derived and/or modified sequence opt1 from ASAP1__Homo_sapiens__NP_060952
augcgcagcuccgccagccggcuguccagcuucuccagccgcgacucccucuggaaccggaugcccgaccagaucagcguguccgaguucaucgccgagaccaccgaggacuacaacagcccgacgaccuccagcuucaccacccgccugcacaacugccggaacacggucacccugcucgaggaggcgcuggaccaggaccgcaccgcccugcagaaggugaagaaguccgugaaggccaucuacaacagcggccaggaccacguccagaacgaggagaacuacgcccaggugcucgacaaguucggguccaacuuccugagccgggacaaccccgaccugggcaccgccuucgugaaguucuccacgcucaccaaggagcugagcacccugcucaagaaccugcugcaggggcucucccacaacgucaucuucacccuggacagccugcucaagggcgaccugaagggggugaagggcgaccugaagaagcccuucgacaaggcguggaaggacuacgagacgaaguucaccaagaucgagaaggagaagcgcgagcacgccaagcagcacggcaugauccggaccgagaucaccggggccgagaucgccgaggagauggagaaggagcgccggcucuuccagcugcagaugugcgaguaccugaucaaggugaacgagaucaagacgaagaagggcgucgaccuccugcagaaccugaucaaguacuaccacgcgcagugcaacuucuuccaggacgggcucaagaccgccgacaagcugaagcaguacaucgagaagcuggccgccgaccucuacaacaucaagcagacccaggacgaggagaagaagcagcugaccgcccugcgcgaccucaucaagagcucccugcagcuggaccagaaggaggacagccagucccggcagggcggguacagcaugcaccagcuccagggcaacaaggaguacggcuccgagaagaagggguaccugcugaagaagagcgacggcauccgcaagguguggcagcggcgcaagugcuccgugaagaacgggauccucacgaucagccacgcgaccuccaaccggcagcccgccaagcugaaccugcucaccugccaggucaagccgaacgccgaggacaagaagagcuucgaccugaucucccacaaccgcaccuaccacuuccaggccgaggacgagcaggacuacguggccuggaucagcgugcugacgaacuccaaggaggaggcgcucaccauggccuuccggggcgagcagagcgccggcgagaacucccuggaggaccugaccaaggccaucaucgaggacguccagcgccuccccgggaacgacaucugcugcgacugcggcagcuccgagcccaccuggcugagcacgaaccuggggauccugaccugcaucgagugcuccggcauccaccgggagaugggggugcacaucagccgcauccagagccucgagcuggacaagcugggcaccuccgagcuccugcuggccaagaacgugggcaacaacagcuucaacgacaucauggaggcgaaccuccccuccccgagccccaagcccacccccuccagcgacaugacgguccgcaaggaguacaucaccgccaaguacguggaccaccgguucucccgcaagaccugcagcaccuccagcgccaagcugaacgagcugcucgaggccaucaagucccgggaccugcuggcccucauccagguguacgcggagggggucgagcugauggagccgcugcucgagcccggccaggagcugggggagacggcccugcaccucgccgugcgcaccgccgaccagaccagccugcaccugguggacuuccucguccagaacugcggcaaccuggacaagcagaccgcgcuggggaacaccgugcuccacuacugcuccauguacagcaagcccgagugccugaagcugcuccugcgguccaagcccacggucgacaucgugaaccaggccggcgagaccgcccuggacaucgccaagcgccucaaggccacccagugcgaggaccugcugagccaggcgaaguccggcaaguucaacccgcacgugcacgucgaguacgaguggaaccuccggcaggaggagaucgacgagagcgacgacgaccuggacgacaagcccagccccaucaagaaggagcgcuccccccggccgcagagcuucugccacuccagcuccaucagcccccaggacaagcuggcccuccccggguucuccaccccccgcgacaagcagcggcugagcuacggcgccuucacgaaccagaucuucguguccaccagcaccgacuccccgaccagccccacgaccgaggcccccccccugccgccccgcaacgccgggaagggccccaccgggccgcccuccacccucccccugagcacgcagaccuccagcggcuccagcacccuguccaagaagcggcccccgcccccccccccgggccacaagcgcacccucagcgacccccccagcccccugccgcacgggccccccaacaagggcgcggugcccugggggaacgacggcggcccguccagcuccagcaagacgaccaacaaguucgaggggcugucccagcagagcuccaccagcuccgccaagaccgcccucggcccccggguccugcccaagcugccccagaagguggcccuccgcaagacggaccaccugagccuggacaaggccaccaucccgcccgagaucuuccagaaguccagccagcucgcggagcugccccagaagcccccgcccggggaccugcccccgaagcccaccgagcucgcccccaagccccagaucggcgaccugccgcccaagcccggggagcugcccccgaagccccagcucggcgaccugccccccaagccgcagcuguccgaccucccccccaagccccagaugaaggaccugccgcccaagccccagcugggcgaccuccuggccaagagccagaccggggacgugucccccaaggcccagcagccgagcgaggucacgcugaagucccacccccucgaccugagccccaacgugcagucccgggacgcgauccagaagcaggccagcgaggacagcaacgaccugacccccacccucccggagacccccgugccccugccccgcaagaucaacacgggcaagaacaagguccggcgcgugaagaccaucuacgacugccaggccgacaacgacgacgagcugaccuucaucgagggggaggugaucaucgucaccggcgaggaggaccaggagugguggaucgggcacaucgagggccagccggagcgcaagggcguguuccccguguccuucguccacauccucagcgacuga

SEQ ID NO: 26938 - RNA, 2886 nt, Artificial Sequence
  derived and/or modified sequence opt1 from ASAP2__Homo_sapiens__NP_001128663
augcccgaccagaucagcguguccgaguucgucgccgagacccacgaggacuacaaggccccgaccgcgagcuccuucacgacccgcaccgcccagugccggaacaccguggccgccaucgaggaggcccuggacguggaccgcaugguccucuacaagaugaagaagagcgugaaggcgaucaacuccagcggccuggcccacguggagaacgaggagcaguacacgcaggcccuggagaaguucgggggcaacugcgucugccgggacgaccccgaccucggguccgccuuccugaaguucagcguguucaccaaggagcugaccgcgcucuucaagaaccugauccagaacaugaacaacaucaucuccuucccccuggacagccuccugaagggcgaccugaagggggugaagggcgaccucaagaagcccuucgacaaggccuggaaggacuacgagaccaagaucacgaagaucgagaaggagaagaaggagcacgccaagcugcacggcaugauccgcaccgagaucuccggggccgagaucgccgaggagauggagaaggagcggcgcuucuuccagcugcagaugugcgaguaccuccugaaggucaacgagaucaagaucaagaagggcguggaccugcuccagaaccugaucaaguacuuccacgcgcagugcaacuucuuccaggacgggcugaaggccguggagagccucaagccguccaucgagacccugagcaccgaccugcacacgaucaagcaggcccaggacgaggagcggcgccagcucauccagcugcgggacauccugaaguccgcccuccaggucgagcagaaggaggacagccagauccgccaguccaccgccuacagccugcaccagccccagggcaacaaggagcacgggaccgagcggaacggcucccuguacaagaagagcgacggcauccgcaagguguggcagaagcggaagugcagcgugaagaacggguuccucaccaucucccacggcacggcgaaccgcccccccgccaagcugaaccugcucaccugccaggucaagaccaacccggaggagaagaagugcuucgaccugaucagccacgaccggaccuaccacuuccaggccgaggacgagcaggagugccagaucuggauguccgugcugcagaacagcaaggaggaggcccucaacaacgccuucaagggggacgacaacacgggcgagaacaacaucgugcaggagcugaccaaggagaucaucuccgagguccagcgcaugaccggcaacgacgugugcugcgacugcggggcgcccgaccccaccuggcugagcacgaaccucggcauccugaccugcaucgagugcuccgggauccaccgggagcugggcgugcacuacagccgcaugcagucccucacccuggacguccuggggaccagcgagcuccugcuggccaagaacaucggcaacgccggcuucaacgagaucauggagugcugccuccccgccgaggacuccgugaagccgaaccccgggagcgacaugaacgcccggaaggacuacaucacggcgaaguacaucgagcgccgguacgcccgcaagaagcacgccgacaacgccgcgaagcugcacucccugugcgaggccgugaagacccgcgacaucuucggccugcuccaggccuacgccgacggggucgaccugaccgagaagaucccccuggccaacggccacgagcccgacgagaccgcgcuccaccuggccgugcggagcgucgaccgcacgucccugcacaucguggacuuccucgugcagaacagcgggaaccuggacaagcagaccggcaagggcuccaccgcccugcacuacugcugccucaccgacaacgccgagugccugaagcugcuccugcgggggaaggccagcaucgagaucgcgaacgaguccggcgagacgccgcuggacaucgccaagcgccucaagcacgagcacugcgaggagcugcugacccaggcccucagcgggcgguucaacagccacguccacguggaguacgaguggcgccugcugcacgaggaccucgacgaguccgacgacgacauggacgagaagcugcagcccagccccaaccggcgcgaggaccggcccaucuccuucuaccagcugggcagcaaccagcuccaguccaacgccgugagccuggcccgcgacgcggccaaccuggccaaggagaagcagcgggccuucaugccguccauccuccagaacgagaccuacggggcgcugcugagcggcucccccccccccgcccagccggccgcccccagcaccaccuccgcccccccccucccgccccgcaacgucggcaaggacccccugacgccgacccccccccccccgguggcgaagacccccagcgugauggaggcccugucccagcccagcaagcccgccccgcccgggaucucccagauccggccccccccgcuccccccccagcccccgagccgccugccccagaagaagcccgcccccggcgccgacaaguccaccccgcugacgaacaaggggcagccccggggccccgucgaccucagcgcgaccgaggcccugggcccccugagcaacgccauggugcuccagccgcccgcccccaugccgcgcaagucccaggccaccaagcugaagcccaagcgggugaaggcgcuguacaacugcgucgccgacaaccccgacgagcucaccuucagcgagggggacgugaucaucguggacggcgaggaggaccaggagugguggaucgggcacaucgacggcgaccccgggcgcaagggcgccuucccggucuccuucgugcacuucaucgccgacuga

SEQ ID NO: 26939 - RNA, 1404 nt, Artificial Sequence
  derived and/or modified sequence opt1 from ASB10__Homo_sapiens__NP_001135931
augcugaugagcuggucccccgaggagugcaagggccagggggagccgcucgacgaccgccacccccugugcgcccggcugguggagaagcccagccgcggcuccgaggagcaccucaagagcgggcccggcccgaucgucacccggaccgccuccgggcccgcgcuggccuucuggcaggccgugcuggccggcgacgugggcugcgucagccgcauccucgccgacuccagcacggggcuggcgcccgacuccguguucgacaccagcgaccccgagcgguggcgcgacuuccgguucaacauccgcgcccugcggcucuggucccugaccuacgaggaggagcugaccacgccgcuccacguggccgccagccgcggccacaccgagguccugcggcugcuccugcgccggcgcgcgcggcccgacuccgcccccgggggccgcaccgcccugcacgaggccugcgccgcggggcacaccgccugcgugcacgugcuccuggucgccggcgccgaccccaacaucgccgaccaggacggcaagcggccgcugcaccucugccgcgggcccggcacgcuggagugcgcggagcugcuccugcgguucggggcccgcguggacggccggagcgaggaggaggaggagacgccccugcacguggccgcccgccucggccacgucgagcuggccgaccugcuccugcgccgcggggcgugccccgacgcccggaacgccgagggcuggaccccgcugcucgccgccugcgacgugcggugccaguccaucaccgacgcggaggccaccaccgcccgcugccugcagcugugcagccuccugcuguccgccggggcggacgccgacgccgccgaccaggacaagcagcggccccuccaccuggccugccgccggggccacgcggccguggucgagcugcuccugagcugcgggguguccgccaacaccauggacuacggcggccacaccccgcugcacugcgcccuccaggggcccgccgcggcccuggcccagagccccgagcacgugguccgcgcccugcucaaccacggcgccgugcggguguggcccggggcgcugcccaagguccuggagcgcuggagcacgugcccccggaccaucgaggugcugaugaacaccuacuccgugguccagcucccggaggaggccgugggccuggucacccccgagacgcugcagaagcaccagcgcuucuacagcucccucuucgcccuggugcggcagccccgcagccugcagcaccucucccggugcgcccugcgcagccaccuggaggggucccucccccaggcgcugccgcggcugccccugcccccgcgccuccugcgguaccuccagcuggacuucgagggcgugcuguacuga

SEQ ID NO: 26940 - RNA, 837 nt, Artificial Sequence
  derived and/or modified sequence opt1 from ASB13__Homo_sapiens__NP_078977
auggagccccgcgccgccgacggcugcuuccugggggacgugggcuucugggucgagcggacccccgugcacgaggcggcccagcgcggggagagccuccagcugcagcagcugaucgaguccggcgccugcgugaaccaggucaccguggacagcaucacgccccuccacgccgccucccugcaggggcaggcgcggugcgugcagcugcuccuggccgccggcgcccaggucgacgcgcgcaacaucgacggcagcaccccgcugugcgacgccugcgccuccgggagcaucgagugcgugaagcuccugcuguccuacggcgccaaggugaacccgccccucuacaccgccagcccccugcacgaggcgugcauguccgggagcuccgagugcguccggcugcucaucgacgugggcgccaaccuggaggcccacgacugccacuucgggacgccccugcacguggccugcgcccgcgagcaccucgacugcgucaaggugcugcugaacgcgggcgccaacgugaacgccgccaagcuccacgagaccgcccugcaccacgcggccaaggucaagaacguggaccugaucgagaugcucaucgaguucggcgggaacaucuacgcccgggacaaccgcggcaagaagcccagcgacuacaccugguccagcuccgcccccgccaagugcuucgaguacuacgagaagacgccccugacccugagccagcucugccgggugaaccugcgcaaggcgaccgggguccggggccuggagaagaucgccaagcucaacaucccgccccgccugaucgacuaccuguccuacaacuga

SEQ ID NO: 26941 - RNA, 1767 nt, Artificial Sequence
  derived and/or modified sequence opt1 from ASB15__Homo_sapiens__XP_005250203
auggacaccaacgacgaccccgacgaggaccaccugaccagcuacgacauccagcucuccauccaggagagcaucgaggccuccaagacggcccugugccccgagcgcuucgugccccugagcgcgcagaaccggaagcucgucgaggccaucaagcagggccacauccccgagcugcaggaguacgugaaguacaaguacgccauggacgaggccgacgagaaggggugguucccccugcacgaggccgugguccagccgauccagcagauccucgagaucgugcuggacgcguccuacaagacccugugggaguucaagaccugcgacggcgagacgccccucacccuggccgugaaggccgggcuggucgagaacgugcgcacccuccuggagaagggcguguggcccaacaccaagaacgacaagggggagacgccccugcucaucgccgucaagaagggcagcuacgacaugguguccacccugaucaagcacaacaccagccuggaccagccgugcgugaagcggugguccgcgaugcacgaggccgccaagcagggccgcaaggacaucgucgcccuccugcugaagcacgggggcaacgugcaccuccgggacggguucggcgugacgccccugggggucgccgcggaguacggccacugcgacgugcuggagcaccucauccacaagggcggggacgugcuggcccuggccgacgacggcgccagcguccucuucgaggccgccgggggcggcaaccccgacugcaucucccugcugcucgaguacgggggcagcgggaacgugcccaaccgcgcgggccaccucccgauccaccgggccgccuacgaggggcacuaccuggcccugaaguaccugauccccgugaccuccaagaacgcgauccgcaagagcggccugacccccauccacuccgccgccgacggccagaacgcccagugccucgagcugcugaucgagaacggguucgacgucaacacccuccuggccgaccacaucagccaguccuacgacgacgagcggaagaccgcgcuguacuucggcgugagcaacaacgacgugcacugcaccgagguccuccuggccgccggggccgaccccaaccuggacccgcucaacugccugcugguggcgguccgcgccaacaacuacgagaucgugcggcuccugcugucccacggcgccaacgugaacugcuacuucaugcacgucaacgacacgcgcuuccccagcgugauccaguacgcccugaacgacgaggugaugcuccggcugcugcucaacaacggguaccaggucgagaugugcuucgacugcaugcacggcgacaucuucggcaacagcuucgugugguccgagauccaggaggaggugcugcccggguggaccagcugcgucaucaaggacaaccccuucugcgaguucaucaccgugccguggaugaagcaccuggugggccgcgucacccgggugcucaucgacuacauggacuacgugccccugugcgccaagcugaaguccgcgcucgagguccagcgcgaguggcccgagauccggcagauccuggagaaccccugcagccugaagcaccucugccgccugaagauccggcgccugauggggcuccagaagcugugccagccggccuccguggagaagcugccccucccgcccgccauccagcgguacauccuguucaaggaguacgaccuguacggccaggagcucaagcugacguga

SEQ ID NO: 26942 - RNA, 1401 nt, Artificial Sequence
  derived and/or modified sequence opt1 from ASB18__Homo_sapiens__NP_997721
augagcaacuccgacuaccugcccgacuacccgcucaacagcgaccuggugaagcgccugaaguccgcccucgacgccaaggacgaggagcggguccgcgaccugaucugcaccgagaucacccccguggacgcggugaucgagcuggccaacgacgacuggaugaaggaccccagcgcccagcuccccaccggcaugcugcugggggaccucgaccaccugaagccgcugauggaccaguucuuccaggacgccaacgucguguucgagaucaacaaggacgagauggaguggcaggucaagucccccgccaccuucggccucagcgggcuguggacccuggaguacaagcgggagcucaccacgccccugugcaucgcggccgcccacggccacaccgccugcgugcgccaccuccuggggcggggcgcggaccccgacgccuccccgggcgggcgcggcgcccugcacgaggccugccucgggggccacaccgccugcgugcggcugcugcugcagcaccgcgcggaccccgaccuccugagcgccgaggggcuggcgccccuccaccugugccggaccgccgccucccugggcugcgcccaggcccuccuggagcacggcgccagcgugcagcgcgucgggggcacggggcgggacacgccccugcacguggccgcccagcgcggccucgacgagcacgcgcggcuguaccugggccgcggggcccacguggacgcccggaacggccgcggggagaccgcccucuccgccgcgugcggcgccgcccggcgcccggacgagcacgggcggugccugcgccugugcgcccuccugcugcggcgcggcgcggaggccgacgcccgcgacgaggacgagcggagcccccuccacaaggccugcggccacgccucccacagccuggcgcgccugcuccugcggcacggggccgacgccggcgcccuggacuacgggggcgccagcccccucgggcgcguccugcagaccgcguccugcgcccugcaggccagcccccagcggaccgugcaggcccugcucaaccacggcuccccgaccguguggcccgacgccuuccccaagguccugaagaccugcgcguccgugcccgccgugaucgagguccuguucaacagcuacccgcagcucugccugagcgaguccuggaaggaggugauccccgaggagguguuccagaugcacaagcccuucuaccagagccuguucgcccucgcccugacgccccgcugccugcagcaccucugccggugcgcgcugcgccggcuguucggcaagcgcugcuucgaccucaucccgcugcugccccuccccaagccccugcagaacuaccugcuccuggagccgcaggggguccugcacuga

SEQ ID NO: 26943 - RNA, 1008 nt, Artificial Sequence
  derived and/or modified sequence opt1 from ASB1__Homo_sapiens__NP_001035535
auggccgagggcgggagccccgacggccgcgccgggccgggcuccgcggggcggaaccugaaggaguggcuccgcgagcaguucugcgaccacccccuggagcacugcgaggacacccggcugcacgacgccgccuacgugggcgaccuccagacccugcgcagccugcuccaggaggaguccuaccggagccgcaucaacgagaaguccgucuggugcugcggcuggcugcccugcacgccccugcggaucgccgccaccgcggggcacggcagcugcguggacuuccucauccgcaagggggccgagguggaccuggucgacgugaagggccagaccgcccuguacguggccgucgugaacgggcaccucgaguccacccagauccugcuggaggcgggcgccgacccgaacggcagccggcaccaccgcuccacgcccguguaccacgccagccgggucgggcgcgccgacauccucaaggcccugauccgguacggcgcggacguggacgugaaccaccaccugacccccgacguccagccccgcuucucccggcgccucaccagccugguggugugcccgcuguacaucuccgccgccuaccacaaccuccagugcuuccggcugcugcuccuggccggggccaaccccgacuucaacugcaacggccccgucaacacccagggcuucuaccgcgggagccccggcugcgugauggacgcggugcugcggcacgggugcgaggccgccuucgucucccuccugguggaguucggcgccaaccugaaccucgugaagugggagagccuggggccggagucccgcggccggcgcaaggucgaccccgaggcccuccagguguucaaggaggcgcgcagcgugccccggacgcugcugugccugugccgcgucgccgugcggcgcgcccucggcaagcaccggcugcaccugauccccucccucccgcugcccgaccccaucaagaaguuccugcuccacgaguga

SEQ ID NO: 26944 - RNA, 1764 nt, Artificial Sequence
  derived and/or modified sequence opt1 from ASB2__Homo_sapiens__NP_057234
augacccgcuucagcuacgccgaguacuucucccuguuccacagcugcuccgcccccagccgguccaccgcgccgcccgagagcucccccgcccgcgcccccaugggccucuuccagggggugaugcagaaguacagcuccagccuguucaagacgucccagcuggccccggccgacccccucaucaaggcgaucaaggacggcgacgaggaggcccugaagaccaugaucaaggaggggaagaaccuggccgagcccaacaaggagggcuggcucccccugcacgaggccgcguacuacgggcaggucggcugccugaaggugcuccagcgggccuacccgggcaccaucgaccagcgcacccugcaggaggagacggccguguaccuggcgaccugccgggggcaccucgacugccugcugagccuccugcaggccggcgccgagcccgacaucuccaacaagagccgcgagacgccccuguacaaggccugcgagcggaagaacgccgaggccgucaagauccucgugcagcacaacgccgacaccaaccaccgcugcaaccggggguggaccgcgcugcacgaguccgugagccgcaacgaccuggaggucaugcagauccucguguccggcggggccaagguggagagcaagaacgccuacggcaucacgccccuguucgucgccgcccaguccggccagcuggaggcgcuccgguuccuggccaaguacggggccgacaucaacacccaggccagcgacaacgccagcgcgcuguacgaggccugcaagaacgagcacgaggaggugguggaguuccuccugucccagggcgccgacgccaacaagaccaacaaggacgggcugcucccgcugcacaucgcgagcaagaagggcaacuaccgcaucguccagaugcugcuccccgugaccucccggacccgcauccggcgcagcggcgugagcccccugcaccuggccgccgagcggaaccacgacgagguccucgaggcccugcuguccgcccgcuucgacgugaacacgccccucgcgccggagcgggcccgccuguacgaggaccggcgcuccagcgcccuguacuucgccguggucaacaacaacguguacgccaccgagcuccugcugcagcacggggcggaccccaaccgcgacgugaucagcccccuccuggucgccauccggcacggcugccugcgcaccaugcagcuccugcuggaccacggggccaacaucgacgccuacaucgccacccaccccaccgcguucccggccaccaucauguucgccaugaagugccugucccuccugaaguuccugauggaccucggcugcgacggggagcccugcuucuccugccuguacggcaacggcccccacccgcccgcgccccagcccagcucccgguucaacgacgcccccgccgccgacaaggagccgagcguggugcaguucugcgaguucgucuccgcccccgaggugagccgcugggccgggcccaucaucgacguccugcucgacuacgugggcaacgugcagcugugcucccggcugaaggagcacaucgacagcuucgaggacugggcggucaucaaggagaaggccgagccgccccgcccccucgcccaccugugccggcugcgcgugcggaaggccaucgggaaguaccgcaucaagcuccuggacacgcugccccucccgggccggcugauccgcuaccugaaguacgagaacacccaguga

SEQ ID NO: 26945 - RNA, 1266 nt, Artificial Sequence
  derived and/or modified sequence opt1 from ASB6__Homo_sapiens__NP_060343
augcccuuccugcacggcuuccgccggaucaucuucgaguaccagccgcucguggacgccauccuggggagccugggcauccaggaccccgagcgccaggagucccucgaccggcccagcuacgucgccuccgaggagagccgcauccuggugcugaccgagcuccuggagcggaaggcgcacucccccuucuaccaggagggggugagcaacgcccugcucaagauggccgagcugggccugacccgcgccgccgacguccuccugcggcacggggcgaaccugaacuucgaggacccggugacguacuacaccgcccuccacaucgccgugcugcgcaaccagcccgacauggucgagcugcucgugcaccacggcgccgacgugaaccggcgcgaccggauccacgaguccagcccccuggaccuggcguccgaggagcccgagcgccucccgugccugcagcggcugcucgaccugggcgccgacgucaacgccgccgacaagcacgggaagaccgcccugcuccacgcgcuggccagcuccgacggcgugcagauccacaacaccgagaacauccgccugcuccuggagggcggggccgacgugaaggccacgaccaaggacggggacaccgucuucacgugcaucaucuuccugcucggcgagaccgugggcggggacaaggaggaggcccagaugaucaaccgguucugcuuccaggugacccgccugcugcucgcgcacggcgccgaccccagcgagugccccgcccacgagucccugacccacaucugccucaagagcuucaagcugcacuucccccugcugcgguuccuccuggaguccggggccgccuacaacugcagccugcacggcgcguccugcuggagcggcuuccacaucaucuucgagcgccucugcucccacccggggugcaccgaggacgagagccacgccgaccugcugcggaaggccgagacgguccucgaccugauggugaccaacagccagaagcugcagcugcccgagaacuucgacauccaccccgugggcucccucgccgagaagauccaggcccugcacuucagccugcgccagcucgaguccuacccgccgccccugaagcaccugugccgggucgcgauccgccucuaccugcagcccuggcccguggacgugaaggucaaggcccugccccuccccgaccgccugaagugguaccugcucagcgagcacuccgggagcguggaggacgacaucuga

SEQ ID NO: 26946 - RNA, 825 nt, Artificial Sequence
  derived and/or modified sequence opt1 from ASB7__Homo_sapiens__NP_078984
augcugcaccaccacugccgccggaaccccgagcuccaggaggagcugcagauccaggccgccguggcggccggcgacguccacaccgugcgcaagaugcuggagcagggguacagcccgaacggccgggacgccaacggguggacccuccugcacuucuccgccgcccgcggcaaggagcggugcgugcgcgucuuccuggagcacggggcggaccccaccgugaaggaccucaucggcggcuucaccgcccugcacuacgccgccaugcacgggcgggcgcgcaucgcccggcugaugcucgagagcgaguaccgcuccgacaucaucaacgccaagagcaacgacggcuggacgccccugcacguggccgcccacuacgggcgggacuccuucguccgccugcuccuggaguucaaggcggagguggacccccugagcgacaagggcaccaccccgcuccagcuggccaucauccgggagcgcuccagcugcgugaagauccugcucgaccacaacgccaacaucgacauccagaacggguuccugcugcgguacgccgucaucaaguccaaccacagcuacugccgcauguuccuccagcggggcgccgacaccaaccugggccgccuggaggacgggcagacgccccuccaccuguccgcgcugcgggacgacgugcucugcgcccgcaugcuguacaacuacggcgccgacaccaacacccggaacuacgaggggcagacgccccuggccgugagcaucuccaucagcggcuccagccgccccugccucgacuuccugcaggaggucaccuccauguga

SEQ ID NO: 26947 - RNA, 1074 nt, Artificial Sequence
  derived and/or modified sequence opt1 from ASCC1__Homo_sapiens__NP_001185727
auggaggugcugcgcccccagcucauccggaucgacggccgcaacuaccggaagaacccgguccaggagcagaccuaccagcacgaggaggacgaggaggacuucuaccaggggagcauggagugcgccgacgagcccugcgacgccuacgagguggagcagacgccccagggcuuccgcuccacccugcgggcgcccagccugcucuacaagcacaucguggggaagcgcggcgacacccggaagaagaucgagauggagaccaagaccuccaucagcaucccgaagcccgggcaggacggcgagaucgucaucacgggccagcaccgcaacggggugaucuccgcccggacccgcaucgacgugcugcuggacaccuuccggcgcaagcagcccuucacccacuuccucgccuucuuccugaacgaggucgaggugcaggagggcuuccugcgguuccaggaggaggugcucgccaagugcagcauggaccacggggucgacuccagcaucuuccagaaccccaagaagcugcaccugacgaucggcaugcucgugcugcuguccgaggaggagauccagcagaccugcgagaugcuccagcagugcaaggaggaguucaucaacgacaucagcgggggcaagccgcuggagguggagauggccggcaucgaguacaugaacgacgaccccgggauggucgacgugcuguacgcgaaggugcacaugaaggacggcuccaaccgccuccaggagcuggucgaccgggugcuggagcgcuuccaggccagcgggcucaucgugaaggaguggaacuccgucaagcugcacgccaccgugaugaacacccuguuccggaaggaccccaacgccgagggccgcuacaaccucuacacggcggagggcaaguacaucuucaaggagcgggagagcuucgacgggcgcaacauccugaagcuguucgagaacuucuacuucggcucccucaagcugaacagcauccacaucucccagcgguucaccguggacagcuucgggaacuacgccuccugcggccagaucgacuucagcuga

SEQ ID NO: 26948 - RNA, 2046 nt, Artificial Sequence
  derived and/or modified sequence opt1 from ASCC2__Homo_sapiens__NP_001229835
augcccgcccugccgcucgaccagcugcagaucacccacaaggaccccaagaccggcaagcugcgcacgagccccgcccucgugaucuucgacgagacccugcagaagugccuggacuccuaccuccgguacgucccccgcaaguucgacgaggggguggcgagcgccccggagguggucgacaugcagaagcggcugcaccgcuccguguuccugaccuuccuccggaugagcacccacaaggaguccaagauccuggaccugugcgugcuguucggcaaggggaacagcccccuccugcagaagaugaucggcaacaucuucacgcagcagcccuccuacuacagcgaccucgacgagacccugcccaccauccugcaggucuucuccaacauccuccagcacugcgggcugcagggcgacggcgccaacaccacgccgcagaagcuggaggagcgcgggcggcucacccccagcgacaugccccugcuggagcucaaggacaucgugcuguaccugugcgacacgugcaccacccucugggccuuccuggacaucuucccccuggccugccagaccuuccagaagcacgacuucugcuaccgccucgcguccuucuacgaggccgccaucccggagauggagagcgccaucaagaagcggcgccuggaggacuccaagcugcucggcgaccuguggcagcggcugagccacucccgcaagaagcucauggagaucuuccacaucauccugaaccagaucugccugcuccccauccuggagagcuccugcgacaacauccagggguucaucgaggaguuccugcagaucuucagcucccuccugcaggagaagcgguuccugcgcgacuacgacgcccucuuccccguggcggaggacaucagccugcugcagcaggccagcuccguccucgacgagacccggaccgccuacauccugcaggccguggagagcgcgugggagggcguggaccgccggaaggccacggacgccaaggaccccuccgucaucgaggagccgaacggggagcccaacggcgugaccgugaccgccgaggccgucagccaggcguccagccaccccgagaacuccgaggaggaggagugcaugggcgccgccgccgccguggggcccgcgaugugcggcguggagcuggacagccugaucucccaggucaaggaccuccugccggaccugggggagggcuucauccucgccugccuggaguacuaccacuacgaccccgagcaggucaucaacaacauccuggaggagcgccucgcccccacccugagccagcuggaccggaaccucgaccgcgagaugaagcccgacccgacgccccugcugaccucccggcacaacguguuccagaacgacgaguucgacguguucagccgcgacuccguggaccucagccgcgugcacaagggcaaguccacccggaaggaggagaacacccgcagccugcugaacgacaagcgggccgucgccgcgcagcgccagcgguacgagcaguacuccguggucguggaggaggugccccuccagcccggggagagccugccguaccacuccgucuacuacgaggacgaguacgacgacacguacgacggcaaccaggugggggccaacgacgccgacagcgacgacgagcugaucagccgccggcccuucaccaucccccaggugcuccgcaccaaggucccgcgggagggccaggaggaggacgacgacgacgaggaggacgacgccgacgaggaggcgcccaagcccgaccacuucgugcaggaccccgccgugcugcgcgagaaggccgaggcccggcgcauggccuuccuggcgaagaagggguaccggcacgacuccagcaccgccgucgccggcuccccgcgcggccacgggcagagccgggagacgacccaggagcgccggaagaaggaggccaacaaggccacccgcgcgaaccacaaccggcgcaccauggccgaccgcaagcgguccaagggcaugauccccagcuga

SEQ ID NO: 26949 - RNA, 2196 nt, Artificial Sequence
  derived and/or modified sequence opt1 from ASCC3__Homo_sapiens__NP_001271200
auggcccugccccgccucaccggcgcccugcggagcuucuccaacgugaccaagcaggacaacuacaacgaggagguggcggaccugaagaucaagcgcagcaagcuccacgagcagguccuggaccuggggcucacguggaagaagaucaucaaguuccugaacgagaagcuggagaaguccaagaugcagagcaucaacgaggaccucaaggacauccugcacgccgccaagcagaucgugggcaccgacaacgggcgggaggccaucgaguccggcgccgcguuccuguucaugaccuuccaccucaaggacagcguggggcacaaggagaccaaggccaucaagcagauguucggcccguuccccuccagcuccgccacggccgcgugcaacgccaccaaccgcaucaucagccacuucucccaggacgaccugaccgcccuggugcagaugaccgagaaggagcacggcgaccggguguucuucgggaagaaccucgccuucagcuucgacaugcacgaccuggaccacuucgacgagcugcccaucaacggcgagacgcagaagaccaucucccucgacuacaagaaguuccugaacgagcaccuccaggaggccugcacccccgagcugaagccggucgagaagaccaacgggagcuuccuguggugcgagguggagaaguaccugaacuccacgcucaaggagaugaccgaggugccccgcgucgaggaccugugcugcacccuguacgacaugcucgcgagcaucaaguccggcgacgagcugcaggacgagcuguucgagcuccuggggcccgagggccuggagcucaucgagaagcugcugcagaaccggaucaccaucguggaccgcuuccucaacagcuccaacgaccaccgguuccaggcccugcaggacaacugcaagaagauccugggcgagaacgccaagcccaacuacgggugccaggugacgauccagagcgagcaggagaagcagcucaugaagcaguaccgccgggaggagaagcgcaucgcccggcgcgagaagaaggccggcgaggaccuggaggucagcgaggggcugaugugcuucgacccgaaggagcuccggauccagcgcgagcaggcgcugcugaacgcccgguccgugcccauccucagccgccagcgggacgccgacguggagaagauccacuacccccacgucuacgacucccaggccgaggccaugaagaccagcgcguucaucgccggcgccaagaugauccugcccgagggcauccagcgcgagaacaacaagcuguacgaggaggugcggaucccguacuccgagcccaugccccucagcuucgaggagaagcccguguacauccaggaccuggacgagaucgggcagcuggccuucaagggcaugaagcgccugaaccgcauccaguccaucgucuucgagaccgccuacaacaccaacgagaacaugcucaucugcgcgccgacgggggccggcaagaccaacaucgccaugcugaccgugcugcacgagauccggcagcacuuccagcagggggugaucaagaagaacgaguucaagaucgucuacguggcccccaugaaggcgcucgccgccgagaugaccgacuacuucagccgccggcuggagccccugggcaucaucgugaaggagcucacgggcgacaugcagcuguccaagagcgagauccugcgcacccagaugcucgucaccacccccgagaagugggacguggucacgcggaaguccgugggggacguggcccugagccagaucguccgccugcucauccuggacgaggugcaccuccugcacgaggaccggggcccggugcuggaguccaucgucgcccgcacccugcgccagguggagagcacccaguccaugauccggauccucgggcugagcgcgacccugcccaacuaccucgacguggccacguuccugcacgucaaccccuacaucggccuguucuucuucgacgggcgguuccgccccgugccgcucggccagaccuuccugggcaucaagugcgccaacaagaugcagcagcugaacaacauggacgaggugugcuacgagaacguccucaagcaggucaaggccgggcaccaggugcaccuguucuaccugcuccugcaccuguucaucugcuucuga

SEQ ID NO: 26950 - RNA, 711 nt, Artificial Sequence
  derived and/or modified sequence opt1 from ASCL1__Homo_sapiens__NP_004307
auggagagcuccgccaagauggagagcggcggggccggccagcagccccagccgcagccccagcagcccuuccugcccccggcggccugcuucuucgccaccgccgccgcggccgccgccgcggccgccgccgccgcggcccaguccgcccagcagcagcagcagcagcagcagcagcagcagcaggcgccccagcuccgccccgccgccgacgggcagcccagcggcgggggccacaaguccgccccgaagcaggucaagcggcagcgcagcuccagccccgagcugaugcggugcaagcgccggcugaacuucuccggcuucggguacagccucccccagcagcagcccgccgccguggcccgccggaacgagcgcgagcggaaccgcgugaagcuggugaaccugggcuucgcgacccuccgggagcacgucccgaacggggccgccaacaagaagauguccaagguggagacgcugcgcagcgccguggaguacauccgggcccugcagcagcuccuggacgagcacgacgcggucuccgccgccuuccaggccggcgugcugagccccaccaucucccccaacuacagcaacgaccucaacuccauggcggggagccccguguccagcuacagcuccgacgagggcagcuacgacccgcugucccccgaggagcaggagcugcucgacuucaccaacugguucuga

SEQ ID NO: 26951 - RNA, 582 nt, Artificial Sequence
  derived and/or modified sequence opt1 from ASCL2__Homo_sapiens__NP_005161
auggacggcgggacccugccccgcagcgccccgcccgccccgcccgugcccgucggcugcgcggcccggcgccggcccgccucccccgagcuccugcgcugcagccggcgccggcgccccgccaccgccgagaccgggggcggggcggccgccguggcccggcgcaacgagcgggagcgcaaccgggugaagcuggucaaccucggcuuccaggcgcugcgccagcacgugccgcacggcggggccuccaagaagcugagcaagguggagacgcuccgguccgccgucgaguacauccgcgcccugcagcggcugcucgccgagcacgacgcggugcgcaacgcccuggccggcgggcugcggccccaggccgugcgccccagcgcgccccggggcccgcccgggaccacccccgucgccgccucccccagccgcgccuccagcuccccgggccgcggcgggagcuccgagcccggcagcccccgguccgccuacagcuccgacgacagcgggugcgagggcgcccucucccccgcggagcgcgagcugcuggacuucagcagcuggcucggcggguacuga

SEQ ID NO: 26952 - RNA, 522 nt, Artificial Sequence
  derived and/or modified sequence opt1 from ASCL4__Homo_sapiens__NP_982260
augauggagacccgcaagcccgccgagcggcuggcccucccguacagccugcgcaccgcgccccugggcgugcccgggacgcuccccggccugccgcggcgcgacccccugcgggucgcccuccgccuggacgccgccugcugggagugggcccgguccgggugcgcgcgcggcuggcaguaccugcccgugccccucgacagcgccuucgagccggccuuccugcggaagcgcaacgagcgggagcgccagcgggugcgcugcgucaacgagggguacgcccggcugcgcgaccaccucccccgggagcuggcggacaagcgccuguccaagguggagacccuccgggccgccaucgacuacaucaagcaccuccaggagcugcuggagcgccaggccuggggccuggagggcgccgcgggggccgugccccagcggcgcgccgagugcaacagcgacggcgaguccaaggccagcuccgcccccagcccguccagcgagcccgaggagggcggguccuga

SEQ ID NO: 26953 - RNA, 615 nt, Artificial Sequence
  derived and/or modified sequence opt1 from ASF1A__Homo_sapiens__NP_054753
auggccaaggugcaggucaacaacguggugguccuggacaaccccagcccguucuacaaccccuuccaguucgagaucaccuucgagugcaucgaggaccucuccgaggaccuggaguggaagaucaucuacgugggcagcgccgaguccgaggaguacgaccaggugcuggacagcguccucguggggcccgugcccgcgggccgccacauguucgucuuccaggccgacgccccgaaccccgggcugauccccgacgccgacgccgugggcgugaccgucgugcugaucacgugcaccuaccgggggcaggaguucauccgcgugggcuacuacgucaacaacgaguacaccgagaccgagcuccgggagaacccgcccgugaagcccgacuucuccaagcugcagcgcaacauccuggcgagcaacccccgggugacgcgcuuccacaucaacugggaggacaacaccgagaagcucgaggacgccgaguccagcaaccccaaccugcagucccugcucagcaccgacgcccugccguccgccagcaagggcugguccaccagcgagaacucccugaacgucaugcucgagagccacauggacugcauguga

SEQ ID NO: 26954 - RNA, 609 nt, Artificial Sequence
  derived and/or modified sequence opt1 from ASF1B__Homo_sapiens__NP_060624
auggccaaggugagcguccugaacguggccgugcucgagaaccccuccccguuccacagccccuuccgcuucgagaucuccuucgagugcagcgaggcgcuggccgacgaccuggaguggaagaucaucuacgucggcuccgccgagagcgaggaguucgaccagauccucgacuccgugcugguggggcccguccccgccggccggcacauguucguguuccaggccgacgcgccgaaccccagccugauccccgagaccgacgccgugggggucaccguggugcucaucacgugcaccuaccacggccaggaguucauccgcgucggguacuacgugaacaacgaguaccugaaccccgagcugcgggagaacccgcccaugaagcccgacuucucccagcuccagcgcaacauccuggccagcaacccccgggugacccgcuuccacaucaacugggacaacaacauggaccggcuggaggccaucgagacccaggacccgucccucggcugcggccugccccugaacugcacgcccaucaaggggcucggccugcccgggugcaucccgggccugcuccccgagaacagcauggacugcaucuga

SEQ ID NO: 26955 - RNA, 8895 nt, Artificial Sequence
  derived and/or modified sequence opt1 from ASH1L__Homo_sapiens__XP_006711513
auggacccccgcaacaccgccaugcugggccucggcagcgacagcgagggcuucagccgcaagagccccagcgccaucagcaccgggacccuggugagcaagcgggaggucgagcuggagaagaacaccaaggaggaggaggaccuccggaagcgcaaccgggagcgcaacaucgaggccggcaaggacgacgggcugaccgacgcccagcagcaguucagcgugaaggagaccaacuucagcgagggcaaccugaagcucaagaucggccugcaggccaagcggaccaagaagccgcccaagaaccuggagaacuacgugugccgccccgccaucaagaccaccaucaagcacccccggaaggcccucaaguccgggaagaugaccgacgagaagaacgagcacugccccagcaagcgcgaccccuccaagcuguacaagaaggccgacgacgucgccgccaucgagugccagagcgaggaggugauccggcugcacucccagggcgagaacaacccccucagcaagaagcuguccccggugcacagcgagauggccgacuacaucaacgcgacgcccuccacccugcucgggagccgcgaccccgaccugaaggaccgggcccugcucaacggcgggaccuccgucaccgagaagcuggcccagcugaucgccacgugcccgcccagcaagagcuccaagaccaagcccaagaagcucggcaccggcaccacggccgggcuggugagcaaggaccugauccgcaaggcgggcgugggguccgucgccggcaucauccacaaggaccucaucaagaagcccaccaucagcaccgccgugggccuggugaccaaggaccccgggaagaagcccgucuucaacgccgccgugggccuggugaacaaggacuccgucaagaagcucgggacgggcaccaccgcgguguucaucaacaagaaccuggggaagaagcccggcaccaucacgaccgugggccugcucagcaaggacuccgggaagaagcugggcaucgggaucguccccggccuggugcacaaggagagcgggaagaagcucggccugggcaccguggucgggcuggugaacaaggaccucggcaagaagcugggguccaccgugggccuggucgccaaggacugcgccaagaagaucguggccagcuccgccauggggcucgucaacaaggacaucggcaagaagcugaugagcugcccccuggcgggccucaucuccaaggacgccaucaaccugaaggccgaggcccugcuccccacgcaggagccccugaaggccagcugcuccaccaacaucaacaaccaggagagccaggagcuguccgagagccucaaggacuccgcgaccagcaagaccuucgagaagaacguggugcggcagaacaaggagagcauccuggagaaguucuccguccgcaaggagaucaucaaccuggagaaggagauguucaacgaggggacgugcauccagcaggacagcuucuccagcuccgagaagggcagcuacgagaccuccaagcacgagaagcagccgcccguguacugcaccagcccggacuucaagaugggcggcgccuccgacgugagcaccgccaagucccccuucagcgccgucggcgaguccaaccugcccagccccuccccgacggugagcgugaacccccucacccggagcccgcccgagaccagcagccagcuggcgcccaacccccugcuccuguccagcaccaccgagcugaucgaggagaucuccgagagcgucgggaagaaccaguucacguccgagagcacccaccucaacgugggccaccgcuccguggggcacagcaucuccaucgagugcaagggcaucgacaaggaggucaacgacagcaagaccacccacaucgacaucccccggaucuccagcucccuggggaagaagcccagccugacguccgagagcuccauccacaccaucacccccagcguggugaacuucaccucccucuucagcaacaagcccuuccugaagcugggcgccgucagcgccuccgacaagcacugccagguggccgagagccucuccacgagccugcaguccaagccccugaagaagcgcaagggccggaagccgcgcuggaccaagguggucgcccgcuccacgugccggucccccaaggggcucgagcuggagcgcagcgagcuguucaagaacguguccugcagcucccucagcaacuccaacagcgagcccgcgaaguucaugaagaacaucgggccgcccuccuucguggaccacgacuuccugaagcggcgccugcccaagcucagcaaguccaccgcccccagccuggcccugcucgccgacuccgagaagcccagccacaagagcuucgccacccacaagcuguccagcuccaugugcgucagcuccgaccugcucagcgacaucuacaagcccaagcgggggcgccccaaguccaaggagaugccccagcuggaggggccgcccaagcggacccugaagauccccgcgagcaagguguucucccuccagagcaaggaggagcaggagccgcccauccugcagcccgagaucgagauccccuccuucaagcaggggcugagcgugucccccuucccgaagaagcgcggccggcccaagcgccagaugcggagccccgucaagaugaagcccccggugcucuccguggcccccuucgucgccaccgagagccccuccaagcuggagagcgaguccgacaaccaccgcagcagcuccgacuucuucgagagcgaggaccagcugcaggaccccgacgaccucgacgacucccaccggccgagcgugugcuccaugagcgaccuggagauggagcccgacaagaagaucaccaagcgcaacaacggccagcugaugaagacgaucauccggaagaucaacaagaugaagacccucaagcgcaagaagcugcugaaccagauccucuccagcuccguggagagcuccaacaaggggaagguccagagcaagcugcacaacaccguguccagccuggccgccaccuucggcuccaagcucgggcagcagaucaacgugagcaagaagggcacgaucuacaucgggaagcggcgcggccggaagcccaagaccguccugaacggcauccuguccgggagccccaccucccucgcggugcuggagcagaccgcccagcaggccgccggcagcgcgcuggggcagauccucccgccccugcugcccagcuccgccagcuccagcgagauccuccccuccccgaucugcagccaguccagcggcacguccgggggccagagccccguguccagcgacgccggcuucgucgagcccuccagcgugcccuaccugcaccuccacucccgccaggggagcaugauccagacccucgccaugaagaaggccuccaagggccgccggcgccugagcccgcccacccugcuccccaacucccccagccaccugagcgagcugaccucccucaaggaggcgacgccgagccccaucuccgagagccacuccgacgagaccauccccagcgacuccgggaucggcaccgacaacaacagcaccuccgaccgggccgagaaguucugcggccagaagaagcgccggcacagcuucgagcacgugucccugaucccgcccgagacgagcaccguccuguccagccucaaggagaagcacaagcacaagugcaagcgccggaaccacgacuaccuguccuacgacaagaugaagcgccagaagcggaagcgcaagaagaaguacccccagcugcggaaccgccaggaccccgacuucaucgccgagcucgaggagcugaucagccggcuguccgagauccgcaucacccaccggagccaccacuucaucccgcgcgaccuccugcccaccaucuuccggaucaacuucaacagcuucuacacgcaccccuccuucccccuggacccgcuccacuacauccgcaagcccgaccugaagaagaagcgggggcggccgcccaagaugcgggaggccauggccgagaugccguucaugcacagccuguccuucccccucagcuccaccggcuucuaccccagcuacgggaugcccuacuccccgagcccccugaccgcggcccccaucggccugggguacuacggccgcuacccgcccacccucuacccgccgccgcccucccccagcuucaccacgccccugcccccgcccuccuacaugcacgccggccaccuccugcugaaccccgccaaguaccacaagaagaagcacaagcugcuccgccaggaggccuuccugaccaccagccggacgccccugcucuccaugagcacguaccccuccgugccgcccgagauggcguacggguggaugguggagcacaagcaccgccaccggcacaagcaccgcgagcaccggagcuccgagcagccgcaggucagcauggacaccggcuccagccgcagcgugcuggagucccugaagcgguaccgcuucgggaaggacgccgugggcgagcgguacaagcacaaggagaagcaccgcugccacaugagcugcccccaccucucccccagcaagucccugaucaaccgggaggagcaguggguccaccgcgagcccagcgaguccagcccgcuggcccuggggcuccagaccccgcugcagaucgacugcuccgagagcucccccagccugucccucggcggcuucacccccaacagcgagccggccuccagcgacgagcacacgaaccuguucaccuccgcgaucgggagcugccggguguccaaccccaacagcagcggccgcaagaagcugaccgacucccccggccucuucagcgcccaggacaccucccugaaccggcugcaccgcaaggagagccuccccuccaacgagcgggccgugcagacgcuggccggcagccagccgaccuccgacaagcccagccagcgccccuccgagagcaccaacugcucccccacccggaagcgcagcuccagcgaguccacgagcuccaccgucaacggggugccgagccgcagcccccggcugguggccuccggcgacgacagcgucgacucccuccugcagcgcauggugcagaacgaggaccaggagcccauggagaaguccaucgacgcggucaucgccaccgccuccgcgccgcccagcuccagccccggccggucccacagcaaggaccgcacccuggggaagcccgacucccuccuggugcccgccgugacgagcgacuccugcaacaacagcaucucccugcucagcgagaagcugaccuccagcugcagcccccaccacaucaagcgguccgucguggaggcgaugcagcgccaggcccggaagaugugcaacuacgacaagauccuggccaccaagaagaaccucgaccacgugaacaagauccugaaggccaagaagcugcagcgccaggcccggaccggcaacaacuucgucaagcgccggcccgggcgcccccggaagugcccgcuccaggcggugguguccaugcaggccuuccaggccgcccaguucgucaaccccgagcugaaccgcgacgaggagggcgccgcgcugcaccucagccccgacacggugaccgacgugaucgaggccgucgugcagagcgugaaccugaaccccgagcacaagaagggccugaagcggaagggguggcuccuggaggagcagacccgcaagaagcagaagccgcugcccgaggaggaggagcaggagaacaacaaguccuucaacgaggcccccgucgagauccccagcccguccgagacccccgccaagcccagcgagcccgaguccacgcuccagccggugcugagccugaucccccgggagaagaagccgccccgcccgcccaagaagaaguaccagaaggcgggccucuacuccgacguguacaagaccaccgaccccaagagccggcugauccagcugaagaaggagaagcucgaguacacccccggggagcacgaguacggccuguucccggcccccauccacgucgggaaguaccugcgccagaagcggaucgacuuccagcuccccuacgacauccuguggcaguggaagcacaaccagcuguacaagaagcccgacgugccgcucuacaagaagauccgcuccaacguguacgucgacgugaagccccugagcggcuacgaggccacgaccugcaacugcaagaagcccgacgacgacacccgcaagggcugcguggacgacugccugaaccggaugaucuucgccgagugcucccccaacacgugcccgugcggggagcagugcugcaaccagcgcauccagcggcacgaguggguccagugccucgagcgcuuccgggccgaggagaagggcugggggauccgcacgaaggagccccugaaggcgggccaguucaucaucgaguaccugggggagguggugagcgagcaggaguuccggaaccgcaugaucgagcaguaccacaaccacuccgaccacuacugccucaaccuggacagcggcauggucaucgacuccuaccggaugggcaacgaggcccgcuucaucaaccacagcugcgaccccaacugcgagaugcagaagugguccgugaacgggguguaccggaucggccuguacgcccucaaggacaugccggccgggaccgagcugaccuacgacuacaacuuccacagcuucaacgucgagaagcagcagcugugcaagugcggcuucgagaagugccgcgggaucaucggcggcaagucccagcgggugaacgggcucaccagcagcaagaacucccagcccauggccacccacaagaaguccggccgcuccaaggagaagcgcaagagcaagcacaagcugaagaagcgccgggggcaccuguccgaggagcccagcgagaacaucaacacgcccacccgccucaccccgcagcugcagaugaagcccauguccaaccgggagcgcaacuucgugcugaagcaccacgucuuccucgugcgcaacugggagaagauccggcagaagcaggaggaggugaagcacaccagcgacaacauccacuccgcgagccuguacacgcgcuggaacggcaucugccgggacgacgggaacaucaaguccgacgucuucaugacccaguucagcgcccugcagaccgcccgcuccgugcggacccgccggcucgccgccgcggaggagaacaucgagguggcccgcgccgcccggcuggcgcagaucuucaaggagaucugcgacggcaucaucagcuacaaggacuccagccgccaggcccuggccgcgccccuccugaaccugcccccgaagaagaagaacgccgacuacuacgagaagaucuccgacccccucgaccugaucacgaucgagaagcagauccugaccggcuacuacaagaccgucgaggcguucgacgccgacaugcucaagguguuccggaacgccgagaaguacuacgggcgcaagagccccgugggccgggacgucugccgccugcggaaggccuacuacaacgcccgccacgaggcgagcgcccagaucgacgagaucgugggggagaccgccuccgaggccgacagcuccgagacgagcguguccgagaaggagaacggccacgagaaggacgacgacgucauccggugcaucugcggccuguacaaggacgaggggcucaugauccagugcgacaagugcaugguguggcagcacugcgacugcaugggcgugaacagcgacgucgagcacuaccugugcgagcagugcgacccccgcccgguggaccgggaggugcccaugaucccccgcccccacuacgcccagccggggugcgucuacuucaucugccugcuccgggacgaccugcugcuccgccagggcgacugcguguaccugaugcgcgacucccggcgcacccccgacgggcaccccguccggcagagcuaccgccugcucucccacaucaaccgggacaagcuggacaucuuccgcaucgagaagcuguggaagaacgagaaggaggagcgguucgcguucggccaccacuacuuccgcccccacgagacccaccacagcccgucccggcgcuucuaccacaacgagcuguuccgggugccccuguacgagaucaucccccuggaggccguggucgggaccugcugcgugcucgaccuguacacguacugcaaggggcgccccaagggcgugaaggagcaggacgucuacaucugcgacuaccggcuggacaagagcgcccaccucuucuacaagauccaccgcaaccgguacccggugugcaccaagcccuacgccuucgaccacuuccccaagaagcugacccccaagaaggacuucuccccgcacuacgugcccgacaacuacaagcgcaacgggggccggagcuccuggaaguccgagcgcuccaagcccccgcugaaggaccucgggcaggaggacgacgcgcugccccugaucgaggagguccuggccagccaggagcaggccgccaacgagauccccucccucgaggagcccgagcgggagggcgccaccgcgaacgugagcgagggcgagaagaagacggaggagagcucccaggagccgcaguccacgugcacccccgaggagcgccgccacaaccagcgggagcgccugaaccagauccugcucaaccugcuggagaagauccccgggaagaacgccaucgacgugaccuaccuccuggaggagggcuccgggcggaagcugcgccggcgcacccucuucauccccgagaacagcuuccggaaguga

SEQ ID NO: 26956 - RNA, 1605 nt, Artificial Sequence
  derived and/or modified sequence opt1 from ASH2L__Homo_sapiens__NP_001098684
auggacacccaggccggcagcguggacgaggagaacgggcgccagcugggcgaggucgagcuccagugcgggaucugcaccaagugguucacggccgacaccuucggcaucgacaccuccagcugccugcccuucaugaccaacuacuccuuccacugcaacgugugccaccacagcgggaacacguacuuccugcggaagcaggcgaaccucaaggagaugugccuguccgcccuggccaaccucaccuggcagagccgcacccaggacgagcacccgaagaccauguucuccaaggacaaggacaucauccccuucaucgacaaguacugggagugcaugacgacccggcagcgccccggcaagaugaccuggcccaacaacaucgugaagaccaugagcaaggagcgggacgucuuccuggugaaggagcacccggaccccggcuccaaggaccccgaggaggacuaccccaaguucgggcugcucgaccaggaccugagcaacaucggcccggccuacgacaaccagaagcaguccagcgccguguccacgagcgggaaccugaacggcgggaucgcggccggcuccagcggcaaggggcgcggcgccaagcggaagcagcaggacgggggcaccaccggcaccacgaagaaggcccgcuccgacccccucuucagcgcgcagcggcugccgccccacggguacccccuggagcaccccuucaacaaggacggcuaccgcuacauccucgccgagcccgacccccacgccccggaccccgagaagcuggagcuggacugcugggccgggaagcccauccccggcgaccucuaccgggccugccuguacgagcgcguccugcucgcgcugcacgaccgggccccgcagcugaagaucuccgacgaccgccucaccguggugggggagaagggcuacagcaugguccgggccagccacggcgugcgcaagggggccugguacuucgagaucaccguggacgagaugccgcccgacaccgccgcgcggcugggcuggucccagccccuggggaaccuccaggcgccccugggcuacgacaaguucagcuacuccuggcgcagcaagaaggggacgaaguuccaccaguccaucggcaagcacuacagcuccggcuacgggcagggcgacguccugggguucuacaucaaccuccccgaggacaccgagaccgccaagagccugcccgacaccuacaaggacaaggcccugaucaaguucaaguccuaccucuacuucgaggagaaggacuucguggacaaggccgagaagucccugaagcagacgccccacagcgagaucaucuucuacaagaacggcgugaaccagggggucgccuacaaggacaucuucgagggcguguacuucccggccaucagccuguacaaguccugcaccgugagcaucaacuucggccccugcuucaaguacccgcccaaggaccucaccuaccggcccauguccgacaugggguggggcgccgucguggagcacacccuggccgacgugcuguaccacgucgagacggagguggacgggcgccggagcccgcccugggagcccuga

SEQ ID NO: 26957 - RNA, 1587 nt, Artificial Sequence
  derived and/or modified sequence opt1 from ASIC1__Homo_sapiens__NP_001086
auggagcugaaggccgaggaggaggaggugggcgggguccagcccgugagcauccaggccuucgcguccagcuccacccuccacggccuggcccacaucuucagcuacgagcgccugucccucaagcgggcccugugggcccugugcuuccucgggagccuggccgugcugcucugcgucugcaccgagcgcgugcaguacuacuuccacuaccaccacgugaccaagcuggacgaggucgcggccucccagcugaccuucccggccgugacccucugcaaccugaacgaguuccgguucagccagguguccaagaacgaccuguaccacgccggcgagcuccuggcgcugcucaacaaccgcuacgagauccccgacacccagauggccgacgagaagcagcuggagauccugcaggacaaggccaacuuccggagcuucaagcccaagcccuucaacaugcgcgaguucuacgaccgggccgggcacgacauccgcgacaugcuccuguccugccacuuccggggcgaggucugcagcgccgaggacuucaaggugguguucacgcgcuacggcaagugcuacaccuucaacuccgggcgggacggccgcccgcggcugaagaccaugaagggcggcaccgggaacggccucgagaucaugcuggacauccagcaggacgaguaccugcccgucuggggcgagacggacgagaccagcuucgaggcggggaucaaggugcagauccacucccaggacgagccgcccuucaucgaccagcucggcuucgggguggcccccggcuuccagaccuucgucgccugccaggagcagcgccugaucuaccugcccccgcccugggggaccugcaaggccgugacgauggacagcgaccucgacuucuucgacuccuacagcaucaccgccugccggaucgacugcgagacccgcuaccugguggagaacugcaacugccggaugguccacaugcccggggacgcgcccuacugcacccccgagcaguacaaggagugcgccgaccccgcccuggacuuccucguggagaaggaccaggaguacugcgugugcgagaugccgugcaaccugacgcgcuacggcaaggagcuguccauggucaagauccccagcaaggccagcgccaaguaccucgcgaagaaguucaacaaguccgagcaguacaucggggagaacauccuggugcuggacaucuucuucgaggugcucaacuacgagaccaucgagcagaagaaggccuacgagaucgccggccugcugggggacaucggcggccagaugggccucuucaucggggccagcauccugaccguccuggagcuguucgacuacgccuacgaggugaucaagcacaagcucugccggcgcgggaagugccagaaggaggcgaagcgguccagcgccgacaagggcgucgcccugucccucgacgacgugaagcgccacaaccccugcgagagccugcgcgggcaccccgccggcaugaccuacgcggccaacauccugccgcaccaccccgcccggggcacguucgaggacuucacgugcuga

SEQ ID NO: 26958 - RNA, 1539 nt, Artificial Sequence
  derived and/or modified sequence opt1 from ASIC2__Homo_sapiens__NP_001085
auggaccugaaggagagccccuccgagggcagccuccagccguccagcauccagaucuucgccaacaccuccacccugcacgggauccgccacaucuucguguacggcccccugacgauccggcgcguccucugggccguggcguucguggggagccugggccugcuccuggucgaguccagcgagcggguguccuacuacuucagcuaccagcacgugaccaaggucgacgaggugguggcccagucccuggucuuccccgccgugacccucugcaaccugaacggguuccgcuucagccggcugaccacgaacgaccucuaccacgccggcgagcugcuggcccuccuggacgugaaccugcagauccccgacccgcaccucgcggaccccuccguccuggaggcccugcgccagaaggccaacuucaagcacuacaagcccaagcaguucagcaugcucgaguuccugcaccgggugggccacgaccugaaggacaugaugcucuacugcaaguucaaggggcaggagugcggccaccaggacuucaccaccguguucaccaaguacgggaagugcuacauguucaacuccggcgaggacgggaagccccugcugacgaccgucaagggcggcaccgggaacggccucgagaucaugcuggacauccagcaggacgaguaccugccgaucuggggcgagaccgaggagacgaccuucgaggccggggugaaggugcagauccacagccaguccgagccgcccuucauccaggagcucggcuucggggucgcgcccggcuuccagaccuucguggccacccaggagcagcgccugacguaccugcccccgcccuggggcgagugccggagcuccgagauggggcucgacuucuuccccguguacagcaucaccgccugccgcaucgacugcgagacccgguacaucgucgagaacugcaacugccgcauggugcacaugcccggggacgcccccuucugcacccccgagcagcacaaggagugcgccgagcccgcgcugggccugcucgccgagaaggacagcaacuacugccugugccggacgccgugcaaccugacccgcuacaacaaggagcucuccauggugaagauccccagcaagaccuccgccaaguaccuggagaagaaguucaacaagagcgagaaguacaucuccgagaacauccugguccucgacaucuucuucgaggcccugaacuacgagaccaucgagcagaagaaggccuacgagguggcggcccugcucggcgacaucgggggccagauggggcuguucaucggcgccagcauccugacgauccucgagcuguucgacuacaucuacgagcugaucaaggagaagcugcucgaccugcuggggaaggaggaggacgagggcucccacgacgagaacgucagcacgugcgacaccaugcccaaccacuccgagaccaucagccacaccgugaacgugccccuccagaccacccugggcacccuggaggagaucgccugcuga

SEQ ID NO: 26959 - RNA, 1596 nt, Artificial Sequence
  derived and/or modified sequence opt1 from ASIC3__Homo_sapiens__NP_004760
augaagcccaccagcggccccgaggaggcccgccggcccgccuccgacauccgcguguucgcgagcaacugcuccaugcacgggcugggccacgucuucgggcccggcagccucucccugcggcgcgggaugugggccgccgccguggugcugagcgucgccaccuuccucuaccagguggcggagcgggugcgcuacuaccgggaguuccaccaccagacggcccuggacgagcgcgagucccaccggcugaucuuccccgccgucacccucugcaacaucaacccgcugcgccggagccgccugacccccaacgaccuccacugggccggcuccgcgcugcugggccucgaccccgccgagcacgccgccuuccugcgggcccuggggcggcccccggcgccgcccggcuucaugcccagccccaccuucgacauggcccagcucuacgcccgcgccgggcacucccuggacgacaugcugcucgacugccgcuuccggggccagcccugcgggcccgagaacuucacgaccaucuucacccgcaugggcaagugcuacaccuucaacagcggcgccgacggggcggagcugcugacgaccacccggggcgggaugggcaacggccucgacaucaugcuggacgugcagcaggaggaguaccugcccguguggcgcgacaacgaggagaccccguucgaggucgggauccgggugcagauccacucccaggaggagccgcccaucaucgaccagcucggccugggggugagccccggcuaccagacguucgucuccugccagcagcagcagcugagcuuccugcccccgcccuggggcgacugcuccagcgccucccucaaccccaacuacgagcccgagcccagcgacccccuggggagccccuccccgagccccuccccgcccuacacccucaugggcugccgccuggccugcgagacccgcuacguggcccggaagugcgggugccgcaugguguacaugcccggcgacguccccgugugcagcccccagcaguacaagaacugcgcccacccggcgaucgacgccaugcugcggaaggacuccugcgccugccccaaccccugcgccagcacccgcuacgccaaggagcucuccauggugcggauccccagccgcgcggccgcccgguuccuggcccgcaagcugaaccgguccgaggcguacaucgccgagaacguccucgcccuggacaucuucuucgaggcccugaacuacgagacgguggagcagaagaaggccuacgagaugagcgagcuccugggggacaucggcgggcagaugggccuguucaucggcgcgucccuccugaccauccuggagauccucgacuaccugugcgagguguuccgcgacaagguccugggguacuucuggaaccggcagcacagccagcgccacuccagcaccaaccuccugcaggagggccuggggucccaccggacccaggugccgcaccugagccucggcccccgcccgcccacgccgcccugcgccgugaccaagacccuguccgccagccaccggaccugcuaccuggucacgcagcucuga

SEQ ID NO: 26960 - RNA, 1944 nt, Artificial Sequence
  derived and/or modified sequence opt1 from ASIC4__Homo_sapiens__NP_878267
augcugagcggcgccgccggggcggcccgccggggcggggccgcccucgcccccucccugacccgcagccuggcgggcacccacgccggggccgacuccugcgccggcgcggacaagggcagccacaaggagacgaucgaggagcgggacaagcgccagcagcggcagcagcgccagcggcagcaccaggggugcggcgccgccggguccggcagcgacuccccgaccagcgggccccaccccgugcccguccucuucccgcuggcccugucccucgaggagcagccccugccgccccugccccucggccgcgcccccggccugcuggcgcgggaggggcagggccgcgaggcccucgccagccccuccagccgggggcagaugcccaucgagaucgugugcaagaucaaguucgccgaggaggacgccaagccgaaggagaaggaggcgggcgacgagcagucccugcugggcgccguggcccccggggccgcgccccgcgaccucgccaccuucgccagcaccuccacgcugcacggccuggggcgggccugcggccccgggccgcacggccuccgccggacccugugggcccuggcccuccugaccagccuggcggccuuccucuaccaggccgccggccuggcgcgcggguaccugacccggccccaccucgucgccauggaccccgccgcccccgccccgguggcgggcuuccccgccgugacgcugugcaacaucaaccgcuuccggcacuccgcccugagcgacgccgacaucuuccaccucgccaaccugaccgggcugccgcccaaggaccgcgacggccaccgggcggccgggcuccgcuaccccgagcccgacauggucgacauccugaaccgcaccggccaccagcuggccgacaugcucaaguccugcaacuucagcggccaccacugcagcgccuccaacuucagcgugguguacacccgguacgggaagugcuacacguucaacgccgacccccgcuccagccugcccucccgggcgggcgggaugggcagcgggcuggagaucaugcucgacauccagcaggaggaguaccugccgaucuggcgcgagaccaacgagaccuccuucgaggccggcauccggguccagauccacagccaggaggagccgcccuacauccaccagcugggcuucggggugucccccggcuuccagaccuucgugagcugccaggagcagcgccucacguaccugccccagcccugggggaacugccgggccgaguccgagcugcgcgagcccgagcuccagggcuacagcgccuacuccgucagcgcgugccggcugcgcugcgagaaggaggccgugcugcagcggugccacugccgcauggugcacaugccggacucccucggcgggggccccgaggggcccugcuucugccccaccccgugcaaccugacccgguacggcaaggagaucagcaugguccgcauccccaaccggggguccgcccgcuaccuggcccggaaguacaaccgcaacgagaccuacauccgggagaacuuccuggugcucgacguguucuucgaggcccugacgagcgaggcgauggagcagcgcgccgccuacggccuguccgcccuccugggcgaccucgggggccagaugggccuguucaucggggccagcauccugacccugcucgagauccuggacuacaucuacgaggucagcugggaccgccugaagcggguguggcgccggcccaagacgccccuccgcaccuccaccgggggcaucagcacccugggccugcaggagcucaaggagcaguccccgugccccagccgggggcgcguggagggcgggggcgucuccagccugcugcccaaccaccaccacccccacgggccgcccggcggccucuucgaggacuucgcgugcuga

SEQ ID NO: 26961 - RNA, 1518 nt, Artificial Sequence
  derived and/or modified sequence opt1 from ASIC5__Homo_sapiens__NP_059115
auggagcagaccgagaaguccaagguguacgccgagaacggccugcucgagaagaucaagcugugccugagcaagaagccccuccccagccccaccgagcgcaagaaguucgaccacgacuucgccaucuccacgagcuuccacgggauccacaacaucguccagaaccgguccaagauccgccgggugcuguggcugguggucgugcucggcagcgugucccuggucaccuggcagaucuacauccgccugcucaacuacuucaccuggcccaccacgaccagcaucgaggugcaguacguggagaagauggaguuccccgcggucaccuucugcaaccugaaccgguuccagaccgacgccguggccaaguucggggugaucuucuuccuguggcacaucgucuccaaggugcuccaccuccaggagaucacggccaacagcaccggcucccgcgaggccaccgacuucgcggccagccaccagaacuucuccaucguggaguucauccggaacaagggguucuaccugaacaacagcacccugcuggacugcgaguucuucggcaagccgugcucccccaaggacuucgcccacgucuucacggaguacggcaacugcuucaccuucaaccacggggagacccugcaggccaagcgcaaggugagcguguccggccgggggcucagccugcuguucaacgucaaccaggaggcguucaccgacaaccccgcccucggcuucguggacgccgggaucaucuucgugauccacucccccaagaaggucccgcaguucgacggccugggccugcucagccccguggggaugcacgcccgcgugacgauccggcaggucaagaccgugcaccaggaguaccccuggggcgagugcaaccccaacaucaagcugcagaacuucagcuccuacagcaccuccgggugccugaaggagugcaaggcccagcacaucaagaagcagugcggcugcgucccguuccuccugcccggcuacgggaucgagugcgaccugcagaaguacuucagcugcgugucccccgugcucgaccacaucgaguucaaggaccugugcaccgucggcacgcacaacagcuccugccccgugagcugcgaggagaucgaguacccggcgaccaucuccuacagcuccuuccccagccagaaggcccugaaguaccucuccaagaagcugaaccagagccgcaaguacauccgggagaaccuggugaagaucgagaucaacuacuccgaccucaacuacaagaucacccagcagcagaaggccgucagcguguccgagcugcuggccgaccucgggggccagcuggggcuguucugcggcgccagccucaucaccaucaucgagaucaucgaguaccuguucacgaacuucuacuggaucugcaucuucuuccugcucaagaucuccgagaugacccaguggaccccgccgccccagaaccaccugggcaacaagaaccgcaucgaggagugcuga

SEQ ID NO: 26962 - RNA, 411 nt, Artificial Sequence
  derived and/or modified sequence opt1 from ASIP__Homo_sapiens__XP_005260469
augcccccgggcauggacgugacccgccugcuccuggccacccugcucgucuuccugugcuucuucaccgccaacagccaccucccgcccgaggagaagcugcgggacgaccgcucccugcggagcaacuccagcgugaaccugcucgacgugcccuccgucagcaucguggcgcugaacaagaaguccaagcagaucgggcgcaaggccgccgagaagaagcggagcuccaagaaggaggccagcaugaagaaggugguccgcccccggacgccccuguccgcccccugcguggcgacccgcaacagcugcaagcccccggcccccgccugcugcgaccccugcgccuccugccagugccgguucuuccgcagcgcgugcuccugccgggugcucagccugaacugcuga

SEQ ID NO: 26963 - RNA, 1395 nt, Artificial Sequence
  derived and/or modified sequence opt1 from ASL__Homo_sapiens__NP_000039
auggccagcgaguccggcaagcuguggggcgggcgcuucgugggggccgucgaccccaucauggagaaguucaacgcgagcaucgccuacgaccggcaccucugggagguggacgugcagggcuccaaggccuacagccgcgggcuggagaaggccggccugcucaccaaggccgagauggaccagauccugcacggccuggacaaggucgcggaggagugggcccaggggaccuucaagcucaacuccaacgacgaggacauccacacggccaacgagcggcgccugaaggagcugaucggcgccaccgcggggaagcuccacaccggccggagccgcaacgaccagguggugaccgaccugcggcuguggaugcgccagacgugcuccacccucagcgggcugcugugggagcucauccggaccauggucgaccgcgccgaggccgagcgggacgugcuguucccgggcuacacccaccuccagcgcgcccagcccauccgguggucccacuggauccugagccacgccguggcgcugacgcgcgacuccgagcggcugcucgagguccgcaagcggaucaacgugcugccccugggcagcggggccaucgccggcaacccccucgggguggaccgcgagcugcugcgggccgagcucaacuucggcgccaucacccugaacuccauggacgcgaccagcgagcgcgacuucgucgccgaguuccuguucugggccucccucugcaugacccaccugagccggauggccgaggaccugauccucuacugcacgaaggaguucuccuucgugcagcugagcgacgccuacuccaccggcagcagccugaugccgcagaagaagaaccccgacucccucgagcugauccgcagcaaggcggggcgcguguucggccggugcgccgggcugcucaugacccugaagggccugcccuccaccuacaacaaggaccuccaggaggacaaggaggccgucuucgaggugagcgacacgauguccgccgugcugcaggucgccaccggggugaucagcacccugcagauccaccaggagaacaugggccaggcgcucucccccgacaugcuggccaccgaccuggccuacuaccucgugcgcaagggcaugccguuccggcaggcccacgaggcgagcgggaaggccgucuucauggccgagacgaagggcguggcccugaaccagcugucccugcaggagcuccagaccaucagcccccuguucuccggggacgugaucugcgucugggacuacggccacagcguggagcaguacggggcccugggcggcaccgcgcgcuccagcgucgacuggcagauccgccaggugcgggcccuccugcaggcccagcaggccuga

SEQ ID NO: 26964 - RNA, 897 nt, Artificial Sequence
  derived and/or modified sequence opt1 from ASMT__Homo_sapiens__NP_001164510
augggcagcuccgaggaccaggccuaccgccugcucaacgacuacgccaacggguucauggugagccagguccuguucgcggccugcgagcugggcguguucgaccuccuggccgaggcccccgggccgcuggacguggccgcggucgccgccggcgugcgggccuccgcgcacgggaccgagcuccugcuggacaucugcgugagccucaagcugcugaaggucgagacccgcggcggcaaggccuucuaccggaacacggagcucuccagcgacuaccugaccaccgugucccccaccagccagugcuccaugcugaaguacauggggcgcacgagcuaccggugcuggggccaccucgccgacgccgugcgcgaggggcggaaccaguaccuggagaccuucggcguccccgccgaggagcuguucaccgcgaucuaccgcuccgagggggagcggcuccaguucaugcaggcccugcaggagguguggagcgugaacggccgcuccguccugaccgccuucgaccucagcguguucccccugaugugcgaccugggcggggacuucuucaaggacccgcuccccgaggccgaccuguacauccuggcccgggugcuccacgacugggcggacggcaagugcucccaccuccuggagcgcaucuaccacacgugcaagcccgggggcggcauccuggucaucgagagccugcuggacgaggaccggcgcgggccccuccugacccagcuguacucccucaacaugcuggugcagaccgagggccaggagcggaccccgacgcacuaccacaugcugcucagcuccgccggguuccgcgacuuccaguucaagaagaccggcgccaucuacgacgccauccuggcccggaaguga

SEQ ID NO: 26965 - RNA, 1818 nt, Artificial Sequence
  derived and/or modified sequence opt1 from ASMTL__Homo_sapiens__NP_001166945
auggugcugugccccgucaucggcaagcuccugcacaagcgcguggugcuggccagcgccuccccgcggcgccaggagauccucagcaacgcggggcugcgguucgaggucgugcccuccaaguucaaggagaagcuggacaaggccagcuucgccacccccuacggcuacgccauggagaccgccaagcagaaggcgcucgagguggccaaccgccuguaccagacggucgggggccugauccucgagaagcccguggacaagcaggacgccuaccggaugcugucccgccugagcgggcgggagcacuccguguucaccggcgucgccaucgugcacugcagcuccaaggaccaccagcucgacacccgcgugagcgaguucuacgaggagaccaaggucaaguucuccgagcugagcgaggagcugcucugggaguacgugcacuccggcgagccgauggacaaggccgggggcuacgggauccaggcccugggcgggaugcugguggagagcguccacggcgacuuccucaacguggugggcuucccccugaaccacuucugcaagcagcuggucaagcucuacuacccgccccggcccgaggaccugcgccgguccgugaagcacgacagcauccccgccgccgacacguucgaggaccuguccgacguggagggcggcgggagcgagcccacccagcgcgacgccgggucccgggacgagaaggcggaggccggcgaggccgggcaggccaccgccgaggcggagugccaccgcacccgggagacgcugcccccguuccccacccgccuccuggagcucaucgagggcuucaugcugagcaaggggcugcucaccgccugcaagcugaaggucuucgaccugcucaaggacgaggcgccccagaaggccgccgacaucgcgagcaagguggacgccuccgccugcggcauggagcggcugcuggacaucugcgccgccauggggcuccuggagaagaccgagcagggcuacagcaacacggagaccgcgaacguguaccuggccuccgacggcgaguacagccuccacggguucaucaugcacaacaacgaccugaccuggaaccuguucaccuaccucgaguucgccauccgcgagggcacgaaccagcaccaccgggcccuggggaagaaggcggaggaccuguuccaggacgccuacuaccagucccccgagacccgccuccgguucaugcgcgccaugcacggcaugaccaagcugaccgccugccaggucgccacggcguucaaccugagccgcuucuccagcgccugcgacgugggcgggugcaccggcgcccucgcccgggagcuggcccgcgaguacccgcggaugcaggucaccguguucgaccugcccgacaucaucgagcuggcggcccacuuccagccgcccgggccccaggccgugcagauccacuucgccgccggcgacuucuuccgcgacccccuccccuccgcggagcuguacguccugugccggauccuccacgacuggcccgacgacaaggugcacaagcugcugagccgcguggccgaguccugcaagccgggggccggccuccugcuggucgagacccuccuggacgaggagaagcggguggcccagcgcgcgcugaugcagagccucaacaugcuggugcagacggaggggaaggagcggucccugggcgaguaccagugccuccuggagcugcacggcuuccaccagguccagguggugcaccucgggggcguccuggacgccauccuggccaccaagguggcccccuga

SEQ ID NO: 26966 - RNA, 1047 nt, Artificial Sequence
  derived and/or modified sequence opt1 from ASNA1__Homo_sapiens__NP_004308
auggccgccggcguggcgggguggggcgucgaggccgaggaguucgaggacgcccccgacguggagccccuggagcccacccucagcaacaucaucgagcagcgcucccugaaguggaucuucgucgggggcaagggcggggugggcaagaccacgugcagcugcucccuggccgugcagcucagcaaggggcgggaguccgugcugaucaucagcaccgaccccgcccacaacaucuccgacgcguucgaccagaaguucagcaagguccccaccaaggugaagggcuacgacaaccuguucgccauggagaucgacccgucccucgggguggccgagcugcccgacgaguucuucgaggaggacaacaugcugagcaugggcaagaagaugaugcaggaggccauguccgcguuccccgggaucgacgaggccaugagcuacgccgaggucaugcgccucgugaagggcaugaacuucuccguggucguguucgacaccgcccccacgggccacacccugcggcugcucaacuucccgaccaucguggagcgcgggcugggccggcugaugcagaucaagaaccagaucagccccuucaucucccagaugugcaacaugcucgggcugggcgacaugaacgccgaccagcuggcgagcaagcucgaggagacccugcccgucauccgcuccgugagcgagcaguucaaggaccccgagcagacgaccuucaucugcgugugcaucgccgaguuccugucccucuacgagaccgagcggcugauccaggagcuggccaagugcaagaucgacacccacaacaucaucgucaaccagcucguguucccggaccccgagaagcccugcaagaugugcgaggcccgccacaagauccaggccaaguaccuggaccagauggaggaccuguacgaggacuuccacaucgugaagcucccccugcugccgcacgagguccggggcgcggacaaggugaacacguucagcgcccuccugcuggagcccuacaagccgcccagcgcccaguga

SEQ ID NO: 26967 - RNA, 1623 nt, Artificial Sequence
  derived and/or modified sequence opt1 from ASNS__Homo_sapiens__NP_001171546
augaagaucgcccaccgcggccccgacgccuuccgguucgagaacgugaacggguacaccaacugcugcuucggcuuccaccgccuggcggucguggacccccucuucgggaugcagccgauccgggugaagaaguaccccuaccuguggcugugcuacaacggcgagaucuacaaccacaagaagaugcagcagcacuucgaguucgaguaccagaccaaggucgacggggagaucauccuccaccuguacgacaagggcggcaucgagcagacgaucugcaugcuggacgggguguucgccuucgugcuccuggacaccgccaacaagaaggucuuccugggccgcgacaccuacggggugcggccccucuucaaggccaugaccgaggacggcuuccuggccgugugcagcgaggcgaaggggcuggucacgcucaagcacuccgccaccccguuccugaagguggagcccuuccugcccggccacuacgaggugcucgaccugaagcccaacggcaaggucgccagcguggagauggugaaguaccaccacugccgcgacgucccgcugcacgcccucuacgacaacguggagaagcuguuccccggguucgagaucgagaccgugaagaacaaccugcggauccucuucaacaacgcggucaagaagcgccugaugaccgaccggcgcaucggcugccugcucuccgggggccuggacagcucccugguggccgccacgcuccugaagcagcugaaggaggcccaggugcaguacccccuccagaccuucgccaucggcauggaggacagccccgaccugcuggcggcccggaaggucgccgaccacaucggguccgagcacuacgagguccucuucaacagcgaggagggcauccaggcccuggacgaggugaucuucucccuggagaccuacgacaucaccacggugcgcgccagcguggggauguaccucaucuccaaguacauccggaagaacaccgacagcgucgugaucuucuccggcgaggggagcgacgagcugacccagggcuacaucuacuuccacaaggcgccgucccccgagaaggccgaggaggagagcgagcgccugcuccgggagcuguaccuguucgacgugcuccgcgccgaccggaccacggccgcccacggccuggagcugcgcguccccuuccucgaccaccgguucuccagcuacuaccugucccugcccccggagaugcgcauccccaagaacgggaucgagaagcaccuccugcgggagaccuucgaggacagcaaccugauccccaaggagauccuguggcgccccaaggaggcguucagcgacggcaucaccuccgugaagaacagcugguucaagauccuccaggaguacguggagcaccaggucgacgacgccaugauggccaacgccgcccagaaguucccguucaacacccccaagacgaaggagggguacuacuaccgccagguguucgagcggcacuaccccggccgcgcggacuggcugucccacuacuggaugcccaaguggaucaacgccaccgacccgagcgcccggacccugacccacuacaaguccgccgugaaggcguga

SEQ ID NO: 26968 - RNA, 942 nt, Artificial Sequence
  derived and/or modified sequence opt1 from ASPA__Homo_sapiens__XP_006721590
augaccagcugccacaucgccgaggagcacauccagaagguggccaucuucggcgggacccacggcaacgagcugacgggggucuuccucgugaagcacuggcuggagaacggcgcggagauccagcgcaccgggcuggaggugaagcccuucaucaccaacccgcgggccgucaagaagugcacccgcuacaucgacugcgaccucaaccggaucuucgaccuggagaaccugggcaagaagauguccgaggaccuccccuacgaggugcgccgggcccaggagaucaaccaccuguucggccccaaggacagcgaggacuccuacgacaucaucuucgaccugcacaacacgaccagcaacauggggugcacccucauccuggaggacucccgcaacaacuuccugauccagauguuccacuacaucaagaccagccucgcgccccugccgugcuacguguaccugaucgagcaccccucccucaaguacgccacgacccggagcaucgccaaguaccccgucggcaucgagguggggccccagccgcagggcgugcugcgcgccgacauccuggaccagaugcggaagaugaucaagcacgcccucgacuucauccaccacuucaacgaggggaaggaguucccgcccugcgccaucgaggucuacaagaucaucgagaagguggacuacccccgcgacgagaacggcgagaucgcggccaucauccaccccaaccugcaggaccaggacuggaagccccugcaccccggcgaccccauguuccucacccuggacgggaagaccaucccgcugggcggggacugcacgguguaccccgucuucgugaacgaggccgccuacuacgagaagaaggaggccuucgcgaagaccaccaagcucacccugaacgccaaguccauccggugcugccugcacuga

SEQ ID NO: 26969 - RNA, 1722 nt, Artificial Sequence
  derived and/or modified sequence opt1 from ASPG__Homo_sapiens__NP_001073933
auggcccgcgccgugggccccgagcggcgccugcucgcggucuacaccgggggcaccaucgggaugcggagcgagcugggcgugcuggugccggggacgggccucgccgccauccugcgcacccugcccauguuccacgacgaggagcacgcccgggcccgcggccucuccgaggacacccugguccugccgcccgcgagccggaaccagcgcauccucuacaccgugcuggagugccagccccuguucgacuccagcgacaugacgaucgccgagugggugugccucgcccagaccaucaagcggcacuacgagcaguaccacggguucgucgugauccacggcaccgacaccauggccuucgcggccuccaugcugagcuucaugcuggagaaccuccagaagacggugauccugaccggggcccagguccccauccacgcccugugguccgacggccgcgagaaccuccugggggcccugcucauggcgggccaguacgugauccccgaggugugccuguucuuccagaaccagcuguuccggggcaaccgcgccaccaaggucgacgcccggcgcuucgccgccuucugcagccccaaccuccugccgcuggcgaccgugggggccgacaucacgaucaaccgggagcucgugcgcaaggucgacggcaaggccgggcugguggugcacuccagcauggagcaggacgucggccugcuccggcuguaccccggcauccccgccgcccuggugcgcgcguuccuccagcccccgcugaaggggguggucauggagaccuucggcuccgggaacggccccaccaagcccgaccugcuccaggagcugcggguggccaccgagcgcgggcuggugaucgucaacugcacgcacugccuccagggcgccgugaccaccgacuacgccgccggcauggcgauggccggggccggcgucaucagcggguucgacaugaccuccgaggccgcgcuggccaagcugagcuacgugcucggccagcccgggcugucccuggacgugcggaaggagcuccugacgaaggaccugcgcggcgagaugaccccgcccagcgucgaggagcgccggcccucccuccagggcaacacccucgggggcggggugagcuggcugcugucccugagcggcagccaggaggccgacgcccugcgcaacgcccuggugcccucccucgcgugcgccgccgcccacgccggggacgucgaggcgcugcaggcccugguggagcucggcagcgaccugggccugguggacuucaacgggcagaccccgcuccacgccgccgcccggggcgggcacacggaggcggucaccaugcugcugcagcgcggcguggacgugaacacccgggacaccgacggcuucagcccccuccugcuggccguccgcgggcggcaccccggcgugaucgggcuccugcgcgaggccggcgccucccuguccacgcaggagcucgaggaggcggggaccgagcugugccggcuggccuaccgcgccgaccucgagggccuccaggugugguggcaggccggcgccgaccuggggcagcccggcuacgacgggcacagcgcgcugcacgucgccgaggccgccggcaaccuggccgugguggcguuccugcagucccucgagggggccgucggcgcccaggccccgugccccgaggugcugcccggcguguga

SEQ ID NO: 26970 - RNA, 2190 nt, Artificial Sequence
  derived and/or modified sequence opt1 from ASPH__Homo_sapiens__NP_001158222
auggccgaggacaaggagaccaagcacggcgggcacaagaacggccgcaagggcgggcugagcgggaccuccuucuucaccugguucauggugaucgcccuccugggcgucuggaccagcguggcgguggucugguucgaccugguggacuacgaggaggugcucggcaagcuggggaucuacgacgccgacggcgacggggacuucgacgucgacgacgccaaggugcugcucggccugaaggagcgguccaccagcgagcccgccgugccgcccgaggaggccgagccccacaccgagcccgaggagcaggucccgguggaggcggagccccagaacaucgaggacgaggccaaggagcagauccagucccugcuccacgagauggugcacgccgagcacgucgagggggaggaccugcagcaggaggacggccccacgggcgagccccagcaggaggacgacgaguuccugauggccaccgacguggacgaccgcuucgagacccucgagccggaggugagccacgaggagaccgagcacuccuaccacgucgaggagacggugagccaggacugcaaccaggacauggaggagaugauguccgagcaggagaaccccgacagcuccgagcccguggucgaggacgagcggcugcaccacgacaccgacgacgugaccuaccagguguacgaggagcaggcggucuacgagccccuggagaacgaggggaucgagaucaccgaggugacggccccgcccgaggacaaccccguggaggacagccaggucaucguggaggaggucuccaucuuccccguggaggagcagcaggaggugccgcccgagaccaaccgcaagaccgacgaccccgagcagaaggccaaggucaagaagaagaagcccaagcuccugaacaaguucgacaagaccaucaaggccgagcuggacgccgcggagaagcuccggaagcgcggcaagaucgaggaggccgugaacgccuucaaggagcuggugcggaaguacccgcagagcccccgcgcccgguacgggaaggcccagugcgaggacgaccuggcggagaagcgccgguccaacgagguccuccgcggcgccaucgagacguaccaggagguggccagccugcccgacgugcccgccgaccugcucaagcugucccugaagcggcgcagcgaccggcagcaguuccucggccacaugcgcgggucccugcugacccuccagcggcugguccagcuguucccgaacgacaccagccucaagaacgaccugggcgugggguaccugcucaucggcgacaacgacaacgccaagaagguguacgaggagguccugagcgugacccccaacgacggguucgcgaaggugcacuacggcuucauccugaaggcccagaacaagaucgccgaguccauccccuaccucaaggagggcaucgagagcggggaccccggcacggacgacgggcgcuucuacuuccaccugggcgacgccaugcagcgggucgggaacaaggaggccuacaagugguacgagcugggccacaagcgcggccacuucgcguccguguggcagcggagccucuacaacgugaacgggcugaaggcccagccgugguggacccccaaggagaccggcuacaccgagcuggucaagucccucgagcgcaacuggaagcugauccgcgacgaggggcuggccgugauggacaaggccaagggccucuuccugcccgaggacgagaaccugcgggagaagggggacuggagccaguucacgcuguggcagcagggccgccggaacgagaacgcgugcaagggcgccccgaagaccugcacccuccuggagaaguuccccgagaccacggggugccgccggggccagaucaaguacuccaucaugcaccccgggacccacguguggccccacaccggcccgaccaacugccgccugcggaugcaccucggccuggucauccccaaggaggggugcaagauccgcugcgccaacgagacgaagaccugggaggagggcaaggugcugaucuucgacgacagcuucgagcacgagguguggcaggacgccuccagcuuccggcucaucuucaucgucgacguguggcaccccgagcugacgccccagcagcgccggucccugccggccaucuga

SEQ ID NO: 26971 - RNA, 5679 nt, Artificial Sequence
  derived and/or modified sequence opt1 from ASPM__Homo_sapiens__NP_001193775
auggccaaccgccgggugggccgcgggugcugggaggugagccccacggagcggcgcccgcccgccggccugcgggggcccgcggccgaggaggaggccagcuccccgcccgugcucucccugagccacuucugccgcucccccuuccugugcuucggcgacgugcuccugggggccagccggacccugucccucgcccuggacaaccccaacgaggaggucgcggaggugaagaucagccacuuccccgccgccgaccugggcuucuccgugagccagcgcugcuucguccuccagccgaaggagaagaucgugaucuccgugaacuggacgccccugaaggagggccggguccgcgagaucaugaccuuccuggugaacgacgugcucaagcaccaggccauccugcuggggaacgcggaggagcagaagaagaagaagcggagccucugggacaccaucaagaagaagaagaucuccgccagcaccucccacaaccgccgggucagcaacauccagaacgugaacaagacguucuccgugagccagaaggucgaccgcgugcggagcccccugcaggccugcgagaaccuggccaugaacgagggcgggcccccgaccgagaacaacagccucauccuggaggagaacaagauccccaucagccccaucucccccgccuucaacgagugccacggcgcgaccugccugccgcucagcgugcgccgguccaccacguacagcucccugcacgccagcgagaaccgcgagcugcucaacguccacuccgccaacgugagcaagguguccuucaacgagaaggccgucaccgagaccagcuucaacuccgugaacgugaacgggcagcggggcgagaacagcaagcugucccugacccccaacugcagcuccacgcucaacaucacccagagccagauccacuuccugucccccgacagcuucgucaacaacucccacggcgccaacaacgagcuggagcucgugaccugccugagcagcgacauguucaugaaggacaacucccagcccguccaccuggagagcaccaucgcgcacgagaucuaccagaagauccucuccccggacagcuucaucaaggacaacuacgggcugaaccaggaccuggaguccgagagcgugaaccccauccucucccccaaccaguuccugaaggacaacauggccuacaugugcacgagccagcagaccugcaaggugccccuguccaacgagaacagccaggucccgcagucccccgaggacuggcgcaagagcgaggugagcccccggauccccgagugccagggcagcaaguccccgaaggccaucuucgaggagcucguggagaugaaguccaacuacuacuccuucaucaagcagaacaaccccaaguucagcgccguccaggacaucagcucccacagccacaacaagcagcccaagcgccgcccgauccuguccgccaccgugaccaagcggaaggcgacgugcacccgcgagaaccagaccgagaucaacaagcccaaggccaagcggugccugaacagcgccgugggggagcacgagaaggucaucaacaaccagaaggagaaggaggacuuccacuccuaccuccccaucaucgaccccauccugagcaaguccaagagcuacaagaacgaggugaccccguccagcacgaccgccuccguggcccgcaagcggaaguccgacggcuccauggaggacgcgaacguccgcguggccaucaccgagcacaccgaggugcgggagaucaagcgcauccacuucagccccuccgagcccaagacgagcgccgucaagaagaccaagaacgugaccacccccaucuccaagcggaucagcaaccgcgagaagcugaaccucaagaagaagacggaccuguccaucuuccggaccccgaucagcaagaccaacaagcgcaccaagcccaucaucgccguggcgcagagcucccugacguucaucaagccccucaagaccgacaucccccggcacccgaugcccuucgccgccaagaacauguucuacgacgagcgcuggaaggagaagcaggagcagggcuucaccugguggcugaacuucauccugacccccgacgacuucaccgucaagacgaacaucagcgaggugaacgccgccacccugcuccuggggaucgagaaccagcacaagaucuccgugccccgggcgccgaccaaggaggagaugagccugcgcgccuacaccgcccggugccgccucaaccggcugcgccgcgccgccugccggcuguucacguccgagaagauggucaaggcgaucaagaagcucgagaucgagaucgaggcccgccggcugaucgugcgcaaggaccggcaccuguggaaggacgugggcgagcgccagaagguccucaacuggcugcugagcuacaacccccucuggcugcggaucgggcuggagaccaccuacggcgagcucaucucccuggaggacaacagcgacgugaccgggcuggccauguucauccucaaccgccugcuguggaaccccgacaucgccgccgaguaccggcaccccacggugccgcaccucuaccgcgacggccacgaggaggcgcuguccaaguucacccugaagaagcuccugcugcucgucugcuuccuggacuacgccaagaucagccggcugaucgaccacgaccccugccucuucugcaaggacgccgaguucaaggccuccaaggagauccugcuggcguucagccgcgacuuccucuccggcgagggggaccugagccggcaccugggccuccuggggcugcccgugaaccacgugcagacccccuucgacgaguucgacuucgccgucaccaaccucgccguggaccugcagugcggcgugcgccugguccggacgauggagcuccugacccagaacugggaccuguccaagaagcuccgcaucccggccaucagccggcugcagaagaugcacaacguggacaucgugcugcagguccucaagucccgcgggaucgagcugagcgacgagcacggcaacaccauccuguccaaggacaucguggaccggcaccgcgagaagacccuccggcugcuguggaagaucgccuucgcguuccagguggacaucagccucaaccuggaccagcugaaggaggagaucgccuuccucaagcacaccaagagcaucaagaagaccaucucccugcugagcugccacuccgacgaccucaucaacaagaagaagggcaagcgcgacagcggguccuucgagcaguacagcgagaacaucaagcugcugauggacugggucaacgccgugugcgccuucuacaacaagaagguggagaacuucaccgucuccuucagcgacggccgcgugcucugcuaccugauccaccacuaccaccccugcuacgugcccuucgacgccaucugccagcggaccacgcagaccgucgagugcacccagaccggguccguggugcugaacagcuccagcgaguccgacgacagcucccucgacaugagccugaaggcguucgaccacgagaacacguccgagcuguacaaggagcuccuggagaacgagaagaagaacuuccaccugguccgcagcgccgugcgggaccucggcgggaucccggccaugaucaaccacuccgacaugagcaacaccauccccgacgagaagguggucaucaccuaccugagcuuccugugcgcccgccuccuggaccugcggaaggagauccgcgccgcgcggcucauccagaccacguggcgcaaguacaagcugaagaccgaccugaagcggcaccaggagcgcgagaaggccgcccggaucauccagcucgccgugaucaacuuccuggcgaagcagcgccugcggaagcgcgucaacgccgcccucgugauccagaaguacuggcggcgcgugcuggcccagcggaagcugcucaugcugaagaaggagaagcuggagaagguccagaacaaggccgcgucccucauccaggccauguggcgccgguaccgcgccaagaaguaccugugcaaggugaaggccgccugcaagauccaggcgugguaccgcugcuggcgggcccacaaggaguaccuggccauccucaaggccgugaagaucauccagggcugcuucuacaccaagcuggagcgcacccgguuccugaacguccgcgccagcgcgaucaucauccagcggaaguggcgcgccauccugcccgccaagaucgcccacgagcacuuccucaugaucaagcggcaccgcgccgcgugccugauccaggcccacuaccggggcuacaaggggcgccagguguuccugcggcagaaguccgccgcccucaucauccagaaguacauccgcgcgcgggaggccggcaagcacgagcgcaucaaguacaucgaguucaagaaguccacggugauccugcaggcccugguccggggguggcucgugcgcaagcgguuccuggagcagcgcgccaagauccggcugcuccacuucaccgccgcggccuacuaccaccugaacgccgugcgcauccagcgggccuacaagcuguaccucgccgucaagaacgcgaacaagcaggucaacuccgugaucugcauccagcgcugguuccgcgcccggcugcaggagaagcgcuucauccagaaguaccacagcaucaagaagaucgagcacgagggccaggagugccugucccagcggaaccgcgccgccagcgucauccagaaggccgugcggcacuuccuccugcgcaagaagcaggagaaguucaccuccggcaucaucaagauccaggcgcuguggcggggguacagcuggcgcaagaagaacgacugcaccaagaucaaggccauccggcucucccuccagguggucaaccgcgagauccgggaggagaacaagcuguacaagcgcacggcccucgcccugcacuaccugcucaccuacaagcaccugagcgcgauccuggaggcccucaagcaccuggagguggugacccggcugagcccccugugcugcgagaacauggcccagagcggcgccaucuccaagaucuucguccugauccgcagcugcaaccgguccaucccgugcauggaggugauccgcuacgccgugcagguccugcucaacgugagcaaguacgagaagaccaccuccgcgguguacgacgucgagaacugcaucgacauccugcuggagcuccugcagaucuaccgggagaagcccgggaacaagguggccgacaagggcgggagcaucuucacgaagaccugcugccugcucgccauccugcugaagaccaccaaccgcgccagcgacgugcggucccgcagcaaggucguggaccgcaucuacucccucuacaagcugacggcccacaagcacaagaugaacaccgagcggauccuguacaagcagaagaagaacagcuccaucagcauccccuucauccccgagaccccggugcgcacccggaucgucucccgccucaagcccgacugggugcugcggcgcgacaacauggaggagaucacgaacccccugcaggcgauccagauggugauggacacccucggcauccccuacuga

SEQ ID NO: 26972 - RNA, 729 nt, Artificial Sequence
  derived and/or modified sequence opt1 from ASPN__Homo_sapiens__NP_001180264
augaaggaguacgugcugcuccuguuccuggcccucugcagcgccaagcccuucuucuccccgagccacaucgcgcugaagaacaugaugcugaaggacauggaggacaccgacgacgacgacgacgacgacgacgacgacgacgacgacgaggacaacucccucuuccccacccgcgagccccggagccacuucuuccccuucgaccuguucccgaugugccccuucggcugccagugcuacucccgcgucgugcacugcagcgaccuggggcucacguccgugcccaccaacauccccuucgacacccggaugcuggaccugcagaacaacaagaucaaggagaucaaggagaacgacuucaagggccucaccagccuguacgggcugauccucaacaacaacaagcugacgaagauccacccgaaggccuuccugaccaccaagaagcuccgccggcuguaccugucccacaaccagcucagcgagaucccccugaaccugcccaagucccucgccgagcugcgcauccacgagaacaaggucaagaagauccagaaggacaccuucaagggcaugaacgcccugcacgugcucgagaugagcgccaacccccuggacaacaacgggaucgagccgggcgcguucgagggcgugacggucuuccacauccggaucgccgaggccaagcugaccuccgugcccaaggacaaccuccccagcuucuga

SEQ ID NO: 26973 - RNA, 1032 nt, Artificial Sequence
  derived and/or modified sequence opt1 from ASPRV1__Homo_sapiens__NP_690005
augggcagccccggggccucccugggcaucaagaaggcccuccagagcgagcaggcgaccgcccugccggccuccgcccccgccgugagccagcccaccgcgcccgccccguccugccugcccaaggccgggcaggucauccccacgcuccugcgcgaggcccccuucagcuccgugaucgcgccgacccugcucugcggcuuccuguuccuggccuggguggccgccgagguccccgaggagagcucccggauggccgggagcggcgcgcgcuccgaggagggccggcgccagcacgccuucgugcccgagcccuucgacggggccaacguggucccgaaccucuggcugcacagcuucgaggugaucaacgaccugaaccacugggaccacaucaccaagcuccgguuccugaaggagucccugcgcggcgaggcccucgggguguacaaccggcugagcccccaggaccagggcgacuacgggaccgucaaggaggcccugcucaaggcguucggcgugcccggcgccgcccccucccaccucccgaaggagaucguguucgccaacagcauggggaagggcuacuaccugaaggggaagaucggcaagguccccgugcgcuuccugguggacuccggcgcccaggucagcguggugcaccccaaccugugggaggaggucacggacggggaccuggacacccuccagcccuucgagaacguggugaaggucgcgaacggcgccgagaugaagauccugggggugugggacaccgccgugucccugggcaagcucaagcugaaggcccaguuccuggucgccaacgcgagcgccgaggaggccaucaucgggaccgacgugcuccaggaccacaacgccauccuggacuucgagcaccggacgugcacccugaagggcaagaaguuccgccuccugccggucggcgggagccuggaggacgaguucgaccucgagcugaucgaggaggaccccuccagcgaggagggccggcaggagcugucccacuga

SEQ ID NO: 26974 - RNA, 1944 nt, Artificial Sequence
  derived and/or modified sequence opt1 from ASPSCR1__Homo_sapiens__NP_001238817
auggccgcccccgcgggcgggggcgggagcgccguguccguccuggccccgaacggccgccggcacaccgugaaggugacccccagcacgguccuccuccaggugcuggaggacacgugccgccggcaggacuucaaccccugcgaguacgaccugaaguuccagcgcuccgugcuggaccugagccuccaguggcgguucgccaaccugcccaacaacgccaagcuggagauggucccggcgucccgcagccgggaggggcccgagaacauggugcgcaucgcccuccagcuggacgacggcucccggcugcaggacagcuucugcuccggccagacccucugggagcugcugagccacuucccccagauccgcgagugccuccagcaccccgggggcgccaccccggugugcgucuacacccgggacgaggugaccggggaggccgcgcugcgcggcaccacccugcagucccucgggcugacgggcggcagcgccaccauccgguucgugaugaagugcuacgaccccgucgggaagacccccggcucccuggggagcuccgccagcgccggccaggccgcggccuccgcgccccucccgcuggagagcggcgagcugucccgcggggaccucagccggcccgaggacgccgacaccagcggccccugcugcgagcacacgcaggagaagcaguccacccgcgcccccgccgccgccccguucgugcccuucagcgggggcgggcagcggcugggcggcccgcccgggcccacccgcccccugaccuccagcuccgccaagcuccccaagagccuguccagccccggcgggccguccaagcccaagaaguccaagagcggccaggacccccagcaggagcaggagcaggagcgggagcgcgacccccagcaggagcaggagcgggagcgcccgguggaccgcgagcccgucgaccgggagcccguggugugccacccggaccuggaggagcgccuccaggccuggcccgcggagcugcccgacgaguucuucgagcugacggucgacgacgugcggcgccggcucgcccagcucaagagcgagcgcaagcggcuggaggaggcgccccuggugaccaaggccuuccgcgaggcccagaucaaggagaagcuggagcgguacccgaaggucgcccugcgcguccucuuccccgaccgguacgugcugcagggguucuuccgccccuccgagaccgugggcgaccugcgggacuucgugcgcagccaccucggcaaccccgagcuguccuucuaccuguucaucaccccgcccaagacgguccucgacgaccacacccagacccuguuccagccccagcugggggaccggguggcccccuucacccucggcccgagccugaagcgcugccuggggcccgagcagcggacgcgccugcccguggucggcgacgggggcgacguggacuccggccggcuccuguucugggggcccagccgcggccgcgccuccccgagcaccgggcagccgcccugccaccccgugugccggcccagcuccccgcccagcccccgccccuccagcggcgaccccucccgggucaaggccggccacaagcacguggggaccggccgcgcgaaccuguuccccgccgcccucgugcaccugggggccgaggagccggccggcgucuaccuggagcccgggcuccuggagcacgcgaucagccccuccgccgccgacgugcugguggcccgguacaugagccgcgccgcgggcucccccagcccgcuccccgcccccgaccccgccccgaaguccgagcccgccgccgaggagggcgcgcuggucccgcccgagcccauccccgggaccgcccagcccgugaagcggagccugggcaaggugcccaaguggcucaagcugccggccuccaagcgcuga

SEQ ID NO: 26975 - RNA, 927 nt, Artificial Sequence
  derived and/or modified sequence opt1 from ASRGL1__Homo_sapiens__NP_001077395
augaaccccaucguggucgugcacggcgggggcgccgggccgaucagcaaggaccgcaaggagcgggugcaccagggcaugguccgcgccgcgaccgugggguacggcauccugcgggagggcggguccgccguggacgccgucgagggcgccgugguggcccucgaggacgaccccgaguucaacgcggggugcggcagcguccugaacaccaacggggagguggagauggacgccuccaucauggacggcaaggaccugagcgccggcgccguguccgcgguccagugcaucgccaaccccaucaagcucgcccgccuggugauggagaagacgccccacugcuuccugaccgaccagggggccgcccaguucgcggccgccaugggcgugccggagauccccggggagaagcucgucaccgagcggaacaagaagcgccuggagaaggagaagcacgagaagggcgcccagaagaccgacugccagaagaaccugggcacggugggggccguggcgcucgacugcaagggcaacgucgccuacgccaccagcaccgggggcaucgugaacaagaugguggggcgggucggcgacucccccugccugggcgccgggggcuacgccgacaacgacaucggggcggugagcaccacgggccacggggaguccauccugaaggugaaccucgcccgccugacccuguuccacaucgagcagggcaagaccgucgaggaggccgccgaccucagccugggcuacaugaagucccgggugaaggggcugggcgggcucaucgucgugagcaagaccggcgacuggguggccaaguggacguccaccagcaugcccugggcggccgccaaggacgggaagcugcacuucggcaucgacccggacgacaccaccaucacggaccugcccuga

SEQ ID NO: 26976 - RNA, 1239 nt, Artificial Sequence
  derived and/or modified sequence opt1 from ASS1__Homo_sapiens__XP_005272257
augagcuccaagggcagcgugguccuggccuacuccgggggccucgacaccagcugcauccugguguggcugaaggagcagggguacgacgugaucgccuaccucgcgaacaucggccagaaggaggacuucgaggaggcccgcaagaaggcccugaagcugggggccaagaaggucuucaucgaggacgugucccgggaguucguggaggaguucaucuggcccgccauccagagcuccgcgcucuacgaggaccgcuaccugcugggcaccagccucgcccggccgugcaucgcccgcaagcaggucgagaucgcccagcgggagggcgcgaaguacgugucccacggggccacgggcaaggggaacgaccaggugcgcuucgagcugagcugcuacucccuggcgccccagaucaaggucaucgcccccuggcggaugcccgaguucuacaaccgcuucaagggccggaacgaccucauggaguacgccaagcagcacgggaucccgauccccgugacccccaagaaccccuggagcauggacgagaaccugaugcacaucuccuacgaggccggcauccuggagaacccgaagaaccaggccccgcccggccucuacaccaagacccaggaccccgccaaggcccccaacacgcccgacauccuggagaucgaguucaagaagggggugcccgucaaggugaccaacgugaaggacggcaccacccaccagacgagccuggagcuguucauguaccucaacgaggucgccgggaagcacggcgugggccgcaucgacaucguggagaaccgguucaucgggaugaagucccgcggcaucuacgagacccccgcggggaccauccuguaccacgcccaccucgacaucgaggccuucaccauggaccgggagguccgcaagaucaagcagggccuggggcugaaguucgccgagcucguguacacgggcuucuggcacagcccggagugcgaguucgugcggcacugcaucgccaagucccaggagcgcgucgagggcaagguccaggugagcgugcugaagggccagguguacauccuggggcgggagagcccccucucccuguacaacgaggagcuggucagcaugaacgugcagggggacuacgagcccaccgacgcgaccggcuucaucaacaucaacucccuccgccugaaggaguaccaccggcugcagagcaaggugaccgccaaguga

SEQ ID NO: 26977 - RNA, 1128 nt, Artificial Sequence
  derived and/or modified sequence opt1 from ASTN2__Homo_sapiens__NP_001171663
augcccuucaucaccuaccugagcggccuccugaccgcccagaugcuguccgacgaccagcucaucagcgggguggagauccgcugcgaggagaagggccggugcccguccacgugccaccugugccgccggcccgggaaggagcagcugagccccacccccguccuccuggagaucaaccgcguggugccgcuguacacccucauccaggacaacggcaccaaggaggccuucaaguccgcgcugaugagcuccuacuggugcagcgggaagggcgacgucaucgacgacuggugccggugcgaccuguccgccuucgacgccaacggccuccccaacugcagcccccugcugcagcccgugcuccgccuguccccgacgguggagcccagcuccaccgucgugagccuggaguggguggacguccagcccgccaucgggaccaagguguccgacuacauccuccagcacaagaagguggacgaguacaccgacacggaccuguacaccggcgaguuccugagcuucgccgacgaccuccuguccgggcugggcaccagcugcgucgcggccgggcggucccacggcgaggugcccgaggugagcaucuacagcgucaucuucaagugccucgagccggacggccuguacaaguucacccuguacgccguggacacgcgcgggcggcacuccgagcucagcaccgugacccugcgcaccgccugcccccuggucgacgacaacaaggcggaggagaucgccgacaagaucuacaaccucuacaacggcuacacguccgggaaggagcagcagauggccuacaacacccugauggaggugagcgccuccaugcuguuccgggugcagcaccacuacaacagccacuacgagaaguucggcgacuucgucuggcgcuccgaggacgagcucggcccccggaaggcccaccugauccugcgccggcucgagcgcgugagcucccacugcagcucccugcugcggagcgcguacauccagucccgcguggagaccguccccuaccucuucugccggagcgaggaggugcgcccggccgggauggucugguacuccauccugaaggacaccaagaucacguacaucaucuga

SEQ ID NO: 26978 - RNA, 2121 nt, Artificial Sequence
  derived and/or modified sequence opt1 from ASUN__Homo_sapiens__NP_060634
augaagaucuucagcgagucccacaagaccguguucgucguggaccacugccccuacauggccgagagcugccgccagcacguggaguucgacaugcuggucaagaaccggacccagggcaucaucccgcucgcccccaucuccaagagccuguggacgugcuccguggagagcuccauggaguacugccgcaucauguacgacaucuuccccuucaagaagcuggugaacuucaucgucagcgacuccggggcgcacgugcucaacagcuggacccaggaggaccagaaccugcaggagcugauggccgcccucgccgccguggggcccccgaacccccgggcggaccccgagugcugcuccauccugcacggccuggucgccgccguggagacccucugcaagaucaccgaguaccagcacgaggcccgcacgcugcugauggagaacgcggagcgggugggcaaccgcgggcggaucaucugcaucaccaacgccaagagcgacucccacguccgcaugcucgaggacugcgugcaggagaccauccacgagcacaacaagcuggccgccaacagcgaccaccugaugcagauccagaagugcgagcucgugcugauccacaccuaccccgucggcgaggacucccuggugagcgaccgguccaagaaggagcucagcccggugcugacguccgagguccacagcgugcgcgccggccggcaccuggcgaccaagcucaacauccuggugcagcagcacuucgaccuggccagcaccaccaucacgaacauccccaugaaggaggagcagcacgccaacaccuccgccaacuacgacgucgagcuccugcaccacaaggacgcccacguggacuuccucaagagcggggacucccaccugggcgggggcagccgcgagggguccuucaaggagaccaucacccugaaguggugcacgccccggaccaacaacaucgagcugcacuacugcaccggcgcguaccgcaucagccccguggacgucaacucccggccgagcuccugccucaccaacuuccugcugaacggccgcagcgugcuccuggagcagccccggaaguccgggagcaaggucaucucccacaugcugagcucccacggcggggagaucuuccuccacgugcugagcuccagccgcuccauccuggaggacccgcccagcaucagcgagggcugcggcgggcgggugacggacuaccgcaucaccgacuucggcgaguucaugcgggagaaccgccucacccccuuccuggacccccgcuacaagaucgacgggucccuggaggucccccucgagcgggccaaggaccagcuggagaagcacacccgcuacuggcccaugaucaucagccagacgaccaucuucaacaugcaggccguggugccgcuggccuccgucaucgugaaggagagccucaccgaggaggacgugcugaacugccagaagaccaucuacaaccuggucgacauggagcggaagaacgacccccuccccaucuccacggugggcacccgcgggaagggccccaagcgggacgagcaguaccgcaucauguggaacgagcuggagacccuggugcgggcccacaucaacaacagcgagaagcaccagcgcguccuggagugccucauggcgugccgguccaagccgcccgaggaggaggagcgcaagaagcggggccgcaagcgggaggacaaggaggacaagagcgagaaggccgugaaggacuacgagcaggagaaguccuggcaggacagcgagcgccugaaggggauccuggagcggggcaaggaggagcucgccgaggccgagaucaucaaggacucccccgacagccccgagccgcccaacaagaagccccugguggagauggacgagaccccgcaggucgagaaguccaaggggcccgugagccugcucucccuguggagcaaccgcaucaacacggccaacucccggaagcaccaggaguucgcgggccgccugaacagcgugaacaaccgggccgagcucuaccagcaccugaaggaggagaacgggauggagaccaccgagaacggcaaggccagccgccaguga

SEQ ID NO: 26979 - RNA, 258 nt, Artificial Sequence
  derived and/or modified sequence opt1 from ASXL1__Homo_sapiens__NP_001158075
augaaggacaagcagaagaagaagaaggagcgcaccugggccgaggccgcgcggcuggugcucgagaacuacagcgacgcccccaugaccccgaagcagauccugcaggucaucgaggccgagggccugaaggagaugcgcuccgggacgagcccccucgccugccugaacgccaugcugcacuccaacagccggggcggggagggccucuucuacaagcugcccgggcgcaucucccuguucacccucaagguguga

SEQ ID NO: 26980 - RNA, 4308 nt, Artificial Sequence
  derived and/or modified sequence opt1 from ASXL2__Homo_sapiens__NP_060733
augcgcgagaagggccggcgcaagaaggggcggaccugggccgaggccgcgaagaccgugcuggagaaguaccccaacacgccgaugagccacaaggagauccuccaggucauccagcgcgagggccugaaggagauccgguccgggaccagcccccuggccugccucaacgccaugcugcacaccaacucccgcggcgaggaggggaucuucuacaaggugcccggccggaugggcguguacacccugaagaaggacguccccgacggggugaaggagcucagcgagggcuccgaggagagcuccgacgggcagagcgacucccagagcuccgagaacagcuccagcuccagcgacggcggguccaacaaggagggcaagaagucccgcuggaagcggaagguguccagcagcuccccgcagagcggcugccccucccccacgauccccgccgggaaggucaucagcccgucccagaagcacagcaagaaggcccugaagcaggcgcugaagcagcagcagcagaagaagcagcagcagcagugccgccccuccaucagcaucuccagcaaccagcaccucucccugaagaccgugaaggccgccagcgacuccgugcccgccaagcccgcgaccugggagggcaagcagagcgacgggcagaccggcuccccgcagaacagcaacuccagcuucuccagcagcgucaagguggagaacacgcugcucggccuggggaagaaguccuuccagcggagcgagcgccugcacacccggcagaugaagcgcaccaagugcgccgacaucgacguggagacccccgacuccauccucgucaacacgaaccugcgggcccugaucaacaagcacaccuucagcgugcuccccggcgacugccagcagcgccugcugcuccugcugcccgagguggaccggcaggucgggccggacggccucaugaagcugaacggguccgcccugaacaacgaguucuucaccagcgccgcgcagggcuggaaggagcgccucuccgagggcgaguucacccccgagaugcagguccggauccgccaggagaucgagaaggagaagaagguggagcccuggaaggagcaguucuucgagagcuacuacgggcaguccagcggccugucccuggaggacagcaagaagcucacggccucccccagcgacccgaaggucaagaagacccccgccgagcagcccaaguccaugcccgugagcgaggccucccugauccggaucgugccggucgugagccagagcgagugcaaggaggaggcccugcagauguccagccccgggcgcaaggaggagugcgagucccagggcgaggugcagcccaacuucagcaccuccagcgagccccuccuguccagcgcgcugaacacccacgagcucuccagcauccugccgaucaagugccccaaggacgaggaccugcucgagcagaagcccgugacgagcgccgagcaggagagcgagaagaaccaccugaccaccgccuccaacuacaacaagagcgagucccaggagagccuggugaccuccccgagcaagcccaagucccccggggucgagaagcccaucgugaagccgacggccggcgccggcccccaggagaccaacaugaaggagccccucgcgacccugguggaccagagccccgagagccugaagcgcaaguccagccucacccaggaggaggccccggucuccugggagaagcggccccgcgugacggagaaccggcagcaccagcagcccuuccaggugagcccccagccguuccugaaccgcggggaccggauccagguccgcaaggugccgccccugaagauccccgugucccggaucagccccaugcccuuccaccccucccaggucagcccccgcgcccgguucccgguguccaucaccagccccaaccgcaccggcgcccggacccucgccgacaucaaggcgaaggcccagcuggugaaggcccagcgcgccgcggccgccgccgccgcggccgccgccgccgcggccuccgucgggggcacgauccccgggcccggcccgggcgggggccaggggcccggcgagggcggggagggccagaccgcccgcgggggcagccccggguccgaccgggugagcgagaccggcaagggcccgacccuggagcuggccgggacgggcucccgcgggggcacccgggagcuccugcccugcgggcccgagacccagccccagagcgagaccaagaccacgccgucccaggcccagccccacagcguguccggcgcgcagcugcagcagaccccgcccgucccgcccacccccgccgugagcggcgccugcaccagcgugcccucccccgcccacaucgagaagcucgacaacgagaagcugaaccccacgcgggcgaccgccaccgucgccagcgugucccacccccaggggcccagcuccugccgccaggagaaggccccgagccccaccggccccgcccugaucuccggggcgagccccgugcacugcgccgccgacggcacggucgagcucaaggccgggccguccaagaacauccccaaccccagcgccuccagcaagaccgacgcguccgugcccguggccgucaccccgagcccccugaccucccugcucacgaccgccacccuggagaagcugcccgugccccaggugagcgccaccacggccccggcgggcuccgccccgcccagcuccacccuccccgccgccagcagccugaagacccccggcaccucccugaacaugaacgggcccacgcuccggcccaccagcuccaucccggcgaacaacccccuggucacccagcugcuccagggcaaggacgugcccauggagcagauccugcccaagccgcugaccaagguggagaugaagacggucccccucaccgccaaggaggagcgcgggaugggcgcccugaucgccaccaacaccacggagaacagcacccgcgaggaggugaacgagcggcagucccaccccgccacccagcagcagcuggggaagacccuccagagcaagcagcugccccaggugccgcgcccccugcagcuguucuccgcgaaggagcuccgggacagcuccaucgacacgcaccaguaccacgagggccugagcaaggccacccaggaccagauccuccagacccugauccagcgcguccggcgccagaaccugcucuccguggugccgcccagccaguucaacuucgcccacuccggcuuccagcuggaggacaucagcaccucccagcgguucaugcugggguucgccggccgccggacgagcaagcccgccauggcggggcacuaccuccugaacaucuccaccuacggccgcggcagcgaguccuuccggcgcacccacagcgucaaccccgaggaccgguucugccugagcucccccaccgaggcccucaagaugggguacaccgacugcaagaacgccacgggcgagagcuccagcuccaaggaggacgacaccgacgaggagagcaccggggacgagcaggaguccgugaccgugaaggaggagccccaggucagccaguccgccggcaagggggacacgagcuccggcccgcacagccgcgagacccuguccaccagcgacugccuggccuccaagaacgugaaggcggagaucccccucaacgagcagaccacgcugagcaaggagaacuaccuguucacccggggccagaccuucgacgagaagacccucgcccgcgaccugauccaggccgcccagaagcagauggcccacgcggugcgggggaaggccauccgcuccagccccgagcuguucuccagcacgguccucccccugccggccgacagccccacccaccagccccugcuccugcccccgcugcagacccccaagcucuacggcucccccacccagaucgggccgagcuaccggggcaugaucaacguguccacgagcuccgacauggaccacaacagcgccgugcccgggucccaggucagcuccaacgugggcgacgugaugagcuucuccgucaccgugaccaccauccccgcgagccaggccaugaaccccuccagccacggccagacgaucccggugcaggccuucuccgaggagaacagcaucgaggggacccccuccaagugcuacugccgccugaaggccaugaucaugugcaagggcugcggggccuucugccacgacgacugcaucggccccagcaagcugugcgucagcugccucgugguccgguga

SEQ ID NO: 26981 - RNA, 6747 nt, Artificial Sequence
  derived and/or modified sequence opt1 from ASXL3__Homo_sapiens__NP_085135
augaaggacaagcgcaagaagaaggaccggaccugggccgaggccgcccgccuggcccucgagaagcaccccaacagccccaugaccgccaagcagauccuggaggugauccagaaggagggccugaaggagaccagcgggaccagcccccucgccugccugaacgccaugcugcacaccaacacccggaucggcgacgggacguucuucaagauccccggcaaguccgggcucuacgcgcugaagaaggaggagagcuccugccccgccgacggcacccuggaccucgugugcgagagcgagcuggacggcaccgacauggccgaggccaacgcgcacggggaggagaacggcgugugcuccaagcaggucaccgacgaggccagcuccacgcgcgacagcucccugaccaacaccgccgugcagagcaagcucguguccagcuuccagcagcacaccaagaaggcccugaagcaggcccugcggcagcagcagaagcgccggaacgggguguccaugauggugaacaagacggugccccgcgugguccucacgccccucaaggugagcgacgagcaguccgacagccccuccggcagcgagagcaagaacggggaggcggacuccagcgacaaggagaugaagcacggccagaagucccccaccggcaagcagaccagccagcaccugaagcggcucaagaaguccgggcugggccaccugaaguggacgaaggccgaggacaucgacaucgagacccccgggagcauccucgugaacaccaaccugcgcgcccugaucaacaagcacaccuucgccucccucccccagcacuuccagcaguaccugcugcuccugcugcccgaggucgaccggcagaugggcagcgacggcauccuccgccuguccacgagcgcccugaacaacgaguucuucgcguacgccgcccagggguggaagcagcggcucgccgagggcgaguucacccccgagaugcagcugcgcauccggcaggagaucgagaaggagaagaagaccgagcccuggaaggagaaguucuucgagcgcuucuacggggagaagcugggcaugucccgggaggagagcgugaagcucaccacggggcccaacaacgccggcgcgcaguccagcuccagcugcggcaccuccgggcugcccgugagcgcccagaccgcccuggccgagcagcagcccaaguccaugaagucccccgccagccccgagcccggcuucugcgcgacccucugccccauggucgagaucccgcccaaggacaucauggccgagcuggaguccgaggacauccugauccccgaggagagcgugauccaggaggagaucgccgaggagguggagacguccaucugcgagugccaggacgagaaccacaagaccauccccgaguucagcgaggaggccgagucccucaccaacagccacgaggagccccagaucgcgccgcccgaggacaaccuggaguccugcgucaugaugaacgacgugcuggagacccucccccacaucgaggugaagaucgagggcaaguccgagagcccccaggaggagaugacggucgugaucgaccagcuggaggugugcgacucccugauccccuccaccagcuccaugacccacgucagcgacaccgagcacaaggaguccgagacggccguggagaccagcacccccaagaucaagaccggcuccagcagccucgaggggcaguuccccaacgagggcaucgccaucgacauggagcugcaguccgaccccgaggagcagcugagcgagaacgccugcaucuccgagaccagcuucuccagcgagucccccgagggcgccugcacgagccugcccucccccggcggggagacccagagcaccuccgaggagagcugcacccccgcgucccucgagacgaccuucugcagcgaggucuccagcaccgagaacaccgacaaguacaaccagcgcaacuccacggacgagaacuuccacgccagccugauguccgagaucagccccaucagcaccucccccgagaucagcgaggccucccugaugagcaaccucccgcugaccuccgaggccagccccguguccaaccugccccucaccagcgagacgucccccaugagcgaccugccgcugaccuccgagaccagcuccgugagcuccaugcuccugaccagcgagacgaccuucgucuccagccugccccuccccuccgagaccagccccaucagcaacagcagcaucaacgagcggauggcccaccagcagcgcaagucccccagcguguccgaggagccccugagcccccagaaggacgaguccagcgcgaccgccaagccccugggggagaaccucacgucccagcagaagaaccugagcaacaccccggagcccaucaucauguccagcuccagcaucgcccccgaggccuuccccuccgaggaccugcacaacaagacccucagccagcagaccugcaagucccacguggacacggagaagccguaccccgccagcauccccgagcuggcguccaccgagaugaucaaggucaagaaccacagcgugcugcagcggaccgagaagaaggugcucccgagcccccuggagcuguccgucuucagcgaggggaccgacaacaaggggaacgagcuccccuccgccaagcugcaggacaagcaguacaucagcuccguggacaaggcccccuucagcgagggcucccgcaacaagacgcacaagcagggcagcacccagucccgccuggagaccagccacaccuccaagagcuccgagccgagcaagucccccgacgggauccggaacgagagccgcgacuccgagaucagcaagcggaagacggccgagcagcacuccuucggcaucugcaaggagaagcgcgcgcggaucgaggacgaccagagcacccgcaacaucagcuccagcagcccgcccgagaaggagcagccgccccgggaggagccccgcgugcccccgcucaagauccagcugagcaagaucgggccgcccuucaucaucaagucccagcccgucagcaagccggagucccgggccagcaccuccaccagcguguccggcggccgcaacacgggggcccggacccuggccgacaucaaggcccgcgcgcagcaggcccgggcccagcgcgaggccgccgcggccgccgccguggccgcggccgccagcaucgucuccggcgccauggggagccccggcgagggcggcaagacccggacccucgcgcacaucaaggagcagaccaaggccaagcuguucgccaagcaccaggcccgcgcccaccuguuccagacguccaaggagacccggcugccgccgccccugagcuccaaggaggggccgcccaaccuggaggugagcuccacccccgagaccaagauggaggggagcacgggcgugaucaucgucaaccccaacugccgcagccccuccaacaagagcgcgcaccuccgggagaccaccaccgugcugcagcagucccugaaccccagcaagcuccccgagacggccaccgaccuguccgugcacagcuccgacgagaacaucccggucagccaccuguccgagaagaucgugagcuccaccagcuccgagaacagcuccgugcccaugcuguucaacaagaacagcguccccguguccgugugcagcaccgccaucagcggggccaucaaggagcacccguucgucuccagcguggacaaguccagcgugcucauguccgucgacagcgccaacacgaccaucuccgcgugcaacaucagcaugcugaagaccauccagggcaccgacacgcccugcaucgccaucauccccaagugcaucgaguccacccccaucagcgccaccaccgagggguccagcaucuccagcuccauggacgacaagcagcuccugaucagcuccagcuccgccagcaaccuggugagcacgcaguacaccuccgugccgacccccagcaucggcaacaaccuccccaaccuguccaccagcuccguccugaucccgcccaugggcaucaacaaccgcuuccccagcgagaagaucgccauccccggguccgaggagcaggcgacggugagcaugggcaccaccgugcgcgccgcccucuccugcagcgacuccgucgccgugaccgacagccugguggcccaccccacggucgcgauguucaccgggaacaugcugaccaucaacuccuacgacagcccgcccaagcucuccgccgagagccuggacaagaacuccggcccccggaaccgcgccgacaacagcgggaagccccagcagccgcccggcggcuucgcccccgcggccaucaaccgguccauccccugcaaggugaucguggaccacagcaccacgcugaccagcucccucagccugaccgucuccguggagagcuccgaggccagccuggaccuccaggggcgccccgugcggaccgaggccuccguccagcccguggccugcccccaggugagcgucaucucccgccccgagccgguggcgaacgagggcaucgaccacagcuccacguucaucgccgccagcgccgccaagcaggacuccaagacccugcccgcgaccugcaccagccugcgggagcucccccuggugcccgacaagcugaacgagccgaccgcccccucccacaacuucgccgagcaggcccgcgggcccgccccguucaagagcgaggcggacacgaccugcuccaaccaguacaaccccagcaaccggaucugcuggaacgacgacggcaugcgcuccaccgggcagccccucgucacccacagcggcagcuccaagcagaaggaguaccuggagcagagcugccccaaggccaucaagacggagcacgccaacuaccugaacguguccgagcuccacccgcggaaccuggucaccaacguggcccugcccgucaagagcgagcuccacgaggcggacaagggcuuccgcauggacaccgaggacuuccccgggcccgagcugccgccgcccgccgccgagggcgccuccagcguccagcagacccagaacaugaaggccuccacgagcucccccauggaggaggcgaucagccuggccaccgacgcccucaagcgggugccgggggccggcuccagcggcugccgccuguccagcguggaggccaacaacccccuggucacccagcuccugcaggggaaccugccccucgagaaggugcugccccagccgcggcugggcgcgaagcucgagaucaaccgccugccccugccccuccagaccacguccguggggaagaccgcccccgagcggaacgucgagaucccgcccagcucccccaaccccgacggcaagggguaccuggccggcacccuggccccgcuccagaugcgcaagcgggagaaccaccccaagaagcgcguggcccggaccgugggcgagcacacgcaggucaagugcgagcccgggaagcugcugguggagccggacgugaagggcguccccugcgugaucagcuccgggaucagccagcucggccacagccagcccuucaagcaggaguggcugaacaagcacuccaugcagaaccgcaucgugcacagccccgaggucaagcagcagaagcgccugcugccguccugcagcuuccagcagaaccucuuccacguggacaagaacgggggcuuccacaccgacgcgggcaccucccaccggcagcaguucuaccagaugcccguggccgcccgcgggcccauccccaccgccgcgcugcugcaggccagcuccaagacgccggucggcugcaacgccuucgccuucaaccggcaccucgagcagaaggggcugggcgaggugagccuguccagcgcgccccaccagcuccgccuggcgaacaugcugucccccaacaugcccaugaaggagggggacgaggugggcggcaccgcccacaccaugccgaacaaggcccucguccacccgccgcccccgcccccgcccccgcccccgccgccccuggcccugcccccgccgccgcccccgcccccgccccucccgccgccccugcccaacgccgaggugcccagcgaccagaagcagccgcccgugaccauggagacgaccaagcggcuguccuggccccagagcaccgggaucugcuccaacaucaagagcgagccccucuccuucgaggagggccugagcuccagcugcgagcuggggaugaagcaggucagcuacgaccagaacgagaugaaggagcagcucaaggcguucgcccugaaguccgccgacuucagcuccuaccugcucagcgagccccagaagcccuucacccagcuggccgcccagaagaugcagguccagcagcagcagcagcugugcggcaacuaccccacgauccacuucggcuccaccagcuucaagcgcgcggccuccgccaucgagaaguccaucgggauccucggcuccgggagcaaccccgccaccggccuguccgggcagaacgcccagaugcccgugcagaacuucgcggacagcuccaacgccgacgagcuggagcucaagugcagcugccggcugaaggccaugaucgucugcaagggcugcggcgccuucugccacgacgacugcaucgggcccuccaagcugugcguggcgugccucgugguccgcuga

SEQ ID NO: 26982 - RNA, 1428 nt, Artificial Sequence
  derived and/or modified sequence opt1 from ASZ1__Homo_sapiens__NP_570124
auggccgccagcgcgcugcgcggccuccccguggccgggggcggggaguccagcgaguccgaggacgacggcugggagaucggguaccuggaccggaccagccagaagcugaagcgccuccugccgaucgaggagaagaaggagaaguucaagaaggccaugaccaucggcgacgucucccuggugcaggagcuccuggacagcggcaucuccguggacagcaacuuccaguacggguggacgccccugauguacgccgccuccgucgcgaacgccgagcucgugcgggugcugcuggaccgcggcgccaacgccagcuucgagaaggacaagcaguccauccucaucaccgcgugcagcgcccacggguccgaggagcagauccugaagugcgucgagcugcuccugagccggaacgccgaccccaacguggccugccgccggcugaugacccccaucauguacgccgcgcgcgacggccacacccagguggucgcccuccugguggcccacggggccgaggugaacacgcaggacgagaacggcuacaccgcccugaccugggcggcccggcagggccacaagaacaucguccucaagcugcuggagcucggggccaacaagaugcugcagaccaaggacggcaagaugccguccgagaucgccaagcgcaacaagcaccacgagaucuucaaccugcucagcuucacgcugaacccccuggaggggaagcuccagcagcugaccaaggaggacaccaucugcaagauccugaccacggacuccgaccgggagaaggaccacaucuucagcuccuacaccgccuucggcgaccucgagguguuccugcacggccuggggcucgagcacaugaccgaccugcugaaggagcgcgacaucacccuccggcaccuccugacgaugcgcgaggacgaguucaccaagaacggcaucaccagcaaggaccagcagaagauccuggcggcccugaaggagcuccagguggaggagauccaguucggggagcugagcgaggagaccaagcuggagaucuccggcgacgaguuccugaacuuccuccugaagcugaacaagcagugcgggcaccugaucacggccguccagaacgugaucaccgagcuccccgugaacagccagaagaucacccuggagugggccagcccccagaacuucaccuccgucugcgaggagcuggugaacaacguggaggaccucuccgagaaggucugcaagcugaaggaccugauccagaagcuccagaacgagcgggagaacgacccgacgcacauccagcugcgcgaggaggugagcaccuggaacucccggauccugaagcgcaccgccaucaccaucugcggcuucggcuuccuccuguucaucugcaagcugacguuccagcggaaguga

SEQ ID NO: 26983 - RNA, 4173 nt, Artificial Sequence
  derived and/or modified sequence opt1 from ATAD2__Homo_sapiens__NP_054828
auggugguccugcgcagcucccucgagcugcacaaccacagcgccgccuccgcgaccggcagccuggaccucuccagcgacuuccugucccuggagcacaucgggcggcgccggcuccgcagcgccggcgccgcccagaagaagcccgccgcgaccacggccaaggccggggacggcuccagcgugaaggagguggagaccuaccaccggacccgcgcccugcggucccugcgcaaggacgcgcagaacagcuccgacagcuccuucgagaagaacgucgagaucaccgagcagcucgccaacgggcggcacuucacgcgccagcuggcccggcagcaggccgacaagaagaaggaggagcaccgcgaggacaaggugaucccggugacccggagccugcgcgcccggaacaucguccaguccaccgagcaccuccacgaggacaacggcgacguggaggugcgccggagcugccgcauccggucccgcuacagcggcgucaaccagagcaugcuguucgacaagcugaucaccaacacggcggaggccgugcuccagaagauggacgacaugaagaagaugcggcgccagcgcaugcgggagcuggaggaccuggggguguucaacgagaccgaggaguccaaccucaacauguacacccgcggcaagcagaaggacauccagcggaccgacgaggagacgaccgacaaccaggaggggagcgucgaguccagcgaggagggcgaggaccaggagcacgaggacgacggggaggacgaggacgacgaggacgacgacgacgacgacgacgacgacgacgacgacgacgacgaggacgacgaggacgaggaggacggcgaggaggagaaccagaagcgcuacuaccugcggcagcgcaaggccaccguguacuaccaggcgccccuggagaagccccggcaccagcgcaagcccaacaucuucuacuccggcccggccagccccgcccggccccgcuaccggcucuccagcgccgggccccgcuccccguacugcaagcggaugaaccgccggcgccacgccauccacagcuccgacagcaccuccagcuccagcuccgaggacgagcagcacuucgagcggcgccggaagcgcagccgcaaccgggccaucaaccgcugccugccccugaacuuccggaaggacgagcucaagggcaucuacaaggaccgcaugaagaucggggccucccuggcggacguggaccccaugcagcuggacagcagcguccgguucgacuccgugggcggccucagcaaccacaucgccgcccugaaggagaugguggucuucccccugcucuacccggagguguucgagaaguucaagauccagccgccccgcgggugccuguucuacggcccgcccgggacgggcaagacccugguggcccgggcccucgcgaacgagugcucccagggggacaagcgcgucgccuucuucaugcggaagggcgccgacugccugagcaagugggugggcgaguccgagcgccagcugcggcuccuguucgaccaggccuaccagaugcgccccagcaucaucuucuucgacgagaucgacgggcuggcgcccgugcgguccagccgccaggaccagauccacuccagcaucgucuccacccuccuggcccugauggacggccucgacagccgcggggagaucguggucaucggcgccaccaaccggcuggacuccaucgaccccgcccugcggcgccccgggcgguucgaccgcgaguuccucuucagccugcccgacaaggaggcccggaaggagauccugaagauccacacgcgcgacuggaaccccaagccccucgacaccuuccuggaggagcuggcggagaacugcgugggcuacugcggcgccgacaucaaguccaucugcgccgaggccgcccugugcgcgcuccgccggcgcuacccgcagaucuacaccaccagcgagaagcugcagcuggaccucuccagcaucaacaucagcgccaaggacuucgagguggccaugcagaagaugauccccgccucccagcgggccgucacgagccccgggcaggcgcuguccaccguggugaagccccugcuccagaacaccgucgacaagauccuggaggcccugcagcgcguguucccgcacgccgaguuccggaccaacaagacgcucgacagcgacaucuccugcccccugcuggagagcgaccucgccuacuccgacgacgacgugcccagcgucuacgagaacggccugucccagaaguccagccacaaggcgaaggacaacuucaacuuccugcaccucaaccgcaacgccugcuaccagccgaugagcuuccggccccgcauccugaucgugggggagcccggcuucgggcagggcucccaccuggcccccgccgugauccacgcccucgagaaguucaccgucuacacccuggacaucccggugcuguucggcgugagcaccacgucccccgaggagaccugcgcgcaggucauccgggaggccaagcgcaccgcccccagcaucguguacgugccccacauccacgucuggugggagaucguggggccgacccucaaggccacguucaccacccugcugcagaacauccccuccuucgcccccgugcuccugcuggcgaccagcgacaagccccacuccgcccucccggaggagguccaggagcuguucauccgggacuacggcgagaucuucaacgugcagcugcccgacaaggaggagcgcaccaaguucuucgaggaccucauccugaagcaggccgccaagccgcccaucagcaagaagaaggccgugcugcaggcgcucgagguccugcccguggccccgccgcccgagccccggagccugacggccgaggaggugaagcgccucgaggagcaggaggaggacaccuuccgggagcugcgcaucuuccugcggaacgucacccaccgccucgccaucgacaagcgguuccgcguguucaccaagcccguggaccccgacgagguccccgacuacgugacggugaucaagcagcccauggaccuguccagcgucaucuccaagaucgaccugcacaaguaccucaccgugaaggacuaccugcgcgacaucgaccugaucugcagcaacgcgcucgaguacaaccccgaccgggaccccggggaccgccugauccggcaccgcgccugcgcccugcgggacaccgccuacgccaucaucaaggaggagcucgacgaggacuucgagcagcugugcgaggagauccaggagucccgcaagaagcggggcugcagcuccagcaaguacgcgccguccuacuaccacgugaugcccaagcagaacagcacccuggucggcgacaagcgcuccgaccccgagcagaacgagaagcucaagacgcccagcaccccgguggccugcuccacccccgcccagcugaagcggaagauccgcaagaaguccaacugguaccuggggaccaucaagaagcggcgcaagaucagccaggccaaggacgacagccagaacgccaucgaccacaagaucgaguccgacacggaggagacccaggacaccagcguggaccacaacgagaccggcaacacgggggaguccagcgucgaggagaacgagaagcagcagaacgcgagcgaguccaagcucgagcugcggaacaacagcaacacgugcaacaucgagaacgagcuggaggacucccgcaagaccaccgccugcaccgagcuccgggacaagaucgccugcaacggcgacgccagcuccagccagaucauccacaucuccgacgagaacgaggggaaggagaugugcgugcugcgcaugacccgggcccgccggagccagguggagcagcagcagcugaucaccgucgagaaggcgcucgccauccugucccagcccacccccagccuggugguggaccacgagcgccucaagaaccugcugaagacggucgugaagaagucccagaacuacaacaucuuccagcucgagaaccuguacgccgugaucagccagugcaucuaccggcaccgcaaggaccacgacaagaccucccugauccagaagauggagcaggaggucgagaacuucagcugcucccgcuga

SEQ ID NO: 26984 - RNA, 1443 nt, Artificial Sequence
  derived and/or modified sequence opt1 from ATAD3B__Homo_sapiens__XP_011540545
augcgccgggccaccguggagcgcgagauggagcugcggcacaagaacgagaugcuccgcgucgagaccgaggcccgggcgcgcgccaaggccgagcgggagaacgccgacaucauccgcgagcagauccggcugaaggccagcgagcaccgccagacggugcuggaguccauccggaccgcgggcacccucuucggggagggcuuccgcgccuucgugaccgaccgggacaaggucacggccaccguggccgggcugacccugcucgcggugggcgucuacagcgccaagaacgccaccgccgugacggggcgcuucaucgaggcccggcugggcaagcccucccuggugcgcgagaccagccggaucaccguccucgaggcgcugcgccacccgauccaggugucccggcgccugcucagccggccccaggacgugcuggagggcgucgugcugucccccagccucgaggcccgcgugcgcgacaucgccaucgccacccggaacacgaagaagaaccgcgggcuguaccggcacauccugcucuacgggcccccgggcaccggcaagacccuguucgccaagaagcuggcgcuccacuccgggauggacuacgccaucaugaccggcggcgacgucgcccccauggggcgcgagggcgugacggccaugcacaagcuguucgacugggccaacaccagccggcgcgggcugcuccuguucauggacgaggcggacgccuuccugcggaagcgcgccaccgaggagaucuccaaggaccuccgggccacccugaacgccuuccuguaccacaugggccagcacagcaacaaguucaugcucgugcuggcguccaaccugcccgagcaguucgacugcgccaucaacagccgcaucgacgucauggugcacuucgaccucccccagcaggaggagcgggagcgccuggugcggcugcacuucgacaacugcguccucaagccggccacggagggcaagcgccggcugaagcuggcccaguucgacuacgggcgcaagugcuccgagguggcgcggcucaccgagggcaugagcgggcgcgagaucgcccagcuggccguguccuggcaggccaccgccuacgcgagcaaggacggcguccugaccgaggccaugauggacgccugcgugcaggacgccguccagcaguaccggcagaagaugcgcuggcucaaggccgaggggcccggccgcggcguggagcacccccuguccggggugcagggcgagacgcugaccagcuggagccucgcgaccgaccccuccuacccgugccuggccgggcccugcaccuuccggaucugcagcuggaugggcacggggcugugccccggcccccucuccccgcgcaugagcugcggcgggggccggcccuucugcccgcccgggcacccccugcuguga

SEQ ID NO: 26985 - RNA, 1290 nt, Artificial Sequence
  derived and/or modified sequence opt1 from ATAD3C__Homo_sapiens__XP_011539310
augcagcgcgcccaccggcgcgccgaccccagcgagcugcagugccucgaggcgauguccaaggacgcccugaaccuggcccagaugcaggagcagacccuccagcuggagcagcagagcaagcugaagcagcucgugaacgaggaccugcggaagcaggaggaguccguccagaagcaccaccagaccuuccuggagagcauccgcgccgccggcacccucuucggggagggcuuccgggcguucgugacggaccgcgacaaggugaccgccaccgucgccgggcugacgcugcucgccgugggcguguacuccgcgaagaacgccaccgccgucaccgggcgguacaucgaggcccgccugggcaagccgagccuggugcgggagaccucccgcaucacggugcucgaggcccugcggcaccccauccagcaggucagccgccggcugcucucccgcccccaggacgugcuggagggcgugguccugagccccucccucgaggcgcgggugcgcgacaucgccaucaugacccggaacaucaagaagaaccgcgggcuguaccggcacauccugcucuacggcccgcccgggaccggcaagacccuguucgccaagaagcuggcccuccacagcgggauggacuacgccaucaugacgggcggcgacguggcgcccauggggcgcgagggcgucaccgccaugcacaagcuguucgacugggccaacaccucccggcgcgggcugcuccuguucguggacgaggccgacgccuuccugcgcaagcgggcgaccgagaagaucagcgaggaccuccgcgccacgcugaacgccuuccuguaccggaccggccagcacuccaacaaguucaugcucauccuggccagcugccaccccgagcaguucgacugggccaucaacgcgugcaucgacgugaugguccacuucgaccugccgggccaggaggagcgcgcccggcucgugcgcauguaccugaacgaguacgugcugaagcccgccaccgaggggaagcggcgccucaagcuggcccaguucgacuacggccggaagugccuggagaucgcgcgccucaccgaggggauguccugccggaagaucgcccagcuggccgucagcuggcaggccacggccuacgcguccaaggacggcgugcugaccgaggccaugauggacgccugcgugcaggacuucguccagcagcaccagcagaugaugcgcuggcucaagggggagcggcccggccccgaggacgagcagccgagcagcuga

SEQ ID NO: 26986 - RNA, 5535 nt, Artificial Sequence
  derived and/or modified sequence opt1 from ATAD5__Homo_sapiens__NP_079133
auggugggcguccuggccauggccgcggccgccgcgcccccgcccgugaaggacugcgagaucgagcccugcaagaagcgcaagaaggacgacgacaccagcacgugcaagaccaucaccaaguaccucagcccccuggggaagacccgggaccgcguguucgccccgcccaagcccagcaacauccuggacuacuuccggaagaccagccccaccaacgagaagacccagcucggcaaggagugcaagaucaagagccccgagagcguccccguggacagcaacaaggacugcaccacgccccuggagauguucuccaacguggaguucaagaagaagcgcaagcgggucaaccugagccaccagcucaacaacaucaagaccgagaacgaggcgcccaucgagaucuccagcgacgacagcaaggaggacuacagccugaacaacgacuucguggaguccagcaccuccgugcugcgcuacaagaagcaggucgaggugcucgccgagaacauccaggacaccaagagccagcccaacaccaugacgucccugcagaacagcaagaaggugaaccccaagcaggggaccaccaagaacgacuucaagaagcugcggaagcgcaagugccgggacgucguggaccucuccgagagccugccccuggccgaggagcucaaccugcugaagaaggacggcaaggacaccaagcagauggagaacacgaccagccacgccaacucccgcgacaacgugaccgaggccgcccagcucaacgacagcaucaucaccgucuccuacgaggaguuccugaagucccacaaggagaacaagguggaggagauccccgacuccacgaugagcaucugcgugcccuccgagaccgucgacgagaucgugaaguccggguacaucagcgagagcgagaacuccgagaucagccagcagguccgguucaagaccgucaccgugcuggcccaggugcaccccaucccgcccaagaagacgggcaagaucccgcgcaucuuccucaagcagaagcaguucgagauggagaacucccugagcgaccccgagaacgagcagaccguccagaagcggaaguccaacguggucauccaggaggaggagcuggagcucgccgugcuggaggccggcagcuccgaggcggugaagcccaagugcacccuggaggagcgccagcaguucaugaaggccuuccggcagcccgccagcgacgcccucaagaacggggucaagaaguccagcgacaagcagaaggaccugaacgagaagugccuguacgaggugggccgcgacgacaacagcaagaagaucauggagaacuccgggauccagauggugagcaagaacggcaaccuccagcugcacaccgacaagggguccuuccugaaggagaagaacaagaagcucaagaagaagaacaagaagacgcuggacaccggcgccaucccgggcaagaaccgggaggggaacacccagaagaaggagaccacguucuuccugaaggagaagcaguaccagaaccgcaugagccuccggcagcgcaagaccgaguucuucaaguccagcacccuguucaacaacgagucccuggucuacgaggacaucgcgaacgacgaccuccugaaggugagcucccugugcaacaacaacaagcucagccggaagaccuccauccccgugaaggacaucaagcugacgcagagcaaggccgaguccgaggccagccugcucaacgucuccacccccaagagcacccgccgcuccggccggaucagcagcacccccaccacggagaccauccgcgggaucgacuccgacgacgugcaggacaacagccagcugaaggccuccacccagaaggccgcgaaccugagcgagaagcacucccucuacaccgccgagcugaucacggugccguucgacagcgagucccccauccggaugaaguucacccgcaucagcacccccaagaaguccaagaagaaguccaacaagcgguccgagaaguccgaggccaccgacggcggcuucacgucccagauccgcaaggccagcaacaccuccaagaacaucagcaaggccaagcagcugaucgagaaggcgaaggcccugcacaucucccggagcaaggucaccgaggagaucgccaucccgcuccgccgguccagccgccaccagacccugcccgagcggaagaagcugagcgagacggaggacuccgugaucaucaucgacagcucccccaccgcccucaagcaccccgagaagaaccagaagaagcugcagugccugaacgacgugcucgggaagaagcugaacaccagcaccaagaacgucccgggcaagaugaagguggcgccccuguuccucgugcgcaaggcccagaaggccgccgaccccguccccuccuucgacgagagcucccaggacacgagcgagaagucccaggacugcgacgugcagugcaaggccaagcgggacuuccugaugagcgggcugccggaccuccugaagcgccagaucgcgaagaaggccgccgcccuggacguguacaacgccgucuccaccagcuuccagcggguggugcacguccagcagaaggacgacggcugcugccucuggcaccugaagccgcccuccugcccccugcucaccaaguucaaggagcugaacaccaaggugaucgaccugagcaagugcgggaucgcgcucggcgaguucuccacgcugaacagcaagcugaaguccggcaacagcgccgccguguucaugcgcacccggaaggaguucaccgaggagguccgcaaccuccugcuggaggagauccggugguccaacccggaguucagccucaagaaguacuucccccugcugcucaagaagcagaucgagcaccaggugcugagcuccgagugccacagcaagcaggagcuggaggccgacgugucccacaaggagaccaagcgcaagcucgucgaggccgagaacagcaaguccaagcgcaagaagcccaacgaguacagcaagaaccuggagaagacgaaccggaaguccgaggagcugagcaagcgcaacaacuccagcgggaucaagcucgacuccagcaaggacuccggcaccgaggacaugcuguggaccgagaaguaccagccccagaccgcgagcgagcugaucgggaacgagcucgccaucaagaagcugcacuccuggcugaaggacuggaagcggcgcgccgagcucgaggagcggcagaaccugaagggcaagcgcgacgagaagcacgaggacuucagcgggggcaucgacuucaagggcuccagcgacgacgaggaggagucccggcugugcaacacggugcucaucaccgggccgaccggcguggggaagaccgccgcggucuacgccugcgcccaggagcugggcuucaagaucuucgaggugaacgccagcagccagcgcuccgggcggcagauccugagccagcucaaggaggccacgcagucccaccagguggacaagcagggcgucaacagccagaagcccugcuucuucaacuccuacuacaucggcaagagccccaagaagaucuccagccccaagaagguggugaccuccccgcgcaaggugccgccgcccagcccgaaguccagcgggcccaagcgggcgcugcccccgaagacccuggccaacuacuucaaggugucccccaagcccaagaacaacgaggagaucggcaugcuccuggagaacaacaaggggaucaagaacagcuucgagcagaagcagaucacccagacgaaguccaccaacgccaccaacagcaacgugaaggacgucggcgccgaggagcccucccgcaagaacgccaccagccugauccucuucgaggagguggacgugaucuucgacgaggacgcgggcuuccugaacgccaucaagaccuucauggccacgaccaagcggccggucauccugaccaccuccgaccccacguucagccucauguucgacgggugcuucgaggagaucaaguucagcacccccucccugcugaacguggccagcuaccuccagaugaucugccugaccgagaacuuccgcaccgacgugaaggacuucgucacgcugcucaccgccaacacgugcgacauccggaaguccauccuguaccugcaguucuggauccgcagcggcgggggcgugcucgaggagcggccccugacccuguaccgcgggaacucccggaacgugcagcucgucugcagcgagcacggccuggacaacaagaucuacccgaagaacacgaagaagaagcgcguggaccugcccaagugcgacuccggcugcgcggagacccucuucgggcugaagaacaucuucagccccuccgaggaccuguucagcuuccucaagcacaagaucaccaugaaggaggaguggcacaaguucauccagcugcugaccgaguuccagaugcggaacgucgacuuccucuacuccaaccuggaguucauccugccccucccgguggacacgauccccgagaccaagaacuucugcggccccagcgugaccgucgacgccuccgccgccaccaagagcaugaacugccuggcgcgcaagcacuccgagcgcgagcagccccugaagaagucccagaagaagaagcagaagaagacgcucgugauccuggacgacuccgaccuguucgacaccgaccucgacuucccggaccagagcaucucccugagcagcguguccagcuccagcaacgccgaggaguccaagaccggggacgaggagagcaaggcccgggacaagggcaacaaccccgagaccaagaaguccauccccugcccgcccaagacgaccgccgggaagaagugcagcgcccuggucucccacugccucaacagccuguccgaguucauggacaacaugagcuuccuggacgcgcuccugaccgacgugcgcgagcagaacaaguacggccggaacgacuucuccuggaccaacggcaaggugacgagcgggcugugcgacgaguucucccuggagagcaacgacggcuggaccucccagagcagcggggagcucaaggccgccgccgaggcccuguccuucaccaagugcagcuccgcgaucagcaaggcccuggagacccucaacuccugcaagaagcugggccgcgaccccacgaacgaccugaccuucuacgucagccagaagcggaacaacguguacuucucccagagcgccgccaaccucgacaacgccuggaagcgcaucuccgugaucaagagcgucuucuccagccggucccugcuguacguggggaaccgccaggcgagcaucaucgaguaccuccccacccugcggaacaucugcaagaccgagaagcugaaggagcagggcaaguccaagcgccgguuccuccacuacuucgagggcauccaccuggacauccccaaggagacggugaacacccuggccgccgacuuccccuga

SEQ ID NO: 26987 - RNA, 1230 nt, Artificial Sequence
  derived and/or modified sequence opt1 from ATAT1__Homo_sapiens__NP_001026892
auguggcugaccuggcccuucugcuuccucaccaucacgcugcgcgaggagggcgugugccaccuggagagcguggaccuccagcagcagaucaugaccaucaucgacgagcuggggaaggccuccgccaaggcgcagaaccugagcgcccccaucaccuccgccagccggaugcaguccaaccgccacgugguguacauccucaaggacagcuccgcccggcccgccggcaagggggcgaucaucggcuucaucaaggucggguacaagaagcuguucgugcuggacgaccgcgaggcccacaacgagguggagccccucugcauccuggacuucuacauccacgagagcguccagcggcacggccacggccgcgagcuguuccaguacaugcuccagaaggagcggguggagccccaccagcuggccaucgaccgccccucccagaagcugcucaaguuccugaacaagcacuacaaccuggagaccacggugccccaggucaacaacuucgugaucuucgagggguucuucgcccaccagcaccggccgcccgcgccgagccuccgcgccacccggcacucccgcgccgccgccguggaccccacccccgcggcccccgcccggaagcugccgcccaagcgcgccgagggcgacaucaagcccuacagcuccagcgaccgggaguuccugaaggucgccguggagcccccguggccccucaaccgcgcgccccggcgcgccacgcccccggcccacccgccgccccgguccagcucccuggggaacagccccgagcgcggcccccugcggcccuucgugcccgagcaggagcuccugcgcucccugcgccucugcccgccccaccccaccgcccggcugcugcucgccgcggaccccgggggcagccccgcccagcgccggcgcacccggggcaccccgcccgggcuggucgcccagagcugcugcuacucccgccacggcggggugaacagcuccagccccaacaccggcaaccaggacuccaagcagggcgagcaggagacgaagaaccggagcgccuccgaggagcaggcccugagccaggacggguccggcgagaagcccaugcacaccgcgccgccccaggcccccgccccgcccgcccagagcuggaccgucgggggcgacauccucaacgcgcgcuucauccggaaccugcaggagcgccgguccacccgccccugguga

SEQ ID NO: 26988 - RNA, 1116 nt, Artificial Sequence
  derived and/or modified sequence opt1 from ATCAY__Homo_sapiens__NP_149053
augggcaccaccgaggccacgcugcgcauggagaacguggacgucaaggaggaguggcaggacgaggaccucccccggccgcugcccgaggagaccgggguggagcugcucggcagccccguggaggacaccuccagcccgcccaacacccugaacuucaacggggcccaccgcaagcggaagacgcuggucgcgcccgagaucaacaucucccucgaccagagcgagggcucccugcugagcgacgacuuccucgacacccccgacgaccuggacaucaacguggacgacaucgagacccccgacgagaccgacucccuggaguuccucgggaacggcaacgagcuggagugggaggacgacacgccgguggccaccgccaagaacaugcccggcgacagcgccgaccuguucggggacggcaccaccgaggacggguccgccgcgaacggccgccucuggcggacggucaucaucggggagcaggagcaccgcaucgaccugcacaugauccggcccuacaugaagguggugacccacggcggcuacuacggggagggccugaacgccaucaucgucuucgccgccugcuuccuccccgacagcucccugccggacuaccacuacaucauggagaaccuguuccucuacgugaucagcucccuggagcugcucguggcggaggacuacaugaucgucuaccugaacggggccacgccccgccggcgcaugcccggcaucggcuggcugaagaagugcuaccagaugaucgaccggcgccuccggaagaaccucaagagccugaucaucgugcaccccuccugguucauccgcaccgugcuggccaucagccggccguucaucuccgucaaguucaucaacaagauccaguacgugcacagccuggaggaccuggagcagcucauccccauggagcacgugcagauccccgacugcguccugcaguacgaggaggagcgccugaaggcccggcgcgaguccgcccggccccagccggaguucgugcucccccgcagcgaggagaagcccgagguggcgcccgucgagaaccggagcgcccugguguccgaggaccaggagaccagcauguccuga

SEQ ID NO: 26989 - RNA, 1557 nt, Artificial Sequence
  derived and/or modified sequence opt1 from ATE1__Homo_sapiens__NP_001001976
auggccuucugggccggcgggagccccuccguggucgacuacuucccgagcgaggacuucuaccgcugcggcuacugcaagaacgaguccgggagccgguccaacggcaugugggcgcacagcaugaccgugcaggacuaccaggaccugaucgaccgcggguggcggcgcuccggcaaguacguguacaagcccgucaugaaccagaccugcugcccccaguacacgauccggugccgcccccuccaguuccagccgagcaagucccacaagaaggugcugaagaagaugcugaaguuccucgccaagggcgaggugcccaaggggagcugcgaggacgagcccauggacuccaccauggacgacgccgucgccggcgacuucgcccugaucaacaagcuggacauccagugcgaccucaagacccugagcgacgacaucaaggagucccuggagagcgaggggaagaacuccaagaaggaggagccccaggagcuccugcagagccaggacuucgugggcgagaagcugggguccggcgagccgagccacuccgugaagguccacaccgugcccaagcccggcaagggggcggaccucagcaagcccccgugccggaaggccaaggagauccgcaaggagcggaagcgccugaagcugaugcagcagaaccccgccggcgagcucgagggguuccaggcccagggccacccgcccagccuguucccgcccaaggcgaaguccaaccagcccaagagccuggaggaccucaucuucgagucccugcccgagaacgccagccacaagcuggaggugcgggucgugcgcuccagcccgcccuccagccaguucaaggccacgcuccuggaguccuaccagguguacaagcgguaccagauggucauccacaagaacccgcccgacacccccaccgagagccaguucacccgcuuccugugcuccagcccccucgaggccgagacgccgcccaacggccccgacugcggguacggcuccuuccaccagcaguacuggcuggacgggaagaucaucgccgugggcgugaucgacauccugcccaacugcgucagcuccguguaccucuacuacgaccccgacuacagcuuccugucccuggggguguacagcgcgcuccgggagaucgccuucacccgccagcugcacgagaagaccucccagcugagcuacuacuacaugggcuucuacauccacagcugccccaagaugaaguacaagggccaguaccggcccuccgaccuccugugccccgagaccuacgucugggugcccaucgagcagugccugccgagccucgagaacuccaaguacugccgcuucaaccaggaccccgaggccguggacgaggaccggagcacggagcccgaccgccugcaggucuuccacaagcgggccaucaugcccuacgggguguacaagaagcagcagaaggacccguccgaggaggccgcgguccugcaguacgccagccucgugggccagaagugcuccgagcgcaugcugcuguuccgcaacuga

SEQ ID NO: 26990 - RNA, 816 nt, Artificial Sequence
  derived and/or modified sequence opt1 from ATF1__Homo_sapiens__XP_011536689
auggaggacagccacaaguccaccaccagcgagacggcgccccagccgggcuccgccgugcagggggcccacaucagccacaucgcccagcaggucuccagccuguccgagagcgaggagucccaggacagcuccgacagcaucggcuccagccagaaggcccacgggauccucgcccgccggcccuccuaccgcaagauccugaaggaccugagcuccgaggacacccggggccgcaagggggacggcgagaacagcggcguguccgccgcggugaccagcaugagcguccccacccccaucuaccagacguccagcgggcaguacaucgccaucgccccgaacggcgcccuccagcuggcgucccccgggaccgacggcgugcaggggcugcagacccucaccaugacgaacagcggcuccacccagcagggcaccaccauccugcaguacgcccagacgagcgacgggcagcagauccuggugcccuccaaccaggucguggugcagaccgccagcggcgacaugcagaccuaccagauccggaccacgcccuccgccaccagccucccgcagaccgucgugaugaccucccccgugacgcugaccagccagaccaccaagacggacgacccccagcugaagcgcgagauccggcucaugaagaaccgcgaggccgcgcgggagugccgccggaagaagaaggaguacgucaagugccuggagaaccgcguggccgugcuggagaaccagaacaagacccucaucgaggagcugaagacccugaaggaccucuacuccaacaagagcgucuga

SEQ ID NO: 26991 - RNA, 1518 nt, Artificial Sequence
  derived and/or modified sequence opt1 from ATF2__Homo_sapiens__NP_001243019
augaaguucaagcugcacgugaacagcgcccgccaguacaaggaccucuggaacauguccgacgacaagcccuuccugugcaccgccccgggcugcgggcagcgguucaccaacgaggaccaccuggcgguccacaagcacaagcacgagaugacgcucaaguucggccccgcccgcaacgacagcgugaucguggccgaccagacccccacccccacccgguuccugaagaacugcgaggaggucgggcuguucaacgagcucgccuccccguucgagaacgaguucaagaaggccagcgaggacgacaucaagaagaugccccuggaccugagcccccucgcgacgcccaucauccgcagcaagaucgaggagccguccgugguggagaccacccaccaggacagcccccugccccaccccgaguccaccacgagcgacgagaaggaggucccgcuggcccagaccgcccagcccaccuccgccaucgugcggcccgcgagccuccaggugcccaacguccugcugaccuccagcgacuccagcgugaucauccagcaggccgugccgucccccacgagcuccaccgucaucacccaggcccccagcagcaaccgccccaucgugccggugcccggccccuucccccuccugcugcaccucccgaacgggcagaccaugcccgucgccauccccgccuccaucacgagcuccaacgugcacgugcccgcggccgucccgcuggugcggcccgugaccaugguccccagcgugccgggcauccccggccccuccagcccccagccggugcaguccgaggccaagaugcgccugaaggccgcccucacccagcagcacccgcccgucaccaacggggacacggugaagggccacgggagcggccugguccggacccaguccgaggagagccgcccccagucccugcagcagcccgcgaccagcaccacggagacccccgccucccccgcccacaccacgccccagacccagagcaccuccgggcggcgccggcgcgccgccaacgaggacccggacgagaagcggcgcaaguuccucgagcggaaccgcgcggccgccagccggugccgccagaagcggaaggugugggugcagucccuggagaagaaggccgaggaccugagcucccucaacggccagcugcagagcgaggucacccugcuccgcaacgagguggcccagcugaagcagcugcuccuggcgcacaaggacugccccgugaccgccaugcagaagaaguccggcuaccacacggccgacaaggacgacuccagcgaggacaucuccguccccagcagcccccacaccgaggccauccagcacuccuccgugagcaccuccaacggggugagcuccaccagcaaggcggaggccgucgccacguccgugcugacccagauggccgaccagagcaccgagccggcccucucccagaucgugauggcgcccagcucccagagccagcccagcggcuccuga

SEQ ID NO: 26992 - RNA, 408 nt, Artificial Sequence
  derived and/or modified sequence opt1 from ATF3__Homo_sapiens__NP_001035709
augaugcugcagcaccccggccaggugagcgccuccgaggucagcgccuccgcgaucgugccgugccucagcccgcccgggucccugguguucgaggacuucgccaaccugacccccuucgucaaggaggagcuccgcuucgccauccagaacaagcaccugugccaccggaugagcuccgcccuggagagcgugaccguguccgaccgcccccucggcgucagcaucacgaaggccgagguggcgcccgaggaggacgagcggaagaagcgccggcgcgagcggaacaagaucgccgccgccaagugccgcaacaagaagaaggagaagaccgagugccugcagaagcugccccggcccuucugggugcagaagaccugcaucugggcggucgacuccugcaaguga

SEQ ID NO: 26993 - RNA, 1056 nt, Artificial Sequence
  derived and/or modified sequence opt1 from ATF4__Homo_sapiens__NP_001666
augaccgagaugagcuuccuguccagcgaggugcucgucggcgaccugaugucccccuucgaccagagcgggcugggcgccgaggagucccucgggcugcuggacgacuaccucgagguggccaagcacuucaagccccacggcuucagcuccgacaaggcgaaggccgggagcuccgaguggcuggccguggacggccuggucagccccuccaacaacagcaaggaggacgccuucuccggcaccgacuggaugcucgagaagauggaccugaaggaguucgaccuggacgcccuccuggggaucgacgaccuggagacgaugcccgacgaccuccugaccacccuggacgacacgugcgaccucuucgcgccccuggugcaggagaccaacaagcagccgccccagaccgugaaccccaucggccaccuccccgagagccugaccaagccggaccaggucgcccccuucaccuuccugcagccccugccccucuccccgggggugcugagcuccacgcccgaccacagcuucucccuggagcucggcagcgagguggacaucaccgagggggaccgcaagcccgacuacaccgccuacgucgccaugaucccccagugcaucaaggaggaggacaccccgagcgacaacgacuccggcaucugcaugagccccgaguccuaccugggcagcccccagcacucccccagcacgcggggguccccgaaccgcagccugcccucccccggcgugcucugcgggagcgcgcggcccaagccguacgacccgcccggcgagaagaugguggccgccaaggucaagggcgagaagcuggacaagaagcugaagaagauggagcagaacaagaccgccgccacccgcuaccggcagaagaagcgcgcggagcaggaggcccucaccggggagugcaaggagcuggagaagaagaacgaggcccugaaggagcgggccgacucccucgccaaggagauccaguaccugaaggaccugaucgaggaggugcgcaaggcgcggggcaagaagcgcgugcccuga

SEQ ID NO: 26994 - RNA, 849 nt, Artificial Sequence
  derived and/or modified sequence opt1 from ATF5__Homo_sapiens__NP_001277675
augagccugcucgccacccugggccuggagcucgaccgcgcccugcugcccgcguccgggcucggcuggcugguggacuacgggaagcugccgcccgcccccgccccccucgccccguacgagguccugggcggggcccuggagggcggccuccccguggggggcgagccccuggcgggggacggcuucagcgacuggaugaccgagcggguggacuucacggcccugcucccccuggagccgccccugccccccgggacccucccgcagcccucccccacccccccggaccuggaggccauggccagccugcucaagaaggagcuggagcagauggaggacuucuuccuggacgcgcccccccuccccccgcccuccccccccccgcugcccccccccccgcugccccccgccccgagccucccccugucccugcccagcuucgaccucccccagccgcccguccuggacacccuggaccuccuggccaucuacugccgcaacgaggccggccaggaggaggugggcaugcccccccugccgcccccccagcagcccccgccccccucccccccgcagcccagccggcucgcccccuacccccacccggcgacgacccgcggggaccggaagcagaagaagcgcgaccagaacaaguccgccgcccugcgguaccgccagcggaagcgcgccgagggcgaggcccuggagggggagugccagggccucgaggcgcggaaccgcgagcugaaggagcgggccgagagcguggagcgcgagauccaguacgucaaggaccugcucaucgagguguacaaggcccggucccagcgcacccggagcugcuga

SEQ ID NO: 26995 - RNA, 2103 nt, Artificial Sequence
  derived and/or modified sequence opt1 from ATF6B__Homo_sapiens__NP_001129625
auggccgagcugaugcuccugagcgagaucgccgaccccacccgcuucuucaccgacaaccugcucuccccggaggacugggacagcacgcuguacuccggccuggacgagguggcggaggagcagacccagcucuuccggugccccgagcaggacguccccuucgacgggagcucccuggacgugggcauggacgugagccccuccgagccgcccugggagcugcuccccaucuuccccgaccugcaggucaagagcgagccguccagccccugcuccagcuccagccuguccagcgaguccagccgccucuccaccgagcccagcagcgaggcccugggggugggcgaggugcugcacgucaagaccgagucccucgcccccccgcugugccugcucggggacgaccccacgagcuccuucgagaccgugcagaucaacgugauccccaccagcgacgacuccagcgacguccagaccaagaucgagcccguguccccgugcagcuccgugaacagcgaggccucccugcugagcgccgacuccagcucccaggcguucaucggcgaggagguccucgaggugaagacggagagccugucccccagcggcugccugcucugggacgugcccgcccccucccugggggccguccagaucagcaugggcccgagccuggacggguccagcggcaaggcccuccccacccggaagcccccccugcagccgaagcccguggugcugaccaccguccccaugcccucccgcgcggugccgcccagcacgaccgugcuccugcagucccugguccagcccccgcccgugagccccgugguccucauccagggggccauccgggugcagcccgagggcccggcccccucccugccccgccccgagcggaagagcaucgucccggcccccaugcccggcaacuccugccccccggagguggacgccaagcugcucaagcgccagcagcggaugaucaagaaccgcgagagcgcgugccagucccggcgcaagaagaaggaguaccugcaggggcuggaggcccggcuccaggccgugcuggccgacaaccagcagcugcgccgggagaacgccgcgcuccgccggcgccuggaggcccugcucgccgagaacagcgagcugaagcugggcuccgggaaccggaaggucgugugcaucaugguguuccuccuguucaucgccuucaacuucggccccgucagcaucuccgagccccccagcgccccgaucuccccccgcaugaacaagggcgagccccagccccggcgccaccugcugggguucagcgagcaggagccggugcagggcguggagccccuccaggggagcucccagggccccaaggagccccagccgagccccaccgaccagcccuccuucagcaaccugaccgcguucccggggggcgccaaggagcugcuccugcgcgaccuggaccagcucuuccuguccagcgacugccggcacuucaaccgcacggagucccugcggcucgccgacgagcugagcggcuggguccagcgccaccagcgggggcgccggaagaucccccagcgcgcccaggagcggcagaagucccagccccgcaagaagagccccccggugaaggccgugcccauccagccccccggcccgcccgagcgggacuccgucgggcagcugcagcucuaccgccaccccgaccggagccagcccgcguuccuggacgccaucgaccgccgggaggacaccuucuacgugguguccuuccgccgggaccaccugcuccugccggccaucagccacaacaagaccucccgccccaagaugagccuggucaugcccgccauggcgcccaacgagacccucuccggccggggggccccgggcgacuacgaggagaugaugcagaucgagugcgaggugauggacacgcgcgugauccacaucaagaccagcaccgucccccccucccugcgcaagcagcccagcccgacccccggcaacgccacggggggcccccugcccgugagcgccgccucccaggcgcaccaggccagccaccagccgcucuaccugaaccaccccuga

SEQ ID NO: 26996 - RNA, 2013 nt, Artificial Sequence
  derived and/or modified sequence opt1 from ATF6__Homo_sapiens__NP_031374
augggcgagcccgccgggguggccggcaccauggagagccccuucucccccgggcuguuccaccgccucgacgaggacugggacagcgcgcuguucgccgagcugggcuacuucaccgacacggacgagcuccagcuggaggccgccaacgagaccuacgagaacaacuucgacaaccuggacuucgaccucgaccugaugcccugggaguccgacaucugggacaucaacaaccagaucugcaccgucaaggacaucaaggccgagccccagccgcugagccccgcguccagcuccuacagcguguccagcccccgguccguggacagcuacuccagcacccagcacguccccgaggagcucgaccuguccagcuccagccagauguccccgcugagccucuacggggagaacagcaacucccugagcuccgccgagccccugaaggaggacaagcccgugacgggcccccgcaacaagaccgagaacggccucaccccgaagaagaagauccaggugaacagcaagcccuccauccagcccaagccccugcugcucccggccgcccccaagacccagacgaacagcuccguccccgcgaagaccaucaucauccagaccgugcccacccugaugccgcuggccaagcagcagcccaucaucagccuccagcccgcccccacgaaggggcagaccgugcugcugucccagccgaccgucgugcagcuccaggcccccggcgugcugcccagcgcccagcccguccuggcgguggccgggggcgugacccagcucccgaaccacgucgugaacgugguccccgcccccuccgccaacagcccggugaacgggaagcuguccgugacgaagcccguccugcagagcaccaugcggaacgugggcuccgacaucgccgugcuccgccggcagcagcgcaugaucaagaaccgggagagcgcgugccagucccgcaagaagaagaaggaguacaugcugggccuggaggcccggcucaaggccgcccugagcgagaacgagcagcugaagaaggagaacgggacccucaagcgccagcuggacgaggucguguccgagaaccagcggcugaagguccccagccccaagcgccggguggugugcgucaugaucgugcucgccuucaucauccugaacuacggcccgaugagcaugcuggagcaggacucccgccggaugaaccccagcgugucccccgcgaaccagcgccggcaccuccugggguucagcgccaaggaggcccaggacaccuccgacggcaucauccagaagaacagcuaccgcuacgaccacuccgucagcaacgacaaggcccugauggugcucacggaggagccccugcuguacaucccgcccccgcccugccagccccucaucaacaccaccgagucccugcggcugaaccacgagcugcgcggcugggugcaccggcacgaggucgagcgcaccaagagccgccggaugacgaacaaccagcagaagacccgcauccuccagggggcccuggagcagggcuccaacagccagcugauggcggugcaguacaccgagaccacguccagcaucucccggaacagcggguccgagcuccagguguacuacgccagcccccgcagcuaccaggacuucuucgaggccauccggcgccggggcgacaccuucuacgucguguccuuccgccgggaccaccuccugcugcccgccaccacccacaacaagacgacccgccccaagaugagcaucgugcugccggcgaucaacaucaacgagaacgucaucaacgggcaggacuacgaggugaugaugcagaucgacugccaggugauggacacccggauccugcacaucaaguccagcuccgucccgcccuaccuccgcgaccagcagcggaaccagaccaacacguucuucggcagcccgcccgccgccaccgaggccacccacgugguguccaccauccccgagagccugcaguga

SEQ ID NO: 26997 - RNA, 1389 nt, Artificial Sequence
  derived and/or modified sequence opt1 from ATF7__Homo_sapiens__NP_001123532
augggcgacgaccgccccuucgugugcaacgccccggggugcggccagcgguucaccaacgaggaccaccuggccguccacaagcacaagcacgagaugacccucaaguucgggcccgcgcgcacggacagcgugaucaucgccgaccagacccccacccccacccgguuccugaagaacugcgaggaggugggccuguucaacgagcucgccuccagcuucgagcacgaguucaagaaggccgccgacgaggacgagaagaaggcggccgccgggccgcuggacaugucccugcccagcacgcccgacaucaagaucaaggaggaggagcccgucgaggaggugaccccgaagcccgugcucaucuccacccccacccccacgaucguccgcccgggcagccugccccugcaccucggcuacgacccccugcaccccacccugccgucccccaccagcgugaucacccaggccccgcccuccaaccggcagauggggagccccacgggcucccucccccuggugaugcaccuggcgaacgggcagaccaugcccguccuccccggcccgcccgugcagaugcccagcgugaucucccuggcccgccccgucagcauggugccgaacauccccgggauccccggcccgcccgugaacuccagcggcuccaucagccccuccgggcaccccaucccgagcgaggccaagaugcggcugaaggccacccucacccaccaggucagcuccaucaacggcgggugcggcaugguggugggcacggccagcaccauggucaccgcgcgccccgagcagucccagauccugauccagcaccccgacgcccccagcccggcccagccccaggugucccccgcccagcccaccccgagcaccgggggccggcgccggcgcaccguggacgaggaccccgacgagcggcgccagcgguuccuggagcgcaaccgggccgcggccucccgcugccggcagaagcgcaagcucugggucagcucccuggagaagaaggccgaggagcugaccagccagaacauccagcucuccaacgaggugacccugcugcggaacgagguggcccagcucaagcagcugcugcucgcccacaaggacugccccgucacggcgcugcagaagaagacccagggguaccuggagagccccaaggaguccagcgagccgaccggcucccccgcccccgugauccagcacagcuccgccaccgcccccagcaacgggcucuccguccgcagcgccgcggaggccguggccacgagcgugcugacccagauggccucccagcgcaccgagcugagcaugccgauccagucccacgucaucaugacgccccagagccaguccgcgggccgguga

SEQ ID NO: 26998 - RNA, 3318 nt, Artificial Sequence
  derived and/or modified sequence opt1 from ATF7IP__Homo_sapiens__NP_001273444
auggacagccuggaggagccccagaagaagguguucaaggcccgcaagaccaugcgggucuccgaccgccagcagcucgaggccguguacaaggugaaggaggagcugcugaagaccgacgucaagcuccugaacggcaaccacgagaacggggaccuggacccgacgagcccccucgagaacauggacuacaucaaggacaaggaggaggugaacggcaucgaggagaucugcuucgaccccgagggguccaaggccgaguggaaggagacccccugcauccugagcgugaacgucaagaacaagcaggacgacgaccugaacugcgagccgcucagcccccacaacaucacccccgagcccguguccaagcugccggccgagcccguguccggcgaccccgcccccggggaccuggacgccggcgacccggccagcggcguccucgcguccggggacagcaccuccggcgaccccacgagcuccgagcccagcuccagcgacgccgccuccggggacgccaccagcggcgacgcgcccuccggggacgugagcccgggcgacgccaccagcggcgacgccaccgccgacgaccuguccagcggggaccccacguccagcgaccccauccccggcgagccggugcccgucgagcccaucuccggggacugcgccgcggacgacaucgccagcuccgagaucaccagcguggaccuggccuccggcgcccccgccagcaccgacccggcguccgacgaccucgccagcggcgaccuguccagcuccgagcuggccagcgacgaccucgccaccggggagcuggccuccgacgagcugacgagcgaguccaccuucgaccggaccuucgagcccaagagcgugcccgucugcgagcccgugccggagaucgacaacaucgagcccagcuccaacaaggacgacgacuuccucgagaagaacggcgcggacgagaagcuggagcagauccagagcaaggacucccuggacgagaagaacaaggccgacaacaacaucgacgccaacgaggagacccucgagacggacgacaccaccaucugcagcgaccggcccccggagaacgagaagaagguggaggaggacaucaucaccgagcuggcccugggggaggacgccaucuccagcuccauggagaucgaccagggcgagaagaacgaggacgagacgagcgcggaccucgucgagaccaucaacgagaacgugaucgaggacaacaaguccgagaacauccuggagaacaccgacagcauggagaccgacgagaucauccccauccuggagaagcucgcccccuccgaggacgagcugacgugcuucagcaagaccucccugcuccccaucgacgagaccaacccggaccuggaggagaagauggagagcuccuucgggagccccuccaagcaggagagcagcgagucccugcccaaggaggccuuccucgugcugagcgacgaggaggacaucuccggcgagaaggacgagagcgaggucaucucccagaacgagaccugcagccccgagguggaguccaacgagaaggacaacaagccggaggaggaggagcaggucauccacgaggacgacgagcgccccagcgagaagaacgaguucucccgccggaagcgcagcaaguccgaggacauggacaacgugcagagcaagcggcgccgguacauggaggaggaguacgaggccgaguuccaggugaagaucacggcgaagggcgacaucaaccagaagcugcagaaggucauccaguggcuccuggaggagaagcugugcgcccuccagugcgccguguucgacaagacccuggccgagcugaagacccgcguggagaagaucgagugcaacaagcggcacaagaccguccucacggagcugcaggccaagaucgcgcgccugaccaagcgguucgaggccgccaaggaggaccucaagaagcgccacgagcacccgcccaacccgcccgugucccccgggaagaccgugaacgacgucaacagcaacaacaacauguccuaccggaacgccggcaccgugcgccagaugcuggagagcaagcggaacguguccgagagcgccccgcccuccuuccagacgcccgucaacaccgugagcagcaccaaccuggugaccccgcccgcggucguguccagccagcccaagcugcagacccccgugacguccgggagccucaccgccaccuccguccugcccgcccccaacaccgccacggugguggccaccacccagguccccagcggcaacccccagcccaccaucucccugcagccgcuccccgugauccugcacgugcccgucgcggugagcucccagccccagcugcuccagagccacccggggacgcuggugaccaaccagcccuccggcaacgucgaguucaucagcgugcaguccccgcccaccgugagcggccugaccaagaaccccgucucccuccccagccugcccaaccccacgaagccgaacaacgugcccuccgugcccagccccuccauccagcgcaacccgaccgccagcgccgcgccccuggggaccacccucgccguccaggccgugcccacggcccacagcaucgugcaggccacccggaccucccugcccaccgucggcccgagcgggcuguacucccccagcacgaaccgcggccccauccagaugaagauccccaucuccgccuucagcaccuccagcgcggccgagcagaacuccaacaccaccccgcgcaucgagaaccagacgaacaagaccaucgacgccagcguguccaagaaggccgccgacagcaccucccagugcgggaaggcgaccggcagcgacuccagcggcgugaucgaccucacgauggacgacgaggaguccggggccagccaggaccccaagaagcugaaccacacccccgucuccaccaugagcagcucccagcccgugagccggccgcugcagcccauccagcccgccccgccccuccagcccuccggcgugcccaccagcgggccgucccagacgaccauccaccuccugcccaccgcccccaccacggucaacgugacccaccgccccgugacccaggucaccacccggcugccggugccccgcgcccccgcgaaccaccagguggucuacacgacccugcccgccccgcccgcccaggcgccccugcggggcaccgugaugcaggcccccgccgugcgccaggucaacccgcagaacagcaagcgguucuuccucuacauggcgccccgcuacauguga

SEQ ID NO: 26999 - RNA, 663 nt, Artificial Sequence
  derived and/or modified sequence opt1 from ATG10__Homo_sapiens__XP_005248667
auggaggaggacgaguucaucggcgagaagaccuuccagcgcuacugcgccgaguucaucaagcacagccagcagaucggggacuccugggaguggcggcccagcaaggacugcuccgacggcuacaugugcaagauccacuuccagaucaagaacgggagcgugaugucccaccugggcgccagcacccacgggcagacgugccucccgauggaggaggcguucgagcugccccuggacgacugcgaggucaucgagaccgccgccgccuccgaggugaucaaguacgaguaccacgugcucuacagcugcuccuaccagguccccgugcuguacuuccgcgccagcuuccuggacggccggccccucacccugaaggacaucugggagggcgugcacgagugcuacaagaugcgccugcuccaggggccgugggacaccaucacgcagcaggagcaccccauccugggccagcccuucuucguccugcaccccugcaagaccaacgaguucaugaccccggugcucaagaacucccagaagaucaacaagaacgugaacuacaucaccagcuggcuguccaucgucgggcccguggugggccugaaccucccccugagcuacgcgaaggccacgucccaggacgagcggaacguccccuga

SEQ ID NO: 27000 - RNA, 225 nt, Artificial Sequence
  derived and/or modified sequence opt1 from ATG12__Homo_sapiens__NP_001264712
auggccgaggagccccagagcgugcugcagcucccgaccuccaucgccgcgggcggggagggccugaccgacgucagccccgagacgaccacccccgagcccccguccagcgccgccgugucccccgggaccgaggagcccgccggcgacacgaagaagaagaucuaccugugcgagagcgugcucugcuccuucccccgcccgcggagcuggaacucccuguga

SEQ ID NO: 27001 - RNA, 1767 nt, Artificial Sequence
  derived and/or modified sequence opt1 from ATG16L1__Homo_sapiens__NP_060444
augagcuccggccugcgcgccgccgacuucccccgguggaagcgccacaucagcgagcagcuccggcgccgggaccgccugcagcggcaggcguucgaggagaucauccugcaguacaacaagcuccuggagaaguccgaccugcacagcgugcucgcccagaagcugcaggccgagaagcacgacgucccgaaccgccacgagaucucccccgggcacgacggcaccuggaacgacaaccagcugcaggagauggcccagcuccggaucaagcaccaggaggagcugaccgagcugcacaagaagcgcggggagcucgcccagcuggugaucgaccugaacaaccagaugcagcggaaggaccgcgagaugcagaugaacgaggcgaagaucgccgagugccuccagacgaucagcgaccuggagaccgagugccuggaccuccggaccaagcugugcgaccuggagcgcgccaaccagacccucaaggacgaguacgacgcccugcagaucacguucaccgcgcuggagggcaagcuccggaagaccaccgaggagaaccaggagcuggugacgcgcuggauggccgagaaggcccaggaggccaaccggcugaacgccgagaacgagaaggacucccgccggcgccaggcgcggcuccagaaggagcuggccgaggccgccaaggagccccugcccgucgagcaggacgacgacaucgaggugaucguggacgagaccagcgaccacaccgaggagaccuccccgguccgcgccaucagccgcgcggccacgcggcgcuccgugagcuccuuccccgugccccaggacaacgucgacacccaccccgggagcggcaaggaggugcgggugccggccaccgcccucugcgucuucgacgcccacgacggcgaggugaacgcggugcaguucucccccgggagccgccugcuggccaccggcgggauggaccggcgcgucaagcucugggagguguucggcgagaagugcgaguucaaggggucccugagcggcuccaacgccggcaucacgagcaucgaguucgacagcgccggguccuaccugcucgccgcgagcaacgacuucgccucccggaucuggaccguggacgacuaccgccugcggcacacccugaccggccacagcgggaagguccucuccgccaaguuccugcuggacaacgcccgcaucgugagcggcucccacgaccggacgcucaagcugugggaccugcgcagcaaggugugcaucaagaccgucuucgcgggcuccagcugcaacgacaucgugugcaccgagcagugcgugauguccgggcacuucgacaagaagauccgguucugggacauccgcagcgaguccaucguccgggagauggagcuccugggcaagaucaccgcccuggaccucaaccccgagcgcacggagcugcugagcugcucccgggacgaccugcucaaggugaucgaccugcgcaccaacgccaucaagcagaccuucagcgcccccggguucaagugcggcuccgacuggacccgggucguguucagcccggacggguccuacguggccgcgggcagcgccgagggcagccuguacaucugguccguccucacggggaagguggagaaggugcugagcaagcagcacuccagcuccaucaacgccgucgccuggagccccuccggcagccacgugguguccgucgacaaggggugcaaggccgugcugugggcgcaguacuga

SEQ ID NO: 27002 - RNA, 6237 nt, Artificial Sequence
  derived and/or modified sequence opt1 from ATG2B__Homo_sapiens__NP_060506
augcccuggcccuucagcgaguccaucaagaagcgcgccugccgguaccugcuccagcgcuaccuggggcacuuccugcaggagaagcucagccuggagcagcugucccucgaccuguaccaggggaccggcagccuggcccaggugccccucgacaaguggugccugaacgagauccuggaguccgccgacgcgccccuggaggucaccgagggguucauccagagcaucucccugagcgugcccuggggcucccugcuccaggacaacugcgcccuggaggugcgggggcuggagauggucuuccgcccgcggccccgccccgccaccggcagcgagcccauguacugguccagcuucaugaccuccagcaugcagcucgccaaggagugccugucccagaagcugaccgacgagcagggcgaggggagccagcccuucgagggccucgagaaguucgcggagaccaucgagaccgugcugcggcgcgugaaggucaccuucaucgacaccgugcugcggaucgagcacgugcccgagaacuccaagaccgggacggcccucgagauccgcaucgagcggaccgucuacugcgacgagaccgccgacgagagcuccggcaucaacgugcaccagcccaccgccuucgcgcacaagcugcugcagcucagcggggugagccuguucugggacgaguucuccgccagcgccaaguccagccccgucugcuccacggcccccguggagaccgagcccaagcugagccccuccuggaaccccaagaucaucuacgagccccacccccagcucacccgcaaccugcccgagaucgcccccagcgacccggugcagaucggccggcugaucggccgccucgagcugucccugacccucaagcagaacgagguccugcccggggcgaagcuggacguggacggccagaucgacagcauccaccuccugcugagcccccgccaggugcaccuccugcuggacaugcucgccgccaucgccgggcccgagaacagcuccaagaucggccuggccaacaaggaccgcaagaaccggccgaugcagcaggaggacgaguaccgcauccagauggagcugaaccgguacuaccuccgcaaggacagccuguccgucggcgugagcuccgagcagagcuucuacgagacggagaccgcgcggacccccuccagccgcgaggaggagguguucuucagcauggccgacauggacaugucccacagccuguccagccugccgccccucggggacccgcccaacauggaccuggagcugucccucaccagcacguacaccaacacccccgccggcuccccgcugagcgccaccguccugcagcccacguggggcgaguuccucgaccaccacaaggagcagcccgugcgcggcuccaccuuccccagcaaccuggugcacccgacgccccugcagaagaccucccuccccagccgguccgucagcguggacgagucccgccccgagcugaucuuccggcuggccgucgggacguucagcaucuccgugcuccacaucgacccgcuguccccgcccgagaccagccagaaccugaacccccucaccccgauggcgguggccuucuucacgugcaucgagaagaucgaccccgcccgcuucuccacggaggacuucaagagcuuccgggccgucuucgccgaggcgugcucccacgaccaccuccgguucaucggcaccggcaucaaggugagcuacgagcagcggcagcgcuccgccagccgguacuucuccaccgacaugagcaucgggcagauggaguuccuggagugccucuuccccaccgacuuccacuccgugcccccgcacuacacggagcugcugaccuuccacagcaaggaggagaccggcucccacagccccgucugccuccagcugcacuacaagcacuccgagaaccgcgggccccagggcaaccaggcccggcugagcuccgugccccacaaggccgagcuccagaucaagcugaacccggugugcugcgagcuggacaucagcaucgucgaccgccucaacucccugcugcagccccagaagcucgcgaccguggagaugauggccagccacauguacaccuccuacaacaagcacaucagccugcacaaggccuucacggagguguuccuggacgacagccacucccccgccaacugccggaucagcguccagguggccacccccgcgcucaaccuguccgugcgcuucccgauccccgaccugcggagcgaccaggagcgcgggcccugguucaagaagucccuccagaaggagauccuguaccuggccuucaccgaccucgaguucaagaccgaguucaucggcggcagcacgccggagcagaucaagcuggagcugaccuuccgggagcucaucggguccuuccaggaggagaagggcgaccccagcaucaaguucuuccacgucuccagcgggguggacggcgacaccaccuccagcgacgacuucgacuggccccgcaucgugcugaagaucaacccgcccgccaugcacuccauccuggagcggaucgccgccgaggaggaggaggagaacgacgggcacuaccaggaggaggaggagggcggcgcgcacagccucaaggacgucugcgaccugcgccgccccgcccccucccccuucagcucccggcgcgugauguucgagaacgagcagauggugaugcccggggaccccgucgagaugacggaguuccaggacaaggccaucagcaacucccacuacgugcuggagcucacccugcccaacaucuacgugacccugcccaacaagagcuucuacgagaagcucuacaaccggaucuucaacgaccugcugcucugggagccgaccgcccccagccccgucgagacguucgagaacaucuccuacggcaucgggcugagcguggccucccagcugaucaacaccuucaacaaggacagcuucuccgcguucaagagcgccgugcacuacgacgaggaguccggcagcgaggaggagacccuccaguacuucuccaccgucgaccccaacuaccgcagccggcgcaagaagaagcuggacucccagaacaagaacagccaguccuuccugagcgugcuccugaacaucaaccacggccugaucgccguguucacggacgucaagcaggacaacggggaccuccuggagaacaagcacggcgaguucuggcuggaguucaacuccgggagccucuucugcgugaccaaguacgagggcuucgacgacaagcacuacaucugccugcacuccagcuccuucagccuguaccacaaggggaucgugaacggcgucauccucccgaccgagacccggcugcccagcuccacgcgcccccacuggcuggagcccaccaucuacagcuccgaggaggacggccucagcaagaccuccagcgacggggugggcggggacucccugaacaugcugagcguggccgucaagauccucuccgacaagagcgaguccaacaccaaggaguuccugaucgcggugggccugaagggggccacgcuccagcaccggaugcugccgagcggccuguccuggcacgagcagauccucuacuuccugaacaucgccgacgagcccgugcugggcuacaacccgcccaccagcuucaccaccuuccacguccaccucugguccugcgcccuggacuaccgcccgcuguaccuccccauccggagccugcugacgguggagaccuucuccgugagcuccagcgucgcccucgacaagagcuccagcacccugcgcaucauccuggacgaggcggcccuccaccuguccgacaagugcaacaccgugacgaucaaccugagccgggacuacgugcgcgucauggacauggggcugcucgagcugaccaucaccgccgugaaguccgacagcgacggcgagcagaccgagccccgguucgagcugcacugcuccagcgacgugguccacauccgcacgugcuccgacagcugcgccgcccucaugaaccugauccaguacaucgcguccuacggggaccugcagacccccaacaaggccgacaugaagccgggcgccuuccagcggcgcagcaagguggacuccagcgggcgguccagcucccgcggccccgugcuccccgaggccgaccagcagaugcugcgggaccugaugagcgacgccauggaggagaucgacaugcagcagggcaccuccagcgucaagccgcaggcgaacggggugcucgacgagaagucccagauccaggagcccugcugcuccgaccuguuccuguuccccgacgagagcggcaacgucucccaggagagcgggcccaccuacgccuccuucagccaccacuucaucuccgacgccaugaccggcgugccgacggagaacgacgacuucugcauccucuucgcccccaaggcggccaugcaggagaaggaggaggagcccgugaucaagaucauggucgacgacgccaucgugauccgcgacaacuacuucagccugcccgugaacaagaccgacaccuccaaggccccgcugcacuuccccauccccgucauccgcuacguggugaaggaggucagccucguguggcaccuguacgggggcaaggacuucggcaccgugcccccgacgucccccgccaagagcuacaucagcccccacuccucccccagccacaccccgacccggcacgggcgcaacaccgucugcggcgggaagggccggaaccacgacuuccugauggagauccagcucuccaaggugaaguuccagcacgagguguacccgcccugcaagcccgacugcgacagcagccuguccgagcacccggucagccgccagguguucaucgugcaggaccuggagauccgggaccgccucgcgacgucccagaugaacaaguuccuguaccuguacugcagcaaggagaugccccggaaggcccacuccaacaugcucaccgucaaggcccugcacgugugccccgagagcggccgcagcccccaggagugcugccugcgggugagccucaugccgcugcgccugaacaucgaccaggacgcccucuucuuccugaaggacuucuucaccucccugagcgccgaggucgagcuccagaugacccccgaccccgaggugaagaagucccccggggcggacgugacgugcagccugccgcggcaccuguccaccagcaaggagcccaaccucgucaucuccuucagcggccccaagcagccgucccagaacgacagcgccaacuccguggagguggucaacgggauggaggagaagaacuucagcgccgaggaggccagcuuccgcgaccagcccguguucuuccgggaguuccgcuucaccuccgaggugcccauccggcuggacuaccacggcaagcacgucagcauggaccaggggacccuggccggcauccucaucggccuggcgcagcugaacugcuccgagcucaagcugaagcgccugagcuaccggcacgggcuccugggcguggacaagcuguucuccuacgccaucacggaguggcucaacgacaucaagaagaaccagcugcccgggauccugggcggggugggcccgaugcacagccucguccagcuggugcagggccugaaggaccucguguggcugcccaucgagcaguaccgcaaggacgggcggaucguccgcggcuuccagcgcggggccgccuccuucggcaccagcaccgccauggcggcccuggagcucaccaaccggauggugcagacgauccaggccgccgcggagaccgccuacgacauggugucccccgggacccugagcaucgagcccaagaagaccaagcgcuucccgcaccaccggcuggcccaccagcccgucgaccuccgcgagggcguggccaaggccuacuccguggucaaggagggcaucacggacaccgcgcagaccaucuacgagaccgccgcccgggagcacgagagccgcggggugacgggcgccgugggggagguccugcggcagaucccgcccgccguggugaagccgcugaucgucgcgaccgaggccaccuccaacgugcucggcggcaugcgcaaccagauccggcccgacgugcgccaggacgagagccagaaguggcggcacggggacgacuga

SEQ ID NO: 27003 - RNA, 945 nt, Artificial Sequence
  derived and/or modified sequence opt1 from ATG3__Homo_sapiens__NP_071933
augcagaacgugaucaacaccgucaagggcaaggcccuggagguggccgaguaccucacccccgugcugaaggagagcaaguucaaggagacgggggucaucaccccggaggaguucguggcggccggcgaccaccuggugcaccacugccccaccuggcagugggccaccggggaggagcucaaggucaaggccuaccugcccacgggcaagcaguuccuggugaccaagaacgugcccugcuacaagcgcugcaagcagauggaguacuccgacgagcucgaggccaucaucgaggaggacgacggggacggcggcugggucgacaccuaccacaacaccgggaucacgggcaucaccgaggcggugaaggagaucacccuggagaacaaggacaacauccggcugcaggacugcagcgcccucugcgaggaggaggaggacgaggacgagggggaggccgccgacauggaggaguacgaggaguccggccugcuggagaccgacgaggcgacgcucgacacccgcaagaucguggaggccugcaaggccaagaccgacgccgggggcgaggacgccauccugcagacccggacguacgaccuguacaucaccuacgacaaguacuaccagaccccgcgccucuggcuguucggcuacgacgagcagcggcagccccugaccgucgagcacauguacgaggacaucagccaggaccacgugaagaagacggugaccaucgagaaccacccccaccucccgcccccgcccaugugcuccguccaccccugccgccacgcggaggugaugaagaagaucaucgagaccguggccgagggcggcggggagcuggggguccacauguaccugcucaucuuccugaaguucgugcaggccgugauccccaccaucgaguacgacuacacgcggcacuucaccauguga

SEQ ID NO: 27004 - RNA, 1197 nt, Artificial Sequence
  derived and/or modified sequence opt1 from ATG4A__Homo_sapiens__NP_443168
auggagagcgugcuguccaaguacgaggaccagaucaccaucuucaccgacuaccucgaggaguaccccgacacggacgagcuggucuggauccugggcaagcagcaccuccugaagaccgagaaguccaagcugcucagcgacaucagcgcccgccugugguucaccuaccggcgcaaguucuccccgaucgggggcaccgggcccagcuccgacgccggcugggggugcaugcugcggugcggccagaugaugcucgcgcaggcccugaucugccgccaccugggccgggacuggagcugggagaagcagaaggagcagcccaaggaguaccagcgcauccuccagugcuuccuggaccggaaggacugcugcuacuccauccaccagauggcccagaugggggugggcgagggcaagagcaucggggagugguucgggcccaacacgguggcccagguccugaagaagcucgcccuguucgacgaguggaacucccuggcgguguacgugagcauggacaacaccgucgugaucgaggacaucaagaagaugugccgcgugcucccgcuguccgccgacaccgccggcgaccggccgcccgacagccugaccgccuccaaccagagcaagggcacguccgcguacugcagcgccuggaagccccuccugcugaucgucccccuccgccuggggaucaaccagaucaaccccguguacguggacgccuucaaggagugcuucaagaugccccagucccugggcgcccucgggggcaagcccaacaacgccuacuacuucaucggcuuccugggggacgagcugaucuuccucgacccgcacaccacccagaccuucgucgacacggaggagaacggcaccgugaacgaccagaccuuccacugccugcagagcccccagcggaugaacauccugaaccucgaccccagcguggcgcugggguucuucugcaaggaggagaaggacuucgacaacuggugcucccugguccagaaggagauccucaaggagaaccugcgcauguucgagcuggugcagaagcaccccagccacuggccgcccuucgugccgcccgccaagcccgaggucaccacgaccggcgccgaguucaucgacuccaccgagcagcucgaggaguucgaccuggaggaggacuucgagauccugagcguguga

SEQ ID NO: 27005 - RNA, 1182 nt, Artificial Sequence
  derived and/or modified sequence opt1 from ATG4B__Homo_sapiens__NP_037457
auggacgccgccacccugaccuacgacacgcuccgcuucgcggaguucgaggacuuccccgagaccagcgagccgguguggauccugggccggaaguacuccaucuucaccgagaaggacgagauccugagcgacgucgccucccgccucugguucaccuaccggaagaacuuccccgccaucgggggcacggggcccaccagcgacaccggcugggggugcaugcugcgcugcggccagaugaucuucgcccaggcccuggugugccggcaccucggccgcgacuggcgguggacccagcgcaagcggcagcccgacuccuacuucagcgugcugaacgcguucaucgaccgcaaggacuccuacuacagcauccaccagaucgcccagaugggggucggcgaggggaaguccaucggccagugguacgggccgaacacgguggcccaggugcugaagaagcucgccgucuucgacaccuggagcucccuggcggugcacaucgccauggacaacaccguggucauggaggagauccggcgccugugccggaccagcgugcccugcgccggcgccacggccuuccccgcggacuccgaccgccacugcaacggcuuccccgccggggccgaggugaccaaccggccgagccccuggcgcccccucguccugcugaucccccuccggcugggccugaccgacaucaacgaggccuacguggagacccucaagcacugcuucaugaugccgcagucccugggggugaucggcggcaagcccaacagcgcccacuacuucaucggguacgucggcgaggagcugaucuaccucgacccccacacgacccagcccgcgguggagccgaccgacgggugcuucauccccgacgaguccuuccacugccagcacccgcccugccgcaugagcaucgccgagcuggaccccuccaucgccgugggcuucuucugcaagaccgaggacgacuucaacgacuggugccagcaggucaagaagcugagccuccucgggggcgcccugcccauguucgagcugguggagcugcagcccagccaccuggccugccccgacgugcucaaccugucccuggacagcuccgacgucgagcggcucgagcgcuucuucgacagcgaggacgaggacuucgagauccugucccuguga

SEQ ID NO: 27006 - RNA, 1272 nt, Artificial Sequence
  derived and/or modified sequence opt1 from ATG4C__Homo_sapiens__XP_011540615
auggaggccaccggcaccgacgagguggacaagcugaagacgaaguucaucagcgccuggaacaacaugaaguacuccuggguccucaagaccaagaccuacuucagccgcaacucccccgugcugcugcucgggaagugcuaccacuucaaguacgaggacgaggacaagacccugccggcggagagcggcugcacgaucgaggaccacgugaucgccgggaacgucgaggaguuccggaaggacuucaucucccgcaucuggcugaccuaccgggaggaguucccccagaucgagggcagcgcccucaccaccgacugcggguggggcugcacgcugcgcaccggccagaugcugcucgcccaggggcugauccugcacuuccucggccgggccuggaccuggcccgacgcgcugaacaucgagaacuccgacagcgaguccuggaccagccacacggugaagaaguucaccgccuccuucgaggccagccuguccggggagcgcgaguucaagacccccaccaucagccucaaggagacgaucggcaaguacuccgacgaccacgagaugcggaacgagguguaccaccgcaagaucaucagcugguucggggacuccccgcuggcccuguucggccuccaccagcugaucgaguacggcaagaaguccgggaagaaggcgggcgacugguacgggcccgccgucguggcccacauccugcggaaggccguggaggaggcccgccaccccgaccuccagggcaucaccaucuacgucgcgcaggacugcaccguguacaacagcgacgugaucgacaagcagagcgccagcaugaccuccgacaacgccgacgacaaggccgucaucauccuggugcccgugcggcugggcggggagcgcacgaacaccgacuaccucgaguucgucaagggcauccugagccuggaguacugcguggggaucaucggcgggaagccgaagcaguccuacuacuucgccggcuuccaggacgacagccucaucuacauggacccccacuacugccaguccuucguggacgucagcaucaaggacuucccccuggagaccuuccacugccccuccccgaagaagaugagcuuccggaagauggaccccuccugcaccaucggcuucuacugccgcaacgugcaggacuucaagcgggcgagcgaggagaucacgaagaaccagaucaugaucaaggccgccaucaucaacauccacgugcaggacuucauguggaccuga

SEQ ID NO: 27007 - RNA, 828 nt, Artificial Sequence
  derived and/or modified sequence opt1 from ATG5__Homo_sapiens__NP_001273035
augaccgacgacaaggacgugcugcgcgacgucugguucggccggaucccgaccugcuucacccucuaccaggacgagaucaccgagcgcgaggccgagcccuacuaccugcugcucccccgggugagcuaccugacccuggugaccgacaaggucaagaagcacuuccagaaggugaugcgccaggaggacaucuccgagaucugguucgaguacgaggggacgccccucaaguggcacuaccccaucggccugcuguucgaccuccuggccagcuccagcgcgcugccguggaacaucaccgugcacuucaaguccuuccccgagaaggaccuccugcacugccccagcaaggacgccaucgaggcccacuucauguccugcaugaaggaggccgacgcccugaagcacaagagccaggucaucaacgagaugcagaagaaggaccacaagcagcucuggauggggcugcagaacgaccgguucgaccaguucugggcgaucaaccgcaagcugauggaguaccccgccgaggagaacggcuuccgguacaucccguuccgcaucuaccagaccaccacggagcggcccuucauccagaagcuguuccgccccguggccgccgacgggcagcuccacacccugggcgaccuccugaaggaggugugccccuccgcgaucgacccggaggacggcgagaagaagaaccaggucaugauccacgggaucgagcccaugcuggagacgccccuccaguggcugagcgagcaccuguccuaccccgacaacuuccuccacaucagcaucaucccgcagcccaccgacuga

SEQ ID NO: 27008 - RNA, 2031 nt, Artificial Sequence
  derived and/or modified sequence opt1 from ATG7__Homo_sapiens__NP_001129503
auggccgccgcgaccggcgaccccgggcugagcaagcuccaguucgcccccuucuccagcgcccuggacgugggcuucuggcacgagcugacccagaagaagcucaacgaguaccgccuggacgaggcccccaaggacaucaagggguacuacuacaacggcgacuccgccgggcugcccgcgcggcucacgcuggaguucagcgccuucgacauguccgcccccaccccggcccgcugcugccccgcgaucggcacccuguacaacaccaacacgcucgagagcuucaagaccgccgacaagaagcugcugcucgagcaggccgccaacgagaucugggaguccaucaagagcggcaccgcccuggagaaccccguccugcucaacaaguuccugcugcucaccuucgcggaccugaagaaguaccacuucuacuacugguucugcuaccccgcccugugccucccggagucccugccccugauccaggggcccgugggccucgaccagcgguucagccugaagcagaucgaggcccuggagugcgccuacgacaaccucugccagacggagggggugaccgcccugcccuacuuccugaucaaguacgacgagaacaugguccucgugucccugcugaagcacuacagcgacuucuuccagggccagcgcaccaagaucaccaucgggguguacgacccgugcaaccucgcgcaguaccccggcuggccccugcggaacuuccugguccucgccgcccaccgcugguccagcuccuuccagagcguggagguggucugcuuccgggaccgcacgaugcagggcgcccgggacguggcccacuccaucaucuucgaggugaagcugcccgagauggcguucagcccggacugccccaaggccgucgggugggagaagaaccagaagggcgggaugggcccccgcauggugaaccuguccgagugcauggaccccaagcggcucgccgagagcagcguggaccugaaccugaagcucaugugcuggcgccuggucccgacccuggaccucgacaaggugguguccgucaagugccugcugcucggcgccgggacccugggcugcaacguggcccggacccugaugggguggggcgugcgccacaucacguucgucgacaacgcgaagaucagcuacuccaaccccgugcggcagccccuguacgaguucgaggacugccucgggggcggcaagcccaaggcccuggccgccgcggaccgccugcagaagaucuucccgggggugaacgcccggggcuucaacaugagcauccccaugcccgggcaccccgucaacuucuccagcgugacccucgagcaggcccgccgggacgucgagcagcuggagcagcugaucgagucccacgacgugguguuccuccugauggacacccgcgagagccgguggcugccggccgucaucgccgcguccaagcgcaagcucgugaucaacgccgcccugggcuucgacaccuucguggucaugcgccacgggcugaagaagcccaagcagcagggcgccggcgaccucugccccaaccacccgguggccagcgcggaccugcugggguccagccucuucgccaacauccccggcuacaagcuggggugcuacuucugcaacgacguggucgcccccggcgacuccacgcgggaccgcacccuggaccagcagugcaccgugagccggcccgggcucgccgugaucgccggcgcgcuggccgucgagcugaugguguccgugcuccagcacccggagggcggguacgccaucgccagcuccagcgacgaccgcaugaacgagccgcccaccucccugggccuggucccccaccaggugcucgaccaguacgagcgggagggguucaacuuccuggcgaagguguucaacagcagccacuccuuccuggaggaccucacgggccugacccugcuccaccaggagacccaggccgccgagaucugggacaugagcgacgacgagaccaucuga

SEQ ID NO: 27009 - RNA, 2520 nt, Artificial Sequence
  derived and/or modified sequence opt1 from ATG9A__Homo_sapiens__NP_001070666
auggcccaguucgacaccgaguaccagcgccuggaggccagcuacuccgacagcccgcccggcgaggaggaccuccuggugcacgucgcggagggguccaagagccccuggcaccacaucgagaaccuggaccucuucuucucccggguguacaaccugcaccagaagaacggcuucacgugcaugcugaucggggagaucuucgagcucaugcaguuccuguucguggucgccuucaccaccuuccuggugagcugcguggacuacgacauccucuucgccaacaagauggucaaccacucccugcaccccaccgagcccgugaaggugacccugcccgacgccuuccuccccgcccaggucugcagcgcgcgcauccaggagaacggcucccugaucacgauccuggugaucgccgggguguucuggauccaccggcucaucaaguucaucuacaacaucugcugcuacugggagauccacagcuucuaccugcacgcccugcgcauccccauguccgcccuccccuacugcaccuggcaggagguccaggcgcggaucgugcagacccagaaggagcaccagaucugcauccacaagcgcgagcugaccgagcuggacaucuaccaccggauccuccgcuuccagaacuacaugguggcccuggucaacaagagccugcucccgcugcgguuccgccugcccggccucggcgaggccguguucuucacgcgggggcugaaguacaacuucgagcugauccucuucuggggccccgggucccuguuccugaacgaguggagccucaaggccgaguacaagcgcggcgggcagcggcuggagcuggcccagcgccucuccaaccggauccuguggaucggcaucgcgaacuuccugcucugcccccugauccugaucuggcagauccucuacgccuucuucagcuacgccgaggugcugaagcgcgagccgggcgcccugggggcccggugcuggucccucuacggccgcugcuaccugcggcacuucaacgagcuggagcacgagcuccagagccgccugaaccggggguacaagcccgcguccaaguacaugaacugcuuccugagcccccugcucacccugcuggccaagaacggcgccuucuucgccggcagcauccucgccguccugaucgcgcugaccaucuacgacgaggacgugcucgccguggagcacguccugaccacggugacccugcucggggugaccgucaccgugugccgcuccuucauccccgaccagcacauggucuucugcccggagcagcugcugcgcgugauccucgcccacauccacuacaugcccgaccacuggcagggcaacgcccaccggagccagacgcgcgacgaguucgcccagcuguuccaguacaaggcgguguucauccuggaggagcuccugucccccaucgucacgccccugauccucaucuucugccugcggccgcgcgcccuggagaucaucgacuucuuccggaacuucaccguggagguggucggggugggcgacacgugcagcuucgcccagauggacgugcgccagcacgggcacccccaguggcucuccgccggccagaccgaggcgagcgucuaccagcaggccgaggacggcaagaccgagcugucccugaugcacuucgccaucaccaaccccggguggcagcccccgcgggagagcaccgccuuccucggcuuccugaaggagcagguccagcgcgacggggccgcggccucccuggcccagggcgggcuccugcccgagaacgcccuguucaccagcauccagucccuccagagcgaguccgagccccugagccugaucgccaacgugguggcgggcuccagcugccgggggcccccgcucccccgcgaccugcagggcucccggcaccgcgccgagguggccagcgcccugcgguccuucagcccccuccagccgggccaggcccccaccgggcgcgcgcacagcaccaugaccggcuccgggguggacgcccggacggccagcuccggcagcuccgucugggagggccagcugcagagccuggugcucuccgaguacgccagcaccgagaugucccugcacgcgcuguacaugcaccagcuccacaagcagcaggcccaggccgagcccgagcgccacguguggcaccggcgcgagagcgacgaguccggggagagcgcccccgacgagggcggggagggcgcccgggcgccgcaguccaucccccgcagcgccuccuaccccugcgccgcgccccgcccgggcgcccccgagaccaccgcccugcacgggggcuuccagcggcgcuacgggggcaucacggaccccgggaccgucccccgggugccgagccacuucucccgccugccccucggcggcugggccgaggacgggcagagcgccagccggcaccccgagcccgugccggaggagggcuccgaggacgagcugccgccccagguccacaagguguga

SEQ ID NO: 27010 - RNA, 1779 nt, Artificial Sequence
  derived and/or modified sequence opt1 from ATIC__Homo_sapiens__NP_004035
auggcccccggccagcuggcccucuucagcguguccgacaagaccgggcuggucgaguucgcgcgcaaccugaccgcccucggccugaaccugguggccagcgggggcacggccaaggcccuccgggacgcggggcuggccgugcgcgacgucuccgagcugaccggcuucccggagaugcucggcgggcgggugaagacccugcaccccgccgugcacgccggcauccuggcgcgcaacauccccgaggacaacgccgacauggcccggcucgacuucaaccugauccgcgucguggccugcaaccuguaccccuucgugaagaccgucgccagcccgggggugacgguggaggaggcggucgagcagaucgacaucggcggggugacccuccugcgggccgccgccaagaaccacgcccgcgugaccgucgugugcgagcccgaggacuacguggucguguccaccgagaugcagagcuccgagagcaaggacacgucccuggagacccggcgccagcucgcgcugaaggccuucacccacaccgcccaguacgacgaggccaucagcgacuacuuccggaagcaguacuccaagggcgugagccagaugccccugcgcuacggcaugaacccccaccagacgccggcccagcucuacacccugcagcccaagcugcccaucaccguccucaacggggcgcccggcuucaucaaccugugcgacgcccugaacgccuggcagcucgugaaggagcugaaggaggcccuggggaucccggccgcggccuccuucaagcacgugagccccgccggcgccgcggucggcaucccccucuccgaggacgaggccaaggugugcauggucuacgaccuguacaagacccugacgcccaucagcgccgccuacgcccgggcgcgcggggccgaccggauguccagcuucggcgacuucguggcccucuccgacgugugcgacgucccgaccgccaagaucaucagccgcgaggugagcgacgggaucaucgcccccggcuacgaggaggaggcgcugaccauccuguccaagaagaagaacgggaacuacugcgugcuccagauggaccagagcuacaagcccgacgagaacgagguccggacccuguucggccugcaccucucccagaagcgcaacaacggcgugguggacaagagccuguucuccaacgucgugacgaagaacaaggaccugcccgagagcgcccuccgggaccugaucguggccaccaucgccgucaaguacacccaguccaacagcgugugcuacgccaagaacggccaggugaucgggaucggggcgggccagcagucccgcauccacugcacccggcuggccggggacaaggccaacuacugguggcuccgccaccacccgcagguccugagcaugaaguucaagacgggcgugaagcgcgccgagaucuccaacgcgaucgaccaguacgugaccggcaccaucggggaggacgaggaccugaucaaguggaaggcccucuucgaggagguccccgagcugcugaccgaggccgagaagaaggaguggguggagaagcugacggaggugagcaucuccagcgacgccuucuuccccuuccgggacaacgucgaccgcgccaagcgguccggcguggcguacaucgccgcccccagcggguccgccgccgacaagguggucaucgaggcgugcgacgagcucggcaucauccuggcccacaccaaccugcgccucuuccaccacuga

SEQ ID NO: 27011 - RNA, 1662 nt, Artificial Sequence
  derived and/or modified sequence opt1 from ATL1__Homo_sapiens__NP_001121185
auggccaagaaccgccgggaccgcaacagcuggggcggguucuccgagaagaccuacgaguggagcuccgaggaggaggagccggugaagaaggccggcccgguccaggugcugaucgugaaggacgaccacagcuucgagcucgacgagaccgcgcugaaccggauccugcucuccgaggccguccgcgacaaggaggugguggccgucagcguggccggggccuuccggaagggcaaguccuuccugauggacuucaugcugcgcuacauguacaaccaggagagcguggacugggucggggacuacaacgagccccucacgggcuucuccuggcggggcgggagcgagcgcgagaccaccggcauccagaucugguccgagaucuuccugaucaacaagcccgacgggaagaagguggcggugcugcucauggacacccagggcacguucgacagccaguccacccugcgggacagcgccaccgucuucgcccuguccaccaugaucagcuccauccagguguacaaccucagccagaacgugcaggaggacgaccugcagcaccuccagcuguucacggaguacgggcgccuggccauggaggagaccuuccugaagcccuuccagucccucaucuuccugguccgggacuggagcuucccguacgaguucagcuacggcgcggacggcggggccaaguuccuggagaagcgccucaagguguccggcaaccagcacgaggagcugcagaacgugcggaagcacauccacagcugcuucaccaacaucuccugcuuccugcucccccaccccgggcugaaggucgccaccaaccccaacuucgacggcaagcugaaggagaucgacgacgaguucaucaagaaccucaagauccugaucccguggcugcucagccccgagucccuggacaucaaggagaucaacggcaacaagaucacgugccgcgggcugguggaguacuucaaggccuacaucaagaucuaccagggcgaggagcucccccaccccaagagcaugcugcaggccaccgcggaggccaacaaccuggccgccguggccaccgcgaaggacaccuacaacaagaagauggaggagaucugcgggggcgacaagccguuccucgcccccaacgaccugcagacgaagcaccuccagcugaaggaggaguccgucaagcuguuccgcggggugaagaagaugggcggcgaggaguucagccggcgguaccugcagcagcucgaguccgagaucgacgagcuguacauccaguacaucaagcacaacgacagcaagaacaucuuccacgccgcccgcacccccgccacccuguucguggucaucuucaucaccuacgugaucgcgggggucacgggcuucaucgggcucgacaucaucgccucccugugcaacaugaucaugggccugacccucaucacccugugcaccugggccuacauccgguacagcggggaguaccgcgagcugggcgccgugaucgaccagguggccgcggcccugugggaccaggcccucuacaagcuguacuccgccgcggccacgcaccggcaccuguaccaccaggccuuccccacccccaagagcgaguccaccgagcagagcgagaagaagaagauguga

SEQ ID NO: 27012 - RNA, 1752 nt, Artificial Sequence
  derived and/or modified sequence opt1 from ATL2__Homo_sapiens__NP_001129145
auggccgagggcgacgaggccgcgcgcgggcagcagccccaccagggccuguggcggcgccggcgcaccagcgacccguccgccgccgugaaccacgucagcuccaccacgagccucggggagaacuacgaggacgacgaccuggugaacuccgacgaggugaugaagaagcccugccccguccagaucgugcuggcccacgaggacgaccacaacuucgagcucgacgaggaggcccuggagcagauccugcuccaggagcacauccgggaccugaacaucguggucgugagcguggcgggcgccuuccgcaaggggaaguccuuccugcucgacuucaugcugcgguacauguacaacaaggacagccaguccuggaucggcggcaacaacgagccccugaccggguucaccuggcgcggcgggugcgagcgggagaccacgggcauccaggucuggaacgagguguucgugaucgaccgcccgaacgggaccaaggucgccgugcuccugauggacacccagggcgccuucgacagccaguccaccaucaaggacugcgcgacgguguucgcccugagcaccaugaccuccagcguccagguguacaaccucucccagaacauccaggaggacgaccugcagcaccuccagcuguucaccgaguacggccggcuggccauggaggagaucuaccagaagcccuuccagacgcugauguuccucauccgcgacuggagcuaccccuacgagcacuccuacgggcuggagggcgggaagcaguuccuggagaagcggcuccaggugaagcagaaccagcacgaggagcugcagaacguccgcaagcacauccacaacugcuucagcaaccugggcugcuuccuccugccccacccgggccugaagguggccaccaaccccuccuucgacgggcggcucaaggacaucgacgaggacuucaagcgcgagcugcggaaccuggugccccuccugcuggcccccgagaaccucgucgagaaggagaucagcggcagcaaggugaccugccgcgaccugguggaguacuucaaggcguacaucaagaucuaccagggggaggagcugccgcaccccaaguccaugcuccaggccaccgccgaggccaacaaccuggccgcggucgccggcgcccgggacacguacugcaagagcauggagcaggucugcgggggcgacaagcccuacaucgcccccuccgaccuggagcgcaagcaccucgaccugaaggagguggccaucaagcaguuccggagcgugaagaagaugggcggggacgaguucugccgccgcuaccaggaccagcuggaggcggagaucgaggagaccuacgccaacuucaucaagcacaacgacggcaagaacaucuucuacgccgcccggaccccggccacccucuucgcggugauguucgccauguacaucaucuccgggcugacgggcuucaucgggcugaacagcaucgccguccucugcaaccuggugaugggccuggcccugaucuuccucugcaccugggcguacgugaaguacuccggcgaguuccgcgagaucgggaccgucaucgaccagaucgccgagacccugugggagcagguccugaagccccucggcgacaaccugauggaggagaacauccggcagagcgugacgaacuccaucaaggccgggcugaccgaccaggugagccaccacgcccgccucaagaccgacuga

SEQ ID NO: 27013 - RNA, 1572 nt, Artificial Sequence
  derived and/or modified sequence opt1 from ATL3__Homo_sapiens__NP_001276977
auggagagcuccaagcccggcccggugcaggucgugcuggugcagaaggaccagcacagcuucgagcucgacgagaaggcccuggccuccauccugcuccaggaccacauccgcgaccuggacgucgugguggucagcguggcgggggccuuccggaagggcaaguccuucauccuggacuucaugcuccgcuaccuguacagccagaaggaguccgggcacagcaacuggcugggcgaccccgaggagccccucaccggguucuccuggcggggcggcagcgaccccgagaccacggggauccagaucugguccgagguguucaccgucgagaagccgggcgggaagaagguggccgugguccugauggacacccagggcgccuucgacagccaguccaccgugaaggacugcgccacgaucuucgcgcugagcaccaugaccuccagcgugcagaucuacaaccucucccagaacauccaggaggacgaccugcagcagcugcagcuguucaccgaguacgggcgccuggccauggacgagaucuuccagaagcccuuccagacgcugauguuccucguccgggacuggagcuuccccuacgaguacuccuacggccugcagggcgggauggccuuccuggacaagcgccuccaggugaaggagcaccagcacgaggagauccagaacgugcggaaccacauccacagcugcuucagcgacgugaccugcuuccugcugccccacccgggccuccaggucgccaccucccccgacuucgacgggaagcugaaggacaucgcgggcgaguucaaggagcagcugcaggcccucauccccuacgugcugaaccccagcaagcugauggagaaggagaucaacggcuccaaggugaccugccgcgggcuccuggaguacuucaaggccuacaucaagaucuaccagggcgaggaccugccgcaccccaagagcaugcuccaggccacggccgaggcgaacaaccuggccgccgccgccuccgcgaaggacaucuacuacaacaacauggaggaggucugcgggggcgagaagcccuaccugagccccgacauccucgaggagaagcacugcgaguucaagcagcuggcccuggaccacuucaagaagaccaagaagaugggcgggaaggacuucuccuuccgguaccagcaggagcucgaggaggagaucaaggagcuguacgagaacuucugcaagcacaacggcagcaagaacguguucuccaccuuccgcaccccggccguccuguucacggggaucguggcccucuacaucgccagcggccugaccggguucaucggccuggaggucguggcgcagcuguucaacugcaugguggggcuccugcucaucgcccugcugaccuggggcuacauccgguacuccggccaguaccgcgagcucgggggcgccaucgacuucggggccgccuacguccucgagcaggcgagcucccacaucggcaacagcacccaggccacggugcgggacgccguggucgggcgccccuccauggacaagaaggcccaguga

SEQ ID NO: 27014 - RNA, 9171 nt, Artificial Sequence
  derived and/or modified sequence opt1 from ATM__Homo_sapiens__XP_006718906
augagccuggugcucaacgaccugcugaucugcugccgccagcucgagcacgaccgggccaccgagcgcaagaaggaggucgagaaguucaagcggcugauccgcgaccccgagaccaucaagcaccuggaccggcacuccgacagcaagcagggcaaguaccucaacugggacgccguguuccgcuuccugcagaaguacauccagaaggagacggagugccugcggaucgcgaagccgaacguguccgccagcacccaggccucccgccagaagaagaugcaggagaucagcucccucgucaaguacuucaucaagugcgccaaccggcgcgccccccggcugaagugccaggagcugcucaacuacaucauggacaccgugaaggacagcuccaacggggcgaucuacggcgccgacugcagcaacauccugcugaaggacauccucuccgugcgcaaguacuggugcgagaucagccagcagcaguggcuggagcuguucuccgucuacuuccggcucuaccugaagcccagccaggacgugcaccgcgugcuggucgcccggaucauccacgccgugaccaaggggugcugcucccagacggacggccucaacagcaaguuccuggacuucuucuccaaggcgauccagugcgcccgccaggagaagagcuccagcgggcugaaccacauccucgccgcccugaccaucuuccugaagacccucgccgugaacuuccggauccgcgucugcgagcugggcgacgagauccugcccacccuccuguacaucuggacgcagcaccggcugaacgacagccucaaggaggugaucaucgagcuguuccagcugcagaucuacauccaccacccgaagggcgcgaagacccaggagaagggggccuacgaguccaccaaguggcgcagcauccucuacaaccuguacgaccugcucgugaacgagaucucccacaucggcagccgggggaaguacuccagcggcuuccgcaacaucgccgucaaggagaaccugaucgagcugauggccgacaucugccaccagguguucaacgaggacacccgcucccucgagaucagccaguccuacacgaccacccagcgggagagcuccgacuacagcgugcccugcaagcgcaagaagaucgagcuggggugggaggucaucaaggaccaccugcagaagucccagaacgacuucgaccucgugcccuggcugcagaucgccacccagcugaucagcaaguaccccgcgucccucccgaacugcgagcugagcccccugcugaugauccucucccagcugcugccccagcagcggcacggcgagcgcacgcccuacgugcuccggugccugaccgaggucgcccugugccaggacaagcgcagcaaccucgaguccagccagaagagcgaccugcugaagcucuggaacaagaucuggugcaucaccuuccggggcaucuccagcgagcagauccaggccgagaacuucgggcugcugggcgccaucauccaggggucccucguggagguggaccgcgaguucuggaagcuguucaccggcagcgccugccggccguccugccccgcggucugcugccugacgcucgcccugaccaccagcaucgugcccggcaccgucaagauggggaucgagcagaacaugugcgaggugaaccgcuccuucagccugaaggaguccaucaugaaguggcuccuguucuaccagcuggagggcgaccucgagaacagcacggaggugcccccgauccugcacuccaacuucccccaccugguccucgagaagauccuggugagccugaccaugaagaacugcaaggccgccaugaacuucuuccaguccgugcccgagugcgagcaccaccagaaggacaaggaggagcucagcuucuccgaggucgaggagcuguuccugcagaccaccuucgacaagauggacuuccucacgaucgugcgggagugcgggaucgagaagcaccagagcuccaucggcuucagcgugcaccagaaccugaaggagagccuggaccgcugccuccuggggcuguccgagcagcuccugaacaacuacagcuccgagaucaccaacagcgagacccugguccggugcucccgccuccuggugggcgugcugggcugcuacugcuacaugggggucaucgccgaggaggaggcguacaagagcgagcucuuccagaaggccaagucccugaugcagugcgccggcgagagcaucacccuguucaagaacaagacgaacgaggaguuccggaucgggucccuccgcaacaugaugcagcugugcacccggugccugagcaacugcaccaagaagucccccaacaagaucgccagcggcuucuuccuccgccugcugaccuccaagcucaugaacgacaucgcggacaucugcaagagccuggccuccuucaucaagaagccguucgaccggggggagguggagagcauggaggacgacacgaacggcaaccugauggagguggaggaccaguccagcaugaaccucuucaacgacuaccccgacuccagcgucagcgacgccaacgagcccggcgagucccagagcaccaucggggccaucaacccccuggccgaggaguaccuguccaagcaggaccuccuguuccuggacaugcucaaguuccugugccugugcgugaccaccgcgcagaccaacacggugagcuuccgcgccgccgacauccgccggaagcuccugaugcugaucgacuccagcacccucgagccgaccaagucccugcaccugcacauguaccucaugcugcugaaggagcuccccggcgaggaguacccccugcccauggaggacguccuggagcuccugaagccgcugagcaacgugugcucccucuaccgccgggaccaggacgugugcaagaccauccugaaccacguccugcacguggugaagaaccucgggcagagcaacauggacuccgagaacacgcgcgacgcccagggccaguuccugaccgucaucggggccuucuggcaccugaccaaggagcggaaguacaucuucagcgugcgcauggcgcucgugaacugccugaagacccugcucgaggccgaccccuacuccaagugggccauccugaacgucaugggcaaggacuuccccgugaacgagguguucacgcaguuccuggccgacaaccaccaccagguccggaugcucgccgcggagagcaucaaccgccuguuccaggacaccaagggcgacuccagccggcugcucaaggcccugccgcugaagcugcagcagaccgccuucgagaacgccuaccucaaggcgcaggaggggaugcgcgagaugucccacagcgccgagaaccccgagacccuggacgagaucuacaaccggaaguccgugcugcucacgcugaucgccgugguccugagcugcagccccaucugcgagaagcaggcccucuucgcccugugcaaguccgugaaggagaacggccuggagccccaccucgugaagaagguccuggagaaggugagcgagaccuucggguaccgccggcuggaggacuucauggcgucccaccucgacuaccuggugcuggaguggcucaaccugcaggacaccgaguacaaccugagcuccuucccguucauccuccugaacuacaccaacaucgaggacuucuaccgcagcugcuacaagguccugaucccccaccucgugauccggucccacuucgacgaggugaagagcaucgccaaccagauccaggaggacuggaagucccugcugacggacugcuuccccaagauccucgucaacauccugcccuacuucgccuacgagggcacccgcgacagcggcauggcccagcagcgggagaccgccaccaagguguacgacaugcugaaguccgagaaccuccuggggaagcagaucgaccaccuguucaucagcaaccucccggagaucguggucgagcugcugaugacgcuccacgagcccgcgaacuccagcgccucccagagcaccgaccugugcgacuucuccggcgaccuggaccccgcccccaacccgccccacuuccccagccacgugaucaaggccaccuucgccuacaucuccaacugccacaagaccaagcucaagagcauccuggagauccugagcaagucccccgacagcuaccagaagauccuccuggcgaucugcgagcaggccgccgagacgaacaacguguacaagaagcaccgcauccugaagaucuaccaccucuucgucucccugcugcucaaggacaucaagagcgggcugggcggggccugggcguucgugcugcgggacgugaucuacacccucauccacuacaucaaccagcgcccguccugcaucauggacgucagccugcgguccuucagccugugcugcgaccuccugucccaggugugccagaccgccgucaccuacugcaaggacgcccuggagaaccaccuccacgugaucgugggcacgcugaucccccuggucuacgagcagguggaggugcagaagcagguccucgaccugcugaaguaccucgugaucgacaacaaggacaacgagaaccuguacaucaccaucaagcugcucgaccccuuccccgaccacguggucuucaaggaccugcgcaucacccagcagaagaucaaguacagccgcggcccguucucccugcucgaggagaucaaccacuuccugagcguguccguguacgacgcccugccccucacccggcuggaggggcugaaggaccuccgccggcagcuggagcugcacaaggaccagauggucgacaucaugcgcgccagccaggacaacccccaggacggcaucauggugaagcucguggucaaccugcugcagcucuccaagauggcgaucaaccacacgggggagaaggaggugcuggaggccgugggcagcugccugggggaggucggccccaucgacuucuccaccaucgccauccagcacagcaaggacgccuccuacaccaaggcccucaagcuguucgaggacaaggagcugcaguggaccuucaucaugcucacguaccugaacaacacccugguggaggacugcgugaagguccggagcgcggccgugaccugccucaagaacauccuggccaccaagaccggccacagcuucugggagaucuacaagaugacgaccgacccgaugcuggccuaccuccagcccuuccgcaccucccggaagaaguuccuggaggugccccgcuucgacaaggagaacccguucgaggggcuggacgacaucaaccucuggaucccccugagcgagaaccacgacaucuggaucaagacccugacgugcgccuuccucgacuccggcgggaccaagugcgagauccugcagcugcucaagcccaugugcgaggucaagaccgacuucugccagaccgugcugcccuaccugauccacgacauccugcuccaggacacgaacgagagcuggcggaaccugcuguccacccacgugcagggcuucuucaccagcugccuccgccacuucucccagaccagccgguccacgaccccggcgaaccuggacagcgaguccgagcacuucuuccgcugcugccuggacaagaagagccagcggaccaugcucgccgucguggacuacaugcgccggcagaagcgccccuccagcgggaccaucuucaacgacgccuucuggcuggaccugaacuaccucgagguggccaaggucgcccaguccugcgcggcccacuucacggcccugcuguacgccgagaucuacgcggacaagaagagcauggacgaccaggagaagcggucccucgccuucgaggagggcagccaguccaccaccaucagcagccuguccgagaagagcaaggaggagaccggcaucucccugcaggaccuccugcuggagaucuaccgcagcaucggggagcccgacucccucuacggcugcgggggcgggaagaugcugcagcccaucacgcggcugcgcaccuacgagcacgaggccauguggggcaaggcccucgugaccuacgaccuggagaccgccaucccgagcuccacgcgccaggcgggcaucauccaggcccugcagaaccucgggcugugccacauccugagcguguaccucaagggccuggacuacgagaacaaggacuggugccccgagcuggaggagcuccacuaccaggccgccuggcggaacaugcagugggaccacugcaccuccgucagcaaggagguggaggggaccuccuaccacgagagccuguacaacgcccugcagucccuccgcgaccgggaguucagcaccuucuacgagucccugaaguacgcgcgcgugaaggaggucgaggagaugugcaagcggagccuggaguccguguacagccucuaccccacgcugagccgccugcaggccaucggcgagcucgaguccaucggcgagcuguucagccgguccgugacccaccgccagcugagcgaggucuacaucaaguggcagaagcacucccagcuccugaaggacagcgacuucuccuuccaggagcccaucauggcccugcggaccgugauccucgagauccugauggagaaggagauggacaacagccagcgcgagugcaucaaggacauccugaccaagcaccucguggagcuguccauccuggcccggacguucaagaacacccagcucccggagcgcgccaucuuccagaucaagcaguacaacagcgucuccugcggggugagcgaguggcagcuggaggaggcgcagguguucugggccaagaaggagcagucccuggcccucagcauccugaagcagaugaucaagaagcuggacgccuccugcgcggccaacaaccccagccucaagcugaccuacaccgagugccugcgggucugcggcaacuggcucgccgagacgugccuggagaaccccgccgugaucaugcagaccuaccuggagaaggccguggaggucgcggggaacuacgacggcgaguccagcgacgagcuccgcaacgggaagaugaaggccuuccugucccuggcccgguucagcgacacccaguaccagcgcaucgagaacuacaugaagagcuccgaguucgagaacaagcaggcccuccugaagcgggccaaggaggaggugggccugcuccgcgagcacaagauccagaccaaccgguacaccgugaagguccagcgcgagcuggagcuggacgagcucgcgcugcgggcccugaaggaggaccgcaagcgcuuccucugcaaggccguggagaacuacaucaacugccugcugagcggcgaggagcacgacaugugggucuuccggcucugcucccuguggcuggagaacagcgggguguccgaggugaacggcaugaugaagcgcgacgggaugaagauccccacguacaaguuccucccgcugauguaccagcuggccgcccggaugggcaccaagaugauggggggccucggcuuccacgagguccugaacaaccugaucagccgcaucuccauggaccacccccaccacacccucuucaucauccuggcgcuggccaacgccaaccgggacgaguuccucaccaagcccgagguggcccgccggagccgcaucacgaagaacgugcccaagcaguccagccagcuggacgaggaccggaccgaggcggccaaccgcaucaucugcaccauccggucccgccggccgcagaugguccgcagcguggaggcccugugcgacgccuacaucauccucgccaaccuggacgcgacccaguggaagacgcagcggaaggggaucaacauccccgccgaccagcccaucaccaagcugaagaaccucgaggacguggucgugcccaccauggagaucaagguggaccacaccggcgaguacgggaaccuggucacgauccaguccuucaaggccgaguuccgccuggccggcggggugaaccugccgaagaucaucgacugcgugggcagcgacggcaaggagcggcgccagcucgucaaggggcgggacgaccugcgccaggacgccgugaugcagcagguguuccagaugugcaacacccugcuccagcgcaacaccgagacccggaagcgcaagcugacgaucugcaccuacaaggucgugccccugucccagcggagcggcgugcucgaguggugcaccgggaccguccccaucggcgaguuccuggugaacaacgaggacggcgcgcacaagcgcuaccggcccaacgacuucuccgccuuccagugccagaagaagaugauggaggugcagaagaagagcuucgaggagaaguacgaggucuucauggacgugugccagaacuuccagccgguguuccgcuacuucugcauggagaaguuccuggaccccgccaucugguucgagaagcggcucgccuacacgcgcuccgucgccaccagcagcaucgugggguacauccugggccugggggaccggcacgugcagaacauccucaucaacgagcaguccgcggagcugguccacaucgaccugggcguggccuucgagcaggggaagauccuccccaccccggagaccgugcccuuccgccugacgcgggacaucgucgacggcaugggcaucaccgggguggagggcguguuccgccggugcugcgagaagaccauggaggucaugcgcaacagccaggagacccugcucacgaucguggaggugcugcuguacgacccccucuucgacuggaccaugaacccccugaaggcccuguaccuccagcagcggccggaggacgagaccgagcugcaccccacccugaacgccgacgaccaggagugcaagcgcaaccucuccgacaucgaccagagcuucaacaaggucgccgagcgggugcugaugcgccugcaggagaagcucaaggggguggaggagggcacgguccuguccguggggggccaggugaaccugcucauccagcaggcgaucgaccccaagaaccugagccggcuguuccccggcuggaaggccugggucuga

SEQ ID NO: 27015 - RNA, 3573 nt, Artificial Sequence
  derived and/or modified sequence opt1 from ATN1__Homo_sapiens__NP_001007027
augaagacccgccagaacaaggacagcauguccaugcggagcggccgcaagaaggaggcccccgggccgcgggaggagcugcgcucccggggccgcgccagccccgggggcguguccaccagcuccagcgacgggaaggcggagaagucccggcagacggccaagaaggcccgcgucgaggaggccagcacccccaaggugaacaagcagggccgguccgaggagaucagcgaguccgagagcgaggagaccaacgcccccaagaagaccaagacggagcaggagcucccgcgcccccagucccccagcgaccuggacucccuggacggccggagccucaacgacgacggguccagcgacccccgcgacaucgaccaggacaaccggagcaccuccccgagcaucuacucccccggcagcguggagaacgacuccgacagcuccagcgggcugucccagggccccgcgcgccccuaccacccgcccccccuguuccccccgagcccccagccccccgacuccaccccgcggcagcccgaggccagcuucgagccccaccccuccgucaccccgacgggguaccacgcccccauggagccccccaccagccgcauguuccaggccccgcccggcgcgcccccgccccacccccagcucuaccccggcgggaccggcggggugcuguccggcccgcccaugggccccaaggggggcggggccgccagcuccgugggcgggcccaacggcggcaagcagcacccgccccccaccacgcccaucagcgucuccagcagcggggccuccggcgccccgcccaccaagccccccaccaccccgguggggggcgggaaccugcccagcgcgccccccccggccaacuucccccacgugacgcccaaccuccccccgccccccgcccugcggccgcugaacaacgccuccgccagcccccccggccucggcgcgcagccccugccggggcaccugcccuccccccacgccaugggccaggggaugggcgggcuccccccgggccccgagaagggccccacccuggcccccagcccgcacucccugccccccgccagcuccagcgcccccgcgccgcccaugcgcuuccccuacuccagcuccagcuccagcuccgccgccgccagcagcuccagcuccagcuccagcuccagcgccucccccuucccggcgagccaggcccuccccuccuacccccacagcuuccccccgcccaccucccugagcgucuccaaccagccccccaaguacacccagccgagccugcccucccaggccguguggagccaggggcccccgcccccccccccguacggccggcuccuggccaacuccaacgcgcaccccgggcccuuccccccgagcacgggcgcccagagcaccgcccacccccccguguccacccaccaccaccaccaccagcagcagcagcagcagcagcagcagcagcagcagcagcagcagcagcagcagcagcaccacggcaacagcgggcccccgccccccggcgccuucccccacccgcuggaggggggcuccagccaccacgcccaccccuacgcgaugucccccagccucgggucccugcgccccuacccgcccggccccgcccaccugcccccgccccacagccaggucuccuacagccaggccggccccaacgggcccccgguguccagcuccagcaacuccagcuccagcaccucccagggcagcuaccccugcagccaccccuccccgagccaggggccccagggcgcccccuaccccuucccgcccgugcccacggucaccaccuccagcgccacccucuccacggugaucgcgaccguggccagcucccccgccggguacaagaccgccagcccgcccggcccccccccguacggcaagcgggcccccucccccggggcguacaagaccgccacgcccccgggcuacaagcccgggagcccccccuccuuccgcaccggcaccccgcccggguaccgcggcaccagcccccccgccggcccggggacguucaagcccggcucccccaccgucgggccgggcccccugccccccgccgggccgagcggccugcccucccucccccccccgcccgcggcccccgccagcggccccccgcuguccgccacccagaucaagcaggagcccgccgaggaguacgagacccccgagagccccgugccgcccgcgcggucccccagccccccgcccaagguggucgacgugcccagccacgccucccagagcgcccgcuucaacaagcaccuggaccggggguucaacuccugcgcccgcagcgaccucuacuucgugccccuggagggcuccaagcuggccaagaagcgggcggaccucgucgagaaggugcgccgggaggccgagcagcgcgcccgggaggagaaggagcgcgagcgggagcgcgagcgggagaaggagcgcgagcgggagaaggagcgcgagcuggagcggagcgucaagcuggcccaggaggggcgcgccccgguggagugccccucccucggccccgugccccaccggccgcccuucgagcccggcagcgcggucgccaccgugccgcccuaccuggggcccgacacgcccgcccugcgcacccucuccgaguacgcccgcccgcacgugaugagccccggcaaccggaaccaccccuucuacgucccccugggggcgguggacccgggccugcucggguacaacgugcccgcccuguacuccagcgaccccgccgcccgcgagcgggagcgcgaggcccgggagcgcgaccugcgggaccgccucaagcccggcuucgaggucaagccguccgagcuggagccccugcacggcgugcccgggcccggccuggacccguucccccggcacgggggccucgcgcugcagcccgggcccccgggccugcaccccuuccccuuccaccccagccucggcccgcuggagcgcgagcggcuggcccucgccgccgggcccgcccugcgccccgacauguccuacgcggagcggcuggccgccgagcgccagcacgccgagcggguggccgcgcucggcaacgacccccuggcccgccugcagaugcucaacgucaccccgcaccaccaccagcacagccacauccacucccaccugcaccugcaccagcaggacgccauccacgccgccagcgcguccgugcacccccucaucgacccccuggccagcgggagccaccugacccggaucccguaccccgccggcacgcuccccaacccccugcugccgcacccccuccacgagaacgaggugcugcgccaccagcuguucgccgcgcccuaccgggaccuccccgccucccugagcgccccgauguccgccgcccaccagcugcaggcgaugcacgcccagagcgccgagcuccagcgccuggcccuggagcagcagcaguggcuccacgcccaccacccccugcacuccgucccccugcccgcgcaggaggacuacuacagccaccucaagaaggaguccgacaagccgcuguga

SEQ ID NO: 27016 - RNA, 1065 nt, Artificial Sequence
  derived and/or modified sequence opt1 from ATOH1__Homo_sapiens__NP_005163
augagccgccugcuccacgccgaggagugggccgaggugaaggagcugggcgaccaccaccggcagccccagccgcaccaccugccccagccccccccgcccccccagcccccggcgacccuccaggcccgcgagcaccccgucuacccccccgagcugucccugcucgacagcaccgacccgcgggccuggcuggcccccacgcugcaggggaucugcaccgcccgcgcggcccaguaccuccugcacucccccgagcugggcgccagcgaggccgcggccccccgggacgagguggacgggcgcggcgagcucgugcggcgcuccagcgggggcgccuccagcuccaagagcccgggccccgucaaggugcgggagcagcugugcaagcugaaggggggcguggucguggacgagcucgggugcucccgccagcgggcccccagcuccaagcaggugaacggcguccagaagcagcgccggcuggccgcgaacgcccgcgagcggcgccggaugcacgggcugaaccacgccuucgaccagcuccgcaacgugauccccagcuucaacaacgacaagaagcuguccaaguacgagacccugcagauggcccagaucuacaucaacgcccucagcgagcugcugcagaccccguccggcggcgagcagcccccccccccgcccgcgagcugcaaguccgaccaccaccaccuccggacggccgccagcuacgaggggggcgccgggaacgccaccgcggccggcgcccagcaggccagcggcgggucccagcgccccacccccccgggcagcugccggacccgcuucuccgcccccgcgagcgccgggggcuacuccgugcagcuggacgcccugcacuucagcacguucgaggacuccgcccucaccgcgaugauggcccagaagaaccugagccccucccugccggggagcauccuccagcccguccaggaggagaacuccaagaccagcccccgcucccaccggagcgacggcgaguucuccccccacagccacuacuccgacagcgacgaggccuccuga

SEQ ID NO: 27017 - RNA, 459 nt, Artificial Sequence
  derived and/or modified sequence opt1 from ATOH7__Homo_sapiens__NP_660161
augaaguccugcaagcccagcggcccgcccgccggggcccgcguggcgccgcccugcgccggcgggaccgagugcgccgggaccugcgccggcgccggccggcuggagagcgcggcccgccggcgccucgccgccaacgcgcgggagcgccggcgcaugcagggccugaacacggccuucgaccggcugcgccgggucgugccccagugggggcaggacaagaagcucuccaaguacgagacccugcagauggcccugagcuacaucauggcccucacccgcauccuggccgaggcggagcgguucggcuccgagcgcgacuggguggggcugcacugcgagcacuucggccgggaccacuaccuccccuuccccggggccaagcugcccggcgagagcgagcuguacucccagcgccucuucggcuuccagccggagcccuuccagauggccaccuga

SEQ ID NO: 27018 - RNA, 207 nt, Artificial Sequence
  derived and/or modified sequence opt1 from ATOX1__Homo_sapiens__NP_004036
augcccaagcacgaguucagcguggacaugaccugcggcgggugcgccgaggccgucucccgcgugcugaacaagcucggcggggugaaguacgacaucgaccugccgaacaagaaggucugcaucgagagcgagcacuccauggacacccugcucgcgacgcugaagaagaccggcaagaccgugagcuaccuggggcucgaguga

SEQ ID NO: 27019 - RNA, 4500 nt, Artificial Sequence
  derived and/or modified sequence opt1 from ATP10A__Homo_sapiens__NP_077816
auggagcgcgagcccgccggcaccgaggagccggggccgcccggccggcgccggcgccgggaggggcgcacccggacggugcgcagcaaccugcucccgccgcccggcgccgaggaccccgcggccggggccgccaagggcgagcggcgccggcgccggggcugcgcccagcaccuggcggacaaccgccugaagaccaccaaguacacccuccuguccuuccugcccaagaaccucuucgagcaguuccaccggcccgccaacgucuacuucguguucaucgcccugcugaacuucgugcccgccgucaacgcguuccagcccgggcucgcccuggcccccgugcuguucauccucgccaucacggccuuccgcgaccugugggaggacuacagccggcaccgcuccgaccacaagaucaaccaccugggcugccucguguucagccgggaggagaagaaguacgucaaccgcuucuggaaggagauccacgugggggacuucgugcggcugcgcugcaacgagaucuuccccgcggacauccugcuccuguccagcuccgaccccgacggccugugccacaucgagaccgccaaccucgacggggagaccaaccugaagcgccggcaggucgugcgcggcuucagcgagcugguguccgaguucaacccccucaccuucacgagcgucaucgagugcgagaagcccaacaacgaccugucccgguuccgcggcugcaucauccacgacaacgggaagaaggccggccuguacaaggagaaccuccugcugcgggggugcacccuccgcaacaccgacgccguggugggcaucgucaucuacgccggccacgagaccaaggcgcugcugaacaacagcgggccgcgguacaagcgcuccaagcucgagcggcagaugaacugcgacgugcuguggugcgugcugcuccuggucugcaugagccuguucuccgccgugggccacgggcucuggaucuggcgcuaccaggagaagaagucccuguucuacgugcccaaguccgacggcagcucccugagccccgucacggccgccguguacagcuuccucaccaugaucaucgugcugcagguccugauccccaucucccucuacgugagcaucgagaucgucaaggccugccagguguacuucaucaaccaggacaugcagcuguacgacgaggagaccgacucccagcugcagugccgggcgcucaacaucaccgaggaccuggggcagauccaguacaucuucagcgacaagacgggcacccugaccgagaacaagaugguguuccgccggugcaccgucuccggcguggaguacagccacgacgccaacgcccagcgccuggcccgguaccaggaggccgacuccgaggaggaggagguggucccgcgcgggggcagcgugucccagcgggggagcaucggcucccaccagagcgugcgcgucgugcaccggacgcaguccaccaagagccaccgccgcaccgggucccgggcggaggccaagcgcgccagcaugcucuccaagcacaccgccuucagcucccccauggagaaggacaucacgcccgaccccaagcugcuggagaaggugagcgagugcgacaagagccucgcggucgcccggcaccaggagcaccuccuggcccaccuguccccggagcugagcgacguguucgacuucuucaucgcccugaccaucugcaacaccguggucgugaccucccccgaccagccccgcacgaaggugcggguccgcuucgagcucaagagccccgugaagaccaucgaggacuuccugcggcgcuucaccccguccugccugaccagcggcugcuccagcaucggcucccucgccgcgaacaagagcucccacaagcuggggagcuccuuccccagcacgcccuccagcgacggcaugcugcuccggcuggaggagcgccuggggcagccgaccuccgccaucgccagcaacggcuacagcucccaggccgacaacugggccagcgagcucgcgcaggagcaggaguccgagcgggagcugcgcuacgaggccgagagccccgacgaggccgcccugguguacgccgcgcgggccuacaacugcguccucguggagcgccugcacgaccagguguccgucgagcugccccaccucgggcggcugaccuucgagcugcuccacacccugggcuucgacagcgugcgcaagcggauguccguggucauccgccacccccugacggacgagaucaacguguacaccaagggcgccgacagcguggucauggaccuccugcagccgugcuccagcguggacgcccgggggcgccaccagaagaagauccgguccaagacccagaacuaccugaacguguacgcggccgagggccuccgcacccugugcaucgccaagcgcguccugagcaaggaggaguacgccugcuggcuccagucccaccuggaggccgagagcucccuggagaacagcgaggagcuccuguuccaguccgcgauccggcuggagaccaaccuccaccuccugggggccacgggcaucgaggaccgccugcaggacggcgugcccgagaccaucagcaagcugcggcaggccgggcugcagaucugggugcucaccggcgacaagcaggagaccgccgucaacaucgccuacgcgugcaagcugcuggaccacgacgaggaggugaucacgcucaacgccaccucccaggaggccugcgccgcccugcuggaccagugccucugcuacgugcagagccgcgggcugcagcgggcgcccgagaagaccaagggcaaggucagcaugcgcuucuccagccugugcccgcccuccaccagcacggccuccgggcggcgccccagccucgugaucgacggccggucccuggccuacgcccuggagaagaaccucgaggacaaguuccuguuccuggcgaagcagugccgcagcgugcucugcugccgguccacgccccugcagaaguccauggucgugaagcuggugcgcagcaagcucaaggccaugacccuggccaucggcgacggggccaacgacgucagcaugauccagguggccgacgugggcgucgggaucuccggccaggaggggaugcaggcggugauggccagcgacuucgccgugcccaaguuccgguaccuggagcgccuccugauccugcacggccacuggugcuacucccggcucgccaacaugguccuguacuucuucuacaagaacaccauguucgugggccuccuguucugguuccaguucuucugcggguucagcgccuccaccaugaucgaccagugguaccugaucuucuucaaccuccuguucagcucccugccgccccuggucaccggcgugcucgaccgcgacgugcccgcgaacguccugcugaccaacccccagcucuacaagagcgggcagaacauggaggaguaccggccgcgcaccuucugguucaacauggccgacgccgccuuccagagccuggugugcuucuccauccccuaccuggccuacuacgacagcaacguggaccucuucacguggggcacccccaucgucaccaucgcgcugcugaccuuccuccugcaccuggggaucgagacgaagaccuggaccuggcucaacuggaucacgugcggcuucuccgugcugcuguucuucaccguggcccugaucuacaacgccagcugcgcgaccugcuacccgcccuccaaccccuacuggaccaugcaggcccuccugggcgaccccgucuucuaccugaccugccucaugacgcccguggccgcccugcugccgcgccucuucuuccggagccugcaggggcgcguguuccccacccagcugcagcucgcccggcagcugacccgcaagagcccccggcgcugcagcgccccgaaggagaccuucgcgcagggccggcugcccaaggacuccgggacggagcacagcuccggccgcaccgucaagaccagcgugccccucucccagcccagcuggcacacccagcagccggugugcucccuggaggccagcggggagcccuccacggucgacaugagcaugcccgugcgggagcacacccugcucgagggccuguccgcccccgccccgaugagcagcgcccccggcgaggcggugcugcgcucccccgggggcugccccgaggagagcaagguccgggccgccuccaccgggcgcgugaccccgcucagcucccuguucagccugcccaccuucucccuccugaacuggaucagcuccuggagccuggugucccggcucggcagcguccugcaguucucccgcacggagcagcuggccgacggccaggccgggcggggccuccccgugcagccccacagcgggcgcuccggccugcaggggccggaccaccggcugcucaucggcgcgagcucccgccggagccaguga

SEQ ID NO: 27020 - RNA, 4386 nt, Artificial Sequence
  derived and/or modified sequence opt1 from ATP10B__Homo_sapiens__NP_079429
auggcccugagcguggacuccagcuggcaccgcuggcaguggcggguccgcgacggcuucccccacugcccguccgagaccaccccccuccugagccccgagaaggggcggcaguccuacaaccugacgcagcagcgcgugguguuccccaacaacagcaucuuccaccaggacugggaggaggucucccggcgcuacccgggcaaccggaccugcaccaccaaguacacgcucuucaccuuccugccccgcaaccuguucgagcaguuccaccggugggccaaccucuacuuccuguuccuggugauccucaacuggaugcccagcauggagguguuccaccgcgagaucaccaugcugccccuggcgaucguccucuucgugaucaugaucaaggacgggauggaggacuucaagcggcaccgcuucgacaaggccaucaacugcuccaacauccggaucuacgagcgcaaggagcagaccuacgugcagaagugcuggaaggacguccgggugggcgacuucauccagaugaagugcaacgagaucgugccggccgacauccugcugcucuucagcuccgaccccaacgggaucugccaccuggagacggccagccuggacggcgagaccaaccucaagcagcgcugcgucgugaagggcuucucccagcaggaggugcaguucgagcccgagcuguuccacaacaccaucgucugcgagaagcccaacaaccaccugaacaaguucaagggguacauggagcacccggaccagacccggacgggcuucgggugcgagagccuccugcugcgcggcugcaccauccggaacaccgagauggccguggggaucgugaucuacgcgggccacgagaccaaggccaugcucaacaacuccggcccccgcuacaagcggagcaagaucgagcgccgcaugaacaucgacaucuucuucugcaucgggauccugauccugaugugccucaucggcgccgucgggcacuccaucuggaacggcacguucgaggagcacccccccuucgacgugccggacgccaacggcagcuuccugcccuccgcgcuggggggcuucuacauguuccucaccaugaucauccugcugcaggugcucauccccaucagccuguacgucagcaucgagcuggugaagcucgggcagguguucuuccuguccaacgaccuggaccucuacgacgaggagaccgaccugagcauccagugccgggcccugaacaucgccgaggaccucggccagauccaguacaucuucuccgacaagaccgggacgcugaccgagaacaagauggucuuccgccggugcaccaucaugggcagcgaguacucccaccaggagaacgccaagcgccuggagacccccaaggagcucgacagcgacggcgaggaguggacgcaguaccagugccuguccuucagcgcccggugggcgcaggacccggccaccaugcgcucccagaagggggcccagccccugcggcgcagccaguccgcccgggugcccauccagggccacuaccgccagcggagcauggggcaccgcgaguccagccagcccccggucgccuucuccagcuccaucgagaaggacgugacccccgacaagaaccuccugaccaaggugcgggacgcggcccuguggcuggagacgcucagcgacucccgccccgccaaggccagccugagcaccaccuccagcaucgccgacuucuuccuggcgcucaccaucugcaacuccgucauggugagcacgaccaccgagccccggcagcgcgugaccaucaagccguccagcaaggcccugggcacgucccuggagaagauccagcagcucuuccagaagcugaagcugcucagccugucccagagcuucuccagcaccgcccccuccgacaccgaccugggggagagccucggcgccaacgucgccaccaccgacuccgacgagcgggacgacgcgagcgugugcuccggcggggacagcacggacgacggcggguaccgcagcuccaugugggaccagggcgacauccuggagagcggguccggcaccagccuggaggaggcccucgaggcccccgccaccgaccuggcgcggccggaguucugcuacgaggccgagucccccgacgaggccgcccuggugcacgccgcgcacgccuacagcuucacccucgucucccgcacgcccgagcaggugaccgugcgccugccccagggcaccugccugaccuucagccuccugugcacgcugggguucgacuccguccggaagcgcaugagcguggugguccggcacccgcucaccggcgagaucgugguguacaccaagggggccgacuccgucaucauggaccugcuggaggaccccgccugcgugcccgacaucaacauggagaagaagcuccgcaagauccgggcccgcacccagaagcaccuggaccuguacgcgcgggacggccuccgcacgcugugcaucgccaagaagguggucagcgaggaggacuuccggcgcugggccuccuuccggcgcgaggccgaggccagccuggacaaccgggacgagcuccugauggagaccgcgcagcaccuggagaaccagcucacccugcugggcgccaccgggaucgaggaccgccuccaggagggcgugcccgacacgaucgccacccugcgggaggccgggauccagcugugggugcucaccggcgacaagcaggagaccgcggucaacaucgcccacuccugccgccugcugaaccagacggacaccguguacaccaucaacaccgagaaccaggagacgugcgagagcauccucaacugcgcccuggaggagcugaagcaguuccgggagcuccagaagccggaccgcaagcuguucggguuccggcugcccuccaagacccccagcaucaccuccgaggccgugguccccgaggccggccucgugaucgacggcaagacccugaacgcgaucuuccaggggaagcuggagaagaaguuccucgagcugacgcaguacugccgcagcgugcugugcugccggagcaccccgcuccagaaguccaugaucgucaagcuggugcgcgacaagcugcgcgugaugacccucagcaucggcgacggggccaacgacgucuccaugauccaggccgccgacaucggcaucgggaucagcggccaggagggcaugcaggccgugauguccagcgacuucgcgaucacccgguucaagcaccugaagaagcugcuccuggugcacgggcacuggugcuacucccgccuggcccggauggucguguacuaccucuacaagaacgugugcuacgucaaccugcuguucugguaccaguucuucugcggcuucagcuccagcacgaugaucgacuacuggcagaugaucuucuucaaccucuucuucaccucccugcccccccugguguucggggugcucgacaaggacaucagcgccgagacccugcuggcccuccccgagcuguacaaguccggccagaacagcgagugcuacaaccuguccaccuucuggaucagcauggucgacgccuucuaccagucccucaucugcuucuucaucccguaccuggcguacaaggggagcgacaucgacguguucacguucggcacccccaucaacaccaucucccugaccaccauccuccugcaccaggccauggagaugaagacguggaccaucuuccacggcgugguccugcucgggagcuuccugauguacuuccuggugagccuccuguacaacgccaccugcgugaucugcaacucccccaccaaccccuacugggucauggagggccagcugagcaacccgacguucuaccucgugugcuuccugacccccguggucgcccugcucccccgcuacuucuuccugucccugcaggggaccugcggcaagagccugaucuccaaggcgcagaagaucgacaagcuccccccggacaagcggaaccuggagauccagagcuggcgcucccggcagcgccccgcccccgugccggaggucgcccggcccacccaccaccccgugagcuccaucacggggcaggacuucagcgccuccacccccaagagcuccaacccgcccaagcgcaagcacguggaggagagcguccugcacgagcagcggugcggcaccgagugcaugcgcgacgacuccugcagcggcgacuccagcgcccagcucuccagcggggagcaccugcugggccccaaccggaucauggcguacagccgcgggcagaccgacaugugccggugcuccaagcgcagcucccaccggcgcagccaguccagccucacgaucuga

SEQ ID NO: 27021 - RNA, 4281 nt, Artificial Sequence
  derived and/or modified sequence opt1 from ATP10D__Homo_sapiens__NP_065186
augaccgaggcccugcagugggcccgcuaccacuggcggcgccucauccggggcgcgacccgcgacgacgacagcgggcccuacaacuacuccagccugcuggccugcggccggaaguccagccagacgccgaagcucuccgggcgccaccggaucguggucccccacauccagcccuucaaggacgaguacgagaaguucagcggcgccuacgugaacaaccgcauccggaccaccaaguacacccugcugaacuucgugccccgcaaccucuucgagcaguuccaccgggccgccaaccuguacuuccuguuccucgucgugcugaacugggugccgcuggucgaggcguuccagaaggagaucacgaugcucccccugguggugguccugaccaucaucgccaucaaggacgggcucgaggacuaccgcaaguacaagaucgacaagcagaucaacaaccugaucaccaagguguacucccggaaggagaagaaguacaucgaccgcugcuggaaggacgugaccgucggcgacuucauccggcugagcugcaacgaggugauccccgccgacauggugcuccuguucuccacggaccccgacggcaucugccacaucgagaccagcgggcuggacggcgaguccaaccucaagcagcgccaggucgugcggggguacgccgagcaggacagcgagguggacccggagaaguucuccagccgcaucgagugcgagucccccaacaacgaccugagccgguuccgcggcuuccuggagcacuccaacaaggagcgggucgggcucagcaaggagaaccugcugcuccgcggcugcaccauccgcaacaccgaggcgguggugggcaucgucguguacgccgggcacgagacgaaggccaugcugaacaacuccggcccccgguacaagcgcagcaagcuggagcggcgcgccaacaccgacgugcucuggugcgucaugcugcuggugaucaugugccucaccggggccgucggccacggcaucuggcugagccgguacgagaagaugcacuucuucaacgugcccgagccggacgggcacaucaucagcccccugcucgcgggcuucuacauguucuggaccaugaucauccugcuccaggugcucauccccaucagccuguacgucuccaucgagaucgugaagcuggggcagaucuacuucauccagagcgacguggacuucuacaacgagaagauggacuccaucguccagugccgcgcccucaacaucgccgaggaccugggccagauccaguaccuguucagcgacaagacggggacccucaccgagaacaagaugguguuccggcgcugcuccguggccggcuucgacuacugccacgaggagaacgcccggcgccuggagagcuaccaggaggcggucuccgaggacgaggacuucaucgacaccgugagcggcucccugagcaacauggccaagccccgggccccguccugccgcacggugcacaacgggccccucggcaacaagcccagcaaccaccuggccggguccagcuucacccugggcuccggggagggcgccagcgaggucccccacucccggcaggcggccuucagcagcccgaucgagaccgacguggugcccgacacccgccugcucgacaaguucucccagaucacgccccggcuguucaugccccuggacgagaccauccagaacccgcccauggagacccucuacaucaucgacuucuucaucgcccuggccaucugcaacaccgucguggugagcgcccccaaccagccccgccagaagauccggcacccgucccugggcgggcuccccaucaagagccuggaggagaucaagucccuguuccagcgcuggagcguccggcgcuccagcucccccagccucaacuccggcaaggagccgagcuccggggugcccaacgcguucgugagccgccugccccuguucucccggaugaagcccgccagcccggucgaggaggaggugucccaggugugcgagagcccccagugcagcuccagcuccgccugcugcacggagaccgagaagcagcacggcgacgccgggcuccugaacggcaaggcggagagccugcccggccagccccucgccugcaaccugugcuacgaggccgaguccccggacgaggccgcccuggucuacgcggcccgcgccuaccagugcacccuccggagccgcacccccgagcaggucaugguggacuucgccgcccuggggccccugacguuccagcuccugcacauccugcccuucgacuccgugcggaagcgcaugagcguggugguccggcacccgcucuccaaccaggugguggucuacaccaagggcgcggacagcgugaucauggagcugcuguccguggccagccccgacggggccucccucgagaagcagcagaugaucguccgcgagaagacccagaagcaccuggacgacuacgccaagcagggccugcggacccucugcaucgccaagaaggugaugagcgacacggaguacgcggaguggcugcgcaaccacuuccuggccgagaccuccaucgacaaccgggaggagcuccugcuggagagcgccaugcgccucgagaacaagcugacccugcucggcgccaccgggaucgaggaccggcugcaggagggcgugcccgaguccaucgaggcgcugcacaaggccgggaucaagaucuggaugcucaccggcgacaagcaggagacggccgucaacaucgccuacgccugcaagcugcuggagcccgacgacaagcuguucauccugaacacccagagcaaggacgcgugcgggaugcugauguccaccauccucaaggagcugcagaagaagacccaggcccugccggagcaggucagccucagcgaggaccugcugcagccgcccgugccccgcgacuccggccuccgggccggccugaucaucacggggaagacccuggaguucgcccuccaggagagccugcagaagcaguuccuggagcucaccuccuggugccaggccguggugugcugccgcgcgacgccccugcagaaguccgagguggucaagcuggugcggucccaccuccaggugaugacccuggccaucggcgacggggccaacgacgucagcaugauccagguggccgacaucggcaucgggguguccggccaggagggcaugcaggccgucauggcgagcgacuucgccgugucccaguucaagcaccugagcaagcuccugcugguccacgggcacuggugcuacacccgccucuccaacaugauccuguacuucuucuacaagaacguggccuacgugaaccuccuguucugguaccaguucuucugcggcuucagcgggaccuccaugaccgacuacuggguccugaucuucuucaaccuccuguucacgagcgccccgcccgugaucuacggcgugcuggagaaggacgucuccgcggagacccugaugcagcuccccgagcuguaccggagcgggcagaaguccgaggccuaccugccccacaccuucuggaucacccuccuggacgccuucuaccagagccuggugugcuucuucgugcccuacuucacguaccagggcuccgacaccgacaucuucgccuucggcaacccccucaacaccgccgcgcuguucaucguccugcuccaccuggugaucgagagcaagagccugaccuggauccaccuccuggugaucaucggguccauccugagcuacuuccucuucgccaucgucuucggcgccaugugcgugacgugcaacccgcccuccaaccccuacuggaucaugcaggagcacaugcuggaccccguguucuaccuggucugcauccugaccaccagcaucgcccuccugccgcgcuucguguaccgggugcugcaggggucccucuuccccagccccauccugcgcgccaagcacuucgaccgccugacccccgaggagcggacgaaggcgcucaagaaguggcgcggcgccgggaagaugaaccaggucaccuccaaguacgccaaccagagcgccggcaaguccggccggcgcccgaugcccgggcccagcgccguguucgcgaugaaguccgccagcuccugcgccaucgagcagggcaaccugagccugugcgagaccgcccucgaccagggguacuccgagaccaaggccuucgagauggcgggccccagcaagggcaaggaguccuga

SEQ ID NO: 27022 - RNA, 3405 nt, Artificial Sequence
  derived and/or modified sequence opt1 from ATP11A__Homo_sapiens__NP_056020
auggacugcagccuggugcgcacccucguccaccgguacugcgccggcgaggagaacuggguggacucccgcaccaucuacguggggcaccgggagcccccgcccggcgccgaggcguacaucccccagcgcuaccccgacaaccggaucgucagcuccaaguacacguucuggaacuucaucccgaagaaccuguucgagcaguuccgccggguggccaacuucuacuuccugaucaucuuccucgugcagcugaucaucgacacccccaccagccccgucaccuccgggcugccccucuucuucgugaucacggugaccgccaucaagcagggcuacgaggacuggcugcgccacaaggccgacaacgccaugaaccagugcccgguccacuucauccagcacgggaagcuggugcggaagcagagccgcaagcuccgggugggcgacaucgucauggugaaggaggacgagaccuuccccugcgaccugaucuuccuguccagcaaccgcggcgacgggaccugccacgugacgaccgcgucccucgacggcgagagcucccacaagacccacuacgccguccaggacaccaagggguuccacacggaggaggacaucggcgggcugcacgccaccaucgagugcgagcagccccagcccgaccuguacaaguucgugggccggaucaacguguacagcgaccucaacgacccggucgugcgcccccugggcuccgagaaccugcuccugcgcggggccacccugaagaacaccgagaagaucuucggcguggcgaucuacacggggauggagaccaagauggcccucaacuaccagagcaagucccagaagcggagcgccgucgagaaguccaugaacgccuuccugaucguguaccugugcauccucaucagcaaggcccugaucaacaccgugcugaaguacauguggcaguccgagcccuuccgggacgagcccugguacaaccagaagaccgagagcgagcgccagcggaaccucuuccugaaggcguucacggacuuccuggccuucaugguccucuucaacuacaucaucccggugagcauguacgucaccguggagaugcagaaguuccugggcuccuacuucaucaccugggacgaggacauguucgacgaggagaccggcgaggggccccuggugaacacgagcgaccucaacgaggagcugggccaggucgaguacaucuucaccgacaagaccgggacccugacggagaacaacauggaguucaaggagugcugcaucgagggccacguguacgugccccacgucaucugcaacggccaggugcuccccgaguccagcgggaucgacaugaucgacuccagcccguccgugaacggccgcgagcgggaggagcuguucuuccgcgcccugugccucugccacaccguccaggugaaggacgacgacagcguggacgggccccgcaagucccccgacggcggcaagagcugcgucuacaucuccagcucccccgacgagguggcccugguggaggggguccagcggcugggguucaccuaccuccgccugaaggacaacuacauggagauccugaaccgggagaaccacaucgagcgcuucgagcuccuggagauccugagcuucgacuccgugcggcgccggaugagcgugaucgucaaguccgccaccggcgagaucuaccucuucugcaagggcgcggacagcuccaucuucccgcgcgugaucgaggggaagguggaccagauccgggcccgcgucgagcggaacgccguggagggccugcgcacgcugugcguggccuacaagcggcugauccaggaggaguacgaggggaucugcaagcuccugcaggccgcgaaggucgcccugcaggaccgcgagaagaagcucgccgaggccuacgagcagaucgagaaggaccugacccugcucggcgccaccgcgguggaggaccggcugcaggagaaggccgccgacaccaucgaggcccugcagaaggcggggaucaagguguggguccucacgggcgacaagauggagaccgccgccgcgaccugcuacgccugcaagcuguuccgccggaacacccagcugcucgagcugaccacgaagcgcaucgaggagcagagccugcacgacguccucuucgagcugagcaagaccgugcugcggcacuccggcagccucacccgcgacaaccuguccgggcugagcgccgacaugcaggacuacggccucaucaucgacggggccgcccugucccugaucaugaagccccgcgaggacggcagcuccggcaacuaccgggagcuguuccucgagaucugccgcagcugcuccgccgugcugugcugccggauggcgccccuccagaaggcccagaucgugaagcugaucaaguucagcaaggagcaccccaucacccuggccaucggggacggcgccaacgacguguccaugauccucgaggcccacgucgggaucggcgugaucgggaaggagggccgccaggccgcgcggaacagcgacuacgccaucccgaaguucaagcaccugaagaagaugcugcucgugcacggccacuucuacuacauccgcaucuccgagcugguccaguacuucuucuacaagaacgugugcuucaucuucccccaguuccuguaccaguucuucugcggguucagccagcagacgcucuacgacaccgccuaccugacccuguacaacaucuccuucaccagccuccccauccugcuguacucccucauggagcagcacgugggcaucgacguccugaagcgggacccgacgcuguaccgcgacguggccaagaacgcgcuccugcgguggcgcguguucaucuacuggacccugcucgggcuguucgacgcccuggucuucuucuucggcgccuacuucguguucgagaacaccaccgugacgagcaacgggcagaucuucggcaacuggaccuucggcacccucgucuucaccgugaugguguucacggucacccugaagcuggcccucgacacccacuacuggaccuggaucaaccacuucgugaucugggggagccugcuguucuacguggucuucucccuccuguggggcggggugaucuggcccuuccugaacuaccagcggauguacuacgucuucauccagaugcucagcuccggccccgccuggcuggcgaucgugcugcucgugacgaucagccugcugcccgacguccucaagaaggugcugugccgccagcuguggccgaccgccaccgagcgggugcagaccaagucccagugccucagcgucgagcaguccacgaucuucaugcugagccagaccuccagcucccugagcuucuga

SEQ ID NO: 27023 - RNA, 366 nt, Artificial Sequence
  derived and/or modified sequence opt1 from ATP11AUN__Homo_sapiens__NP_997323
augaacagccccgaggcccgccugugcguggcccagugccgggacuccuacccgggcugccagccccucaaggacacccgcgcgugggccagcucccugaagauggaccccgccgggcuggagggcgggccccgggacgagagccgcgacgagccgcccauccgggcccaggccgcguccugggaccagccccagggcugccucaccuacaaggggcgccggagcgccuccggcacgcagaagcagcugcagcugcccgacacccucagcucccugcugugcuggcgcggcgccaucauggucuacaucaaggugaccgugcagaccgacgacagcaacaagcuccugucccugcucuaccgguga

SEQ ID NO: 27024 - RNA, 3534 nt, Artificial Sequence
  derived and/or modified sequence opt1 from ATP11B__Homo_sapiens__NP_055431
auguggcgcuggauccggcagcagcugggcuucgacccgccccaccagagcgacacccgcaccaucuacguggccaaccgguucccccagaacgggcucuacacgccccagaaguucaucgacaaccgcaucaucuccagcaaguacaccgucuggaacuucgugcccaagaaccuguucgagcaguuccggcgcguggccaacuucuacuuccugaucaucuuccucguccagcugaugaucgacaccccgaccucccccgugacgagcggccugccccucuucuucgugaucaccgucaccgcgaucaagcagggguacgaggacuggcugcggcacaacuccgacaacgaggugaacggcgcccccguguacgucgugcgcagcgggggccuggugaagacccgguccaagaacauccgcgucggcgacaucgugcggaucgccaaggacgagaucuucccggccgaccucgugcugcugagcuccgaccgccucgacgggagcugccacgucacgaccgccucccuggacggcgagaccaaccugaagacccacguggcggugcccgagacggcccuccugcagaccgucgccaaccuggacacccucguggccgugaucgagugccagcagcccgaggcggaccuguaccgguucauggggcgcaugaucaucacccagcagauggaggagaucguccggccccugggcccggagagccuccugcugcgcggggcccggcucaagaacacgaaggagaucuucggcguggccguguacaccggcauggagaccaagauggcccugaacuacaaguccaagagccagaagcgcuccgccgucgagaaguccaugaacaccuuccugaucaucuaccucgugauccugaucagcgaggcggucaucagcacgauccugaaguacaccuggcaggccgaggagaagugggacgagcccugguacaaccagaagaccgagcaccagcggaacuccagcaagauccuccgcuucaucagcgacuuccuggccuuccuggugcucuacaacuucaucauccccaucucccuguacgugaccgucgagaugcagaaguuccuggggagcuucuucaucggcugggaccucgaccuguaccacgaggaguccgaccagaaggcccaggugaacacgagcgaccugaacgaggagcucgggcaggucgaguacgucuucaccgacaagaccggcacccugacggagaacgagaugcaguuccgggagugcuccaucaacggcaugaaguaccaggagaucaacgggcgccuggugcccgagggcccgacccccgacagcuccgaggggaaccucagcuaccuguccagccugucccaccucaacaaccugagccaccugaccaccuccagcuccuuccgcacgagccccgagaacgagaccgagcucaucaaggagcacgaccuguucuucaaggccgugucccugugccacaccguccagaucagcaacgugcagaccgacugcacgggcgacgggcccuggcaguccaaccuggcgccgagccagcucgaguacuacgccagcucccccgacgagaaggcccugguggaggccgccgcgcggaucggcaucgucuucaucggcaacagcgaggagaccauggaggugaagacccuggggaagcucgagcgcuacaagcugcugcacauccucgaguucgacuccgaccggcgccggaugagcgugaucguccaggcccccuccggcgagaagcugcuguucgccaagggggccgagagcuccauccuccccaagugcaucggcggggagaucgagaagacccgcauccacguggacgaguucgcccugaagggccugcggacccucugcaucgcguaccgcaaguucacgagcaaggaguacgaggagaucgacaagcggaucuucgaggcccgcaccgcccugcagcagcgggaggagaagcuggccgcgguguuccaguucaucgagaaggaccucauccugcugggcgccaccgccgucgaggaccgccuccaggacaaggugcgggagaccaucgaggcccugcgcauggccgggaucaagguguggguccugacgggcgacaagcacgagaccgcgguguccgugagccucuccugcgggcacuuccaccggaccaugaacauccuggagcugaucaaccagaaguccgacagcgagugcgccgagcagcuccgccagcuggcccggcgcaucaccgaggaccacgucauccagcacggccuggugguggacgggacgagccucucccuggcccugcgggagcacgagaagcuguucauggaggucugccgcaacugcagcgccgugcucugcugccgcauggcgccgcugcagaaggccaaggugauccggcucaucaagaucucccccgagaagcccaucacccuggccgucggcgacggcgccaacgacgugagcaugauccaggaggcccacguggggaucggcaucauggggaaggagggccgccaggcggcccggaacagcgacuacgccaucgcccgcuucaaguuccuguccaagcuccuguucguccacggccacuucuacuacauccggaucgcgacccuggugcaguacuucuucuacaagaacgugugcuucaucacgccccaguuccucuaccaguucuacugccuguucagccagcagacccuguacgacuccgucuaccucacccuguacaacaucugcuucaccagccugccgauccucaucuacucccugcuggagcagcacguggacccccacgugcuccagaacaagcccacccuguaccgcgacaucagcaagaaccggcugcucuccaucaagacguuccuguacuggaccauccugggguucagccacgccuucaucuucuucuucggcuccuaccuccugaucgggaaggacaccagccugcucggcaacgggcagauguucggcaacuggaccuucggcacgcuggucuucaccgugauggugaucaccgucaccgugaagauggcccuggagacgcacuucuggaccuggaucaaccaccucgugaccuggggguccaucaucuucuacuucgucuucagccuguucuacggcgggauccuguggccguuccucggcucccagaacauguacuucguguucauccagcugcugagcuccgggagcgccugguucgccaucauccucaugguggugaccugccuguuccuggacaucaucaagaagguguucgaccgccaccuccaccccacguccaccgagaaggcgcagcugaccgagaccaacgccggcaucaagugccuggacagcaugugcugcuuccccgagggcgaggccgccugcgccuccguggggcggaugcucgagcgcgucaucggccggugcagccccacgcacaucagccgcuccuggagcgcguccgacccguucuacaccaacgaccggagcauccugacccuguccaccauggacagcuccacgugcuga

SEQ ID NO: 27025 - RNA, 3138 nt, Artificial Sequence
  derived and/or modified sequence opt1 from ATP12A__Homo_sapiens__NP_001172014
augcaccagaagacccccgagaucuacagcguggagcuguccggcaccaaggacaucgucaagacggacaagggggacggcaaggagaaguaccgcgggcucaagaacaacugccuggagcugaagaagaagaaccacaaggaggaguuccagaaggagcuccaccuggacgaccacaagcugagcaaccgggagcucgaggagaaguacggcaccgacaucaucauggggcuguccagcacccgcgccgccgagcugcucgcgcgggacggcccgaacucccugaccccgcccaagcagacgcccgagaucgugaaguuccugaagcagauggugggcggguucagcauccuccugugggucggcgccuuccugugcuggaucgccuacgggauccaguacuccagcgacaaguccgccagccucaacaacguguaccugggcugcgugcuggggcucgucgugauccugaccggcaucuucgccuacuaccaggaggcgaaguccaccaacaucaugagcuccuucaacaagaugaucccccagcaggcccuggugauccgcgacagcgagaagaagaccauccccuccgagcagcucgucgugggcgacaucguggaggucaagggcggggaccagauccccgccgacauccgggugcugagcucccaggggugccgcguggacaacagcucccugacgggcgagagcgagccccagccgcggagcuccgaguucacccacgagaacccccucgagaccaagaacaucugcuucuacagcaccacgugccuggaggccuccaccagccccgucggcaccgugaccgggauggugaucaacacgggcgaccgcaccaucaucgggcacaucgcgucccuggccagcggcgucgggaacgagaagacccccaucgccaucgagaucgagcacuucgugcacaucguggccggcgucgccguguccaucggcauccucuucuucaucaucgcggugagccugaaguaccagguccuggacuccaucaucuuccucaucgggaucaucguggccaacgucccggagggccugcuggccaccgugacggugacccucagccugaccgccaagcggauggccaagaagaacugccuggucaagaaccucgaggcgguggagacccugggguccacgagcaucaucugcuccgacaagaccggcacccugacccagaaccgcaugacgguggcccaccucugguucgacaaccagaucuucgucgccgacaccagcgaggaccacuccaaccagguguucgaccagagcucccggaccugggccagccuguccaagaucaucacccugugcaaccgcgccgaguucaagcccgggcaggagaacgugcccaucaugaagaaggcggucaucggcgacgccagcgagacggcccuccugaaguucagcgaggugauccugggcgacgugauggagauccggaagcgcaaccggaaggucgccgagauccccuucaacuccaccaacaaguuccagcucagcauccacgagauggacgacccgcacgggaagcgcuuccugauggugaugaagggcgcccccgagcggauccuggagaagugcuccaccaucaugaucaacggggaggagcacccccucgacaagagcaccgcgaagacguuccacaccgccuacauggagcugggcgggcugggcgagcgcgugcugggcuucugccaccucuaccugcccgccgacgaguucccggagaccuacuccuucgacaucgacgccaugaacuuccccaccagcaaccugugcuucgucgggcuccuguccaugaucgacccgccccggagcaccgugcccgacgcggugacgaagugccgcuccgccggcaucaaggucaucauggugaccggggaccaccccaucaccgccaaggccaucgccaagagcgugggcaucaucuccgcgaacagcgagaccgucgaggacaucgcccaccggcugaacaucgccguggagcaggucaacaagcgcgacgccaaggccgcgguggugacgggcauggagcucaaggacauguccagcgagcagcuggacgagauccuggccaacuaccaggagaucguguucgcccgcaccagcccccagcagaagcucaucaucgucgaggggugccagcggcaggacgccgugguggccgucaccggcgacggggugaacgacucccccgcgcugaagaaggccgacaucggcaucgccauggggaucgccggcuccgacgcggccaagaacgccgccgacauggugcugcucgacgacaacuucgccagcaucgucaccggcguggaggaggggcgccugaucuucgacaaccugaagaagacgaucgcguacagccucaccaagaacaucgccgagcugugcccguuccugaucuacaucaucgugggccucccccugcccaucgggaccaucaccauccuguucaucgaccucggcacggacaucaucccguccaucgcccuggccuacgagaaggccgagagcgacaucaugaaccggaagccccgccacaagaacaaggaccggcuggucaaccagccccucgcgguguacuccuaccugcacaucgggcugaugcaggcccucggcgccuuccugguguacuucaccgucuacgcccaggagggcuuccugccccgcacccucaucaaccugcggguggagugggagaaggacuacgugaacgaccugaaggacagcuacgggcaggaguggacccgcuaccagcgggaguaccucgaguggacgggcuacaccgccuucuucgucgggauccuggugcagcagaucgcggaccugaucauccgcaagacccggcgcaacuccaucuuccagcagggccucuuccggaacaaggugaucugggucgggaucaccagccagaucaucaucggccugauccuguccuacggccucgggagcgugacggcccuguccuucaccaugcugcgcgcccaguacugguucguggccgucccgcacgcgauccucaucuggguguacgacgaggugcggaagcuguucauccgccuguaccccggcagcuggugggacaagaacauguacuacuga

SEQ ID NO: 27026 - RNA, 3681 nt, Artificial Sequence
  derived and/or modified sequence opt1 from ATP13A3__Homo_sapiens__NP_078800
auggaccgcgaggagcggaagaccaucaaccagggccaggaggacgagauggagaucuacggguacaaccugagccgcuggaagcucgccaucgugucccugggcgucaucugcagcgggggcuuccugcuccugcugcucuacuggaugcccgaguggcgggugaaggcgaccugcgugcgcgccgccaucaaggacugcgaggucgugcugcugcggacgaccgacgaguucaagaugugguucugcgccaagauccgcgugcucucccuggagaccuacccggucagcucccccaagagcauguccaacaagcugagcaacgggcacgccgugugccucaucgagaaccccaccgaggagaaccggcaccgcaucuccaaguacagccagacggagucccagcagauccgguacuucacccaccacagcgugaaguacuucuggaacgacaccauccacaacuucgacuuccugaagggccuggacgagggcgucuccugcaccagcaucuacgagaagcacuccgccgggcucacgaagggcaugcacgcguaccgcaagcugcuguacggggugaacgagaucgccgugaagguccccagcguguucaagcuccugaucaaggaggugcugaacccguucuacaucuuccagcuguucuccgucauccuguggagcaccgacgaguacuacuacuacgcccuggccaucguggugauguccaucgucagcaucgugagcucccucuacagcauccggaagcaguacgugaugcugcacgacauggucgcgacccacuccaccgugcgcgugagcgucugccgggugaacgaggagaucgaggagaucuucuccacggaccugguccccggcgacgugauggugaucccccucaacgggaccaucaugcccugcgacgccguccugaucaacgggaccugcaucgugaacgagagcaugcugaccggcgaguccgugccggucacgaagaccaaccuccccaaccccagcguggacgugaaggggaucggcgacgagcuguacaaccccgagacccacaagcgccacacccuguucugcgggacgaccgucauccagacccgguucuacaccggcgagcucgugaaggccaucgugguccgcacgggcuucuccaccagcaaggggcagcuggugcgguccauccuguacccgaagcccaccgacuucaagcucuaccgcgacgccuaccuguuccugcucugccugguggccgucgcgggcaucggguucaucuacaccaucaucaacagcauccugaacgagguccaggugggcgugaucaucaucgagucccucgacaucaucacgaucaccgugccgcccgcccugcccgccgccaugaccgccgggaucguguacgcgcagcggcgccugaagaagaucggcaucuucugcaucagcccccagcggaucaacaucugcggccagcucaaccuggucugcuucgacaagaccgggacgcugaccgaggacggccucgaccugugggggauccagcgcguggagaacgcccgcuuccugucccccgaggagaacgugugcaacgagaugcuggucaagagccaguucguggccugcauggcgaccugccacucccucaccaagaucgagggcgugcugagcggggacccccuggaccucaagauguucgaggccaucggcuggauccuggaggaggccacggaggaggagaccgcccugcacaaccggaucaugccgaccgucgugcgcccgcccaagcagcuccugcccgaguccacccccgccggcaaccaggagauggagcuguucgagcuccccgccaccuacgagaucgggaucgugcggcaguuccccuucagcagcgcccugcagcgcauguccgucguggcgcgggugcugggcgaccgcaagauggacgccuacaugaagggggcccccgaggccaucgcgggccucugcaagccggagacgguccccguggacuuccagaacgugcuggaggacuucaccaagcagggguuccgggucaucgcccuggcccaccgcaagcucgagagcaagcugaccuggcacaaggugcagaacaucucccgggacgccaucgagaacaacauggacuucaugggccugaucaucaugcagaacaagcucaagcaggagacccccgccgugcuggaggaccugcacaaggcgaacauccgcacggucauggugaccggcgacagcaugcucaccgccguguccgucgcccgggacugcgggaugauccugccgcaggacaaggugaucaucgccgaggcccugccgcccaaggacggcaagguggcgaagaucaacuggcacuacgccgacagccucacccagugcucccaccccagcgccaucgaccccgaggccauccccgucaagcuggugcacgacucccuggaggaccuccagaugacgcgcuaccacuucgccaugaacggcaagagcuucuccgugauccuggagcacuuccaggaccugguccccaagcucaugcugcacggcaccguguucgcgcggauggcccccgaccagaagacccagcugaucgaggcccuccagaacguggacuacuucgucggcaugugcggggacggcgccaacgacugcggggcgcugaagcgcgcccacggcgggaucagccuguccgagcucgaggccagcguggccuccccguucaccagcaagacgcccuccaucagcugcguccccaaccugauccgggagggccgcgccgcgcugaucaccagcuucugcguguucaaguucauggcccucuacuccaucauccaguacuucagcgugacccugcuguacuccauccucagcaaccugggcgacuuccaguuccuguucaucgaccucgccaucauccuggucgugguguucaccaugucccugaaccccgccuggaaggagcucgucgcccagcggccgcccagcgggcugaucuccggcgcgcuccucuucagcgugcugucccagaucaucaucugcaucggguuccagagccugggcuucuucugggugaagcagcagcccugguacgaggucuggcaccccaaguccgacgccugcaacacgaccgggagcggcuucuggaacuccagccacguggacaacgagaccgagcucgacgagcacaacauccagaacuacgagaacaccacgguguucuucaucuccagcuuccaguaccugaucgucgccaucgccuucuccaagggcaagccguuccgccagcccugcuacaagaacuacuucuucguguucagcgugaucuuccuguacaucuucauccucuucaucaugcuguaccccgucgccuccguggaccaggugcugcagaucgucugcgugcccuaccaguggcgggugaccaugcucaucaucguccuggugaacgcguucgugagcaucaccgucgaggagagcguggaccgcugggggaagugcugccugccgugggcccucggcugccgcaagaagacccccaaggccaaguacauguaccuggcccaggagcugcucguggaccccgaguggcccccgaagccccagacgaccaccgaggcgaaggcccuggucaaggagaacggguccugccagaucaucaccaucacguga

SEQ ID NO: 27027 - RNA, 3591 nt, Artificial Sequence
  derived and/or modified sequence opt1 from ATP13A4__Homo_sapiens__NP_115655
augggccacuucgagaaggggcagcacgcccugcucaacgagggcgaggagaacgagauggagaucuucggguaccggacccagggcugccgcaagagccugugccuggccggguccaucuucagcuucggcauccucccccugguguucuacuggcggccggcguggcacgucugggcccacugcgugcccugcucccugcaggaggccgacaccgugcuccugcggacgaccgacgaguuccagaucuacagcuggaagaaggucaucuggaucuaccuguccgcccucaacagcgccuucggccugacccccgaccacccccugaugaccgacgaggaguacaucaucaaccgcgcgauccggaagccggaccucaaggugcgcugcaucaaggugcagaagauccgguacgucuggaacuaccuggaggggcaguuccagaagaucggcucccuggaggacuggcucagcuccgccaagauccaccagaaguucgggagcggccugacgcgcgaggagcaggagauccggcgccugaucugcgggcccaacaccaucgacguggaggugacccccaucuggaagcuccugaucaaggagguccugaaccccuucuacaucuuccagcuguucuccgugugccucugguucagcgaggacuacaaggaguacgccuucgccaucaucaucauguccaucaucagcaucucccugaccguguacgaccuccgggagcagagcgucaagcugcaccaccugguggagucccacaacagcaucacgguguccgucugcggccgcaaggcgggcgugcaggagcucgagagccgggugcuggucccgggggaccugcucauccugaccggcaacaaggugcugaugcccugcgacgccgugcucaucgaggggagcugcgucguggacgagggcaugcugaccggcgaguccauccccgugaccaagacgccccugccgaagauggacagcuccguccccuggaagacccagagcgaggccgacuacaagcgccacguccucuucugcgggaccgaggugauccaggccaaggccgcgugcuccggcaccgugcgggccgugguccugcagacgggguucaacaccgccaagggcgaccuggugcgcagcauccucuaccccaagcccgugaacuuccagcuguaccgggacgccauccgcuuccugcucugccuggucgggaccgccaccaucggcaugaucuacacgcugugcguguacgugcucuccggcgagccgcccgaggaggucgugcggaaggcgcuggacgugaucaccaucgccgucccgcccgcccugcccgccgcccucaccaccgggaucaucuacgcgcagcgccggcugaagaagcgcggcaucuucugcaucagcccccagcgcaucaacgugugcgggcagcugaaccuggugugcuucgacaagacgggcacccucacccgggacgggcuggaccuguggggcgucguguccugcgaccgcaacggcuuccaggaggugcacagcuucgccuccgggcaggcccuccccuggggcccccugugcgccgccauggcgagcugccacucccugauccuccuggacgggaccauccagggcgacccgcuggaccucaagauguucgaggccacgaccugggagauggccuucagcggggacgacuuccacaucaagggcguccccgcccacgcgaugguggugaagcccugccggaccgccucccagguccccguggagggcaucgccauccugcaccaguucccguucagcuccgcccugcagcgcaugaccgugaucguccaggagaugggcggggaccggcucgccuucaugaagggggcgcccgagcgcguggccagcuucugccagcccgagacggugccgaccuccuucgucagcgagcugcagaucuacaccacccagggcuuccgggugaucgcccuggccuacaagaagcucgagaacgaccaccacgccacgacccugacccgcgagaccguggagagcgaccugaucuuccucggccugcugauccucgagaaccggcugaaggaggagaccaagcccguccuggaggagcucaucuccgcgcgcauccggacggugaugaucaccggggacaaccugcagaccgccaucaccguggcccgcaagagcggcauggucuccgagagccagaaggugauccugaucgaggccaacgagacgaccggguccagcuccgccagcaucuccuggacccucguggaggagaagaagcacaucauguacggcaaccaggacaacuacaucaacauccgggacgaggucagcgacaaggggcgcgagggcuccuaccacuucgcgcugaccggcaagagcuuccacgugaucucccagcacuucagcucccugcuccccaagauccugaucaacgggacgaucuucgcccggaugagccccggccagaaguccagccugguggaggaguuccagaagcucgacuacuucgucgggaugugcggcgacggggccaacgacugcggcgcccugaagauggcgcacgugggcaucagccuguccgagcaggaggccagcguggccuccccguucaccagcaagacccccaacaucgagugcgucccccaccucaucaaggaggggcgcgccgcccuggugaccuccuucugcauguucaaguacauggcgcuguacagcaugauccaguacgugggcguccuccugcuguacugggagacgaacucccucagcaacuaccaguuccuguuccaggaccuggccaucaccacccucaucggggugaccaugaaccugaacggcgccuaccccaagcuggugccguuccggcccgccgggcgccucaucuccccgccccugcugcucagcgucaucuucaacauccugcugucccucgccaugcacaucgcgggcuucauccuggugcagcggcagcccugguacagcguggagauccacuccgccugcacgguccagaacgagagcaucuccgagcugaccaugagccccaccgcccccgagaagauggaguccaacagcaccuucacguccuucgagaacaccaccgugugguuccucggcaccaucaacugcaucacggucgcccugguguucagcaaggggaagcccuuccgccagccgaccuacaccaacuacaucuucgugcugguccucaucauccagcugggcgugugccuguucauccucuucgccgacauccccgagcuguaccgccggcuggaccuccugugcacccccgugcuguggcgcgcgagcaucgucaucaugcucucccugaacuucaucgugagccugguggccgaggaggccgucaucgagaaccgggcccucuggaugaugaucaagcgcugcuucggguaccaguccaagagccaguaccggaucuggcagcgcgaccuggcgaacgaccccuccuggccgccccugaaccagacgagccacuccgacaugcccgagugcggccgcggggugagcuacuccaaccccguguucgagagcaacgaggagcagcucuga

SEQ ID NO: 27028 - RNA, 3063 nt, Artificial Sequence
  derived and/or modified sequence opt1 from ATP1A2__Homo_sapiens__NP_000693
augggccgcggggccggccgggaguacagccccgccgcgaccaccgccgagaacgggggcgggaagaagaagcagaaggagaaggagcuggacgagcucaagaaggagguggccauggacgaccacaagcugucccuggacgagcucggccgcaaguaccaggucgaccugagcaagggccugacgaaccagcgggcccaggacgugcucgcccgcgacgggccgaacgcgcugaccccgccgcccaccacccccgagugggugaaguucugccggcagcuguucggcggguucuccauccuccuguggaucggcgccauccugugcuuccucgccuacgggauccaggccgcgauggaggacgagcccagcaacgacaaccuguaccugggcgucgugcucgccgccguggucaucgugacgggcugcuucuccuacuaccaggaggccaagagcuccaagaucauggacagcuucaagaacauggugccccagcaggcccuggucauccgcgagggggagaagaugcagaucaacgcggaggaggugguggucggcgaccugguggaggugaagggcggggaccggguccccgccgaccuccgcaucaucuccagccacggcugcaagguggacaacuccagccugaccggggaguccgagccccagacccggagccccgaguucacccacgagaacccccuggagacgcgcaacaucugcuucuucuccaccaacugcguggagggcaccgcccgggggaucgucaucgccaccggcgaccgcacggugauggggcggaucgccacccucgcgagcggccuggaggugggccgcacccccaucgccauggagaucgagcacuucauccagcugaucaccggggucgccguguuccucggcguguccuucuucguccugagccugauccucggguacuccuggcuggaggccgugaucuuccugaucggcaucaucgucgccaacgugccggaggggcuccuggcgacggugaccgucugccugacccucaccgccaagcggauggcccgcaagaacugccuggugaagaaccuggaggccguggagacgcucggcagcaccagcaccaucugcuccgacaagaccggcacgcugacccagaaccggaugaccgucgcccacaugugguucgacaaccagauccacgaggcggacaccacggaggaccagagcggggccaccuucgacaagcgcucccccaccuggaccgcccugagccggaucgccggccucugcaaccgcgcgguguucaaggccgggcaggagaacaucuccgugagcaagcgggacacggccggcgacgccuccgagagcgcccugcugaagugcaucgagcucuccugcgggagcguccgcaagaugcgcgaccggaaccccaagguggcggagauccccuucaacuccaccaacaaguaccagcugagcauccacgagcgcgaggacuccccgcagagccacgugcuggucaugaagggcgcccccgagcggauccucgaccgcugcuccaccauccuggugcagggcaaggagaucccccuggacaaggagaugcaggacgccuuccagaacgccuacauggagcucgggggccugggggagcgggugcugggcuucugccagcugaaccuccccagcggcaaguucccgcgcggguucaaguucgacaccgacgagcugaacuuccccacggagaagcugugcuucgucggccucauguccaugaucgacccgccccgggccgcggugcccgacgccguggggaagugccgcagcgccggcaucaaggucaucauggugaccggggaccaccccaucaccgccaaggccaucgcgaagggcgugggcaucaucuccgaggggaacgagaccgucgaggacaucgccgcccggcugaacauccccaugagccaggugaacccccgcgaggccaaggcgugcgugguccacggcagcgaccugaaggacaugaccuccgagcagcucgacgagauccugaagaaccacacggagaucguguucgcccggaccagcccgcagcagaagcugaucaucguggaggggugccagcgccagggcgccaucgucgccgugaccggggacggcgugaacgacucccccgcccucaagaaggcggacaucggcaucgccauggggaucagcggcuccgacgucagcaagcaggccgccgacaugauccugcuggacgacaacuucgccuccaucgugaccgggguggaggagggccggcucaucuucgacaaccugaagaaguccaucgcguacacgcugaccagcaacauccccgagaucaccccguuccuccuguucaucaucgccaacaucccccugccccucgggaccgucacgauccugugcaucgaccugggcaccgacauggugcccgccaucagccucgccuacgaggccgcggaguccgacaucaugaagcgccagccgcggaacagccagaccgacaagcuggugaacgagcgccugaucuccauggccuacggccagaucgggaugauccaggcccucggcggguucuucaccuacuucgucauccuggccgagaacggcuuccugcccagccggcuccuggggauccgccuggacugggacgaccggacgaugaacgaccucgaggacuccuacggccaggaguggaccuacgagcagcgcaaggugguggaguucacgugccacaccgcguucuucgccagcaucgucguggugcagugggccgaccugaucaucugcaagacccgccggaacuccgucuuccagcagggcaugaagaacaagauccugaucuucgggcuccuggaggagaccgcccuggccgcguuccucagcuacugccccggcauggggguggcccugcgcauguacccccugaaggugaccuggugguucugcgccuucccguacagccuccugaucuucaucuacgacgagguccggaagcugauccuccgccgguaccccggcggcuggguggagaaggagaccuacuacuga

SEQ ID NO: 27029 - RNA, 3075 nt, Artificial Sequence
  derived and/or modified sequence opt1 from ATP1A3__Homo_sapiens__NP_001243142
augggcgggugggaggaggagcgcaaccggcgcgccaccgacaagaaggacgacaaggacagccccaagaagaacaagggcaaggagcggcgcgaccuggacgaccucaagaaggagguggccaugaccgagcacaagauguccgucgaggaggugugccggaaguacaacacggacugcgugcaggggcugacccacagcaaggcgcaggagauccuggcccgcgacggcccgaacgcccucaccccgccgcccaccacgcccgagugggucaaguucugccggcagcuguucgggggcuucuccauccugcucuggaucggcgccauccugugcuuccuggccuacgggauccaggcgggcaccgaggacgaccccagcggggacaaccucuaccugggcaucgugcuggccgccguggucaucaucaccgggugcuucuccuacuaccaggaggccaagagcuccaagaucauggagagcuucaagaacauggugccccagcaggcgcucgugauccgcgagggcgagaagaugcaggucaacgccgaggaggugguggucggcgaccugguggagaucaagggcggggaccgggugcccgccgaccugcgcaucaucuccgcccacgggugcaaggucgacaacagcucccucaccggcgagagcgagccccagacgcggucccccgacugcacccacgacaacccccuggagacccgcaacaucaccuucuucagcacgaacugcguggagggcaccgcccgcgggguggucguggcgaccggcgaccggaccgugauggggcggaucgccacgcuggccuccggccucgaggucgggaagacccccaucgccaucgagaucgagcacuucauccagcugaucaccggcguggccguguuccugggcgucagcuucuucauccucucccugauccugggguacaccuggcucgaggcggugaucuuccugaucggcaucaucgucgccaacgugccggaggggcugcucgccacggugaccgucugccugacccugaccgccaagcgcauggcccggaagaacugccucgugaagaaccuggaggcgguggagacgcugggcagcaccuccaccaucugcagcgacaagaccgggacgcucacccagaaccgcaugaccgucgcccacaugugguucgacaaccagauccacgaggccgacaccacggaggaccagagcggcaccuccuucgacaagagcucccacaccuggguggcccugagccacaucgccggccugugcaaccgggcgguguucaagggcgggcaggacaacauccccguccucaagcgcgacguggccggggacgccuccgagagcgcccugcugaagugcaucgagcucuccagcggcuccgugaagcugaugcgggagcgcaacaagaaggucgcggagauccccuucaacagcaccaacaaguaccagcuguccauccacgagacggaggaccccaacgacaaccgcuaccuccuggugaugaagggggccccggagcggauccuggaccgcugcagcaccauccuccugcagggcaaggagcagccccuggacgaggagaugaaggaggccuuccagaacgccuaccucgagcugggcgggcugggcgagcgggugcugggguucugccacuacuaccuccccgaggagcaguuccccaagggcuucgccuucgacugcgacgacgucaacuucaccaccgacaaccugugcuucgugggccugauguccaugaucgacccgccccgcgcggccgugcccgacgccgucgggaagugccggagcgccggcaucaaggugaucauggugaccggggaccaccccaucacggccaaggcgaucgccaagggcgucgggaucaucuccgagggcaacgagaccguggaggacaucgccgcccgccucaacaucccggugagccaggucaacccccgggacgccaaggcgugcgugauccacggcaccgaccugaaggacuucaccuccgagcagaucgacgagauccugcagaaccacacggagaucguguucgcccgcaccagcccccagcagaagcucaucaucgucgaggggugccagcggcagggcgccaucguggccgugaccggggacggcgucaacgacucccccgcgcugaagaaggccgacaucgggguggccaugggcaucgccggcagcgacgugagcaagcaggccgcggacaugauccugcucgacgacaacuucgccuccaucgucaccgggguggaggagggccgccugaucuucgacaaccugaagaaguccaucgccuacacgcucaccagcaacaucccggagaucacccccuuccugcuguucaucauggccaacaucccccucccgcuggggaccaucacgauccugugcaucgaccucggcaccgacauggugcccgccaucagccuggcguacgaggccgccgaguccgacaucaugaagcggcagccccgcaacccccggaccgacaagcuggucaacgagcgccucaucagcauggccuacgggcagaucggcaugauccaggcccugggcggguucuucuccuacuucgugauccuggcggagaacggcuuccucccggggaaccuggugggcauccggcugaacugggacgaccgcaccgucaacgaccucgaggacagcuacgggcagcaguggacguacgagcagcggaaggugguggaguucacgugccacaccgccuucuucgucuccaucguggugguccagugggccgaccugaucaucugcaagacccgccggaacagcguguuccagcagggcaugaagaacaagauccugaucuucggccucuucgaggagaccgcccuggcggccuuccuguccuacugccccgggauggacguggcccuccgcauguacccccugaagcccagcuggugguucugcgccuucccguacuccuuccugaucuucgucuacgacgagauccgcaagcucauccugcggcgcaaccccggcggguggguggagaaggagaccuacuacuga

SEQ ID NO: 27030 - RNA, 498 nt, Artificial Sequence
  derived and/or modified sequence opt1 from ATP1A4__Homo_sapiens__NP_001001734
augauccaggcccuggccggcuucuucaccuacuucgugauccucgcggagaacggguuccgccccgucgaccugcugggcauccggcuccacugggaggacaaguaccugaacgaccuggaggacagcuacgggcagcaguggaccuacgagcagcgcaaggugguggaguucacgugccagaccgccuucuucgucaccaucguggugguccagugggccgaccucaucaucuccaagacccggcgcaacagccuguuccagcagggcaugcggaacaaggugcugaucuucgggauccucgaggagacgcugcuggccgccuuccucuccuacaccccgggcauggacguggcgcugcgcauguacccccugaagaucaccugguggcucugcgccauccccuacagcauccugaucuucgucuacgacgagauccggaagcugcucauccgccagcaccccgacggcuggguggagcgggagaccuacuacuga

SEQ ID NO: 27031 - RNA, 912 nt, Artificial Sequence
  derived and/or modified sequence opt1 from ATP1B1__Homo_sapiens__NP_001668
auggcccgcggcaaggccaaggaggaggggagcuggaagaaguucaucuggaacuccgagaagaaggaguuccugggccggaccgggggcagcugguucaagauccuccuguucuacgugaucuucuacgggugccuggcgggcaucuucaucggcaccauccaggugaugcuccugacgaucuccgaguucaagcccaccuaccaggaccgcguggccccgcccgggcugacccagaucccccagauccagaagaccgagaucagcuuccggcccaacgacccgaaguccuacgaggccuacgugcucaacaucguccgcuuccuggagaaguacaaggacagcgcccagcgggacgacaugaucuucgaggacugcggcgacgugcccuccgagcccaaggagcgcggggacuucaaccacgagcggggcgagcgcaaggugugccgguucaagcuggaguggcucgggaacugcagcggccugaacgacgagacguacggcuacaaggaggggaagcccugcaucaucaucaagcugaaccgcguccucggcuucaagccgaagccgcccaagaacgagucccuggagaccuaccccgugaugaaguacaaccccaacgugcugcccguccagugcaccgggaagcgggacgaggacaaggacaaggugggcaacguggaguacuucggccucgggaacagccccggcuucccccugcaguacuacccguacuacgggaagcugcuccagcccaaguaccugcagccccugcucgccguccaguucaccaaccugacgauggacaccgagauccgcaucgagugcaaggcguacggcgagaacaucggguacuccgagaaggaccgguuccagggccgcuucgacgugaagaucgaggucaagagcuga

SEQ ID NO: 27032 - RNA, 873 nt, Artificial Sequence
  derived and/or modified sequence opt1 from ATP1B2__Homo_sapiens__NP_001669
auggugauccagaaggagaagaaguccugcggccaggucguggaggaguggaaggaguucguguggaacccccgcacccaccaguucauggggcggaccggcacgagcugggccuucauccuccuguucuaccuggucuucuacggguuccugaccgccauguucacccucaccaugugggugaugcugcagacggugagcgaccacaccccgaaguaccaggaccgccuggcgacccccggccucaugauccggcccaagaccgagaaccuggacgucaucgugaacguguccgacacggagagcugggaccagcacguccagaagcugaacaaguuccucgagcccuacaacgacuccauccaggcccagaagaacgacgugugccgcccggggcgguacuacgagcagcccgacaacggcgugcugaacuaccccaagcgcgccugccaguucaaccggacccagcugggcaacugcagcgggaucggcgacuccacccacuacggguacagcaccggccagcccugcgucuucaucaagaugaaccgcgugaucaacuucuacgccggggccaaccaguccaugaacgugacgugcgcgggcaagcgggacgaggacgccgagaaccucggcaacuucgucauguucccggccaacgggaacaucgaccugauguacuuccccuacuacggcaagaaguuccacgugaacuacacccagccccugguggccgucaaguuccucaacgugacccccaacguggaggucaacguggagugccgcaucaacgcggccaacaucgccaccgacgacgagcgggacaaguucgccgggcgcguggccuucaagcugcggaucaacaagacguga

SEQ ID NO: 27033 - RNA, 2610 nt, Artificial Sequence
  derived and/or modified sequence opt1 from ATP2A1__Homo_sapiens__NP_001273004
augggcaagguguaccgcgccgaccgcaagagcguccagcggaucaaggcccgggacaucgugcccggggacaucguggaggucgcggugggcgacaaggugccggccgacauccgcauccuggccaucaaguccaccacccuccgggucgaccagagcauccugacgggggaguccgugagcgugaucaagcacaccgagcccguccccgacccccgcgccgugaaccaggacaagaagaacaugcuguucuccggcaccaacaucgccgcggggaaggcccucggcaucguggccaccacgggcgucgggaccgagaucggcaagauccgggaccagauggccgcgaccgagcaggacaagaccccgcugcagcagaagcuggacgaguucggggagcagcucagcaaggugaucucccugaucugcguggccgucuggcugaucaacaucggccacuucaacgaccccgugcacgggggcagcugguuccgcggcgccaucuacuacuucaagaucgccguggcccucgcggucgccgccauccccgaggggcugcccgccgugaucacgaccugccuggcccucggcacccggcgcauggcgaagaagaacgccaucgugcggucccugccgagcgucgagacccuggggugcacguccgugaucugcagcgacaagaccggcacccucaccacgaaccagauguccgugugcaagauguucaucaucgacaaggucgacggcgacaucugccugcugaacgaguucagcaucaccggguccaccuacgcccccgagggcgaggugcucaagaacgacaagcccguccgccccgggcaguacgacggccugguggagcuggccaccaucugcgcccucugcaacgacagcucccuggacuucaacgaggcgaaggggguguacgagaaggucggcgaggccacggagaccgcccugaccacccucguggagaagaugaacguguucaacacggacguccggagccuguccaagguggagcgcgccaacgccugcaacagcgugauccggcagcugaugaagaaggaguucacccucgaguucagccgcgaccggaaguccaugagcgucuacugcuccccggccaagagcucccgcgcggccgugggcaacaagauguucgugaagggggcccccgagggcgucaucgaccggugcaacuacgugcgcguggggaccacccgggucccccugacgggccccgugaaggagaagaucauggcggugaucaaggagugggggaccggccgcgacacccugcgcugccucgcccuggccacccgggacacgccgcccaagcgcgaggagaugguccuggacgacagcgcccgguuccucgaguacgagaccgaccugaccuucgugggcguggucgggaugcuggacccgccccgcaaggaggugaccggcuccauccagcucugccgggacgccgggauccgcgugaucaugaucacgggcgacaacaaggggaccgcgaucgccaucugccggcgcaucggcaucuucggcgagaacgaggaggucgccgaccgggccuacaccgggcgcgaguucgacgaccugccccuggccgagcagcgggaggcgugccgccgggccugcugcuucgcccgcguggagcccagccacaaguccaagaucguggaguaccuccagagcuacgacgagaucaccgccaugaccggcgacggggucaacgacgcccccgcgcugaagaaggccgagaucggcaucgccaugggcuccgggacggccguggcgaagaccgccagcgagauggugcuggccgacgacaacuucuccaccaucgucgccgccguggaggagggccgggcgaucuacaacaacaugaagcaguucauccgcuaccucaucagcuccaacgugggggaggucgugugcaucuuccugaccgccgcccugggccuccccgaggcccugaucccggugcagcugcucugggucaaccuggugacggacgggcugcccgccaccgcgcugggcuucaacccgcccgaccucgacaucauggaccggccgccccgcagccccaaggagccccugaucuccggcuggcuguucuuccgguacauggccaucgggggcuacgugggggccgccaccgucggcgccgcggccuggugguuccucuacgccgaggacgggccccacgugaacuacagccagcugacccacuucaugcagugcacggaggacaacacccacuucgagggcaucgacugcgagguguucgaggcccccgagcccaugaccauggcgcuguccguccucgugaccaucgagaugugcaacgcccugaacagccugagcgagaaccagucccuccugcgcaugccgcccugggugaacaucuggcugcucggcagcaucugccuguccaugagccugcacuuccucauccuguacgucgacccccugcccaugaucuucaagcuccgcgcccuggaccugacgcaguggcucauggugcugaagaucucccugccggugaucgggcucgacgagauccugaaguucgucgcccggaacuaccuggagggcuga

SEQ ID NO: 27034 - RNA, 2994 nt, Artificial Sequence
  derived and/or modified sequence opt1 from ATP2A2__Homo_sapiens__NP_001672
auggagaacgcccacaccaagaccguggaggagguccugggccacuucggggugaacgagagcacgggccucucccuggagcaggucaagaagcugaaggagcgcugggggagcaacgagcuccccgccgaggagggcaagacccugcuggagcucgugaucgagcaguucgaggaccugcuggugcggauccuccugcuggcggccugcaucuccuucgugcucgccugguucgaggagggggaggagaccaucaccgccuucgucgagccguucgugauccugcugauccucguggccaacgcgaucgucggcguguggcaggagcgcaacgccgagaacgccaucgaggcccugaaggaguacgagcccgagaugggcaagguguaccggcaggaccgcaagagcguccagcggaucaaggcgaaggacaucgugcccggggacaucguggagaucgccgucggcgacaaggugcccgccgacauccgccugacguccaucaagagcaccacccuccggguggaccaguccauccugaccggggagagcgucuccgugaucaagcacacggacccggugcccgacccccgcgccgucaaccaggacaagaagaacaugcuguucagcggcaccaacaucgccgcggggaaggccaugggcgugguggucgccaccggcgugaacaccgagaucgggaagauccgggacgagauggucgccacggagcaggagcgcacgccccuccagcagaagcuggacgaguucggcgagcagcuguccaaggugaucagccucaucugcaucgccguguggaucaucaacaucgggcacuucaacgacccgguccacggcggcuccuggauccgcggggcgaucuacuacuucaagaucgccguggcccuggccguggccgcgauccccgagggccugcccgccgucaucacgaccugccucgcccuggggacccggcggauggccaagaagaacgccaucgugcgcagccugcccuccguggagacccucggcugcaccagcgucaucugcuccgacaagaccgggacccugaccaccaaccagaugagcgugugccggauguucauccuggaccgcguggagggcgacacgugcucccucaacgaguucaccaucaccggcagcaccuacgcgccgaucggggagguccacaaggacgacaagcccgugaacugccaccaguacgacggccugguggagcuggccaccaucugcgcccucugcaacgacagcgcccuggacuacaacgaggcgaagggggucuacgagaaggugggcgaggccacggagaccgcccugaccugccucguggagaagaugaacgucuucgacaccgagcugaaggggcuguccaagaucgagcgggccaacgccugcaacagcgugaucaagcagcucaugaagaaggaguucacgcuggaguucucccgcgaccgcaagagcauguccguguacugcacccccaacaagcccagccggaccuccaugagcaagauguucgucaagggcgcgccggagggcgugaucgaccggugcacccacauccgcgugggguccacgaagguccccaugaccagcggcgugaagcagaagaucauguccgugauccgcgagugggggagcggcuccgacacccugcggugccucgcccuggccacccacgacaacccccugcgccgggaggagaugcaccucgaggacagcgccaacuucaucaaguacgagaccaaccugacguucgucgggugcgugggcaugcuggacccgccccgcaucgagguggccuccagcgucaagcugugccggcaggcgggcauccgcgugaucaugaucaccggggacaacaagggcaccgccguggccaucugccggcgcaucgggaucuucggccaggacgaggacgucaccuccaaggccuucacgggccgggaguucgacgagcucaaccccagcgcccagcgcgacgcgugccugaacgcccggugcuucgcccgcguggagcccucccacaagagcaagaucguggaguuccugcagagcuucgacgagaucaccgccaugaccggggacggcgucaacgacgcgcccgcccucaagaaggccgagaucgggaucgccaugggcuccgggaccgccguggcgaagacggccagcgagauggugcuggccgacgacaacuucuccaccaucgucgccgccguggaggagggccgggcgaucuacaacaacaugaagcaguucauccgcuaccugaucagcuccaacgugggcgaggucgugugcaucuuccucaccgccgcccugggguucccggaggcccugauccccgugcagcuccugugggucaaccuggugaccgacggccuccccgccacggcgcugggguucaacccgcccgaccuggacaucaugaacaagccgccccggaaccccaaggagccccucaucagcggcuggcuguucuuccgcuaccuggccaucgggugcuacgugggcgccgccaccgucggcgcggccgccuggugguucaucgccgccgacgggggcccccggguguccuucuaccagcucagccacuuccugcagugcaaggaggacaaccccgacuucgaggggguggacugcgcgaucuucgaguccccguaccccaugaccauggcccugagcguccucgugaccaucgagaugugcaacgcccugaacucccugagcgagaaccagucccuccugcgcaugccgcccugggagaacaucuggcuggucggcagcaucugccucuccaugagccugcacuuccugauccucuacguggagccccugccccugaucuuccagaucacgccccucaacgugacccaguggcugaugguccugaagaucucccuccccgugauccugauggacgagacccugaaguucguggcccggaacuaccucgagccggccauccuggaguga

SEQ ID NO: 27035 - RNA, 3159 nt, Artificial Sequence
  derived and/or modified sequence opt1 from ATP2A3__Homo_sapiens__NP_777613
auggaggccgcccaccuccuccccgcggccgacgugcugcgccacuucagcgucaccgccgagggcgggcuguccccggcccaggugaccggcgcccgggagcgcuacgggcccaacgagcuccccagcgaggagggcaagucccugugggagcuggugcucgagcaguucgaggaccugcugguccggauccuccugcuggcggcccucgugagcuucgugcuggccugguucgaggagggggaggagacgaccaccgccuucgucgagccccuggugaucaugcucauccugguggcgaacgccaucgucggcguguggcaggagcgcaacgccgaguccgccaucgaggcccugaaggaguacgagccggagaugggcaaggugauccggagcgaccgcaaggggguccagcggauccgcgcgcgggacaucgugcccggcgacaucguggaggucgccgugggggacaaggugcccgccgaccuccgccugaucgagaucaaguccaccacgcugcgggucgaccagagcauccucaccggcgaguccgugagcgugaccaagcacaccgaggccauccccgacccgcgcgccgucaaccaggacaagaagaacaugcuguucuccgggacgaacaucaccagcggcaaggcggugggcguggccgucgccaccgggcugcacaccgagcucggcaagauccggucccagauggccgccguggagcccgagcgcacgccccugcagcggaagcuggacgaguucgggcgccagcucagccacgcgaucuccgucaucugcguggccgugugggucaucaacaucggccacuucgccgaccccgcccacggcgggagcuggcugcggggcgccguguacuacuucaagaucgcgguggcccuggccgucgccgcgaucccggaggggcuccccgccgugaucacgaccugccuggcccugggcacccgccggauggcccgcaagaacgccaucgugcggucccuccccagcgucgagacccuggggugcaccuccgugaucugcagcgacaagaccggcacccugacgaccaaccagaugagcgugugccgcauguucgucguggcggaggccgacgccggcuccugccuccugcacgaguucaccaucagcgggaccacguacacccccgagggcgaggugcgccagggggaccagccgguccggugcggccaguucgacgggcugguggagcucgccaccaucugcgcccugugcaacgacuccgcgcuggacuacaacgaggccaagggcguguacgagaaggucggcgaggccaccgagacggcccugaccugccugguggagaagaugaacguguucgacaccgaccugcaggcccucagccgcgucgagcgggcgggggccugcaacaccgugaucaagcagcugaugcgcaaggaguucacgcuggaguucucccgggaccgcaagagcauguccguguacugcacccccacccggccccaccccaccggccaggggagcaagauguucgucaagggcgccccggaguccgugaucgagcgcugcagcuccgugcgggucgggagccgcacggcgccccucacccccaccucccgggagcagauccuggccaagauccgcgacuggggcagcggcuccgacacccugcggugccuggcccucgccacccgcgacgcgcccccgcggaaggaggacauggagcuggacgacugcagcaaguucgugcaguacgagacggaccugaccuucguggggugcgucggcaugcucgacccgccccgccccgagguggccgccugcaucacccggugcuaccaggccgggauccgcguggucaugaucaccggcgacaacaagggcacggccguggccaucugccggcgccuggggaucuucggcgacaccgaggacguggccgggaaggcguacaccggccgcgaguucgacgaccuguccccggagcagcagcggcaggccugccgcaccgcccggugcuucgcccgcgucgagcccgcccacaagagccggaucguggagaaccuccaguccuucaacgagaucacggcgaugaccggggacggcgugaacgacgcccccgcccugaagaaggccgagaucggcaucgcgauggggagcggcaccgccgucgccaagagcgccgccgagauggugcuguccgacgacaacuucgcgagcaucguggccgccgucgaggaggggcgcgccaucuacuccaacaugaagcaguucauccgguaccucaucagcuccaacgugggcgagguggucugcaucuuccugaccgccauccuggggcucccggaggcgcugauccccgugcagcugcucugggugaaccuggucacggacggccugcccgccaccgcccucggcuucaacccgcccgaccuggacaucauggagaagcugccccgcagcccccgggaggcccucaucuccggguggcuguucuuccgcuaccuggccaucggcguguacguggggcucgcgaccgucgccgccgccaccuggugguucguguacgacgccgagggcccccacaucaacuucuaccagcugcggaacuuccugaagugcagcgaggacaacccccucuucgcggggaucgacugcgaggucuucgagucccgcuuccccacgaccauggcccugagcgugcuggugaccaucgagaugugcaacgcccucaacuccgucagcgagaaccagucccugcugcggaugccgcccuggaugaaccccuggcuccugguggccguggcgaugagcauggcccugcacuuccucauccugcuggucccgccccucccccugaucuuccaggugacgccccuguccggccgccaguggguggucgugcuccagaucagccugcccgugauccugcucgacgaggcccugaaguaccugucccggaaccacaugcacgccugccucuaccccggccugcugcgcaccgucagccaggccuggagccggcagccccucaccaccuccuggaccccggaccacacggggcuggcgagccugggccaggggcacuccaucgugagccucuccgagcugcugcgcgagggcgggagccgggaggagaugucccagaaguga

SEQ ID NO: 27036 - RNA, 3663 nt, Artificial Sequence
  derived and/or modified sequence opt1 from ATP2B1__Homo_sapiens__XP_011536710
augggcgacauggccaacaacagcguggccuacuccggggucaagaacagccugaaggaggcgaaccacgacggcgacuucgggaucacccucgccgagcugcgcgcccugauggagcuccgguccaccgacgcccugcgcaagauccaggagagcuacggcgacguguacgggaucugcacgaagcugaagaccucccccaacgagggccucagcggcaacccggccgaccuggagcggcgcgaggcgguguucgggaagaacuucaucccccccaagaagcccaagaccuuccugcagcucgucugggaggcccugcaggacgugacccugaucauccucgagaucgccgccaucgugucccugggccugagcuucuaccagccgcccgagggggacaacgcgcucugcggcgaggucuccgugggggaggaggagggcgagggcgagacgggguggaucgagggcgccgccauccugcugagcguggucugcguggugcucgucaccgccuucaacgacugguccaaggagaagcaguuccgggggcugcagagccgcaucgagcaggagcagaaguucaccgugauccggggcggccaggugauccagauccccgucgccgacaucaccgugggggacaucgcgcaggugaaguacggcgaccugcuccccgccgacgggauccugauccagggcaacgaccugaagaucgacgaguccagccucacgggggaguccgaccacgucaagaagagccuggacaaggacccgcugcuccuguccggcacccacgugauggagggcagcgggcgcaugguggucaccgccgugggcgugaacucccagaccgggaucaucuucacgcugcucggcgccgggggcgaggaggaggagaagaaggacgagaagaagaaggagaagaagaacaagaagcaggacggcgccaucgagaaccggaacaaggcgaaggcccaggacggggccgccauggagaugcagccccugaagagcgaggagggcggggacggcgacgagaaggacaagaagaaggccaaccugcccaagaaggagaagagcguccuccaggggaagcugaccaagcuggcggugcagaucggcaaggccggccuccugauguccgccaucaccgucaucauccuggugcucuacuucgugaucgacaccuucuggguccagaagcgccccuggcuggccgagugcacgccgaucuacauccaguacuucgugaaguucuucaucaucggggugaccguccuggugguggccguccccgagggccucccccuggcggugaccaucagccuggccuacuccgugaagaagaugaugaaggacaacaaccucguccggcaccuggacgccugcgagaccauggggaacgccacggcgaucugcagcgacaagaccggcacccugaccaugaaccgcaugacgguggugcaggccuacaucaacgagaagcacuacaagaagguccccgagccggaggccaucccccccaacauccucuccuaccuggugaccggcaucagcgugaacugcgccuacaccuccaagauccugcccccggagaaggaggggggccugccccggcacgucgggaacaagaccgagugcgcccuccugggccugcuccuggaccugaagcgcgacuaccaggacgugcggaacgagauccccgaggaggcgcucuacaagguguacacguucaacagcguccgcaaguccaugagcaccgugcugaagaacuccgacgggagcuaccggaucuucuccaagggcgccagcgagaucauccugaagaagugcuucaagauccucuccgccaacggcgaggccaagguguuccgcccccgggaccgcgacgacaucgucaagaccgugaucgagccgauggccagcgaggggcugcggaccaucugccuggcguuccgcgacuuccccgccggcgagcccgagcccgagugggacaacgagaacgacaucgugacggggcucaccugcaucgccgucgugggcaucgaggacccggugcgccccgagguccccgacgccaucaagaagugccagcgggccgggaucaccgugcgcauggugaccggcgacaacaucaacacggcgcgggccaucgccaccaagugcggcauccugcacccgggggaggacuuccugugccucgagggcaaggacuucaaccgccggauccgcaacgagaagggggagaucgagcaggagcggaucgacaagaucuggcccaagcugcgcguccuggcccgguccagccccaccgacaagcacacccucgugaagggcaucaucgacuccaccgugagcgaccagcgccaggucguggcggugacgggggacggcaccaacgacggccccgcccugaagaaggccgacgucggguucgccaugggcaucgccgggaccgacguggcgaaggaggccagcgacaucauccugaccgacgacaacuucacguccaucgugaaggccgucauguggggccggaacguguacgacagcaucuccaaguuccuccaguuccagcugaccgugaacgucguggccgugaucgucgccuucaccggggcgugcaucacccaggacagcccgcugaaggccgugcagaugcucugggugaaccugaucauggacacgcuggccucccucgcccuggccaccgagccccccaccgagagccugcuccugcgcaagcccuacggccggaacaagccgcugaucucccgcaccaugaugaagaacauccucggccacgcguucuaccagcuggucguggucuucacgcugcucuucgccggggagaaguucuucgacaucgacagcggccggaacgccccccugcacgccccccccuccgagcacuacaccaucguguucaacaccuucgugcugaugcagcucuucaacgagaucaacgcgcgcaagauccacggggagcggaacgucuucgagggcaucuucaacaacgccaucuucugcaccaucgugcugggcacguucgugguccagaucaucaucgugcaguucgggggcaagccguucagcugcuccgagcugagcaucgagcaguggcucugguccaucuuccuggggaugggcacccugcucugggggcagcugaucagcaccauccccaccucccgccugaaguuccucaaggaggccggccacggcacgcagaaggaggagauccccgaggaggagcuggccgaggacguggaggagaucgaccacgccgagcgggagcugcgccgcgggcagauccucugguuccggggccugaaccgcauccagacccagauccgggucgugaacgcguuccgcagcucccuguacgaggggcucgagaagcccgagagccggagcuccauccacaacuucaugacccacccggaguuccgcaucgaggacagcgagccccacaucccccugaucgacgacaccgacgccgaggacgacgcccccacgaagcggaacuccagcccgccccccucccccaacaagaacaacaacgccguggacagcggcauccaccugaccaucgagaugaacaaguccgccaccagcuccagcccgggguccccccuccacagccuggagaccucccuguga

SEQ ID NO: 27037 - RNA, 3732 nt, Artificial Sequence
  derived and/or modified sequence opt1 from ATP2B2__Homo_sapiens__NP_001001331
augggcgacaugaccaacagcgacuucuacuccaagaaccagcgcaacgagagcucccacgggggcgaguucgggugcaccauggaggagcugcggagccucauggagcugcgcggcacggaggccguggucaagaucaaggagaccuacggggacaccgaggccaucugccggcgccugaagaccucccccguggagggccucccgggcacggcgcccgaccuggagaagcggaagcagaucuucgggcagaacuucaucccgcccaagaagcccaagaccuuccugcagcucgugugggaggcccugcaggacgucacccugaucauccucgagaucgccgccaucaucagccugggccuguccuucuaccacccgcccggggagggcaacgaggggugcgccaccgcgcagggcggcgccgaggacgagggggaggccgaggccggcuggaucgagggggcggccauccuccugagcgugaucugcgugguccuggugacggccuucaacgacugguccaaggagaagcaguuccgcggccuccagagccggaucgagcaggagcagaaguucaccgugguccgcgccggccagguggugcagauccccgucgccgagaucguggugggggacaucgcgcaggucaaguacggcgaccugcugcccgccgacggccucuucauccaggggaacgaccugaagaucgacgaguccagccugaccggggaguccgaccaggugcgcaagagcguggacaaggaccccaugcuccuguccggcacccacgucauggagggcagcgggcggaugcuggugacggccgugggcgucaacucccagaccgggaucaucuucacccuccugggcgccgggggcgaggaggaggagaagaaggacaagaagggcgugaagaagggggacggccugcagcuccccgccgcggacggggccgccgccagcaacgccgcggacuccgccaacgccagccuggugaacggcaagaugcaggacgggaacgucgacgccagccaguccaaggccaagcagcaggacggcgcggccgccauggagaugcagccccucaagagcgccgagggcggggacgcggacgaccggaagaaggccuccaugcacaagaaggagaaguccgugcuccagggcaagcugaccaagcuggccguccagaucgggaaggccggccucgugauguccgccaucacggugaucauccugguccuguacuucaccguggacaccuucguggucaacaagaagccguggcuccccgagugcacccccguguacgugcaguacuucgucaaguucuucaucaucggcgugacggugcuggucguggcggugcccgaggggcugccgcucgccgucaccaucagccuggccuacuccgugaagaagaugaugaaggacaacaaccuggugcgccaccucgacgccugcgagaccaugggcaacgccaccgcgaucugcagcgacaagacggggacccugaccaccaaccggaugacggucgugcaggccuacgugggcgacguccacuacaaggagauccccgaccccuccagcaucaacaccaagaccauggagcugcucaucaacgccaucgccaucaacuccgccuacaccacgaagauccugcccccggagaaggagggggcgcugccccgccaggugggcaacaagaccgagugcggccuccugggguucgugcuggaccugaagcaggacuacgagcccguccggagccagaugcccgaggagaagcucuacaagguguacaccuucaacuccgugcgcaagagcauguccaccgucaucaagcugccggacgagagcuuccggauguacuccaagggcgccagcgagaucgugcugaagaagugcugcaagauccucaacggggccggcgagccccgcguguuccggccccgcgaccgggacgagauggucaagaaggugaucgagcccauggccugcgacgggcugcgcacgaucugcguggcguaccgcgacuucccguccagccccgagcccgacugggacaacgagaacgacauccugaacgagcugaccugcaucugcgucgugggcaucgaggacccggugcggcccgagguccccgaggccauccgcaagugccagcgggccggcaucaccgugcgcauggugaccggggacaacaucaacaccgcccgggccaucgcgaucaagugcggcaucauccaccccggggaggacuuccugugccuggagggcaaggaguucaaccgccggauccgcaacgagaagggggagaucgagcaggagcggaucgacaagaucuggccgaagcuccgcguccuggcccggagcucccccacggacaagcacacccuggugaagggcaucaucgacagcacccacaccgagcagcgccagguggucgccgugacgggcgacgggaccaacgacggccccgcccucaagaaggccgacgugggguucgcgaugggcaucgccgggaccgacgucgccaaggaggccuccgacaucauccugaccgacgacaacuucagcuccaucgugaaggccgugauguggggccggaacgucuacgacagcaucuccaaguuccugcaguuccagcucacggugaacguggucgcggugaucgucgccuucaccggcgccugcaucacccaggacagcccccugaaggccgugcagaugcugugggugaaccucaucauggacaccuucgcgucccuggcccuggccacggagccgcccaccgagacccuccugcugcgcaagcccuacgggcggaacaagccccucaucagccgcaccaugaugaagaacauccugggccacgccgucuaccagcuggcccucaucuucacgcugcuguucgugggggagaagauguuccagaucgacuccggccggaacgcgccgcuccacagcccgcccuccgagcacuacaccaucaucuucaacaccuucgugaugaugcagcuguucaacgagaucaacgcccgcaagauccacggcgagcggaacgucuucgacgggaucuuccgcaaccccaucuucugcaccaucgugcugggcacguucgccauccagaucgugaucguccaguucgggggcaagcccuucagcugcagcccccuccagcuggaccaguggauguggugcaucuucaucgggcugggcgagcucguguggggccaggugaucgccaccauccccaccagccgccugaaguuccugaaggaggccgggcggcucacccagaaggaggagauccccgaggaggagcugaacgaggacgucgaggagaucgaccacgcggagcgcgagcugcggcgcggccagauccucugguuccgggggcugaaccgcauccagacgcagauccggguggugaaggccuuccgcuccagccuguacgagggccucgagaagccggagagccggaccuccauccacaacuucauggcccaccccgaguuccgcaucgaggacagccagccccacaucccccugaucgacgacaccgaccuggaggaggacgccgcccucaagcagaacuccagcccgcccuccagccugaacaagaacaacuccgcgaucgacagcgggaucaaccugaccacggacaccuccaagagcgccaccuccagcucccccggcagcccgauccacucccucgagaccagccuguga

SEQ ID NO: 27038 - RNA, 3663 nt, Artificial Sequence
  derived and/or modified sequence opt1 from ATP2B3__Homo_sapiens__XP_005274747
augggcgacauggccaacagcuccaucgaguuccaccccaagccgcagcagcagcgcgacgugccccaggccgggggcuucgggugcacccuggcggagcuccggacccugauggagcugcgcggcgccgaggcccuccagaagaucgaggaggccuacggggacgucagcggccugugccggcgccugaagacgucccccaccgagggccucgccgacaacaccaacgaccuggagaagcggcgccagaucuacgggcagaacuucauccccccgaagcagcccaagaccuuccugcagcucgugugggaggcgcugcaggacgugacgcugaucauccucgaggucgccgccaucgugagccugggccuguccuucuacgccccccccggggaggagagcgaggcgugcggcaacguguccgggggcgccgaggacgagggcgaggccgaggccggguggaucgagggcgccgcgauccuccugagcgucaucugcguggugcuggucaccgccuucaacgacugguccaaggagaagcaguuccgggggcuccagagccgcaucgagcaggagcagaaguucaccgugauccggaacggccagcugcugcaggugccggucgccgcccucguggugggcgacaucgcccaggucaaguacggggaccugcugcccgcggacggcgugcucauccaggccaacgaccugaagaucgacgaguccagccugaccggggaguccgaccacgugcgcaagagcgccgacaaggaccccaugcuccuguccggcacgcacgucauggaggggagcggccggaugguggugaccgccgucggcgugaacucccagaccgggaucaucuucacccugcucggcgccgggggcgaggaggaggagaagaaggacaagaaggggaagcagcaggacggcgcgauggagagcucccagacgaaggccaagaagcaggacggcgccguggccauggagaugcagccccugaagagcgccgaggggggcgagauggaggagcgcgagaagaagaaggcgaacgccccgaagaaggagaagagcguccugcaggggaagcucaccaagcuggccgugcagaucggcaaggccgggcuggucauguccgcgaucaccgugaucauccucgugcuguacuucgucaucgagaccuucgugguggagggccggacguggcuggccgagugcacccccgucuacgugcaguacuucgugaaguucuucaucaucggcgucaccgugcucguggucgccgugcccgaggggcugccccuggccgugaccaucagccucgccuacuccgucaagaagaugaugaaggacaacaaccuggugcgccaccuggacgcgugcgagacgaugggcaacgccaccgccaucugcagcgacaagaccgggacccucacgaccaaccggaugaccgugguccaguccuaccugggcgacacccacuacaaggagaucccggcccccagcgcccugacgcccaagauccucgaccugcuggugcacgcgaucuccaucaacagcgccuacaccaccaagauccugcccccggagaaggagggcgcccucccccgccagguggggaacaagaccgagugcgcccugcugggcuucguccucgaccugaagcgggacuuccagcccgugcgcgagcagauccccgaggacaagcuguacaagguguacacguucaacuccguccggaagagcauguccaccgugauccgcaugccggacgggggcuuccggcucuucagcaagggggccuccgagauccugcugaagaagugcaccaacauccucaacagcaacggcgagcugcgcggcuuccgcccccgggaccgcgacgacauggugcggaagaucaucgagcccauggcgugcgacgggcugcgcaccaucugcaucgccuaccgggacuucuccgccggccaggagcccgacugggacaacgagaacgaggucgugggggaccucacgugcaucgccguggucggcaucgaggacccggugcgccccgaggugcccgaggcgauccggaagugccagcgcgccgggaucaccguccggauggugaccggcgacaacaucaacaccgcccgcgccaucgccgcgaagugcggcaucauccagccgggggaggacuuccugugccuggagggcaaggaguucaaccggcgcauccggaacgagaagggggagaucgagcaggagcgccucgacaagguguggcccaagcugcggguccuggcccgcagcucccccaccgacaagcacacgcucgugaagggcaucaucgacagcaccaccggggagcagcggcagguggucgccgugaccggcgacggcacgaacgacgggcccgcccugaagaaggccgacgugggcuucgcgauggggaucgccggcaccgacgucgccaaggaggccuccgacaucauccugaccgacgacaacuucaccagcaucgugaaggccgugaugugggggcgcaacgucuacgacagcaucuccaaguuccuccaguuccagcugacggugaacguggucgcggugaucguggccuucaccggcgccugcaucacccaggacagcccgcugaaggccguccagaugcucugggugaaccugaucauggacaccuucgcgucccuggcccucgccacggagccccccaccgagagccugcugcuccggaagcccuacggccgcgacaagccgcugaucucccgcaccaugaugaagaacauccuggggcacgccgucuaccagcucgccaucaucuucacccugcuguucgugggcgagcucuucuucgacaucgacagcgggcggaacgcgccccugcacuccccccccagcgagcacuacacgaucaucuucaacaccuucgugaugaugcagcuguucaacgagaucaacgcccgcaagauccacggcgagcggaacgucuucgacggcaucuucuccaacccgaucuucugcaccaucgugcucgggaccuucggcauccagaucgugaucguccaguucgggggcaagcccuucagcugcuccccccugagcacggagcaguggcuguggugccucuucgugggggugggcgagcuggucuggggccaggugaucgccaccauccccaccucccagcugaagugccucaaggaggccgggcacggcccggggaaggacgagaugaccgacgaggagcuggccgagggcgaggaggagaucgaccacgcggagcgcgagcugcggcgcgggcagauccucugguuccggggccugaaccgcauccagacgcagauccggguggucaaggccuuccgcagcucccuguacgagggccucgagaagcccgagagcaagaccuccauccacaacuucauggccacccccgaguuccugaucaacgacuacacccacaacaucccccugaucgacgacacggacguggacgagaacgaggagcggcuccgcgccccgcccccccccagcccgaaccagaacaacaacgccaucgacagcgggaucuaccugaccacccacgugaccaaguccgcgacgagcuccgucuucagcuccagccccggcuccccccugcacagcguggagaccucccucuga

SEQ ID NO: 27039 - RNA, 3513 nt, Artificial Sequence
  derived and/or modified sequence opt1 from ATP2B4__Homo_sapiens__NP_001001396
augaccaaccccagcgaccgcgugcugccggccaacuccauggccgagagccgggagggcgacuucgggugcaccgucauggagcuccgcaagcugauggagcugcggucccgcgacgcgcucacgcagaucaacgugcacuacggcggggugcagaaccugugcagccggcugaagaccucccccgucgagggccucagcgggaaccccgccgaccuggagaagcgccgccagguguucggccacaacgugaucccgcccaagaagcccaagaccuuccuggagcucgucugggaggcccugcaggacgugacccugaucauccucgagaucgccgccaucaucucccuggugcugagcuucuaccggcccgcgggcgaggagaacgagcucugcgggcaggucgccacgacccccgaggacgagaacgaggcccaggccggcuggaucgagggggcggccauccuguucuccgugaucaucgugguccuggugaccgccuucaacgacuggagcaaggagaagcaguuccggggccuccagugccgcaucgagcaggagcagaaguucuccaucauccggaacgggcagcugauccagcugccgguggccgagaucgucgugggcgacaucgcccaggugaaguacggcgaccuccugcccgcggacgggauccugauccagggcaacgaccucaagaucgacgagagcucccugaccggggagagcgaccacgucaagaagucccuggacaaggaccccaugcuccugagcggcacgcacgugauggagggcuccgggcgcaugguggucaccgccgugggcgugaacagccagaccgggaucauccugacccuccugggcgucaacgaggacgacgagggggagaagaagaagaagggcaagaagcagggcgugcccgagaaccggaacaaggccaagacgcaggacggggucgcccuggagauccagccgcucaacucccaggagggcaucgacaacgaggagaaggacaagaaggccgugaaggugcccaagaaggagaaguccguccugcaggggaagcugacccgccucgcggugcagaucggcaaggccgggcugcugaugagcgcccucaccguguucauccugauccuguacuucgucaucgacaacuucgugaucaaccggcgccccuggcuccccgagugcaccccgaucuacauccaguacuucgugaaguucuucaucaucggcaucacgguccuggugguggccguccccgagggccugccccucgccgugaccaucagccuggcguacagcgugaagaagaugaugaaggacaacaaccugguccggcaccucgacgccugcgagaccauggggaacgccaccgccaucugcuccgacaagacgggcacccugaccaugaaccgcaugaccguggugcaggccuacaucgggggcauccacuaccggcagauccccagcccggacgucuuccugcccaaggugcuggaccucaucgugaacgggaucuccaucaacagcgcguacacguccaagauccugccgcccgagaaggagggcggccugccccgccaggucgggaacaagaccgagugcgcccuccugggcuucgugaccgaccugaagcaggacuaccaggccgugcggaacgagguccccgaggagaagcucuacaagguguacaccuucaacagcgugcgcaaguccaugagcacggucauccgcaaccccaacgggggcuuccggauguacuccaagggcgccagcgagaucauccugcgcaagugcaaccggauccuggaccgcaagggggaggcggugcccuucaagaacaaggaccgggacgacauggugcgcaccgucaucgagccgauggccugcgacggccuccggaccaucugcaucgccuaccgcgacuucgacgacaccgagcccuccugggacaacgagaacgagauccugacggagcugaccugcaucgccgugguggggaucgaggaccccguccggccggaggugcccgacgccaucgcgaagugcaagcaggccggcaucaccgugcgcauggucaccggggacaacaucaacacggcccgggccaucgccaccaagugcggcauccucacccccggcgacgacuuccugugccuggaggggaaggaguucaaccgccucauccggaacgagaagggcgagguggagcaggagaagcuggacaagaucuggcccaagcugcgcgugcucgcgcggagcuccccgaccgacaagcacacccuggucaaggggaucaucgacagcacggugggcgagcaccgccagguggucgccgugaccggggacggcaccaacgacggccccgcccugaagaaggccgacgugggguucgccaugggcaucgcggggaccgacgucgccaaggaggccuccgacaucauccucacggacgacaacuucaccagcaucgugaaggccgugauguggggccggaacgucuacgacuccaucagcaaguuccugcaguuccagcugaccgugaacguggucgcggugaucgucgccuucaccggggccugcaucacgcaggacagcccccucaaggccgugcagaugcugugggugaaccugaucauggacaccuucgccucccucgcgcuggccaccgagcccccgaccgagagccugcucaagcgccggcccuacggccgcaacaagccccugaucucccgcacgaugaugaagaacauccugggccacgccuucuaccagcucaucgucaucuucauccugguguucgccggggagaaguucuucgacaucgacagcggccggaaggcgccccugcacuccccgcccagccagcacuacaccaucguguucaacaccuucguccucaugcagcuguucaacgagaucaacucccgcaagauccacggggagaagaacguguucagcggcaucuaccggaacaucaucuucugcuccgugguccuggggaccuucaucugccagaucuucaucguggaguucggcggcaagcccuucagcugcacgucccucagccugucccaguggcuguggugccucuucaucgggaucggcgagcugcugugggggcaguucaucagcgccauccccacccgcucccucaaguuccugaaggaggccggccacggcaccaccaaggaggagaucacgaaggacgccgaggggcuggacgagaucgaccacgccgagauggagcuccggcgcggccagauccugugguuccgggggcugaaccgcauccagacccagaucgacgugaucaacaccuuccagaccggcgccagcuucaaggggguccuccggcgccagaacaugggccagcaccuggacgugaagcuggugccguccagcagcuacgucgcgguggcccccgugaaguccagccccacgaccuccguccccgccgugagcuccccgcccaugggcaaccagagcgggcaguccgugcccuga

SEQ ID NO: 27040 - RNA, 2850 nt, Artificial Sequence
  derived and/or modified sequence opt1 from ATP2C1__Homo_sapiens__NP_001001486
augaagguggcccgcuuccagaagauccccaacggcgagaacgagaccaugaucccgguccugaccagcaagaaggccuccgagcuccccgugagcgagguggcguccauccugcaggccgaccugcagaacgggcucaacaagugcgaggucagccaccggcgcgccuuccacggcuggaacgaguucgacaucuccgaggacgagccccuguggaagaaguacaucagccaguucaagaacccccugaucaugcuccugcuggccuccgccgugaucagcgugcucaugcaccaguucgacgacgcggucuccaucacgguggccauccugaucguggucaccguggccuucgugcaggaguaccggagcgagaagucccuggaggagcucagcaagcuggucccgcccgagugccacugcgugcgcgaggggaagcuggagcacacccucgcccgggaccuggugcccggcgacaccgucugccuguccgugggggaccgcgugcccgcggaccuccggcuguucgaggccgucgaccugagcaucgacgaguccagccucacgggcgagaccaccccgugcuccaaggugaccgcgccccagcccgccgccacgaacggcgaccuggccagccgcuccaacaucgccuucauggggacccuggugcggugcggcaaggccaagggggucgugaucggcaccggggagaacagcgaguucggcgagguguucaagaugaugcaggccgaggaggcccccaagaccccgcuccagaaguccauggaccugcugggcaagcagcucagcuucuacagcuucgggaucaucggcaucaucaugcuggucggguggcugcucggcaaggacauccuggagauguucacgaucuccgugagccuggcggucgccgccauccccgagggccuccccaucguggugaccgucacccuggcccugggggugaugcgcauggugaagaagcgggccaucgucaagaagcuccccaucguggagacccugggcugcugcaacgugaucugcuccgacaagacggggacccugaccaagaacgagaugaccgucacgcacaucuucaccagcgacggccuccacgcggaggugaccggggugggcuacaaccaguucggcgaggucaucguggacggggacgugguccacggcuucuacaacccggccgugucccgcaucguggaggccgggugcgucugcaacgacgccgugauccggaacaacacccugaugggcaagcccacggagggggcccugaucgcgcucgccaugaagaugggccuggacggccugcagcaggacuacauccgcaaggccgaguaccccuucagcuccgagcagaaguggauggccgugaagugcguccaccggacccagcaggaccgccccgagaucugcuucaugaagggggcguacgagcaggucaucaaguacugcaccaccuaccagagcaagggccagacgcucacccugacccagcagcagcgggacguguaccagcaggagaaggcccgcaugggguccgccggccugcgggugcucgcccuggccagcgggccggagcugggccagcugaccuuccucggccugguggggaucaucgacccgccccgcacgggcgugaaggaggcggucaccacccugaucgccuccggggugagcaucaagaugaucaccggcgacucccaggagacggccguggccaucgccagccggcucggccuguacuccaagaccagccaguccgucagcggggaggagaucgacgcgauggacgugcagcagcugagccagaucgugcccaaggucgccguguucuaccgcgccagcccccgccacaagaugaagaucaucaagucccuccagaagaacggcuccguggucgccaugaccggggacggcgugaacgacgccguggcgcugaaggccgccgacaucggggucgccaugggccagaccggcaccgacgugugcaaggaggcggccgacaugauccugguggacgacgacuuccagacgaucaugagcgccaucgaggaggggaagggcaucuacaacaacaucaagaacuucguccgguuccagcucuccaccagcaucgccgcccugacccugaucucccucgcgacccugaugaacuuccccaacccccugaacgccaugcagauccucuggaucaacaucaucauggacgggcccccggcccagagccugggcguggagcccguggacaaggacgucauccgcaagcccccgcggaacuggaaggacuccauccugacgaagaaccucauccugaagauccuggugagcuccaucaucaucgugugcgggacccucuucgucuucuggcgcgagcugcgggacaacgugaucacgccccgcgacaccaccaugaccuucacgugcuucguguucuucgacauguucaacgcccugagcucccggagccagaccaaguccgucuucgagaucggccucugcagcaaccgcauguucugcuacgccgugcugggcuccaucauggggcagcugcucgucaucuacuucccgccccugcagaagguguuccagaccgagagccugagcauccucgaccugcuguuccuccugggccugaccuccagcgugugcaucgucgcggagaucaucaagaagguggagcggucccgcgagaagauccagaagcacgugagcuccaccagcuccagcuuccucgaggucuggcugugggagcgguccgggcagcagcugguggagauccacccccaccucgagaccggccugccccugacggaggacgugagcugcgucuga

SEQ ID NO: 27041 - RNA, 2928 nt, Artificial Sequence
  derived and/or modified sequence opt1 from ATP2C2__Homo_sapiens__NP_001273456
augguggagggccgcgucagcgaguuccugaagaagcucggguucuccggcgggggccggcaguaccaggcccuggagaaggacgaggaggaggcccugaucgacgagcagagcgagcucaaggcgaucgagaaggagaagaaggugaccgcccugcccccgaaggaggccugcaagugccagaaggaggaccuggcccgcgccuucugcguggaccuccacaccgggcuguccgaguucagcgucacgcagcggcgccuggcgcacggcuggaacgaguucguggccgacaacuccgagcccguguggaagaaguaccucgaccaguucaagaacccccugauccugcuccugcugggcagcgcccucgucuccgugcugaccaaggaguacgaggacgccgugagcaucgcgaccgccguccuggugguggucaccguggccuucauccaggaguaccgguccgagaagagccucgaggagcugacgaagcuggugcccccggagugcaacugccuccgcgaggggaagcugcagcaccugcucgcccgggagcugguccccggcgacguggugucccugagcaucggggaccgcauccccgccgacauccggcucaccgaggucaccgaccugcugguggacgaguccagcuucaccggcgaggcggagcccugcuccaagacggacagcccgcucaccgggggcggcgaccugaccacccuguccaacaucguguucauggggacgcucguccaguacggccgcgggcagggcguggugaucggcaccggggagagcucccaguucggcgaggucuucaagaugaugcaggccgaggagacccccaagaccccccugcagaagagcauggaccggcuggggaagcagcucacgcuguucagcuucggcaucaucgggcugaucaugcucaucggcuggucccagggcaagcagcugcugagcauguucaccaucggggugucccucgccgucgccgccauccccgagggccugccgaucguggugauggucacccuggugcucggggugcugcgcauggcgaagaagcgggucaucgugaagaagcugcccaucguggagacccucggcugcugcagcguccugugcuccgacaagacggggacccugaccgccaacgagaugaccgugacgcagcuggugaccagcgacggccuccgcgccgaggucuccggcgugggguacgacggccaggggaccgugugccugcugcccagcaaggaggucaucaaggaguucuccaacgugagcgugggcaagcucgucgaggccgggugcguggccaacaacgcggugauccggaagaacgccgucaugggccagcccaccgagggcgcccugauggcccuggccaugaagauggaccucuccgacaucaagaacagcuacauccgcaagaaggagaucccguucuccagcgagcagaaguggauggcggugaagugcucccugaagacggaggaccaggaggacaucuacuucaugaagggggcccuggaggaggugauccgguacugcaccauguacaacaacggcgggaucccccucccccugaccccccagcagcgcagcuucugccugcaggaggagaagcggaugggcucccucggccugcgcguccuggcccucgccagcgggccggagcugggccggcugaccuuccucgggcuggugggcaucaucgaccccccccgcgugggggucaaggaggcggugcaggugcuguccgagagcggcgucagcgugaagaugaucacgggcgacgcccucgagaccgcccuggccaucgggcgcaacaucggccugugcaacgggaagcuccaggccauguccggcgaggagguggacagcgucgagaagggggagcuggcggaccgggugggcaagguguccgucuucuuccgcaccagccccaagcacaagcugaagaucaucaaggcccuccaggaguccggcgccaucguggccaugaccggggacggcgugaacgacgccgucgcgcugaagagcgccgacaucgggaucgccaugggccagacggggaccgacguguccaaggaggccgccaacaugauccugguggacgacgacuucagcgcgaucaugaacgccgucgaggagggcaagggcaucuucuacaacaucaagaacuucgugcgguuccagcucuccaccagcaucuccgcccugagccugaucacccucuccaccguguucaaccugccgagcccccugaacgccaugcagauccucuggaucaacaucaucauggacgggccccccgcgcagcgcuccagccagaagacggaggucugcugcaccgccgugcggcugggcguggaggggcgcggcgaguccaccugggccgggcgggccggccugggcgucgagccgguggacaaggacgccuuccgccagcccccccggagcgugcgcgacaccauccucagccgggcgcugauccugaagauccucauguccgccgccaucaucaucagcgggacgcuguucaucuucuggaaggagaugccggaggaccgcgccuccaccccccggaccaccacgaugaccuucaccugcuucgucuucuucgaccuguucaacgcccucaccugccgcagccagacgaagcugaucuucgagaucggcuuccugcggaaccacauguuccucuacuccgugcuggggagcauccugggccagcucgcggucaucuacauccccccccugcagcgcguguuccagaccgagaaccugggcgcccucgaccugcuguuccucaccgggcuggccuccagcguguucauccuguccgagcuccugaagcugugcgagaaguacugcugcagcccgaagcggguccagaugcaccccgaggacguguga

SEQ ID NO: 27042 - RNA, 3108 nt, Artificial Sequence
  derived and/or modified sequence opt1 from ATP4A__Homo_sapiens__NP_000695
augggcaaggccgagaacuacgagcuguacagcguggagcucgggcccggccccgggggcgacauggccgcgaagauguccaagaagaagaaggccgggggcggcgggggcaagcgcaaggagaagcuggagaacaugaagaaggagauggagaucaacgaccaccagcugagcgucgccgagcucgagcagaaguaccagaccuccgccaccaaggggcugagcgccucccuggcggccgagcuccugcugcgggacggccccaacgcccuccgcccgccccgggggacgccggaguacgugaaguucgcccgccagcuggcgggcggccugcagugccucauguggguggccgccgccaucugccugaucgccuucgcgauccaggccagcgagggggaccugaccaccgacgacaaccucuaccuggccaucgcccugaucgccgucgugguggucaccggcugcuucggguacuaccaggaguucaaguccacgaacaucaucgcgagcuucaagaaccucgugccccagcaggccaccgugauccgggacggcgacaaguuccagaucaacgccgaccagcuggucgugggcgaccugguggagaugaagggcggggaccgcguccccgccgacauccggauccucgccgcgcaggggugcaagguggacaacuccagccugaccggcgaguccgagccccagacccgcagcccggagugcacgcacgagagcccccuggagacccggaacaucgccuucuucagcaccaugugccucgaggggaccgugcagggccuggucgugaacacgggcgaccgcaccaucaucgggcggaucgccucccuggccagcggcguggagaacgagaagacccccaucgccaucgagaucgagcacuucgucgacaucaucgcggggcucgccauccuguucggcgccaccuucuucaucguggccaugugcaucggguacacguuccugcgcgcgaugguguucuucauggccaucgucguggccuacgugcccgagggccuccuggccaccgucaccgugugccugucccucaccgccaagcggcuggcgagcaagaacugcgucgugaagaaccuggaggccguggagacgcucggcuccaccagcgucaucugcagcgacaagaccgggacccugacgcagaaccgcaugaccgugucccaccugugguucgacaaccacauccacaccgccgacaccacggaggaccagagcggccagaccuucgaccaguccagcgagaccuggcgggcccucugccgcgugcugacccugugcaaccgggccgcguucaaguccgggcaggacgccgucccggugcccaagcgcaucgugaucggcgacgccagcgagacggcccuccugaaguucuccgagcugacccucgggaacgccaugggcuaccgggaccgcuuccccaaggucugcgagauccccuucaacagcaccaacaaguuccagcuguccauccacacccuggaggacccgcgggacccccgccaccuccuggugaugaagggcgcgcccgagcgcgugcuggagcggugcagcuccauccugaucaaggggcaggagcucccccuggacgagcaguggcgcgaggccuuccagacggccuaccugagccucggcgggcugggcgagcggguccugggcuucugccagcucuaccugaacgagaaggacuacccgcccggguacgccuucgacguggaggcgaugaacuuccccuccagcggccugugcuucgccgggcucguguccaugaucgacccgccccgcgccaccguccccgacgccgugcugaagugccggaccgccggcauccgcgugaucauggucaccggggaccaccccaucaccgcgaaggccaucgccgccagcgugggcaucaucuccgagggcagcgagacgguggaggacaucgccgcgcggcugcgcguccccguggaccaggugaaccggaaggacgcccgcgccugcgucaucaacgggaugcagcucaaggacauggacccguccgagcugguggaggcccugcggacccaccccgagaugguguucgcccgcaccagcccccagcagaagcucgucaucguggagagcugccagcggcugggcgcgaucguggccgucaccggggacggcgugaacgacuccccggcccugaagaaggccgacaucgggguggcgaugggcaucgccggcagcgacgccgccaagaacgccgcggacaugauccuccuggacgacaacuucgccuccaucgucacggggguggagcagggccgccugaucuucgacaaccucaagaaguccaucgccuacacccugaccaagaacauccccgagcugacccccuaccucaucuacaucacgguguccgucccccugccgcuggggugcaucaccauccucuucaucgagcugugcaccgacaucuuccccagcgugucccuggccuacgagaaggccgagagcgacaucaugcaccuccggccccgcaaccccaagcgggaccgccuggugaacgagccgcuggcggccuacuccuacuuccagaucggcgccauccagagcuucgccggguucaccgacuacuucacggccauggcgcaggagggcugguucccccuccugugcgucggccugcgggcccagugggaggaccaccaccuccaggaccugcaggacuccuacgggcaggaguggaccuucggccagcgccuguaccagcaguacacgugcuacaccguguucuucaucagcaucgaggugugccagaucgccgacguccucauccgcaagacccggcgccuguccgccuuccagcagggguucuuccggaacaagauccuggugaucgccaucguguuccaggucugcaucggcugcuuccucugcuacugccccgggaugcccaacaucuucaacuucaugccgauccgcuuccagugguggcuggugccccugcccuacggcauccucaucuucguguacgacgagauccggaagcugggcguccgcugcugccccgggagcuggugggaccaggagcuguacuacuga

SEQ ID NO: 27043 - RNA, 876 nt, Artificial Sequence
  derived and/or modified sequence opt1 from ATP4B__Homo_sapiens__NP_000696
auggccgcccugcaggagaagaagaccugcggccagcgcauggaggaguuccagcgguacugcuggaaccccgacaccgggcagaugcucggccgcacgcugagccgguggguguggaucucccuguacuacgucgcguucuacguggugaugaccggccucuucgcccugugccuguacguccucaugcagaccguggacccguacacccccgacuaccaggaccagcugcgcagccccggggugacgcugcggcccgacgucuacggggagaagggccucgagaucguguacaacguguccgacaaccgcaccugggccgaccugacccagacccugcacgccuuccucgccggcuacagcccggcggcccaggaggacuccaucaacugcacgagcgagcaguacuucuuccaggaguccuuccgggcccccaaccacaccaaguucagcugcaaguucaccgccgacaugcugcagaacugcuccgggcuggcggaccccaacuucggcuucgaggaggggaagcccugcuucaucaucaagaugaaccgcaucgucaaguuccucccgagcaacggcuccgcgccccggguggacugcgccuuccuggaccagccccgcgagcuggggcagccccuccaggugaaguacuacccgcccaacggcaccuucagccugcacuacuuccccuacuacggcaagaaggcccagccccacuacuccaacccgcuggucgccgccaagcuccugaacaucccccggaacgccgagguggccaucgugugcaaggucauggccgagcacgugacguucaacaacccccacgaccccuacgaggggaagguggaguucaagcugaagaucgagaaguga

SEQ ID NO: 27044 - RNA, 1662 nt, Artificial Sequence
  derived and/or modified sequence opt1 from ATP5A1__Homo_sapiens__NP_001001937
augcugagcgugcgcgucgccgccgcgguggugcgggcccucccccgccgggccggccuggucucccgcaacgcccuggggagcuccuucaucgccgcgcggaacuuccacgccagcaacacccaccuccagaagaccggcacggccgagauguccagcauccuggaggagcgcauccugggggccgacaccuccguggaccucgaggagaccggccgggugcugagcaucggggacggcaucgcgcgcguccacggccugcggaacgugcaggccgaggagaugguggaguucuccagcgggcucaagggcaugucccugaaccuggagccggacaacgucggggugguggucuucggcaacgacaagcucaucaaggagggggacaucgugaagcgcaccggcgccaucguggacguccccgugggcgaggagcugcuggggcggguggucgacgcccucggcaacgccaucgacgggaagggccccaucggcagcaagacgcgccggcgcguggggcugaaggcgcccggcaucaucccgcggaucuccgugcgcgagcccaugcagaccgggaucaaggccgucgacagccuggugcccaucggccgggggcagcgcgagcucaucaucggcgaccggcagaccggcaagaccuccaucgccaucgacacgaucaucaaccagaagcgcuucaacgacgggagcgacgagaagaagaagcuguacugcaucuacguggccaucggccagaagcgguccaccgucgcccagcuggugaagcgccucaccgacgcggacgccaugaaguacaccaucgucgugagcgccacggccuccgacgccgcgccccugcaguaccuggccccguacagcgggugcagcaugggcgaguacuuccgcgacaacgggaagcacgcccucaucaucuacgacgaccuguccaagcaggccguggccuaccggcagaugagccugcuccugcgccggccgcccggccgcgaggcguaccccggcgacgucuucuaccugcacucccggcuccuggagcgcgccgccaagaugaacgacgccuucgggggcgggagccugaccgcgcuccccgugaucgagacccaggccggcgacguguccgccuacauccccaccaacgucaucagcaucacggacgggcagaucuuccuggagaccgagcuguucuacaagggcauccggcccgccaucaacgugggccucuccgugagccgcgucggguccgccgcgcagacccgggccaugaagcaggucgccggcaccaugaagcuggagcuggcccaguaccgcgagguggccgcguucgcccaguucgggagcgaccucgacgccgccacgcagcagcugcugucccggggcgugcgccucaccgagcugcugaagcagggccaguacagccccauggccaucgaggagcaggucgcggugaucuacgccggggugcggggcuaccucgacaagcuggagccguccaagaucaccaaguucgagaacgccuuccugagccacguggugucccagcaccaggcccuccuggggaccauccgcgcggacggcaagaucagcgagcaguccgacgccaagcugaaggagaucgucacgaacuuccuggccggguucgaggccuga

SEQ ID NO: 27045 - RNA, 1590 nt, Artificial Sequence
  derived and/or modified sequence opt1 from ATP5B__Homo_sapiens__NP_001677
augcugggcuucguggggcgcgucgccgccgcgcccgccagcggcgcccuccggcgccugaccccguccgccagccugccgcccgcccagcuccugcugcgggcggcccccaccgccgugcaccccgugcgcgacuacgccgcgcagacgucccccagccccaaggccggggccgccaccggccggaucgucgccgugaucggggcgguggucgacgugcaguucgacgagggccugcccccgauccugaacgcccuggaggugcagggccgcgagacccggcucguccuggagguggcccagcaccugggggaguccaccgugcgcacgaucgccauggacggcaccgaggggcucguccggggccagaaggugcuggacagcggggcccccaucaagauccccgugggccccgagacccugggccgcaucaugaacgucaucggggagccgaucgacgagcggggccccaucaagaccaagcaguucgcgcccauccacgccgaggcccccgaguucauggagauguccguggagcaggagauccucgugacggggaucaaggucguggaccugcuggccccguacgccaagggcggcaagaucgggcuguucggcggggcgggcguggggaagaccguccucaucauggagcugaucaacaacguggccaaggcccacggcggcuacagcguguucgccggggucggcgagcgcacccgggaggggaacgaccucuaccacgagaugaucgaguccggcgugaucaaccugaaggacgccaccagcaaggucgcgcugguguacgggcagaugaacgagccgcccggcgcccgcgcccggguggcccucacgggccugaccgucgcggaguacuuccgcgaccaggaggggcaggacgugcuccucuucaucgacaacaucuuccgguucacccaggccggcuccgaggugagcgcccugcuggggcgcauccccuccgccgucggcuaccagcccacccucgccacggacauggggaccaugcaggagcggaucaccaccacgaagaagggcagcaucaccuccgugcaggcgaucuacgugcccgccgacgaccugaccgaccccgcccccgccaccacguucgcccaccuggacgcgaccaccguccucagccgcgccaucgccgagcugggcaucuacccggccguggacccccuggacuccaccagccggaucauggaccccaacaucgugggguccgagcacuacgacgucgcccgcggcgugcagaagauccuccaggacuacaagagccugcaggacaucaucgcgauccuggggauggacgagcucagcgaggaggacaagcugacggugucccgcgcccggaagauccagcgcuuccugagccagcccuuccaggucgccgagguguucaccggccacaugggcaagcucgugccgcugaaggagaccaucaagggguuccagcagauccuggccggcgaguacgaccaccuccccgagcaggcguucuacauggucgggcccaucgaggaggccguggccaaggccgacaagcuggccgaggagcacuccagcuga

SEQ ID NO: 27046 - RNA, 897 nt, Artificial Sequence
  derived and/or modified sequence opt1 from ATP5C1__Homo_sapiens__NP_001001973
auguucagccgcgccggcguggccgggcuguccgcguggacccuccagccccaguggauccagguccggaacauggccacccugaaggacaucacgcgccggcucaagagcaucaagaacauccagaagaucaccaaguccaugaagaugguggccgccgccaaguacgcgcgcgccgagcgggagcugaagccggcccgcaucuacggccuggggagccuggcccucuacgagaaggcggacaucaagggccccgaggacaagaagaagcaccuccugaucgggguguccagcgaccggggccugugcggcgccauccacuccagcaucgccaagcagaugaaguccgaggucgccacccugaccgccgcggggaaggaggugaugcuggugggcaucggggacaagauccgcggcauccucuaccggacgcacagcgaccaguuccuggucgccuucaaggagguggggcgcaagccgcccaccuucggcgacgccuccgugaucgcccuggagcuccugaacagcggcuacgaguucgacgagggguccaucaucuucaacaaguuccggagcgucaucuccuacaagaccgaggagaagcccaucuucagccugaacaccguggccuccgcggacagcauguccaucuacgacgacaucgacgccgacgugcuccagaacuaccaggaguacaaccuggccaacaucaucuacuacagccugaaggagagcacgaccuccgagcagagcgcccgcaugaccgccauggacaacgcguccaagaacgccagcgagaugaucgacaagcucacccugacguucaaccggacccgccaggccgucaucaccaaggagcugaucgagaucaucuccggcgccgccgcgcucgacuga

SEQ ID NO: 27047 - RNA, 507 nt, Artificial Sequence
  derived and/or modified sequence opt1 from ATP5D__Homo_sapiens__NP_001001975
augcugcccgccgcccuccugcgccggccgggccuggggcgccucgugcggcacgcgcgcgccuacgccgaggccgccgcggcccccgccgccgcgagcggccccaaccagauguccuucaccuucgccagccccacccaggucuucuucaacggggccaacgugcgccagguggacgucccgacgcugaccggcgccuucgggauccuggccgcgcacgugcccacccuccaggugcugcggcccggccuggucguggugcacgccgaggacggcaccacguccaaguacuucgucagcuccgggagcaucgccgugaacgccgacuccagcgugcagcuccuggccgaggaggcggucacccuggacaugcucgaccugggcgccgccaaggccaaccuggagaaggcccaggcggagcucguggggaccgccgacgaggccacccgggccgagauccagauccgcaucgaggccaacgaggcgcuggugaaggcccuggaguga

SEQ ID NO: 27048 - RNA, 156 nt, Artificial Sequence
  derived and/or modified sequence opt1 from ATP5E__Homo_sapiens__NP_008817
augguggccuacuggcgccaggccggccugagcuacauccgguacucccagaucugcgcgaaggccguccgcgacgcccucaagaccgaguucaaggccaacgccgagaagaccagcggguccaacgugaagaucgugaaggucaagaaggaguga

SEQ ID NO: 27049 - RNA, 411 nt, Artificial Sequence
  derived and/or modified sequence opt1 from ATP5G1__Homo_sapiens__NP_005166
augcagaccgccggggcccuguucaucagccccgcgcucauccgcugcugcacccgggggcugauccgcccgguguccgccagcuuccugaacucccccgucaacagcuccaagcagcccagcuacuccaacuucccccuccagguggcccggcgcgaguuccagacgagcguggucucccgggacaucgacaccgccgccaaguucaucggcgcgggggccgccaccgugggcguggccgggagcggcgcgggcaucgggaccgucuucggcucccugaucaucggguacgcccgcaacccgagccugaagcagcagcuguucuccuacgccauccucggcuucgcccugagcgaggccaugggccucuucugccugaugguggcguuccugauccucuucgccauguga

SEQ ID NO: 27050 - RNA, 474 nt, Artificial Sequence
  derived and/or modified sequence opt1 from ATP5G2__Homo_sapiens__NP_001002031
augcccgagcugauccucagcccggccaccgcgccccacccccugaagauguucgccugcuccaaguucgugagcacccccucccuggucaagagcacgucccagcuccugagccgcccgcuguccgccguggugcucaagcggcccgagauccugaccgacgagagccuguccagccucgccgucuccugcccccugaccagccugguguccagccgcuccuuccagaccagcgccaucucccgggacaucgacacggccgcgaaguucaucggcgccggggccgccaccgugggcgucgcggggagcggcgccgggaucggcaccguguucggcucccucaucaucggguacgcccgcaaccccagccugaagcagcagcuguucagcuacgccauccucggcuucgcccuguccgaggcgauggggcuguucugccucaugguggccuuccugauccuguucgccauguga

SEQ ID NO: 27051 - RNA, 429 nt, Artificial Sequence
  derived and/or modified sequence opt1 from ATP5G3__Homo_sapiens__NP_001002258
auguucgccugcgccaagcuggcgugcacccccagccucauccgcgccggcucccggguggccuaccgcccgaucagcgccuccguccugagccggcccgaggccucccgcaccggggagggcagcacgguguucaacggggcgcagaacggcgugucccagcugauccagcgggaguuccagaccagcgccaucucccgcgacaucgacaccgccgccaaguucaucggggcgggcgccgccaccgucggcguggccgggagcggcgccgggaucggcacgguguucgggucccucaucaucggcuacgcgcggaaccccagccugaagcagcagcuguucuccuacgccauccucggcuucgcccugagcgaggccauggggcuguucugccucauggucgccuuccugauccuguucgcgauguga

SEQ ID NO: 27052 - RNA, 414 nt, Artificial Sequence
  derived and/or modified sequence opt1 from ATP5H__Homo_sapiens__NP_001003785
auggccggccgcaagcuggcccucaagaccaucgacuggguggcguucgccgagaucaucccccagaaccagaaggccaucgccagcucccucaagagcuggaacgagacccugacgucccggcuggccgcgcugccggagaacccgcccgccaucgacugggccuacuacaaggccaacgucgcgaaggccgggcugguggacgacuucgagaagaaggucaagagcugcgccgagugggugucccucagcaaggcccgcaucguggaguacgagaaggagauggagaagaugaagaaccugauccccuucgaccagaugaccaucgaggaccugaacgaggccuuccccgagaccaagcucgacaagaagaaguaccccuacuggccccaccagcccaucgagaaccuguga

SEQ ID NO: 27053 - RNA, 267 nt, Artificial Sequence
  derived and/or modified sequence opt1 from ATP5J2__Homo_sapiens__NP_001003713
auggccagcgugguccccgugaaggacaagaagcugcucgaggugaagcugggcgagcugccguccuggauccucaugcgcgacuucagccccuccgggaucuucggcgccuuccagcggggguacuaccgcuacuacaacaaguacaucaacgucaagaagggcagcaucuccgggaucaccauggugcuggcgugcuacgugcuguucagcuacuccuucagcuacaagcaccucaagcacgagcggcugcgcaaguaccacuga

SEQ ID NO: 27054 - RNA, 327 nt, Artificial Sequence
  derived and/or modified sequence opt1 from ATP5J__Homo_sapiens__NP_001003696
augauccugcagcgccucuuccgguucagcuccgugauccgcagcgccgucuccgugcaccuccggcgcaacaucggcgugaccgccgucgcguucaacaaggagcuggaccccauccagaagcuguucguggacaagauccgggaguacaagagcaagcgccagaccuccgggggcccgguggacgccagcuccgaguaccagcaggagcuggagcgggagcuguucaagcucaagcagauguucgggaacgccgacaugaacacguuccccaccuucaaguucgaggaccccaaguucgaggucaucgagaagccccaggccuga

SEQ ID NO: 27055 - RNA, 312 nt, Artificial Sequence
  derived and/or modified sequence opt1 from ATP5L__Homo_sapiens__NP_006467
auggcccaguucgugcgcaaccuggucgagaagacccccgcccucgugaacgcggccgugaccuacagcaagccgcggcuggccacguucugguacuacgccaaggucgagcuggugccgcccacccccgccgagaucccccgcgcgauccagucccucaagaagaucgugaacagcgcccagaccggcuccuucaagcagcugaccgucaaggaggccgugcugaacgggcucguggccacggagguccugaugugguucuacgugggcgagaucaucgggaagcggggcaucaucggguacgacguguga

SEQ ID NO: 27056 - RNA, 642 nt, Artificial Sequence
  derived and/or modified sequence opt1 from ATP5O__Homo_sapiens__NP_001688
auggccgcccccgcggugagcggccugucccgccagguccggugcuucagcaccuccguggugcgcccguucgccaagcucguccggccgcccguccagguguacgggaucgagggccgcuacgccaccgcccuguacagcgccgcguccaagcagaacaagcuggagcaggucgagaaggagcuccugcggguggcccagauccugaaggagcccaagguggccgccagcgugcucaaccccuacgugaagcgcuccaucaaggucaagagccugaacgacaucacggcgaaggagcgguucagcccccugaccaccaaccucaucaaccugcuggccgagaacgggcgccucuccaacacccagggcgugguguccgccuucagcacgaugauguccgugcaccgcggggagguccccugcaccgugaccagcgccagcccccuggaggaggccacccuguccgagcucaagacggugcugaaguccuuccugagccagggccagguccucaagcuggaggcgaagaccgacccguccauccugggcgggaugaucgugcggaucggcgagaaguacguggacaugagcgucaagaccaagauccagaagcucgggcgggccaugcgcgagaucguguga

SEQ ID NO: 27057 - RNA, 1413 nt, Artificial Sequence
  derived and/or modified sequence opt1 from ATP6AP1__Homo_sapiens__NP_001174
augauggccgccauggcgaccgcccgcgugcggaugggcccccgcugcgcccaggcccuguggcggaugccguggcuccccgucuuccugagccuggccgcggccgccgccgcggccgccgccgagcagcaggucccccucgugcugugguccagcgaccgcgaccugugggcccccgcggccgacacccacgaggggcacaucacguccgaccuccagcugagcaccuaccuggacccggcccucgagcugggcccccggaacgugcuccucuuccugcaggacaagcuguccaucgaggacuucaccgccuacgggggcguguucgggaacaagcaggacagcgccuucuccaaccucgagaacgcgcuggaccuggcccccagcucccucgugcugcccgccgucgacugguacgccgugagcacccugacgaccuaccuccaggagaagcugggcgccuccccgcugcacguggaccucgcgacccugcgcgagcugaagcucaacgccagccugcccgcccugcuccugauccggcugcccuacaccgccuccagcggccucauggcgccccgcgagguccugacggggaacgacgaggugaucggccaggugcuguccacccucaagagcgaggacgucccguacaccgccgcccugaccgccgugcggcccucccgcguggcccgggacgucgcggugguggccgggggccuggggcgccagcuccugcagaagcagcccgucagccccgugauccacccgcccguguccuacaacgacacggcgccccggauccuguucugggcccagaacuucagcgucgccuacaaggaccagugggaggaccucacgccccugaccuucggcgugcaggagcugaaccucaccggcagcuucuggaacgacuccuucgcccgccugagccugaccuacgagcggcuguucgggaccaccgugaccuucaaguucauccuggccaaccgccuguacccggucuccgcccggcacugguucacgauggagcgccuggaggugcacagcaacggcuccgucgccuacuucaacgccagccaggugaccgggcccuccaucuacagcuuccacugcgaguacguguccagccucuccaagaagggcagccugcuggucgcgcggacccagcccucccccuggcagaugaugcuccaggacuuccagauccaggccuucaacgugaugggcgagcaguucagcuacgccuccgacugcgccagcuucuucuccccggggaucuggaugggccugcugaccagccucuucaugcuguucaucuucacguacgggcugcacaugauccucucccugaagaccauggaccgcuucgacgaccacaagggccccaccaucagccugacccagaucguguga

SEQ ID NO: 27058 - RNA, 675 nt, Artificial Sequence
  derived and/or modified sequence opt1 from ATP6AP1L__Homo_sapiens__XP_011542025
augcgccuguggaaggcccgggugcucaagcugguccugaagaccgccaaggacagccgccucggccugaacuccaaguggcugagccucaagcugggggacgcgggcaacccccggucccuggccauccgcuucauccucaccaacuacaacaagcugagcauccaguccugguucagccugcggcgcguggagaucaucuccaacaacagcauccaggccguguucaacccgacgggggucuacgcccccuccggcuacagcuaccggugccagcgcguggggucccuccagcaggaccaggcccugcugcuccccagcgacaccgacgacggcuccagccugugggaggugaccuucaucgacuuccagauccagggcuucgcgaucaagggcgggcgguucaccaaggcccaggacugcgccuccagcuucucccccgccuuccugaucgggcucgcgaugagccugauccugcuccugguccuggccuacgcccuccacaugcugaucuaccugcgcuaccucgaccagcaguacgaccugaucgccuccccggcccacuucagccagcugaaggcgcgggacacggccgaggagaaggagcuccugcgcagccagggcgccgagugcuacaagcugcggucccagcagaucagcaagaucuacguguga

SEQ ID NO: 27059 - RNA, 1053 nt, Artificial Sequence
  derived and/or modified sequence opt1 from ATP6AP2__Homo_sapiens__NP_005756
auggccguguucgucgugcugcucgcccugguggcgggcguccuggggaacgaguucagcauccucaagucccccggcagcgugguguuccgcaacgggaacuggccgauccccggcgagcggauccccgacgucgccgcccuguccaugggguucagcgugaaggaggaccuguccuggcccggccucgccgugggcaaccuguuccaccgcccgcgggccaccgucauggugauggugaagggggucaacaagcuggcgcucccgcccggcagcgugaucuccuacccccuggagaacgccgugcccuucagccuggacuccgucgccaacagcauccacucccucuucagcgaggagacccccguggugcugcagcuggcccccuccgaggagcgcgucuacaugguggggaaggcgaacagcguguucgaggaccucuccgucacgcugcggcagcugcgcaaccggcuguuccaggagaacagcgugcuguccagccugccccucaacucccugagccgcaacaacgagguggaccuccucuuccugagcgagcugcagguccuccacgacaucuccagccugcugucccggcacaagcaccucgccaaggaccacagcccggaccuguacucccuggagcucgccggccuggacgagaucgggaagcgcuacggcgaggacagcgagcaguuccgggacgccuccaagauccugguggacgcccuccagaaguucgcggacgacauguacagccuguacggcgggaacgccgucguggagcuggugaccgucaaguccuucgacaccagccucauccgcaagacccggacgauccuggaggccaagcaggccaagaaccccgccucccccuacaaccuggcguacaaguacaacuucgaguacagcgugguguucaacaugguccucuggaucaugaucgcccuggcccuggccgugaucaucaccuccuacaacaucuggaacauggaccccggcuacgacagcaucaucuaccgcaugaccaaccagaagauccggauggacuga

SEQ ID NO: 27060 - RNA, 2517 nt, Artificial Sequence
  derived and/or modified sequence opt1 from ATP6V0A1__Homo_sapiens__NP_001123492
augggcgagcuguuccgcagcgaggagaugacccucgcccagcuguuccugcaguccgaggccgcguacugcugcgugagcgagcucggggagcugggcaagguccaguuccgggaccugaaccccgacgugaacguguuccagcgcaaguucgucaacgaggugcggcgcugcgaggagauggaccggaagcuccgcuucguggagaaggagauccggaaggccaacaucccgaucauggacaccggggagaaccccgagguccccuucccccgcgacaugaucgaccuggaggccaacuucgagaagaucgagaacgagcugaaggagaucaacacgaaccaggaggcccucaagcggaacuuccuggagcugaccgagcucaaguucauccugcgcaagacccagcaguucuucgacgaggccgagcugcaccaccagcagauggcggacccggaccuccuggaggaguccagcucccugcucgagcccagcgagaugggccgggggacgccccugcgccugggcuucguggccggcgugaucaaccgggagcgcauccccaccuucgagcggaugcucuggcgcgucugccgggggaacguguuccugcgccaggccgagaucgagaacccgcuggaggaccccgugaccggcgacuacguccacaaguccguguucaucaucuucuuccagggggaccagcucaagaaccgggugaagaagaucugcgagggcuuccgcgccagccuguaccccugccccgagaccccgcaggagcggaaggagauggcguccggggucaacacccgcaucgacgaccugcagauggugcucaaccagacggaggaccaccgccagcgggugcugcaggccgccgccaagaacauccgcgucugguucaucaaggugcggaagaugaaggccaucuaccacacccugaaccucugcaacaucgacgugacccagaagugccugaucgcggaggucuggugccccgugaccgaccuggacagcauccaguucgcccuccgccggggcacggagcacuccggcagcaccgugcccuccauccugaaccgcaugcagaccaaccagacgcccccgaccuacaacaagaccaacaaguucaccuacggguuccagaacaucgucgacgccuacggcaucgggaccuaccgggagaucaaccccgcccccuacacgaucaucaccuuccccuuccuguucgccgugauguucggcgacuucggccacgggauccucaugacccuguucgcggucuggauggugcugcgcgagagccggauccucucccagaagaacgagaacgagauguucagcaccguguucuccggccgcuacaucauccugcugaugggggucuucagcauguacacgggccucaucuacaacgacugcuucuccaagagccugaacaucuucgggagcuccuggagcgugcggccgauguucaccuacaacuggaccgaggagacccugcgcggcaaccccgugcuccagcugaaccccgcccugcccggcgucuucgggggcccguaccccuucgggaucgaccccaucuggaacaucgccacgaacaagcucaccuuccugaacuccuucaagaugaagaugagcgugauccugggcaucauccacaugcuguucggggugucccucagccuguucaaccacaucuacuucaagaagccccugaacaucuacuucggcuucaucccggagaucaucuucaugaccucccucuucggcuaccuggucauccugaucuucuacaaguggaccgccuacgacgcccacacgagcgagaacgcgcccucccuccugauccacuucaucaacauguuccuguucagcuaccccgaguccggguacagcaugcucuacuccggccagaaggggauccagugcuuccuggugguggucgcccugcucugcgugccguggaugcugcuguucaagccccucgugcugcggcgccaguaccugcggcgcaagcaccucggcacccugaacuucgggggcauccgggucggcaacgggcccaccgaggaggacgccgagaucauccagcacgaccagcugagcacccacuccgaggacgccgacgaguucgacuucggcgacacgauggugcaccaggccauccacaccaucgaguacugccucgggugcaucagcaacaccgcguccuaccugcgccugugggcccucagccuggcccacgcccagcuguccgaggugcucuggaccauggucauccacaucggccugagcgucaagagccuggcgggcgggcucgugcuguucuucuucuucaccgccuucgccacgcugaccguggccauccuccugaucauggagggccuguccgccuuccuccacgcgcugcggcugcacuggguggaguuccagaacaaguucuacagcgggaccggcuucaaguuccuccccuucuccuucgagcacauccgcgaggggaaguucgaggaguga

SEQ ID NO: 27061 - RNA, 2571 nt, Artificial Sequence
  derived and/or modified sequence opt1 from ATP6V0A2__Homo_sapiens__NP_036595
augggcagccuguuccgcuccgagaccaugugccucgcccagcuguuccugcagagcgggaccgccuacgagugccucuccgcgcugggcgagaaggggcuggugcaguuccgggaccucaaccagaacgucagcuccuuccagcgcaaguucgugggcgaggugaagcggugcgaggagcuggagcgcauccuggucuaccucgugcaggagaucaaccgggccgacaucccccugccggagggggaggccagcccgcccgccccgccccugaagcagguccucgagaugcaggagcagcugcagaagcuggagguggagcuccgcgaggugacgaagaacaaggagaagcugcggaagaaccugcucgagcugaucgaguacacccacaugcugcgcgugaccaagaccuucgucaagcggaacguggaguucgagcccacguacgaggaguuccccucccucgagagcgacucccugcuggacuacagcugcaugcagcgccucggcgccaagcugggcuucguguccgggcugaucaaccagggcaaggucgaggcguucgagaagaugcucuggcgggugugcaagggguacaccaucgugagcuacgccgagcuggacgagucccuggaggaccccgagaccggcgaggucaucaagugguacguguuccucaucagcuucuggggcgagcagaucgggcacaaggugaagaagaucugcgacugcuaccacugccacgucuaccccuaccccaacaccgccgaggagcgccgggagauccaggagggccugaacacgcgcauccaggaccuguacaccgugcuccacaagaccgaggacuaccugcgccaggugcugugcaaggccgcggaguccgucuacagccgggugauccaggugaagaagaugaaggccaucuaccacaugcucaacaugugcuccuucgacgucaccaacaagugccugaucgccgagguguggugccccgaggccgaccugcaggaccuccggcgcgcccuggaggaggggagccgggaguccggcgcgacgauccccagcuucaugaacaucaucccgaccaaggagaccccgcccacccgcauccggacgaacaaguucaccgagggguuccagaacaucgucgacgccuacggcgugggcagcuaccgcgaggugaaccccgcccuguucaccaucaucaccuuccccuuccucuucgccgucauguucggggacuucggccacggguucgugauguuccuguucgcccugcuccuggugcugaacgagaaccacccccgccucaaccagucccaggagaucaugcggauguucuucaacggccgcuacauccugcugcugauggggcuguucagcgucuacacgggccugaucuacaacgacugcuucuccaagagcgugaaccuguucggcuccggguggaacgugagcgcgauguacuccagcucccacccgcccgccgagcacaagaagaugguccucuggaacgacagcguggugcggcacaacuccauccugcagcuggaccccagcauccccggcgucuuccgcgggcccuacccccucggcaucgacccgaucuggaaccuggccaccaaccggcugaccuuccucaacuccuucaagaugaagaugagcgugauccuggggaucauccacaugaccuucggcgugauccugggcaucuucaaccaccuccacuuccgcaagaaguucaacaucuaccuggucuccauccccgagcuccucuucaugcugugcaucuucggguaccugaucuucaugaucuucuacaaguggcucguguucagcgccgagacgucccggguggcccccagcauccugaucgaguucaucaacauguuccuguuccccgcguccaagaccagcggccucuacaccgggcaggaguacguccagcgcgugcugcugguggucaccgcccucagcgugccggugcuguuccugggcaagccccucuuccugcuguggcuccacaacgggcgguccugcuucggcgucaaccgcagcggcuacacgcugauccggaaggacuccgaggaggaggugagccugcucgggucccaggacaucgaggagggcaaccaccagguggaggacgggugccgcgagauggccugcgaggaguucaacuucggcgagauccugaugacccaggucauccacagcaucgaguacugccugggcugcaucuccaacaccgccagcuaccuccggcugugggcccugucccucgcgcacgcccagcugagcgacgugcugugggccaugcucaugcgcguggggcugcgggucgacaccacguacggcgugcugcuccugcugcccgugaucgcccucuucgcgguccugaccaucuucauccugcucaucauggaggggcuguccgccuuccugcacgccauccgccuccacuggguggaguuccagaacaaguucuacgugggcgccgggaccaaguucgucccguucagcuucucccugcugagcuccaaguucaacaacgacgacagcguggccuga

SEQ ID NO: 27062 - RNA, 2523 nt, Artificial Sequence
  derived and/or modified sequence opt1 from ATP6V0A4__Homo_sapiens__XP_005250451
auggugagcgucuuccgcuccgaggagaugugccugagccagcucuuccugcagguggaggccgccuacugcugcguggcggagcugggcgagcucgggcugguccaguucaaggaccugaacaugaacgugaacuccuuccagcggaaguucgugaacgagguccgccggugcgagagccucgagcgcauccugcgguuccuggaggacgagaugcagaacgagaucguggugcagcuccuggagaaguccccccugaccccgcucccccgcgagaugaucacccuggagacgguccuggagaagcucgagggcgagcugcaggaggccaaccagaaccagcaggcccugaagcagagcuuccucgagcugaccgagcugaaguaccuccugaagaagacccaggacuucuucgagaccgagacgaaccuggccgacgacuucuucaccgaggacaccuccgggcuccuggagcugaaggccgugcccgcguacaugaccggcaagcucggguucaucgccggcgugaucaaccgggagcgcauggccagcuucgagcggcugcuguggcgcaucugccggggcaacgucuaccucaaguucuccgagauggacgccccccuggaggacccggugacgaaggaggagauccagaagaacaucuucaucaucuucuaccagggggagcagcugcgccagaagaucaagaagaucugcgacggcuuccgggcgaccguguaccccugccccgagcccgccgucgagcgccgggagaugcucgagagcgugaacgugcgccuggaggaccugaucaccgucaucacccagacggagucccaccggcagcgccuccugcaggaggccgccgccaacuggcacagcuggcugaucaaggugcagaagaugaaggcgguguaccacauccucaacaugugcaacaucgacgucacccagcagugcgugaucgccgagaucugguucccgguggccgacgccacccggaucaagcgcgcccuggagcaggggauggagcuguccggcagcuccauggcgcccaucaugaccacgguccagagcaagaccgccccccccaccuucaaccggaccaacaaguucacggccggguuccagaacaucguggacgccuacggcgucggcuccuaccgcgagaucaacccggcccccuacaccaucaucaccuuccccuuccucuucgcggugauguucggggacugcggccacgggaccgugaugcugcuggccgcccucuggaugauccugaacgagcgccggcugcucagccagaagacggacaacgagaucuggaacaccuucuuccacggccgcuaccugauccugcugaugggcaucuucuccaucuacaccgggcucaucuacaacgacugcuucagcaagagccugaacaucuucggcuccagcugguccguccagcccauguuccggaacgggaccuggaacacgcacgugauggaggagagccuguaccuccagcuggacccggccauccccggcguguacuucgggaaccccuaccccuucggcaucgacccgaucuggaaccuggccuccaacaagcucaccuuccugaacagcuacaagaugaagauguccgucauccugggcaucgugcagaugguguucggggucauccucagccuguucaaccacaucuacuuccgccggacccugaacaucauccuccaguucauccccgagaugaucuucauccugugccuguucggcuaccucguguucaugaucaucuucaaguggugcugcuucgacgugcacgucucccagcacgcgcccagcauccugauccacuucaucaacauguuccuguucaacuacuccgacagcuccaacgccccccucuacaagcaccagcaggaggugcagagcuucuucguggucauggcccugaucuccgugccguggaugcugcucaucaagcccuucauccugcgcgccagccaccggaagucccagcugcaggcgagccgcauccaggaggacgccaccgagaacaucgagggggacuccagcagccccuccagccgguccggccagcgcacgagcgccgacacccacggggcccucgacgaccacggcgaggaguucaacuucggcgacguguucguccaccaggccauccacaccaucgaguacugccuggggugcaucuccaacaccgcgagcuaccugcggcucugggcccugucccuggcccacgcccagcucagcgaggugcuguggacgauggugaugaacuccggccugcagacccgcggguggggcgggaucgucggcguguucaucaucuucgccguguucgcgguccucaccguggccauccugcugaucauggagggccucagcgccuuccugcacgcccugcggcuccacuggguggaguuccagaacaaguucuacgucggggacggcuacaaguucucccccuucagcuucaagcacauccuggacgggaccgccgaggaguga

SEQ ID NO: 27063 - RNA, 468 nt, Artificial Sequence
  derived and/or modified sequence opt1 from ATP6V0C__Homo_sapiens__NP_001185498
augagcgaguccaagagcggccccgaguacgccuccuucuucgccgugaugggggcgagcgccgccauggucuucuccgcccugggcgccgcguacgggaccgccaagagcggcaccgggaucgccgccauguccgugaugcgcccggagcagaucaugaaguccaucauccccguggucauggcgggcaucaucgccaucuacggccucgugguggccguccugaucgccaacagccugaacgacgacaucagccucuacaaguccuuccugcagcugggggccggccucagcguggggcuguccggccuggcggccggguucgccaucggcaucgugggcgacgccgggguccggggcacggcccagcagccccgccucuucguggggaugauccugauccugaucuucgcggaggugcucggccuguacggccugaucgucgcccucauccugagcaccaaguga

SEQ ID NO: 27064 - RNA, 1056 nt, Artificial Sequence
  derived and/or modified sequence opt1 from ATP6V0D1__Homo_sapiens__NP_004682
augagcuucuuccccgagcuguacuucaacguggacaacggcuaccucgaggggcugguccgcggccugaaggccggggugcucucccaggccgacuaccugaaccuggugcagugcgagacccucgaggaccugaagcugcaccuccagagcaccgacuacggcaacuuccuggcgaacgaggccuccccgcugacggucagcgugaucgacgaccggcucaaggagaagaugguggucgaguuccgccacaugcggaaccacgccuacgagccccuggccuccuuccuggacuucaucaccuacagcuacaugaucgacaacgugauccuccugaucaccgggacccugcaccagcgcuccaucgccgagcucgugcccaagugccacccccugggcagcuucgagcagauggaggcggucaacaucgcccagacgccggccgagcuguacaacgccauccucguggacacgccccuggcggccuucuuccaggacugcaucuccgagcaggaccuggacgagaugaacaucgagaucauccggaacacccucuacaaggccuaccuggagagcuucuacaaguucugcacccugcucggcgggaccaccgccgacgccaugugccccauccuggaguucgaggcggaccgccgggccuucaucaucaccaucaacuccuucggcaccgagcugagcaaggaggaccgcgccaagcuguucccccacugcgggcggcucuacccggagggccuggcccagcucgcccgcgcggacgacuacgagcaggucaagaacguggccgacuacuaccccgaguacaagcugcuguucgagggggccggcuccaaccccggcgacaagacgcucgaggaccgguucuucgagcacgaggugaagcugaacaagcuggccuuccucaaccaguuccacuucgggguguucuacgccuucgucaagcugaaggagcaggagugccgcaacaucguguggaucgcggagugcaucgcccagcggcaccgcgccaagaucgacaacuacauccccaucuucuga

SEQ ID NO: 27065 - RNA, 246 nt, Artificial Sequence
  derived and/or modified sequence opt1 from ATP6V0E1__Homo_sapiens__NP_003936
auggccuaccacggccugaccgugccccucaucgucaugagcguguucuggggguucgugggcuuccuggucccgugguucauccccaaggggcccaaccgcggcgugaucaucaccaugcuggugacgugcuccgucugcugcuaccucuucuggcugaucgccauccuggcgcagcucaacccccuguucgggccgcagcugaagaacgagaccaucugguaccucaaguaccacuggcccuga

SEQ ID NO: 27066 - RNA, 642 nt, Artificial Sequence
  derived and/or modified sequence opt1 from ATP6V0E2__Homo_sapiens__NP_001094062
augcgcgugcggggccccgcccgccugaucgccagcggggcccggcuccugcugcgcaugcucuccgcccugccgggcugggggcccgcccaccuccagcggccccugcugggccccgccagcugccuggggauccuccgcccggccaugaccgcgcacuccuucgcccugcccgucaucaucuucaccacguucuggggccuggugggcaucgccgggcccugguucgugcccaagggcccgaaccgcggggucaucaucaccaugcucguggccaccgcggugugcugcuaccugcugugccccgcccucggcaugaccgucgcgccccugagccugacgacccccuccagcgggccgucccccacccagcucugccuggugaccagcucccugcuccuggcgccccgggaccccgacccgcagggccugcccggcagcuggaaguccagccaguccagccagcccgcccgggcccucgggucccccggccacagcuccgggcgcggcgacgugcugcugcaguacccgcacugcagcggcgucugcccccucucccagggggacgccgccggcgagcugguguggguggggagcuucccccugcagacgggccagaugcccgggcucagcccguccuga

SEQ ID NO: 27067 - RNA, 1542 nt, Artificial Sequence
  derived and/or modified sequence opt1 from ATP6V1B1__Homo_sapiens__NP_001683
auggccauggagaucgacagccgccccggcgggcugccgggcuccagcugcaaccucggggccgcgcgggagcacaugcaggccgugacccgcaacuacaucacccacccccgggucacguaccgcaccgugugcuccgugaacggcccccuggucgugcuggaccgggugaaguucgcccaguacgccgagaucguccacuucacccuccccgacgggacccagcgcagcggccaggugcuggagguggccggcacgaaggcgaucguccagguguucgaggggaccuccggcaucgacgcccggaagacgaccugcgaguucaccggggacauccugcgcaccccggugagcgaggacaugcucggccgggucuucaacggguccggcaagcccaucgacaagggccccguggugauggccgaggacuuccuggacaucaacgggcagcccaucaacccgcacagccgcaucuaccccgaggagaugauccagaccggcaucucccccaucgacgucaugaacagcaucgcccgggggcagaagauccccaucuucuccgcggccggccugccgcacaacgagaucgccgcccagaucugccgccaggccggccucgugaagaaguccaaggcggugcuggacuaccacgacgacaacuucgccaucgucuucgccgccaugggggugaacauggagaccgcccgguucuucaagagcgacuucgagcagaacggcacgauggggaacgugugccuguuccucaaccuggcgaacgaccccaccaucgagcgcaucaucacgccccggcuggcccucaccaccgccgaguuccuggccuaccagugcgagaagcacguccuggugauccucaccgacaugagcuccuacgccgaggcgcugcgcgaggugagcgccgcccgggaggagguccccggccgccggggguucccgggcuacauguacaccgaccuggccaccaucuacgagcgcgccggccggguggaggggcgcggcggguccaucacgcagauccccauccucaccaugcccaacgacgacaucacccaccccaucccggaccugaccggcuucaucacggaggggcagaucuacgucgaccgccagcugcacaaccggcagaucuacccgcccaucaacgugcuccccagccugucccgccugaugaaguccgcgaucggcgagggcaugacccggaaggaccacggggacgugagcaaccagcucuacgccugcuacgccaucggcaaggacguccaggccaugaaggcgguggugggggaggaggcccugaccagcgaggaccugcucuaccuggaguuccugcagaaguucgagaagaacuucaucaaccagggccccuacgagaaccgcagcgucuucgagucccucgaccugggguggaagcugcuccggaucuuccccaaggagaugcugaagcgcaucccccaggccgugaucgacgaguucuacagccgggagggcgcccugcaggaccucgcccccgacaccgcgcuguga

SEQ ID NO: 27068 - RNA, 1536 nt, Artificial Sequence
  derived and/or modified sequence opt1 from ATP6V1B2__Homo_sapiens__NP_001684
auggcccugcgcgccaugcggggcaucgugaacggggcggcccccgagcucccgguccccaccggcgggcccgccgugggcgcccgcgagcaggcccuggcggugagccggaacuaccugucccagccccgccucaccuacaagacggucagcggggugaacggcccgcuggugauccuggaccacgucaaguucccccgguacgccgagaucgugcaccucacccugcccgacggcaccaagcgcuccggccaggugcuggaggucagcggguccaaggccguggugcaggucuucgaggggaccagcggcaucgacgccaagaagacguccugcgaguucaccggggacauccuccggacccccgugagcgaggacaugcugggccgcguguucaacggcuccgggaagccgaucgaccggggccccgucgugcuggcggaggacuuccucgacaucauggggcagcccaucaacccccagugccgcaucuacccggaggagaugauccagaccggcaucagcgccaucgacggcaugaacuccaucgcccgggggcagaagauccccaucuucagcgccgccggccugccccacaacgagaucgcggcccagaucugccgccaggccgggcuggugaagaaguccaaggacgucguggacuacagcgaggagaacuucgccaucguguucgccgcgaugggcgucaacauggagacggcccgguucuucaaguccgacuucgaggagaacgggagcauggacaacgugugccucuuccugaaccuggccaacgaccccaccaucgagcgcaucaucaccccgcggcucgcccugaccacggccgaguuccuggcguaccagugcgagaagcacgugcucgucauccugaccgacauguccagcuacgccgaggcccugcgcgagguguccgccgcccgggaggagguccccggccgccggggcuuccccggguacauguacaccgaccucgcgaccaucuacgagcgcgccggccggguggaggggcgcaacggcagcaucacgcagauccccauccugaccaugccgaacgacgacaucacccaccccauccccgaccugaccggguacaucacggagggccagaucuacguggaccgccagcuccacaaccggcagaucuacccgcccaucaacguccugcccagccugucccgccucaugaaguccgccaucggcgaggggaugacccggaaggaccacgccgacgugagcaaccagcuguacgcgugcuacgccaucggcaaggacgugcaggccaugaaggccgucgugggggaggaggcccugaccagcgacgaccuccuguaccuggaguuccuccagaaguucgagcgcaacuucaucgcgcagggccccuacgagaaccggaccguguucgagacgcuggacaucggguggcagcugcuccgcaucuuccccaaggagaugcugaagcggaucccgcaguccacccugagcgaguucuacccccgcgacuccgccaagcacuga

SEQ ID NO: 27069 - RNA, 1149 nt, Artificial Sequence
  derived and/or modified sequence opt1 from ATP6V1C1__Homo_sapiens__NP_001686
augaccgaguucuggcugaucagcgcccccggcgagaagaccugccagcagacgugggagaagcuccacgccgcgaccuccaagaacaacaaccuggccgugaccagcaaguucaacaucccggaccugaaggucgggacccucgacgugcuggugggccuguccgacgagcucgccaagcuggacgccuucgucgaggggguggugaagaaggucgcccaguacauggcggacgugcuggaggacagcaaggacaaggugcaggagaaccuccuggccaacggcgucgaccuggugacguacaucacccgcuuccagugggacauggccaaguaccccaucaagcagucccucaagaacaucagcgagaucaucgccaagggggugacccagaucgacaacgaccugaagucccgggcgagcgccuacaacaaccugaagggcaaccuccagaaccuggagcgcaagaacgccggcucccugcucacccggagccuggccgagaucgucaagaaggacgacuucgugcuggacuccgaguaccucgugacgcugcuggucguggugcccaagcucaaccacaacgacuggaucaagcaguacgagacccuggccgagauggucgugccccgcagcuccaacgugcugagcgaggaccaggacuccuaccucugcaacgucacccuguuccggaaggcgguggacgacuuccgccacaaggcccgggagaacaaguucaucgugcgcgacuuccaguacaacgaggaggagaugaaggccgacaaggaggagaugaaccggcugagcaccgacaagaagaagcaguucgggccgcucguccgcuggcugaaggugaacuucuccgaggccuucaucgccuggauccacgucaaggcgcugcggguguucguggagagcguccuccgcuacggccugcccgugaacuuccaggccaugcugcuccagcccaacaagaagacgcugaagaagcugcgggaggugcuccacgagcuguacaagcaccuggacuccagcgccgccgccaucaucgacgcgcccauggacaucccggggcucaaccugagccagcaggaguacuaccccuacgucuacuacaagaucgacugcaaccugcucgaguucaaguga

SEQ ID NO: 27070 - RNA, 744 nt, Artificial Sequence
  derived and/or modified sequence opt1 from ATP6V1D__Homo_sapiens__NP_057078
augagcggcaaggaccgcaucgagaucuuccccagccggauggcccagaccaucaugaaggcccgccugaagggggcgcagaccggccggaaccuccugaagaagaaguccgacgcccugacgcuccgcuuccggcagauccugaagaagaucaucgagaccaagaugcugaugggggaggugaugcgcgaggccgccuucagccucgccgaggcgaaguucaccgccggcgacuucagcaccacggucauccagaacgugaacaaggcccaggugaagauccgggccaagaaggacaacgucgcgggggugacccugccgguguucgagcacuaccacgagggcaccgacuccuacgagcugaccggccucgcccgcgggggcgagcagcuggccaagcugaagcggaacuacgccaaggccgucgagcuccugguggagcuggcgagccuccagacguccuucgugacccuggacgaggccaucaagaucaccaaccgccgggucaacgccaucgagcacgugaucaucccccgcaucgagcggacccuggccuacaucaucacggagcucgacgagcgcgagcgggaggaguucuaccgccugaagaagauccaggagaagaagaagauccugaaggagaaguccgagaaggaccucgagcagcggcgcgccgcgggggaggugcuggagcccgccaaccugcucgccgaggagaaggacgaggaccugcuguucgaguga

SEQ ID NO: 27071 - RNA, 615 nt, Artificial Sequence
  derived and/or modified sequence opt1 from ATP6V1E1__Homo_sapiens__NP_001034455
auggcccugagcgacgccgacgugcagaagcaggcggaggaggaguucaacaucgagaagggccgccucguccagacccagcggcugaagaucauggaguacuacgagaagaaggagaagcagaucgagcagcagaagaagauccagauguccaaccugaugaaccaggcccgccucaaggugcugcgggcccgcgacgaccugaucaccgaccuccugaacgaggccaagcagcggcugagcaagguggucaaggacacgacccgcuaccaggugcuccuggacgggcuggugcuccagggccuguaccagcugcucgagccccggaugaucguccgcugccggaagcaggacuucccgcuggugaaggccgcggugcagaaggccauccccauguacaagaucgccaccaagaacgacgucgacgugcagaucgaccaggaguccuaccugcccgaggacaucgccgggggcguggagaucuacaacggggaccgcaagaucaaggucagcaacacccucgagucccggcuggaccugaucgcgcagcagaugaugcccgaggugcgcggcgcccucuucggcgccaacgccaaccggaaguuccuggacuga

SEQ ID NO: 27072 - RNA, 444 nt, Artificial Sequence
  derived and/or modified sequence opt1 from ATP6V1F__Homo_sapiens__NP_001185838
auggccggccgcgggaagcugaucgccgugaucggcgacgaggacaccgucaccggguuccuccugggcgggaucggcgagcugaacaagaaccggcaccccaacuuccucgugguggagaaggacacgaccaucaacgagaucgaggacaccuuccgcagccugggcucccugccggggagcgucguggaggcgaaccccaaccagcgggacccgccccucugggacgagaucgacucccgccaguuccugaaccgggacgacaucggcaucauccugaucaaccaguacaucgccgagauggugcgccacgcccucgacgcccaccagcagagcauccccgccguccuggagauccccuccaaggagcaccccuacgacgcggccaaggacagcauccugcggcgcgcccgggggauguucaccgccgaggaccuccgcuga

SEQ ID NO: 27073 - RNA, 357 nt, Artificial Sequence
  derived and/or modified sequence opt1 from ATP6V1G1__Homo_sapiens__NP_004879
auggccagccagucccagggcauccagcagcugcuccaggccgagaagcgcgcggccgagaaggugagcgaggcccggaagcgcaagaaccggcgccugaagcaggccaaggaggaggcccaggcggagaucgagcaguaccggcugcagcgcgagaaggaguucaaggccaaggaggccgccgcgcucgggucccggggcagcugcuccaccgaggucgagaaggagacccaggagaagaugacgauccugcagaccuacuuccgccagaaccgggacgaggugcuggacaaccuccuggccuucgugugcgacauccgccccgagauccacgagaacuaccggaucaacggguga

SEQ ID NO: 27074 - RNA, 237 nt, Artificial Sequence
  derived and/or modified sequence opt1 from ATP6V1G2__Homo_sapiens__NP_001191007
auggccagccagucccagggcauccagcagcugcuccaggccgagaagcgcgcggccgagaagguggccgacgcccggaagcgcaaggcccggcgccugaagcaggcgacccggcgccagguccaggggaugcagagcucccagcagcggaaccgcgagcgggugcuggcccagcuccugggcauggugugcgacguccgcccccaggugcacccgaacuaccggaucagcgccuga

SEQ ID NO: 27075 - RNA, 357 nt, Artificial Sequence
  derived and/or modified sequence opt1 from ATP6V1G3__Homo_sapiens__XP_006725021
augaccagccagucccagggcauccaccagcugcuccaggccgagaagcgcgccaaggacaagcuggaggaggcgaagaagcggaaggggaagcgccugaagcaggccaaggaggaggccaugguggagaucgaccaguaccggaugcagcgcgacaaggaguuccggcucaagcagagcaagaucaugggcucccagaacaaccugagcgacgagaucgaggagcagacccuggggaagauccaggagcucaacggccacuacaacaaguacauggaguccgucaugaaccagcugcugagcauggugugcgacaugaagcccgagauccacgugaacuaccgcgccacgaacuga

SEQ ID NO: 27076 - RNA, 4503 nt, Artificial Sequence
  derived and/or modified sequence opt1 from ATP7A__Homo_sapiens__NP_000043
auggaccccagcaugggcgugaacuccgucaccaucagcguggaggggaugaccugcaacuccugcguguggacgaucgagcagcagaucggcaaggucaacggggugcaccacaucaaggugagccuggaggagaagaacgccaccaucaucuacgacccgaagcuccagacccccaagacccugcaggaggccaucgacgacaugggcuucgacgcggucauccacaaccccgacccccugccggugcucacggacacccuguuccugaccgugaccgccucccucacgcugcccugggaccacauccagagcacccugcucaagaccaagggggucaccgacaucaagaucuacccccagaagcgcacgguggccgugaccaucauccccuccaucgucaacgccaaccagaucaaggagcuggugccggagcugagccucgacaccggcacccuggagaagaaguccggcgccugcgaggaccacagcauggcgcaggccggggaggugguccugaagaugaagguggagggcaugacgugccacuccugcaccagcaccaucgaggggaagaucggcaagcuccagggggugcagcggaucaaggucucccuggacaaccaggaggccaccaucguguaccagccccaccugaucagcguggaggagaugaagaagcagaucgaggccaugggcuuccccgcguucgucaagaagcagcccaaguaccucaagcugggcgccaucgacguggagcgccugaagaacacgccggugaaguccagcgaggggucccagcagcggagccccuccuacaccaacgacagcaccgccaccuucaucaucgacggcaugcacugcaagagcugcgucuccaacaucgagagcacgcucuccgcccugcaguacgugagcuccaucgucgugagccuggagaaccgcuccgccaucgugaaguacaacgcgagcuccgucacccccgagagccuccggaaggccaucgaggccgugucccccgggcuguaccgcgugagcaucaccuccgaggucgagagcaccuccaacagcccguccagcuccagccugcagaagaucccccucaacguggugagccagccccugacgcaggagaccgucaucaacaucgacggcaugaccugcaacuccugcgugcagagcaucgagggcgugaucuccaagaagcccggggucaagagcauccgggugucccuggccaacagcaacggcaccguggaguacgacccgcuccugacgucccccgagacccugcgcggggccaucgaggacaugggcuucgacgcgacccucagcgacaccaacgagccccuggucgugaucgcccagcccuccagcgagaugccgcugcucacguccaccaacgaguucuacaccaaggggaugacccccgugcaggacaaggaggagggcaagaacagcuccaagugcuacauccaggucaccggcaugacgugcgccagcugcguggccaacaucgagcggaaccugcgccgggaggaggggaucuacuccauccugguggcccucauggcgggcaaggccgagguccgcuacaaccccgccgugauccagcccccgaugaucgccgaguucauccgggagcugggguucggcgccaccgugaucgagaacgcggacgagggggacggcguccuggagcucguggugcgcggcaugaccugcgccagcugcguccacaagaucgaguccagccugaccaagcaccgggggauccuguacugcagcguggcccucgccacgaacaaggcgcacaucaaguacgaccccgagaucaucggcccccgcgacaucauccacaccaucgagucccugggguucgaggccagccuggugaagaaggaccgguccgccagccaccucgaccacaagcgcgagauccggcaguggcgccgguccuuccuggucagccuguucuucugcaucccggugaugggccugaugaucuacaugauggugauggaccaccacuucgccacccuccaccacaaccagaacauguccaaggaggagaugaucaaccugcacagcuccauguuccuggagcgccagauccuccccgggcugagcgucaugaaccugcucuccuuccugcugugcgugcccgugcaguucuucggcggcugguacuucuacauccaggccuacaaggcgcucaagcacaagaccgccaacauggacguccugaucgugcuggccacgaccaucgccuucgccuacagccucaucauccugcugguggcgauguacgagcgcgccaaggucaaccccaucaccuucuucgacaccccgcccaugcuguucguguucaucgcccucgggcgguggcuggagcacaucgccaagggcaagacguccgaggcccucgcgaagcugaucagccugcaggccaccgaggccaccaucgugacccucgacuccgacaacauccugcugagcgaggagcaggucgacguggagcucgugcagcgcggggacaucaucaaggucgugcccggcggcaaguuccccguggacgggcgggucaucgagggccacuccaugguggacgagagccugaucacgggggaggccaugccgguggcgaagaagcccggcuccaccgucaucgccgggagcaucaaccagaacggcagccugcucaucugcgccacccacgugggcgccgacaccacgcugucccagaucgucaagcugguggaggaggcccagaccagcaaggcgcccauccagcaguucgccgacaagcucuccggguacuucgugcccuucaucgucuucgugagcaucgccacccugcugguguggaucgucaucggcuuccucaacuucgagaucguggagaccuacuucccgggguacaaccgcuccaucagccggacggagaccaucauccgcuucgccuuccaggccuccaucaccgugcugugcaucgcgugccccugcagccugggccucgccacccccacggccgucaugguggggaccggcgugggcgcccagaacgggauccugaucaagggcggggagccccuggagauggcccacaaggucaaggugguggucuucgacaagaccggcaccaucacgcacgggaccccgguggugaaccaggucaaggugcucaccgaguccaaccggaucagccaccacaagauccuggcgaucgugggcaccgccgaguccaacagcgagcacccccugggcacggccaucaccaaguacugcaagcaggagcucgacaccgagacccuggggaccugcaucgacuuccaggucgugcccggcugcgggaucuccugcaaggugacgaacaucgagggccugcuccacaagaacaacuggaacaucgaggacaacaacaucaagaacgccagccugguccagaucgacgcguccaacgagcagagcuccaccagcuccagcaugaucaucgacgcccagaucagcaacgcccugaacgcccagcaguacaaggugcucaucgggaaccgcgaguggaugauccggaacggccuggugaucaacaacgacgucaacgacuucaugaccgagcacgagcgcaagggccggaccgccgugcugguggcggucgacgacgagcucugcgggcugaucgccaucgccgacacggugaagcccgaggccgagcuggccauccacauccucaaguccaugggccuggaggugguccugaugaccggggacaacagcaagaccgcgcgcuccaucgccagccaggugggcaucaccaagguguucgccgagguccucccgucccacaagguggccaaggugaagcagcugcaggaggagggcaagcgggucgccauggugggggacggcaucaacgacagccccgcgcuggccauggccaacguggggaucgccaucggcacggggaccgacgucgccaucgaggcggccgacguggugcucauccgcaacgaccugcuggacgucguggccuccaucgaccucagccggaagaccgugaagcgcauccggaucaacuucgucuucgcccugaucuacaaccuggugggcauccccaucgcggccggcguguucaugcccaucgggcucguccugcagccguggaugggcuccgccgccauggccgcgagcuccgugagcgucgugcuguccagccucuuccugaagcuguaccgcaagcccaccuacgaguccuacgagcuccccgcccggagccagaucgggcagaaguccccgagcgagaucuccgugcacgucggcaucgacgacacgagccgcaacagccccaagcuggggcugcucgaccgcaucgugaacuacucccgggccagcaucaacucccugcugagcgacaagcgcucccucaacagcguggucaccuccgagcccgacaagcacagccugcuggugggcgacuuccgggaggacgacgacaccgcccucuga

SEQ ID NO: 27077 - RNA, 3777 nt, Artificial Sequence
  derived and/or modified sequence opt1 from ATP7B__Homo_sapiens__NP_001005918
augcccgagcaggagcgccagaucaccgcccgggagggcgccagccgcaagauccuguccaagcucagccugccgacccgggcgugggagcccgccaugaagaaguccuucgccuucgacaacgugggguacgagggcgggcuggacggccucgggcccagcucccaggucgccacgagcaccgugcgcauccugggcaugaccugccaguccugcgucaagagcaucgaggaccggaucuccaaccugaagggcaucaucagcaugaaggugucccucgagcaggggagcgccaccgugaaguacgugcccuccgucgugugccugcagcaggucugccaccagaucggcgacaugggguucgaggcgagcaucgccgagggcaaggccgccuccuggccgagccgcucccugcccgcgcaggaggccguggugaagcuccggguggaggggaugacgugccagagcugcgucuccagcaucgagggcaaggugcgcaagcugcagggcgugguccgggugaaggugagccuguccaaccaggaggccgucaucaccuaccagcccuaccucauccagcccgaggaccugcgcgaccacgugaacgacaugggguucgaggccgccaucaagagcaagguggcgccgcugucccucggccccaucgacaucgagcggcugcagagcaccaaccccaagcgcccccuguccagcgccaaccagaacuucaacaacuccgagacccucgggcaccagggcagccacgucgugacgcugcagcugcggaucgacggcaugcacugcaaguccugcgugcucaacaucgaggagaacaucgggcagcugcugggcguccagagcauccaggugucccucgagaacaagaccgcccaggucaaguacgacccgagcugcaccucccccguggcccugcagcgcgccaucgaggcgcugccgcccgggaacuucaaggugagccuccccgacggcgccgagggguccggcaccgaccaccggagcuccagcucccacagccccggcagcccgccccgcaaccagguccaggggacgugcuccaccacccugaucgccaucgccggcaugaccugcgccagcugcgugcacuccaucgaggggaugaucagccagcuggagggcgugcagcagaucuccgucagccucgcggaggggacggccaccgugcuguacaaccccuccgugaucagccccgaggagcugcgggccgccaucgaggacaugggcuucgaggccuccgucgugagcgaguccugcagcaccaacccccucggcaaccacuccgcggggaacagcauggugcagaccacggacggcacccccaccuccguccaggagguggccccgcacaccgggcgccugcccgccaaccacgcccccgacauccuggccaagagcccccaguccacgcgggcgguggccccgcagaagugcuuccuccagaucaagggcaugaccugcgccagcugcgucagcaacaucgagcgcaaccugcagaaggaggccggggugcuguccgugcucgucgcgcugauggccggcaaggccgagaucaaguacgaccccgaggugauccagccccuggagaucgcccaguucauccaggaccucggcuucgaggccgcggugauggaggacuacgccgggagcgacggcaacaucgagcugaccaucaccgggaugacgugcgccuccugcguccacaacaucgagagcaagcugacccggaccaacggcaucaccuacgccuccguggcccucgcgacgagcaaggcccuggugaaguucgacccggagaucaucggcccccgcgacaucaucaagaucaucgaguccaagaccagcgaggcccuggccaagcucaugucccugcaggcgaccgaggccaccgucgugacgcugggggaggacaaccugaucauccgcgaggagcagguccccauggagcucgugcagcggggcgacaucgugaaggugguccccgggggcaaguucccgguggacgggaaggugcuggagggcaacaccauggccgacgagagccugaucaccggcgaggccaugcccgucaccaagaagcccggguccaccgugaucgccggcagcaucaacgcgcacggguccgugcucaucaaggccacgcacgucggcaacgacaccacccuggcccagaucgugaagcugguggaggaggcccagaugagcaagaaccccaacaagcacaucucccagaccgaggucaucauccgcuucgccuuccagacgagcaucaccgugcucugcaucgcgugcccgugcucccuggggcuggccacccccaccgccgugauggucggcacgggcguggccgcccagaacgggauccucaucaagggcgggaagccccuggagauggcgcacaagaucaagaccgugauguucgacaagaccggcaccaucacgcacggggucccccgggugaugcgcgugcugcuccugggcgacgucgccacccugccgcuccggaaggugcuggccguggucggcaccgccgaggcgagcuccgagcacccccuggggguggccgucaccaaguacugcaaggaggagcucggcacggagacccugggguacugcaccgacuuccaggccgugcccggcugcgggaucggcugcaaggugagcaacgucgagggcauccuggcccacagcgagcgcccccucuccgccccggcgagccaccugaacgaggccgggucccugcccgccgagaaggacgccgugccccagaccuucagcgugcucaucggcaaccgggaguggcugcgccggaacgggcugacgaucuccagcgacgucuccgacgccaugaccgaccacgagaugaagggccagaccgcgauccucguggccaucgacggcgugcugugcgggaugaucgccaucgccgacgccgucaagcaggaggcggcccuggccgugcacacccuccagagcaugggcguggacgucgugcugaucacgggggacaaccgcaagaccgcccgggccaucgcgacccaggugggcaucaacaaggucuucgccgaggugcugcccucccacaagguggccaagguccaggagcuccagaacaaggggaagaagguggccauggugggcgacggcgucaacgacagcccggcgcuggcccaggccgacauggggguggccaucggcaccgggacggacguggccaucgaggcggccgacgucgugcugauccgcaacgaccuccuggacguggucgccuccauccaccugagcaagcggaccgugcgccggauccgcaucaaccucgugcuggcccugaucuacaaccucgucggcauccccaucgccgcggggguguucaugcccaucggcaucgugcugcagcccuggaugggcuccgccgccauggccgccagcuccgucagcguggugcuguccagccuccagcugaagugcuacaagaagccggaccuggagcgguacgaggcgcaggcccacgggcacaugaagccccucaccgccucccaggucagcgugcacaucggcauggacgaccgcuggcgggacagcccccgcgccaccccgugggaccagguguccuacgucagccaggugucccugagcucccugacgagcgacaagcccucccgccacagcgcggccgccgacgacgacggggacaaguggucccuccugcugaacggccgggacgaggagcaguacaucuga

SEQ ID NO: 27078 - RNA, 3450 nt, Artificial Sequence
  derived and/or modified sequence opt1 from ATP8A1__Homo_sapiens__NP_001098999
augcccaccaugcgccggaccgugagcgagauccgcucccgggccgagggcuacgagaagacggacgacgucagcgagaagaccucccuggccgaccaggaggaggugcgcaccaucuucaucaaccagccgcagcucaccaaguucugcaacaaccacgugagcacggcgaaguacaacaucaucaccuuccugccccgguuccuguacucccaguuccgccgggccgccaacagcuucuuccucuucaucgcccugcugcagcagauccccgacgucucccccaccgggcgcuacaccacgcucgugccgcugcuguucauccucgccguggcggccaucaaggagaucaucgaggacaucaagcggcacaaggccgacaacgccgucaacaagaagcagacccaggugcugcgcaacggcgcgugggagaucgugcacugggagaaggucaacgugggggacaucgugaucaucaagggcaaggaguacauccccgccgacaccguccugcucagcuccagcgagccccaggccaugugcuacaucgagaccuccaaccuggacggggagacgaaccugaagauccggcagggccuccccgccaccagcgacaucaaggacguggacucccugaugcgcaucagcggccggaucgagugcgaguccccgaaccgccaccuguacgacuucguggggaacauccggcucgacggccacgggaccgucccccugggcgccgaccagauccugcuccgcggggcgcagcugcggaacacccagugggugcacggcaucguggucuacacgggccacgacaccaagcugaugcagaacagcaccuccccgccccucaagcugagcaacguggagcgcaucaccaacgugcagauccugauccucuucugcauccugaucgccaugucccuggucugcagcguggggagcgccaucuggaaccggcgccacuccggcaaggacugguaccucaaccugaacuacgggggcgccagcaacuucggccugaacuuccucacguucaucauccuguucaacaaccugauccccaucucccuccuggugacccuggaggucgugaaguucacccaggccuacuucaucaacugggaccucgacaugcacuacgagcccaccgacacggcggccauggcccggaccagcaaccugaacgaggagcuggggcaggucaaguacaucuucuccgacaagaccggcacccucacgugcaacgugaugcaguucaagaagugcaccaucgccgggguggccuacggccagaacagccaguucggggacgagaagaccuucuccgacagcucccugcuggagaaccuccagaacaaccaccccaccgcgcccaucaucugcgaguuccugacgaugauggccgucugccacaccgccgugccggagcgcgagggcgacaagaucaucuaccaggccgccagccccgacgagggcgcgcuggugcgcgccgccaagcagcucaacuucgucuucaccgggcggacccccgacuccgugaucaucgacagccugggccaggaggagcgcuacgagcugcugaacgugcucgaguucacguccgcccggaagcgcaugagcgucaucgugcggacccccuccgggaagcugcgccuguacugcaagggcgcggacaccgugaucuacgaccggcucgccgagaccagcaaguacaaggagaucacccugaagcaccuggagcaguucgccacggaggggcuccgcacccugugcuucgccgucgccgagaucuccgagagcgacuuccaggaguggcgggcgguguaccagcgcgccuccaccagcgugcagaaccggcugcucaagcuggaggagagcuacgagcugaucgagaagaaccuccagcugcugggcgccaccgccaucgaggacaagcuccaggaccaggucccggagacgaucgagacccugaugaaggccgacaucaagaucuggauccugaccggcgacaagcaggagaccgcgaucaacaucgggcacuccugcaagcuccugaagaagaacaugggcaugaucgugaucaacgaggggagccuggacggcacgcgcgagacccucucccggcacugcaccacccugggggacgcccugcgcaaggagaacgacuucgcccucaucaucgacggcaagacgcugaaguacgcccugaccuucggcgugcggcaguacuuccucgaccuggcccugagcugcaaggcggucaucugcugccgcgugagcccccuccagaaguccgagguggucgagauggugaagaagcaggucaagguggugacccuggccaucggggacggcgccaacgacguguccaugauccagaccgcccacgucggggugggcaucagcggcaacgaggggcugcaggcggccaacuccagcgacuacuccaucgcccaguucaaguaccucaagaaccugcugaugauccacggcgccuggaacuacaaccgggugagcaagugcauccucuacugcuucuacaagaacaucguccuguacaucaucgagaucugguucgccuucgugaacggguucuccggccagauccuguucgagcgcuggugcaucgggcucuacaacgugauguucacggcgaugccgccccugacccugggcaucuucgagcggagcugccgcaaggagaacaugcucaaguaccccgagcuguacaagaccucccagaacgcccuggacuucaacaccaaggucuucugggugcacugccucaacggccuguuccacagcgugauccuguucugguucccccucaaggcccugcaguacgggacggccuucggcaacgggaagaccuccgacuaccugcuccugggcaacuucgucuacaccuucguggugaucaccgucugccugaaggccgggcucgagacgagcuacuggaccugguucagccacaucgcgaucuggggcuccaucgcccugugggugguguucuucggcaucuacagcucccuguggcccgccauccccauggccccggacaugagcggggaggccgcgaugcuguucuccagcggcgucuucuggauggggcuccuguucauccccguggccucccuccugcuggacguggucuacaaggugaucaagcgcaccgccuucaagacccucguggacgagguccaggagcuggaggccaagagccaggaccccggcgcgguggugcuggggaagucccucacggagcgggcccagcugcugaagaacgucuucaagaagaaccacgugaaccucuaccgcagcgagucccugcagcagaaccugcuccacggcuacgccuucagccaggacgagaacggcaucgucucccagagcgaggugauccgggccuacgacaccaccaagcagcgcccggacgagugguga

SEQ ID NO: 27079 - RNA, 3567 nt, Artificial Sequence
  derived and/or modified sequence opt1 from ATP8A2__Homo_sapiens__NP_057613
augcugaacggcgccgggcucgacaaggcccugaagaugagccugccccgccggucccgcauccggagcuccgugggccccguccgcagcucccucggguacaagaaggcggaggacgagaugagccgggccaccuccgugggcgaccagcuggaggcccccgcccgcaccaucuaccugaaccagccccaccucaacaaguuccgggacaaccagaucagcacggccaaguacuccgugcugaccuuccugccccgcuuccucuacgagcagauccggcgcgcggccaacgccuucuuccuguucaucgcccugcuccagcagaucccggacgucagccccaccgggcgguacaccacgcuggugccccugaucaucauccucaccaucgcgggcaucaaggagaucguggaggacuucaagcgccacaaggccgacaacgccgucaacaagaagaagaccaucgugcugcggaacggcauguggcacaccaucauguggaaggagguggccgucggggacaucgugaagguggucaacggccaguaccugcccgccgacguggugcuccuguccagcuccgagccgcaggcgaugugcuacgucgagacggccaaccuggacggggagaccaaccucaagauccgccagggccugagccacaccgccgacaugcagacccgggaggugcugaugaagcucuccgggacgaucgagugcgagggccccaaccgccaccuguacgacuucaccggcaaccugaaccucgacggcaagagccugguggcccuggggcccgaccagauccuccugcgggggacccagcugcgcaacacccagugggucuucggcaucgugguguacacgggccacgacaccaagcucaugcagaacuccaccaaggcgccccugaagcggagcaacgucgagaaggugaccaacgugcagauccugguccucuucgggauccugcuggugauggcccucgucuccagcgccggcgcccuguacuggaaccgcagccacggggagaagaacugguacaucaagaagauggacacgaccuccgacaacuucggcuacaaccugcucaccuucaucauccuguacaacaaccugaucccgaucagccuccuggugacccuggagguggucaaguacacgcaggcccucuucaucaacugggacaccgacauguacuacaucgggaacgacacccccgccauggcgcggaccuccaaccugaacgaggagcugggccaggugaaguaccuguucagcgacaagacgggcacccugaccugcaacaucaugaacuucaagaagugcuccaucgccggggugaccuacggccacuuccccgagcucgcccgcgagcccagcuccgacgacuucugccgcaugccgccgcccugcagcgacuccugcgacuucgacgacccccggcugcucaagaacaucgaggaccgccaccccacggcccccugcauccaggaguuccugacccugcucgccgucugccacaccguggugcccgagaaggacggggacaacaucaucuaccaggcgagcucccccgacgaggccgcccuggucaagggcgccaagaagcugggguucguguucaccgcgcggacgccguucagcgugaucaucgaggccaugggccaggagcagaccuucggcauccucaacguccuggaguucuccagcgaccgcaagcggauguccgugaucgugcgcacccccagcgggcggcugcgccucuacugcaagggcgccgacaacgucaucuucgagcggcuguccaaggacagcaaguacauggaggagacccugugccaccucgaguacuucgccaccgaggggcugcgcacgcugugcguggccuacgcggaccucuccgagaacgaguacgaggaguggcugaagguguaccaggaggccagcaccauccugaaggaccgggcccagcgccucgaggagugcuacgagaucaucgagaagaaccugcugcuccugggcgccaccgccaucgaggaccggcugcaggcggggguccccgagaccaucgccacgcuccugaaggccgagaucaagaucugggugcugaccggcgacaagcaggagaccgccaucaacaucggcuacagcugccgccucgugucccagaacauggcccugauccugcucaaggaggacagccuggacgcgacccgggccgccaucacgcagcacugcaccgaccuggggaaccuccugggcaaggagaacgacgucgcccugaucaucgacgggcacacccucaaguacgcgcuguccuucgaggugcgccggagcuuccuggaccucgcccuguccugcaaggccgugaucugcugccgcgucagcccccugcagaaguccgagaucguggacguggucaagaagcgggugaaggccaucacccucgccaucggcgacggcgcgaacgacguggggaugauccagacggcccacgucggcguggggaucagcggcaacgaggggaugcaggccaccaacaacuccgacuacgccaucgcccaguucagcuaccuggagaagcugcuccuggugcacggcgcgugguccuacaaccgcgucaccaagugcauccuguacugcuucuacaagaacguggugcucuacaucaucgagcugugguucgccuucgucaacggcuucagcgggcagauccuguucgagcgcuggugcaucggccucuacaacgugaucuucaccgcccugccgcccuucacgcuggggaucuucgagcgguccugcacccaggagagcaugcuccgcuucccccagcuguacaagaucacccagaacggcgagggguucaacaccaagguguucuggggccacugcaucaacgcccugguccacucccucauccuguucugguucccgaugaaggcccuggagcacgacacggugcucaccagcggccacgcgaccgacuaccuguucguggggaacaucgucuacaccuacgugguggucacggugugccugaaggccggccucgagaccaccgccuggaccaaguucucccaccuggccgugugggggagcaugcugacguggcucgucuucuucggcaucuacagcaccaucuggcccaccauccccaucgcgcccgacaugcgggggcaggccaccauggugcuguccagcgcccacuucuggcugggccucuuccuggugccgacggccugccugaucgaggacgucgccuggcgcgcggccaagcacacgugcaagaagacccuccuggaggaggugcaggagcuggagaccaagucccggguccucggcaaggccgugcugcgcgacagcaacgggaagcggcugaacgagcgcgaccggcucaucaagcgccugggccggaagaccccgcccacccuguuccgcggguccagccuccagcagggcgugccccacggguacgccuucucccaggaggagcacggcgccgucagccaggaggaggugauccgggcguacgacaccaccaagaagaagucccgcaagaaguga

SEQ ID NO: 27080 - RNA, 3756 nt, Artificial Sequence
  derived and/or modified sequence opt1 from ATP8B1__Homo_sapiens__XP_011524324
augagcaccgagcgcgacuccgagaccacguucgacgaggacagccagcccaacgacgagguggucccguacuccgacgacgagaccgaggacgagcuggacgaccagggcagcgccguggagcccgagcagaaccgggugaaccgcgaggccgaggagaaccgggagcccuuccgcaaggagugcaccuggcaggucaaggcgaacgaccggaaguaccacgagcagccccacuucaugaacaccaaguuccucugcaucaaggaguccaaguacgccaacaacgccaucaagacguacaaguacaacgccuucaccuucaucccgaugaaccuguucgagcaguucaagcgcgccgcgaaccuguacuuccucgcccugcugauccuccaggccgugccccagaucagcacccuggccugguacaccacgcuggugccccuccuggucgugcugggggugaccgcgaucaaggaccucgucgacgacguggcccggcacaagauggacaaggagaucaacaaccggaccugcgaggugaucaaggacggccgguucaaggucgccaaguggaaggagauccaggugggggacgugauccgccugaagaagaacgacuucguccccgccgacauccugcuccuguccagcuccgagccgaacagccugugcuacguggagaccgccgagcucgacggcgagacgaaccugaaguucaagaugucccuggagaucaccgaccaguaccuccagcgggaggacacccuggcgaccuucgacggguucaucgagugcgaggagcccaacaaccgccuggacaaguucacgggcacccucuucuggcggaacaccagcuucccccuggacgccgacaagauccugcuccgcggcugcgugauccggaacaccgacuucugccacgggcuggucaucuucgccggcgccgacacgaagaucaugaagaacuccgggaagacccgcuucaagcggaccaagaucgacuaccugaugaacuacaugguguacaccaucuucgugguccucauccugcugagcgccggccucgcgaucgggcacgccuacugggaggcccaggugggcaacuccagcugguaccuguacgacggcgaggacgacacgcccuccuaccgcggguuccugaucuucuggggcuacaucaucgugcucaacaccauggucccgaucagccuguacguguccgucgaggugauccggcuggggcagagccacuucaucaacugggaccuccagauguacuacgccgagaaggacacccccgccaaggcgcgcaccacgacccugaacgagcagcugggccagauccacuacaucuucagcgacaagaccggcacccucacgcagaacaucaugaccuucaagaagugcugcaucaacgggcagaucuacggcgaccaccgggacgccucccagcacaaccacaacaagaucgagcaggucgacuucagcuggaacaccuacgccgacgggaagcuggccuucuacgaccacuaccugaucgagcagauccaguccggcaaggagcccgaggugcgccaguucuucuuccuccuggccgugugccacaccgugauggucgaccgcacggacgggcagcugaacuaccaggcggccagccccgacgagggcgcccucgugaacgccgcgcggaacuucggcuucgccuuccuggcccgcacccagaacaccaucaccaucuccgagcuggggaccgagcggacguacaacgugcuggccauccucgacuucaacagcgaccgcaagcggauguccaucaucguccgcaccccggagggcaacaucaagcuguacugcaagggggccgacaccgugaucuacgagcggcugcaccgcaugaaccccaccaagcaggagacgcaggacgcgcucgacaucuucgccaacgagacccugcggacccugugccucugcuacaaggagaucgaggagaaggaguucaccgaguggaacaagaaguucauggccgccagcguggccuccacgaaccgcgacgaggcgcuggacaaggucuacgaggagaucgagaaggaccugauccuccugggcgccaccgccaucgaggacaagcugcaggacggggugcccgagaccaucagcaagcucgccaaggccgacaucaagaucugggugcugaccggcgacaagaaggagacggcggagaacaucggcuucgccugcgagcugcucaccgaggacaccaccaucugcuacggggaggacaucaacucccugcugcacgcccggauggagaaccagcgcaaccggggcggggucuacgccaaguucgcgcccccggugcaggagagcuucuucccgcccggcgggaaccgcgcccucaucaucacgggcuccuggcugaacgagauccugcucgagaagaagaccaagcggaacaagauccugaagcugaaguucccccgcaccgaggaggagcggcgcaugcggacccagagcaagcgccgccucgaggccaagaaggagcagcggcagaagaacuucguggaccuggccugcgagugcuccgccgucaucugcugccgcgugacgcccaagcagaaggcgaugguggucgaccuggugaagcgguacaagaaggccaucacccucgccaucggcgacggggccaacgacgugaacaugaucaagaccgcccacaucggcgucgggaucagcggccaggagggcaugcaggcggugauguccagcgacuacuccuucgcccaguuccgcuaccugcagcggcugcuccuggugcacgggcgcuggagcuacauccggaugugcaaguuccugcgcuacuucuucuacaagaacuucgccuucacccucguccacuucugguacagcuucuucaacggcuacuccgcccagacggccuacgaggacugguucaucacccuguacaacgugcuguacaccagccuccccgugcugcugauggggcuccuggaccaggacgucuccgacaagcugagccuccgguuccccggccuguacaucguggggcagcgcgaccuccuguucaacuacaagcgguucuucgugucccugcugcacggcguccucaccagcaugauccuguucuucaucccccugggcgcguaccuccagacgguggggcaggacggcgaggccccguccgacuaccagagcuucgccgugaccaucgccuccgcgcuggucaucaccgugaacuuccagaucgggcuggacaccagcuacuggacguucgugaacgccuucuccaucuucggcagcaucgcccucuacuucgggaucauguucgacuuccacuccgccggcauccacguccuguuccccagcgccuuccaguucaccggcaccgcguccaacgcccugcgccagcccuacaucuggcucaccaucauccuggccguggccgugugccugcucccggucguggccauccgguuccugagcaugacgaucuggcccuccgagagcgacaagauccagaagcaccgcaagcggcugaaggcggaggagcaguggcagcgccggcagcaggucuuccgccgcggggugagcacccgccgguccgccuacgccuucagccaccagcgcggcuacgccgaccucaucuccagcgggcgcuccauccggaagaagcgcagcccccuggacgccaucguggcggacggcaccgccgaguaccggcgcaccggggacuccuga

SEQ ID NO: 27081 - RNA, 3792 nt, Artificial Sequence
  derived and/or modified sequence opt1 from ATP8B3__Homo_sapiens__NP_001171473
augggcgacagccccgggcgcggcgccccggagcggcgccacaaggcccagcccgggcgggcgcgcaaguacgaguggcggcccgagggccccaccuccauggggagccugggccagcgcgaggaccuccaggacgaggaccggaacuccgccuucaccuggaaggugcaggccaacaaccgcgccuacaacggccaguucaaggagaaggucauccugugcuggcagcggaagaaguacaagacgaacgugauccgcaccgccaaguacaacuucuacagcuuccugccgcucaaccuguacgagcaguuccaccggguguccaaccuguucuuccucaucaucaucauccugcagagcauccccgacaucuccacccugcccugguucagccucuccacccccauggucugccugcuguucauccgcgcgacgcgggaccucguggacgacauggggcgccacaagagcgaccgggccaucaacaaccgcccgugccagauccugaugggcaaguccuucaagcagaagaaguggcaggaccugugcgugggggacgucgugugccuccggaaggacaacaucgugcccgccgacaugcugcugcucgccagcaccgagcccuccagccugugcuacgucgagaccguggacaucgacggcgagaccaaccugaaguuccgccaggcgcucauggugacgcacaaggagcuggccaccaucaagaagauggccuccuuccaggggaccgugaccugcgaggcccccaacagccggaugcaccacuucgugggcugccuggaguggaacgacaagaaguacucccucgacaucggcaaccugcugcuccgcgggugccggauccgcaacacggacacgugcuacggccuggugaucuacgccgacggguacauguucgucggcuucgacaccaagaucaugaagaacugcggcaagauccaccugaagcgcaccaagcucgaccugcugaugaacaagcucgugguggucaucuucaucagcguggugcuggucugccuggugcucgcguucggguucggcuucuccgugaaggaguucaaggaccaccacuacuaccugagcgggguccacggcagcuccguggccgccgagagcuucuucgucuucugguccuuccugauccuccugagcgugaccaucccgauguccauguucauccugagcgaguucaucuaccucgggaacuccguguucaucgacugggacguccagauguacuacaagccccaggacgugcccgccaaggcccggagcaccucccugaacgaccaccugggccagguggaguacaucuucagcgacaagaccggcacccucacgcagaacauccugaccuucaacaagugcugcaucuccgggcgcgucuacggccccgacagcgaggcgaccacccggccgaaggagaaccccuaccuguggaacaaguucgccgacgggaagcuccuguuccacaacgccgcccugcugcaccucgugcgcacgaacggcgacgaggccgugcgggaguucuggcgccugcuggcgaucugccacaccgucauggugcgggagagcccccgcgagcggcccgaccagcuccuguaccaggccgccuccccggacgagggggcccuggugaccgccgcgcgcaacuucggcuacgucuuccucucccggacccaggacacggugaccaucauggagcugggcgaggagcgcguguaccagguccuggccaucauggacuucaacagcacccggaagcgcauguccgugcucgugcggaagcccgagggggccaucugccuguacaccaagggcgccgacacggucaucuucgagcgccugcaccggcgcggggcgauggaguucgccaccgaggaggcccucgccgccuucgcgcaggagacccugcggacccugugccucgccuaccgcgagguggccgaggacaucuacgaggacuggcagcagcgccaccaggaggccagccugcugcuccagaaccgggcccaggcgcugcagcaggucuacaacgagauggagcaggaccugcgccuccugggcgccacggccaucgaggaccggcugcaggacgggguccccgagaccaucaagugccucaagaaguccaacaucaagaucugggugcugaccggcgacaagcaggagaccgccgugaacaucggcuucgccugcgagcugcucagcgagaacaugcugauccuggaggagaaggagaucagccgcauccucgagaccuacugggagaacuccaacaaccugcugacgcgggagagccucucccaggucaagcuggcgcuggugaucaacggggacuuccucgacaagcugcuggugagccuccgcaaggagccccgggcccuggcccagaacgucaacauggacgaggccuggcaggagcugggccagucccgccgggacuuccucuacgcgcgccggcugagccugcucugccgccgguucgggcugccgcuggccgccccgcccgcccaggacucccgcgcccggcgcagcuccgaggugcuccaggagcgggcguucguggaccuggccagcaagugccaggccgucaucugcugccgcgugacccccaagcagaaggcccugaucguggcccucgucaagaaguaccaccagguggugacccuggcgaucggcgacggcgccaacgacaucaacaugaucaagaccgccgacgucggggugggccuggccgggcaggagggcaugcaggccgugcagaacuccgacuucguccucgggcaguucugcuuccugcagcggcugcuccuggugcacggccgcuggagcuacgugcggaucugcaaguuccugcgcuacuucuucuacaaguccauggcgagcaugaugguccaggugugguucgccugcuacaacggcuucacggggcagccccucuacgagggcugguuccuggcccuguucaaccuccuguacuccacccugcccgugcucuacaucgggcuguucgagcaggacgucagcgccgagcagucccuggagaagcccgagcucuacguggugggccagaaggacgagcuguucaacuacugggucuucgugcaggcgaucgcccacggggugaccaccagccuggucaacuucuucaugacgcucuggaucagccgcgacaccgccggcccggccuccuucagcgaccaccaguccuucgccguggucguggcgcugagcugccugcucuccaucaccauggaggugauccugaucaucaaguacuggaccgcccugugcgucgccacgauccuccugagccugggcuucuacgccaucaugaccaccaccacgcaguccuucuggcuguuccgggugagccccaccaccuuccccuuccucuacgccgaccuguccgugaugagcucccccagcauccuccuggucgugcugcucuccgugagcaucaacaccuucccgguccuggcgcugcgcgugaucuuccccgcccucaaggagcugcgggccaaggaggagaagguggaggaggggcccuccgaggagaucuucacgauggagccccugccgcacguccaccgcgagagccgggcccgccgguccagcuacgccuucucccaccgcgagggcuacgcgaaccucaucacccaggggaccauccugcggcgcggccccggggugagcagcgacaucgccuccgagagccuggaccccuccgacgaggaggccgccagcucccccaaggagagccaguga

SEQ ID NO: 27082 - RNA, 3579 nt, Artificial Sequence
  derived and/or modified sequence opt1 from ATP8B4__Homo_sapiens__NP_079113
auguucugcagcgagaagaagcugcgcgagguggagcggaucgucaaggccaacgaccgcgaguacaacgagaaguuccaguacgccgacaaccggauccacaccuccaaguacaacauccucaccuuccugcccaucaaccuguucgagcaguuccagcgcguggcgaacgccuacuuccucugccugcugauccuccagcugauccccgagaucagcucccugacgugguucaccaccaucgugccccucguccuggugaucaccaugacggccgugaaggacgccaccgacgacuacuuccggcacaagagcgacaaccaggucaacaaccgccaguccgaggugcugaucaacagcaagcuccagaacgagaaguggaugaacgugaaggucggcgacaucaucaagcuggagaacaaccaguucguggccgcggaccugcuccugcuguccagcuccgagccccacgggcucugcuacguggagaccgccgagcuggacggcgagaccaaccugaagguccggcacgcccucagcgugacguccgagcugggggccgacaucagccgccuggcgggcuucgacgggaucguggucugcgaggugcccaacaacaagcucgacaaguucaugggcauccuguccuggaaggacagcaagcacucccugaacaacgagaagaucauccuccggggcugcauccugcgcaacaccagcuggugcuucgggauggugaucuucgccggccccgacaccaagcugaugcagaacuccgggaagaccaaguucaagcggacgagcaucgaccgccucaugaacacccugguccuguggaucuucggcuuccucaucugccuggggaucauccuggccaucggcaacuccaucugggagagccagaccggcgaccaguuccggaccuuccucuucuggaacgagggggagaaguccagcguguucagcggcuuccugacguucugguccuacaucaucauccugaacaccgugguccccaucagccucuacguguccguggaggucauccgccuggggcacagcuacuucaucaacugggaccggaagauguacuacucccgcaaggccauccccgccguggcgcggaccaccacgcugaacgaggagcucggccagaucgaguacaucuucagcgacaagaccggcacccugacccagaacaucaugacguucaagcgcugcuccaucaacgggcggaucuacggcgagguccacgacgaccuggaccagaagaccgagaucacccaggagaaggagcccguggacuucagcgugaagucccaggccgaccgcgaguuccaguucuucgaccaccaccucauggagagcaucaagaugggggacccgaagguccacgaguuccugcggcugcucgcccugugccacaccgugauguccgaggagaacagcgccggcgagcugaucuaccaggugcagucccccgacgagggggcccuggucacggcggcccgcaacuucggcuucaucuucaagagccgcacccccgagaccaucaccaucgaggagcucggcacgcuggugaccuaccagcugcucgccuuccuggacuucaacaacacccggaagcgcauguccgugaucguccggaaccccgaggggcagaucaagcuguacagcaagggcgccgacaccauccucuucgagaagcugcacccguccaacgaggugcugcucagccugacgagcgaccaccuguccgaguucgccggggagggccuccgcacccuggcgaucgccuaccgggaccuggacgacaaguacuucaaggaguggcacaagaugcucgaggacgccaacgccgccaccgaggagcgcgacgagcggaucgcggggcuguacgaggagaucgagcgcgaccugaugcuccugggcgccaccgccguggaggacaagcugcaggagggcgucaucgagaccgugacgagccucucccuggccaacaucaagaucugggugcugaccggggacaagcaggagaccgcgaucaacaucggcuacgccugcaacaugcucaccgacgacaugaacgacgucuucgugaucgccgggaacaacgccguggagguccgggaggagcugcgcaaggccaagcagaaccuguucggccagaaccggaacuucagcaacgggcacguggugugcgagaagaagcagcagcucgagcuggacuccaucgucgaggagacgaucaccggcgacuacgcgcugaucaucaacggccacagccucgcccacgcccuggaguccgacgugaagaacgaccugcucgagcuggccugcaugugcaagaccgugaucugcugccgcgucacgccccugcagaaggcccaggugguggagcucgucaagaaguaccggaacgcggugacccuggccaucggggacggcgccaacgacgugagcaugaucaaguccgcccacaucggggucggcaucagcggccaggaggggcugcaggccgugcucgcguccgacuacagcuucgcccaguuccgcuaccugcagcggcugcuccuggugcacggccgcugguccuacuuccggaugugcaaguuccugugcuacuucuucuacaagaacuucgccuucacccucguccacuucugguucggguucuucugcggcuucagcgcccagaccguguacgaccagugguucaucacccuguucaacaucguguacacgucccugcccguccucgcgauggggaucuucgaccaggacgugagcgaccagaacuccguggacugcccccagcuguacaagccgggccagcugaaccuccuguucaacaagcgcaaguucuucaucugcguccugcacggcaucuacaccagccucgugcuguucuucauccccuacggggccuucuacaacguggccggcgaggacgggcagcacaucgccgacuaccagagcuucgccgucaccauggcgaccucccuggugaucguggucagcgugcagaucgcccucgacacguccuacuggaccuucaucaaccacguguucaucuggggcagcaucgccaucuacuucuccauccuguucaccaugcacagcaacgggaucuucggcaucuuccccaaccaguuccccuucgucggcaacgcccggcacucccugacccagaagugcaucuggcucgugauccugcugacgaccguggccagcgucaugccgguggucgcguuccgcuuccucaagguggaccuguaccccacccuguccgaccagauccgccgguggcagaaggcccagaagaaggcccgcccgcccagcucccggcgcccccggacccgccggagcuccagccgccgguccggguacgccuucgcccaccaggagggcuacggggagcucaucacgagcggcaagaacaugcgcgcgaagaacccgccgcccaccuccgggcuggagaagacccacuacaacagcaccuccuggaucgagaaccugugcaagaagacgaccgacaccgugagcagcuucucccaggacaagaccgucaagcucuga

SEQ ID NO: 27083 - RNA, 3444 nt, Artificial Sequence
  derived and/or modified sequence opt1 from ATP9B__Homo_sapiens__NP_940933
auggccgaccagaucccccuguacccggugcgcagcgccgcggccgccgccgccaaccggaagcgcgcggccuacuacuccgccgccggcccccggcccggggcggaccgccacagccgguaccagcucgaggacgaguccgcccaccuggacgagaugccccugaugaugagcgaggagggcuucgagaacgaggaguccgacuaccacacccucccgcgcgcccggaucaugcagcgcaagcgggggcuggagugguucgucugcgacggcuggaaguuccugugcaccagcugcugcggguggcucaucaacaucugccgccggaagaaggagcugaaggcccgcacgguguggcugggcugccccgagaagugcgaggagaagcacccccggaacuccaucaagaaccagaaguacaacguguucaccuucauccccggcguccucuacgagcaguucaaguucuuccugaaccuguacuuccucgugaucagcugcucccaguucgugccggcccugaagaucggguaccuguacaccuacugggcgccccucggcuucguccuggccgugaccaugacgcgcgaggccaucgacgaguuccggcgcuuccagcgggacaaggaggugaacagccagcuguacuccaagcucaccguccgcgggaaggugcaggucaagagcuccgacauccaggugggcgaccugaucaucguggagaagaaccagcggauccccagcgacaugguguuccugcgcaccuccgagaaggccgggagcugcuucauccggaccgaccagcucgacggcgagacggacuggaagcugaaggucgccguguccugcacccagcagcugcccgcgcucggcgaccuguucagcaucuccgccuacguguacgcccagaagccgcagauggacauccacagcuucgaggggaccuucacccgcgaggacagcgacccgcccauccacgagucccugagcaucgagaacacgcucugggccuccaccaucgucgccagcggcaccgugaucgggguggucaucuacaccggcaaggagacgcgcuccgugaugaacaccagcaaccccaagaacaaggugggccugcuggaccucgagcugaaccggcugaccaaggcccucuuccuggcgcuggucgcccucuccaucgugauggucacccugcagggguucgugggccccugguaccgcaaccuguuccgguuccuccugcuguucagcuacaucauccccaucucccuccgcgugaaccuggacauggggaaggccgucuacggcuggaugaugaugaaggacgagaacauccccgggacgguggugcggaccagcaccauccccgaggagcugggccgccucgucuaccugcugaccgacaagacgggcacccucacccagaacgagaugaucuucaagcggcugcaccuggggaccguguccuacggcgccgacacgauggacgagauccagagccacgugcgcgacuccuacagccagaugcagucccaggccgggggcaacaacaccgggagcaccccgcugcggaaggcgcaguccagcgcccccaagguccgcaaguccgugagcagccggauccacgaggccgugaaggcgaucguccucugccacaacgugacccccguguacgagucccgcgccggcgucacggaggagaccgaguucgccgaggccgaccaggacuucagcgacgagaaccggaccuaccaggccuccagccccgacgagguggcgcuggugcaguggaccgaguccgucggccugacgcucgugagccgcgaccugaccuccaugcagcugaagaccccgagcggccaggugcucuccuucugcauccugcagcuguuccccuucaccagcgaguccaagcggaugggggucaucgugcgcgacgagagcaccgccgagaucacguucuacaugaagggggccgacguggccaugucccccaucguccaguacaacgacuggcucgaggaggagugcggcaacauggcccgggaggggcugcgcacccuggugguggcgaagaaggcccucaccgaggagcaguaccaggacuucgagagccgguacacccaggccaagcuguccaugcacgaccgcagccugaaggucgccgccgugguggagucccucgagcgcgagauggagcugcugugccucacgggcgucgaggaccagcugcaggcggacgugcggcccacccuggagaugcuccgcaacgccggcaucaagaucuggaugcugaccggggacaagcuggagaccgccacgugcaucgccaagagcagccaccucgugucccggacccaggacauccacaucuuccgccaggucaccagccggggcgaggcgcaccuggagcugaacgccuuccgccggaagcacgacugcgcccucgugaucuccggggacagccuggaggugugccugaaguacuacgagcacgaguucgucgagcucgccugccagugcccggccguggugugcugccgcugcucccccacccagaaggcgcggaucgucacgcugcugcagcagcacaccggccgccggaccugcgccaucggcgacgggggcaacgacgugagcaugauccaggccgccgacugcgggaucggcaucgaggggaaggagggcaagcaggccucccucgcggccgacuucagcaucacccaguuccgccacaucggccggcugcugauggugcacgggcgcaacuccuacaagcggagcgccgcccucggccaguucgucaugcaccgcgggcugaucaucuccacgaugcaggccguguucagcuccguguucuacuucgcgagcgucccccuguaccagggcuuccucauggugggguacgccaccaucuacaccauguucccgguguucucccugguccuggaccaggacgugaagcccgagauggccaugcucuaccccgagcuguacaaggaccugaccaagggccggagccucuccuucaagacguuccugaucugggugcugaucagcaucuaccagggcgggauccucauguacggcgcccugguccuguucgaguccgaguucgugcacgucguggcgaucagcuucaccgcccucauccugaccgagcugcucaugguggcccugaccguccgcacguggcacuggcugauggugguggccgaguuccucagccuggggugcuacgucuccagccuggccuuccucaacgaguacuucggcaucgggcggguguccuucggcgcguuccuggacguggccuucaucaccaccgucaccuuccuguggaaggugagcgccaucacgguggucuccugccucccccuguacgugcugaaguaccuccgccggaagcugagcccgcccuccuacugcaagcuggccagcuga

SEQ ID NO: 27084 - RNA, 870 nt, Artificial Sequence
  derived and/or modified sequence opt1 from ATPAF2__Homo_sapiens__NP_663729
auguggcgcagcugccugcggcuccgcgacggcgggcggcgccugcugaaccggcccgccggcgggccguccgccagcaugucccccggccccaccauccccagcccggcgcgcgccuacgccccgcccaccgagcggaagcgcuucuaccagaacguguccaucacgcagggggagggcggcuucgagaucaaccucgaccaccggaagcugaagacgccccaggccaagcuguucaccguccccagcgaggcccucgcgaucgccguggccaccgagugggacucccagcaggacaccaucaaguacuacaccaugcaccugaccacccugugcaacacgagccucgacaaccccacccagcgcaacaaggaccagcugauccgggccgcggugaaguuccuggacaccgacaccaucugcuaccgcgucgaggagcccgagacgcucguggagcugcagcggaacgagugggaccccaucaucgagugggccgagaagcgcuacgggguggagaucuccagcuccaccagcaucaugggcccguccauccccgccaagacccgggagguccuggugagccaccucgccuccuacaacaccugggcccugcaggggaucgaguucguggcggcccagcucaagagcaugguccugacgcugggccugaucgaccuccgccugaccguggagcaggccgugcugcucucccggcuggaggaggaguaccagauccagaagugggggaacaucgagugggcccacgacuacgagcugcaggagcuccgcgcccggaccgcggccggcacccuguucauccaccugugcagcgaguccacgaccgucaagcacaagcuccugaaggaguga

SEQ ID NO: 27085 - RNA, 690 nt, Artificial Sequence
  derived and/or modified sequence opt1 from ATRAID__Homo_sapiens__NP_001164266
auggccccgcacgacccgggcagccugaccacccucgugcccugggccgcggcccugcugcucgcccugggggucgagcgcgcccuggcccuccccgagaucugcacgcagugccccggcuccgugcagaaccugagcaagguggcguucuacugcaagaccacccgggagcugaugcuccacgcccgcugcugccugaaccagaaggggaccauccugggccucgaccugcagaacugcucccuggaggacccggggcccaacuuccaccaggcccacacgaccgucaucaucgaccuccaggccaacccccugaagggcgaccuggcgaacaccuuccggggcuucacccagcuccagacgcugauccugccccagcacgugaacugccccgggggcaucaacgccuggaacaccaucaccagcuacaucgacaaccagaucugccaggggcagaagaaccucugcaacaacaccggcgaccccgagaugugccccgagaacggguccugcgugcccgacggcccgggccugcugcagugcgucugcgccgacggguuccacggcuacaagugcaugcgccaggggagcuucucccuccugauguucuucggcauccugggcgccacgacccucagcguguccauccugcugugggccacccagcggcgcaaggcgaagaccagcuga

SEQ ID NO: 27086 - RNA, 7935 nt, Artificial Sequence
  derived and/or modified sequence opt1 from ATR__Homo_sapiens__NP_001175
augggcgagcacgggcuggagcuggccagcaugauccccgcccugcgcgagcugggcagcgccaccccggaggaguacaacaccgugguccagaagccccggcagauccucugccaguucaucgaccgcauccugaccgacgugaacguggucgccguggagcuggugaagaagaccgacagccagcccaccuccgucaugcuccuggacuucauccagcacaucaugaaguccagcccccucauguucgugaacgugagcgggucccacgaggccaagggcagcugcaucgaguucuccaacuggaucaucacccggcuccugcgcaucgccgccaccccgagcugccaccuccugcacaagaagaucugcgaggucaucugcucccugcuguuccucuucaagagcaagucccccgccaucuucggggugcugaccaaggagcugcuccagcuguucgaggaccugguguaccuccaccggcgcaacgucaugggccacgccguggaguggcccguggucaugagccgguuccugucccagcuggacgagcacaugggcuaccuccagagcgcgccccugcagcugauguccaugcagaaccucgaguucaucgaggugacccugcugauggugcucacccgcaucaucgccaucgucuucuuccggcgccaggagcugcugcucuggcagaucgggugcgugcugcuggaguacggcagcccgaagaucaagucccucgcgaucagcuuccugacggagcuguuccagcucgggggccugcccgcccagcccgccagcaccuucuucuccagcuuccuggagcuccugaagcaccugguggagauggacaccgaccagcucaagcuguacgaggagccccuguccaagcucaucaagacccuguucccguucgaggccgaggccuaccggaacaucgagcccgucuaccugaacaugcugcucgagaagcugugcgugauguucgaggacggggugcugaugcgccucaagagcgaccugcugaaggcggcccucugccaccuccugcaguacuuccucaaguucguccccgccggcuacgaguccgcccuccaggugcggaaggucuacgugcgcaacaucugcaaggcccugcucgacgugcugggcaucgaggucgacgcggaguaccugcucgggccccuguacgccgcccugaagauggagagcauggagaucaucgaggagauccagugccagacgcagcaggagaaccucuccagcaacuccgacggcaucagcccgaagcggcgccggcuguccagcucccugaaccccagcaagcgcgcccccaagcagaccgaggagaucaagcacguggacaugaaccagaaguccauccucuggagcgcccugaagcagaaggcggagucccugcagaucagccucgaguacuccgggcugaagaaccccgugaucgagaugcuggagggcaucgccgucgugcuccagcugaccgcccugugcaccgugcacugcagccaccagaacaugaacugccggacguucaaggacugccagcacaagagcaagaagaagccguccgucgugaucaccuggaugagccucgacuucuacaccaaggugcugaaguccugccgcagccugcucgaguccguccagaagcuggaccuggaggccaccaucgacaagguggugaagaucuacgacgcccucaucuacaugcaggucaacagcuccuucgaggaccacauccuggaggaccugugcggcaugcucagccugcccuggaucuacucccacagcgacgacgggugccugaagcucacgaccuucgcggccaaccugcugacccucuccugccggaucagcgacuccuacagcccccaggcccagucccgcugcguguuccugcugacccucuucccccgccggaucuuccuggaguggcgcacggccguguacaacugggcgcugcagagcucccacgaggucauccgggccagcugcgugagcggcuucuucauccuccugcagcagcagaacuccugcaaccgcgugccgaagauccugaucgacaaggucaaggacgacagcgacaucgugaagaaggaguucgccuccauccucgggcagcuggugugcacccugcacggcauguucuaccucaccagcucccugaccgagcccuucagcgagcacgggcacgucgaccuguucugccggaaccucaaggccacgucccagcacgagugcagcuccagccagcugaaggccuccgugugcaagcccuuccuguuccuccugaagaagaagauccccagcccggugaagcuggcguucaucgacaaccuccaccaccugugcaagcaccuggacuuccgcgaggacgagaccgacgucaaggccgugcucggcacccugcugaaccucauggaggaccccgacaaggacgugcgggucgccuucuccggcaacaucaagcacauccuggagagccuggacuccgaggacggguucaucaaggagcuguucgugcugcgcaugaaggaggccuacacccacgcccagaucagccggaacaacgagcugaaggacacgcucauccugaccaccggcgacaucgggcgcgcggccaagggcgaccuggugcccuucgcccuccugcaccuccugcacugccugcuguccaagagcgccuccgucagcggggccgcguacaccgagauccgggcccucguggccgccaagagcgugaagcugcaguccuucuucagccaguacaagaagccgaucugccaguuccuggucgagucccuccacagcucccagaugacggcgcugcccaacacccccugccagaacgccgacgugcgcaagcaggacguggcccaccagcgggagauggcccugaacacccucagcgagaucgccaacgucuucgacuuccccgaccugaaccgcuuccugacccggacccuccaggugcuccugccggaccuggcggccaaggccucccccgccgccagcgcgcucauccgcacgcugggcaagcagcugaacgugaaccggcgcgagauccucaucaacaacuucaaguacaucuucucccaccuggucugcagcugcuccaaggacgagcuggagcgggcccuccacuaccugaagaacgagaccgagaucgagcugggcagccuccugcgccaggacuuccaggggcugcacaacgagcuccugcugcgcaucggcgagcacuaccagcaggucuucaacgggcucuccauccuggccagcuucgccuccagcgacgaccccuaccagggcccccgggacaucaucuccccggagcugauggccgacuaccuccagcccaagcugcuggggauccucgcguucuucaacaugcagcugcugagcuccagcgugggcaucgaggacaagaagauggcccucaacagccugaugucccugaugaagcucaugggccccaagcacgugagcuccgugcgcgugaagaugaugaccacccugcggacggggcugcgcuucaaggacgacuuccccgagcucugcugccgggccugggacugcuucguccgcugccuggaccacgccugccugggcagccuccugucccacgugaucguggcgcugcucccgcugauccacauccagcccaaggagaccgccgccaucuuccacuaccugaucaucgagaaccgggacgccguccaggacuuccuccacgagaucuacuuccugcccgaccaccccgagcugaagaagaucaaggccgugcuccaggaguaccgcaaggagaccagcgaguccaccgaccugcagacgacccugcagcucagcaugaaggcgauccagcacgagaacgucgacgugcggauccacgcccugaccucccugaaggagacccucuacaagaaccaggagaagcugaucaaguacgccacggacagcgagaccguggagccgaucaucucccagcuggucaccgugcuccugaaggggugccaggacgccaacagccaggcccgccugcucugcggcgagugccugggcgagcugggggcgaucgaccccggccggcucgacuucuccaccacggagacccaggggaaggacuucaccuucgugaccggcgucgaggacagcuccuucgccuacgggcugcugauggagcucacgcgcgccuaccuggccuacgccgacaacagccgggcgcaggacuccgccgccuacgccauccaggagcugcucagcaucuacgacugccgcgagauggagaccaacggccccggccaccagcuguggcggcgcuuccccgagcacgugcgggagauccuggagccgcaccucaacacccgcuacaaguccagccagaaguccaccgacugguccggggugaagaagcccaucuaccugagcaagcugggcuccaacuucgccgaguggagcgcguccugggccggguaccucaucacgaagguccggcacgaccuggccagcaagaucuucacgugcugcuccaucaugaugaagcacgacuucaaggugaccaucuaccugcucccccacauccugguguacguccugcucggcugcaaccaggaggaccagcaggagguguacgccgagaucauggcggugcugaagcacgacgaccagcacaccaucaacacgcaggacaucgccagcgaccugugccagcucuccacccagaccgucuucagcaugcuggaccaccugacccagugggcccgccacaaguuccaggcccucaaggccgagaagugcccccacuccaagagcaaccggaacaagguggacuccauggugagcacggucgacuacgaggacuaccaguccgugacccgcuuccuggaccugaucccgcaggacacccucgcgguggccagcuuccgcuccaaggccuacacccgggccgucaugcacuucgagagcuucaucacggagaagaagcagaacauccaggagcaccugggguuccugcagaagcucuacgccgcgaugcacgagcccgacggcguggccggcguguccgccauccgcaaggccgagcccagccugaaggagcagauccuggagcacgagagccucgggcugcugcgggacgccaccgcgugcuacgaccgcgccauccagcucgagccggaccagaucauccacuaccacggcgucgugaaguccaugcuggggcugggccagcucagcaccgugaucacccaggucaacggggugcacgccaaccgguccgaguggaccgacgagcugaacacguaccgcguggaggccgcguggaagcugagccagugggaccuggucgagaacuaccucgccgccgacggcaaguccaccaccuggagcgugcggcugggccagcugcuccuguccgccaagaagcgcgacaucaccgccuucuacgacagccugaagcucgugcgggcggagcagaucgucccccuguccgccgccagcuucgagcgcggguccuaccagcggggcuacgaguacaucgugcgccugcacaugcucugcgagcuggagcacagcaucaagccccuguuccagcacucccccggggacagcucccaggaggacagccucaacuggguggcccggcuggagaugacgcagaacuccuaccgcgccaaggagccgauccuggcgcuccggcgcgcccugcugagccucaacaagcggcccgacuacaacgagauggucggcgagugcuggcugcaguccgcccgcguggcccggaaggccgggcaccaccagaccgcguacaacgcccugcucaacgccggcgagagccgccuggccgagcuguacguggagcgcgcgaaguggcucuggagcaagggcgacguccaccaggcccugaucgugcugcagaaggggguggagcucugcuuccccgagaacgagacgccgcccgagggcaagaacaugcugauccacgggcgggccaugcugcucgucggccgcuucauggaggagaccgccaacuucgaguccaacgccaucaugaagaaguacaaggacgugacggcgugccugcccgagugggaggacggccacuucuaccuggccaaguacuacgacaagcucaugcccauggugaccgacaacaagauggagaagcagggggaccugauccgguacaucguccugcacuucggccgcagccuccaguacgggaaccaguucaucuaccaguccaugccccggaugcugacccuguggcucgacuacggcaccaaggccuacgagugggagaaggccgggcgcagcgaccgggugcagaugcgcaacgaccugggcaagaucaacaaggugaucacggagcacaccaacuaccuggcccccuaccaguuccucaccgcguucucccagcugaucagccggaucugccacucccacgacgaggucuucguggugcugauggagaucaucgccaaggucuuccucgccuacccccagcaggccauguggaugaugaccgccgugagcaaguccagcuaccccaugcgcgucaaccggugcaaggagauccugaacaaggcgauccacaugaagaagucccuggagaaguucgugggcgacgccacgcgccucaccgacaagcugcuggagcucugcaacaagcccguggacgggagcuccagcacccuguccaugagcacccacuucaagaugcugaagaagcucgucgaggaggccacguucuccgagauccugaucccgcugcagagcgugaugauccccacccuccccagcauccugggcacccacgccaaccacgccucccacgagcccuucccggggcacugggcguacaucgccggcuucgacgacaugguggagauccuggccagccuccagaagcccaagaagaucucccugaaggggagcgacggcaaguucuacaucaugaugugcaagcccaaggacgaccugcggaaggacugccgccucauggaguucaacucccugaucaacaagugccugcggaaggacgccgagagccgccggcgcgagcuccacauccggaccuacgcggucaucccccugaacgacgagugcggcaucaucgagugggugaacaacacggccgggcugcgcccgauccucaccaagcuguacaaggagaagggcguguacaugaccgggaaggagcugcggcagugcaugcuccccaaguccgccgcccugagcgagaagcugaaggucuuccgcgaguuccuccugccccgccacccgccgaucuuccacgagugguuccugcggaccuuccccgaccccacguccugguacagcucccgcagcgccuacugccgguccaccgcggugaugagcauggugggcuacauccucgggcugggcgaccgccacggcgagaacauccuguucgacucccucaccggggagugcguccacguggacuucaacugccuguucaacaagggcgagaccuucgaggugccggagaucguccccuuccggcugacgcacaacauggugaacgggaugggccccaugggcaccgaggggcuguuccgccgggccugcgaggugaccaugcgccugaugcgggaccagcgcgagccccugaugagcguccucaagaccuuccugcacgacccgcugguggagugguccaagcccgugaagggccacagcaaggcgccccugaacgagacgggggaggucgugaacgagaaggccaagacccacgugcuggacaucgagcagcggcugcagggcgucaucaagacccgcaaccgggugaccgggcucccccuguccaucgagggccacgugcacuaccugauccaggaggccaccgacgagaaccuccugugccagauguaccugggcuggacgccguacauguga

SEQ ID NO: 27087 - RNA, 2097 nt, Artificial Sequence
  derived and/or modified sequence opt1 from ATRIP__Homo_sapiens__NP_001257952
augagcaagaaccccuccggcaagaaccgcgagaccgugccgaucaaggacaacuucgagcuggagguccuccaggcccaguacaaggagcugaaggagaagaugaaggugauggaggaggaggugcugaucaagaacggggagaucaagauccuccgggacagccugcaccagaccgaguccguccuggaggagcagcgccggagccacuuccuccuggagcaggagaagacgcaggcccuguccgacaaggagaaggaguucagcaagaagcuccagucccugcagagcgagcugcaguucaaggacgcggagaugaacgagcuccgcaccaagcugcagaccuccgagcgggccaacaagcuggccgcccccagcgugucccacgugagcccccgcaagaaccccuccgucgugaucaagccggaggccugcagcccccaguucggcaagaccuccuuccccacgaaggagagcuucuccgcgaacaugagccucccccacccgugccagaccgaguccggguacaagccccuggugggccgggaggacagcaagccccacagccugcgcggggacuccaucaagcaggaggaggcccagaaguccuucgucgacuccuggcggcagcgcagcaacacccagggcuccauccucaucaaccugcugcucaagcagccccugaucccgggcagcucccugagccucugccaccuccuguccagcuccagcgagucccccgccgggacgccccugcagcccccgggcuucgggagcacccuggccggcauguccgggcugcggaccaccggcagcuacgacggcuccuucagccucuccgcgcugcgcgaggcccagaaccuggccuucaccgggcucaaccugguggcccggaacgagugcagccgcgacggcgaccccgccgagggcgggcggcgcgcguucccccugugccagcuccccggcgccgugcacuuccugccgcugguccaguucuucaucgggcuccacugccaggcccugcaggaccuggccgccgcgaagcggagcggcgcccccggggacucccccacgcacagcuccugcgugagcuccggcguggagaccaaccccgaggacagcgucugcauccucgagggguucuccgugaccgcccugagcauccugcagcaccucgugugccacuccggcgccgucgugagccugcugcucuccggcgugggggccgacagcgcggccggcgaggggaaccgcucccugguccaccggcugagcgacggcgacaugaccuccgcccugcgcgggguggccgacgaccagggccagcacccgcuccugaagaugcugcuccaccuccuggccuucagcuccgcggccacgggccaccuccaggccagcgugcugacccagugccugaagguccuggugaagcuggccgagaacaccagcugcgacuuccugccccgguuccagugcgucuuccaggugcuccccaagugccugucccccgagaccccgcugcccagcgugcuccuggcggucgagcugcucucccugcuggccgaccacgaccagcucgcgccccagcugugcagccacuccgaggggugccugcuccugcugcucuacauguacaucacgagccgcccggaccgcguggcccuggagacccaguggcugcagcucgagcaggagguggucuggcugcuggccaagcucggcgugcagagcccccugccgcccgugaccgggagcaacugccagugcaacgucgagguggugcgggcccugaccgucaugcuccaccgccaguggcugacggugcggcgcgccggcgggccgccccggaccgaccagcagcgccggaccgugcgcugccugcgggacaccguccuccugcugcacggccucucccagaaggacaagcuguucaugaugcacugcguggaggugcugcaccaguucgaccaggucaugcccggcgugagcaugcucauccgcgggcugcccgacgugacggacugcgaggaggccgcccuggacgaccucugcgccgcggagaccgacgucgaggaccccgagguggagugcggcuga

SEQ ID NO: 27088 - RNA, 4290 nt, Artificial Sequence
  derived and/or modified sequence opt1 from ATRN__Homo_sapiens__NP_647537
augguggccgccgcggccgccaccgaggcccgccugcggcgccggaccgccgcgacggccgcccucgccggccgcagcgggggcccccacugggacugggacgucacccgggcggggcgcccgggccugggggccggccugcggcucccccgccugcugucccccccccuccggccgcgccugcugcuccugcugcuccugcugagccccccccuccugcugcuccugcugcccugcgaggccgaggccgccgcggccgccgccgccguguccggcagcgcggccgccgaggccaaggagugcgaccggccgugcgugaacgggggccgcugcaaccccgggaccggccagugcgucugccccgccgggugggugggcgagcagugccagcacugcggcgggcgguuccgccucaccggcuccagcggguucgugacggacggccccggcaacuacaaguacaagaccaagugcaccuggcugaucgaggggcagccgaaccggaucaugcgccugcgguucaaccacuucgcgaccgagugcuccugggaccaccucuacgucuacgacggcgacagcaucuacgccccccugguggccgccuucuccgggcugaucgugcccgagcgcgacggcaacgagacgguccccgaggugguggccaccagcggguacgcgcuccugcacuucuucuccgacgccgccuacaaccugaccggcuucaacaucaccuacagcuucgacaugugcccgaacaacugcuccggccggggggagugcaagaucagcaacuccagcgacacggucgagugcgagugcuccgagaacuggaagggcgaggccugcgacaucccccacugcaccgacaacugcggguucccccaccgcggcaucugcaacagcuccgacgugcgggggugcagcugcuucagcgacuggcagggccccggcugcuccgugccgguccccgcgaaccagagcuucuggacccgcgaggaguacuccaaccucaagcugccccgcgccagccacaaggccguggugaacgggaacaucaugugggucgugggcggguacauguucaaccacuccgacuacaacauggugcuggccuacgaccucgccagccgggaguggcugccccugaaccgcuccgucaacaacguggugguccgguacggccacagccucgcgcuguacaaggacaagaucuacauguacgggggcaagaucgacuccaccggcaacgugacgaacgagcugcgcgucuuccacauccacaacgagagcugggugcuccugaccccgaaggccaaggagcaguacgccguggucgggcacuccgcccacaucgugacccugaagaacggccggguggucaugcucgugaucuucgggcacugcccccuguacggcuacaucagcaacgugcaggaguacgaccuggacaagaacaccugguccauccuccacacgcagggcgcccugguccaggggggcuacgggcacagcuccguguacgaccaccgcacccgggcgcuguacgugcacggcggguacaaggccuucagcgccaacaaguaccgccucgccgacgaccuguaccgguacgacgucgacacccagauguggaccauccugaaggacucccgcuucuuccgguaccugcacacggccgugaucgugagcggcaccaugcucgucuucggcgggaacacccacaacgacaccuccaugagccacggcgcgaagugcuucagcuccgacuucauggccuacgacaucgccugcgaccgcuggagcgugcugccccggcccgaccugcaccacgacgugaaccgcuucgggcacuccgccguccuccacaacagcacgauguacguguucggcggguucaacucccugcugcucagcgacauccugguguucaccuccgagcagugcgacgcgcaccggagcgaggccgccugccuggccgccggcccgggcauccgcugcgucuggaacaccggguccagccagugcaucuccugggcgcucgccaccgacgagcaggaggagaagcugaagagcgagugcuucuccaagcggacgcuggaccacgaccgcugcgaccagcacaccgacugcuacagcugcaccgccaacaccaacgacugccacuggugcaacgaccacugcgugccccggaaccacuccugcagcgagggccagaucuccaucuuccgcuacgagaacugccccaaggacaacccgauguacuacugcaacaagaagacgagcugccgcagcugcgcccucgaccagaacugccagugggagccccggaaccaggagugcaucgcccugcccgagaacaucugcgggaucggcuggcaccugguggggaacuccugccucaagaucaccaccgcgaaggagaacuacgacaacgccaagcuguucugccgcaaccacaacgcccugcucgccagccugaccacccagaagaaggucgaguucgugcugaagcagcuccggaucaugcaguccagccaguccaugagcaagcugacgcugacccccugggugggccuccgcaagaucaacgucuccuacuggugcugggaggacaugagcccguucaccaacucccugcugcaguggaugcccagcgagcccuccgacgccggcuucugcgggauccucagcgagcccuccacccggggccugaaggcggccacgugcaucaacccgcugaacgggagcgugugcgagcgccccgccaaccacuccgccaagcagugccggacccccugcgcgcuccgcaccgccugcggcgacugcaccagcggguccagcgagugcauguggugcuccaacaugaagcagugcguggacagcaacgccuacgucgccagcuuccccuucggccagugcauggagugguacacgauguccaccugcccgcccgagaacugcagcggcuacugcaccugcucccacugccuggagcagcccgggugcggcuggugcaccgaccccagcaacacggggaagggcaagugcaucgagggcuccuacaaggggccggugaagaugcccagccaggcccccaccggcaacuucuacccccagccgcugcucaacuccagcaugugccuggaggacucccgguacaacuggagcuucauccacugccccgcgugccagugcaacgggcacuccaagugcaucaaccagagcaucugcgagaagugcgagaaccugaccaccggcaagcacugcgagacgugcaucuccggguucuacggcgaccccaccaacggcgggaagugccagcccugcaagugcaacggccacgccagccucugcaacaccaacaccgggaagugcuucugcacgaccaagggcgugaagggggacgagugccagcugugcgaggucgagaaccgcuaccagggcaacccgcugcggggcaccugcuacuacacccuccugaucgacuaccaguucacguucucccugagccaggaggacgaccgcuacuacaccgccaucaacuucguggccacccccgacgagcagaaccgggaccucgacauguucaucaacgccuccaagaacuucaaccugaacaucaccugggcggccagcuucuccgccgggacgcaggccggcgaggagaugcccguggucagcaagaccaacaucaaggaguacaaggacagcuucuccaacgagaaguucgacuuccgcaaccacccgaacaucaccuucuucguguacgugagcaacuucaccuggcccaucaagauccagaucgccuucucccagcacagcaacuucauggaccugguccaguucuucgugacguucuucuccugcuuccucagccugcugcucguggcggccgucguguggaagaucaagcaguccugcugggccagccggcgccgggagcagcugcugcgcgagaugcagcagauggccucccggcccuucgccagcgugaacgucgcgcucgagaccgacgaggagcccccggaccugaucgggggcuccaucaagaccgugcccaagcccaucgcccuggagcccugcuucgggaacaaggccgccgugcucagcgucuucgugcgccugccgcggggccugggcgggauccccccccccggccaguccgggcucgcgguggccagcgcccuggucgacaucucccagcagaugccgaucguguacaaggagaagagcggcgccguccgcaaccgcaagcagcagccccccgcccagcccggcaccugcaucuga

SEQ ID NO: 27089 - RNA, 4140 nt, Artificial Sequence
  derived and/or modified sequence opt1 from ATRNL1__Homo_sapiens__NP_997186
auggagaccggcgggcgcgcccggaccggcacgccccagccggccgcgcccgggguguggcgcgcccggcccgccggcgggggcggcgggggcgccagcuccuggcugcucgacgggaacagcuggcugcugugcuacggcuuccucuaccuggcccuguacgcgcaggucucccagagcaagcccugcgagcgcaccggguccugcuucagcggccggugcgugaacuccacgugccucugcgacccgggcugggugggggaccagugccagcacugccagggccgcuucaagcugaccgagcccagcggguaccugaccgacggccccaucaacuacaaguacaagaccaagugcaccuggcucaucgagggcuaccccaacgccguccugcggcugcgcuucaaccacuucgccaccgagugcuccugggaccacauguacguguacgacggggacagcaucuacgccccgcucaucgcggugcuguccggccugaucguccccgagauccgggggaacgagacggugcccgagguggucaccaccagcggcuacgcccuccugcacuucuucuccgacgccgccuacaaccugaccggguucaacaucuucuacagcaucaacuccugccccaacaacugcagcggccacggcaagugcacgaccuccgugagcgugccgucccaggucuacugcgagugcgacaaguacuggaagggggaggccugcgacauccccuacugcaaggcgaacugcggcagccccgaccacggguacugcgaccucaccggcgagaagcugugcgugugcaacgacagcuggcaggggcccgacugcucccugaacgugccgagcaccgaguccuacuggauccuccccaacgucaagcccuucagccccuccgugggccgcgccagccacaaggccgugcugcacggcaaguucaugugggucaucgggggcuacacguucaacuacuccagcuuccagauggugcugaacuacaaccucgaguccagcaucuggaacguggggaccccgucccggggcccccugcagcgcuacgggcacagccuggcccucuaccaggagaacaucuucauguacggcggccggaucgagaccaacgacgggaacgucaccgacgagcuguggguguucaacauccacucccagagcugguccacgaagacccccaccgugcugggccacgggcagcaguacgccgucgagggccacagcgcgcacaucauggagcucgacucccgcgacguggucaugaucaucaucuucggcuacagcgccaucuacggguacaccuccagcauccaggaguaccacaucagcuccaacacguggcuggugcccgagaccaagggcgccaucgugcagggcggcuacgggcacaccagcgucuacgacgagaucaccaaguccaucuacgugcacggcggcuacaaggcccugccggggaacaaguacggccucguggacgaccuguacaaguacgaggucaacacgaagaccuggaccauccugaaggagagcggguucgcccgguaccuccacuccgcggugcugaucaacggcgccaugcugaucuucgggggcaacacccacaacgacacgagccucuccaacggcgccaagugcuucagcgccgacuuccuggccuacgacaucgcgugcgacgaguggaagauccugcccaagcccaaccuccaccgcgacgugaaccgguucgggcacuccgccgucgugaucaacggcagcauguacaucuucgggggcuucuccagcgugcugcugaacgacauccucgucuacaagcccccgaacugcaaggccuuccgcgacgaggagcugugcaagaacgccgggcccggcaucaagugcguguggaacaagaaccacugcgaguccugggagagcggcaacaccaacaacauccugcgggcgaagugcccgcccaagaccgccgccuccgacgaccgcugcuaccgguacgccgacugcgccagcugcaccgcgaacacgaacgggugccaguggugcgacgacaagaagugcaucuccgccaacagcaacugcagcauguccgugaagaacuacaccaagugccacguccgcaacgagcagaucugcaacaagcucaccagcugcaaguccugcagccugaaccugaacugccagugggaccagcgccagcaggagugccaggcccugcccgcccaccucugcggcgagggguggucccacaucggcgacgccugccugcgggugaacagcucccgcgagaacuacgacaacgcgaagcuguacugcuacaaccucagcgggaaccuggccucccugaccaccagcaaggagguggaguucguccucgacgagauccagaaguacacgcagcagaaggugucccccugggugggccugcggaagaucaacaucagcuacuggggcugggaggacaugucccccuucaccaacaccacccugcaguggcucccgggggagcccaacgacagcggcuucugcgccuaccuggagcgcgccgccgucgcggggcugaaggccaaccccugcacguccauggccaacggccucgugugcgagaagcccguggucagcccgaaccagaacgcccggcccugcaagaagcccugcucccugcgcaccagcugcuccaacugcaccagcaacggcauggagugcauguggugcagcuccaccaagcggugcguggacagcaacgcguacaucaucuccuuccccuacgggcagugccuggaguggcagacggcgaccugcagcccgcagaacugcuccggccuccggaccugcgggcagugccuggagcagcccggcugcggguggugcaacgaccccagcaacaccggccgcggccacugcaucgagggguccagccgcggccccaugaagcugaucgggaugcaccacuccgagauggugcucgacacgaaccugugcccgaaggagaagaacuacgaguggagcuucauccagugccccgccugccagugcaacggccacuccacgugcaucaacaacaacgucugcgagcagugcaagaaccugaccaccgggaagcagugccaggacugcaugcccggcuacuacggcgaccccaccaacgggggccagugcaccgccugcacgugcagcgggcacgccaacaucugccaccuccacaccggcaagugcuucugcaccaccaaggggaucaagggcgaccagugccagcugugcgacuccgagaaccgguacgugggcaacccgcugcgcgggaccugcuacuacagccuccugaucgacuaccaguucaccuucucccugcuccaggaggacgaccggcaccacacggccaucaacuucaucgccaaccccgagcagagcaacaagaaccuggacaucuccaucaacgccagcaacaacuucaaccugaacaucaccugguccgugggcagcaccgccgggaccaucagcggcgaggagacguccaucgucagcaagaacaacaucaaggaguaccgcgacuccuucagcuacgagaaguucaacuuccgguccaaccccaacaucaccuucuacguguacgugagcaacuucuccuggcccaucaagauccagaucgccuucagccagcacaacaccaucauggaccucguccaguucuucgugaccuucuucuccugcuuccugagccugcuccugguggcggccgucguguggaagaucaagcagacgugcugggccucccgccggcgcgagcagcugcuccgggagcgccagcagauggccagccgcccguucgccuccguggacgucgcgcuggaggugggcgccgagcagaccgaguuccugcgggggccccucgagggcgcccccaagccgaucgccaucgagcccugcgcggggaaccgcgccgccgugcugaccgucuuccugugccucccccggggcagcuccggggcgcccccgcccggccagagcggccuggccaucgccuccgcccugaucgacaucagccagcagaaggccuccgacagcaaggacaagaccagcggggugcgcaaccggaagcaccucuccacgcgccaggggaccugcguguga

SEQ ID NO: 27090 - RNA, 7479 nt, Artificial Sequence
  derived and/or modified sequence opt1 from ATRX__Homo_sapiens__NP_000480
augaccgccgagcccaugagcgagagcaagcucaacacccucgugcagaagcugcacgacuuccuggcccacagcagcgaggagagcgaggagacguccagcccgccccggcucgccaugaaccagaacaccgacaagaucuccgggagcggguccaacagcgacaugauggagaacuccaaggaggagggcaccagcuccagcgagaaguccaagagcuccgggagcucccggagcaagcgcaagcccagcaucgugaccaaguacguggaguccgacgacgagaagccccuggacgacgagacggugaacgaggacgccagcaacgagaacuccgagaacgacaucaccaugcagagccugcccaagggcaccgugaucgugcagcccgagcccgugcucaacgaggacaaggacgacuucaaggggcccgaguuccggucccgcagcaagaugaagaccgagaaccugaagaagcggggcgaggacggccugcacgggaucguguccugcacggccugcggccagcaggucaaccacuuccagaaggacagcaucuaccgccaccccucccuccaggugcugaucugcaagaacugcuucaaguacuacaugagcgacgacaucucccgggacagcgacgggauggacgagcagugccgcuggugcgccgagggcgggaaccugaucugcugcgacuucugccacaacgccuucugcaagaagugcauccuccggaaccugggccgcaaggagcuguccaccaucauggacgagaacaaccagugguacugcuacaucugccaccccgagccccuccuggaccuggucaccgcgugcaacagcguguucgagaaccucgagcagcugcugcagcagaacaagaagaagaucaagguggacuccgagaaguccaacaaggucuacgagcacaccucccgguucagccccaagaagacguccagcaacugcaacggcgaggagaagaagcucgacgacagcugcuccgggagcgugaccuacuccuacagcgcccugaucgugcccaaggagaugaucaagaaggccaagaagcugaucgagaccaccgccaacaugaacuccagcuacgucaaguuccucaagcaggcgacggacaacuccgagaucagcuccgccaccaagcugcgccagcugaaggccuucaagagcgugcucgccgacaucaagaaggcccaccuggcgcuggaggaggaccucaacuccgaguuccgggccauggacgccgugaacaaggagaagaacaccaaggagcacaaggucaucgacgccaaguucgagaccaaggcccgcaagggcgagaagcccugcgcgcuggagaagaaggacaucagcaaguccgaggccaagcugagccggaagcaggucgacuccgagcacaugcaccagaacgugcccacggaggagcagcgcaccaacaagagcaccgggggcgagcacaagaaguccgaccggaaggaggagccccaguacgagccggccaacaccagcgaggaccucgacauggacaucgucagcgugcccuccagcgugcccgaggacaucuucgagaaccuggagacggccauggagguccaguccagcguggaccaccagggcgacggguccagcggcaccgagcaggaggucgaguccagcuccgugaagcugaacaucagcuccaaggacaaccgcgggggcaucaagagcaagaccaccgccaaggugacgaaggagcucuacgucaagcugacccccgugucccugagcaacuccccgaucaagggggcggacugccaggaggugccccaggacaaggacggcuacaagagcugcggccucaaccccaagcuggagaagugcgggcugggccaggagaacuccgacaacgagcaccucgucgagaacgaggugagccugcugcucgaggaguccgaccugcggcgcagcccccgggugaagaccaccccgcugcgccgccccacggagaccaaccccgucaccagcaacuccgacgaggagugcaacgagaccgugaaggagaagcagaagcucagcgugcccguccggaagaaggacaagcgcaacuccagcgacuccgccaucgacaacccgaagcccaacaagcugcccaagagcaagcaguccgagacgguggaccagaacagcgacuccgacgagaugcuggccauccugaaggaggugagccggaugucccacagcuccagcuccgacaccgacaucaacgagauccacaccaaccacaagacccucuacgaccugaagacccaggccgggaaggacgacaagggcaagcgcaagcgcaagagcuccacgagcggguccgacuucgacaccaagaagggcaagagcgccaagagcuccaucaucagcaagaagaagcgccagacccaguccgagagcuccaacuacgacagcgagcuggagaaggagaucaaguccaugagcaagaucggcgcggcccggaccacgaagaagcgcaucccgaacaccaaggacuucgacuccagcgaggacgagaagcacuccaagaaggggauggacaaccagggccacaagaaccucaagaccagccaggagggguccagcgacgacgccgagcggaagcaggagcgcgagaccuucuccagcgccgagggcacggucgacaaggacaccaccaucauggagcugcgggaccgccugcccaagaagcagcaggcguccgccagcaccgacgggguggacaagcucuccggcaaggaggagagcuucacgagccuggaggugcggaaggucgccgagaccaaggagaaguccaagcaccugaagaccaagaccugcaagaaggugcaggacggccucagcgacaucgccgagaaguuccugaagaaggaccaguccgacgagacgagcgaggacgacaagaagcaguccaagaaggggaccgaggagaagaagaagcccagcgacuucaagaagaaggugaucaagauggagcagcaguacgaguccagcuccgacggcaccgagaagcugcccgagcgcgaggagaucugccacuucccgaaggggaucaagcagaucaagaacggcaccacggacggcgagaagaaguccaagaagauccgggacaagaccuccaagaagaaggacgagcucagcgacuacgccgagaaguccaccgggaagggcgacagcugcgacuccagcgaggacaagaaguccaagaacggggcguacggccgcgagaagaagcggugcaagcugcugggcaagagcucccgcaagcggcaggacugcagcagcuccgacaccgagaaguacagcaugaaggaggacggcugcaacuccagcgacaagcgccucaagcgcaucgagcugcgggagcgccggaaccuguccagcaagcgcaacacgaaggagauccaguccggcagcuccagcuccgacgccgaggagagcuccgaggacaacaagaagaagaagcagcggaccagcuccaagaagaaggccgucaucgugaaggagaagaagcgcaacagccuccggaccuccaccaagcgcaagcaggccgacaucacgagcuccagcagcuccgacaucgaggacgacgaccagaacagcaucggggagggcuccagcgacgagcagaagaucaagcccgugaccgagaaccugguccuguccagccacaccggguucugccaguccagcggcgacgaggcccucuccaagagcgugcccgugaccgucgacgacgacgacgacgacaacgaccccgagaaccggaucgcgaagaagaugcugcuggaggagaucaaggccaaccucuccagcgacgaggacggguccagcgacgacgagccggaggagggcaagaagcgcacgggcaagcagaacgaggagaaccccggggacgaggaggccaagaaccaggugaacuccgagagcgacuccgacagcgaggagagcaagaagccccgguaccgccaccggcugcugcgccacaagcucaccguguccgacggcgagagcggggaggagaagaagaccaagcccaaggagcacaaggaggucaagggccggaaccgccggaagguguccagcgaggacuccgaggacagcgacuuccaggaguccggggugagcgaggaggucuccgagagcgaggacgagcagcgcccgcggacccgcuccgccaagaaggccgagcuggaggagaaccagcggagcuacaagcagaagaagaagcgccgccggaucaaggugcaggaggacuccagcuccgagaacaagagcaacuccgaggaggaggaggaggagaaggaggaggaggaggaggaggaggaggaggaggaggaggaggaggaggacgagaacgacgacagcaagucccccggcaagggccgcaagaagauccggaagauccugaaggacgacaagcuccgcacggagacccagaacgcgcugaaggaggaggaggagcggcgcaagcggaucgccgagcgcgagcgggagcgcgagaagcugcgggaggugaucgagaucgaggacgccagccccaccaagugccccaucaccaccaagcucguccuggacgaggacgaggagacgaaggagccgcugguccaggugcaccgcaacauggucaucaagcucaagccccaccagguggacggggugcaguucaugugggacugcugcugcgagagcgucaagaagaccaagaagucccccggcagcgggugcauccuggcccacugcaugggccuggggaagacccuccaggugguguccuuccugcacaccguccugcucugcgacaagcuggacuucagcacggcgcugguggugugcccccucaacaccgcccugaacuggaugaacgaguucgagaaguggcaggagggccugaaggacgacgagaagcucgaggucuccgagcuggccaccgugaagcggccgcaggagcgcagcuacaugcugcagcgguggcaggaggacggcggggugaugaucaucggcuacgagauguaccgcaaccucgcccaggggcggaacgucaagucccgcaagcugaaggagaucuucaacaaggcccugguggaccccggccccgacuucgucgugugcgacgagggccacauccucaagaacgaggcgagcgccguguccaaggccaugaacagcauccggucccgccgccggaucauccugaccgggacgccccugcagaacaaccucaucgaguaccacugcauggucaacuucaucaaggagaaccugcugggcagcaucaaggaguuccgcaaccgguucaucaacccgauccagaacgggcagugcgccgacuccaccaugguggacgugcgcgucaugaagaagcgggcccacauccucuacgagaugcuggcgggcugcgugcagcgcaaggacuacaccgcccugaccaaguuccugccgcccaagcacgaguacgugcuggccguccggaugacgagcauccagugcaagcuguaccaguacuaccucgaccaccugaccggggugggcaacaacuccgagggcgggcgcggcaaggccggggccaagcuguuccaggacuuccagaugcucagccggaucuggacccacccguggugccugcagcuggacuacaucuccaaggagaacaagggcuacuucgacgaggacagcauggacgaguucaucgcguccgacagcgacgagaccagcaugucccucagcuccgacgacuacacgaagaagaagaagaaggggaagaagggcaagaaggacagcuccagcuccggcagcggguccgacaacgacguggaggucaucaagguguggaacagccgcucccggggcgggggcgaggggaacguggacgagaccggcaacaaccccagcgucucccugaagcuggaggagagcaaggccaccuccagcuccaaccccagcucccccgccccggacugguacaaggacuucgugaccgacgccgacgcggaggugcucgagcacagcggcaagaugguccugcuguucgagauccuccgcauggccgaggagaucggggacaaggugcugguguucagccagucccugaucagccucgaccugaucgaggacuuccuggagcucgccucccgggagaagacggaggacaaggacaagccccugaucuacaagggcgaggggaaguggcugcgcaacaucgacuacuaccggcucgacggcagcaccaccgcccagucccgcaagaagugggccgaggaguucaacgacgagaccaacguccggggccgccuguucaucaucagcacgaaggcggggucccugggcaucaaccucguggccgccaaccgggugaucaucuucgacgccagcuggaaccccuccuacgacauccagagcaucuuccgcgucuaccgguucgggcagaccaagcccguguacguguaccgcuuccuggcccagggcaccauggaggacaagaucuacgaccgccaggucaccaagcagucccugagcuuccgggugguggaccagcagcaggucgagcgccacuucacgaugaacgagcucaccgagcuguacaccuucgagccggaccugcuggacgaccccaacuccgagaagaagaagaagcgggacacccccaugcuccccaaggacacgauccuggcggagcugcuccagauccacaaggagcacaucgugggguaccacgagcacgacagccugcuggaccacaaggaggaggaggagcucaccgaggaggagcgcaaggccgccugggccgaguacgaggccgagaagaagggccugaccaugcgguucaacaucccgaccggcacgaaccugccgcccguguccuucaacagccagacccccuacaucccguucaaccucggggcgcuguccgccaugagcaaccagcagcuggaggaccucaucaaccagggccgcgagaaggucguggaggccaccaacuccgugaccgccguccggauccagccccuggaggacaucaucagcgccguguggaaggagaacaugaaccugagcgaggcccaggugcaggcgcucgcccugucccgccaggccagccaggagcuggacgucaagcggcgcgaggcgaucuacaacgacgugcucaccaagcagcagaugcugaucuccugcgugcagcggauccugaugaaccgccggcuccagcagcaguacaaccagcagcagcagcagcagaugacguaccagcaggccacccuggggcaccugaugaugcccaagcccccgaaccucaucaugaaccccagcaacuaccagcagaucgacaugcgcggcauguaccagcccgucgccgggggcaugcagcccccgccccugcagcgggcgccgccgcccaugcgcuccaagaaccccggccccagccaggggaaguccauguga

SEQ ID NO: 27091 - RNA, 1236 nt, Artificial Sequence
  derived and/or modified sequence opt1 from ATXN10__Homo_sapiens__NP_001161093
auggccgcgccccgcccgccgcccgcccggcugagcggcgugaugguccccgcccccauccaggaccuggaggcccugcgcgcccugaccgcccucuucaaggagcagcggaaccgcaaccuggacaccaucgggguggcgguggaccugauccuccuguuccgggagcugcgcgucgagcaggagucccuccugacggccuuccggugcggccugcaguuccucgggaacaucgccagccgcaacgaggacucccagagcaucgugugggugcacgccuuccccgagcuguuccuguccugccucaaccaccccgacaagaagaucgucgcguacagcuccaugauccuguucaccagccugaaccacgagcggaugaaggagcucgaggagaaccugaacaucgccaucgacgugaucgacgccuaccagaagcaccccgaguccgaguggccguuccugaucaucaccgaccucuuccucaagagccccgagcuggugcaggccauguuccccaagcugaacaaccaggagcgcgucacccugcuggaccucaugaucgccaagaucacguccgacgagccccugaccaaggacgacaucccgguguuccugcggcacgcggagcucaucgccagcaccuucguggaccagugcaagaccguccugaagcuggccuccgaggagccgcccgacgacgaggaggcccucgccacgauccgccugcuggacgugcucugcgagaugaccgugaacaccgagcugcugggcuaccuccaggucuuccccgggcugcuggagcgggugaucgaccuccugcgcgugauccacgucgcgggcaaggagaccacgaacaucuucagcaacugcggcugcgugcgggccgagggggacaucuccaacguggccaacggcuucaagagccaccugauccgccucaucgggaaccugugcuacaagaacaaggacaaccaggacaaggucaacgagcuggacggcaucccccucauccuggacaacugcaacaucuccgacagcaaccccuuccugacccagugggugaucuacgccauccggaaccugaccgaggacaacucccagaaccaggaccucaucgccaagauggaggagcaggggcuggcggacgccagccugcucaagaaggugggcuucgaggucgagaagaagggcgagaagcugauccucaagagcacccgcgacacgcccaagcccuga

SEQ ID NO: 27092 - RNA, 2448 nt, Artificial Sequence
  derived and/or modified sequence opt1 from ATXN1__Homo_sapiens__NP_001121636
augaagagcaaccaggagcgcuccaacgagugccugcccccgaagaagcgggagauccccgccaccagccgcuccagcgaggagaaggcccccacccuccccuccgacaaccaccggguggagggcacggcguggcugccggggaaccccggcgggcgcggccacgggggcggccggcacgggcccgccggcaccagcgucgagcuggggcuccagcagggcaucgggcugcacaaggcccuguccaccggccucgacuacagccccccguccgccccccgcagcgugcccguggccaccacgcugcccgcggccuacgccaccccgcagcccggcacccccgucucccccgugcaguacgcccaccugccgcacaccuuccaguucaucgggagcucccaguacagcggcacguacgcguccuucauccccagccagcucaucccccccaccgccaacccggugaccuccgccgucgccagcgccgcgggggccaccacgcccucccagcggagccagcuggaggccuacagcacccugcucgccaacaugggcucccugagccagacccccggccacaaggccgagcagcagcagcagcagcagcagcagcagcagcagcagcaccagcaccagcagcagcagcagcagcagcagcagcagcagcagcagcagcaccugucccgcgcgcccgggcucaucaccccgggcagccccccccccgcccagcagaaccaguacgugcacaucuccagcuccccgcagaacacggggcggaccgccagcccccccgccaucccggugcaccugcacccccaccagaccaugaucccccacacccugacgcucggccccccgucccaggucgugaugcaguacgccgacagcgggucccacuucgugccccgcgaggcgaccaagaaggccgagagcucccggcugcagcaggccauccaggccaaggagguccugaacggcgagauggagaagagccgccgguacggcgcccccuccagcgcggaccucgggcugggcaaggccgggggcaaguccgugccccacccguacgagagccgccacguggucgugcaccccucccccagcgacuacagcucccgggaccccagcggggugcgcgccuccgucauggugcugccgaacagcaacacccccgccgcggaccucgaggugcagcaggccacccaccgggaggccucccccagcacgcugaacgacaaguccggccugcaccucggcaagcccgggcaccgcagcuacgcccuguccccgcacaccgucauccagaccacccacagcgccuccgagccccugcccgugggccuccccgcgacggccuucuacgccgggacccagccgcccgugaucggcuaccugagcgggcagcagcaggccaucaccuacgccggcucccugccccagcaccucgucauccccggcacccagccgcugcugauccccguggggagcacggacauggaggcguccggcgccgcccccgccaucgucaccagcuccccgcaguucgccgcggugccccacaccuucgugaccacggcccuccccaagagcgagaacuucaaccccgaggcccuggucacccaggccgcguacccggccauggugcaggcccagauccaccugcccgugguccagagcguggccucccccgccgcggcccccccgacccucccccccuacuucaugaaggggagcaucauccagcuggccaacggcgagcugaagaagguggaggaccucaagaccgaggacuucauccaguccgccgagaucagcaacgaccugaagaucgacuccagcaccgucgagcggaucgaggacucccacagccccggcguggccgugauccaguucgcggucggggagcaccgcgcccagguguccguggagguccugguggaguacccguucuucguguucggccagggguggagcuccugcugccccgagcggacgagccagcucuucgaccugcccugcuccaagcugagcgucggcgacgugugcaucucccucacccugaagaaccugaagaacgggagcgugaagaagggccagcccgucgacccggccuccgugcugcucaagcacagcaaggccgacggccuggccgggucccgccaccgcuacgcggagcaggagaacggcaucaaccaggggagcgcccagaugcugagcgagaacggcgagcucaaguuccccgagaagauggggcugcccgccgcccccuuccugaccaagaucgagccguccaagcccgcggccacccggaagcgccgguggagcgcccccgagucccgcaagcucgagaagagcgaggacgagcccccgcugacgcugcccaagcccucccucaucccccaggaggugaagaucugcaucgagggccggagcaacgucggcaaguga

SEQ ID NO: 27093 - RNA, 2070 nt, Artificial Sequence
  derived and/or modified sequence opt1 from ATXN1L__Homo_sapiens__NP_001131147
augaagcccgugcacgagcgcagccaggagugccugccgcccaagaagcgggaccuccccgucaccuccgaggacaugggccgcaccacgagcugcuccaccaaccacacccccagcuccgacgccagcgaguggucccgcggggugguggucgccggccagagccaggcgggggcccgggugucccugggcggggacggcgccgaggccaucaccggccugacgguggaccaguacgggaugcucuacaaggucgccgugccgcccgcgaccuucagccccaccggccugcccuccguggucaacaugagcccgcugccgcccaccuucaacguggccuccagccucauccagcaccccgggauccacuacccgccccugcacuacgcccagcugcccuccacgagccuccaguucaucggcucccccuacagccugcccuacgccgugccgcccaacuuccugcccagcccccuccugucccccagcgcgaaccuggccaccucccaccucccccacuucguccccuacgccagccugcuggccgagggggccaccccgccgccccaggcgcccucccccgcccacagcuucaacaaggcccccuccgccaccagccccuccggccagcucccgcaccacagcuccacgcagccccuggaccuggcccccggccggaugcccaucuacuaccagaugagccgccucccggcgggguacacccugcacgagaccccgcccgccggcgccucccccgugcugacgccccaggagagccaguccgcccucgaggccgcggccgccaacgggggccagcggccccgcgagcggaaccuggugcgccgggagagcgaggcccuggacucccccaacagcaagggcgaggggcagggccucguccccgugguggagugcgucguggacgggcagcuguucuccggcagccagaccccgcgcguggaggucgccgcgcccgcccaccgggggacccccgacaccgaccuggaggugcagcgcguggucggcgcccucgccucccaggacuaccggguggucgcggcccagcgcaaggaggagcccagcccgcugaaccugagccaccacacccccgaccaccagggcgaggggcggggcuccgcccgcaaccccgccgagcucgccgagaagucccaggcgcggggguucuacccccagagccaccaggagccggugaagcaccgcccccugcccaaggccaugguggucgccaacggcaaccuggugcccacggggaccgacagcggccuccugccggugggcuccgagauccuggucgccagcucccucgacgugcaggcccgggcgaccuuccccgacaaggagcccaccccgccgcccaucacgagcucccaccuccccagccacuucaugaagggggccaucauccagcuggccaccggcgagcugaagcgcguggaggaccugcagacccaggacuucguccgcuccgccgaggugagcgggggccugaagaucgacuccagcaccguggucgacauccaggagucccaguggcccggguucgugaugcuccacuucguggucggcgagcagcagagcaagguguccaucgaggugccgcccgagcaccccuucuucgucuacggccagggguggagcagcugcucccccggccggacgacccagcuguucagccugcccugccaccgccuccaggugggggacgugugcaucuccaucagccugcagucccugaacagcaacuccgucagccaggccuccugcgcgccgcccagccagcugggcccgccccgggagcgccccgagcggaccgugcucggcucccgcgagcugugcgacagcgaggggaagucccagcccgccggcgaggggagccggguggucgagcccucccagcccgagagcggcgcccaggccugcuggcccgcgcccuccuuccagcgcuacagcaugcagggggaggaggcccgggccgcccugcuccgcccguccuucaucccccaggaggugaagcugagcaucgagggccggagcaacgccggcaaguga

SEQ ID NO: 27094 - RNA, 3942 nt, Artificial Sequence
  derived and/or modified sequence opt1 from ATXN2__Homo_sapiens__NP_002964
augcgcagcgccgccgcggccccccgguccccggccguggccaccgagagccgccgguucgccgcggcccgcuggcccggcuggcggucccugcagcgccccgcccggcgcagcgggcggggcgggggcggggccgcgcccggcccguaccccuccgccgccccccccccgcccggccccgggcccccgcccagccgccaguccagcccccccuccgccagcgacugcuucggcuccaacgggaacggcgggggcgccuuccggccgggcagccgccggcuccuggggcugggcgggcccccccgccccuucgucgugcuccugcugccgcucgcgucccccggcgccccccccgccgccccgacccgggccagcccccugggcgcgcgcgccucccccccccggagcggggugucccuggcccgcccggcccccggcugcccccggccggccugcgagcccgucuacgggccccucacgaugagccugaagccccagcagcagcagcagcagcagcagcagcagcagcagcagcagcagcagcagcagcagcagcagcagcagccgccccccgcggccgccaacgugcgcaagcccggcggguccggccugcucgccagcccggccgcggcccccagccccuccagcuccagcguguccagcuccagcgccaccgcccccuccagcgucguggcggccaccuccggcgggggccggccggggcugggccgcgggcgcaacagcaacaagggccugccccaguccaccaucagcuucgacggcaucuacgccaacaugcggauggugcacauccucacguccgucguggggagcaagugcgaggugcaggucaagaacggcgggaucuacgagggcguguucaagaccuacucccccaagugcgaccuggugcuggacgccgcccacgagaagagcaccgaguccagcagcgggcccaagcgcgaggagaucauggaguccauccucuucaagugcagcgacuucgucguggugcaguucaaggacauggacuccagcuacgcgaagcgggacgccuucaccgacuccgccaucagcgccaaggucaacggcgagcacaaggagaaggaccuggagccgugggacgccggcgagcugacggcgaacgaggagcucgaggcccuggagaacgacguguccaacgggugggaccccaacgacauguuccgcuacaacgaggagaacuacggcguggucagcaccuacgacuccagccuguccagcuacaccgugccccucgagcgggacaacuccgaggaguuccugaagcgcgaggcccgggccaaccagcuggccgaggagaucgagagcuccgcgcaguacaaggcccgcguggcccucgagaacgacgaccggagcgaggaggagaaguacaccgccguccagcgcaacuccagcgagcgggaggggcacagcaucaacacgcgcgagaacaaguacauccccccgggccagcggaaccgcgaggugaucuccuggggcagcgggcggcagaacuccccccgcaugggccagcccgggagcggcuccaugcccagccgguccaccagccacaccuccgacuucaacccgaacagcggguccgaccagcgcgucgugaacggcggcgugcccuggcccagcccgugccccucccccagcucccggcccccgagccgcuaccaguccgggcccaacagccugcccccccgcgcggccaccccgacgcggccccccucccgccccccgagccggcccagccgcccccccucccacccgagcgcccacggcucccccgcccccgucagcaccaugcccaagcggauguccagcgaggggccgccccgcaugucccccaaggcccagcggcacccccgcaaccaccgggugagcgcgggccgcggguccaucagcuccggccuggaguucgugagccacaacccgcccuccgaggccgccaccccccccgucgcccggaccagcccguccggcgggacguggagcuccguggugagcggcgucccccgccucucccccaagacccaccggccgcgcagcccccggcagaacagcaucgggaacacccccuccggccccgugcuggccagcccgcaggcggggaucauccccaccgaggccguggccaugcccauccccgccgccuccccgacgcccgcgagccccgccuccaaccgcgccgucacccccagcuccgaggccaaggacagccggcugcaggaccagcgccagaacuccccggcgggcaacaaggagaacaucaagcccaacgagaccagccccuccuucagcaaggccgagaacaagggcaucucccccguggugagcgagcaccggaagcagaucgacgaccucaagaaguucaagaacgacuuccgccugcagccguccagcaccuccgagagcauggaccagcugcucaacaagaaccgggagggggagaagucccgcgaccugaucaaggacaagaucgagcccagcgccaaggacagcuucaucgagaacuccagcuccaacugcacgagcggcuccagcaagcccaacucccccagcaucuccccgagcauccuguccaacaccgagcacaagcgcgggcccgaggucaccagccagggcgugcagaccuccagccccgccugcaagcaggagaaggacgacaaggaggagaagaaggacgccgcggagcaggugcggaaguccacgcucaaccccaacgccaaggaguucaacccgcgcagcuucucccagcccaagcccagcaccacccccaccuccccgcggccccaggcccagcccagcccgagcauggucgggcaccagcagcccacgcccguguacacccagcccgugugcuucgccccgaacaugauguaccccguccccgugucccccggcgugcagccgcuguaccccauccccaugacccccaugccggucaaccaggccaagaccuaccgcgcggugcccaacaugccccagcagcggcaggaccagcaccaccagagcgccaugaugcaccccgccuccgccgccggcccgcccaucgcggccaccccccccgccuacagcacgcaguacguggccuacuccccgcagcaguuccccaaccagccccugguccagcacgugccccacuaccagagccagcacccgcacguguacucccccgucauccaggggaacgcccgcaugauggcgcccccgacccacgcccagcccggccucgugagcuccagcgccacccaguacggggcccacgagcagacccacgcgauguacgccugccccaagcugcccuacaacaaggagacguccccgagcuucuacuucgccaucuccaccggcagccuggcccagcaguacgcccaccccaacgcgacccuccacccccacaccccccacccgcagcccuccgccacgcccaccggccagcagcagagccagcacgggggcucccaccccgccccgagccccgugcagcaccaccagcaccaggccgcccaggcgcugcaccuggccuccccccagcagcagagcgccaucuaccacgccgggcucgcccccaccccgcccagcaugacccccgcguccaacacgcagagcccccagaacuccuucccggccgcccagcagaccgucuucaccauccaccccagccacgugcagcccgccuacaccaaccccccgcacauggcgcacgugccccaggcccacguccaguccggcauggugcccagccaccccacggcccacgccccgaugaugcugaugaccacccagccccccgggggcccgcaggccgcgcuggcccaguccgcccugcagcccauccccgugagcaccacggcccacuuccccuacaugacccacccguccguccaggcccaccaccagcagcagcucuga

SEQ ID NO: 27095 - RNA, 3228 nt, Artificial Sequence
  derived and/or modified sequence opt1 from ATXN2L__Homo_sapiens__NP_009176
augcugaagccccagccgcuccagcagcccagccagccccagcagcccccgcccacccagcaggccguggcccgccggccccccggcgggaccuccccgcccaacggcgggcugcccggcccccuggcgacgagcgccgccccgcccgggccccccgccgccgcguccccgugccucggccccgucgccgccgccggcagcgggcugcgccggggcgcggaggggauccuggccccccagcccccgcccccccagcagcaccaggagcgccccggcgccgccgccaucggguccgcgcggggccagagcaccggcaaggggccgccccagucccccguguucgagggcguguacaacaacagccgcaugcuccacuuccugaccgccgucgugggguccaccugcgacgugaaggucaagaacggcacgaccuacgagggcaucuucaagacccugagcuccaaguucgagcucgccguggacgccgugcaccggaaggccagcgagcccgcggggggcccgcgccgggaggacaucgucgacaccaugguguucaagcccuccgacgugaugcugguccacuuccgcaacguggacuucaacuacgccacgaaggacaaguucaccgacagcgccaucgccaugaacuccaaggugaacggggagcacaaggagaagguccugcagcggugggagggcggggacagcaacuccgacgacuacgaccucgagagcgacauguccaacggcugggaccccaacgagauguucaaguucaacgaggagaacuacggcgugaagaccaccuacgacagcagccuguccagcuacacggugccgcuggagaaggacaacuccgaggaguuccgccagcgggagcuccgcgccgcgcagcuggcccgggagaucgagagcuccccccaguaccgccugcggaucgccauggagaacgacgacgggcgcaccgaggaggagaagcacagcgccguccagcggcagggcuccgggcgcgagagccccucccucgccagccgggagggcaaguacaucccccugccgcagcgcgugcgcgaggggccccggggcggcgugcgcugcuccagcucccgggggggccgccccgggcugagcucccuccccccgcggggcccccaccaccuggacaacagcucccccgggcccggcagcgaggcgcgcggcaucaacgggggcccgucccggaugagccccaaggcccagcgcccccugcggggggccaagacccucagcucccccagcaaccgcccguccggcgagaccagcguccccccccccccggccgugggccggauguaccccccccgcucccccaagagcgcggccccggcccccaucuccgccagcugccccgagccgcccaucggguccgccgugcccacgagcuccgcgagcauccccgucaccuccagcguguccgacccgggcgucgggagcaucucccccgccagccccaagaucagccuggcccccaccgacgugaaggagcuguccaccaaggagccgggccggacgcucgagccccaggagcuggcccgcaucgccgggaaggugcccggccugcagaacgagcagaagcgguuccagcucgaggagcugcgcaaguucggcgcgcaguucaagcugcagcccagcuccagcccggagaacucccucgaccccuuccccccccggauccugaaggaggagccgaaggggaaggagaaggaggucgacggccugcucaccagcgagcccauggggucccccgugagcuccaagaccgagagcguguccgacaaggaggacaagcccccgcuggcccccagcggcgggaccgagggccccgagcagcccccgccccccugccccucccagacgggcagcccgcccgucgggcugaucaagggcgaggacaaggacgaggggcccguggccgagcaggugaagaaguccacccucaacccgaacgccaaggaguucaaccccaccaagccccugcugagcgucaacaaguccaccagcacgcccaccuccccgggcccccgcacccacagcacccccagcauccccgugcucacggccgggcaguccggccuguacagcccgcaguacaucuccuacaucccccagauccacaugggccccgcggugcaggccccccagauguacccguaccccgucagcaacuccgugcccgggcagcagggcaaguaccggggggccaagggcagccugcccccgcagcgcuccgaccagcaccagcccgccagcgcgccccccaugaugcaggccgccgccgccgcggggccgccccucguggccgccacccccuacuccagcuacauccccuacaacccgcagcaguuccccggccagcccgccaugaugcagcccauggcccacuacccgucccagcccgucuucgcgcccaugcugcagagcaacccgcgcaugcugaccuccggcagccacccccaggccaucguguccagcuccaccccccaguaccccagcgccgagcagccgacgccccaggcccucuacgccaccgugcaccaguccuacccccaccacgcgacccagcugcacgcccaccagccccagccggccaccacccccacggggagccagccccagagccagcacgccgcgcccuccccgguccagcaccaggccggccaggccccccaccuggggagcggccagccccagcagaaccuguaccaccccggcgcccucaccgggaccccgcccucccugccccccggcccgagcgcccaguccccccagagcuccuucccccagcccgcggccguguacgccauccaccaccagcagcugccgcacggguucaccaacauggcccacgugacgcaggcccacguccagaccggcaucaccgcggccccccccccgcaccccggggccccccaccccccgcaggugaugcuccugcaccccccccagagccacggcggccccccgcagggggccgugccccaguccggcguccccgcccugagcgcguccacccccagcccguaccccuacaucgggcacccccagggcgagcagcccgggcaggccccgggcuuccccggcggggccgacgaccggauccgcgaguucucccucgccggcgggaucuggcacggccgggccgaggggcugcaggugggccaggacgcgcgcgugcugggcggggaguga

SEQ ID NO: 27096 - RNA, 1041 nt, Artificial Sequence
  derived and/or modified sequence opt1 from ATXN3__Homo_sapiens__NP_001121168
auggagagcaucuuccacgagaagcaggagggcucccugugcgcccagcacugccucaacaaccugcugcagggggaguacuucagccccguggagcucuccagcaucgcccaccagcuggacgaggaggagcgcaugcggauggcggagggcggggucaccuccgaggacuaccgcaccuuccuccaggugaucagcaacgcccugaagguguggggccuggagcugauccucuucaacuccccggaguaccagcggcugcgcaucgaccccaucaacgagcggagcuucaucugcaacuacaaggagcacugguucacgguccgcaagcuggggaagcagugguucaaccucaacucccugcugaccggccccgagcucaucagcgacaccuaccuggcccuguuccucgcccagcugcagcaggagggcuacuccaucuucguggugaagggggaccugcccgacugcgaggccgaccagcuccugcagaugauccggguccagcagaugcaccgcccgaagcugaucggcgaggagcucgcgcagcugaaggagcagcgggugcacaagaccgaccuggagcgcgugcucgaggccaacgacgggagcggcaugcuggacgaggacgaggaggaccugcagcgggcccucgcccugucccgccaggagaucgacauggaggacgaggaggcggaccugcggcgcgccauccagcucagcaugcagggguccagccggaacaucucccaggacaugacgcagaccagcggcaccaaccugaccuccgaggagcugcgcaagcggcgcgaggccuacuucgagaagcagcagcagaagcagcagcagcagcagcagcagcagcagcagggcgaccucagcgggcagagcucccaccccugcgagcggcccgccacgagcuccggcgcccuggggagcgaccugggcgacgcgauguccgaggaggacaugcuccaggccgccgucaccaugagccuggagaccgugcgcaacgaccugaagaccgagggcaagaaguga

SEQ ID NO: 27097 - RNA, 2679 nt, Artificial Sequence
  derived and/or modified sequence opt1 from ATXN7__Homo_sapiens__NP_000324
augagcgagcgcgccgccgacgacgugcggggcgagccccgccgggcggccgccgccgccgggggcgcggccgccgccgcggcccgccagcagcagcagcagcagcagcagcagcagccgcccccgccccagccccagcggcagcagcacccgccgccgccgccccgccggacccgccccgaggacgggggccccggggccgccuccaccagcgccgcggccauggccacggucggcgagcggcgcccccugcccucccccgaggugaugcucggccagagcuggaaccuguggguggaggccuccaagcugcccgggaaggacggcaccgagcucgacgagagcuucaaggaguucgggaagaaccgggaggucaugggccugugccgcgaggacaugcccaucuucggguucugccccgcccacgacgacuucuaccugguggugugcaacgacugcaaccaggucgugaagccccaggcguuccagucccacuacgagcggcgccacagcuccagcuccaagccgccccucgccgugccgcccaccagcgucuucuccuucuuccccagccuguccaagagcaagggcggcuccgccagcggguccaaccggagcagcuccggcggggugcugagcgccuccagcuccagcuccaagcuccucaagagccccaaggagaagcugcagcugcgcggcaacacccggcccaugcaccccauccagcagucccgcgugccccacggccggaucaugacgcccagcgucaagguggagaagauccaccccaagauggacgggacccugcugaaguccgccgugggcccgaccugccccgcgaccgucagcucccucgugaagcccgggcugaacugccccagcauccccaagccgacgcugcccucccccggccagauccucaacgggaagggccugcccgccccgcccacccuggagaagaagcccgaggacaacagcaacaaccgcaaguuccucaacaagcggcuguccgagcgcgaguucgaccccgacauccacugcggcgugaucgaccuggacaccaagaagccgugcacccgcagccucacgugcaagacccacucccugacccagcggcgcgccguccaggggcggcgcaagcgguucgacgugcugcucgccgagcacaagaacaagacccgcgagaaggagcugauccggcaccccgacagccagcagccgccccagccccugcgcgacccccaccccgcgcccccgcggacgagccaggagccccaccagaacccccacggcgugauccccuccgagagcaagccguucgucgccuccaagcccaagccccacaccccgagccucccccgcccgcccgggugccccgcccagcagggcggguccgcccccaucgacccgccgcccgugcacgagagcccccacccgccccugcccgccaccgagcccgcgucccggcugagcuccgaggagggcgagggcgacgacaaggaggagagcguggagaagcucgacugccacuacuccgggcaccacccccagcccgccagcuucugcaccuucggcucccgccagaucgggcggggcuacuacgucuucgacagccgcuggaaccggcugcgcugcgcccugaaccucaugguggagaagcaccugaacgcccagcuguggaagaagaucccgcccguccccuccacgaccagccccaucuccacccggaucccccaccgcaccaacagcgugcccacgagccagugcgggguguccuaccucgccgcggccaccgucagcaccucccccgugcugcugagcagcacgugcaucucccccaacuccaagagcgugccggcccacggcaccacccucaacgcccagcccgccgcguccggcgccauggaccccgucugcagcaugcagucccgccaggugagcuccagcuccagcucccccagcaccccguccgggcugagcagcgugcccuccagccccaugucccggaagccgcagaagcucaagagcuccaagagccugcgccccaaggaguccagcggcaacuccaccaacugccagaacgccagcuccagcacguccgggggcagcggcaagaagcggaagaacuccagcccccugcugguccacuccagcuccagcagcuccagcuccagcuccagcucccacagcauggaguccuuccgcaagaacugcguggcccacagcgggcccccguaccccuccaccgugaccagcucccacagcaucggccucaacugcgucaccaacaaggccaacgcggugaacgugcggcacgaccaguccgggcgcggcccgcccacggggagccccgccgaguccaucaagcggaugagcgucauggugaacuccagcgacagcacccugucccugggccccuucauccaccagagcaacgagcugcccgugaacucccacggcagcuucucccacagccacacgccccucgacaagcugaucgggaagaagcgcaagugcuccccgagcuccagcuccaucaacaacagcuccagcaagcccaccaaggucgccaaggugcccgccgugaacaacguccacaugaagcacaccggcaccauccccggggcgcagggccugaugaacuccagccuccugcaccagccgaaggcccggcccuga

SEQ ID NO: 27098 - RNA, 294 nt, Artificial Sequence
  derived and/or modified sequence opt1 from ATXN7L3B__Homo_sapiens__NP_001129734
auggaggagaucagccuggccaaccucgacaccaacaagcuggaggccaucgcgcaggagaucuacguggaccugaucgaggacuccugccucggcuucugcuucgagguccaccgcgccgugaagugcggguacuucuaccuggaguucgccgagaccggcagcgugaaggacuucgggauccagcccgucgaggacaagggcgccugccggcugccgcucugcucccugcccggggagcccggcaacggccccgaccagcagcugcagcgcagcccgcccgaguuccaguga

SEQ ID NO: 27099 - RNA, 1020 nt, Artificial Sequence
  derived and/or modified sequence opt1 from AUH__Homo_sapiens__NP_001689
auggccgccgcgguggccgccgcccccggcgcccuggggagccuccacgcgggcggggcccgccuggucgccgccugcuccgcguggcugugcccgggccuccggcugcccgggagccuggccggccgccgggccggccccgccaucugggcccaggggugggugcccgcggccggcgggccggcccccaagcgcggcuacuccagcgagaugaagaccgaggacgagcuccgggugcgccaccuggaggaggagaaccgggggaucgucgugcugggcaucaaccgcgccuacggcaagaacucccucagcaagaaccugaucaagaugcuguccaaggccguggacgcgcucaagagcgacaagaagguccggaccaucaucauccgcuccgaggugcccgggaucuucugcgccggcgccgaccugaaggagcgggccaagaugagcuccagcgagguggggcccuucgucuccaagauccgcgccgugaucaacgacaucgcgaaccugccggugcccacgaucgccgccaucgacggccucgcccugggcgggggccuggagcucgcccuggcgugcgacauccgggucgccgccagcuccgccaagauggggcugguggagaccaagcucgcgaucauccccggcgggggcggcacccagcgccugccccgggccaucgggaugagccuggccaaggagcucaucuucuccgcccgcgugcuggacggcaaggaggccaaggcggucgggcugaucagccacgugcucgagcagaaccaggagggcgacgccgccuaccggaaggcccuggaccuggcccgcgaguuccucccgcaggggcccguggcgaugcgggucgccaagcuggccaucaaccagggcauggagguggaccuggugaccggccucgccaucgaggaggccugcuacgcgcagacgauccccaccaaggaccgccuggaggggcugcucgccuucaaggagaagcggcccccgcgcuacaagggcgaguga

SEQ ID NO: 27100 - RNA, 1212 nt, Artificial Sequence
  derived and/or modified sequence opt1 from AURKA__Homo_sapiens__XP_006723935
auggaccgcagcaaggagaacugcaucuccggccccgugaaggccaccgccccggucgggggccccaagcgggugcuggugacccagcaguuccccugccagaacccccucccggucaacagcgggcaggcgcagcgcgugcugugccccuccaacagcucccagcggaucccccugcaggcccagaagcucgugagcucccacaagcccguccagaaccagaagcagaagcagcugcaggccacgagcgugccgcaccccgugucccgcccccugaacaacacccagaaguccaagcagccccucccgagcgcccccgagaacaaccccgaggaggagcuggccagcaagcagaagaacgaggaguccaagaagcggcagugggcgcuggaggacuucgagaucggccgcccccucgggaagggcaaguucggcaacgucuaccuggcccgggagaagcagagcaaguucauccuggcccucaaggugcuguucaaggcccagcuggagaaggcggggguggagcaccagcuccgccgggaggucgagauccagucccaccuccgccacccgaacauccugcggcuguacggcuacuuccacgacgccacccgcguguaccugauccuggaguacgcgccccucgggaccguguaccgggagcugcagaagcugagcaaguucgacgagcagcgcacggccaccuacaucaccgagcucgccaacgcccuguccuacugccacagcaagcgggucauccaccgcgacaucaagcccgagaaccugcuccugggcuccgccggggagcugaagaucgccgacuucggcuggagcgugcacgcccccagcucccggcgcaccacgcucugcggcacccuggacuaccugccgcccgagaugaucgaggggcggaugcacgacgagaagguggaccucuggagccugggcguccugugcuacgaguuccucguggggaagccgcccuucgaggccaacaccuaccaggagaccuacaagcgcaucucccggguggaguucacguuccccgacuucgucaccgagggcgcgcgcgaccugaucagccgccugcucaagcacaaccccucccagcggcccaugcugcgcgaggugcuggagcaccccuggaucaccgccaacagcuccaagccgagcaacugccagaacaaggaguccgccagcaagcaguccuga

SEQ ID NO: 27101 - RNA, 1038 nt, Artificial Sequence
  derived and/or modified sequence opt1 from AURKB__Homo_sapiens__NP_001271455
auggcccagaaggagaacagcuaccccuggcccuacggccgccagaccgcccccuccgggcugagcacccucccccagcgggugcugcgcaaggagcccgucacgccguccgcgcuggugcucaugagccgguccaacgugcagcccaccgccgcccccggccagaaggucauggagaacagcuccgggacccccgacauccugacccgccggcacuucacgaucgacgacuucgagaucggccgcccgcuggggaagggcaaguucggcaacguguaccucgcccgggagaagaagucccacuucaucguggcccugaagguccuguucaagagccagaucgagaaggaggggguggagcaccagcuccgccgggagaucgagauccaggcgcaccuccaccaccccaacauccugcgccuguacaacuacuucuacgaccggcgccggaucuaccugauccuggaguacgcgccccgcggcgagcucuacaaggagcugcagaaguccugcaccuucgacgagcagcggaccgccaccaucauggaggagcuggccgacgcccucauguacugccacgggaagaaggugauccaccgcgacaucaagcccgagaaccugcugcucggccugaagggggagcugaagaucgccgacuucggcuggagcguccacgccccgagccuccggcgcaagacgaugugcggcacccuggacuaccugccgcccgagaugaucgaggggcggaugcacaacgagaagguggaccucuggugcaucggcgugcugugcuacgagcugcucgucgggaacccgcccuucgaguccgccagccacaacgagaccuaccgccggaucgugaagguggaccugaaguuccccgccuccguccccaugggcgcgcaggaccugaucagcaagcuccugcgccacaaccccuccgagcgccugccccucgcccaggugagcgcccaccccugggugcgggccaacucccgccggguccugccgcccagcgcccugcagagcguggcguga

SEQ ID NO: 27102 - RNA, 930 nt, Artificial Sequence
  derived and/or modified sequence opt1 from AURKC__Homo_sapiens__NP_001015878
augagcagcccccgcgccgugguccagcugggcaaggcccagcccgcgggggaggagcucgccaccgccaaccagaccgcccagcagcccagcucccccgccaugcggcgccugacgguggacgacuucgagaucggccggccccuggggaagggcaaguucgggaacguguaccucgcgcgccugaaggagagccacuucaucgucgcccugaagguccucuucaagucccagaucgagaaggagggccuggagcaccagcugcggcgcgagaucgagauccaggcccaccuccagcacccgaacauccugcggcuguacaacuacuuccacgacgcccgccggguguaccucauccuggaguacgcgccccgcggcgagcuguacaaggagcuccagaaguccgagaagcuggacgagcagcggaccgccaccaucaucgaggagcuggccgacgcccucaccuacugccacgacaagaaggugauccaccgcgacaucaagcccgagaaccugcugcucggguuccggggcgaggugaagaucgccgacuucgggugguccgugcacacgcccagccugcgccggaagaccaugugcggcacccuggacuaccucccgcccgagaugaucgaggggcgcaccuacgacgagaaggucgaccuguggugcaucggcgugcugugcuacgagcuccuggugggcuacccgcccuucgaguccgcgagccacuccgagacguaccggcgcauccugaaggucgacgugcgguucccccucagcaugccccugggggcccgcgaccugaucucccggcuccugcgcuaccagccccuggagcgccucccccuggcccagauccugaagcacccgugggugcaggcccacagccggcgcguccucccgcccugcgcccagauggcguccuga

SEQ ID NO: 27103 - RNA, 3708 nt, Artificial Sequence
  derived and/or modified sequence opt1 from AUTS2__Homo_sapiens__NP_001120703
auggacggccccacccgggggcacggccugcggaagaagcgccggagccgcagccagcgggaccgcgagcggcgcagccgcgggggccucggggccggcgccgccggcgggggcggggccggccgcacccgggcccugagccuggccagcuccagcggguccgacaaggaggacaacggcaagccgcccagcuccgcccccagccgcccccggccgccccgccggaagcgccgggaguccacgagcgcggaggaggacaucaucgacggcuucgccaugaccuccuucgugaccuucgaggcccucgagaaggacgucgcccugaagccccaggagcgcguggagaagcggcagacgccccucaccaagaagaagcgcgaggcccucaccaacgggcugagcuuccacuccaagaagucccggcugucccacccgcaccacuacagcuccgaccgcgagaacgaccgcaaccucugccagcaccugggcaagcggaagaagaugcccaaggcccugcgccagcucaagcccgggcagaacagcugccgggacagcgacuccgagagcgccuccggcgagagcaagggcuuccaccgcuccagcucccgggagcgccugagcgacuccagcgcccccuccagccuggggaccggcuacuucugcgacuccgacagcgaccaggaggagaaggccuccgacgccagcuccgagaagcuguucaacaccgugaucgucaacaaggacccggagcugggggugggcacccugcccgagcacgacagccaggacgccgggcccaucgugcccaagaucuccggccucgagcggagccaggagaagucccaggacugcugcaaggagccgaucuucgagcccgucgugcugaaggaccccugcccccagguggcccagccgaucccccagccccagaccgagccccagcugcgcgccccgucccccgaccccgaccucguccagcggaccgaggcgccgccccagcccccgccccugagcacccagccgccccagggcccgcccgaggcgcagcugcagcccgcgccccagccccaggugcagcgcccgccccggccccagucccccacgcagcuccugcaccagaaccugccgcccgugcaggcccaccccagcgcccagucccucagccagccccuguccgccuacaacagcuccagccugucccucaacagccuguccagcucccgcagcuccacccccgccaagacccagcccgccccgccccacaucagccaccaccccagcgccucccccuucccccugagccuccccaaccacagcccccugcacuccuucacccccacccugcagcccccggcccacucccaccaccccaacauguucgcgccgcccaccgcgcucccgccgccgccgccccugaccagcgggucccugcaggucgccggccaccccgccgggagcaccuacuccgagcaggacauccuccggcaggagcugaacacgcgcuuccuggccagccaguccgccgaccggggcgccagccucgggcccccgcccuaccugcgcaccgaguuccaccagcaccagcaccagcaccagcacacccaccagcacacccaccagcacacguucacccccuucccccacgccaucccgcccaccgccaucaugcccacccccgcgccgcccauguucgacaaguaccccacgaagguggaccccuucuaccggcacucccuguuccacagcuacccgcccgcgguguccggcaucccgcccaugaucccgcccaccggccccuucgggagccuccagggcgccuuccagcccaagcugaccgaccccuuccgccccaugcugcggaagcccgggaaguggugcgccaugcacguccacaucgccuggcagaucuaccaccaccagcagaaggugaagaagcagaugcaguccgacccccacaagcucgacuucggccugaagcccgaguuccugagccggccgcccgggcccucccuguucggcgccauccaccacccccacgaccucgcgcgccccagcacccuguucagcgccgccggcgccgcccaccccacggggacccccuucgggcccccgccccaccacuccaacuuccugaaccccgcggcccaccucgagccguucaaccggcccagcaccuucaccggccuggccgccgugggcggcaacgcguucgggggccuggggaaccccuccgucacgcccaacagcauguucggccacaaggacgggccguccgugcagaacuucagcaacccccacgagcccuggaaccgccuccaccggacgccgcccuccuuccccacgcccccgcccuggcugaagcccggcgagcuggagcgcagcgccuccgccgccgcccacgaccgggaccgcgacguggacaagcgggacagcuccgucagcaaggacgacaaggagcgcgaguccguggagaagcggcacagcucccaccccagccccgcgcccgugcuccccgucaacgcccugggccacacccgcuccagcaccgagcagauccgggcccaccugaacacggaggcccgcgagaaggacaagcccaaggagcgggagcgcgaccacuccgagagccggaaggaccucgccgcggacgagcacaaggccaaggaggggcaccuccccgagaaggacggccacgggcacgagggccgcgccgccggggaggaggccaagcagcuggcgcgggugcccagccccuacguccgcacccccgugguggaguccgcccggccgaacagcaccuccagccgcgaggccgagccccggaagggcgagcccgccuacgagaaccccaagaaguccagcgaggucaaggugaaggaggagcgcaaggaggaccacgaccugccgcccgaggcgccccagacccaccgcgccuccgagcccccgccgcccaacagcuccagcuccgugcaccccggcccccuggccagcaugcccaugacggucggggugaccggcauccaccccaugaacuccaucagcucccuggaccggacccgcaugaugacccccuucauggggaucagcccgcuccccggcggggagcgguuccccuacccguccuuccacugggaccccauccgcgacccccugcgggaccccuaccgcgagcuggacauccaccggcgcgacccgcucggccgggacuuccugcugcgcaacgacccccuccaccggcugagcacgccccgccuguacgaggccgaccgguccuuccgcgaccgggagccccacgacuacagccaccaccaccaccaccaccaccacccgcucagcguggacccccgccgggagcacgagcgcggcgggcaccuggacgagcgggagcgccugcacaugcuccgcgaggacuacgagcacacccggcugcacuccguccaccccgccagccuggacggccaccucccccacccgucccugaucacccccgggcugcccagcaugcacuacccccgcaucuccccgaccgcgggcaaccagaacgggcuccugaacaagacgccgcccaccgccgcccugagcgcgcccccgccccucaucuccacccugggcggccggcccgugagcccccgccggaccacgccccuguccgccgagauccgcgagcggccgcccagccacacccucaaggacaucgaggcgcgcuga

SEQ ID NO: 27104 - RNA, 1089 nt, Artificial Sequence
  derived and/or modified sequence opt1 from AVEN__Homo_sapiens__NP_065104
augcaggccgagcgcggcgcccgcgggggccgggggcggcgccccggccgggggcgcccgggcggcgaccggcacagcgagcgccccggggcggccgccgccguggcccggggcgggggcgggggcggcgggggcgacgggggcggccgccgggggcgcggccgggggcgcggcuuccgcggggcgcggggcggccgcgggggcgggggcgccccgcgggggucccggcgcgagcccggcggcuggggcgccggggccagcgcgccggucgaggacgacuccgacgccgagaccuacggggaggagaacgacgagcagggcaacuacagcaagcggaagaucguguccaacugggaccgcuaccaggacaucgagaaggaggugaacaacgagagcggggagucccagcgcggcaccgacuucagcguccugcucuccagcgccggcgacuccuucagccaguuccgguucgccgaggagaaggagugggacuccgaggccagcugccccaagcagaacuccgcguucuacguggacagcgagcugcuggugcgcgcccuccaggagcugccccugugccuccggcugaacgucgccgccgagcuggugcaggggacggugccccucgaggucccccaggugaagcccaagcgcaccgacgacggcaaggggcugggcaugcagcugaagggcccccucgggcccggcgggcggggcccgaucuucgagcugaaguccguggccgcggggugccccguccugcucggcaaggacaaccccagccccggcccgucccgcgacagccagaagcccaccagcccccugcaguccgccggggaccaccuggaggaggagcucgaccugcugcucaaccuggacgcccccaucaaggagggcgacaacauccugccggaccagaccagccaggaccucaaguccaaggaggacggggagguggugcaggaggaggaggucugcgccaagcccagcgugacggaggagaagaacauggagcccgagcagcccuccaccagcaagaacgugaccgaggaggagcuggaggacuggcuggacuccaugaucagcuga

SEQ ID NO: 27105 - RNA, 495 nt, Artificial Sequence
  derived and/or modified sequence opt1 from AVP__Homo_sapiens__NP_000481
augcccgacaccaugcugccggccugcuuccucggccugcuggccuucagcuccgcgugcuacuuccagaacugcccccgcgggggcaagcgggccaugagcgaccucgagcugcgccagugccugcccugcgggcccggcgggaagggccggugcuucggcccguccaucugcugcgccgacgagcucgggugcuucgugggcaccgccgaggcccugcgcugccaggaggagaacuaccugcccagccccugccaguccgggcagaaggcgugcggcagcgggggccggugcgccgccuucggcgucugcugcaacgacgaguccugcgugacggagcccgagugccgcgagggguuccaccggcgcgcccgggcgagcgaccgcuccaacgccacccagcucgacggcccggccggggcccugcugcuccggcuggugcagcuggccggcgcgcccgagcccuucgagcccgcccagccggacgccuacuga

SEQ ID NO: 27106 - RNA, 444 nt, Artificial Sequence
  derived and/or modified sequence opt1 from AVPI1__Homo_sapiens__NP_068378
augggcacccccgccagcguggucuccgagccgccgcccuggcaggcccccaucgaggcgcgcgggcggaagcaggccagcgccaacaucuuccaggacgccgagcugcuccagauccaggcccuguuccagcgcuccggcgaccagcuggcggaggagcgggcccagaucaucugggagugcgccggggaccaccgcguggccgaggcgcucaagcggcugcgccggaagcgcccgccccggcagaagccccugggccacagccuccaccacugcucccgccugcggauccuggagccccacagcgcccucgccaacccccaguccgccaccgagacggccagcuccgagcaguaccugcacagccgcaagaaguccgcgcggauccgccggaacuggcgcaagagcgggcccaccuccuaccugcaccagauccggcacuga

SEQ ID NO: 27107 - RNA, 1257 nt, Artificial Sequence
  derived and/or modified sequence opt1 from AVPR1A__Homo_sapiens__NP_000697
augcgccugagcgccggccccgacgccgggccguccggcaacagcucccccugguggccccuggcgaccggggccggcaacaccagccgggaggccgaggcccugggggagggcaacgggcccccgcgcgacgugcggaacgaggagcuggccaagcucgagaucgcgguccuggccgugacguucgccguggccguccugggcaacuccagcgugcuccuggcgcugcaccgcacgccccggaagaccucccgcaugcaccucuucauccggcaccugagccuggccgaccucgccguggccuucuuccagguccugccccagaugugcugggacaucaccuaccgcuuccggggccccgacuggcugugccgcguggugaagcaccuccaggucuucgggauguucgccuccgcguacaugcugguggugaugaccgccgaccgguacaucgccgucugccacccgcugaagacccuccagcagcccgcccgccggagccgccugaugaucgccgcggccugggugcuguccuucgugcucagcacgccccaguacuucgucuucuccaugaucgaggugaacaacgugaccaaggcccgggacugcugggccaccuucauccagcccuggggcagccgcgccuacgucaccuggaugaccgggggcaucuucguggcgccgguggucauccuggggaccugcuacggcuucaucugcuacaacaucuggugcaacgugcggggcaagacggccucccgccagagcaagggggccgagcaggccggcguggccuuccagaagggcuuccugcucgcgcccugcgucuccagcgugaaguccaucagccgggccaagauccgcaccgucaagaugaccuucgugaucgugaccgccuacaucgucugcugggcccccuucuucaucauccagauguggagcgugugggaccccauguccguguggacggagagcgagaacccgaccaucaccaucaccgcgcugcuggggucccucaacagcugcugcaaccccuggaucuacauguucuucuccggccaccuccugcaggacugcguccagagcuuccccugcugccagaacaugaaggagaaguucaacaaggaggacacggacuccaugagccggcgccagaccuucuacuccaacaaccgcagccccaccaacuccaccgggauguggaaggacagcccgaaguccagcaaguccaucaaguucauccccgugagcacguga

SEQ ID NO: 27108 - RNA, 1275 nt, Artificial Sequence
  derived and/or modified sequence opt1 from AVPR1B__Homo_sapiens__NP_000698
auggacagcggcccccugugggacgccaacccgacgccccgcgggacccucuccgcccccaacgcgaccacccccuggcugggccgggacgaggagcuggccaagguggagaucgggguccucgccaccgugcuggugcuggccaccggcgggaaccucgccguccugcugacgcucggccagcugggccgcaagcggagccgcaugcaccuguucgugcuccaccuggcgcugaccgaccucgccguggcccuguuccagguccugccgcagcuccugugggacaucaccuaccgguuccaggggcccgaccugcucugccgcgccgugaaguaccuccaggugcuguccauguucgcgagcaccuacaugcugcuggccaugacgcuggaccgguaccucgccgucugccacccccugcgcucccugcagcagcccggccagagcaccuaccuccugaucgccgccccguggcugcucgcggccaucuucucccugccccagguguucaucuucagccugcgggaggugauccagggguccggcguccucgacugcugggccgacuucggguuccccuggggcccccgcgccuaccugaccuggaccacgcuggccaucuucgugcucccggugaccaugcugaccgcgugcuacagccugaucugccacgagaucugcaagaaccucaaggucaagacccaggccuggcgggugggcgggggcggguggcgcacgugggaccggcccucccccagcacccuggccgccaccacccgcggccugcccucccgggugagcuccaucaacacgaucagccgcgccaagauccggaccgucaagaugaccuucgugaucgugcucgcguacaucgccugcugggccccguucuucuccguccagauguggagcgugugggacaagaacgcccccgacgaggacuccaccaacguggccuucacgaucagcaugcugcugggcaaccucaacagcugcugcaaccccuggaucuacaugggguucaacucccaccuccugccccgcccgcugcggcaccuggcgugcugcggcgggccccagccccgcaugcggcgccgccugagcgacggcucccugagcucccggcacaccacccuccugacccgcagcuccugccccgccacgcugagccucucccugagccugacccucuccgggcggccgcgccccgaggagagcccccgggaccuggagcuggccgacggcgagggcaccgccgagaccaucaucuucuga

SEQ ID NO: 27109 - RNA, 930 nt, Artificial Sequence
  derived and/or modified sequence opt1 from AVPR2__Homo_sapiens__NP_001139623
augcugauggccagcaccaccuccgccgugcccggccacccgagccuccccucccugcccagcaacuccagccaggagcgcccccuggacacgcgggacccgcuccuggcgcgcgccgagcuggcccuccuguccaucgucuucguggccguggcccugagcaacgggcucguccuggcggcccuggcccggcgcggccggcgcgggcacugggcccccauccacguguucaucggccaccucugccuggcggaccuggccguggcccucuuccagguccugccccagcuggccuggaaggccaccgaccgguuccgcgggcccgacgcgcucugccgggccgugaaguaccugcagauggugggcauguacgccuccagcuacaugauccuggccaugacccucgaccgccaccgggccaucugccgcccgaugcuggcguaccggcacggcuccggggcccacuggaaccgccccguccugguggccugggccuucagccuccugcugucccucccccagcuguucaucuucgcccagcggaacguggagggcgggagcggcgucaccgacugcugggcgugcuucgccgagcccugggggcgccggacguacgugaccuggaucgcccugaugguguucgucgccccgacccucggcaucgccgcgugccaggugcugaucuuccgcgagauccacgccucccuggugcccggccccagcgagcggcccgggggccgccggcgcgggcgccggaccggcuccccgggcgagggggcccacgucagcgccgcgguggccaagacggugcgcaugacccucgucaucgugguggucuacgugcugugcugggcccccuucuuccugguccagcucugggccgccugggaccccgaggcgccccuggagggcgggugcucccggggcuga

SEQ ID NO: 27110 - RNA, 987 nt, Artificial Sequence
  derived and/or modified sequence opt1 from AWAT1__Homo_sapiens__NP_001013597
auggcccacagcaagcagcccucccacuuccagagccugaugcuccugcaguggccgcuguccuaccucgccaucuucuggauccugcagccccuguucguguaccuccuguucaccagccuguggccccuccccguccuguacuucgcguggcuguuccucgacuggaagaccccggagcgcggcgggcggcgcuccgccugggugcggaacuggugcguguggacgcacauccgcgacuacuuccccaucaccauccugaagaccaaggaccugagccccgagcacaacuaccucaugggcguccacccccacgggcugcugaccuucggcgccuucugcaacuucugcacggaggccaccggguucuccaagaccuucccgggcaucacgccccaccucgccacccugagcugguucuucaagauccccuucgugcgggaguaccugauggcgaagggcgugugcuccgucagccagcccgccaucaacuaccuccugucccacgggaccggcaaccugguggggaucguggucggcggggugggcgaggcccuccagagcgugccgaacaccaccacgcugauccugcagaagcgcaagggcuucguccggaccgcccuccagcacggggcgcaccuggugcccaccuucaccuucggcgagacggagguguacgaccagguccuguuccacaaggacucccgcauguacaaguuccagagcugcuuccggcgcaucuucggguucuacugcugcguguucuacggccaguccuucugccagggcagcaccgggcuccugcccuacucccggcccaucgugaccgucgugggcgagccgcugccccucccccagaucgagaagcccagccaggagaugguggacaaguaccacgcccuguacauggacgcccugcacaagcuguucgaccagcacaagacccacuacgggugcuccgagacgcagaagcuguucuuccucuga

SEQ ID NO: 27111 - RNA, 3039 nt, Artificial Sequence
  derived and/or modified sequence opt1 from AXDND1__Homo_sapiens__NP_653297
augagccugcccaagaccccguccacgccccucaacagcaccuccaccagcgaguccaagaagcugaaggugagcgucgccaaggagggcacccgcgggcugcccgagcucaaggagaagaagaacaugguggaccgguccaagcugcugcccaccagccuccagaacgaguucaucccgaaggaggugcugcugucccucacguacgccgcgaacgccggccccugccccgagaaccugcugcccccgaagaagaucaagacccccaaggggacccucccccgccuggucgaccacguguggcaccaccccgugcggcgcaacaaguucaaguaccugaucgaccacccggucagccucaccggcgccgggcgggacaucuccuuccuguacgacgugacguacgccaagggccagacccgcgagaaggccgugugcccgccccaccuggcgcggagccuccagucccacgacggcgucaucgugccccacaagcccaagacccugaccgacacgcugauccccgaggaguuccacaucgugagcuccaccggggucagcggccucgagugcuacgacgacaaguacaccacccugcugacggacuccgagaaccgccuccugcuguuccccagcaugaagcccaacaagcggguggagguggcccagcucaacgacgucauggacaccaugcuggagcgcgccgggguggagaaccaggaguacaccggcccgaccaagaugcacaagcugcuccacauccugaagaaggagcagacgaucuacaacaugaucuuccacgagcugauccggcaggucuccguggacugcgccgaccgcggggagcuccugagcaaggugcgggagcgcuacgugcagaugcuggaccagaucgcgcggcagaugaucgacuucuacaaggaccucgucacccagcgcgugauggaccagcggauccuggaggagcuguacaacuucaagcacgugaucgaggagcucacccgcgagcugugccugguccgggcccacgacgugaagcucaccaaggagacggagaaggcccacaaggaccuggcccaggcccugcucaacgcggagaagaacgccaagaucgucgaggaguaccacgaccuguacacccugcagcgcgagcggauggagaacgacaugaagaagcucguggccgagcgcgacaucuggagcuccgccaccuacgagcuggcccugaaggugaucgagcgcaaccgggucauccuggcgcgccggcucuaccugaacgagaagggcuggaacaaguacaccaagcacuucaucauccugcucagcaacaaggacacggaggaccuggcccugcuccagaagcugacccagaaguggcgcaaccuggugaacaagcucaagcaggagguggagcagauggaggaguccaccagcgagacccugaagaucgucaaggacggccugaucaaguggcaggaguucuucaacgagaaggacauccucucccccaacaaggggaacaucuucaacagcgugcugcuggacuucaagcaguggcagaagauccucaacgagaagaaggaggaguucacgggcgacgugcugcuguccaaguacgacacccucaagaucaucaagcaccuccaggagaacugggccgacaucgggcugggcaucuucaaccggcacaagagccuggagggcgagaugcccuccgagcgccaguacauggaggagaucaucaagaacauccagaagcuguacaaggaguacgagauccggaucaacggggacaacggcuacagcaagauccugcccucccucaucagcucccuggacuucugcagcuucaagcuggagaaccucgaguucccggacacgccccuggaggaguggcaggagaucgacgagaagaucaacgagaugaagucccaccuggacauccuccugaaccugaccgggaucgucccccagcacaucgacguggacagcguguccguccuccaggccuacaucuucaacaugauccagcaguggcugcugaagaucggcaacgagaucaacaacgggaacaucgagcuccagcaccacauggacgagcugcacaucagcaugauccaguggauggugaaccugcucauccugaugauccccaacuucaccgaccaggacugccugcucaagcuggaggaggaguccgccgagaagcacgacaucggcguggcgcgccuggagcucgacgccaucgagcugacccggaagcuguaccaguacagcagcuaccucuccagcugcugcaagggcauggucaccgccauggcccuguccaagagcaccaacucccacaagaacgccaccgaggaccuguacgagguggacaagcucaagaaggagugcuacgaguggaucaacacgugcagcugccugcuguccaacaucaaggggcgcaagaucacccuccugaccuacgaggagaucgagcggcugcucgaggaggaggcggugaaggaguucaucgagccggagaucgacgagagcuucaaggaggacgaggaggaguccaaggaggaccgcaagcugcaggaggagaacaaggagcgggccgaggagcagcccagcaccuccacggagaaggagaagcugauccgcuucaucggcgaggacgagaacguccacagcaagccccucuucgagaccgacgugcuguccagcuggcgggaguccgccaagcaggggacccuggcccagaaguaccucgaggcgauggccgugaucgagcacaugcaggagaagcugcuggaggucgagaaccgcgcccggcaggccgaggagaaguucgaggacgccuacgagaagcuccaccacacccugaucaagaacaaggaccuggaggagcucgugaugacgagccgcaaggaguccaaggaggagaaggagaaccaggacgagcgggaggugaaggaggaggaggagcagcaggaggaggaggagguccgcagcgcggagaacagcuccaagagcccgaagaagggccacuga

SEQ ID NO: 27112 - RNA, 2589 nt, Artificial Sequence
  derived and/or modified sequence opt1 from AXIN1__Homo_sapiens__NP_003493
augaacauccaggagcagggcuucccccuggaccucggggccagcuucaccgaggacgccccgcgcccgcccgugcccggcgaggagggggagcuggucuccaccgacccccggcccgcgagcuacuccuucugcagcggcaagggggugggcaucaagggcgagacguccaccgccacgccccgccggagcgaccuggaccucggguacgagcccgagggcuccgccagcccgaccccgcccuaccugaagugggccgagucccugcacagccuccuggacgaccaggacgggaucucccuguuccgcaccuuccucaagcaggagggcugcgccgaccugcuggacuucugguucgcgugcaccggguuccggaagcucgagcccugcgacagcaacgaggagaagcgccugaagcuggcccgggccaucuaccgcaaguacauccucgacaacaacggcaucgugucccggcagaccaagcccgccaccaagagcuucaucaagggcugcaucaugaagcagcugaucgaccccgcgauguucgaccaggcccagacggagauccaggccaccauggaggagaacaccuaccccuccuuccucaagagcgacaucuaccuggaguacacccgcacgggguccgagagccccaaggucugcuccgaccagagcagcggcuccgggaccggcaagggcaucagcggguaccugccgacccugaacgaggacgaggaguggaagugcgaccaggacauggacgaggacgacggccgggacgccgccccgcccgggcgccucccccagaagcugcugcucgagaccgcggcgccccggguguccagcucccgccgguacagcgagggccgcgaguuccgguacggguccuggcgcgagcccgugaaccccuacuacgucaacgccggcuacgcccuggcccccgccacgagcgccaacgacuccgagcagcagagccuguccagcgacgccgacacccucucccugaccgacagcuccguggacggcaucccgcccuaccggauccgcaagcagcaccggcgcgagaugcaggagagcgugcaggucaacgggcgcgugccccugccccacaucccgcggaccuaccgcgugcccaaggagguccggguggagccccagaaguucgccgaggagcucauccaccgccuggaggccgugcagcggacgcgcgaggcggaggagaagcuggaggagcggcucaagcgcguccggauggaggaggagggcgaggacggggacccguccagcggcccgcccgggcccugccacaagcugccgcccgcccccgccuggcaccacuucccgccccgcugcguggacaugggcugcgccggccugcgggacgcccacgaggagaaccccgaguccauccucgacgagcacgugcagcgcguccugcggacccccgggcgccagagccccggccccgggcaccggagccccgacuccggccacguggcgaagaugcccguggcccucgggggcgccgccagcggccacgggaagcacguccccaaguccggcgcgaagcuggacgccgccgggcugcaccaccaccgccacgugcaccaccacgugcaccacagcaccgcccggccgaaggagcaggucgaggccgaggcgacccgccgggcccaguccagcuucgccuggggccuggagccccacucccacggcgcccgcagccgcggguacuccgagagcgugggcgccgcgcccaacgccuccgacgggcucgcccacagcggcaaggucgggguggccugcaagcggaacgccaagaaggcggaguccggcaagagcgccuccacggaggugcccggcgccagcgaggacgccgagaagaaccagaagaucaugcaguggaucaucgagggggagaaggagaucucccgccaccggcgcaccggccacgggagcagcggcacccggaagccgcagccccacgagaacucccgcccccugagccuggagcaccccugggcggggccgcagcuccggaccuccguccagcccagccaccuguucauccaggaccccacgaugccgccccaccccgcccccaacccgcugacccagcucgaggaggcccgccggcgccuggaggaggaggagaagcgggccucccgcgcccccagcaagcagcgguacgugcaggaggugaugcgccggggccgcgcgugcguccggcccgccugcgcccccgugcugcacguggucccggccguguccgacauggagcugagcgagaccgagacccgcucccagcggaaggugggcgggggcagcgcccagcccugcgacuccaucgucguggcguacuacuucugcggggagcccauccccuaccgcacgcucgugcggggccgcgccgucacccuggggcaguucaaggagcugcucaccaagaagggcagcuaccgcuacuacuucaagaagguguccgacgaguucgacugcggcguggucuucgaggaggugcgggaggacgaggccgugcugccggucuucgaggagaagaucaucgggaagguggagaagguggacuga

SEQ ID NO: 27113 - RNA, 2532 nt, Artificial Sequence
  derived and/or modified sequence opt1 from AXIN2__Homo_sapiens__XP_011523623
augagcuccgccaugcuggugaccugccuccccgacccgagcuccagcuuccgcgaggacgcgccccggccgcccguccccggcgaggagggggagaccccgcccugccagcccggcguggggaagggccaggugacgaagcccaugcccgucuccagcaacacccgccggaacgaggacgggcugggcgagcccgagggccgcgccucccccgacagcccgcugacccgguggaccaagucccuccacagccugcugggggaccaggacggcgccuaccucuuccgcacguuccuggagcgggagaagugcguggacacccuggacuucugguucgccugcaacggguuccgccagaugaaccucaaggacaccaagacccugcggguggccaaggccaucuacaagcgcuacaucgagaacaacuccaucgucagcaagcagcugaagcccgcgacgaagaccuacauccgggacggcaucaagaagcagcagaucgacuccaucauguucgaccaggcccagaccgagauccagagcgugauggaggagaacgccuaccagauguuccucaccuccgacaucuaccuggaguacgugcgcagcgggggcgagaacacggccuacauguccaacggcgggcugggcagccucaaggucgugugcggguaccugcccacccugaacgaggaggaggaguggaccugcgcggacuucaagugcaagcucucccccaccguggucggccugagcagcaagacgcugcgggccaccgccuccgugcgcagcaccgagaccguggacuccggcuaccggagcuucaagcgcuccgacccggucaaccccuaccacaucgggagcggcuacguguucgcccccgccacguccgcgaacgacagcgagaucuccagcgacgcccucaccgacgacuccaugagcaugaccgacuccagcguggacgggaucccgcccuaccgggucggcuccaagaagcagcugcagcgcgagaugcaccggagcgugaaggccaacggccaggugucccugccccacuucccccgcacccaccggcuccccaaggagaugacgccggucgagcccgccaccuucgccgcggagcugaucagccgccuggagaagcucaagcuggagcuggagucccgccacagccucgaggagcggcugcagcagauccgcgaggacgaggagcgggaggggagcgagcugacccucaacucccgcgagggcgcccccacccagcacccccugagccugcucccguccgggagcuacgaggaggacccccagacgauccuggacgaccaccugucccgggugcucaagacccccggcugccagagcccgggggugggccgcuacagcccccggucccgcucccccgaccaccaccaccaccaccacagccaguaccacucccugcugcccccgggcgggaagcucccgcccgccgccgccagccccggcgcgugcccccugcucgggggcaagggguucgucaccaagcagaccacgaagcacgugcaccaccacuacauccaccaccacgccguccccaagaccaaggaggagaucgaggccgaggccacccagcgggugcacugcuucugccccggcggguccgaguacuacugcuacagcaagugcaagucccacagcaaggcccccgagaccaugccguccgagcaguucggcggcagccgcgggagcacgcugcccaagcggaacggcaaggggaccgagcccggccuggcgcugcccgcccgcgagggcggggccccgggcggggccggcgcgcuccagcugccccgggaggagggggaccgcucccaggacguguggcaguggaugcuggagagcgagcggcaguccaagcccaagccccacagcgcccaguccaccaagaaggccuacccgcuggagagcgcccgcuccagccccggcgagcgggccucccgccaccaccucuggggcgggaacagcggccacccccggaccacgccccgcgcgcaccuguucacccaggacccggccaugccgccccugaccccgcccaacacccucgcccagcuggaggaggccugccgccggcuggccgaggucuccaagccgcccaagcagcgcugcugcguggcgagccagcagcgggaccgcaaccacuccgccaccgugcagacgggggccacccccuucagcaaccccucccucgcccccgaggaccacaaggagcccaagaagcuggccggcguccacgcgcugcaggccagcgagcucguggugaccuacuucuucugcggggaggagauccccuaccggcgcaugcugaaggcccagucccugacccucggccacuucaaggagcagcugagcaagaagggcaacuaccgguacuacuucaagaaggccuccgacgaguucgcgugcggggccgucuucgaggagaucugggaggacgagacggugcugcccauguacgagggccgcauccucgggaagguggagcggaucgacuga

SEQ ID NO: 27114 - RNA, 2658 nt, Artificial Sequence
  derived and/or modified sequence opt1 from AXL__Homo_sapiens__NP_001690
auggccuggcgcugcccccggaugggccgcgugccgcuggccuggugccucgcgcugugcgggugggccugcauggcgccccggggcacccaggccgaggagagccccuucgucgggaaccccggcaacaucaccggggcccgcggccugacgggcacccuccggugccagcuccaggugcagggggagccgcccgaggugcacuggcugcgcgacggccagauccuggagcuggccgacuccacccagacccaggucccccugggggaggacgagcaggacgacuggaucguggugagccagcuccggaucacgucccugcagcugagcgacaccggccaguaccagugccucgucuuccuggggcaccagaccuucgugucccagcccggcuacgugggccuggaggggcucccguacuuccuggaggagcccgaggaccgcaccgucgccgccaacacgcccuucaaccugagcugccaggcccaggggcccccggagcccguggaccuccuguggcugcaggacgcggugccccucgccaccgcccccggccacggcccgcagcggucccugcacguccccggccugaacaagaccagcuccuucagcugcgaggcccacaacgccaagggggugaccacgucccgcaccgcgaccaucaccgugcucccccagcagccccggaaccugcaccuggucagccgccagccgacggagcucgagguggccuggacccccggccuguccgggaucuacccccugacccacugcacccuccaggccgugcugagcgacgacggcauggggauccaggccggcgagcccgacccgcccgaggagccccugacgucccaggccagcgugcccccgcaccagcuccggcugggcucccugcacccccacacccccuaccacauccgcgucgcgugcaccagcucccaggggccgagcagcuggacccacuggcuccccguggagacgcccgagggcgucccccuggggccgcccgagaacaucuccgccacccggaacggcagccaggccuucgugcacuggcaggagccccgcgcgccccugcaggggacccuccugggcuaccggcuggccuaccagggccaggacaccccggaggugcucauggacaucgggcugcgccaggaggucacgcuggagcuccagggcgacggguccgugagcaaccugaccgucugcguggccgccuacaccgccgccggcgacgggcccuggucccugcccgugccccucgaggccuggcggccggucaaggagcccagcacccccgcguucuccuggcccuggugguacgugcugcugggcgccguggucgccgccgcgugcgugcugauccucgcccuguuccuggugcaccgccggaagaaggagacgcgcuacggcgaggucuucgagccgaccguggagcgcggggagcucgugguccgguaccgcgugcgcaagagcuacucccggcggaccaccgaggccacgcugaacagccugggcaucuccgaggagcucaaggagaagcugcgcgacgugauggucgaccggcacaagguggcccuggggaagacccucggcgagggcgaguucggggccgugauggagggccagcugaaccaggacgacagcauccugaaggucgcggugaagaccaugaagaucgccaucugcacccgcuccgagcucgaggacuuccugagcgaggccgugugcaugaaggaguucgaccaccccaacgucaugcggcugaucggggugugcuuccagggcuccgagcgcgagagcuuccccgcccccguggucauccucccguucaugaagcacggggaccugcacuccuuccugcucuacagccggcugggcgaccagcccguguaccugcccacccagaugcucgugaaguucauggccgacaucgcguccggcauggaguaccugagcacgaagcgcuucauccaccgggaccuggccgcccgcaacugcaugcucaacgagaacaugagcgucugcguggccgacuucgggcuguccaagaagaucuacaacggcgacuacuaccggcaggggcgcaucgccaagaugcccgugaaguggaucgcgaucgagagccuggccgaccgggucuacaccuccaagagcgacgugugguccuucggcgugaccaugugggagaucgccacccgcgggcagacgccguaccccggcgucgagaacagcgagaucuacgacuaccuccggcagggcaaccgccugaagcagcccgccgacugccuggacgggcucuacgcgcugaugucccgcugcugggagcugaacccgcaggaccggcccagcuucaccgagcuccgcgaggaccuggagaacacccugaaggcccucccgcccgcccaggagcccgacgagauccuguacgugaacauggacgagggcgggggcuaccccgagccgcccggggccgccggcggcgcggacccgcccacccagcccgaccccaaggacuccugcagcugccugacggccgccgaggugcaccccgccgggcgguacguccucugccccuccaccacccccagccccgcccagccggcggaccgcggcucccccgccgcccccgggcaggaggacggcgccuga

SEQ ID NO: 27115 - RNA, 897 nt, Artificial Sequence
  derived and/or modified sequence opt1 from AZGP1__Homo_sapiens__NP_001176
auggugcgcaugguccccgugcugcucagccugcugcuccugcugggcccggccgugccccaggagaaccaggacgggcgguacucccucaccuacaucuacaccggccugagcaagcacgucgaggacgugcccgccuuccaggcgcuggggucccucaacgaccugcaguucuuccgcuacaacagcaaggaccggaagucccagcccaugggccuguggcgccagguggaggggauggaggacuggaagcaggacagccagcuccagaaggcccgggaggacaucuucauggagacgcugaaggacaucgucgaguacuacaacgacuccaacggcagccacgugcugcagggccgcuucgggugcgagaucgagaacaaccgguccagcggcgccuucuggaaguacuacuacgacgggaaggacuacaucgaguucaacaaggagaucccggccugggugcccuucgaccccgccgcgcagaucaccaagcagaagugggaggccgagcccgucuacgugcagcgcgccaaggccuaccucgaggaggagugcccggcgacccugcggaaguaccugaaguacuccaagaacauccucgaccgccaggacccgcccagcguggucgugaccucccaccaggcccccggcgagaagaagaagcugaagugccuggccuacgacuucuaccccgggaagaucgacgugcacuggacgcgggccggcgagguccaggagcccgagcuccgcggcgacgugcugcacaacgggaacggcaccuaccagagcuggguggucguggccgugccgccccaggacaccgcgcccuacuccugccacguccagcacagcucccuggcccagccccucguggugcccugggaggccagcuga

SEQ ID NO: 27116 - RNA, 732 nt, Artificial Sequence
  derived and/or modified sequence opt1 from AZI2__Homo_sapiens__NP_001127904
auggacgcccugguggaggacgacaucugcauccucaaccacgagaaggcccacaagcgcgacaccgucacccccgugagcaucuacuccggcgacgagagcguggcgucccacuucgcccuggucacggccuacgaggacaucaagaagcggcugaaggacagcgagaaggagaacucccuccugaagaagcgcauccgguuccuggaggagaagcucaucgcccgcuucgaggaggagaccagcuccguggggcgggagcaggucaacaaggccuaccacgcguaccgcgaggugugcaucgaccgggacaaccucaagagcaagcuggacaagaugaacaaggacaacuccgagagccugaaggugcugaacgagcagcugcaguccaaggagguggagcuccugcagcugcgcaccgaggucgagacccagcaggucaugcggaaccucaacccgcccagcuccaacugggagguggagaagcugagcugcgaccugaagauccacggccucgagcaggagcuggagcugaugcgcaaggagugcuccgaccucaagaucgagcugcagaaggccaagcagacggaccccuaccaggaggacaaccucaagagccgggaccugcagaagcuguccaucagccgccaguccaucugcagcaccgccuggagcgccguggcgcaguccugggacagcaugaacuucgaggacugcucccuguucgccuga

SEQ ID NO: 27117 - RNA, 1092 nt, Artificial Sequence
  derived and/or modified sequence opt1 from AZIN1__Homo_sapiens__NP_001288597
augaagggcuucaucgacgacgccaacuacagcguggggcuccucgacgagggcaccaaccuggggaacgucaucgacaacuacguguacgagcacacccugacgggcaagaacgccuucuucgugggggaccucggcaagaucgucaagaagcacucccaguggcagaacgugguggcgcagaucaagcccuucuacaccgucaagugcaacagcgccccggccgugcuggagauccuggccgcccucggcaccggguucgcgugcuccagcaagaacgagauggcccuggugcaggagcugggcgucccgcccgagaacaucaucuacaucucccccugcaagcaggucagccagaucaaguacgccgccaaggugggggugaacauccugaccugcgacaacgagaucgagcugaagaagaucgcgcgcaaccaccccaacgccaaggugcugcuccacaucgccacggaggacaacaucggcggggaggagggcaacaugaaguucggcaccacccugaagaacugccggcaccuccucgagugcgccaaggagcuggacgugcagaucaucggggucaaguuccacguguccagcgccugcaaggagucccagguguacguccacgcgcugagcgacgcccgcugcguguucgacauggccggcgagaucggguucaccaugaacaugcucgacaucggcggcggguucacgggcaccgaguuccagcuggaggaggugaaccacgucaucagcccccugcucgacaucuacuuccccgagggguccggcgugaagaucaucuccgagcccgggagcuacuacguguccagcgccuucacccuggccgucaacaucaucgcgaagaagguggucgagaacgacaaguucccguccggcguggagaagaccggcagcgacgagcccgccuucauguacuacaugaacgacgggguguacggcuccuucgccagcaagcugagcgaggaccucaacacgauccccgagguccacaagaaguacaaggaggacgagccccuguucaccuccagccugugggggccguccugcgacgagcuguuccgguga

SEQ ID NO: 27118 - RNA, 1443 nt, Artificial Sequence
  derived and/or modified sequence opt1 from AZIN2__Homo_sapiens__NP_001288754
auggccggcuaccugagcgaguccgacuucgugauggucgaggagggguucagcacccgcgaccuccugaaggagcugacccucggcgccucccaggcgacgaccgacgagguggccgccuucuucguggccgaccugggggccaucguccggaagcacuucugcuuccugaagugccucccccgcgugcggccguucuacgcggugaagugcaacagcucccccggcguccugaaggugcuggcccagcucgggcugggcuucagcugcgccaacaaggccgagauggagcuggugcagcacaucggcauccccgcguccaagaucaucugcgccaaccccugcaagcagaucgcccagaucaaguacgccgccaagcacgggauccagcuccugagcuucgacaacgagauggagcuggcgaaggucgugaagucccacccgagcgccaagauggugcucugcaucgccaccgacgacucccacagccuguccugccugagccucaaguucggcgucucccucaagagcugccgccaccuccuggagaacgccaagaagcaccacguggagguggucgggguguccuuccacaucggcagcgggugccccgacccccaggccuacgcgcaguccaucgccgacgcccggcugguguucgagaugggcaccgagcugggccacaagaugcacguccucgaccucgggggcggguuccccggcacggagggcgccaaggugcgcuucgaggagaucgccagcgugaucaacagcgcgcuggaccuguacuucccggaggggugcggcgucgacaucuucgccgagcuggggcgguacuacgugaccuccgccuucaccguggccgucagcaucaucgccaagaaggaggugcugcucgaccagcccggccgcgaggcgccccugcccccgccccacaucgcgaccugcgccgccuccgagcccagcccgcccgccgaggagaacggguccacgagcaagaccaucgucuaccaccuggacgagggcguguacggcaucuucaacuccgugcuguucgacaacaucugccccacccccauccugcagaagaagcccagcaccgagcagccgcuguacuccagcucccucugggggcccgccgucgacggcugcgacugcguggccgaggggcuguggcugccccagcuccacgugggcgacuggcuggucuucgacaacaugggggccuacacggugggcaugggcagccccuucugggggacccaggccugccacaucaccuacgcgaugucccggguggccugggaggcccugcgccggcagcucauggccgccgagcaggaggacgacgucgagggcgugugcaagccgcugagcugcgggugggagaucaccgacacgcugugcgugggccccgucuucacccccgcguccaucauguga

SEQ ID NO: 27119 - RNA, 756 nt, Artificial Sequence
  derived and/or modified sequence opt1 from AZU1__Homo_sapiens__NP_001691
augacccgccugaccgugcucgcccugcuggccggccuccuggcgagcucccgggccgggagcagcccccugcucgacaucgucggcgggcgcaaggcccggccgcgccaguuccccuuccuggccuccauccagaaccagggccggcacuucugcgggggcgcccugauccacgcgcgcuucgugaugacggccgccuccugcuuccagagccagaaccccggcguguccaccgucgugcucggggccuacgaccugcggcgccgggagcgccagagccggcagaccuucuccaucagcuccaugagcgagaacggcuacgacccccagcagaaccugaacgaccucaugcugcugcagcucgaccgcgaggcgaaccugaccuccagcgugacgauccugccgcucccccugcagaacgccaccgucgaggccgggacccggugccagguggccggcugggggucccagcgcagcggcggccggcugucccgcuucccccgguucgugaacgucaccgugacgcccgaggaccagugccgcccgaacaacgugugcaccgggguccucacccggcgcggcgggaucugcaacggcgacggcgggacgccccuggugugcgagggccuggcccacgggguggcgagcuucucccucggccccugcgggcggggccccgacuucuucacccgcgucgcccuguuccgcgacuggaucgacggcgugcugaacaacccggggcccggccccgccuga

SEQ ID NO: 27120 - RNA, 360 nt, Artificial Sequence
  derived and/or modified sequence opt1 from B2M__Homo_sapiens__NP_004039
augagccgcuccguggcccuggccguccucgcgcugcugagccucuccggccuggaggccauccagcggacccccaagauccagguguacagccgccacccggccgagaacgggaaguccaacuuccugaacugcuacgugagcggcuuccaccccuccgacaucgaggucgaccuccugaagaacggggagcggaucgagaagguggagcacagcgaccuguccuucagcaaggacugguccuucuaccuccuguacuacaccgaguucacgcccaccgagaaggacgaguacgccugccgcgugaaccacgucacccugagccagcccaagaucgugaagugggaccgggacauguga

SEQ ID NO: 27121 - RNA, 996 nt, Artificial Sequence
  derived and/or modified sequence opt1 from B3GALNT1__Homo_sapiens__XP_005247921
auggccagcgcccuguggaccgugcuccccucccgcaugagccugcggucccugaaguggagccuccugcugcucucccugcugagcuucuucgugaugugguaccucucccugccgcacuacaacgugaucgagcgcgugaacuggauguacuucuacgaguacgagcccaucuaccggcaggacuuccacuucacccugcgcgagcacagcaacugcucccaccagaaccccuuccucgucauccuggugaccagccaccccuccgacgugaaggcgcggcaggccauccgcgucaccuggggcgagaagaaguccugguggggguacgaggugcugaccuucuuccuccugggccaggaggccgagaaggaggacaagaugcuggcccucagccuggaggacgagcaccuccuguacggggacaucauccggcaggacuuccuggacaccuacaacaaccugacgcucaagaccaucauggccuuccgcugggugaccgaguucugcccgaacgcgaaguacgucaugaagaccgacacggacguguucaucaacaccggcaaccuggugaaguaccugcucaaccugaaccacagcgagaaguucuucaccggguacccccugaucgacaacuacuccuaccggggcuucuaccagaagacccacaucagcuaccaggaguaccccuucaaggucuucccgcccuacugcuccggccucggguacaucaugagccgcgaccuggugccccggaucuacgagaugaugggccacgugaagcccaucaaguucgaggacgucuacguggggaucugccugaaccuccugaaggugaacauccacauccccgaggacacgaaccuguucuuccucuaccgcauccaccuggacgucugccagcugcggcgcgugaucgccgcccacggcuucuccagcaaggagaucaucaccuucuggcaggucaugcuccggaacacgaccugccacuacuga

SEQ ID NO: 27122 - RNA, 981 nt, Artificial Sequence
  derived and/or modified sequence opt1 from B3GALNT2__Homo_sapiens__NP_001264084
augcgcaacuggcuggugcuccugugccccugcguccugggcgccgcccuccaccuguggcugcggcuccgcagcccgccgcccgcgugcgccuccggggccggccccgccgggggcgugagccugcugcucccccggcuggagugcaacggggccguguccgcgcaccccaaccugcaccuccccggcagccgcgacucccccgccagcgccucccaggucgccggcaucaccgaccagcuggcgcuguucccgcaguggaaguccacccacuacgacgugguggucggggugcucagcgcccggaacaaccacgagcugcgcaacgugauccggagcacguggaugcgccaccuccugcagcaccccacccugucccagcggguccuggugaaguucaucaucggcgcccacgggugcgaggugcccgucgaggaccgcgaggaccccuacagcugcaagcuccugaacaucaccaacccggugcugaaccaggagaucgaggccuucucccucagcgaggacaccuccagcggccugcccgaggaccggguggucuccgugagcuuccgcgugcuguaccccaucgucaucacgucccucgggguguucuacgacgccaacgacgugggcuuccagcggaacaucaccgucaagcuguaccaggcggagcaggaggaggcccuguucaucgcccgcuucagcccgcccagcugcggcguccaggugaacaagcucugguacaagcccguggagcaguucauccugcccgaguccuucgaggggaccaucgugugggagagccaggaccugcacggccucgucucccggaaccugcacaaggugaccgugaacgacgggggcggcguccugcgcgugaucacggccggggagggcgcccucccccacgaguuccuggaggggguggagggcgucgccgggggcuucaucuacaccauccagggcaaguucgcgagcuga

SEQ ID NO: 27123 - RNA, 1269 nt, Artificial Sequence
  derived and/or modified sequence opt1 from B3GALT2__Homo_sapiens__NP_003774
augcugcaguggcgccggcgccacugcugcuucgccaagaugaccuggaacgccaagcggagccucuuccgcacccaccugaucggcgugcugucccucgucuuccuguucgcgauguuccuguucuucaaccaccacgacuggcuccccgggcgggccggcuucaaggagaaccccgugacguacaccuuccgcggguuccggagcaccaaguccgagaccaaccacagcucccugcgcaacaucuggaaggagacggugccccagacccugcggccccagaccgccaccaacagcaacaacacggaccucagcccccagggcgucaccgggcuggagaacacccuguccgccaacggcuccaucuacaacgagaagggcaccgggcacccgaacagcuaccacuucaaguacaucaucaacgagcccgagaagugccaggagaagucccccuuccucauccugcugaucgccgcggagcccggccagaucgaggcccgccgggccauccgccagacgugggggaacgagagccucgccccgggcauccagaucacccggaucuuccugcuggggcucuccaucaagcugaacggcuaccugcagcgcgcgauccucgaggagagccggcaguaccacgacaucauccagcaggaguaccuggacaccuacuacaaccugaccaucaagacgcucaugggcaugaacuggguggccaccuacugcccccacauccccuacgugaugaagaccgacuccgacauguucgucaacaccgaguaccugaucaacaagcugcucaagcccgaccugccgccccgccacaacuacuucacgggguaccugaugcggggcuacgcccccaaccgcaacaaggacagcaagugguacaugcccccggaccucuaccccuccgagcgguaccccguguucugcagcgggaccggcuacguguucuccggcgaccuggccgagaagaucuucaaggucagccuggggauccgccggcuccaccuggaggacguguacgugggcaucugccuggccaagcuccgcaucgaccccgucccgccgcccaacgaguucguguucaaccacuggcgcgugagcuacuccagcugcaaguacucccaccugaucaccagccaccaguuccagcccuccgagcugaucaaguacuggaaccaccuccagcagaacaagcacaacgcgugcgccaacgccgccaaggagaaggccgggcgguaccgccaccggaagcugcacuga

SEQ ID NO: 27124 - RNA, 1137 nt, Artificial Sequence
  derived and/or modified sequence opt1 from B3GALT4__Homo_sapiens__NP_003773
augcagcugcgccucuuccggcgccugcugcucgccgcccugcugcucgugaucgucuggacccuguucggccccagcgggcugggcgaggagcuccugucccugagccucgcgucccugcugccggcccccgccagccccgggcccccgcucgcccugccccggcugcucauccccaaccaggaggccugcuccggccccggggcgccgcccuuccugcugauccucgugugcaccgcccccgagaaccugaaccagcgcaacgccauccgggccagcuggggcggccugcgcgaggcgcgggggcuccgcgugcagacgcuguuccugcucggcgagcccaacgcccagcacccggucugggggucccagggcagcgaccuggccuccgagagcgccgcccagggggacauccugcaggcggccuuccaggacuccuaccggaaccucacccugaagacccugagcggccucaacugggccgagaagcacugccccauggcccgcuacgugcugaagaccgacgacgacguguacgucaacgugcccgagcugguguccgagcucguccugcggggcgggcgcuggggccagugggagcggagcacggagccccagcgcgaggccgagcaggagggcggccaggugcugcacuccgaggaggugccgcuccuguaccuggggcggguccacuggcgcgugaaccccagccggacccccgggggccgccaccggguguccgaggagcaguggccccacaccugggggccguucccgcccuacgcgagcggcaccggguacguccucuccgccagcgccgugcagcugauccugaagguggccagccgcgcgccccuccugccccuggaggacgucuucgugggcguguccgcccggcgcggcgggcucgcccccacgcagugcgucaagcuggccggcgccacccacuacccccuggaccgcugcugcuacgggaaguuccugcucaccagccaccggcuggaccccuggaagaugcaggaggccuggaagcuggugggcggguccgacggcgagcgcaccgcgccguucugcagcugguuccagggcgugcucgggauccugcggugccgcgccaucgccuggcugcaguccuga

SEQ ID NO: 27125 - RNA, 933 nt, Artificial Sequence
  derived and/or modified sequence opt1 from B3GALT5__Homo_sapiens__NP_149361
auggccuuccccaagaugcgccugauguacaucugccuccuggugcugggcgcccucugccuguacuucagcauguacucccugaaccccuucaaggagcagagcuucgucuacaagaaggacgggaacuuccucaagcugcccgacaccgacugccggcagaccccgcccuuccuggugcuccuggugacguccagccacaagcagcuggcggagcgcauggccauccggcagaccuggggcaaggagcgcauggucaaggggaagcagcucaagaccuucuuccugcugggcaccacguccagcgccgccgagaccaaggagguggaccaggagucccagcggcacggggacaucauccagaaggacuuccucgacguguacuacaaccugacccugaagaccaugaugggcaucgaguggguccaccgcuucugcccgcaggccgcguucgugaugaagacggacagcgacauguucaucaacguggacuaccucaccgagcugcugcucaagaagaaccggaccacccgcuucuucacgggcuuccugaagcugaacgaguuccccauccggcagcccuucuccaagugguucgucagcaaguccgaguaccccugggaccgcuacccgcccuucugcagcgggaccggcuacguguucuccggggacguggccagccaggucuacaacguguccaagagcgugcccuacaucaagcucgaggacgucuucgugggccugugccuggagcggcucaacauccgccuggaggagcugcacucccagcccaccuucuuccccgggggccuccgguucagcgugugccuguuccgccggaucgucgccugccacuucaucaagccccgcacccugcucgacuacuggcaggcccuggagaacucccggggcgaggacugcccgcccguguga

SEQ ID NO: 27126 - RNA, 1497 nt, Artificial Sequence
  derived and/or modified sequence opt1 from B3GALTL__Homo_sapiens__NP_919299
augcggcccccggccugcugguggcugcucgccccgcccgcgcugcuggcccuccugaccugcagccuggccuucggccucgccuccgaggacaccaagaaggaggugaagcagagccaggaccuggagaaguccgggaucagccgcaagaacgacaucgaccugaagggcaucgucuucgugauccagucccagagcaacuccuuccacgccaagcgcgcggagcagcucaagaaguccauccugaagcaggccgccgaccugacgcaggagcuccccagcgugcugcugcuccaccagcuggccaagcaggagggggcguggaccauccugccccuccugccccacuucagcgucaccuacucccggaacagcuccuggaucuucuucugcgaggaggagacccgcauccagauccccaagcugcucgagacgcugcggcgcuacgaccccagcaaggagugguuccugggcaaggcccuccacgacgaggaggccaccaucauccaccacuacgccuucuccgagaacccgaccguguucaaguaccccgacuucgccgcggggugggcccugagcaucccccuggugaacaagcucaccaagcggcugaaguccgagagccugaaguccgacuucacgaucgaccucaagcacgagaucgcccuguacaucugggacaagggcggcgggcccccgcugacccccguccccgaguucugcaccaacgacguggacuucuacugcgccaccacguuccacagcuuccucccccugugccgcaagccggugaagaagaaggacaucuucgucgccgugaagaccugcaagaaguuccacggcgaccggauccccaucgugaagcagaccugggagagccaggcgucccugaucgaguacuacagcgacuacaccgagaacuccauccccacggucgaccucgggauccccaacaccgaccgcggccacugcgggaagaccuucgccauccuggagcgguuccugaaccgcagccaggacaagaccgccuggcucgugaucguggacgacgacacgcugaucuccaucagccggcugcagcaccuccuguccugcuacgacagcggcgagccggucuuccugggcgagcgcuacggguacggccucgggaccggcggcuacuccuacaucaccgggggcgggggcaugguguucagccgggaggccgugcgccggcugcuggccuccaagugccgcugcuacagcaacgacgcgcccgacgacaugguccucgggaugugcuucuccggccugggcauccccgugacccacagcccccuguuccaccaggcccggccgguggacuaccccaaggacuaccugucccaccagguccccaucagcuuccacaagcacuggaacaucgaccccgugaagguguacuucacguggcucgccccguccgacgaggacaaggcccgccaggagacccagaagggguuccgggaggagcuguga

SEQ ID NO: 27127 - RNA, 1044 nt, Artificial Sequence
  derived and/or modified sequence opt1 from B3GAT1__Homo_sapiens__XP_011541055
augggcaacgaggagcccugggugcagccggcccuggagaugcccaagcgccgggacauccucgccaucguccugaucgugcugcccuggacccuccugaucaccguguggcaccagagcacgcuggcgccccuccuggccguccacaaggacgagggguccgacccgcgccgggagaccccgcccggcgccgacccccgcgaguacugcaccagcgaccgggacaucguggaggugguccgcaccgaguacguguacacgcggcccccgcccugguccgacacccugcccaccauccacguggucacccccacguacagccgccccgugcagaaggccgagcucacccggauggccaacacccugcugcacgugcccaaccuccacuggcuggucguggaggacgcgccccgccggaccccgcugacggcccgccuccugcgggacaccgggcugaacuacacccaccuccacguggagacgccccgcaacuacaagcugcggggcgacgcccgcgacccccggaucccccgcgggaccaugcagcggaaccuggcccuccgcuggcugcgggagaccuucccgcgcaacuccagccagcccggcgucguguacuucgcggacgacgacaacaccuacucccuggagcuguucgaggagaugcgcagcacccggcgcguguccgucuggcccguggccuucgugggcgggcuccgguacgaggcgccccgcgucaacggcgccgggaagguggugggcuggaagacggucuucgacccgcaccggcccuucgccaucgacauggccggguucgccgugaaccugcgccucauccugcagcggagccaggccuacuucaagcugcgcggcgucaagggcggguaccaggaguccagccuccugcgggagcuggugacccucaacgaccuggagcccaaggccgccaacugcaccaagauccugguguggcacacccgcacggagaagcccguccucgugaacgagggcaagaagggguucaccgacccguccguggagaucuga

SEQ ID NO: 27128 - RNA, 972 nt, Artificial Sequence
  derived and/or modified sequence opt1 from B3GAT2__Homo_sapiens__NP_542780
augaaguccgcccuguucacccgcuucuucauccuccugcccuggauccugaucgugaucaucaugcucgacgucgacacccggcgcccggugccgccccugacgccccggcccuacuucagccccuacgccgugggccgcgggggcgcgcggcugccccuccgccgcgggggccccgcccacgggacccagaagcggaaccagagccggccgcagccccagcccgagccccagcugccgaccaucuacgccaucacccccacguacucccgccccguccagaaggccgagcugacccggcucgccaacaccuuccgccagguggcgcagcugcacuggauccugguggaggacgccgccgcccggagcgagcucgucucccgcuuccuggcgcgggccggccugcccagcacccaccuccacgugccgacgccccgccgguacaagcgccccggccugccccgggccaccgagcagcgcaacgccgggcuggccuggcuccggcagcgccaccagcaccagcgcgcgcagccgggcgugcuguucuucgccgacgacgacaacaccuacucccuggagcuguuccaggagaugcggaccacgcgcaaggucagcguguggcccguggggcucgucggcgggcggcgcuacgagcggccccugguggagaacggcaagguggucggcugguacaccggguggcgcgccgaccggcccuucgccaucgacauggccggcuucgcggugucccuccaggugauccugagcaacccgaaggccgucuucaagcgccgggggucccagcccggcaugcaggagagcgacuuccugaagcagaucaccaccguggaggagcucgagcccaaggccaacaacugcacgaaggugcuggucuggcacacccgcaccgagaaggugaaccuggccaacgagcccaaguaccaccucgacaccgugaagaucgaggucuga

SEQ ID NO: 27129 - RNA, 948 nt, Artificial Sequence
  derived and/or modified sequence opt1 from B3GAT3__Homo_sapiens__NP_001275652
augaagcugaagcucaagaacguguuccuggccuacuuccuggucagcaucgccggccuccuguacgcgcuggugcagcucgggcagcccugcgacugccugccgccccugcgcgccgccgccgagcagcuccggcagaaggaccugcgcaucucccagcugcaggccgagcuccggcgcccgccgcccgcgcccgcccagccgcccgagcccgaggcccugcccaccaucuacguggucacccccacguacgcccggcuggugcagaaggcggagcucgugcgccugagccagacccugucccucgucccccggcugcacuggcugcucguggaggacgccgagggccccacgccccuggugagcgggcugcucgccgccuccggccugcuguucacccaccucgucgugcugacccccaaggcccagcgccugcgggagggggagcccggcugggugcacccgcgcggcgucgagcagcggaacaaggcgcucgacuggcugcgcgggcggggcggggccgugggcggggagaaggacccgcccccgcccggcacccagggcguggucuacuucgccgacgacgacaacaccuacagccgcgagcuguucgaggagaugcgguggacccgcgggguguccguguggcccgucggccucgucgggggccugcgguucgagggcccccaggugcaggacgggcgcguggugggcuuccacacggccugggagcccagccggcccuuccccguggacauggccggguucgcggucgcccugccccuccugcuggacaagcccaacgcccaguucgacuccaccgccccgcgcggccaccucgagagcucccugcugagccaccucguggaccccaaggaccuggagccccgggccgcgaacugcacccgcaccgagucccgcugcgucacgcaggccggggugcaguga

SEQ ID NO: 27130 - RNA, 1194 nt, Artificial Sequence
  derived and/or modified sequence opt1 from B3GNT2__Homo_sapiens__NP_001306004
augagcgugggccgccggcgcaucaagcugcucgggauccugaugauggccaacgucuucaucuacuucaucauggagguguccaagagcuccagccaggagaagaacggcaagggggaggugaucauccccaaggagaaguucuggaagaucuccaccccgcccgaggccuacuggaaccgggagcaggagaagcugaaccgccaguacaaccccauccucagcaugcugaccaaccagacgggcgaggcggggcggcuguccaacaucagccaccucaacuacugcgagcccgaccugcgcgucaccuccguggugaccggcuucaacaaccugccggaccgguucaaggacuuccuccuguaccugcgcugccggaacuacagccuccugaucgaccagcccgacaagugcgccaagaagcccuuccugcuccuggccaucaagucccugacgccccacuucgcccgccggcaggccauccgcgagagcuggggccaggaguccaacgcggggaaccagaccgucgugcggguguuccuccugggccagaccccgcccgaggacaaccaccccgaccugagcgacaugcucaaguucgaguccgagaagcaccaggacauccugauguggaacuaccgcgacaccuucuucaaccugagccucaaggagguccuguuccugcgguggguguccaccagcugccccgacacggaguucguguucaagggggacgacgacgucuucgugaacacccaccacauccucaacuaccugaacucccugagcaagaccaaggccaaggaccucuucaucggcgacgugauccacaacgccgggccgcaccgcgacaagaagcugaaguacuacauccccgaggucguguacagcggccuguacccgcccuacgccggcgggggcggguuccucuacuccggccaccuggcgcugcggcucuaccacaucaccgaccaggugcaccuguaccccaucgacgacgucuacacgggcaugugccugcagaagcucgggcuggugcccgagaagcacaagggcuuccgcaccuucgacaucgaggagaagaacaagaacaacaucugcagcuacguggaccugaugcucguccacucccggaagccccaggagaugaucgacaucuggagccagcugcaguccgcccaccugaagugcuga

SEQ ID NO: 27131 - RNA, 1119 nt, Artificial Sequence
  derived and/or modified sequence opt1 from B3GNT3__Homo_sapiens__XP_011525929
augaaguaccugcgccaccggcgccccaacgccacccucauccuggccaucggcgcguucacccugcuccuguucagccugcucguguccccgcccacgugcaagguccaggagcagccgcccgccauccccgaggcccuggccuggcccaccccgcccacccggcccgcccccgcgcccugccacgccaacaccagcauggugacgcaccccgacuucgccacccagccgcagcacgugcagaacuuccugcucuaccgccacugccggcacuucccccugcugcaggacgucccgcccuccaagugcgcccagcccguguuccuccugcuggugaucaagagcucccccagcaacuacguccgccgggagcuccugcgccggaccugggggcgcgagcggaaggugcgcggccugcagcuccggcugcuguuccucguggggaccgcguccaacccccacgaggcccgcaaggucaaccggcugcuggagcucgaggcccagacgcacggcgacauccugcagugggacuuccacgacagcuucuucaaccugacccucaagcagguccuguuccugcaguggcaggagacccgcugcgccaacgccuccuucgugcucaacggggacgacgacguguucgcgcacaccgacaacaugguguucuaccugcaggaccacgaccccggccggcaccuguucgugggccagcucauccagaacgucgggccgauccgcgccuucuggagcaaguacuacgugcccgagguggucacgcagaacgagcgguacccgcccuacugcggcgggggcggguuccugcugucccgcuucaccgccgccgcccuccggcgcgcggcccacgugcuggacaucuuccccaucgacgacguguuccugggcaugugccucgagcuggagggccugaagcccgccagccacuccgggauccgcaccagcggcguccgggcccccucccagcgccucagcuccuucgaccccugcuucuaccgggaccugcugcucgugcaccgcuuccugccguacgagaugcugcucaugugggacgcccugaaccagcccaaccugaccugcgggaaccagacgcagaucuacuga

SEQ ID NO: 27132 - RNA, 1137 nt, Artificial Sequence
  derived and/or modified sequence opt1 from B3GNT5__Homo_sapiens__XP_011511531
augcgcaugcuggugagcggccggcgcgucaagaaguggcagcucaucauccagcuguucgcgaccugcuuccuggccucccucauguucuucugggagcccaucgacaaccacaucgugagccacaugaaguccuacagcuaccgguaccugaucaacuccuacgacuucgugaacgacacccugagccucaagcacacguccgccgggccgcgcuaccaguaccugaucaaccacaaggagaagugccaggcccaggacguccugcuccugcuguucgugaagaccgcccccgagaacuacgaccggcgcagcggcauccggcgcaccugggggaacgagaacuacgugcggucccagcucaacgccaacaucaagacccuguucgcccugggcacgcccaacccccucgagggggaggagcugcagcgcaagcuggcgugggaggaccagcgguacaacgacaucauccagcaggacuucgucgacagcuucuacaaccucacccugaagcugcucaugcaguucuccugggccaacaccuacugcccgcacgccaaguuccugaugaccgccgacgacgacaucuucauccacaugcccaaccugaucgaguaccuccagagccuggagcagaucggcgugcaggacuucuggaucggccgcgugcaccgcggggcgccgcccauccgggacaaguccagcaaguacuacgucuccuacgagauguaccaguggcccgccuaccccgacuacacggccggcgccgccuacgugaucagcggggacguggcggccaaggucuacgaggccucccagacccugaacagcucccucuacaucgacgacguguucaugggccugugcgccaacaagaucgggaucgugccccaggaccacgucuucuucagcggcgagggcaagacccccuaccacccgugcaucuacgagaagaugaugaccagccacgggcaccuggaggaccuccaggaccuguggaagaacgccacggaccccaaggugaagaccaucuccaagggcuucuucgggcagaucuacugccggcugaugaagaucauccuccugugcaagaucagcuacguggacaccuaccccugccgcgcggccuucaucuga

SEQ ID NO: 27133 - RNA, 1155 nt, Artificial Sequence
  derived and/or modified sequence opt1 from B3GNT6__Homo_sapiens__NP_619651
auggccuuccccugccgccggagccugaccgccaagacccucgcgugccugcuggugggcgucuccuuccucgcccugcagcagugguuccugcaggccccgcgcagcccccgggaggagcgcagcccccaggaggagacccccgaggggccgaccgacgcccccgccgcggacgagccgcccuccgagcucgugcccggcccgcccugcguggccaacgccuccgccaacgcgaccgccgacuucgagcagcugcccgcccggauccaggacuuccugcgcuaccggcacugccgccacuucccccuccugugggacgcccccgccaagugcgccgggggccgcggggucuuccugcuccuggcggucaagagcgcccccgagcacuacgagcggcgggagcugauccgccggaccuggggccaggagcgcuccuacggcgggcggcccgugcgccgccucuuccugcugggcacgccggggcccgaggacgaggcccgggccgagcggcucgcggagcugguggcccuggaggcccgcgagcacggcgacgugcuccagugggccuucgccgacaccuuccugaaccugacccucaagcaccuccaccuccuggacuggcuggcggcccggugcccccacgcccgcuuccugcugagcggggacgacgacguguucguccacaccgccaacguggugcgcuuccugcaggcccagcccccgggccggcaccuguucuccggccagcucauggaggggagcguccccauccgcgacuccuggagcaaguacuucgugccgccccagcuguuccccggcuccgcguaccccguguacugcagcgggggcggcuuccugcucuccgggcccacggcccgggcccugcgcgccgcggcccggcacacgccccuguucccgaucgacgacgccuacaugggcaugugccucgagcgcgccgggcuggcccccagcggccacgaggggauccggcccuucggcguccagcugccgggcgcgcagcaguccagcuucgaccccugcauguaccgcgagcuccugcuggugcaccgguucgcccccuacgagaugcuccugauguggaaggcccugcacucccccgcccucagcugcgaccgcgggcaccgggugagcuga

SEQ ID NO: 27134 - RNA, 1194 nt, Artificial Sequence
  derived and/or modified sequence opt1 from B3GNT8__Homo_sapiens__NP_940942
augcgcugccccaagugccugcucugccugagcgcccugcucacccugcugggccucaagguguacaucgaguggaccuccgagagccggcuguccaaggccuacccgagcccccgcgggacgccgcccuccccgacccccgcgaaccccgagcccacccugccggccaaccucagcacccggcugggccagacgaucccccugcccuucgccuacuggaaccagcagcaguggcgccucgggucccugcccagcggcgacuccaccgagaccgggggcugccaggccuggggcgccgcggccgccaccgagaucccggacuucgccagcuaccccaaggaccugcggcgcuuccuccuguccgcggccugccggagcuucccccaguggcugcccgggggcgggggcucccaggucagcuccugcagcgacacggacgugccguaccuccugcuggccgugaaguccgagcccgggcgcuucgccgagcggcaggccguccgcgagaccuggggcagccccgcgcccggcauccggcuccuguuccugcucggguccccggugggcgaggccgggcccgaccuggacagccugguggccugggagagccgccgguacuccgaccuccugcugugggacuuccucgacguccccuucaaccagacccugaaggaccugcuccugcuggccuggcucggccgccacugccccaccgugagcuucgugcugcgggcccaggacgacgcguucguccacacgccggcccugcucgcccaccuccgcgcccugccgcccgccuccgcgcggagccuguaccugggcgagguguucacccaggccaugccccugcgcaagcccgggggccccuucuacgugcccgaguccuucuucgagggcggguaccccgccuacgccagcgggggcggcuacgucaucgccgggcggcucgcgcccuggcugcugcgcgccgccgcccggguggcgcccuuccccuucgaggacguguacaccggccucugcauccgcgcccuggggcuggucccgcaggcccaccccggcuuccugaccgccuggcccgccgaccgcacggcggaccacugcgccuuccggaaccuccugcuggugcgcccccucgggccgcaggccuccauccggcuguggaagcagcugcaggacccccgccuccagugcuga

SEQ ID NO: 27135 - RNA, 1086 nt, Artificial Sequence
  derived and/or modified sequence opt1 from B3GNTL1__Homo_sapiens__XP_006722335
augagcggcgccggggugggcggggccuccgaggagagccaggcgaugcaggcccacgucuccaucauccugcccgugcacaacgccgagcccuggcucgacgagugccugcgcagcgugcugcagcaggacuucgagggcaccauggagcucuccgucuucaacgacgccagcaaggacaaguccggggccaucaucgagaaguggcgggugaagcuggaggacagcggcgugcacgucaucaucggcgggcacgacucccccagcccccgcggcgugggguacgcgaagaaccaggccguggcccaguccagcggcuccuaccugugcuuccucgacagcgacgacgucaugaugccccagcgggugcgccugcagcacgaggccgcggugcagcacccguccagcaucaucgggugccggguccgccgggacccgcccaacuccaccgagcgcuacacgcgguggaucaaccagcugacccccgagcagcuccugacccagguguucaccagcaacggccccacggugaucaugcccaccugguucugcucccgcgccugguucagccacgucggccccuucaacgagggcgggcagggggugcccgaggaccugcuguucuucuacgagcaccuccggaagggcggcggggugauccgcgucgaccagagccugcuccuguaccggcaccacccgcaggccgccacccacugcgugcuggagaccacgaucuggacccaccgcgugcgguuccucgaggagcaggcccugccccgcugggcggccuucaccaucuggaacgccggcaagcaggggcggcgccuguaccggucccucaccgccggcagccagcgcaaggucguggccuucugcgacguggacgagaacaagauccggaagggguucuacugccacgaggacucccaggagcgccccaagccccgcaucccgauccugcacuuccgggcggcccgcccgcccuucgucaucugcgugaagcuggaccucacgggcggcgccuucgaggacaaccugcggagccugcaccuccaggaggggcaggacuuccugcacuucuccuga

SEQ ID NO: 27136 - RNA, 987 nt, Artificial Sequence
  derived and/or modified sequence opt1 from B4GALNT1__Homo_sapiens__NP_001263398
auguggcugggccgccgggcccucugcgcccuggugcugcuccuggcgugcgccagccuggggcuccuguacgccuccacccgcgacgcccccggccugcggcucccgcuggcccccugggcgccgccccagagcccccgccggcccgagcugcccgaccucgcccccgagccgcgcuacgcccacauccccguccggaucaaggagcaggucguggggcugcuggccuggaacaacugcuccugcgagagcuccggcgggggccucccccugcccuuccagaagcagguccgcgcgaucgaccugaccaaggccuucgacccggccgagcuccgggccgccagcgcgacgcgcgagcaggaguuccaggccuuccugucccggagccagucccccgccgaccagcugcucaucgcccccgccaacagcccccugcaguacccgcugcagggcguggaggugcagccccuccgcuccauccuggugcccgggcugagccuccaggcggccuccggccaggagguguaccaggugaaccugaccgccagccuggggaccugggacgucgccggcgaggugaccggggugacgcucaccggcgagggccaggccgaccugacccuggucucccccgggcucgaccagcugaaccggcagcugcagcucgugaccuacagcucccgcagcuaccagacgaacaccgcggacaccggcgcccggccgggguggcgcgacggccaggccggccagaccgagaagaaccagaaggggugguccggccagauggccgaggggaugggcgggaucugggccauggcgcgggccgugcagccccacaacggcugcuucaacuggacgagccgcgcccggggccgcaagggggccuucguccaccugggccuggagcaggcgcgggggaagcccgagcccugggugugccucccguuccgccccaccgugggcgggccccgcaagcggcuggucuga

SEQ ID NO: 27137 - RNA, 1521 nt, Artificial Sequence
  derived and/or modified sequence opt1 from B4GALNT2__Homo_sapiens__NP_001152859
augaccagcggcgggucccgcuuccuguggcuccugaagauccuggugaucauccucguccugggcaucgugggguucauguucggcagcauguuccugcaggccguguucuccagccccaagccggagcuccccucccccgcccccgggguccagaagcugaagcugcucccggaggagcggcugcgcaaccuguucagcuacgacggcaucuggcuguuccccaagaaccagugcaagugcgaggcgaacaaggagcagggcggguacaacuuccaggacgccuacggccaguccgaccuccccgccgugaaggcccggcgccaggccgaguucgagcacuuccagcggcgcgaggggcugccccggccgcucccccugcuggugcagcccaaccuccccuucggcuacccgguccacgggguggaggugaugccccugcacaccguccccauccccggccugcaguucgagggcccggacgcgcccguguacgaggugacgcucaccgccagccuggggacccugaacacccucgccgacguccccgacuccguggugcagggccgcgggcagaagcagcugaucaucagcacguccgaccggaagcugcucaaguucauccugcagcacgucaccuacaccagcaccggcuaccagcaccagaagguggacaucgugucccuggagagccgcuccagcgucgccaaguuccccgugacgauccggcacccggugauccccaagcucuacgaccccggccccgagcgcaagcugcggaaccuggucaccaucgcgaccaagaccuuccuccgcccgcacaagcugaugaucaugcugcgguccauccgcgaguacuaccccgaccucacggugaucguggccgacgacagccagaagccccuggagaucaaggacaaccacgucgaguacuacaccaugcccuucgggaagggcugguucgccgggcggaaccuggccaucucccaggugaccaccaaguacguccucuggguggacgacgacuuccuguucaacgaggagacgaagaucgaggugcuggucgacgugcucgagaagaccgagcuggacguggucggcgggagcgugcugggcaacguguuccaguucaagcuccugcuggagcagagcgagaacggcgccugccuccacaagcgcaugggguucuuccagccgcuggacggcuuccccuccugcgucgugaccagcgggguggucaacuucuuccuggcgcacaccgagcggcugcagcgcgugggcuucgacccccggcuccagcgcguggcccacuccgaguucuucaucgacgggcugggcacgcugcucgucggcagcugcccggaggugaucaucgggcaccagucccgcagccccguggucgacuccgagcuggccgcccuggagaagaccuacaacaccuaccggagcaacacccucacgcgcgugcaguucaagcuggcccugcacuacuucaagaaccaccuccagugcgcggccuga

SEQ ID NO: 27138 - RNA, 2997 nt, Artificial Sequence
  derived and/or modified sequence opt1 from B4GALNT3__Homo_sapiens__NP_775864
augggcagcccccgcgccgcccggccgccccugcuccugcgccccgugaagcugcuccggcgccgguuccgccugcugcucgcgcuggccgucguguccguggggcuguggacccucuaccuggagcuggucgccagcgcccaggugggcgggaacccccucaaccggcgcuacggcuccuggcgggagcuggccaaggcgcuggccagccgcaacaucccggccguggacccccaccuccaguucuaccacccccagcggcugucccuggaggaccacgacaucgaccagggggucagcuccaacagcuccuaccucaaguggaacaagcccgugccguggcugagcgaguuccgcggccgggccaaccugcacguguucgaggacuggugcggcuccagcauccagcagcuccgccggaaccugcacuucccccuguacccccacauccgcaccacgcuccggaagcuggcggucucccccaaguggaccaacuacgggcugcgcaucuucggcuaccuccacccguucaccgacgggaagauccaguucgccaucgccgccgacgacaacgccgaguucuggcugagccuggacgaccagguguccggccuccagcugcuggcgagcguggggaagaccggcaaggaguggacggcccccggcgaguucgggaaguuccggucccagaucagcaagcccgucucccucagcgccagccaccgcuacuacuucgaggugcugcacaagcagaacgaggagggcaccgaccacguggaggucgccuggcggcgcaacgaccccggggccaaguucaccaucaucgacucccugagccucucccuguucaccaacgagacguuccugcagauggacgaggugggccacaucccgcagaccgcggccagccacguggacuccagcaacgcccucccccgcgacgagcagccgcccgccgacaugcugcggcccgacccccgcgacacccuguaccgggucccccucauccccaagucccaccuccgccacgugcugccggacugccccuacaagcccagcuaccugguggacggccugccccugcagcgguaccaggggcuccgcuucguccaccuguccuucguguacccgaacgacuacacccggcugagccacauggagacgcacaacaagugcuucuaccaggagaacgccuacuaccaggaccgcuucuccuuccaggaguacaucaagaucgaccagcccgagaagcagggccuggagcagcccggguucgaggagaaccuccuggaggagagccaguacggcgagguggcggaggagaccccggccuccaacaaccagaacgcccggaugcuggaggggcgccagacccccgccagcacccucgagcaggacgccacggacuaccggcugcgcucccugcggaagcuccuggcgcagccccgcgagggccugcucgcccccuucagcaagcggaacuccaccgccagcuucccgggccgcaccucccacauccccguccagcagcccgagaagcggaagcagaagcccagcccggagcccagccaggacagcccccacuccgacaaguggcccccggggcaccccgugaagaaccugccccagaugcgcggcccccggccgcgccccgccggggacagcccccgcaagacccaguggcugaaccaggucgaguccuacaucgcggagcagcggcgcggcgaccggaugcgcccccaggccccggggcggggcuggcacggcgaggaggaggugguggccgccgccgggcaggagggccaggucgagggggaggaggagggcgaggaggaggaggaggaggaggacauguccgagguguucgaguacgugcccgucuucgaccccguggugaacugggaccagacguucagcgcgcgcaaccucgacuuccaggcccugcggaccgacuggaucgaccuguccugcaacaccagcgggaaccuccugcugcccgagcaggaggcccucgaggucacccgcguguuccugaagaagcugaaccagcggucccgcggccgguaccagcuccagcgcaucgugaacgucgagaagcggcaggaccagcugcgcggcgggcgguaccugcucgagcuggagcugcucgagcagggccagcgcguggugcggcugagcgaguacgucuccgcccgcggguggcagggcaucgacccggccggcggggaggagguggaggcgcggaaccugcagggccucgugugggacccccacaaccgccggcgccagguccugaacacgcgcgcccaggagcccaagcugugcuggccgcagggguucagcuggucccaccgggccguggugcacuucgucgugcccgugaagaaccaggcccgcuggguccagcaguucaucaaggacauggagaaccucuuccaggugaccggcgacccccacuucaacaucgugaucaccgacuacagcuccgaggacauggacgucgagauggcccugaagcggagcaagcugcgcuccuaccaguacgugaagcucagcgggaacuucgagcggagcgcgggccugcaggccggcaucgaccuggugaaggacccccacuccaucaucuuccucugcgaccugcacauccacuucccggccggggucaucgacgccauccgcaagcacugcguggagggcaagauggcguucgcccccauggugaugcggcugcacugcggggccacgccccaguggcccgagggcuacugggaggucaacggguucggccuccugggcaucuacaagagcgaccuggaccgcaucgggggcaugaacaccaaggaguuccgggaccgcuggggcggggaggacugggagcuccuggaccggauccugcaggccgggcucgacguggagcgccugucccugcggaacuucuuccaccacuuccacagcaagcgcggcauguggucccggcgccagaugaagacccucuga

SEQ ID NO: 27139 - RNA, 1197 nt, Artificial Sequence
  derived and/or modified sequence opt1 from B4GALT1__Homo_sapiens__NP_001488
augcgccugcgggagccccuccugagcggcuccgccgccaugccgggggcgagccugcagcgcgccugccggcuccugguggccgucugcgcccugcaccucggcgugacccugguguacuaccuggccgggcgcgaccucucccggcugccccagcuggucggcgugagcacgccccuccagggcggguccaacagcgcggccgccaucggccaguccagcggggagcugcgcaccggcggggcccggcccccgccgccccugggcgcguccagccagccccgccccgggggcgacuccagccccguggucgacuccggccccgggcccgccagcaaccucaccuccgugccggugccccacaccaccgcccugagccugcccgccugccccgaggaguccccgcuccuggucggccccaugcugaucgaguucaacaugcccguggaccucgagcugguggccaagcagaaccccaacgucaagaugggcgggcgguacgcgccgcgcgacugcgugagcccccacaagguggccaucaucauccccuuccggaaccgccaggagcaccugaaguacuggcucuacuaccugcaccccguccugcagcggcagcagcucgacuacggcaucuacgugaucaaccaggccggggacacgaucuucaaccgcgccaagcugcugaacgugggcuuccaggaggcccucaaggacuacgacuacacgugcuucgucuucuccgacguggaccugaucccgaugaacgaccacaacgcguaccggugcuucagccagccccgccacaucagcguggccauggacaaguucggguucucccugcccuacguccaguacuucggcggggugagcgcccucuccaagcagcaguuccugaccaucaacggcuuccccaacaacuacuggggcuggggcggggaggacgacgacaucuucaaccggcugguguuccgcgggaugagcaucucccggccgaacgccgucgugggccgcugccggaugauccgccacagccgcgacaagaagaacgagcccaacccccagcgguucgaccgcaucgcccacaccaaggagaccaugcucuccgacgggcugaacagccugaccuaccagguccucgacgugcagcgguacccgcuguacacccagaucaccguggacaucggcacgcccuccuga

SEQ ID NO: 27140 - RNA, 1182 nt, Artificial Sequence
  derived and/or modified sequence opt1 from B4GALT3__Homo_sapiens__NP_003770
augcugcgccggcuccuggagcgccccugcacccuggcccuccuggugggcagccagcuggccgucaugauguaccucucccucgggggcuuccggagccuguccgcccuguucgggcgcgaccagggcccgaccuucgacuacagccacccccgggacguguacuccaaccugagccaccuccccggggcccccggcggcccgcccgcgccccaggggcugcccuacugcccggagcgcagcccccugcuggugggccccgucuccguguccuucagccccgugccgucccucgccgagaucgucgagcggaacccccgcguggagcccgggggccgguaccgccccgccgggugcgagccgcggagccgcacggcgaucaucgugccccaccgggcccgcgagcaccaccuccggcugcugcuguaccaccuccaccccuuccugcagcgccagcagcuggccuacggcaucuacgucauccaccaggccggcaacgggaccuucaaccgggcgaagcugcucaacgugggcgugcgcgaggcccugcgggacgaggagugggacugccuguuccuccacgacgucgaccugcugcccgagaacgaccacaaccucuacgugugcgacccgcgcgggccccggcacguggccgucgccaugaacaaguucggcuacucccugcccuacccccaguacuucggcggggugagcgcccugaccccggaccaguaccucaagaugaacggcuuccccaacgaguacuggggguggggcggggaggacgacgacaucgcgacccgcgugcgccuggccggcaugaagaucucccggccgcccacgagcgucggccacuacaagauggugaagcaccgcggggacaagggcaacgaggagaacccccaccgguucgaccugcucgugcgcacccagaacuccuggacccaggacgggaugaacagccugaccuaccagcugcucgcccgggagcugggcccccuguacacgaacaucaccgccgacaucgggaccgacccccgcggcccgcgggcccccuccggcccccgcuacccgcccgggagcagccaggcguuccggcaggagaugcuccagcgccggccgcccgcccgccccggcccccuguccaccgccaaccacacggcccugcgggggagccacuga

SEQ ID NO: 27141 - RNA, 1035 nt, Artificial Sequence
  derived and/or modified sequence opt1 from B4GALT4__Homo_sapiens__NP_997708
augggcuucaaccugaccuuccaccucagcuacaaguuccgccugcugcuccugcugacccucugccugacgguggucgggugggccaccuccaacuacuucgugggcgccauccaggagauccccaaggcgaaggaguucauggccaacuuccacaagacccugauccucgggaagggcaagacccugacgaacgaggccagcaccaagaagguggagcuggacaacugcccguccgucagccccuaccuccgggggcaguccaagcugaucuucaagcccgaccugacccucgaggaggugcaggccgagaaccccaaggugagccgcggccgguaccgcccgcaggagugcaaggcccugcagcgggucgcgauccuggugccccaccgcaaccgggagaagcaccucauguaccugcuggagcaccuccaccccuuccugcagcgccagcagcuggacuacggcaucuacgugauccaccaggccgaggggaagaaguucaaccgggccaagcuccugaacgucggcuaccuggaggcccucaaggaggagaacugggacugcuucaucuuccacgacguggaccuggugcccgagaacgacuucaaccuguacaagugcgaggagcacccgaagcaccucgucguggggcgcaacuccaccggcuaccggcugcgcuacagcggguacuucggcggcgugacggcgcugucccgggagcaguucuucaaggucaacggguucagcaacaacuacuggggcuggggcggggaggacgacgaccuccgccugcggguggagcugcagcgcaugaagaucucccggccccuccccgaggugggcaaguacaccauggucuuccacacccgcgacaaggggaacgaggugaacgccgagcggaugaagcugcugcaccaggugagccgcgucuggcggaccgacggccucuccagcugcuccuacaagcuggugagcguggagcacaacccccuguacaucaacaucacggucgacuucugguucggggccuga

SEQ ID NO: 27142 - RNA, 1167 nt, Artificial Sequence
  derived and/or modified sequence opt1 from B4GALT5__Homo_sapiens__NP_004767
augcgcgcccggcgcggccugcuccggcugccccgccggagccugcucgccgcgcuguucuucuucucccugagcuccagccuccuguacuucguguacgucgccccggggaucgugaacaccuaccuguucaugaugcaggcccagggcauccucauccgcgacaacgugcggaccaucggggcccaggucuacgagcagguccugcgcuccgccuacgcgaagcggaacagcuccgugaacgacagcgacuacccccuggaccucaaccacuccgagacguuccugcagaccaccaccuuccugcccgaggacuucacguacuucgccaaccacacgugccccgagcgccucccgagcaugaagggccccaucgacaucaacauguccgagaucgggauggacuacauccacgagcuguucagcaaggaccccaccaucaagcugggcggccacuggaagcccuccgacugcaugccgcgguggaagguggccauccucauccccuuccgcaaccggcacgagcaccuccccgugcuguuccgccaccuccugcccaugcugcagcggcagcgccugcaguucgccuucuacguggucgagcaggucgggacccagccguucaaccgggcgaugcuguucaacgugggcuuccaggaggccaugaaggaccuggacugggacugccucaucuuccacgacguggaccacauccccgagagcgaccgcaacuacuacgggugcggccagaugccccggcacuucgccaccaagcuggacaaguacauguaccugcuccccuacaccgaguucuucgggggcguguccggccugaccguggagcaguuccgcaagaucaacggguucccgaacgccuucuggggcuggggcggggaggacgacgaccuguggaaccggguccagaacgccggcuacagcgugucccgccccgagggggacaccggcaaguacaagagcaucccccaccaccaccgcggggaggugcaguuccucggccgguacgcgcugcugcgcaaguccaaggagcggcaggggcucgacggccugaacaaccugaacuacuucgccaacaucacguacgacgcccucuacaagaacaucaccgucaaccugacccccgagcuggcccaggugaacgaguacuga

SEQ ID NO: 27143 - RNA, 1149 nt, Artificial Sequence
  derived and/or modified sequence opt1 from B4GALT6__Homo_sapiens__NP_004766
augagcgugcugcgccggaugaugcgcgucuccaaccggagccuccuggccuucaucuucuucuucucccugagcuccagcugccucuacuucaucuacguggcccccggcaucgcgaacaccuaccuguucauggugcaggcccgcgggaucaugcugcgggagaacgucaagaccaucggccacaugauccgccucuacacgaacaagaacuccacccugaacgggaccgacuacccggagggcaacaacagcuccgacuaccuggugcagaccacgaccuaccuccccgagaacuucaccuacagccccuaccugcccugcccggagaagcugcccuacaugcggggguuccucaacgugaacgucuccgaggugagcuucgacgagauccaccagcuguucuccaaggaccuggacaucgagcccggcggccacuggcgccccaaggacugcaagccgcgguggaagguggccguccucauccccuuccgcaaccggcacgagcaccuccccaucuucuuccugcaccucauccccaugcugcagaagcagcgccuggaguucgccuucuacgugaucgagcagaccgggacgcagccguucaaccgggccaugcuguucaacgugggcuucaaggaggcgaugaaggacagcgucugggacugcgugaucuuccacgacguggaccaccuccccgagaacgaccgcaacuacuacgggugcggcgagaugccccggcacuucgccgccaagcuggacaaguacauguacauccugcccuacaaggaguucuucgggggcgucuccggccugaccguggagcaguuccgcaagaucaacggguucccgaacgccuucuggggcuggggcggggaggacgacgaccuguggaaccgggugcacuacgcgggcuacaacgucacccgccccgagggggaccucggcaaguacaagagcaucccccaccaccaccgcggggaggugcaguuccugggccgguacaagcugcuccgguacuccaaggagcgccaguacaucgacgggcugaacaaccugaucuaccgccccaagauccucguggaccggcuguacaccaacaucagcgucaaccugaugccggagcucgcccccaucgaggacuacuga

SEQ ID NO: 27144 - RNA, 984 nt, Artificial Sequence
  derived and/or modified sequence opt1 from B4GALT7__Homo_sapiens__NP_009186
auguuccccagccgccggaaggccgcccagcugccgugggaggacggccgcuccgggcuccugagcggcgggcugccccggaagugcuccguguuccaccucuucguggcgugccugagccugggcuucuucucccuccuguggcugcagcucagcugcuccggggacguggcccgcgccgugcggggccagggccaggagaccagcgggccgccccgcgccugcccgcccgagcccccgcccgagcacugggaggaggacgccuccuggggcccccaccggcuggcgguccuggugcccuuccgcgagcgguucgaggagcuccugguguucgucccccacaugcgccgguuccugagccgcaagaagauccggcaccacaucuacgugcucaaccagguggaccacuuccgcuucaaccgggccgcccugaucaacgucggguuccuggaguccagcaacuccaccgacuacaucgccaugcacgacguggaccuccugccccugaacgaggagcucgacuacggcuuccccgaggcggggcccuuccacguggccagccccgagcugcacccgcuguaccacuacaagacguacgucggcggcauccuccugcuguccaagcagcacuaccgccucugcaacgggaugagcaaccgguucuggggcugggggcgcgaggacgacgaguucuaccggcgcaucaagggcgccggccugcagcuguuccggcccuccgggaucaccaccggcuacaagaccuuccgccaccuccacgaccccgccuggcgcaagcgggaccagaagcgcaucgccgcgcagaagcaggagcaguucaagguggaccgggagggcgggcugaacacggugaaguaccacgucgccagccgcaccgcccuguccgucgggggcgcccccugcaccgugcucaacaucaugcuggacugcgacaagaccgccacgccguggugcaccuucagcuga

SEQ ID NO: 27145 - RNA, 1248 nt, Artificial Sequence
  derived and/or modified sequence opt1 from B4GAT1__Homo_sapiens__NP_006867
augcagaugagcuacgccauccgcugcgccuucuaccagcugcuccuggcggcccugaugcucguggccaugcugcagcugcucuaccugucccugcucagcggccugcacgggcaggaggagcaggaccaguacuucgaguucuucccgcccagcccccgguccgucgaccaggugaaggcccagcugcgcaccgcccucgcguccggcggggugcuggacgccagcggcgacuaccgggucuaccgcgggcugcucaagaccacgauggaccccaacgacgugauccuggccacccacgccuccguggacaaccugcuccaccugagcggccugcucgagcggugggagggcccccuguccgucagcguguucgcggccaccaaggaggaggcccagcuggccaccgugcucgccuacgcgcuguccagccacugcccggacaugcgcgcccgggucgccaugcaccuggugugccccucccgcuacgaggccgccgugcccgacccccgggagccgggggaguucgcgcuccugcgcagcugccaggaggucuucgacaagcuggcccggguggcccagcccggcaucaacuacgcccucgggacgaacguguccuaccccaacaaccugcugcgcaaccucgcccgggagggcgcgaacuacgcccuggucaucgacguggacauggugcccagcgaggggcuguggcgcggccuccgggagaugcuggaccaguccaaccaguggggcgggaccgcccuggucgugccggccuucgagauccgccgggcccgccggaugcccaugaacaagaacgagcucgugcagcuguaccaggucggcgaggugcgccccuucuacuacgggcugugcacccccugccaggcgccgaccaacuacagccggugggugaaccuccccgaggagucccugcugcgccccgccuacgucgugcccuggcaggacccgugggagcccuucuacgucgccggcggcaaggugcccacguucgacgagcgcuuccggcaguacggguucaaccgcaucagccaggccugcgagcuccacguggcgggcuucgacuucgagguccugaacgagggguuccuggugcacaagggcuucaaggaggcccucaaguuccacccccagaaggaggccgagaaccagcacaacaagauccuguaccggcaguucaagcaggagcugaaggccaaguacccgaacagcccccgccggugcuga

SEQ ID NO: 27146 - RNA, 444 nt, Artificial Sequence
  derived and/or modified sequence opt1 from B9D1__Homo_sapiens__NP_001230404
augaugaccagcaccgccuccaccgcccugugcaccgcgcgcaccgggcccccgcagcggguguggcgccgggggagccaccgcucccacccccgggccaagaugugcggcaagcacuggugcgggaccagcccccucaugagcccccugaaggccccgacgcccaccgccggccaccgcuccugcuccgccugcauggaccagaugugcagcgggaccaugugguucgaggcgaugggccccugcacgugccccucccaccuggccggcaccaaggggccgagccccugccucucccagaaccugcggcugaacugccgcagccuccaggccggcuccuggggcggcgggcccagcacccagacgccccggugguggcugcgcgucaaggccggcaagccgcccuccggccugagcgugaaggacuccagcgugucccgguga

SEQ ID NO: 27147 - RNA, 528 nt, Artificial Sequence
  derived and/or modified sequence opt1 from B9D2__Homo_sapiens__NP_085055
auggccgaggugcacgucaucggccagaucaucggggccagcggcuucuccgagagcucccuguucugcaagugggggauccacaccggcgcggccuggaagcuccugagcggggugcgcgagggccagacccagguggacacgccccagaucggcgacauggccuacuggucccacccgaucgaccugcacuucgccaccaaggggcuccagggcuggccccggcugcacuuccaggucuggagccaggacuccuucgggcgcugccagcuggccggcuacggguucugccacgugcccagcucccccggcacccaccagcucgcgugcccgaccuggcggccccugggcagcuggcgcgagcagcuggcccgggccuucgucgggggcgggccccagcuccugcacggcgacacgaucuacuccggcgccgaccgcuaccggcugcacaccgcggccgggggcaccgugcaccucgagaucgggcugcugcuccgcaacuucgaccgguacggcguggagugcuga

SEQ ID NO: 27148 - RNA, 165 nt, Artificial Sequence
  derived and/or modified sequence opt1 from BAALC__Homo_sapiens__NP_001019543
augggcugcgggggcagccgcgccgacgccaucgagccccgguacuacgaguccuggacccgcgagaccgagagcacguggcugaccuacaccgacuccgacgcgccgcccagcgccgccgcccccgacuccgggcccgaggccggcgggcuccacagcggcuga

SEQ ID NO: 27149 - RNA, 1257 nt, Artificial Sequence
  derived and/or modified sequence opt1 from BAAT__Homo_sapiens__NP_001692
augauccagcugaccgccacccccgugagcgcccucgucgacgagccggugcacauccgcgcgacgggccugauccccuuccagaugguguccuuccaggccagccuggaggacgagaacggggacauguucuacucccaggcccacuaccgggccaacgaguucggcgaggucgaccucaaccacgccagcucccucgggggcgacuacaugggggugcaccccaugggccuguucuggagccucaagcccgagaagcugcugacccgccuccugaagcgggacgugaugaaccgcccguuccagguccaggugaagcuguacgaccucgagcugaucgugaacaacaaggucgcguccgcccccaaggccagccugacccucgagcggugguacguggcccccggcgugacccgcaucaagguccgggaggggcgccugcggggcgcgcuguuccugcccccgggggagggccuguuccccggggugaucgaccuguucggcggccucgggggccugcuggaguuccgcgccucccuccuggccagccggggguucgccucccuggcccucgcguaccacaacuacgaggaccugccccgcaagcccgaggugacggaccuggaguacuucgaggaggccgccaacuuccuccugcggcacccgaaggucuucggcagcggcguggggguggucuccgugugccagggcgugcagaucgggcugagcauggccaucuaccucaagcaggucaccgccaccgugcugaucaacggcaccaacuuccccuucgggaucccccagguguaccacggccagauccaccagccccugccgcacuccgcgcagcucaucagcacgaacgcccugggccugcucgagcuguaccgcaccuucgagaccacccaggucggggccucccaguaccuguuccccaucgaggaggcccagggccaguuccucuucaucgugggggagggcgacaagacgaucaacagcaaggcccacgcggagcaggccaucgggcagcugaagcggcacggcaagaacaacuggacccugcucuccuaccccggcgccgggcaccugaucgagcccccguacagcccccugugcugcgccagcaccacccacgaccuccgccugcacuggggcggggaggucaucccccacgccgcggcccaggagcacgccuggaaggagauccagcgguuccugcgcaagcaccugauccccgacgugacgucccagcucuga

SEQ ID NO: 27150 - RNA, 990 nt, Artificial Sequence
  derived and/or modified sequence opt1 from BABAM1__Homo_sapiens__NP_001275685
auggagguggccgagcccagcuccccgaccgaggaggaggaggaggaggaggagcacagcgccgagccccgcccccggacccgcuccaaccccgagggcgcggaggaccgggccgucggggcccaggccagcgugggcucccgcagcgagggggagggcgaggccgcguccgccgacgacgggagccugaacacguccggcgccggccccaagagcuggcaggucccgccgcccgcccccgaggugcagauccggacgccccgcgugaacugccccgagaaggugaucaucugccucgaccuguccgaggagaugagccugcccaagcucgaguccuucaacgggagcaagaccaacgcgcugaacgucucccagaagaugaucgagauguucgugcggaccaagcacaagaucgacaagagccacgaguucgcccugguggucgugaacgacgacaccgccuggcucuccggccugaccagcgacccgcgcgagcugugcuccugccucuacgaccuggagaccgccagcugcagcaccuucaaccuggagggccucuucucccugauccagcagaagacggagcugcccgugaccgagaacguccagaccaucccgccgcccuacguggugcggaccauccucgucuacagccgcccgcccugccagccccaguucucccugacggagcccaugaagaagauguuccagugccccuacuucuucuucgacgugguguacauccacaacgggaccgaggagaaggaggaggagaugagcuggaaggacauguucgccuucauggggucccuggacaccaagggcaccagcuacaaguacgaggucgcgcucgccggccccgcccuggagcugcacaacugcauggccaagcuccuggcccacccccugcagcggcccugccagucccacgcgagcuacucccuccuggaggaggaggacgaggccaucgagguggaggccacgguguga

SEQ ID NO: 27151 - RNA, 1131 nt, Artificial Sequence
  derived and/or modified sequence opt1 from BACE1__Homo_sapiens__NP_001193978
auggugcccuucaucuaccugcaggcccacuucacccucugcagcggcugguccagcaccuaccgcgaccugcggaagggggucuacgugccguacacgcagggcaagugggagggggagcugggcaccgaccucguguccaucccccacgggcccaacgucaccgugcgcgccaacaucgcggccaucaccgagagcgacaaguucuucaucaacggcuccaacugggagggcauccuggggcuggccuacgccgagaucgcccggcucugcggcgcgggguucccccugaaccagagcgaggugcuggccuccgucggcgggagcaugaucaucggcggcaucgaccacucccucuacacggggagccugugguacaccccgauccgccgggagugguacuacgaggugaucaucgugcgcgucgagaucaacggccaggaccugaagauggacugcaaggaguacaacuacgacaaguccaucguggacagcgggaccaccaaccuccggcugcccaagaagguguucgaggccgccgucaaguccaucaaggcggccagcuccacggagaaguuccccgacggcuucuggcugggcgagcagcucgugugcuggcaggccgggaccacccccuggaacaucuucccggugaucagccuguaccugaugggcgaggucaccaaccaguccuuccgcaucacgauccucccccagcaguaccugcggcccguggaggacguggccaccagccaggacgacugcuacaaguucgccaucucccagagcagcaccgggaccgucaugggcgcggugaucauggagggguucuacguggucuucgaccgcgcccggaagcgcaucggcuucgccguguccgccugccacgugcacgacgaguuccggacggccgcggucgagggccccuucgugacccuggacauggaggacugcggguacaacaucccgcagaccgacgagagcacccucaugacgaucgccuacgucauggccgccaucugcgcccuguucaugcugccccucugccugauggugugccaguggcgcugccugcggugccuccgccagcagcacgacgacuucgcggacgacaucucccugcugaaguga

SEQ ID NO: 27152 - RNA, 1557 nt, Artificial Sequence
  derived and/or modified sequence opt1 from BACE2__Homo_sapiens__NP_036237
augggcgcccuggcccgcgcgcuccugcugccccuccuggcccaguggcugcuccgggccgccccggagcuggcccccgcgcccuucacccugccccuccgcguggccgccgccaccaaccgggucguggcgccgacgcccgggcccggcacccccgccgagcgccacgccgacgggcuggcccuggcccucgagccggcgcuggccagccccgccggcgccgccaacuuccuggcgaugguggacaaccuccagggggacuccggccggggcuacuaccuggagaugcugaucgggaccccgccccagaagcuccagauccuggucgacaccggcagcuccaacuucgccguggccgggacgccccacagcuacaucgacaccuacuucgacaccgagcgcuccagcaccuaccgguccaagggcuucgacgugacggucaaguacacccaggggagcuggaccggcuucgugggcgaggaccuggugaccauccccaagggguucaacacguccuuccucgucaacaucgccaccaucuucgagagcgagaacuucuuccugcccggcaucaaguggaacgggauccugggccucgccuacgcgacccuggccaagcccuccagcucccuggagaccuucuucgacagccucgugacgcaggccaacaucccgaacguguucuccaugcagaugugcggcgccgggcugcccgucgccggcagcgggaccaacggcgggucccuggugcucggcggcaucgagcccagccuguacaagggggacaucugguacacccccaucaaggaggagugguacuaccagaucgagauccugaagcucgagaucggcgggcagucccugaaccuggacugccgcgaguacaacgcggacaaggccaucguggacagcggcaccacgcuccugcggcugccgcagaaggucuucgacgccgugguggaggccgucgcgcgcgccagccucauccccgaguucuccgacggguucuggaccggcagccagcuggccugcuggaccaacuccgagacccccuggagcuacuuccccaagaucuccaucuaccugcgggacgagaacagcucccgcagcuuccggaucacgauccucccgcagcuguacauccagcccaugaugggcgccgggcugaacuacgagugcuaccgcuucggcaucucccccagcaccaacgcccucgugaucggggcgaccgugauggagggcuucuacgucaucuucgaccgggcccagaagcgcgugggguucgccgccucccccugcgccgagaucgcgggcgccgccgugagcgagaucuccggcccguucagcaccgaggacgucgccuccaacugcgugcccgcccagagccuguccgagcccauccuguggaucgucagcuacgcgcucauguccgugugcggggccauccugcuggugcugaucguccuccugcugcucccguuccggugccagcgccggccccgcgaccccgagguggugaacgacgagagcagccugguccggcaccgcuggaaguga

SEQ ID NO: 27153 - RNA, 2211 nt, Artificial Sequence
  derived and/or modified sequence opt1 from BACH1__Homo_sapiens__NP_996749
augagccuguccgagaacagcguguucgccuacgaguccagcguccacuccaccaacgugcuccugagccugaacgaccagcgcaagaaggacgugcucugcgacgucaccaucuucguggagggccagcgguuccgcgcccaccgguccgugcuggcggccugcagcuccuacuuccacagccgcaucgucgggcaggccgacggcgagcugaacaucacgcuccccgaggaggugaccgugaagggguucgagccgcugauccaguucgccuacaccgccaagcugauccucuccaaggagaacgucgacgaggugugcaagugcguggaguuccugagcguccacaacaucgaggaguccugcuuccaguuccugaaguucaaguuccucgacagcaccgcggaccagcaggagugcccccggaagaagugcuucuccagccacugccagaagacggaccugaagcugucccuccuggaccagcgcgaccuggagaccgacgagguggaggaguuccucgagaacaagaacgugcagacgccccagugcaagcugcggcgcuaccagggcaacgccaaggccagcccgccccugcaggacuccgccagccagaccuacgagagcaugugccucgagaaggacgcggcccuggcccugcccucccucugccccaaguaccggaaguuccagaaggccuucgggaccgaccgcguccggaccggcgagagcuccgugaaggacauccacgccagcgugcagcccaacgagcgcuccgagaacgagugccugggcggggucccggagugccgggaccuccaggugaugcugaagugcgacgagagcaagcuggcgauggagcccgaggagaccaagaaggaccccgccucccagugccccaccgagaaguccgaggugacgccguucccccacaacagcagcaucgacccccacggccuguacucccucagccugcugcacaccuacgaccaguacggggaccucaacuucgccggcaugcagaacaccaccguccugacggagaagccccuguccgggaccgacgugcaggagaagaccuucggcgagagccaggaccucccgcugaaguccgaccugggcacccgcgaggacagcuccguggccagcuccgaccggagcagcgucgagcgcgagguggccgagcaccucgcgaagggguucugguccgacaucugcagcacggacacccccugccagaugcagcugucccccgccgucgccaaggacggcagcgagcagaucucccagaagcggagcgagugccccuggcuggggauccgcaucuccgagagcccggagcccggccagcggaccuucaccacgcucuccagcgugaacugccccuucaucuccacccugagcaccgagggcugcuccagcaaccuggagaucgggaacgacgacuacguguccgagccccagcaggagccgugccccuacgccugcgucaucagccucggcgacgacuccgagaccgacacggagggggacagcgagagcugcuccgcccgcgagcaggagugcgaggugaagcugcccuucaacgcgcagcggaucaucagccugucccgcaacgacuuccagagccuccugaagaugcacaagcugacccccgagcagcuggacugcauccacgacauccgccggcgcuccaagaaccggaucgccgcccagcgcugccggaagcgcaagcucgacugcauccagaaccuggagagcgagaucgagaagcugcaguccgagaaggagagccuccugaaggagcgggaccacauccuguccacccucggcgagaccaagcagaaccugacggggcugugccagaaggugugcaaggaggccgcccucagccaggagcagauccagauccuggcgaaguacuccgccgccgacugcccgcugagcuuccucaucuccgagaaggacaagagcacccccgacggcgagcuggcccugcccuccaucuucagccucuccgaccgcccgcccgcgguccugccgcccugcgcccggggcaacagcgagcccggguacgcccgcggccaggagucccagcagaugagcaccgccaccagcgagcaggccgggcccgcggagcagugccggcaguccggcgggaucagcgacuucugccagcagaugacggacaagugcaccaccgacgaguga

SEQ ID NO: 27154 - RNA, 2634 nt, Artificial Sequence
  derived and/or modified sequence opt1 from BACH2__Homo_sapiens__XP_005248815
augagccgccacaccggcaagcggcgcaagacccagguggaggagacgucccagaucagccggaacuggaacgucuucaaguccuggcagagccagggggugaacggcauguccguggacgagaagcccgacagccccauguacgucuacgaguccaccgugcacugcaccaacauccugcucgggcugaacgaccagcgcaagaaggacauccugugcgacgugacccucaucgucgagcggaaggaguuccgcgcccaccgggccgugcuggcggccugcagcgaguacuucuggcaggcccuggugggccagacgaagaacgaccucgucgugucccugcccgaggaggugaccgcccgcggguucggcccccugcuccaguucgccuacaccgcgaagcugcugcucagccgggagaacauccgcgaggucauccggugcgccgaguuccugcgcaugcacaaccuggaggacuccugcuucagcuuccuccagacccagcugcugaacuccgaggacggccucuucgugugccggaaggacgccgccugccagcgcccccacgaggacugcgagaacagcgcgggggaggaggaggacgaggaggaggagacgauggacuccgagaccgccaagauggccugcccgcgggaccagaugcugcccgagcccaucagcuucgaggccgccgcgauccccguggccgagaaggaggaggcccugcucccggagcccgacguccccaccgacaccaaggaguccagcgagaaggacgcccugacgcaguacccccgcuacaagaaguaccagcuggccugcaccaagaacguguacaacgcguccagccacagcaccuccggcuucgccagcaccuuccgggaggacaacuccagcaacucccucaagccggggcuggcccgcggccagaucaagagcgagccgcccuccgaggagaacgaggaggagagcaucacgcugugccucuccggggacgagcccgacgccaaggaccgggccggcgacguggagauggaccgcaagcagcccagccccgcgcccacccccaccgccccggccggcgccgccugccuggagcggucccgcagcgucgcgucccccagcugccugcgcucccucuucagcaucaccaaguccguggagcugagcgggcugcccuccacgagccagcagcacuucgcccggagccccgccugcccguucgacaagggcaucacccagggggaccucaagaccgacuacacccccuucacgggcaacuacggccagccccacguggggcagaaggaggucuccaacuucaccaugggcagcccccugcgcgggccgggccuggaggcccucugcaagcaggagggggagcuggaccggcgcuccgugaucuucagcuccagcgcgugcgaccagguguccaccagcguccacuccuacagcggcguguccagccuggacaaggaccucuccgagcccguccccaagggccugugggugggggccggccagagccugccguccagccaggccuacucccacgggggccucauggccgaccaccuccccgggcggaugcgccccaacaccagcugccccgugccgaucaaggucugcccccggagcccgccccuggagacgcgcacccggaccuccagcuccugcagcuccuacagcuacgccgaggacggcuccggcgggagccccugcucccugccccugugcgaguucagcuccagccccugcucccagggcgcgcgcuuccuggccaccgagcaccaggagcccgggcucaugggcgacgggauguacaaccaggugcggccgcagaucaagugcgagcagagcuacggcacgaacuccagcgacgaguccggcagcuucuccgaggccgacagcgagagcugccccgugcaggaccgcgggcaggaggucaagcugcccuuccccguggaccagaucaccgaccugccgcggaacgacuuccagaugaugaucaagaugcacaagcugaccuccgagcagcucgaguucauccacgacgugcgccggcgcagcaagaaccggaucgccgcccagcgcugccggaagcgcaagcuggacugcauccagaaccuggagugcgagauccgcaagcucgucugcgagaaggagaagcugcuguccgagcggaaccagcucaaggcgugcaugggcgagcugcuggacaacuucagcugccucucccaggaggugugccgcgacauccagagccccgagcagauccaggcccugcaccgguacugccccgugcugcgccccauggaccucccgaccgccuccagcaucaaccccgcgccccugggggccgagcagaacaucgccgccucccagugcgccgucggcgagaacgugcccugcugccuggagccgggcgccgcgccgcccgggccgcccugggcccccagcaacacguccgagaacugcaccagcggccggcgccucgaggggaccgaccccggcaccuucuccgagcgggggccgccccuggagccccgcagccagaccgugacggucgacuucugccaggagaugaccgacaagugcaccaccgacgagcagccccggaaggacuacacguga

SEQ ID NO: 27155 - RNA, 507 nt, Artificial Sequence
  derived and/or modified sequence opt1 from BAD__Homo_sapiens__NP_004313
auguuccagauccccgaguucgagccgagcgagcaggaggacuccagcuccgccgagcgcggccuggggcccagccccgccggcgacgggcccuccggcagcgggaagcaccaccggcaggcgccgggccuccugugggacgccucccaccagcaggagcagcccaccagcuccagccaccacggcggggccggcgccguggagauccgcucccggcacagcuccuaccccgccgggaccgaggacgacgagggcaugggggaggagcccagcccguuccgcggccggucccgcagcgcgccgcccaaccugugggccgcccagcgguacggccgcgagcuccggcgcauguccgacgaguucgucgacagcuucaagaaggggcugccccggcccaaguccgccggcacggcgacccagaugcgccagagcagcuccuggacccggguguuccagagcuggugggaccgcaaccuggggcggggcuccagcgcccccucccaguga

SEQ ID NO: 27156 - RNA, 693 nt, Artificial Sequence
  derived and/or modified sequence opt1 from BAG1__Homo_sapiens__NP_001165886
augaaccgcagccaggaggugacccgggacgaggaguccacccgcagcgaggaggucacgcgggaggagauggccgccgcgggccugaccgugaccgugacccacuccaacgagaagcacgaccuccacgucacgagccagcagggguccagcgagcccguggugcaggaccuggcccaggucguggaggaggugaucggcgucccgcaguccuuccagaagcugaucuucaagggcaagagccucaaggagauggagacgccccuguccgcccuggggauccaggacgggugccgcgugaugcucaucggcaagaagaacagcccccaggaggagguggagcugaagaagcugaagcaccucgagaaguccgucgagaagaucgccgaccagcuggaggagcugaacaaggagcucaccggcauccagcagggguuccugcccaaggaccugcaggccgaggcgcucugcaagcuggaccggcgcgugaaggccaccaucgagcaguucaugaagauccuggaggagaucgacacccucauccugccggagaacuucaaggacagccggcugaagcgcaagggccucgugaagaagguccaggccuuccuggccgagugcgacaccguggagcagaacaucugccaggagaccgagcggcugcaguccaccaacuucgcgcucgccgaguga

SEQ ID NO: 27157 - RNA, 1728 nt, Artificial Sequence
  derived and/or modified sequence opt1 from BAG3__Homo_sapiens__NP_004272
augagcgccgccacccacucccccaugaugcaggucgcgagcggcaacggggaccgcgacccgcugccgcccggcugggagaucaagaucgacccccagaccggguggcccuucuucguggaccacaacucccggacgaccaccuggaacgacccccgcgugcccagcgagggccccaaggagaccccguccagcgccaacgggcccucccgggagggcagccgccucccgcccgcccgggagggccaccccguguacccccagcugcgccccggguacauccccaucccgguccugcacgagggcgccgagaaccgccaggugcaccccuuccacguguacccccagcccgggaugcagcgguuccggacggaggccgcggccgccgccccgcagcgcucccagagcccccuccggggcaugcccgagaccacccagcccgacaagcagugcgggcaggucgcggccgccgccgccgcgcagccgcccgccucccacggccccgagcgcagccagucccccgccgccagcgacugcuccagcuccagcuccagcgccagccugccguccagcggccgguccagccuggggucccaccagcucccccgcggcuacaucagcauccccgugauccacgagcagaacgugacccggccggcggcccagcccuccuuccaccaggcccagaagacgcacuaccccgcccagcagggggaguaccagacccaccagcccgucuaccacaagauccagggcgacgacugggagccgcgcccccugcgggccgcgagccccuuccgcuccagcgugcagggcgccuccagccgggaggggucccccgcccgcagcuccaccccgcugcacagccccucccccauccgggugcacaccgucguggaccgcccccagcagccgaugacgcaccgcgagaccgcccccgugagccagcccgagaacaagcccgaguccaagccgggccccgucgggcccgagcugcccccgggccacauccccauccaggugauccggaaggagguggacagcaagcccgucagccagaagcccccgccgcccuccgagaagguggaggugaaggucccgcccgcccccgugcccugcccgccgcccagccccgggcccuccgcggugcccagcucccccaagagcgucgccaccgaggagcgcgccgcccccuccaccgcgcccgccgaggccacgccgcccaagcccggcgaggccgaggccccgcccaagcaccccggcgugcucaaggucgaggcgauccuggagaaggugcaggggcucgagcaggccguggacaacuucgagggcaagaagaccgacaagaaguaccugaugaucgaggaguaccugaccaaggagcuccuggcccuggacagcgucgaccccgaggggcgggccgacgugcgccaggcccggcgcgacggcgugcggaagguccagaccauccucgagaagcuggagcagaaggcgaucgacgugcccggccaggugcaggucuacgagcugcagcccuccaaccucgaggccgaccagccccugcaggccaucauggagaugggggccguggccgcggacaagggcaagaagaacgccgggaacgccgaggacccccacacggagacccagcagccggaggccaccgcggccgccaccagcaaccccuccagcaugacggacacccccggcaaccccgccgccccguga

SEQ ID NO: 27158 - RNA, 1266 nt, Artificial Sequence
  derived and/or modified sequence opt1 from BAG4__Homo_sapiens__NP_001191807
augagcgcccugcgccgguccggcuacgggcccagcgacggcccguccuacgggcgcuacuacggccccgggggcggcgacgugcccguccaccccccgcccccccucuacccccugcggccggagcccccccagcccccgaucagcuggcgcgugcgggggggcgggcccgccgagaccaccuggcugggcgaggggggcggcggggacggcuacuaccccuccgggggcgcguggcccgagccgggccgcgccgggggcagccaccagucccucaacagcuacacgaacggggccuacggccccaccuacccccccgggccgggcgccaacaccgccuccuacagcggcgcguacuacgcccccggguacacccagacguccuacagcaccgaggugcccuccaccuaccggagcuccggcaacagccccaccccggucucccgcuggaucuacccccagcaggacugccagacggaggcccccccccugcgggggcaggugccgggcuacccccccagccagaacccggggaugacccugccccacuaccccuacggcgacggcaaccgcuccgugccccagagcgggccgaccguccggccccaggaggacgccugggcgagccccggcgccuacgggaugggcgggcgcuaccccuggccguccagcgcccccuccgccccccccggcaaccucuacaugaccgagagcacguccccguggcccagcuccggcagcccccagucccccccgagcccccccgugcagcagcccaaggacuccagcuacccguacucccagagcgaccaguccaugaaccggcacaacuuccccugcagcgugcaccaguacgaguccagcgggaccgucaacaacgacgacuccgaccugcuggacagccaggugcaguacagcgccgagccccagcucuacggcaacgcgaccuccgaccaccccaacaaccaggaccagagcuccagccugccggaggagugcgugcccuccgacgagagcacccccccguccaucaagaagaucauccacguccuggagaaggugcaguaccucgagcaggagguggaggaguucgucgggaagaagacggacaaggccuacuggcugcuggaggagaugcucaccaaggagcugcuggagcucgacagcguggagaccggcggccaggacuccgugcgccaggcccggaaggaggccgucugcaagauccaggccauccuggagaagcuggagaagaaggggcucuga

SEQ ID NO: 27159 - RNA, 1467 nt, Artificial Sequence
  derived and/or modified sequence opt1 from BAG5__Homo_sapiens__NP_001015049
augcgcuuccacuggcugcccacccucagcgagccguucgaccggaaccaggagcuggagaccugcauccgcccccuguggacgcccuccggcagcgccugcgagaccgagcacaacaaguccauggacauggggaaccagcaccccagcaucucccggcuccaggagauccagaaggaggucaagagcguggagcagcaggucaucggcuucuccgggcugagcgacgacaagaacuacaagaagcuggagcgcauccucaccaagcagcuguucgagaucgacuccguggacaccgagggcaagggggacauccagcaggcccggaagcgcgcggcccaggagacggagcggcugcucaaggagcuggagcagaacgccaaccacccgcaccgcaucgagauccagaacaucuucgaggaggcccagagccuggugcgggagaagaucgugcccuucuacaacggcggcaacugcgugaccgacgaguucgaggaggggauccaggacaucauccuccgccugacccacgucaagaccggcgggaagaucucccugcggaaggcccgcuaccacacgcucaccaagaucugcgcggugcaggagaucaucgaggacugcaugaagaagcagcccagccugccccuguccgaggacgcccacccgagcguggccaagaucaacuucgucaugugcgaggugaacaaggcccggggcgugcucaucgcgcugcugaugggggucaacaacaacgagaccugccgccaccucuccugcgugcugagcggccugaucgccgaccucgacgcccuggacgugugcggccggaccgagauccgcaacuaccggcgcgaggucguggaggacaucaacaagcugcucaaguaccuggaccuggaggaggaggccgacacgaccaaggccuucgaccuccggcagaaccacuccauccugaagaucgagaaggugcugaagcgcaugcgggagaucaagaacgagcuccugcaggcgcagaaccccagcgagcuguaccucuccagcaagaccgagcugcaggggcugaucggccagcucgacgaggucagccuggagaagaaccccugcauccgcgaggcccgccggcgcgccgugaucgaggugcagacccugaucacguacaucgaccucaaggaggcccuggagaagcggaagcuguucgccugcgaggagcaccccucccacaaggcggucuggaacgugcucgggaaccugagcgagauccagggcgaggugcuguccuucgacggcaaccgcaccgacaagaacuacauccggcucgaggagcugcugaccaagcagcugcucgcccuggacgccgucgacccgcagggggaggagaagugcaaggccgcccgcaagcaggcggugcggcuggcccagaacauccucagcuaccuggaccugaaguccgacgagugggaguacuga

SEQ ID NO: 27160 - RNA, 2712 nt, Artificial Sequence
  derived and/or modified sequence opt1 from BAG6__Homo_sapiens__NP_001186626
auggagcccaacgacagcaccuccaccgccguggaggagccggacagccuggagguccucgugaagacgcuggacucccagacccgcaccuucaucgugggcgcccagaugaacgucaaggaguucaaggagcacaucgcggccagcguguccauccccagcgagaagcagcggcugaucuaccaggggcgcgugcuccaggacgacaagaagcugcaggaguacaacgucggcgggaaggugauccaccugguggagcgggcccccccccagacccaccucccguccggcgccagcuccgggacgggcagcgccuccgcgacccacggcgggggcagcccccccgggacccgcggccccggggccuccguccacgaccggaacgccaacagcuacgugauggugggcaccuucaaccugccguccgacggcagcgccgucgacgugcacaucaacauggagcaggcgcccauccaguccgagccccgcgugcggcuggucauggcccagcacaugauccgcgacauccagacgcuccugagccggauggagugccgcgggggcccccagccgcagcacucccagccccccccccagccgcccgccgugacccccgagcccguggcccugagcagccagaccuccgagccggucgagagcgaggcccccccccgggagcccauggaggcggaggagguggaggagcgcgccccggcccagaaccccgagcucacccccgggcccgccccggccggccccacgcccgcgccggagaccaacgcccccaaccaccccucccccgccgaguacguggagguccugcaggagcugcagcggcucgagagccgccugcagccguuccugcagcgguacuacgaggugcucggcgccgccgcgaccaccgacuacaacaacaaccacgaggggcgcgaggaggaccagcggcugaucaaccuggugggcgagucccuccgccugcuggggaacacguucgucgcccucagcgaccugcggugcaaccuggccugcacccccccccgccaccuccacgugguccggcccaugucccacuacaccaccccgauggugcugcagcaggccgccauccccauccagaucaacgugggcacgaccgucaccaugaccgggaacggcacgcgcccccccccgacccccaacgcggaggccccccccccgggccccgggcaggccagcuccguggcccccagcuccaccaacguggagagcuccgcggagggcgcccccccgcccgggcccgcccccccgcccgccaccagccacccccgcgucauccggaucucccaccagagcguggagccgguggucaugaugcacaugaacauccaggacuccggcacgcagcccgggggcgugcccagcgcccccaccggcccgcuggggccccccggccacgggcagacccucggccagcaggugcccggguucccgaccgcgcccacgcgcgucgugaucgcccggcccacccccccgcaggcccgccccucccaccccggcggccccccggugagcgggacccugggcgccgggcugggcaccaacgccagccucgcgcagauggucuccggccugguggggcagcugcucaugcagcccgugcuggucgcccagggcacgcccgggagccccggcgggcugggccucgagucccugagcccggaguucuucaccuccguggugcagggcguccugagcucccuccuggggagccugggcgcccgggccggguccagcgaguccaucgccgcguucauccagcgccucagcggcuccagcaacaucuucgagcccggggccgacggcgcccugggcuucuucggggcccugcucucccugcugugccagaacuucagcaugguggacguggucaugcugcuccacggccacuuccagccccugcagcggcugcagccccagcuccgcuccuucuuccaccagcacuaccuggggggccaggagccgacccccagcaacauccggauggcgacccacacccugaucacggggcucgaggaguacgugcgcgagagcuucucccuggugcagguccagcccggcguggacaucauccggaccaaccuggaguuccuccaggagcaguucaacagcaucgccgcccacgugcugcacugcaccgacuccggcuucggggcccgccugcucgagcugugcaaccagggccuguucgagugccucgcccugaaccugcacugccucgggggccagcagauggagcuggcggccgucaucaacgggcggauccgccggaugagccgcggcgugaaccccucccuggugagcuggcucaccacgaugaugggccugcggcugcaggucgugcucgagcacaugccgguggggcccgacgccauccugcgcuacguccggcgcgugggcgaccccccgcagccccugcccgaggagcccauggaggugcagggggccgagcgcgccuccccggagccccaggaguggguccccaucauccagcaggacauccagagccagcggaaggugaagccccagccgccccucuccgacgcguaccugagcggcaugcccgccaagcgccggaagcugcgcuccgacauccagaagcggcuccaggaggaccccaacuacagcccgcagcgcuuccccaacgcccagcgggccuucgccgacgaccccuga

SEQ ID NO: 27161 - RNA, 1536 nt, Artificial Sequence
  derived and/or modified sequence opt1 from BAIAP2L1__Homo_sapiens__NP_061330
augagccgcggccccgaggaggugaaccggcugaccgaguccaccuaccgcaacgucauggagcaguucaacccggggcuccggaaccugaucaaccugggcaagaacuacgagaaggccgugaacgccaugauccucgcggggaaggccuacuacgacggcguggccaagaucggggagaucgccacgggcagccccgucuccaccgagcugggccacgugcugaucgagaucagcuccacccacaagaagcucaacgagagccuggacgagaacuucaagaaguuccacaaggagaucauccacgagcuggagaagaagaucgagcucgacgugaaguacaugaacgccacccugaagcgcuaccagacggagcacaagaacaagcuggagucccucgagaagucccaggcggagcugaagaagauccggcgcaagagccaggggagccggaacgcccugaaguacgagcacaaggagaucgaguacgucgagaccgugaccucccgccagagcgagauccagaaguucaucgccgacggcugcaaggaggcccuccuggaggagaagcggcgcuucugcuuccugguggacaagcacugcggguucgcgaaccacauccacuacuaccaccuccaguccgccgagcugcugaacagcaagcucccccgguggcaggagaccugcgucgacgccaucaaggugcccgagaagaucaugaacaugaucgaggagaucaagacgccggccuccacccccgugagcggcacgccccaggccucccccaugaucgagcgcagcaacgucgugcggaaggacuacgacacccuguccaagugcagcccgaagaugccgcccgcgcccagcgggcgcgccuacaccagcccccugaucgacauguucaacaaccccgccaccgccgcccccaacucccagcgggugaacaacuccaccggcaccagcgaggaccccucccuccagcgcagcgucuccguggcgacgggccugaacaugaugaagaagcagaaggugaagaccaucuucccgcacaccgccgggagcaacaagacccugcucuccuucgcccagggcgacgucaucacgcugcugauccccgaggagaaggacggguggcucuacggcgagcacgacgugagcaaggcccggggcugguuccccuccagcuacaccaagcugcuggaggagaacgagaccgaggccgugaccguccccacgccgucccccacccccgugcgcagcaucuccaccgugaaccucagcgagaacuccagcgucgugaucccgccgcccgacuaccuggagugccuguccaugggggcggccgccgaccggcgcgccgacagcgcccggaccacgagcaccuucaaggcgcccgccuccaagcccgagaccgccgcccccaacgacgcgaacggcaccgccaagccgcccuuccucagcggggagaaccccuucgccacggucaagcugcgccccaccgugaccaacgaccgcuccgcccccaucauccgguga

SEQ ID NO: 27162 - RNA, 3351 nt, Artificial Sequence
  derived and/or modified sequence opt1 from BAIAP3__Homo_sapiens__NP_001186025
augagcacccugcucgacaucaaguccagcgugcugcgccagguccaggugugccccuccuuccggcgccggaccgagcaggacccgggcagcgccuccgccgacccccaggagcccgcgacgggggccuggaagcccggcgacgggguggaguucuucgcccacaugcgccugaugcucaagaagggcgaggggcggcagggccugccgugccuggaggucccccuccgcagcggcucccccgcgcccccggagcccguggaccccagccuggggcugcgggcccucgcccccgaggagguggagaugcuguacgaggaggcccuguacaccguccucuaccgcgccggcaccauggggccggaccagguggacgacgaggaggcccugcuguccuaccuccagcaggucuucggcaccagccuggaggagcacacggaggcgaucgagcgggugcgcaaggccaaggcccccaccuacgcccugaagguguccgugaugcgggccaagaaccuccuggcgaaggaccccaacggguucagcgaccccuacugcaugcugggcauccucccggccuccgacgccacccgcgagccccgggcccagaaggagcagcgcuucggcuuccggaaggggagcaagcgcggcgggccccugcccgccaagugcauccaggucaccgaggugaaguccagcacgcugaacccgguguggaaggagcacuuccucuucgagaucgaggacgucuccaccgaccagcugcaccuggacaucugggaccacgacgacgacgugagccucguggaggcgugccggaagcugaacgaggucaucggccugaagggcauggggcgcuacuucaagcagaucgugaaguccgcccgggccaacggcaccgccgggcccaccgaggaccacacggacgacuuccucggcugccugaacauccccgugcgccgggacaccgccaugagccagcgcgggcgcagcggcuuccugucccaccuccugcugcucagccaccuccugcggcuggagcacuccgcggaggagcccaacagcuccagcuggcgcggcgagcuguccaccccggccgccaccauccugugccuccacggggcccagagcaaccugagcccccugcagcucgccguccugcacuggcaggucuccucccggcaccaccagacgugcacccuggacuacagcuaccuccugggccugcuggaggacaugcaggcgcacugggaggaggcccccucccucccccaggagcaggaggagagccuggccgacucccugagcgccuucuccgaguucgggcuccagcugcugcgccagcuccgggacuacuucccggcgaccaacagcaccgccgugcaccgccuggagcugcuccugaagugccugggcaagcuccagcuguuccagcccuccuucgagaucugccccuucgagagcgagcugaacauggacaucgccgccgcccucaagcgggggaaccgcgagugguacgaccggauccugaacgacaagagcccgcgcgagcagcccggcccccagcggcugcccggccucguggugcuggcggacgccgucuacgacgaccugcaguucugcuacuccguguacgccagccucuuccacuccauccugaacguggacgucuucacgcugaccuuccgccagcucgagcggcugguggccgaggaggccugggugcugaccgaggagcucagcccgaagaugacccuggaggucgcguccgggcuguucgagcucuaccugacgcuggccgaccuccagcgcuucugggacagcauccccggccgggacucccgcagccuggcccuggccgggauccacgcccccuuccuccccgcggugaagcugugguuccaggugcugcgggaccaggccaaguggcgccuccagggcgccgucgacauggacacccuggagccgguggacgccuccagccggcacuccagcuccgcggccaccgccgggcugugccucagccacauccaggagcugugggugcgccuggccuggcccgaccccgcccaggcgcagggccucggcacccagcuggggcaggacgucugcgaggccacgcuguucuacaccgagcuccugcgcaagaagguggacacccagcccggcgccgccggggaggccguguccgaggcgcugugcgucgugcucaacaacguggagcugguccggaaggccgccggccaggcccugaagggccucgccuggccggagggggcgaccggccccgagggggugcugccccgcccccugcucagcugcacgcaggcccuggacgacgaccugcagcgggaggcccacaccgugaccgcccaccucaccuccaagauggucggcgacauccgcaaguacgugcagcacaucagccugagcccggacuccauccagaacgacgaggcgguggcgccccugaugaaguaccucgacgagaagcuggcccugcucaacgccagccuggucaaggggaaccugucccgggugcucgaggcccugugggagcugcuccugcaggccauccugcaggcccucggcgccaaccgcgacgugagcgccgacuucuacucccgguuccacuucacgcuggaggcccuggucagcuucuuccacgcggagggccaggggcucccccuggagucccugcgcgacggcagcuacaagcggcucaaggaggagcugcgccugcacaagugcuccacccgggagugcaucgagcaguucuaccucgacaagcugaagcagcgcacccuggagcagaaccgguucgggcgccucagcgugcggugccacuacgaggccgccgagcagcgccuggccguggagguccugcacgccgcggaccuccugccccuggacgccaacggccucuccgacccguucgugaucguggagcuggggccgccccaccuguucccccugguccggagccagcgcacccaggugaagacccggacgcuccaccccguguacgacgagcuguucuacuucuccguccccgccgaggccugccgccggcgcgccgcgugcgugcuguucaccgugauggaccacgacuggcucagcaccaacgacuucgccggcgaggccgcccugggccucgggggcgucaccgggguggcgcgcccccaggugggcgggggcgcccgggccggccagccggucacgcugcaccugugccgcccccgggcccaggugcgcuccgcccugcggcgccucgaggggcggaccagcaaggaggcgcaggaguucgugaagaagcugaaggagcuggagaagugcauggaggccgaccccuga

SEQ ID NO: 27163 - RNA, 636 nt, Artificial Sequence
  derived and/or modified sequence opt1 from BAK1__Homo_sapiens__NP_001179
auggccagcggccaggggcccggcccgccccgccaggagugcggggagcccgcccugcccuccgcgagcgaggagcaggucgcccaggacaccgaggagguguuccgguccuacguguucuaccgccaccagcaggagcaggaggccgagggcguggccgccccggcggaccccgagauggucacccucccccugcagcccagcuccacgaugggccagguggggcggcagcuggccaucaucggcgacgacaucaaccgccgguacgacagcgaguuccagaccaugcuccagcaccuccagccgaccgccgagaacgccuacgaguacuucaccaagaucgcgacgucccuguucgagagcgggaucaacuggggccgcguggucgcccugcugggguucggcuaccggcuggcccuccacguguaccagcacgggcugaccggcuuccugggccaggugacccgcuucgucguggacuucaugcuccaccacugcaucgcccgguggaucgcccagcgcgggggcuggguggcggcccugaaccuggggaacggccccauccucaacguccugguggugcugggcgucgugcuccuggggcaguucgugguccggcgcuucuucaaguccuga

SEQ ID NO: 27164 - RNA, 783 nt, Artificial Sequence
  derived and/or modified sequence opt1 from BAMBI__Homo_sapiens__NP_036474
auggaccgccacagcuccuacaucuucaucuggcugcagcucgagcugugcgccauggccgugcugcucaccaagggcgagauccggugcuacugcgacgcggcccacugcgucgccaccggguacaugugcaagagcgagcuguccgccugcuucagccgccugcucgacccccagaacuccaacagcccgcugacgcacggcugccuggacucccucgccagcaccaccgacaucugccaggcgaagcaggcccggaaccacuccgggaccacgauccccacccuggagugcugccacgaggacaugugcaacuaccgcggccugcacgacgugcucagcccgccccgcggggaggccuccggccagggcaaccgguaccagcacgacgggagccggaaccugaucaccaaggugcaggagcugaccuccagcaaggagcucugguuccgcgccgcggucaucgccgugcccaucgccggcgggcugauccuggugcuccugaucaugcuggcccuccggaugcugcgcuccgagaacaagcggcugcaggaccagcgccagcagaugcucagccggcugcacuacuccuuccacggccaccacagcaagaaggggcaggucgccaagcuggaccucgagugcauggugcccguguccggccacgagaacugcugccugacgugcgacaagaugcgccaggcggaccugagcaacgacaagauccucagccugguccacuggggcauguacuccgggcacggcaagcuggaguucguguga

SEQ ID NO: 27165 - RNA, 270 nt, Artificial Sequence
  derived and/or modified sequence opt1 from BANF1__Homo_sapiens__NP_001137457
augaccaccagccagaagcaccgcgacuucguggccgagcccaugggcgagaagccggucgggucccuggccggcaucggggaggugcucggcaagaagcuggaggagcggggguucgacaaggcguacgugguccugggccaguuccucgugcugaagaaggacgaggaccuguuccgcgaguggcucaaggacacgugcggcgccaacgccaagcagagccgggacugcuucgggugccugcgcgaguggugcgacgccuuccuguga

SEQ ID NO: 27166 - RNA, 2268 nt, Artificial Sequence
  derived and/or modified sequence opt1 from BANK1__Homo_sapiens__NP_001077376
augaucuacgaggaggacgccgaggagugggcccuguaccucaccgagguguuccugcacgucgugaagcgcgaggcgauccugcucuaccggcuggagaacuucagcuuccgccaccuggagcuccugaaccugaccuccuacaagugcaagcuccugauccugagcaacucccuccugcgggaccugacgcccaagaagugccaguuccucgagaagauccugcacagcccgaaguccguggucacccugcucugcggcgucaagagcuccgaccagcuguacgagcugcucaacaucagccagucccgcugggagaucagcaccgagcaggagcccgaggacuacaucuccgugauccagagcaucaucuucaaggacuccgaggacuacuucgaggugaacauccccaccgaccugcgggccaagcacagcggggagaucuccgagcgcaaggagaucgaggagcugagcgaggccucccggaacacgaucccccucgccguggugcugccgaccgagauccccugcgagaaccccggcgagaucuucaucauccugcgcgacgaggucaucggggacaccguggagguggaguucaccagcuccaacaagcggauccgcacgcggcccgcccucuggaacaagaaggucuggugcaugaaggcgcuggaguucccggccggcagcgugcacgugaacgucuacugcgacgggaucgugaaggccaccaccaagaucaaguacuaccccaccgccaaggcgaaggagugccuguuccgcauggccgacagcggcgagucccucugccagaacagcaucgaggagcuggacggcgugcugacguccaucuucaagcacgagauccccuacuacgaguuccagagccuccagaccgagaucugcucccagaacaaguacacccacuucaaggagcugcccacccugcuccacugcgccgccaaguucgggcugaagaaccuggccauccaccuccugcagugcagcggcgcgacgugggccuccaagaugaagaacauggaggggagcgacccggcccacaucgccgagcggcacggccacaaggagcugaagaagaucuucgaggacuucuccauccaggagaucgacaucaacaacgagcaggagaacgacuacgaggaggacaucgccagcuucuccaccuacauccccagcacccagaaccccgcguuccaccacgagucccgcaagaccuacgggcagagcgccgacggcgccgaggccaacgagauggagggcgaggggaagcagaacggcuccgggauggagacgaagcacagcccccucgaggucggcuccgagagcuccgaggaccaguacgacgaccuguacguguucaucccgggcgccgaccccgagaacaacagccaggagccccugaugagcucccggcccccgcucccgccgccccgccccguggcgaacgccuuccagcuggagcggccccacuucacccugcccgggaccauggucgagggccagauggagcgcagccagaacugggggcaccccggcgugcggcaggagaccggggacgagccgaagggcgagaaggagaagaaggaggaggagaaggagcaggaggaggaggaggaccccuacacguucgccgagaucgacgacuccgaguacgacaugauccucgccaaccugagcaucaagaagaagaccggcucccgcagcuucaucaucaaccggcccccggcccccacgccccgccccaccuccaucccgcccaaggaggagaccacccccuacaucgcccagguguuccagcagaagaccgcgcgccggcagagcgacgacgacaaguuccgcgggcugcccaagaagcaggaccgggcccgcaucgaguccccggccuucagcacccugcggggcugccucacggacgggcaggaggagcugauccugcuccaggagaaggucaagaacggcaagauguccauggacgaggcgcuggagaaguucaagcacuggcagaugggcaagagcgggcuggagaugauccagcaggagaagcuccgccagcugcgggacugcaucaucggcaagcgccccgaggaggagaacguguacaacaagcugaccaucguccaccaccccgggggcaaggagaccgcccacaacgagaacaaguucuacaacgugcacuucuccaacaagcuccccgcccggccccagguggagaaggaguucggguucugcugcaagaaggaccacuga

SEQ ID NO: 27167 - RNA, 1518 nt, Artificial Sequence
  derived and/or modified sequence opt1 from BANP__Homo_sapiens__NP_001167010
augaugagcgagcacgaccuggccgacgugguccagaucgccguggaggaccucucccccgaccacccggugguccuggagaaccacguggugaccgacgaggacgagcccgcgcugaagcgccagcggcucgagaucaacugccaggaccccagcaucaaguccuuccuguacagcaucaaccagaccaucugccugcgccucgacuccaucgaggccaagcugcaggcccuggaggccacgugcaagagccucgaggagaagcuggaccuggucaccaacaagcagcacucccccauccaggugccgaugguggccggcagcccccucggggcgacccagaccugcaacaagguccggugcguggugccccagacgaccgucauccugaacaacgaccgccagaacgccaucguggccaagauggaggacccccuguccaaccgggccccggacagccucgagaacgugaucuccaacgcgguccccggccgccggcagaacaccaucguggugaagguccccgggcaggaggacagccaccacgaggacggcgaguccgggagcgaggccuccgacagcguguccagcugcggccaggccggcucccagagcaucgggagcaacgugacccugaucacgcugaacuccgaggaggacuaccccaacggcaccuggcucggggacgagaacaacccggagaugcgcguccggugcgccaucauccccagcgacaugcugcacaucuccaccaacugccgcaccgccgagaagauggcgcugacgcuccuggacuaccuguuccaccgggaggugcaggccgugagcaaccucuccggccaggggaagcacggcaagaagcagcuggacccccugaccaucuacggcauccgcugccaccucuucuacaaguucgggaucaccgagagcgacugguaccggaucaagcaguccaucgacagcaagugccgcaccgccuggcggcgcaagcagcggggccagucccuggccgucaagagcuucucccgccggacgcccaacagcuccagcuacugcccguccgagcccaugaugagcaccccgccgcccgccuccgagcugccccagccccagccccagccccaggcgcuccacuacgcccuggccaacgcccagcagguccagauccaccagaucggggaggacggccagguccaggugggccaccuccacaucgcccaggugccccagggggagcagguccagaucacccaggacagcgagggcaaccugcagauccaccacguggggcaggacggccaggugcugcagggggcgcagcugaucgccguggccuccagcgaccccgccgccgcgggcguggacggcagcccccuccagggguccgacauccaggugcaguacguccagcuggccccggugagcgaccacaccgccggcgcccagacggcggaggcccugcagcccacccuccagcccgagaugcagcuggagcacggggccauccagauccaguga

SEQ ID NO: 27168 - RNA, 2190 nt, Artificial Sequence
  derived and/or modified sequence opt1 from BAP1__Homo_sapiens__NP_004647
augaacaagggcuggcuggagcucgagagcgaccccgggcuguucacccugcucguggaggacuucggcgucaaggggguccagguggaggagaucuacgaccugcaguccaagugccagggcccgguguacggguucaucuuccuguucaaguggaucgaggagcgccggagccgccggaagguguccacccucguggacgacacgagcgucaucgacgacgacaucgugaacaacauguucuucgcccaccagcugauccccaacuccugcgccacccacgcgcugcucagcgugcugcugaacugcuccagcgucgaccucggccccacccugucccgcaugaaggacuucaccaagggcuucagccccgaguccaagggguacgccaucggcaacgccccggagcuggccaaggcccacaacagccacgcgcggcccgagccccgccaccuccccgagaagcagaacgggcuguccgccgugcggacgauggaggccuuccacuucgugagcuacgucccgaucaccggccgccuguucgagcucgacgggcugaagguguaccccaucgaccacggccccuggggcgaggacgaggaguggaccgacaaggcccggcgcgugaucauggagcggaucgggcuggcgaccgccggcgagcccuaccacgacauccgcuucaaccucauggccgucgugccggaccggcgcaucaaguacgaggcccggcugcacgugcugaaggucaaccgccagacggugcucgaggcccugcagcagcugauccgggugacccagcccgagcucauccagacccacaagucccaggagagccagcugcccgaggaguccaagagcgcguccaacaagagcccccugguccucgaggccaaccgcgccccggccgccagcgaggggaaccacaccgacggcgcggaggaggccgccggcuccugcgcccaggcccccagccacuccccgcccaacaagcccaagcugguggugaagccgcccgggagcucccugaacggcguccaccccaaccccacgcccaucgugcagcggcuccccgcguuccuggacaaccacaacuacgccaagagccccaugcaggaggaggaggaccuggccgccggggucggccgcucccgggugccggugcgcccgccccagcaguacagcgacgacgaggacgacuacgaggacgacgaggaggacgacguccagaacaccaacuccgcccuccgcuacaaggggaagggcaccggcaagcccggggcgcugagcggcuccgccgacgggcagcugagcgugcuccagcccaacaccaucaacgugcuggccgagaagcugaaggagucccagaaggaccucagcaucccccuguccaucaagacgagcuccggcgccgggagccccgcggucgccgugccgacccacucccagcccagccccacccccagcaacgaguccaccgacacggccagcgagaucggcuccgccuucaacagcccgcugcggucccccauccgcagcgccaaccccacccggcccuccagcccggugaccucccacaucagcaagguccucuucggcgaggacgacucccugcugcgcguggacugcauccgguacaaccgcgcggugcgggaccucgggcccgucaucagcaccggccugcugcaccuggccgaggacggggugcucagcccccuggcccugacggagggcgggaagggcuccucccccagcauccgcccgauccagggcucccaggggagcagcucccccguggagaaggaggucguggaggccaccgacagccgggagaagaccggcauggugcgccccggggagccccucuccggcgagaaguacagcccgaaggagcugcuggcccuccugaagugcgucgaggcggagaucgccaacuacgaggccugccugaaggaggagguggagaagcggaagaaguucaagaucgacgaccagcgccggacccacaacuacgacgaguucaucugcacguucaucuccaugcucgcccaggagggcaugcuggccaaccugguggagcagaacaucagcguccgccggcgccaggggguguccaucggccggcuccacaagcagcgcaagcccgaccggcgcaagcgcagccggcccuacaaggcgaagcgccaguga

SEQ ID NO: 27169 - RNA, 2334 nt, Artificial Sequence
  derived and/or modified sequence opt1 from BARD1__Homo_sapiens__NP_000456
augcccgacaaccgccagccgcggaaccgccagccccggauccgcagcggcaacgagccccgguccgcccccgccauggagccggacgggcgcggcgcgugggcccacagccgggccgcccuggaccgccucgagaagcugcugcggugcucccgcugcaccaacauccuccgggagcccgugugccucgggggcugcgagcacaucuucugcagcaacugcgucuccgacugcaucgggaccggcugccccgugugcuacacgcccgccuggauccaggaccugaagaucaaccgccagcuggacagcaugauccagcugugcuccaagcugcggaaccuccugcacgacaacgagcugagcgaccucaaggaggacaagccgcgcaagucccuguucaacgacgcgggcaacaagaagaacagcaucaagaugugguucagcccccggagcaagaaggugcgcuacgucguguccaaggccagcgugcagacccagcccgccaucaagaaggacgccuccgcgcagcaggacagcuacgaguucgucucccccagcccgcccgccgacguguccgagcgggccaagaaggccagcgcccgcagcgggaagaagcagaagaagaagacccuggcggagaucaaccagaaguggaaccucgaggccgagaaggaggacggcgaguucgacuccaaggaggagagcaagcagaagcugguguccuucugcagccagcccuccgucaucagcagcccccagaucaacggggagaucgaccugcucgccuccggcucccugaccgagagcgagugcuucgggucccugacggaggugagccucccgcuggccgagcagaucgagucccccgacaccaagagccggaacgagguggucacccccgagaaggugugcaagaacuaccugaccuccaagaagucccucccccuggagaacaacggcaagcgcggccaccacaaccggcuguccagcccgaucuccaagcgcugccgcacgagcauccucagcaccuccggggacuucgugaagcagaccguccccagcgagaacaucccccugcccgagugcuccagcccgcccuccugcaagcggaaggugggcgggaccagcggccgcaagaacuccaacaugagcgacgaguucaucucccugagccccggcacgcccccguccacccucagcuccagcuccuaccggcgcgugaugagcucccccagcgccaugaagcugcugcccaacauggcggucaagcggaaccaccgcggggagacccuccugcacaucgccagcaucaagggcgacaucccguccguggaguaccugcuccagaacgggagcgaccccaacgugaaggaccacgccggcuggacgccccugcacgaggccugcaaccacgggcaccugaaggucguggagcuccugcugcagcacaaggcccucgugaacaccaccggcuaccagaacgacagcccccugcacgacgcggccaagaacggccacgucgacaucgugaagcugcuccuguccuacggggccucccggaacgccgucaacaucuucggccugcgcccgguggacuacaccgacgacgagagcaugaagucccuccugcugcugcccgagaagaacgagagcuccagcgccucccacugcagcgugaugaacaccgggcagcggcgcgacggcccccucguccugaucggguccggccugagcuccgagcagcagaagaugcucagcgagcuggcggugauccugaaggccaagaaguacacggaguucgacuccaccgugacccacgucguggugcccggcgacgccguccagagcacccucaagugcaugcuggggauccugaacggcugcuggauccucaaguucgagugggugaaggccugccugcggcgcaaggugugcgagcaggaggagaaguacgagaucccggaggggccccggcgcucccggcugaaccgcgagcagcuccugcccaagcuguucgacggcugcuacuucuaccucugggggacguucaagcaccaccccaaggacaaccugaucaagcuggucaccgcgggcggcgggcagauccucagccggaagccgaagcccgacagcgacgugacccagaccaucaacacgguggccuaccacgcccgccccgacuccgaccagcgguucugcacccaguacaucaucuacgaggaccugugcaacuaccaccccgagcgcguccgccagggcaagguguggaaggccccgagcuccugguucaucgacugcgugaugagcuucgagcugcucccccuggacuccuga

SEQ ID NO: 27170 - RNA, 984 nt, Artificial Sequence
  derived and/or modified sequence opt1 from BARHL1__Homo_sapiens__NP_064448
auggagggcagcaacggguucggcaucgacuccauccugagccaccgcgccgggucccccgcccuccccaagggcgacccccugcugggggacugccggagcccccucgagcugagcccccgcuccgaguccagcuccgacugcagcucccccgcgagccccggccgggacugccuggagaccggcacgccccgccccgggggcgccuccgggccgggccucgacagccaccuccagcccgggcagcuguccgcccccgcccagagccggaccgugaccuccagcuuccugauccgcgacauccuggccgacugcaagccccuggcggccugcgccccguacuccagcagcggccagcccgccgcgcccgagcccggcgggcggcucgccgccaaggccgccgaggacuuccgcgacaagcuggacaaguccggcagcaacgcguccagcgacuccgaguacaaggucaaggaggagggggaccgggagaucagcuccagccgcgacuccccgcccgugcggcugaagaagccccgcaaggcccggaccgccuucaccgaccaccagcucgcccagcuggagcgcagcuucgagcggcagaaguaccuguccgugcaggaccgcauggagcucgccgcgagccugaaccugacggacacccaggucaagaccugguaccagaaccggcgcaccaaguggaagcggcagacggccgugggccucgagcugcuggccgaggccggcaacuacuccgcccuccagcgcauguuccccagcccguacuucuacccccagucccuggugagcaaccuggaccccggggcggcccucuaccuguaccggggccccuccgccccgccgcccgcccugcagcgcccccucgucccccgcauccugauccacgggcugcagggcgccagcgagccgccgccgccccugccgccccucgcgggggugcugccccgggccgcccagccccgcuga

SEQ ID NO: 27171 - RNA, 765 nt, Artificial Sequence
  derived and/or modified sequence opt1 from BARX1__Homo_sapiens__NP_067545
augcagcgccccggcgagccgggggccgcccgguucggcccgcccgaggggugcgcggaccaccgcccccaccgguaccgcagcuucaugaucgaggagauccugaccgagccgcccggccccaagggggccgcccccgccgccgcggccgccgccgcgggcgagcuccugaaguucggcgugcaggcccugcucgccgcccggccguuccacucccaccuggccguccugaaggcggagcaggccgccguguucaaguucccccucgcgccccuggggugcagcggccuguccagcgcccuccuggccgccgggcccggccugcccggggccgccggcgcgccccaccucccccuggagcugcagcuccgcggcaagcuggaggccgccgggcccggcgagccggggaccaaggccaagaagggccggcgcucccggacgguguucaccgagcugcagcucaugggccuggagaagcgcuucgagaagcagaaguaccugagcacccccgaccggaucgaccucgccgagucccuggggcugagccagcuccaggucaagaccugguaccagaaccgccggaugaaguggaagaagaucgugcugcagggcgggggccuggagucccccacgaagcccaaggggcgcccgaagaagaacagcauccccaccuccgagcagcucaccgagcaggagcgggccaaggacgcggagaagcccgccgaggugcccggcgagccgagcgaccgcucccgggaggacuga

SEQ ID NO: 27172 - RNA, 840 nt, Artificial Sequence
  derived and/or modified sequence opt1 from BARX2__Homo_sapiens__NP_003649
augcacugccacgccgagcugcgccucagcucccccggccagcugaaggccgcgcggcgccgguacaagaccuucaugaucgacgagauccugagcaaggagaccugcgacuacuucgagaagcucucccuguacagcgugugcccgucccuggucgugcgccccaagccccuccacagcugcacggggucccccagccugcgggccuacccgcugcucuccgugaucacccgccagcccaccgucaucagccaccuggugcccgccacccccggcaucgcccaggcccuguccugccaccaggugacggaggcggucagcgccgaggcccccgggggcgaggcccucgcguccagcgaguccgagaccgagcagcccacgccccggcagaagaagccccgccggagccgcaccaucuucaccgagcugcagcugauggggcucgagaagaaguuccagaagcagaaguaccuguccaccccggaccggcuggaccucgcccagagccugggccugacccagcuccaggugaagaccugguaccagaaccgccggaugaaguggaagaagauggugcugaagggcgggcaggaggcccccacgaagcccaagggccgccccaagaagaacuccaucccgaccagcgaggagaucgaggccgaggagaagaugaacagccaggcccaggggcaggagcagcuggagcccucccagggccaggaggagcucugcgaggcgcaggagcccaaggcccgggacgucccccuggagauggccgagccgcccgacccgccccaggagcugccgauccccagcuccgagcccccgccccucagcuga

SEQ ID NO: 27173 - RNA, 684 nt, Artificial Sequence
  derived and/or modified sequence opt1 from BASP1__Homo_sapiens__NP_006308
augggcgggaagcugagcaagaagaagaagggcuacaacgugaacgacgagaaggccaaggagaaggacaagaaggccgagggggcggccaccgaggaggagggcacccccaaggaguccgagccgcaggccgccgccgagcccgcggaggccaaggaggggaaggagaagcccgaccaggacgccgagggcaaggccgaggagaaggagggcgagaaggacgcggccgccgccaaggaggaggcccccaaggcggagccggagaagacggagggggccgccgaggccaaggccgagccgcccaaggcgcccgagcaggagcaggccgcccccggccccgccgccgggggcgaggcgcccaaggccgccgaggccgccgcggcccccgccgagagcgccgcgccggccgccggggaggagcccuccaaggaggagggcgagcccaagaagaccgaggcccccgccgcgccggccgcccaggagaccaagagcgacggcgcccccgccuccgacagcaagcccggguccagcgaggcggcccccuccagcaaggagaccccggccgccacggaggcccccuccagcacccccaaggcgcagggccccgccgccuccgccgaggagccgaagcccgucgaggcgcccgccgccaacagcgaccagaccgugaccgugaaggaguga

SEQ ID NO: 27174 - RNA, 825 nt, Artificial Sequence
  derived and/or modified sequence opt1 from BATF2__Homo_sapiens__NP_612465
augcaccugugcggcgggaacggccuccugacccagaccgaccccaaggagcagcagcgccagcugaagaagcagaagaaccgggccgccgcgcagcgcagccggcagaagcacacggacaaggccgacgcccuccaccagcagcacgagucccuggagaaggacaaccuggcccuccgcaaggagauccagagccugcaggccgagcuggcgugguggucccggacccuccacgugcacgagcgccugugcccgauggacugcgccagcugcuccgcccccgggcugcucggcugcugggaccaggccgaggggcugcugggccccggcccccaggggcagcacggcugccgggagcagcucgagcuguuccagaccccggggagcugcuaccccgcgcagccccugucccccggcccgcagccccacgacagccccucccuccugcagugcccccugccgagccucucccuggggcccgccgucguggccgagccgcccgugcagcugagccccagcccccuccuguucgccucccacaccggcuccagccugcagggcuccagcuccaagcucagcgcccugcagcccagccugacggcgcagaccgcgcccccgcagccccucgagcuggagcaccccacccgcgggaagcugggcuccagccccgacaacccguccagcgcccucgggcuggcccggcugcagucccgcgagcacaagcccgcccucagcgccgccaccuggcagggccuggucguggaccccagcccccacccgcugcucgccuucccccugcuguccuccgcccaggugcacuucuga

SEQ ID NO: 27175 - RNA, 378 nt, Artificial Sequence
  derived and/or modified sequence opt1 from BATF__Homo_sapiens__NP_006390
augccccacuccuccgacagcuccgacagcuccuucagccgcuccccgccgcccggcaagcaggacagcuccgacgacgugcggcgcguccagcggcgcgagaagaaccggaucgccgcccagaagucccgccagcggcagacccagaaggcggacacccugcaccucgagagcgaggaccuggagaagcagaacgccgcccugcgcaaggagaucaagcagcucacggaggagcugaaguacuucaccagcgugcugaacucccacgagccccucugcagcgugcuggccgccuccacccccagcccgcccgaggucguguacuccgcgcacgccuuccaccagccccacgugagcagcccccgguuccagcccuga

SEQ ID NO: 27176 - RNA, 666 nt, Artificial Sequence
  derived and/or modified sequence opt1 from BAX__Homo_sapiens__NP_001278357
auggacggcagcggggagcagccccgcggcgggggccccaccuccagcgagcagaucaugaagaccggggcccugcuccugcagggcuucauccaggaccgggccggccgcaugggcggggaggcgcccgagcuggcccucgaccccgugccccaggacgccuccacgaagaagcugagcgagugccugaagcggaucggggacgagcucgacuccaacauggagcugcagcgcaugaucgccgccgucgacaccgacagcccgcgggagguguucuuccgcguggcggccgacauguucuccgacggcaacuucaacugggggcgggucguggcccuguucuacuucgccagcaagcucgugcugaaggcgcugugcaccaagguccccgagcucauccgcaccaucaugggcuggacgcuggacuuccugcgggagcgccuccugggcuggauccaggaccagggcgggugggggcugccccucgccgagucccugaagcggcugaugagccucucccccggccgcccgccccugcugcucugggacgcccacguggccgaccgggaccaccugugcggcgggagcgcccaccgccugacccaccaccucgaggaggacggccugcggccgcccgcggcccuggacugcguguucccgcccuga

SEQ ID NO: 27177 - RNA, 4671 nt, Artificial Sequence
  derived and/or modified sequence opt1 from BAZ1A__Homo_sapiens__NP_038476
augccccugcuccaccgcaagccguucgugcggcagaagccgcccgccgaccugcgccccgacgaggaggucuucuacugcaaggugaccaacgagaucuuccggcacuacgacgacuucuucgagcgcaccauccugugcaacagccucgugugguccugcgccgucacgggccggcccgggcugaccuaccaggaggcgcuggagagcgagaagaaggcccgccagaaccuccaguccuuccccgagccccugaucauccccgugcuguaccucaccagccugacccaccggucccgccugcacgagaucugcgacgacaucuucgccuacgugaaggaccgguacuucgucgaggagacgguggaggugauccgcaacaacggcgcccggcuccagugccgcauccuggagguccugccgcccagccaccagaacggguucgccaacggccacgugaacuccguggacggggagaccaucaucaucagcgacuccgacgacagcgagacccaguccugcagcuuccagaacggcaagaagaaggacgcgaucgacccccuccuguucaaguacaagguccagcccaccaagaaggagcugcacgaguccgccaucgugaaggccacgcagaucagccggcgcaagcaccucuucucccgggacaagcugaagcuguuccucaagcagcacugcgagccgcaggacggcgugaucaagaucaaggccagcucccugagcaccuacaagaucgcggagcaggacuucuccuacuucuuccccgacgacccgcccaccuucaucuucagccccgccaaccgccggcgcgggcggccgcccaagcgcauccacaucagccaggaggacaacgucgccaacaagcagacccuggccuccuaccggagcaaggccacgaaggagcgcgacaagcuccugaagcaggaggagaugaagucccuggcguucgagaaggccaagcucaagcgcgagaaggccgacgcccuggaggccaagaagaaggagaaggaggacaaggagaagaagcgggaggagcugaagaagaucguggaggaggagcgccucaagaagaaggaggagaaggagcggcugaagguggagcgcgagaaggagcgggagaagcugcgcgaggagaagcggaaguacgucgaguaccucaagcaguggagcaagccccgcgaggacauggagugcgacgaccugaaggagcugcccgagcccacccccgugaagacccggcugcccccggagaucuucggcgacgcgcucauggugcuggaguuccucaacgccuucggggagcuguucgaccugcaggacgaguuccccgacggcgucacccucgaggugcuggaggaggcccugguggggaacgacuccgagggcccccucugcgagcugcuguucuucuuccucacggccaucuuccaggccaucgcggaggaggaggaggaggucgccaaggagcagcugaccgacgccgacaccaaggaccugaccgaggcccuggacgaggacgccgaccccaccaagagcgcgcucuccgccguggccagccuggccgcggccuggccgcagcugcaccagggcugcucccucaagagccuggaccuggacuccugcacccucagcgagauccugcgccugcacauccucgccuccggggccgacgucaccagcgccaacgcgaaguaccgguaccagaagcgcggcggguucgacgccaccgacgacgccugcauggagcugcggcuguccaaccccagccucgugaagaagcuguccagcacguccguguacgaccugacccccggcgagaagaugaagauccuccacgcccugugcggcaagcugcucacccuggucagcacccgcgacuucaucgaggacuacguggacauccugcggcaggccaagcaggaguuccgcgagcucaaggcggagcagcaccggaaggagcgcgaggaggccgccgcccggauccgcaagcgcaaggaggagaagcugaaggagcaggagcagaagaugaaggagaagcaggagaagcugaaggaggacgagcagcggaacagcacggccgacaucuccaucggggaggaggagcgcgaggacuucgacaccagcaucgaguccaaggacaccgagcagaaggagcucgaccaggacauggugaccgaggacgaggacgacccgggcagccacaagcgggggcgccggggcaagcgcgggcagaacggcuucaaggaguucacgcggcaggagcagaucaacugcgucacccgcgagccccugaccgcggacgaggaggaggcccugaagcaggagcaccagcggaaggagaaggagcuccuggagaagauccaguccgccaucgccugcaccaacaucuucccccugggccgcgaccggauguaccgccgguacuggaucuuccccagcaucccgggccucuucaucgaggaggacuacuccgggcugacggaggacaugcugcucccccgccccagcuccuuccagaacaacgugcagagccaggacccccagguguccaccaagaccggggagccgcugaugagcgaguccaccagcaacaucgaccagggcccccgggaccacuccguccagcugcccaagcccgugcacaagccgaaccgcuggugcuucuacagcuccugcgagcagcucgaccagcugaucgaggcgcugaacagccgggggcaccgcgagagcgcccucaaggagacccugcugcaggagaagucccggaucugcgcccagcucgcccgcuucagcgaggagaaguuccacuucuccgacaagccccagcccgacagcaagcccacguacucccggggccgcagcuccaacgccuacgacccgagccagaugugcgcggagaagcagcuggagcugcgccuccgggacuuccugcuggacaucgaggaccgcaucuaccagggcacccucggggccaucaaggugaccgaccggcacaucuggcgcuccgcccuggagagcggccgguacgagcugcucuccgaggagaacaaggagaacgggaucaucaagaccgucaacgaggacguggaggagauggagaucgacgagcagacgaaggugaucgucaaggaccgccugcugggcaucaagaccgagacccccagcaccguguccacgaacgccagcacgccccaguccgugagcuccgucgugcacuaccucgccauggcgcuguuccagaucgagcaggggaucgagcggcgcuuccugaaggcgccccucgacgccagcgacuccggccggagcuacaagaccgugcuggaccgcuggcgggagagccugcucuccagcgccucccugagccaggucuuccugcaccucuccacccuggaccgcagcgugaucugguccaagagcauccugaacgcccggugcaagaucugccgcaagaagggcgacgccgagaacauggugcucugcgacgggugcgaccggggccaccacacguacugcguccgcccgaagcugaagaccgugcccgagggggacugguucugccccgagugccggcccaagcagcgcucccggcgccugagcucccgccagcggccgagccucgaguccgacgaggacguggaggacagcaugggcggcgaggacgacgaggucgacggggacgaggaggagggccaguccgaggaggaggaguacgagguggagcaggacgaggacgacagccaggaggaggaggaggugucccugcccaagcgcgggcggccccagguccgccugccggugaagacccggggcaagcucagcuccagcuucagcucccgcgggcagcagcaggagcccggccgguaccccagccgcucccagcagagcacccccaagacgaccguguccagcaagaccggccggucccugcgcaagaucaacagcgccccgcccaccgagacgaagucccugcggaucgccagccgcuccacccggcacagccacgggccccuccaggccgacgucuucguggagcugcugagcccccgccggaagcgccggggccgcaaguccgcgaacaacaccccggagaacucccccaacuuccccaacuuccgggugaucgccaccaagagcuccgagcagagccgcuccgucaacaucgccagcaagcucagccugcaggaguccgagagcaagcggcgcugccgcaagcggcagucccccgagccgagccccgugacgcuggggcgccgguccagcggccgccagggcggggugcacgagcucuccgccuucgagcagcuggucguggagcuggugcggcacgacgacagcuggcccuuccucaagcuggucuccaagauccaggugcccgacuacuacgacaucaucaagaagccgaucgcccugaacaucauccgcgagaaggugaacaagugcgaguacaagcucgcgagcgaguucaucgacgacaucgagcugauguucuccaacugcuucgaguacaacccccggaacaccagcgaggccaaggccggcacccgccugcaggccuucuuccacauccaggcccagaagcucgggcugcacgucacccccuccaacguggaccaggugagcacgcccccggcggccaagaagucccggaucuga

SEQ ID NO: 27178 - RNA, 4452 nt, Artificial Sequence
  derived and/or modified sequence opt1 from BAZ1B__Homo_sapiens__NP_115784
auggcgccccugcucggccgcaagccguucccccuggugaagccccugcccggggaggagccccucuucaccaucccccacacccaggaggccuuccggacgcgcgaggaguacgaggcccggcuggagcgcuacagcgagcggaucuggaccugcaaguccaccggcagcucccagcugacccacaaggaggccugggaggaggagcaggaggucgccgagcuccugaaggaggaguuccccgccugguacgagaagcuggugcucgagauggugcaccacaacacggccagccuggagaagcuggucgacaccgcguggcucgagaucaugaccaaguacgccgugggggaggagugcgacuucgaggugggcaaggagaagaugcugaaggucaagaucgugaagauccacccccuggagaagguggacgaggaggccaccgagaagaaguccgacggggccugcgacagcccguccagcgacaaggagaacuccagccagaucgcgcaggaccaccagaagaaggagacggucgugaaggaggacgagggccgccgggaguccaucaacgaccgcgcccggcgcagcccccggaagcuccccaccucccugaagaagggcgagcgcaagugggcgcccccgaaguuccugccccacaaguacgacgugaagcuccagaacgaggacaagaucaucagcaacguccccgccgacucccugauccggaccgagcggcccccgaacaaggagaucgugcgcuacuucauccgccacaacgcccugcgggccgggaccggcgagaacgcccccuggguggucgaggacgagcucgugaagaaguacagccugcccuccaaguucagcgacuuccugcucgaccccuacaaguacaugacgcugaacccguccaccaagcgcaagaacaccgggagccccgaccggaagcccagcaagaaguccaagaccgacaacagcucccugagcuccccgcucaaccccaagcuguggugccacgugcaccugaagaagucccucuccggcagcccccugaaggucaagaacuccaagaacagcaagucccccgaggagcaccuggaggagaugaugaagaugaugagccccaacaagcuccacacgaacuuccacaucccgaagaaggggccgcccgccaagaagcccggcaagcacuccgacaagccccugaaggccaagggccgcagcaaggggauccugaacggccagaaguccaccgggaacagcaagucccccaagaagggccucaagacccccaagaccaagaugaagcagaugacgcugcuggacauggccaagggcacccagaagaugacccgggcgccgcgcaacagcgggggcacgccccgcaccuccagcaagccccacaagcaccucccgcccgccgcccugcaccugaucgccuacuacaaggagaacaaggaccgggaggacaagcgcagcgcccucagcugcgugaucagcaagaccgcgcggcugcuguccagcgaggaccgcgcccggcucccggaggagcugcgcucccuggugcagaagcgguacgagcuccuggagcacaagaagcgcugggccagcauguccgaggagcagcggaaggaguaccugaagaagaagcgcgaggagcugaagaagaagcucaaggagaaggccaaggagcggcgcgagaaggagaugcuggagcggcuggagaagcagaagcgcuacgaggaccaggagcucaccgggaagaaccugcccgccuuccggcuggucgacacccccgagggccucccgaacacgcuguucggggacguggcgaugguggucgaguuccugagcugcuacuccggccuccugcugcccgacgcccaguaccccaucaccgccgugagccucauggaggcccuguccgcggacaagggcggguuccuguaccucaaccgcguccuggugauccugcuccagacccugcugcaggacgagaucgccgaggacuacggcgagcucgggaugaagcugagcgagaucccccugacccuccacuccgugagcgagcugguccggcugugccuccgccgguccgacgugcaggaggagagcgagggcuccgacacggacgacaacaaggacagcgccgccuucgaggacaacgaggugcaggacgaguuccuggagaagcuggagaccagcgaguucuucgagcucaccuccgaggagaagcugcagauccugaccgcccucugccaccgcauccugaugacguacagcguccaggaccacauggagacccgccagcagauguccgcggagcuguggaaggagcggcucgccgugcugaaggaggagaacgacaagaagcgcgccgagaagcagaagcggaaggagauggaggccaagaacaaggagaacgggaagguggagaacggccugggcaagaccgaccgcaagaaggagaucgucaaguucgagccccagguggacaccgaggccgaggacaugaucagcgcggugaagucccggcgccuccuggccauccaggccaagaaggagcgggagauccaggagcgcgagaugaaggucaagcuggagcggcaggccgaggaggagcgcauccggaagcacaaggccgcggccgagaaggccuuccaggaggggaucgccaaggcgaagcucgugaugcgccggaccccgaucggcacggaccgcaaccacaaccgguacuggcuguucagcgacgaggugcccgggcuguucaucgagaagggcuggguccacgacuccaucgacuaccgcuucaaccaccacugcaaggaccacaccgugagcggggacgaggacuacugcccccgguccaagaaggccaaccucggcaagaacgccagcaugaacacccagcacggcaccgccacggagguggccgucgagaccaccaccccgaagcaggggcagaaccugugguuccugugcgacucccagaaggagcucgacgagcugcugaacugccuccacccccagggcauccgcgagagccagcugaaggagcggcuggagaagcgcuaccaggacaucauccacuccauccaccucgcgcggaagcccaaccuggggcucaagagcugcgacggcaaccaggagcugcugaacuuccugcgcuccgaccucaucgagguggccacgcgccugcagaagggcgggcugggcuacguggaggagaccagcgaguucgaggcccgggucaucucccucgagaagcugaaggacuucggggagugcgugaucgcccugcaggccagcgugaucaagaaguuccuccagggcuucauggcgcccaagcagaagcgccggaagcugcaguccgaggacagcgccaagaccgaggaggucgacgaggagaagaagaugguggaggaggccaagguggccagcgcccuggagaaguggaagaccgcgauccgcgaggcccagacguucucccggaugcacguccuccuggggaugcuggacgccugcaucaagugggacaugagcgccgagaacgcgcgcugcaaggugugccggaagaagggcgaggacgacaagcucauccugugcgacgagugcaacaaggccuuccaccuguucugccuccgcccggcccuguacgaggugcccgacggcgaguggcagugccccgccugccagccggccaccgcgcggcgcaacucccgggggcgcaacuacaccgaggagagcgccuccgaggacagcgaggacgacgaguccgacgaggaggaggaggaggaggaggaggaggaggaggaggaggacuacgaggucgccggccugcggcuccgcccccggaagaccauccgcgggaagcacagcgugaucccgcccgccgcccgguccggccgccggcccgggaagaagccccacagcacgcgccgcucccagcccaaggcgcccccgguggacgacgccgaggucgacgagcuggugcugcagaccaagcggagcucccgccggcagagccucgagcugcagaagugcgaggagauccugcacaagaucgugaaguaccgcuucuccuggcccuuccgggagcccgucacccgcgacgaggccgaggacuacuacgacgugaucacccaccccauggacuuccagacggugcagaacaagugcagcugcggcuccuaccggagcguccaggaguuccucaccgacaugaagcaggucuucaccaacgccgagguguacaacugccgcggcucccacgugcugagcugcauggugaagaccgagcagugccugguggcccuccugcacaagcaccucccggggcaccccuacguccggcgcaagcggaagaaguuccccgaccgccuggcggaggacgagggcgacagcgagcccgaggccguggggcagucccggggccgccggcagaagaaguga

SEQ ID NO: 27179 - RNA, 5712 nt, Artificial Sequence
  derived and/or modified sequence opt1 from BAZ2A__Homo_sapiens__NP_001287834
auggaggccaacgaccacuucaacuucaccggccugccgcccgcccccgccgccuccggccugaagcccucccccagcuccggcgaggggcuguacaccaacggcagccccaugaacuucccccagcaggggaagucccugaacggcgacgugaacgucaacggccugagcacggugucccacaccaccaccagcgggauccugaacuccgcgccccacagcuccagcacgucccaccuccaccaccccagcguggccuacgacugccucuggaacuacucccaguaccccagcgccaaccccggcuccaaccugaaggacccgccccugcucagccaguucuccgggggccaguacccccugaacgggauccugggcggcagccgccagcccagcucccccagccacaacaccaaccuccgggcggggucccaggaguucugggccaacggcacccagagccccauggggcugaacuucgacucccaggagcuguacgacagcuuccccgaccagaacuucgaggucaugcccaacgggccgcccuccuucuucaccagcccccagacgucccccaugcucggcagcuccauccagaccuucgcccccagccaggaggugggguccggcauccaccccgacgaggccgcggagaaggagaugaccagcguggucgccgagaacgggaccggccugguggggucccuggagcucgaggaggagcagcccgagcugaagaugugcggcuacaacggcagcgugcccuccgucgagagccugcaccaggagguguccgugcucguccccgaccccacggugagcugccuggacgaccccagccaccuccccgaccagcucgaggacacccccauccuguccgaggacagccuggagccguucaacucccucgcccccgagcccgugagcgggggccuguacgggaucgacgacaccgagcugaugggcgccgaggacaagcucccccuggaggacuccccggucaucagcgcccuggacugccccucccucaacaacgcgaccgccuucagccugcuggccgacgacucccagacgagcaccuccaucuucgccagccccaccagcccgcccgugcucggggagagcgugcugcaggacaacuccuucgaccugaacaacggcagcgacgccgagcaggaggagauggagacccaguccagcgacuucccgcccagccucacgcagcccgcgcccgaccaguccagcaccauccagcugcaccccgccaccucccccgccgucagccccaccacguccccggccgugagccugguggucucccccgccgcgagccccgagaucucccccgaggugugcccggccgccagcaccguggucucccccgccguguucagcgucgugucccccgccagcuccgcggugcuccccgccgucagccuggaggugccgcugaccgccuccgugaccagccccaaggccucccccgucacgagcccggcggccgccuuccccaccgccagccccgccaacaaggacguguccagcuuccucgagaccaccgcggacguggaggagaucacgggcgaggggcugaccgccuccggcagcggggacgucaugcgccggcgcaucgccacccccgaggaggugcggcugccgcuccagcacggcuggcgccgggaggugcgcaucaagaaggggucccaccgguggcagggcgagaccugguacuacggccccugcgggaagcgcaugaagcaguuccccgaggucaucaaguaccugagccggaacguggugcacuccguccgccgggagcacuucagcuucagcccccgcaugccggugggcgacuucuucgaggagcgggacacgcccgaggggcugcagugggugcagcugagcgccgaggagauccccucccgcauccaggccaucaccggcaagcggggccgcccccggaacaccgagaaggcgaagaccaaggaggucccgaaggugaagcgcgggcggggccggccgcccaaggugaagaucaccgagcuccugaacaagacggacaaccgcccccugaagaagcucgaggcccaggagacccugaacgaggaggacaaggccaagaucgccaagagcaagaagaagaugcggcagaagguccagcgcggggagugccagaccaccauccagggccaggcccggaacaagcgcaagcaggagacgaagucccugaagcagaaggaggcgaagaagaaguccaaggccgagaaggagaaggggaagaccaagcaggagaagcucaaggagaaggugaagcgggagaagaaggagaaggugaagaugaaggagaaggaggaggucaccaaggccaagccggccugcaaggcggacaagacccuggccacgcagcgccggcuggaggagcgccagcggcagcagaugauccucgaggagaugaagaagcccaccgaggacaugugccugaccgaccaccagccccugcccgacuucucccgcgugccgggccucacccugcccagcggcgccuucuccgacugccugacgaucguggaguuccuccacagcuucgggaagguccugggcuucgaccccgccaaggacgugcccucccugggggugcuccaggagggccugcugugccagggggacagccucggcgagguccaggaccugcuggugcggcuccugaaggccgcgcugcacgacccgggcuuccccagcuacugccagucccucaagauccugggggagaaggugagcgagaucccccugacccgcgacaacgucuccgagauccuccggugcuuccugauggccuacggcguggagcccgcccugugcgaccgccuccggacccagccguuccaggcccagccgccccagcagaaggccgcggugcuggccuuccugguccacgagcucaacgggagcacccugaucaucaacgagaucgacaagacgcuggaguccaugagcuccuaccgcaagaacaaguggaucguggagggccggcuccgccggcugaagaccgugcuggccaagcgcaccgggcgcagcgaggucgagauggagggcccggaggagugccucggccggcgccgguccagccgcaucauggaggagaccuccgggauggaggaggaggaggaggaggagagcaucgccgccgugcccggccggcgcgggcggcgcgacggcgagguggacgcgacggccuccagcauccccgagcuggagcggcagaucgagaagcuguccaagcgccagcuguucuuccggaagaagcuccugcacagcucccagaugcuccgcgccgucagccuggggcaggaccgguaccgccggcgcuacugggugcugcccuaccucgccggcaucuucguggagggcaccgaggggaaccuggucccggaggaggugaucaagaaggagaccgacucccugaagguggcggcccacgccagccucaaccccgcccuguucagcaugaagauggagcuggccggcuccaacaccacggcgagcucccccgcccgggcccgcgggcggccccgcaagaccaagccgggcagcaugcagccccggcaccucaagucccccguccgcggccaggacagcgagcagccccaggcccagcugcagccggaggcccagcugcacgcgcccgcccagccccagccccagcuccagcugcagcugcagucccacaagggguuccucgagcaggagggcagcccgcugucccuggggcagagccagcacgaccucucccagagcgccuuccuguccuggcugagccagacccagucccacagcucccuccugagcuccagcgugcugacccccgacagcucccccggcaagcucgaccccgccccgagccagccgcccgaggagcccgagccggacgaggccgaguccagccccgacccccaggcgcugugguucaacaucuccgcccagaugcccugcaacgccgccccgacgccgccgcccgccgugagcgaggaccagcccacccccagcccccagcagcuggcgagcuccaagcccaugaaccgccccagcgccgccaaccccugcucccccguccaguucagcuccaccccgcucgccgggcuggcgcccaagcggcgcgccggcgaccccggcgagaugccccagagcccgaccgggcugggccagcccaagcggcgcgggcggccgcccuccaaguucuucaagcagauggagcagcgcuaccucacgcagcugaccgcccagccggugccgcccgagaugugcagcggcuggugguggauccgggaccccgagaugcuggacgccaugcucaaggcccugcacccgcgcgggauccgggagaaggcgcugcacaagcaccucaacaagcaccgcgacuuccugcaggaggucugccugcggcccuccgccgaccccaucuucgagccccgccagcucccggccuuccaggagggcaucaugagcuggucccccaaggagaagaccuacgagaccgaccuggccgugcugcaguggguggaggagcucgagcagcgggucaucaugagcgaccugcagauccgcggcuggacgugccccagcccggacuccacccgggaggaccuggccuacugcgagcaccucagcgacucccaggaggacaucaccuggcgcgggcggggccgcgaggggcuggcgccccagcggaagaccaccaacccccuggaccuggccgugaugcgccucgccgcccuggagcagaacguggagcgccgguaccugcgcgagccccucuggccgacgcacgaggucgugcuggagaaggcccugcucagcacccccaacggcgcgcccgaggggaccaccacggagaucuccuacgagaucacgccccgcauccgcguguggcggcagacccuggagcgcugccggagcgccgcccaggucugccugugccucggccagcuggagcgcuccaucgccugggagaaguccgugaacaaggugaccugccuggucugccggaagggcgacaacgacgaguuccuccugcugugcgacgggugcgaccgcggcugccacaucuacugccaccggccgaagauggaggcggugcccgagggggacugguucugcaccgugugccucgcccagcaggucgagggcgaguucacccagaagcccggcuuccccaagcgcgggcagaagcggaaguccggcuacagccugaacuucuccgagggggacggccgccggcgccgggugcugcuccgcgggcgggagagcccggccgccggcccccgcuacuccgaggagggccugagccccuccaagcggcgccgccugagcaugcggaaccaccacuccgaccucaccuucugcgagaucauccugauggagauggagagccacgacgccgcguggcccuuccuggagccggugaacccccgccucgucagcggguaccggcgcaucaucaagaaccccauggacuucuccaccaugcgggagcgccugcugcggggcggguacacgagcuccgaggaguucgccgccgacgcccuccugguguucgacaacugccagaccuucaacgaggacgacagcgaggugggcaaggccgggcacaucaugcgccgguucuucgagucccgcugggaggaguucuaccagggcaagcaggcgaaccuguga

SEQ ID NO: 27180 - RNA, 6399 nt, Artificial Sequence
  derived and/or modified sequence opt1 from BAZ2B__Homo_sapiens__NP_001276904
auggagagcggcgagcgccugcccagcagcgccgccuccagcaccacccccaccuccagcuccacccccagcguggccuccguggugagcaagggcgggcucuccaccgggguggccagccuguccagcaccaucaaccccugcggccaccuguuccggaccgccggggaccagcccuucaaccucuccaccgucagcuccgccuuccccauggugagccaccccguguucggccugcacuccgccagcagcggccacuccgaguucgggggccuggggacccucggcacccccacggcccuggccgcccacccccagcuggccagcuuccccgagugguggcgcaccaccgacgcgcacacccggacgggggccaccuucuucccgccccuccugggcaucccgccccuguucgcgccgcccgcccagaaccacgacuccagcuccuuccacagccgcaccuccggcaagagcaaccggaacgggcccgagaagggcgucaacggguccaucaacggcagcaacaccuccagcgugaucggcaucaacacguccgugcucagcaccaccgccuccagcuccauggggcagaccaagagcacguccagcggcgggggcaaccgcaagugcaaccaggagcagagcaagaaccagccccuggacgcgcgggucgacaagaucaaggacaagaagccccgcaagaaggccauggaguccagcuccaacagcgacuccgacagcgggaccuccagcgacaccuccagcgagggcaucuccagcuccgacagcgacgaccuggaggaggacgaggaggaggaggaccaguccaucgaggagagcgaggacgacgacuccgacagcgagagcgaggcccagcacaaguccaacaaccaggugcuccugcacggcaucagcgaccccaaggccgacgggcagaaggccaccgagaaggcgcaggagaagcggauccaccagccccugccgcucgccuccgagagccagacgcacuccuuccagagccagcagaagcagccccaggugcugucccagcagcugcccuucaucuuccagagcucccaggccaaggaggagagcgucaacaagcacaccuccgugauccagagcaccggccucguguccaacgucaagccccugagccuggugaaccaggccaagaaggagaccuacaugaagcucaucgugccgucccccgacguccugaaggccgggaacaagaacacgagcgaggaguccagccugcucaccuccgagcugcgcagcaagcgggagcaguacaagcaggcguuccccagccagcugaagaagcaggaguccagcaagucccucaagaaggugaucgccgcccugagcaaccccaaggccaccuccagcuccccggcccaccccaagcagacccuggagaacaaccaccccaacccguuccucacgaacgcgcugcugggcaaccaccagcccaacggggugauccagagcgucauccaggaggcgccccucgcccugaccaccaagaccaagaugcaguccaagaucaacgagaacaucgccgcggccagcuccacgcccuucagcuccccggugaaccugagcaccuccggccgccggacccccggcaaccagacccccgugaugcccagcgccuccccgauccuccacagccaggggaaggagaaggccgucuccaacaacgugaaccccgucaagacccagcaccacagccaccccgccaagagccugguggagcaguuccgcggcacggacuccgacauccccagcuccaaggacagcgaggacuccaacgaggacgaggaggaggacgacgaggaggaggacgaggaggacgacgaggacgacgagagcgacgacucccagagcgaguccgacagcaacuccgagagcgacaccgagggguccgaggaggaggacgacgacgacaaggaccaggacgagagcgacuccgacaccgagggcgagaagaccagcaugaagcugaacaagacgaccuccagcgugaaguccccgagcaugagccucaccgggcacuccacgccccggaaccugcacaucgcgaaggcccccggcagcgcccccgccgcccugugcuccgagagccagucccccgcguuccucggcacgagcuccagcacccugaccuccagcccccacuccgggaccagcaagcgccggcgcgucacggacgagcgggagcugcgcaucccccucgaguacggcuggcagcgggagacccgcauccgcaacuucgggggccggcugcagggcgagguggccuacuacgcccccugcgggaagaagcugcgccaguacccggaggugaucaagggcaugcaguggugccugcucaaggaggaggacgucaucccccggauccgcgccauggaggggcggcgcggccggccgcccaacccggaccgccagcgggcccgcgaggagucccggaugcgccggcgcaaggggcggccgcccaacgugggcaacgcggaguuccuggacaacgccgacgccaagcugcuccgcaagcugcaggcccaggagaucgcgcggcaggccgcccagaucaagcugcuccgcaagcugcagaagcaggagcaggcccggguggccaaggaggcgaagaagcagcaggccaucauggccgccgaggagaagcgcaagcagaaggagcagaucaagaucaugaagcagcaggagaagaucaagcgcauccagcagauccggauggagaaggagcugcgcgcccagcagauccucgaggcgaagaagaagaagaaggaggaggccgccaacgccaagcugcuggaggccgagaagcggaucaaggagaaggagaugcgccggcagcaggcgguccuccugaagcaccaggagcgcgagcggcgccggcagcacaugaugcugaugaaggccauggaggcccgcaagaaggccgaggagaaggagcggcucaagcaggagaagcgcgacgagaagcggcugaacaaggagcgcaagcuggagcagcggcgccucgagcuggagauggcgaaggagcugaagaagccgaacgaggacaugugccucgccgaccagaagccccugcccgagcugccccggaucccgggccucgugcugagcggguccaccuucagcgacugccugauggugguccaguuccuccgcaacuucggcaaggugcugggguucgacgugaacaucgacguccccaaccuguccgugcuccaggagggccugcugaacaucggggacagcaugggcgaggugcaggaccuccugguccggcugcucuccgccgccgugugcgaccccggccugaucaccggguacaaggccaagacggcgcugggcgagcaccuccugaacgugggggucaaccgcgacaacgugagcgagauccugcagaucuucauggaggcccacugcggccagaccgagcucaccgagagccugaagaccaaggccuuccaggcccacacgcccgcccagaaggcguccgugcuggccuuccucaucaacgagcuggccugcagcaaguccgucgugagcgagaucgacaagaacaucgacuacauguccaaccugcggcgcgacaaguggguggucgaggggaagcuccgcaagcugcggaucauccacgccaagaagaccggcaagcgcgacaccagcggcgggaucgaccugggcgaggagcagcacccgcucgggacccccacgcccggccggaagcgccggcgcaagggcggggacuccgacuacgacgacgacgacgacgacgacagcgacgaccagggcgacgaggacgacgaggacgaggaggacaaggaggacaagaaggggaagaagaccgacaucugcgaggacgaggacgagggcgaccaggccgcguccguggaggagcuggagaagcagaucgagaagcugagcaagcagcagucccaguaccggcgcaagcuguucgacgccagccacucccugcggagcgugauguucgggcaggaccgcuaccggcgccgguacuggauccugccccagugcggcggcaucuucgucgaggggauggaguccggcgaggggcucgaggagaucgccaaggagcgcgagaagcugaagaaggccgagagcgugcagaucaaggaggagauguucgagaccuccggcgacagccugaacugcuccaacaccgaccacugcgagcagaaggaggaccucaaggagaaggacaacacgaaccuguuccugcagaagccggggagcuucagcaagcucuccaagcugcuggagguggccaagaugccgcccgagagcgaggucaugacccccaagccgaacgcgggcgccaacggcugcacccucuccuaccagaacagcgggaagcacucccugggcagcgugcaguccaccgccacgcagagcaacguggagaaggccgacuccaacaaccuguucaacaccgggagcuccggccccgggaaguucuacagcccccuccccaacgaccagcugcugaagacccucaccgagaagaaccggcagugguucucccugcugccgcgcacgcccugcgacgacaccagccucacccacgcggacauguccaccgccagccuggucacgccccagucccagcccccgagcaagagccccucccccacgcccgccccgcugggcagcuccgcccagaaccccgugggccucaaccccuucgcccugagcccgcuccaggugaagggcggggucuccaugauggggcuccaguucugcggcuggcccaccgggguggugaccagcaacauccccuucaccuccagcguccccucccugggcagcggccuggggcucuccgagggcaacgggaacagcuuccugacguccaacguggcgagcuccaagagcgaguccccggugccccagaacgagaaggccaccagcgcccagcccgccgccgucgagguggcgaagcccguggacuucccgucccccaagcccauccccgaggagaugcaguucggcugguggcggaucaucgacccggaggaccugaaggcccuccugaagguccugcaccuccgcggcauccgggagaaggcccugcagaagcagauccagaagcaccuggacuacaucacccaggccugccucaagaacaaggacguggccaucaucgagcugaacgagaacgaggagaaccaggugacccgcgacaucgucgagaacuggagcguggaggagcaggcgauggagauggaccugagcguccugcagcaggucgaggaccucgagcgccggguggccuccgccagccugcaggucaagggguggaugugccccgagcccgccuccgagcgcgaggaccugguguacuucgagcacaagagcuucacgaagcucugcaaggagcacgacggcgaguucaccggggaggacgaguccagcgcgcacgcccuggagcggaaguccgacaacccccuggacaucgccgugacccgccucgccgaccuggagcggaacaucgagcgccggaucgaggaggacaucgccccgggccugcgcgucuggcggcgcgcgcucagcgaggcccgguccgccgcccagguggcccugugcauccagcagcugcagaaguccaucgcgugggagaaguccaucaugaagguguacugccagaucugccgcaagggggacaacgaggagcuccugcugcucugcgacggcugcgacaagggcugccacaccuacugccaccggcccaagaucacgaccauccccgacggggacugguucugccccgccugcaucgccaaggccagcggccagacccugaagaucaagaagcugcacgucaaggggaagaagaccaacgaguccaagaagggcaagaaggugacgcucaccggggacaccgaggacgaggacagcgccuccaccagcuccagccugaagcgcggcaacaaggaccugaagaagcggaagauggaggagaacacguccaucaaccucagcaagcaggagagcuucaccuccgugaagaagccgaagcgcgacgacagcaaggaccuggcgcugugcuccaugauccucaccgagauggagacccacgaggacgccuggcccuuccugcugcccgucaaccucaagcuggugcccggcuacaagaaggugaucaagaagccgauggacuucagcacgauccgggagaagcuguccagcgggcaguaccccaaccucgagaccuucgcccuggacguccgccugguguucgacaacugcgagaccuucaacgaggacgacuccgacaucggccgggccgggcacaacaugcgcaaguacuucgagaagaaguggaccgacacguucaaggugagcuga

SEQ ID NO: 27181 - RNA, 786 nt, Artificial Sequence
  derived and/or modified sequence opt1 from BBC3__Homo_sapiens__NP_001120712
augaaguucggcauggggagcgcccaggccugccccugccaggugccccgcgcggccuccaccaccuggguccccugccagaucugcggcccccgggagcgccacgggccccggacgccgggcgggcagcugcccggcgcccgccggggccccgggccccgccggccggcgccccuccccgcccggcccccgggcgcccuggggagcgugcugcggccccuccgcgcccggcccggcugccgcccccggcgcccgcaccccgccgcccggugccugccccugcgcccccaccggccgacccgccggcaccgccggcccgggggcuucccccucgcguggggcagcccccagccggcgccccgccccgcccccgggcgcuccuccgcccuggcccuggccggcggggccgccccgggcguggcccgggcccagcgccccggcgggagcggcgggcggucccaccccggcgggccgggcagcccccgcggcgggggcaccgucgggcccggcgaccgggggcccgcggccgccgacggcggccgcccgcagcggaccgugcgcgccgccgagacgcgcggggcggccgccgccccgccccucacccuggagggccccgugcagucccaccacgggacccccgcccugacccagggcccccagagcccccgcgacggggcgcagcucggcgccugcacgcggcccgucgacgugcgcgacuccggcgggcggccgcugcccccgcccgacacccuggccagcgccggcgacuuccucugcaccauguga

SEQ ID NO: 27182 - RNA, 312 nt, Artificial Sequence
  derived and/or modified sequence opt1 from BBIP1__Homo_sapiens__NP_001182233
augcugaaggccgccgcgaagcgccccgagcucagcggccugcugaaguucaacaacuacgggauccucuccgagagcccgcugaccucccagcggaccacguggcugcucuaccagagccccuccuucauccccggcuucgccuaccccagccgcugccugaagaccaucgggggcguguacaagcaggcccggaagaagcacuacauccagcagcugcgcuacgggcgguccgaggucaacgugccgggcagcuccagcaaggcccgcgccaccgugugcggccgguacaacgacaacggggcggucuga

SEQ ID NO: 27183 - RNA, 1164 nt, Artificial Sequence
  derived and/or modified sequence opt1 from BBOX1__Homo_sapiens__XP_011518705
auggccugcaccauccagaaggccgaggcgcuggacggcgcccaccucaugcagauccugugguacgacgaggaggagagccuguaccccgccguguggcuccgcgacaacugcccgugcuccgacugcuaccuggacagcgccaaggcccggaagcugcucgucgaggcgcuggacgugaacaucgggaucaagggccugaucuucgaccgcaagaagguguacaucaccuggcccgacgagcacuacuccgaguuccaggccgacuggcucaagaagcggugcuucagcaagcaggcccgcgccaagcugcagcgggagcuguucuuccccgagugccaguacuggggguccgagcuccagcugcccacgcuggacuucgaggacguccuccgcuacgacgagcacgcguacaaguggcugagcacccugaagaaggugggcaucgugcggcucaccggggccuccgacaagccgggcgaggucagcaagcugggcaagcgcaugggguuccuguaccucaccuucuacggccacacguggcagguccaggacaagaucgacgccaacaacguggccuacaccaccgggaagcuguccuuccacaccgacuaccccgcccugcaccacccgcccggcgugcagcuccugcacugcaucaagcagacggugaccgggggcgacagcgagaucguggacggcuucaacgucugccagaagcugaagaagaacaacccccaggcguuccagauccucuccagcaccuucguggacuucaccgacaucgggguggacuacugcgacuucuccguccagagcaagcacaagaucaucgagcuggacgacaagggccagguggugcggaucaacuucaacaacgccacgcgcgacaccaucuucgacguccccguggagcgggugcagcccuucuacgccgcccugaaggaguucgucgaccucaugaacuccaaggagagcaaguucaccuucaagaugaaccccggggacgugaucaccuucgacaacuggcgccugcugcacggccggcgcuccuacgaggccggcacggagaucagccggcaccucgagggggcguacgccgacugggacguggucaugucccgccugcggauccugcgccagcggguggagaacggcaacuga

SEQ ID NO: 27184 - RNA, 2172 nt, Artificial Sequence
  derived and/or modified sequence opt1 from BBS10__Homo_sapiens__NP_078961
augcugagcuccauggccgccgcgggcagcgugaaggccgcccuccaggucgccgaggugcuggaggccaucguguccugcugcgucgggcccgagggccgccaggugcugugcaccaagccgaccggggaggugcuccugagccggaacggcgggcgccugcucgaggcgcugcaccuggagcaccccaucgcccggaugaucgucgacugcguguccagccaccucaagaagacgggcgacggcgccaagaccuucaucaucuuccugugccaccuccugcgcgggcugcacgccaucaccgaccgggagaaggacccccugaugugcgagaacauccagacccacggccgccacuggaagaacugcucccgguggaaguucaucagccaggcgcuccugacguuccagacccagauccuggacgggaucauggaccaguaccucucccgccacuuccugagcaucuucuccagcgccaaggagcggacccugugccgcuccagccucgagcugcugcucgaggccuacuucugcggccggguggggcgcaacaaccacaaguucaucucccagcugaugugcgacuacuucuucaagugcaugaccugcaagagcggcaucggcgucuucgagcugguggacgaccacuucguggagcucaacgucggggugacgggccugcccguguccgacagccggaucaucgccgggcugguccuccagaaggacuucuccguguaccgcccggccgacggcgacaugcggauggugaucgucaccgagaccauccagccccuguucagcaccagcggcuccgaguucauccugaacagcgaggcgcaguuccagacgucccaguucuggaucauggagaagaccaaggccaucaugaagcaccuccacagccagaacgugaagcugcugaucuccagcgugaagcagcccgaccucgucuccuacuacgccggggugaacggcaucagcguggucgagugccuguccagcgaggaggugucccugauccgccggaucaucgggcucagccccuucgucccgccccaggccuucucccagugcgagauccccaacaccgcccuggugaaguucugcaagccccugauccuccgcagcaagcgguacgugcaccugggccugaucuccacgugcgcguucaucccgcacagcaucguccucugcgggcccgugcacggccugaucgagcagcacgaggacgcccugcacggcgcccucaagaugcugcgccagcuguucaaggaccuggaccucaacuacaugacccagaccaacgaccagaacgggaccuccagccuguucaucuacaagaacuccggcgagagcuaccaggcccccgaccccgggaacggcagcauccagcggccguaccaggacaccguggccgagaacaaggacgcgcuggagaagacgcagaccuaccucaagguccacuccaaccuggugauccccgacguggagcuggagaccuacauccccuacagcacccccacgcucaccccgaccgacaccuuccagacggucgagacccugaccugccugucccucgagcgcaaccgccugaccgacuacuacgagccccugcucaagaacaacagcacggccuacuccacccgggggaaccgcaucgagaucagcuacgagaaccuccaggugaccaacaucacccggaagggcuccaugcugcccgugagcugcaagcugcccaacaugggcacgucccagagcuaccuguccagcuccaugccggccgggugcguccugcccgugggcgggaacuucgagauccuccugcacuacuaccugcucaacuacgccaagaagugccaccagagcgaggagaccaugguguccaugaucaucgccaacgcgcugcugggcauccccaagguccucuacaagagcaagaccgggaaguacuccuucccccacaccuacauccgcgccgugcacgcccugcagaccaaccagccgcuggugagcagccagacgggccucgaguccgucaugggcaaguaccagcugcugaccagcgugcuccagugccugaccaagauccugaccaucgacauggugaucacggucaagcggcacccccagaaggugcacaaccaggacuccgaggacgagcucuga

SEQ ID NO: 27185 - RNA, 2133 nt, Artificial Sequence
  derived and/or modified sequence opt1 from BBS12__Homo_sapiens__NP_689831
auggugauggccugccgcgucgugaacaagcggcgccacaugggccugcagcagcucagcuccuucgccgagaccgggcggaccuuccugggcccccucaagagcuccaaguucaucaucgacgaggagugccacgagagcgugcugaucuccagcacgguccgccugcuggagucccucgaccugaccagcgcgguggggcagcugcucaacgaggccgugcaggcccagaacaacaccuaccggaccggcaucuccacgcugcuguuccucgucggggccuggagcuccgccguggaggagugccugcaccugggcgugccgaucagcaucaucgucuccgugaugagcgagggccucaacuucugcuccgaggagguggucagccugcacgugcccgugcacaacaucuucgacugcauggacuccaccaagaccuucagccagcuggagaccuucuccgucagccucugccccuuccuccaggugcccagcgacacggaccugaucgaggagcugcacgggcugaaggacguggcgucccagacccugaccaucagcaaccucuccggccgcccgcucaagagcuacgagcuguucaagccccagaccaaggucgaggccgacaacaacacgucccggacccugaagaacagccugcuggccgacacgugcugccgccaguccauccucauccacagccggcacuucaaccgcaccgacaacaccgaggggguguccaagcccgacggcuuccaggagcacgugaccgccacccacaagaccuaccggugcaacgaccuggucgagcuggcgguggggcucagccacggcgaccacuccagcaugaagcugguggaggaggccguccagcugcaguaccagaacgccugcgugcagcagggcaacugcacgaagcccuucauguucgacaucucccgcaucuucacgugcugccucccggggcugcccgagaccagcuccugcgucugccccggcuacaucaccguggugagcgucuccaacaaccccgugaucaaggagcugcagaaccagccggugcggaucguccucaucgagggggaccugaccgagaacuaccgccaccugggcuucaacaagagcgccaacaucaagaccgugcucgacuccaugcggcugcaggaggacagcagcgaggagcugugggccaaccacgugcuccagguccugauccaguucaaggugaaccuggugcucguccagggcaacguguccgagcgccugaucgagaagugcaucaacagcaagcggcuggugaucggguccgucaacggcagcgugaugcaggcguucgccgaggccgccggggccgugcaggucgcguacaucacccaggugaacgaggacugcgugggcgacggggucugcgugaccuucuggcgcuccagcccccuggacguggucgaccggaacaaccgcaucgccauccuccugaagacggagggcaucaaccuggugaccgccgugcucaccaaccccgucaccgcccagaugcagaucaaggaggaccgguucuggacgugcgccuaccgccuguacuacgcgcugaaggaggagaagguguuccucggcgggggcgccguggaguuccugugccuguccugccuccacauccuggccgagcagagccugaagaaggagaaccacgccugcuccggguggcuccacaacaccagcuccuggcuggccagcucccuggcgaucuaccgccccaccguccucaaguuccuggccaacggcuggcagaaguaccugagcacccuccuguacaacacggccaacuacuccagcgaguucgaggccuccaccuacauccagcaccaccuccagaacgcgaccgacagcgggagcccguccagcuacauccugaacgaguacuccaagcugaacagccggaucuucaacuccgacaucagcaacaagcuggagcagaucccccgcguguacgacguggucacccccaagaucgaggccuggcggcgcgcccucgaccuggugcugcucgugcugcagaccgacuccgagaucaucacgggccacggccacacccagaucaacagccaggagcugaccggguuccucuuccuguga

SEQ ID NO: 27186 - RNA, 1782 nt, Artificial Sequence
  derived and/or modified sequence opt1 from BBS1__Homo_sapiens__NP_078925
auggccgccgcgagcuccagcgacuccgacgccugcggcgccgagagcaacgaggccaacuccaaguggcuggacgcccacuacgaccccauggcgaacauccacaccuucagcgccugccucgcccuggccgaccugcacggggacggcgaguacaagcucguggucggggaccugggccccgggggccagcagccccgccugaaggugcucaagggcccccuggugaugaccgaguccccgcugccggcgcuccccgccgccgccgccacguuccugauggagcagcacgagccccggacccccgcgcuggcccucgccagcgggccgugcgucuacguguacaagaaccugcgccccuacuucaaguucucccugccccagcugcccccgaacccccucgagcaggaccuguggaaccaggccaaggaggaccggaucgacccccucacccugaaggagaugcuggagagcauccgcgagaccgccgaggagccccucuccauccagagccugcgguuccugcagcucgagcuguccgagauggaggcguucgugaaccagcacaagagcaacuccaucaagcgccagacggucaucaccaccaugaccacgcugaagaagaaccucgccgacgaggacgccgugagcugccuggugcugggcaccgagaacaaggagcuccugguccuggacccggaggccuucaccauccucgccaagaugucccugcccagcgugcccguguuccuggaggucuccgggcaguucgacguggaguuccggcucgcggccgccugccgcaacggcaacaucuacauccugcggcgcgacagcaagcaccccaaguacugcaucgagcugagcgcccagccgguggggcucauccggguccacaaggugcugguggucggcuccacccaggacagccugcacggcuucacgcacaaggggaagaagcucuggaccgugcagaugcccgccgcgauccugaccaugaaccugcucgagcagcacucccgcggccugcaggccgugauggccgggcuggccaacggcgagguccggaucuaccgcgacaaggcgcuccugaacgugauccacacccccgacgccgugacgagccugugcuucggccgguacgggcgcgaggacaacacccugaucaugaccacccggggcgggggccucaucaucaagauccugaagcgcacggccgucuucguggagggcggcuccgaggucgggcccccgcccgcccaggccaugaagcugaacgugccccggaagacccgccucuacguggaccagacccugcgggagcgcgaggcggggaccgccaugcaccgcgccuuccagacggaccuguaccuccugcggcugcgcgccgcccgggcguaccuccaggcccuggagagcucccugagcccccucuccaccaccgcccgcgagccgcugaagcugcacgccgucgugcagggccucgggcccaccuucaagcugacgcugcaccuccagaacaccagcaccacccggcccgugcugggccugcucgucugcuuccuguacaacgaggcccuguacucccucccgcgcgcguucuucaaggugccccugcuggugcccgggcucaacuacccccuggagacguucgucgagagccuguccaacaagggcaucagcgacaucaucaaggugcucgugcugcgggagggccaguccgccccgcugcucagcgcccacgucaacaugcccggguccgagggccuggccgcggccuga

SEQ ID NO: 27187 - RNA, 2166 nt, Artificial Sequence
  derived and/or modified sequence opt1 from BBS2__Homo_sapiens__XP_005256137
augcugcuccccguguucacccugaagcugcgccacaagaucagcccgcggauggucgccaucggccgcuacgacgggacccaccccugccucgccgcggccacgcagaccggcaagguguucauccacaacccccacacccggaaccagcacguguccgccagccgcgucuuccagagcccccuggaguccgacgugucccugcucagcaucaaccaggccguguccugccugaccgccgggguccugaacccggagcucggcuacgacgcgcugcugguggggacgcagaccaaccuccuggccuacgacguguacaacaacagcgaccuguucuaccgggaggucgccgacggcgccaacgcgaucgugcucggcacccugggggacaucuccagcccccuggccaucaucggcgggaacugcgcccuccagggcuucaaccacgagggguccgaccuguucuggaccgugacgggcgacaacgucaacagccuggcccucugcgacuucgacggcgacgggaagaaggagcugcuggugggcuccgaggacuucgacauccgcguguucaaggaggacgagaucgucgccgagaugaccgagaccgagaucgugaccagccucugccccauguacgggucccgguucggcuacgcgcugagcaacggcacggugggggucuacgacaagaccucccgcuacuggcggaucaagagcaagaaccacgccauguccauccacgccuucgaccugaacagcgacggcgugaacgagcucaucaccggguggagcaacggcaagguggacgcccgcuccgaccggaccggggaggucaucuucaaggacaacuucagcuccgccaucgcgggcgugguggagggcgacuaccgcauggacgggcacauccagcugaucugcugcagcgucgacggcgagauccggggguaccugcccggcacggccgagaugcgcgggaaccucauggacaccuccgccgagcaggaccugauccgggagcugagccagaagaagcagaaccuccugcuggagcuccgcaacuacgaggagaacgccaaggccgagcuggcguccccgcugaacgaggccgacggccaccggggcaucauccccgccaacacccgccuccacaccacgcugagcgugucccuggggaacgagacccagaccgcccacaccgagcuccggaucagcacguccaacgacaccaucauccgcgccguccugaucuucgcggagggcaucuucaccggggagagccacguggugcaccccuccauccacaaccugagcuccagcaucugcauccccaucgucccgcccaaggacgugcccguggaccuccaccugaaggccuucgucggcuaccgguccagcacccaguuccacguguucgaguccacgcgccagcugccccgcuucagcauguacgcccucaccagccuggacccggccuccgagcccaucagcuacgugaacuucaccaucgcggagcgggcccagcgcgucgugguguggcuggggcagaacuuccugcuccccgaggacacccacauccagaacgcccccuuccaggucugcuucacgucccugcggaacggcggccaccuccacaucaagaucaagcugagcggggagaucaccaucaacaccgacgacaucgaccuggccggcgacaucauccaguccauggccagcuucuucgcgaucgaggaccuccagguggaggccgacuucccgguguacuucgaggagcugcgcaagguccuggugaagguggacgaguaccacuccguccaccagaagcugagcgccgacauggccgaccacuccaaccucauccggagccugcuggugggggccgaggacgcgcgccucaugcgggacaugaagaccaugaagucccgcuacauggagcuguacgaccugaaccgggaccuccugaacggcuacaagauccgcugcaacaaccacacggagcugcucggcaaccugaaggccgugaaccaggccauccagcgggccgggcgccugcgggucggcaagcccaagaaccaggugaucaccgccugccgcgacgcgauccggagcaacaacaucaacacccucuucaagaucaugcgcguggggaccgccuccagcuga

SEQ ID NO: 27188 - RNA, 1560 nt, Artificial Sequence
  derived and/or modified sequence opt1 from BBS4__Homo_sapiens__NP_149017
auggccgaggagcgcguggccacccggacccaguuccccgucagcacggagucccagaagccgcgccagaagaaggcgcccgaguuccccauccuggagaagcagaacuggcucauccaccuccacuacauccggaaggacuacgaggccugcaaggccgugaucaaggagcagcugcaggagacccagggccugugcgaguacgccaucuacgugcaggcccugaucuuccgccuggaggggaacauccaggagagccucgagcuguuccagaccugcgcgguccugagcccccaguccgccgacaaccucaagcaggucgcccggucccuguuccugcucggcaagcacaaggccgcgaucgagguguacaacgaggccgccaagcugaaccagaaggacugggagaucagccacaaccugggggugugcuacaucuaccucaagcaguucaacaaggcccaggaccagcugcacaacgcccugaaccucaaccgccacgaccugaccuacaucaugcugggcaagauccaccuccuggagggggaccuggacaaggcgaucgagguguacaagaaggccguggaguucuccccggagaacacggagcuccugaccacccugggccuccuguaccugcagcucggcaucuaccagaaggccuucgagcaccuggggaacgcccugaccuacgaccccacgaacuacaaggccauccucgcggccggcagcaugaugcagacccacggggacuucgacgucgcccugaccaaguaccgggugguggccugcgccguccccgaguccccgccccuguggaacaacaucggcaugugcuucuucgggaagaagaaguacguggcggccaucagcugccucaagcgcgccaacuaccuggcccccuucgacuggaagauccuguacaaccucggccuggugcaccugaccaugcagcaguacgccuccgcguuccacuuccucagcgccgccaucaacuuccagcccaagaugggcgagcuguacaugcugcucgccgucgcgcugacgaaccuggaggacaucgagaacgccaagcgggccuacgccgaggccgugcaccucgacaagugcaacccccuggugaaccugaacuacgcgguccugcucuacaaccagggggagaagaagaacgcccuggcccaguaccaggagauggagaagaaggugucccugcucaaggacaacagcucccuggaguucgacagcgagaugguggagauggcccagaagcugggcgccgcgcuccaggucggggaggcccugguguggaccaagccggugaaggaccccaaguccaagcaccagaccaccagcacguccaagcccgccagcuuccagcagccccugggcagcaaccaggcccucggccaggccauguccagcgcggccgccuaccgcacccugccguccggggccggcgggaccagccaguucaccaagccgcccucccugccccucgagcccgagcccgcggucgagagcucccccacggagaccagcgagcagauccgggagaaguga

SEQ ID NO: 27189 - RNA, 1026 nt, Artificial Sequence
  derived and/or modified sequence opt1 from BBS5__Homo_sapiens__NP_689597
augagcgugcuggacgcccucugggaggaccgcgacguccgguucgaccuguccgcccagcagaugaagacccgccccggcgaggugcugaucgacugccucgacagcaucgaggacaccaaggggaacaacggcgaccgggggcgccugcuggugacgaaccuccggauccuguggcacucccuggcgcucagccgcgucaacguguccgugggcuacaacugcauccugaacaucaccacccggaccgccaacagcaagcugcgcgggcagacggaggcccucuacauccugaccaagugcaacuccacccgguucgaguucaucuucaccaaccuggucccgggcagcccccgccucuucacguccgugauggccgugcaccgggccuacgagaccagcaagauguaccgcgacuucaagcugcgguccgcgcugauccagaacaagcagcuccgccugcugccccaggagcacgucuacgacaagaucaacggcguguggaaccucagcuccgaccaggggaaccugggcaccuucuucaucaccaacgugcggaucgucuggcacgccaacaugaacgacagcuucaacguguccauccccuaccugcagauccgcagcaucaagauccgggacuccaaguucgggcucgcccuggugaucgagagcucccagcagagcggcggguacguccugggcuucaagaucgacccgguggagaagcuccaggagagcgugaaggagaucaacucccugcacaaggucuacagcgccucccccaucuucggcguggacuacgagauggaggagaagccccagccccuggaggcgcucacgguggagcagauccaggacgacgucgagaucgacagcgacgggcacaccgacgccuucguggccuacuucgccgacggcaacaagcagcaggaccgcgagccgguguucuccgaggagcuggggcuggccaucgagaagcucaaggacggcuucacccugcagggccugugggaggucaugagcuga

SEQ ID NO: 27190 - RNA, 2019 nt, Artificial Sequence
  derived and/or modified sequence opt1 from BBS7__Homo_sapiens__NP_060660
auggaccugauccucaaccgcauggacuaccuccaggugggcgucaccagccagaagaccaugaagcugauccccgccucccggcaccgcgccacgcagaagguggugaucggggaccacgacggcgucgugaugugcuucgggaugaagaagggcgaggcggccgccguguucaagacccugccggggcccaagaucgcccggcuggagcugggcggcgucaucaacacgccccaggagaagaucuucaucgccgcggccagcgagauccgcggguucaccaagcggggcaagcaguuccucuccuucgagaccaaccugaccgagagcaucaaggccaugcacaucuccgggagcgaccuguuccucuccgccagcuacaucuacaaccacuacugcgacugcaaggaccagcacuacuaccuguccggcgacaagaucaacgacgugaucugccugcccguggagcgccucagccggaucaccccgguccuggcgugccaggaccgcgugcugcgggugcuccagggguccgacgucauguacgccguggaggugcccggcccgcccaccguccuggcccugcacaacggcaacgggggcgacagcggggaggaccuccuguucggcacguccgacggcaagcuggcccucauccagaucaccaccagcaagcccgugcgcaagugggagauccagaacgagaagaagcgcgggggcauccugugcaucgacuccuucgacaucgugggggacggcgucaaggaccugcucguggggcgggacgacggcaugguggaggucuacagcuucgacaacgccaacgagcccgugcugcgguucgaccagaugcuguccgagagcgugaccuccauccagggcgggugcgucggcaaggacagcuacgacgagaucguggucagcacguacuccgggugggugaccggccucaccaccgagcccauccacaaggagagcgggcccggcgaggagcugaagaucaaccaggagaugcagaacaagaucuccagccugcgcaacgagcucgagcaccuccaguacaaggugcugcaggagcgggagaacuaccagcaguccagccaguccagcaaggcgaaguccgccgucccgagcuucggcaucaacgacaaguucacgcugaacaaggacgacgccuccuacagccugauccuggaggugcagaccgccaucgacaacgugcucauccaguccgacguccccaucgaccugcuggacguggacaagaacagcgccguggucuccuucagcuccugcgacagcgaguccaacgacaacuuccuccuggcgaccuaccgcugccaggccgacaccacgcggcuggagcucaagauccgcagcaucgaggggcaguacggcacccugcaggccuacgugacgccccggauccagcccaagaccugccaggugcgccaguaccacaucaagccgcugagccuccaccagcggacccacuucaucgaccacgaccgccccaugaacacccugacccugaccgggcaguucuccuucgccgagguccacagcugggugguguucugccuccccgagguccccgagaagccgcccgccggcgagugcgugacguucuacuuccagaacaccuuccuggacacccagcuggaguccaccuaccgcaagggggagggcguguucaagagcgacaacaucuccacgaucagcauccugaaggacguccucuccaaggaggcgaccaagcggaagaucaaccugaacaucagcuacgagaucaacgagguguccgugaagcacacccugaagcucauccaccccaagcuggaguaccagcugcuccuggccaagaagguccagcugaucgacgcccucaaggagcugcagauccacgagggcaacaccaacuuccugauccccgaguaccacugcauccucgaggaggccgaccaccuccaggaggaguacaagaagcagccggcccaccuggagcgccuguacggguga

SEQ ID NO: 27191 - RNA, 2559 nt, Artificial Sequence
  derived and/or modified sequence opt1 from BBS9__Homo_sapiens__NP_001028776
augagccuguucaaggcccgcgacuggugguccaccauccucggcgacaaggaggaguucgaccaggggugccugugccuggccaacguggacaacagcggcaacgggcaggacaagaucaucgucggcuccuucaugggguaccuccggaucuucagcccccacccggcgaagaccggcgacggcgcccaggccgaggaccugcugcucgagguggaccugcgcgaccccgugcugcaggucgagguggggaaguucguguccggcacggagaugcuccaccuggccguccugcacagccggaagcucugcguguacuccgugagcgggacccugggcaacgucgagcacgggaaccagugccagaugaagcugauguacgagcacaaccuccagcgcaccgccugcaacaugaccuacggcuccuucggcggggugaagggccgggaccugaucugcauccagagcauggacgggaugcugaugguguucgagcaggaguccuacgcguucggccgcuuccuccccggcuuccugcugcccgggccgcucgccuacagcucccggacggacagcuuccugaccgucuccagcugccagcaggucgaguccuacaaguaccaggugcuggccuucgccaccgacgcggacaagcgccaggagaccgagcagcagaagcucggcagcgggaagcggcuggugguggacuggacgcugaacaucggcgagcaggcccucgacaucugcaucguguccuucaaccagagcgccagcuccgucuucgugcugggggagcgcaacuucuucugccugaaggacaacggccagauccgguucaugaagaagcucgacuggagccccuccugcuuccugcccuacugcagcguguccgagggcaccaucaacacccugaucgggaaccacaacaacaugcuccacaucuaccaggacgucacccugaagugggccacgcagcugccccacaucccgguggccgugcgcgucggcugccuccacgaccugaagggggugaucgucacccugagcgacgacggccaccuccagugcuccuaccuggggaccgaccccagccuguuccaggcgcccaacgugcagucccgggagcucaacuacgacgagcuggacguggagaugaaggagcugcagaagaucaucaaggacgucaacaagagccagggcguguggcccaugaccgagcgcgaggacgaccucaacguguccgucguggugagcccgaacuucgacuccgucagccaggccacggacguggaggugggcaccgaccugguccccuccgugaccgugaaggucacccugcagaaccgggugauccuccagaaggccaagcugagcguguacguccagccgccccuggagcugacgugcgaccaguucaccuucgaguucaugaaccgcaaccccgacgggaucccccgggugauccagugcaaguuccgccucccccugaagcugaucugccuccccggccagccguccaagaccgccagccacaagaucaccaucgacacgaacaagucccccgugagccugcugagccucuuccccggguucgccucccagagcgacgacgaccaggucaacgugaugggcuuccacuuccucgggggcgcgcggaucaccgugcuggccuccaagaccagccagcgcuaccggauccaguccgagcaguucgaggaccucuggcugaucaccaacgagcugauccuccgccugcaggaguacuucgagaagcagggcgucaaggacuucgccugcagcuucuccgggagcaucccccugcaggaguacuucgagcucaucgaccaccacuucgagcugcgcaucaacggcgagaagcuggaggagcuccuguccgagcgggccgugcaguuccgcgccauccagcggcgccugcucgcgcgguucaaggacaagacgccggcgccccugcagcaccuggacacccuccuggacgggaccuacaagcaggucaucgcccuggccgacgccguggaggagaaccagggcaaccucuuccagagcuucacccgccugaaguccgccacgcaccuggugauccuccugaucgcccuguggcagaagcucagcgccgaccagguggccauccuggaggcggccuuccugccccuccaggaggacacccaggagcugggcugggaggagaccgucgacgccgccaucucccaccuccugaagaccugccugagcaaguccagcaaggagcaggcccugaaccucaacucccagcugaacauccccaaggacacgagccagcugaagaagcacaucacccuccugugcgaccggcugagcaagggcgggcgccucugccuguccaccgacgcggccgccccgcagaccauggugaugcccgggggcugcaccacgauccccgagagcgaccuggaggagcgguccguggagcaggacagcaccgagcuguucaccaaccaccgccaccugaccgccgagacgccgcggcccgaggucagcccccugcaggggguguccgaguga

SEQ ID NO: 27192 - RNA, 2826 nt, Artificial Sequence
  derived and/or modified sequence opt1 from BBX__Homo_sapiens__NP_001136040
augaagggcagcaaccgcaacaaggaccacuccgccgagggggagggcguggggaagcggcccaagcgcaagugccugcaguggcacccgcuccuggccaagaagcugcucgacuucagcgaggaggaggaggaggaggacgaggaggaggacaucgacaagguccagcugcugggcgcggacgggcucgagcaggacgugggcgagaccgaggacgacgagucccccgagcagcgggcccgccggcccaugaacgccuuccugcuguucugcaagcgccaccggagccucgugcgccaggagcacccccggcuggacaaccgcggcgccaccaagauccuggccgacuggugggcgguccucgacccgaaggagaagcagaaguacacggacauggccaaggaguacaaggacgccuucaugaaggccaaccccggguacaaguggugccccaccaccaacaagcccgugaaguccccgacccccacggugaacccccggaagaagcugugggcguuccccagcgacuccagccgcgaccugccgucccccaagaaggccaagaccgaggagaugccccagcucaacuucggcauggccgaccccacccagaugggcgggcugagcaugcugcuccuggccggggagcacgcccugggcaccccggaggucuccagcggcacgugccggcccgacguguccgagagccccgagcuccgccagaaguccccgcuguuccaguucgcggagaucagcuccagcaccucccacagcgacgccagcaccaagcagugccagaccuccgcccuguuccaguucgccgagaucagcuccaacacgagccagcucgggggcgccgagcccgugaagcggugcgggaaguccgcgcuguuccagcuggccgagaugugccucgccagcgagggcaugaagauggaggaguccaagcugaucaaggccaaggagagcgacggcgggcgcaucaaggagcuggagaagggcaaggaggagaaggagaucaagauggagaagaccgacgagacccggcuccagaaggaggccgaguucgagaaguccgcgaaggagaaccugcgcgacagcaaggagcugcggaacuucgaggcccuccagaucgacgacaucauggccaucaagauggaggaccccaaggagauccgcaaggaggagcuggaggaggaccacaagugcucccacuuccccgacuucagcuacuccgccagcuccaagaucaucaucagcgacguccccucccggaaggaccacaugugccacccgcacgggaucaugaucaucgaggaccccgccgcgcugaacaagcccgagaagcucaagaagaagaagaagaaguccaagauggaccgccacggcaacgacaagagcacccccaagaagacgugcaagaagcgccagagcagcgaguccgacaucgagagcgugaucuacaccaucgaggccguggccaagggggacuggggcaucgagaagcugggcgacaccccgcggaagaagguccgcaccuccagcuccgggaagggcagcauccuggacgccaagccgcccaagaagaaggugaagucccgggagaagaagaugagcaaggagaaguccagcgacacgaccaaggagucccgcccgcccgacuucaucagcaucuccgcgagcaagaacaucuccggggagacccccgagggcaucaaggccgagccccucacccccauggaggacgcccugccgcccagccuguccgggcaggccaagcccgaggacagcgacugccaccggaagaucgagacgugcggcagccgcaaguccgagcggagcugcaagggcgcccucuacaagacccugguguccgaggggaugcugaccagccuccgcgcgaacgucgaccggggcaagcgcuccagcgggaagggcaacuccagcgaccacgaggggugcuggaacgaggaguccuggaccuucagccaguccggcacgagcggcuccaagaaguucaagaagaccaagcccaaggaggacugccugcuggggagcgccaagcucgacgaggaguucgagaagaaguucaacucccugccccaguacagccccgugaccuucgaccggaagugcgugcccgucccgcgcaagaagaagaagaccggcaacguguccagcgagcccacgaagaccuccaaggggcccuuccagagccagaagaagaaccuguuccacaagaucgugagcaaguacaagcacaagaaggagaagcccaacgucccggagaagggcuccggcgacaaguggagcaacaagcagcuguuccucgacgccauccaccccaccgaggccaucuucuccgaggaccggaacaccauggagcccgugcacaaggugaagaacauccccagcaucuucaacacgccggagcccaccaccacccaggagccccuggucgggucccagaagcgcaaggcccggaagaccaagaucacgcaccuggugcgcaccgcggacggccgggucagccccgccgggggcacccucgacgacaagccgaaggagcagcugcagcgcucccugcccaaggccaccgagacggacugcaacgacaagugcagccacaacaccgaggugggggagacccgguccagcacccccgagaugccggccguguccgccuucuucagccucgcggcccuggccgaggucgccgcgauggagaacgugcaccgcggccagcgcuccacgccccugacccacgacggccagcccaaggagaugccccaggccccggugcucaucagcugcgccgaccaguga

SEQ ID NO: 27193 - RNA, 1767 nt, Artificial Sequence
  derived and/or modified sequence opt1 from BCAM__Homo_sapiens__NP_001013275
auggagcccccggacgcccccgcccaggcgcgcggcgcgccccggcugcuccugcuggccgugcuccuggccgcccaccccgacgcccaggccgagguccgccugagcgugccgccccucguggaggucaugcgggggaaguccgugauccuggacugcacccccaccggcacgcacgaccacuacaugcuggagugguuccucaccgaccgcagcggggcccggccccgccuggccuccgcggagaugcagggcagcgagcuccaggugaccaugcacgacacccgggggcgcuccccgcccuaccagcuggacagccagggccggcugguccuggccgaggcccaggugggcgacgagcgcgacuacgugugcgucgugcgggccggggccgcgggcacggccgaggccaccgcccgccucaacguguucgccaagcccgaggcgaccgaggucucccccaacaaggggacccugagcgugauggaggacuccgcccaggagaucgccacgugcaacagccggaacggcaacccggcccccaagaucaccugguaccgcaacgggcagcggcuggaggugcccgucgagaugaaccccgagggcuacaugaccucccgcaccgugcgggaggccagcggccuccugucccugacgagcacccucuaccugcgccugcggaaggacgaccgcgacgcguccuuccacugcgccgcccacuacagccucccggaggggcggcacggccgccuggacucccccaccuuccaccugacccuccacuaccccacggagcacgugcaguucugggucgggagccccuccaccccggccggcugggugcgcgagggcgacaccgugcagcugcugugccgcggggacggcagccccagccccgaguacacccucuuccggcugcaggacgagcaggaggagguccugaacgugaaccucgaggggaaccugacgcuggagggcgugacccgggggcaguccggcaccuacggcugccgcgucgaggacuacgacgccgcggacgacgugcagcucagcaagacccuggagcugcgggucgccuaccucgacccccuggagcuguccgaggggaaggugcucagccugccgcugaacuccagcgccguggucaacugcuccgugcacggccuccccacgcccgcccugcgcuggaccaaggacagcacgccccugggggacggcccgaugcucucccugagcuccaucaccuucgacagcaacgggaccuacgugugcgaggcgucccugcccaccguccccgugcugagccggacccagaacuucacccuccuggugcagggcuccccggagcugaagacggccgagaucgagcccaaggccgacggcagcuggcgcgagggggacgaggucacccucaucugcuccgcccggggccaccccgaccccaagcugagcuggucccagcucgggggcagcccggccgagcccauccccgggcgccagggcugggugagcuccagccugacccugaaggugaccuccgcgcugagccgggacggcaucuccugcgaggccagcaacccccacgggaacaagcgccacgucuuccacuucggcacgguguccccgcagaccagccaggccgggguggccgucauggccguggcgguguccgucggccuccugcugcucgugguggccgucuucuacugcgugcggcgcaagggcgggcccugcugccggcagcgccgggagaagggcgcccccuga

SEQ ID NO: 27194 - RNA, 2016 nt, Artificial Sequence
  derived and/or modified sequence opt1 from BCAN__Homo_sapiens__NP_940819
auggcccagcuguuccucccccugcuggccgcgcucgugcuggcccaggccccggccgcccuggcggacguccucgagggcgacagcuccgaggaccgcgccuuccgggugcgcaucgccggggacgcgccccugcagggcgugcucgggggcgcccugaccauccccugccacguccacuaccugcggcccccgcccagccgccgggccgugcuggggagcccccgcgugaaguggaccuuccucucccggggccgcgaggccgagguccugguggcccggggcgugcgcgucaaggugaacgaggccuaccgguuccgcguggcgcugcccgccuacccggccucccucacggacgucagccuggcccuguccgagcuccggcccaacgacagcgggaucuaccgcugcgaggugcagcacggcaucgacgacuccagcgacgccguggaggucaaggugaaggggguggucuuccuguaccgggagggcuccgcgcgcuacgccuucagcuucuccggggcccaggaggccugcgcccggaucggcgcgcacaucgccacccccgagcagcuguacgccgccuaccucggcggguacgagcagugcgacgccggcuggcugagcgaccagaccgugcgcuaccccauccagaccccgcgggaggcgugcuacggggacauggacggcuuccccggcgugcgcaacuacggggucguggaccccgacgaccuguacgacguguacugcuacgccgaggaccucaacggcgagcuguuccugggggacccgcccgagaagcucacgcuggaggaggcccgggccuacugccaggagcgcggcgcggagaucgccaccaccgggcagcuguacgccgccugggacggcggccucgaccacugcucccccggguggcuggccgacggcagcguccgcuaccccaucgugacccccucccagcggugcgggggcgggcugccgggcgucaagacccucuuccuguuccccaaccagaccggcuuccccaacaagcacagccgcuucaacguguacugcuuccgggacuccgcgcagcccagcgccaucccggaggccagcaaccccgccuccaaccccgccagcgacgggcuggaggcgaucgugaccgucaccgagacgcucgaggagcugcagcugccccaggaggccaccgaguccgagagccgcggcgccaucuacuccaucccgaucauggaggacgggggcgggggcagcuccacccccgaggaccccgccgaggccccgcggacccuccuggaguucgagacgcagagcauggugccgcccaccggcuucuccgaggaggaggggaaggcgcuggaggaggaggagaaguacgaggacgaggaggagaaggaggaggaggaggaggaggaggagguggaggacgaggcccucugggccuggcccagcgagcuguccagccccggccccgaggccucccugcccaccgagcccgcggcccaggaggagagccucucccaggccccggcccgcgccguccugcagcccggggcgagcccccugcccgacggcgaguccgaggccagccggccgccccgcgugcacggcccgcccaccgagacgcuccccacgccccgggagcgcaaccuggccucccccagccccagcacccugguggaggcccgggaggucggggaggccaccggcgggccggagcuguccggcgugccccgcggggagagcgaggagacgggcuccagcgagggcgcgcccucccuccugcccgccacccgggccccggaggggacccgcgagcuggaggcccccagcgaggacaacuccggccggaccgcccccgcggggacgagcgugcaggcccagccgguccuccccaccgacuccgccagccgcggcgggguggccgugguccccgcguccggcaacagcgcccagggcuccaccgcccugagcauccugcuccuguucuucccccugcagcucugggugaccuga

SEQ ID NO: 27195 - RNA, 1047 nt, Artificial Sequence
  derived and/or modified sequence opt1 from BCAP29__Homo_sapiens__NP_001008405
augacccugcagugggccgccguggcgaccuuccucuacgccgagaucggccugauccugaucuucugccuccccuucaucccgccccagcgcuggcagaagaucuucagcuucaacgucugggggaagaucgccaccuucuggaacaaggccuuccugaccaucaucauccugcucaucgugcuguuccuggacgccgugcgggagguccgcaaguacuccagcgugcacaccaucgagaaguccagcaccucccggcccgacgcguacgagcacacgcagaugaagcuguuccgcagccagcggaaccuguacaucuccggcuucagccuguucuucuggcucgugcugcgccggcuggucacccucaucacccagcuggccaaggagcuguccaacaagggggugcucaagacccaggccgagaacacgaacaaggccgcgaagaaguucauggaggagaacgagaagcugaagcgcauccucaagagccacggcaaggacgaggagugcgugcucgaggccgagaacaagaagcuggucgaggaccaggagaagcugaagaccgagcuccggaagaccuccgacgcccugagcaaggcccagaacgacgugauggagaugaagaugcaguccgagcgccugagcaaggaguacgaccagcuccugaaggagcacuccgagcugcagcacagcuccuucggggaguuccucagcaagcggucccacaagaacggcagcaucggcaagcagaccgggagccgcaagggcuccuuccggaagcgccagcaggagaagacggugaacuucaucaaggacacgugcaacauccugugccagaacgacaacuucgucaugcuggccagccggaaguucaaguuccgcaagaugcacuacgaccgguucgugaucuuccucaugccccacaucgggugcaucgugauggcgcuguccaaguaccugaugauguuccagaucuacugcaaggucugcaucccggcccucaagaagaacaucagcaugcugaacaccaucuucaccuacuga

SEQ ID NO: 27196 - RNA, 942 nt, Artificial Sequence
  derived and/or modified sequence opt1 from BCAP31__Homo_sapiens__NP_001132929
augggcgccgaggccagcuccagcuggugccccgggaccgcgcugccggaggagcgccucuccgugaagcgggccagcgagaucuccggcuuccuggggcagggcagcuccggggaggccgcccuggacguccucacccacgugcuggagggcgccggcaacaagcugacgagcuccugcgggaagcccagcuccaaccgcaugagccuccaguggaccgcgguggccaccuuccuguacgccgaggucuucguggugcugcuccugugcauccccuucaucucccccaagcgguggcagaagaucuucaagagccgccuggucgagcuccugguguccuacggcaacaccuucuucgugguccugaucgugauccucgugcugcuggucaucgacgccgugcgggagauccgcaaguacgacgacgugacggagaaggucaaccuccagaacaacccgggggcgauggagcacuuccacaugaagcuguuccgggcccagcgcaaccuguacaucgccggcuucagccuccugcuguccuuccuccugcggcgccuggugacccucaucagccagcaggccacccugcuggccuccaacgaggcguucaagaagcaggccgagagcgccagcgaggccgccaagaaguacauggaggagaacgaccagcucaagaagggggcggccguggacggcggcaagcuggacgucgggaacgccgaggugaagcuggaggaggagaaccggucccucaaggccgaccugcagaagcugaaggacgagcucgccagcaccaagcagaagcuggagaaggcggagaaccaggugcuggccaugcgcaagcaguccgagggccucacgaaggaguacgaccggcugcuggaggagcacgccaagcuccaggccgccgucgacgggcccauggacaagaaggaggaguga

SEQ ID NO: 27197 - RNA, 2751 nt, Artificial Sequence
  derived and/or modified sequence opt1 from BCAR1__Homo_sapiens__NP_001164185
augcccgccaagccguuccugagcuccgugcuccugagcuggaagguccuggacuucuccggccccgggccccagggcaccgggcagcccugcagcugcggccacugggccgaggggcagggcggcccgcccgagcccgcggggggccccaacgugcucgccaaggcccuguacgacaacguggccgaguccccggacgagcugagcuuccgcaagggggacaucaugaccguccucgagcaggacacgcagggccuggacgggugguggcugugcucccuccacggccggcagggcaucgugcccgggaaccgccugaagauccuggugggcauguacgacaagaagcccgccgggcccggcccgggcccccccgcgacccccgcccagccgcagcccgggcuccacgcccccgcccccccggcgagccaguacacccccaugcugcccaacaccuaccagccccagccggacuccgucuaccuggugcccacgcccagcaaggcccagcagggccucuaccaggugcccgggccguccccccaguuccagagccccccggccaagcagaccuccaccuucagcaagcagaccccccaccaccccuuccccuccccggccacggaccuguaccaggucccccccggccccgggggcccggcccaggacaucuaccaggugccccccagcgcgggcauggggcacgacaucuaccaggugcccccguccauggacacccggagcugggagggcaccaagccccccgccaaggucguggugcccacccgcgucgggcagggcuacguguacgaggccgcccagccggagcaggacgaguacgacaucccccggcaccugcucgcccccgggccccaggacaucuacgacgugccgcccguccgcggccugcugcccucccaguacggccaggagguguacgacacgcccccgauggcggugaaggggcccaacggccgggacccccuccuggaggucuacgacgugccgcccagcguggagaaggggcugccccccagcaaccaccacgccgucuacgacgugccgcccuccgucagcaaggacgugcccgacggcccccuccugcgcgaggagaccuacgacgugccgcccgccuucgccaaggccaagcccuucgaccccgcgcggaccccgcugguccucgccgcccccccccccgacuccccgcccgccgaggacguguacgacgugccccccccggcccccgaccuguacgacgucccccccgggcugcgccggccgggccccggcacccucuacgacgugccccgcgagcgggugcugcccccggaggucgcggacgggggcgugguggacagcggggucuacgccgugccccccccggccgagcgcgaggcccccgcggagggcaagcggcuguccgccagcuccacgggcagcacccgcuccagccaguccgccagcucccucgagguggccgggcccggccgggagccccuggagcuggaggucgccguggaggcgcucgcccgccugcagcagggggugagcgccaccgucgcccaccugcucgaccuggccggcuccgcgggggccaccggcagcuggcgguccccgagcgagccccaggagccccuggugcaggaccuccaggccgccguggccgcgguccaguccgccgugcacgagcugcuggaguucgcccgcagcgccgugggcaacgcggcccacacgagcgaccgggcccuccacgccaagcugucccgccagcugcagaagauggaggacguccaccagacccucguggcccacgggcaggcgcuggacgccggccgcgggggcagcggggccacccuggaggaccuggaccggcucguggccugcucccgcgccguccccgaggacgcgaagcagcuggccagcuuccugcacggcaacgccucccuccuguuccggcgcaccaaggccacggccccgggccccgaggggggcgggacccugcaccccaaccccaccgacaagaccagcuccauccagagccggccgcuccccuccccccccaaguucacgagccaggacuccccggacggccaguacgagaacagcgaggggggcuggauggaggacuacgacuacgugcaccugcagggcaaggaggaguucgagaagacccagaaggagcugcucgagaagggguccaucacccgccagggcaagagccagcuggagcugcagcagcucaagcaguucgagcggcuggagcaggaggugucccgccccaucgaccacgaccuggcgaacuggacccccgcccagccccucgccccggggcggacgggcgggcugggccccagcgaccgccagcugcuccuguucuaccuggagcagugcgaggccaaccucaccacccugaccaacgcggucgacgccuucuucacggccguggccaccaaccagccccccaagaucuucguggcccacuccaaguucgucauccugagcgcgcacaagcucguguucaucggcgacacccugagccggcaggccaaggccgccgacgugcgcucccaggucacccacuacagcaaccugcucugcgaccugcugcgggggaucguggccaccacgaaggcggccgcccuccaguacccgucccccagcgccgcccaggacaugguggagcgcgucaaggagcugggccacuccacccagcaguuccggcgcgugcuggggcagcucgcggccgccuga

SEQ ID NO: 27198 - RNA, 1755 nt, Artificial Sequence
  derived and/or modified sequence opt1 from BCAS1__Homo_sapiens__NP_003648
augggcaaccagaugagcgugccccagcgcgucgaggaccaggagaacgagccggaggccgagaccuaccaggacaacgccuccgcgcugaacggggugcccguggucgugagcacccacacggugcagcaccucgaggaggucgaccugggcaucuccgugaagaccgacaacguggccaccagcucccccgagaccacggagaucagcgccgucgccgacgccaacgggaagaaccugggcaaggaggcgaagcccgaggccccggccgccaagucccgguucuuccucaugcugagccgccccgugcccgggcggaccggcgaccaggcggccgacuccagccugggcuccgugaagcucgacgucagcuccaacaaggcccccgccaacaaggacccgagcgaguccuggacccugcccguggccgcggggcccggccaggacaccgacaagacgcccgggcacgccccggcccaggacaaggugcugagcgccgcccgcgaccccacccuccugccgcccgagaccggcggggcgggcggcgaggcccccuccaagcccaaggacagcuccuucuucgacaaguucuucaagcuggacaaggggcaggagaagguccccggcgacagccagcaggaggccaagcgggccgagcaccaggacaagguggacgaggugcccgggcucagcggccaguccgacgacgucccggccggcaaggacaucguggacgggaaggagaaggagggccaggagcuggggaccgcggacugcagcgugcccggcgaccccgaggggcuggagacggccaaggacgacucccaggccgccgccaucgcggagaacaacaacagcaucauguccuucuucaagacccucgucagccccaacaaggccgagaccaagaaggacccggaggacaccggcgccgagaagucccccacgaccagcgccgaccugaaguccgacaaggcgaacuucaccagccaggagacccagggcgccgggaagaacuccaagggcugcaaccccagcgggcacacgcaguccgugaccacccccgagccggccaaggagggcaccaaggagaaguccgggcccacgagccugccccucggcaagcuguucuggaagaaguccgugaaggaggacagcgucccgaccggcgccgaggagaacguggucugcgagagccccguggagaucaucaaguccaaggagguggagagcgcccugcagaccgucgaccucaacgagggggacgcggcccccgagcccaccgaggccaagcugaagcgcgaggagagcaagccgcggacgucccugauggccuuccuccgccagaugagcgugaagggcgacgggggcaucacccacuccgaggagaucaacgggaaggacagcuccugccagaccagcgacuccaccgagaagacgaucaccccgcccgagcccgagcccaccggcgcgccccagaagggcaaggaggggagcuccaaggacaagaaguccgccgccgagaugaacaagcagaaguccaacaagcaggaggccaaggagcccgcccagugcaccgagcaggccacgguggacaccaacagccugcagaacggcgacaagcugcagaagcggcccgagaagcgccagcagagccucgggggcuucuucaagggccuggggccgaagcggaugcuggacgcgcagguccagaccgaccccgugagcaucggccccguggggaaguccaaguga

SEQ ID NO: 27199 - RNA, 2787 nt, Artificial Sequence
  derived and/or modified sequence opt1 from BCAS3__Homo_sapiens__NP_001092902
augaacgaggccauggccaccgacagcccccgccggccgucccgcugcaccggcgggguggucgugcggccccaggcggugacggagcagagcuacauggaguccgucgugaccuuccugcaggacguggucccccaggccuacagcggcacgccccucaccgaggagaaggagaagaucgugugggugcgcuucgagaacgccgaccugaacgacaccucccggaaccuggaguuccacgagauccacagcaccgggaacgagccgccccuccugaucaugaucggcuacuccgacgggaugcaggucuggagcauccccaucuccggcgaggcccaggagcuguucagcgugcgccacggccccauccgggccgcgcgcauccucccggcgccccaguucggggcccagaagugcgacaacuucgccgagaagcggccccugcugggcgugugcaaguccaucgggagcuccggcaccagcccgcccuacugcugcgucgaccucuacucccugcgcaccggggagauggugaaguccauccaguucaagacgcccaucuacgaccugcacugcaacaagcggauccucguggucgugcugcaggagaagaucgccgccuucgacuccugcaccuucaccaagaaguucuucgugaccagcugcuaccccugccccggcccgaacaugaaccccaucgcccugggcucccgcuggcucgccuacgccgagaacaagcugauccggugccaccagagccgcgggggcgcgugcggggacaacauccagagcuacacggccaccgucaucuccgccgccaagacccucaagagcggccugaccauggugggcaagguggucacgcagcugaccgggacccugcccuccggcgugaccgaggacgacguggccauccacagcaacucccggcgcagcccccucgucccggggaucaucacggugaucgacaccgagaccgucggcgagggccaggugcugguguccgaggacagcgacuccgacgggaucgucgcgcacuuccccgcccacgagaagcccgugugcugcauggccuucaacaccagcggcaugcugcucgugacgaccgacacccuggggcacgacuuccacgucuuccagauccugacccaccccugguccagcucccagugcgccgugcaccaccucuacacgcugcaccggggcgagaccgaggccaaggugcaggacaucugcuucagccacgacugccgcugggucgugguguccacccugcgggggaccagccacgucuucccgaucaaccccuacggcgggcagcccugcgugcgcacgcacaugagcccccggguggucaaccgcaugagccgcuuccagaaguccgcgggccucgaggagaucgagcaggagcugaccagcaagcagggcgggcggugcagcccggugcccggccuguccagcucccccagcggguccccgcuccacggcaagcugaacagccaggacuccuacaacaacuucaccaacaacaaccccgggaacccccgccugagcccccucccgucccugaugguggucaugccccuggcccagaucaagcagcccaugacccucggcacgaucaccaagcggaccggccccuaccuguucggggccggcugcuucagcaucaaggccccgugcaaggugaagcccccgccccagaucucccccagcaaguccaugggcggggaguucugcguggccgcgaucuucggcaccagccgcuccugguucgccaacaacgccgggcugaagcgggagaaggaccagagcaagcaggucgugguggagucccucuacaucaucagcugcuacggcacccuggucgagcacaugauggagccccgcccccugagcacggcccccaagaucuccgacgacaccccgcucgagaugaugaccagcccccgggcguccuggacccuggugcgcacgccccaguggaacgagcugcagcccccguucaacgccaaccacccccuccugcuggccgccgacgccgugcaguacuaccaguuccugcucgcggggcuggucccgcccggcagccccgggcccaucacccggcacggcuccuacgacagccuggccuccgaccacagcggccaggaggacgaggaguggcucucccagguggagaucgugacccacaccgggccccaccgccggcuguggaugggcccgcaguuccaguucaagacgauccaccccagcgggcagaccaccgucaucuccagcuccagcuccgugcugcagagccacggccccuccgacacgccccagccgcuccuggacuucgacaccgacgaccuggaccucaacagccugcgcauccagcccgugcgguccgaccccgucagcaugcccgggagcucccgcccggugagcgaccggcgcggcguguccaccgucaucgacgccgccagcggcaccuucgaccgguccgugacccugcucgaggugugcgggagcuggcccgagggcuucgggcugcgccacauguccagcauggagcacacggaggagggccugcgggagcgccucgccgacgcgauggccgagucccccagccgcgacgucgugggguccggcaccgagcugcagcgggagggcagcaucgagacccuguccaacagcuccgggagcaccuccggcagcaucccccgcaacuucgacggguaccgguccccgcuccccacgaacgagagccagccccugagccuguuccccaccggcuucccguga

SEQ ID NO: 27200 - RNA, 477 nt, Artificial Sequence
  derived and/or modified sequence opt1 from BCAS4__Homo_sapiens__NP_001010974
augcagcgcaccggcgggggcgcgccccggccggggcgcaaccacggccugcccgggagccuccggcagcccgaccccguggcccugcugaugcuccuggucgacgccgaccagccggagcccaugcgcuccggcgcccgggagcuggcccucuuccugacccccgagcccggcgccgaggccaaggagguggaggagacgaucgaggggaugcugcuccgccuggaggaguucugcagccuggcggaccucauccgguccgacaccagccagauccuggaggagaacaucccggugcugaaggccaagcucaccgagaugcgcggcaucuacgccaaggucgaccggcuggagaagucccccgcccccgugcccgugaccuacgagcugccgacgcucuaccgcaccgaggacuacuuccccgucgacgcgggggaggcccagcaccacccccggaccugcccccgcccgcuguga

SEQ ID NO: 27201 - RNA, 1050 nt, Artificial Sequence
  derived and/or modified sequence opt1 from BCAT1__Homo_sapiens__NP_001171562
augaaggacugcagcaacggcugcuccgccgagugcaccggggagggcgggagcaaggagguggucggcaccuucaaggccaaggaccugaucgugacgcccgcgaccauccucaaggagaagccggaccccaacaaccugguguucgggaccgucuucaccgaccacaugcugacgguggagugguccagcgaguucggcugggagaagccccacaucaagccccuccagaaccugucccugcacccgggcagcuccgcccuccacuacgccguggaggucuucgacaaggaggagcugcuggagugcauccagcagcucgugaagcuggaccaggagugggugcccuacagcaccuccgccagccuguacauccgccccaccuucaucgggaccgagcccucccucggcgucaagaagccgacgaaggcccugcuguucgugcuccugagccccguggggcccuacuucuccagcggcaccuucaaccccgucucccugugggcgaacccgaaguacgugcgggccuggaagggcgggaccggcgacugcaagaugggcgggaacuacgggagcucccucuucgcccagugcgaggccguggacaacggcugccagcagguccuguggcuguacggcgaggaccaccagaucaccgagguggggacgaugaaccucuuccuguacuggaucaacgaggacggcgaggaggagcuggcgaccccgccccucgacgggaucauccugcccggcgugacccgccggugcauccuggaccucgcccaccaguggggcgaguucaaggucagcgagcgcuaccugaccauggacgaccugacgaccgcccucgaggggaaccgggugcgcgagauguucggcuccgggaccgccugcguggucugccccgugagcgacauccuguacaagggcgagaccauccacauccccacgauggagaacgggcccaagcuggccagccggauccucuccaagcugaccgacauccaguacggccgcgaggagagcgacuggaccaucgugcuguccuga

SEQ ID NO: 27202 - RNA, 903 nt, Artificial Sequence
  derived and/or modified sequence opt1 from BCAT2__Homo_sapiens__NP_001158245
auggccgccgcggcccugggccagcuguucgaggggaugaaggccuucaagggcaaggaccagcagguccgccucuuccggcccuggcugaacauggaccgcaugcuccggagcgccaugcgccugugccugccguccuucgacaagcucgagcugcuggagugcauccggcgccucaucgagguggacaaggacugggugcccgacgccgcggggaccagccuguacgugcggcccguccugaucggcaacgagcccucccucggggugagccagccgacccgcgcccugcuguucgugauccucugccccgucggcgccuacuuccccggcggguccgugacgcccgugagccugcuggccgacccggcguucauccgggccugggucggcggggugggcaacuacaagcucgggggcaacuacggccccaccgugcugguccagcaggaggcccugaagcgcgggugcgagcagguccucuggcuguacggccccgaccaccagcugaccgagguggggaccaugaacaucuucguguacuggacgcacgaggacggcgugcucgagcuggugacgcccccgcugaacggcgucauccuccccgggguggugcggcagucccugcuggacauggcccagaccuggggcgaguuccgcgucguggagcggaccaucaccaugaagcagcuccugcgcgcccuggaggaggggcgggugcgcgaggucuucggcagcgggaccgcgugccaggugugccccguccaccggauccucuacaaggaccgcaaccugcacauccccaccauggagaacggcccggagcugauccuccgguuccagaaggagcugaaggagauccaguacggcauccgcgcccacgaguggauguuccccguguga

SEQ ID NO: 27203 - RNA, 969 nt, Artificial Sequence
  derived and/or modified sequence opt1 from BCCIP__Homo_sapiens__NP_057651
auggccagccgcuccaagcggcgcgccguggagagcggcgucccccagccgcccgacccgcccgugcagcgggacgaggaggaggagaaggagguggagaacgaggacgaggacgacgacgacuccgacaaggagaaggacgaggaggacgaggucaucgacgaggaggugaacaucgaguucgaggcguacagccuguccgacaacgacuacgacgggaucaagaagcuccugcagcagcuguuccucaaggcccccgugaacaccgccgagcugaccgaccugcucauccagcagaaccacaucggcagcgucaucaagcagacggacguguccgaggacagcaacgacgacauggacgaggacgagguguucggguucaucucccugcugaaccucaccgagcgcaagggcacccagugcgucgagcagauccaggagcuggugcugcgguucugcgagaagaacugcgagaaguccaugguggagcagcucgacaaguuccugaacgacaccacgaagcccgucgggcugcuccugagcgagcgcuucaucaacgugccgccccagaucgcccugcccauguaccagcagcuccagaaggagcuggccggcgcgcaccggaccaacaagcccugcggcaagugcuacuucuaccugcucaucagcaagaccuucguggaggccgggaagaacaacuccaagaagaagcccagcaacaagaagaaggccgcccugauguucgcgaacgccgaggaggaguucuucuacgaggagcagggcaagcccgagguccucgggggcccggacacccgccgggggcuggagcccgugcccauccagcacaacggcggcucccgcggccaggugacggcccuggucagccugaaggccgggcucauccagucccggagcacccuguccgacuuccaggggaccuucaugaccgugggcaucgcccugagcuga

SEQ ID NO: 27204 - RNA, 879 nt, Artificial Sequence
  derived and/or modified sequence opt1 from BCDIN3D__Homo_sapiens__NP_859059
auggccgugcccaccgagcuggacggcgggagcgucaaggagaccgccgcggaggaggagucccgcgugcucgccccgggcgccgcccccuucgggaacuucccccacuacagccgguuccacccgcccgagcagcgccugcggcugcucccgcccgagcugcugcgccagcuguuccccgagucccccgagaacggccccauccuggggcuggacgugggcugcaacagcggcgaccucuccgucgcccuguacaagcacuuccugagccuccccgacggggagacgugcuccgacgcgagccgggaguuccgccugcugugcugcgacaucgaccccgugcucgugaagcgggccgagaaggagugcccguuccccgacgcccugaccuucaucacccuggacuucaugaaccagcgcacccggaagguccuccuguccagcuuccugucccaguucggccgcagcguguucgacaucggguucugcauguccaucacgauguggauccaccucaaccacggcgaccacgggcugugggaguuccuggcccaccucagcucccugugccacuaccugcucguggagccccagcccuggaagugcuaccgggcggccgcccgccggcugcgcaagcugggccuccacgacuucgaccacuuccacagccuggccauccggggcgacaugccgaaccagaucguccagauccugacccaggaccacgggauggagcucaucugcugcuucggcaacaccuccugggaccgcagccugcuccucuuccgggccaagcagaccaucgagacgcaccccauccccgagucccugaucgagaaggggaaggagaagaaccgccugagcuuccagaagcaguga

SEQ ID NO: 27205 - RNA, 1809 nt, Artificial Sequence
  derived and/or modified sequence opt1 from BCHE__Homo_sapiens__NP_000046
augcacagcaaggugaccaucaucugcauccgcuuccuguucugguuccuccugcugugcaugcucaucggcaagucccacaccgaggacgacaucaucaucgccacgaagaacgggaagguccggggcaugaaccugaccguguucgggggcaccgugaccgccuuccuggggauccccuacgcgcagccgccccucggccgccugcgguucaagaagccccagagccugacgaagugguccgacaucuggaacgccaccaaguacgccaacagcugcugccagaacaucgaccaguccuuccccggcuuccacgggagcgagauguggaacccgaacaccgaccucuccgaggacugccuguaccugaacgucuggauccccgcccccaagcccaagaacgccaccgugcucaucuggaucuacggcgggggcuuccagacggggaccagcucccugcacguguacgacggcaaguuccuggcgcgcgucgagcgggugaucguggucagcaugaacuaccgcgugggcgcccucggguuccuggcccugccgggcaaccccgaggcccccgggaacaugggccucuucgaccagcagcuggcgcugcagugggugcagaagaacaucgccgccuucggcgggaaccccaaguccgucacccucuucggcgagagcgccggggccgcguccgugagccugcaccuccuguccccgggcagccacucccuguucacccgggccauccugcagagcggguccuucaacgcccccugggccgugacgagccucuacgaggcccgcaaccggacccugaaccuggcgaagcucaccggcugcagccgcgagaacgagaccgagaucaucaagugccugcggaacaaggacccccaggagauccugcucaacgaggccuucgucgugcccuacggcacgccgcuguccgugaacuucgggcccaccgucgacggcgacuuccugaccgacaugcccgacauccuccuggagcuggggcaguucaagaagacccagauccucgugggcgugaacaaggacgaggggacggccuuccuggucuacggcgcccccggcuucagcaaggacaacaacuccaucaucacccgcaaggaguuccaggaggggcugaagaucuucuucccgggcgugagcgaguucgggaaggaguccauccucuuccacuacaccgacuggguggacgaccagcggcccgagaacuaccgcgaggcccugggcgacgucgugggggacuacaacuucaucugccccgcgcuggaguucaccaagaaguucagcgaguggggcaacaacgccuucuucuacuacuucgagcaccgguccagcaagcuccccuggccggaguggaugggcgucaugcacggguacgagaucgaguucguguucggccugccccuggagcgccgggacaacuacacgaaggccgaggagauccucucccgcagcaucgugaagcggugggccaacuucgccaaguacgggaaccccaacgagacccagaacaacuccaccagcuggcccgucuucaaguccaccgagcagaaguaccugacgcugaacaccgagagcacccgcaucaugaccaagcugcgggcgcagcagugccgcuucuggacguccuucuucccgaaggugcucgagaugaccggcaacaucgacgaggccgagugggaguggaaggccggcuuccaccgcuggaacaacuacaugauggacuggaagaaccaguucaacgacuacaccagcaagaaggaguccugcguggggcuguga

SEQ ID NO: 27206 - RNA, 1338 nt, Artificial Sequence
  derived and/or modified sequence opt1 from BCKDHA__Homo_sapiens__NP_000700
auggccguggccaucgcggccgcccgcgucuggcggcugaaccgcggccucagccaggccgcccugcugcuccugcggcagcccggggcgcgcggccuggcccggucccacccgccccgccagcagcagcaguucagcucccucgacgacaagccccaguuccccggggccagcgccgaguucaucgacaagcuggaguucauccagccgaacgugaucuccggcauccccaucuaccgggugauggaccgccaggggcagaucaucaaccccagcgaggacccccaccucccgaaggagaagguccucaagcuguacaaguccaugacccugcucaacaccauggaccggauccuguacgagagccagcgccagggccggaucuccuucuacaugacgaacuacggcgaggaggggacccacgugggcagcgcggccgcccuggacaacaccgaccucguguucgggcaguaccgcgaggccggcguccugauguaccgggacuacccccuggagcuguucauggcccagugcuacgggaacaucuccgaccugggcaagggccgccagaugcccgugcacuacgggugcaaggagcggcacuucgugaccaucagcagcccccuggcgacgcagaucccgcaggccgucggcgccgccuacgccgcgaagcgcgccaacgccaaccggguggugaucugcuacuucggggagggcgccgccuccgagggcgacgcgcacgccggguucaacuucgccgccacccucgagugccccaucaucuucuucugccgcaacaacggcuacgccaucuccacccccaccagcgagcaguaccgcggggacggcaucgcggcccgggggcccggcuacggcaucauguccauccgggucgacgggaacgacguguucgccguguacaacgccacgaaggaggcgcgccgccgggccgucgccgagaaccagccguuccugaucgaggccaugaccuaccgcaucggccaccacagcaccuccgacgacagcagcgccuaccgguccguggacgaggugaacuacugggacaagcaggaccaccccaucagccgccugcggcacuaccuccugucccagggguggugggacgaggagcaggagaaggcguggcgcaagcagagccggcgcaaggucauggaggccuucgagcaggccgagcggaagcccaagcccaacccgaaccuccuguucuccgacguguaccaggagaugcccgcccagcugcgcaagcagcaggagagccuggcccggcaccuccagaccuacggcgagcacuacccccuggaccacuucgacaaguga

SEQ ID NO: 27207 - RNA, 1179 nt, Artificial Sequence
  derived and/or modified sequence opt1 from BCKDHB__Homo_sapiens__NP_000047
auggccguggucgccgcggccgccggcuggcugcuccgccugcgggccgccggggcggagggccacuggcgccggcugcccggggccggccucgcccgcggguuccugcacccggccgcgaccguggaggacgccgcccagcggcgccagguggcccacuucaccuuccagcccgaccccgagccccgggaguacggccagacgcagaagaugaaccuguuccagagcgucaccuccgcccucgacaacagccuggcgaaggacccgaccgccgugaucuucggcgaggacguggccuucgggggcgucuuccgcugcaccguggggcugcgggacaaguacggcaaggaccgcguguucaacacgccccucugcgagcaggggaucgucggcuucggcaucgggaucgccgugaccggcgccaccgcgaucgccgagauccaguucgccgacuacaucuuccccgccuucgaccagaucgugaacgaggccgcgaaguaccgguaccgcuccggggaccuguucaacugcggcagccugaccauccggucccccuggggcugcgucgggcacggcgcccucuaccacagccaguccccggaggccuucuucgcccacugccccgggaucaagguggugaucccccgcagccccuuccaggccaagggccugcugcucuccugcaucgaggacaagaacccgugcaucuucuucgagcccaagauccuguaccgggcggccgccgaggagguccccaucgagcccuacaacaucccgcugagccaggccgaggugauccaggagggguccgacgugacgcucgucgcguggggcacccaggugcacgugauccgcgaggucgccagcauggccaaggagaagcugggcguguccugcgaggugaucgaccugcggaccaucauccccugggacgucgacaccaucugcaagagcgugaucaagacggggcgccuccugaucucccacgaggcgccccugaccggcggguucgccagcgagaucuccagcaccguccaggaggagugcuuccucaaccuggaggcccccaucucccgggugugcggcuacgacaccccguucccccacaucuucgagcccuucuacauccccgacaaguggaagugcuacgacgcccugcgcaagaugaucaacuacuga

SEQ ID NO: 27208 - RNA, 1098 nt, Artificial Sequence
  derived and/or modified sequence opt1 from BCKDK__Homo_sapiens__NP_001116429
augauccuggccagcgugcuccgcuccggccccgggggcgggcugccgcugcggccccuccugggccccgcccuggcgcuccgcgcccggagcaccuccgccaccgacacgcaccacgucgagauggcccgcgagcggagcaagaccgugaccuccuucuacaaccagagcgccaucgacgcggccgccgagaagcccuccgugcgccugaccccgacgaugaugcuguacgccgggcggagccaggacggcucccaccuccucaagagcgcgcgcuaccugcagcaggagcuccccguccggaucgcccaccgcaucaagggcuuccggugccugcccuucaucaucgggugcaaccccaccauccugcacgugcacgagcucuacauccgcgccuuccagaagcugaccgacuucccgcccaucaaggaccaggccgacgaggcccaguacugccagcuggugcggcagcuccuggacgaccacaaggacgucgugacccugcucgcggagggccugcgcgagucccggaagcacaucgaggacgagaagcuggugcgcuacuuccucgacaagacgcugaccagccggcuggggauccgcaugcucgccacccaccaccuggcccugcacgaggacaagcccgacuucgucggcaucaucugcacccggcucucccccaagaagaucaucgagaaguggguggacuucgcccgccggcugugcgagcacaaguacgggaacgccccgcgcgugcgcaucaacggccacgucgcggcccgguuccccuucauccccaugccccuggacuacauccucccggagcugcugaagaacgccaugcgcgccacgauggagagccaccucgacacccccuacaacgugcccgacguggucaucaccaucgccaacaacgacguggaccugaucauccggaucuccgaccgcggcgggggcaucgcgcacaaggaccuggaccgggugauggacuaccacuucaccacggccgaggccagcacccaggacccccgcaucuccccgcuguucgggcaccuggacaugcacagcggcgcccaguccggccccaugcacggguga

SEQ ID NO: 27209 - RNA, 648 nt, Artificial Sequence
  derived and/or modified sequence opt1 from BCL10__Homo_sapiens__XP_011540701
auggcccuggagaaccuccgcguguaccugugcgagaagaucaucgccgagcggcacuucgaccaccuccgcgcgaagaagauccugagccgggaggacaccgaggagaucuccugccgcaccagcucccggaagcgcgccggcaagcugcuggacuaccuccaggagaaccccaaggggcuggacacgcuggucgagagcauccggcgcgagaagacccagaacuuccucauccagaagaucaccgacgaggugcugaagcugcggaacaucaagcucgagcaccugaagggccugaagugcuccagcugcgagccguuccccgacggggccaccaacaaccucucccgcagcaacuccgacgagagcaacuucuccgagaagcugcgggccagcacggugauguaccaccccgagggcgaguccagcaccacccccuucuucuccaccaacagcucccugaaccucccgguccuggagguggggcgcacggagaacaccaucuucagcuccaccacccugccccggcccggcgaccccggcgccccgccccucccgcccgaccugcagcuggaggaggaggggacgugcgcgaacagcagcgagauguuccucccccugcgcucccggaccgugagccgccaguga

SEQ ID NO: 27210 - RNA, 2322 nt, Artificial Sequence
  derived and/or modified sequence opt1 from BCL11A__Homo_sapiens__NP_060484
augagccgccggaagcagggcaagccccagcaccuguccaagcgcgaguucagcccggagccccucgaggccauccugaccgacgacgagcccgaccacgggccccugggcgccccggagggggaccacgaccuccugaccugcggccagugccagaugaacuucccccugggggacauccucaucuucaucgagcacaagcggaagcagugcaacggcucccugugccuggagaaggcgguggacaagccccccagcccgucccccaucgagaugaagaaggccagcaaccccgucgaggugggcauccaggugacgcccgaggacgacgacugccucuccaccagcucccgcgggaucugcccgaagcaggagcacaucgccgacaagcugcugcacuggcggggccucagcuccccccgcagcgcccacggggcccugauccccacccccggcauguccgcggaguacgccccgcaggggaucugcaaggacgagcccagcuccuacaccugcacgaccugcaagcagcccuucaccagcgccugguuccugcuccagcacgcccagaacacccacggccugcggaucuaccuggaguccgagcacggcagcccccucacgccgcgcgucgggauccccuccggccugggggcggagugccccagccagcccccgcugcacggcauccacaucgccgacaacaaccccuucaaccuccugcggauccccggcagcgugucccgcgaggccagcgggcuggccgagggccgguuccccccgacccccccccucuucuccccgcccccccgccaccaccuggacccccaccggaucgagcgccugggggccgaggagauggcgcucgccacccaccacccgagcgccuucgaccgggugcugcgccugaaccccauggccauggagccccccgccauggacuucucccggcgccuccgggagcuggcgggcaacaccagcuccccgccccugagccccgggcgccccuccccgaugcagcggcuccugcagcccuuccagcccggcagcaagcccccguuccuggccacgcccccccuccccccgcugcaguccgcccccccccccagccagccgcccgucaaguccaagagcugcgaguucugcggcaagaccuucaaguuccaguccaaccugguggugcaccgccgcagccacaccggggagaagcccuacaagugcaaccucugcgaccacgccugcacccaggccuccaagcugaagcggcacaugaagacgcacaugcacaagagcuccccgaugaccgucaagagcgacgacggccugagcaccgcguccagccccgagcccgggaccuccgaccucgugggcagcgccuccagcgcccugaaguccguggucgccaaguucaagagcgagaacgaccccaaccugaucccggagaacggggacgaggaggaggaggaggacgacgaggaggaggaggaggaggaggaggaggaggaggaggagcucacggaguccgagcgcguggacuacggcuucggccugagccuggaggccgcgcggcaccacgagaacuccagccgcggggccguggucggcgugggggacgagucccgggcccuccccgacgugaugcagggcaugguccugagcuccaugcagcacuucagcgaggccuuccaccaggugcugggggagaagcacaagcgcggccaccuggcggaggccgagggccaccgggacaccugcgacgaggacuccguggccggggagagcgaccgcaucgacgacggcaccgucaacgggcggggcugcagccccggcgaguccgccagcgggggccucuccaagaagcugcugcucgggagccccuccagccuguccccguucagcaagcgcaucaagcuggagaaggaguucgaccucccccccgccgcgaugcccaacaccgagaacguguacucccaguggcuggccggcuacgccgccagccggcagcugaaggacccguuccucuccuucggggacagccgccagucccccuucgccagcuccagcgagcacuccagcgagaacggcucccugcgguucagcacgccccccggcgagcuggacgggggcaucagcgggcgcuccggcaccgggagcggcggcuccaccccgcacaucagcgggcccggccccgggcggcccuccagcaaggagggccgccgguccgacaccugcagcucccacacgccgauccgccggagcacccagcgcgcgcaggacguguggcaguucuccgacgggagcucccgcgcccucaaguucuga

SEQ ID NO: 27211 - RNA, 2472 nt, Artificial Sequence
  derived and/or modified sequence opt1 from BCL11B__Homo_sapiens__NP_075049
augagccgccggaagcagggcaacccccagcaccugucccagcgcgagcucaucaccccggaggccgaccacguggaggccgcgauccuggaggaggacgaggggcuggagaucgaggagcccagcggccucgggcugauggucggcgggcccgaccccgaccugcucaccugcggccagugccagaugaacuucccgcugggcgacauccugguguucaucgagcacaagcggaagcagugcgggggcucccucggggccugcuacgacaaggcccuggacaaggacagccccccccccuccagccgcuccgagcugcggaaggugagcgagccggucgagaucggcauccaggugacgcccgacgaggacgaccaccuccugucccccaccaaggggaucugccccaagcaggagaacaucgccggcaaggacgagccgagcuccuacaucugcaccaccugcaagcagcccuucaacagcgccugguuccugcuccagcacgcgcagaacacgcacggcuuccgcaucuaccuggagcccgggcccgccuccagcucccugaccccgcggcucaccaucccccccccccugggcccggaggccguggcccagagcccccugaugaacuuccucggggacuccaaccccuucaaccugcugcgcaugaccggccccauccuccgggaccacccgggcuucggggagggccgccugcccgggacgcccccccuguucagcccgcccccccggcaccaccucgacccgcaccgccuguccgcggaggagaugggccuggucgcccagcaccccagcgccuucgaccgggugaugcgccucaaccccauggccaucgacagccccgccauggacuucucccggcgccugcgggagcuggcggggaacagcuccaccccgccccccgugagccccggccgcggcaacccgaugcaccggcuccugaaccccuuccagcccucccccaagagcccguuccuguccacccccccccuccccccgaugccccccgggggcacccccccgccccagccccccgccaagagcaaguccugcgaguucugcgggaagacguucaaguuccagagcaaccugaucguccaccgccggucccacaccggcgagaagccguacaagugccagcugugcgaccacgccugcagccaggccuccaagcucaagcgccacaugaagacccacaugcacaaggccgggagccuggcgggccgcuccgacgacggccugagcgccgccuccagccccgagcccgggaccuccgagcucgccggcgaggggcugaaggccgcggacggcgacuuccggcaccacgagagcgacccgagccuggggcacgagcccgaggaggaggacgaggaggaggaggaggaggaggaggagcuccugcuggagaacgagucccgccccgagagcuccuucagcauggacuccgagcucagccggaaccgcgagaacggcggcgggggcgugcccggggugccgggcgccggcgggggcgccgccaaggcccuggcggacgagaaggcccugguccuggggaaggugauggagaacgugggccucggggcccugccccaguacggcgagcugcucgccgacaagcagaagcggggcgcguuccugaagcgcgccgccgggggcggggacgccggcgacgacgacgacgccgggggcugcggcgacgcgggggccggcggggccgucaacggccgggggggcggcuucgcccccgggacggagcccuucccgggccuguucccccgcaagcccgccccccucccgucccccgggcugaacagcgcggccaagcggaucaagguggagaaggaccuggagcucccccccgccgcccugaucccguccgagaacguguacagccaguggcuggucggcuacgccgcgucccgccacuucaugaaggaccccuuccucggguucaccgacgcccggcagagccccuucgccaccuccagcgagcacuccagcgagaacggcucccugcgcuucagcacccccccgggcgaccugcucgacgggggccugagcgggcgguccggcacggccagcggcggguccaccccccaccugggcgggcccggccccgggcgcccgagcuccaaggagggccggcgcagcgacaccugcgaguacugcggcaagguguucaagaacugcuccaaccucaccgugcaccggcgcagccacacgggggagcggcccuacaagugcgagcugugcaacuacgcgugcgcccaguccagcaagcugacccgccacaugaagacccacggccagaucgggaaggaggucuaccgcugcgacaucugccagaugcccuucuccguguacagcacccucgagaagcacaugaagaaguggcacggcgagcaccugcugacgaacgacgugaagaucgagcaggccgagcgguccuga

SEQ ID NO: 27212 - RNA, 492 nt, Artificial Sequence
  derived and/or modified sequence opt1 from BCL2A1__Homo_sapiens__NP_001108207
augaccgacugcgaguucggcuacaucuaccgccuggcccaggacuaccuccagugcgugcugcagaucccccagccggggagcggccccuccaagaccagccggguccugcagaacguggccuucuccgugcagaaggaggucgagaagaaccucaagagcugccuggacaacgugaacguggucuccguggacacggcgcgcacccuguucaaccaggugauggagaaggaguucgaggacgggaucaucaacuggggccggaucgucaccaucuucgccuucgaggggauccucaucaagaagcugcugcgccagcagaucgcccccgacguggacaccuacaaggagaucagcuacuucguggccgaguucaucaugaacaacacgggcgaguggauccggcagaacggcggguggggcaaguggcacaaccacacccccaugcucgucgaguccguggcccacaagaagcgcaagauggcgcuguga

SEQ ID NO: 27213 - RNA, 720 nt, Artificial Sequence
  derived and/or modified sequence opt1 from BCL2__Homo_sapiens__NP_000624
auggcccacgccggccgcaccggguacgacaaccgggagaucgugaugaaguacauccacuacaagcugagccagcgcggcuacgagugggacgcgggggacgucggcgccgcgcccccgggggccgcccccgcccccggcaucuucuccagccagcccggccacaccccgcaccccgccgccucccgggaccccguggcccgcacgagcccccuccagaccccggcggcccccggggccgccgccggccccgcgcugucccccgugccgcccgucgugcaccugacccuccggcaggccggggacgacuucagccgccgguaccgccgggacuucgccgagauguccagccagcugcaccugacccccuucacggcccgcggccgguucgccaccguggucgaggagcuguuccgcgacggggugaacuggggccggaucguggcguucuucgaguucggcggggucaugugcguggaguccgugaaccgcgagaugagcccccuggucgacaacaucgcccuguggaugaccgaguaccucaaccggcaccuccacaccuggauccaggacaacggcgggugggacgccuucguggagcuguacggcccguccaugcgcccccucuucgacuucagcuggcugucccugaagacgcuccugagccuggcccucgugggcgccugcaucacccugggggcguaccugggccacaaguga

SEQ ID NO: 27214 - RNA, 615 nt, Artificial Sequence
  derived and/or modified sequence opt1 from BCL2L10__Homo_sapiens__NP_065129
augguggaccagcugcgcgagcggaccaccauggccgacccccuccgcgagcggacggagcugcugcucgccgacuaccugggcuacugcgcgcgcgagccggggacccccgagcccgcccccagcaccccggaggccgccguccugcgguccgccgcggcccgccuccggcagauccaccgcagcuucuucuccgccuaccugggcuaccccgggaaccgguucgagcugguggcccucauggcggacagcgugcuguccgacagccccggccccaccugggggcgcgucgugacgcuggugaccuucgccggcacccuccuggagcggggcccgcuggucaccgcccgcuggaagaaguggggguuccagccccggcucaaggagcaggagggcgacguggcccgcgacugccagcggcugguggcccugcucuccagccgccugauggggcagcaccgggcguggcugcaggcccagggcgggugggacggcuucugccacuucuuccgcacgcccuucccccucgccuucuggcggaagcagcugguccaggccuuccuguccugccuccugaccaccgccuucaucuaccuguggacccgccuccuguga

SEQ ID NO: 27215 - RNA, 258 nt, Artificial Sequence
  derived and/or modified sequence opt1 from BCL2L11__Homo_sapiens__NP_001191036
auggccaagcagcccagcgacguguccagcgagugcgaccgcgagggccggcagcugcagccggccgagcgcccgccccagcuccggcccggggcgcccaccucccugcagaccgagccccaggccagcaugcgccaggccgagcccgccgacaugcggcccgagaucuggaucgcccaggagcugcgccggaucggcgacgaguucaacgcguacuacgcccgccggcucgccaagcugcuggccuccagcacguga

SEQ ID NO: 27216 - RNA, 1002 nt, Artificial Sequence
  derived and/or modified sequence opt1 from BCL2L12__Homo_sapiens__NP_001035758
augggccgccccgccgggcuguucccgccccucugccccuuccugggcuuccggcccgaggccugcugggagcgccacaugcagaucgagcgggcgccgagcgugccgcccuuccugcgcugggccggguaccggcccggccccguccgccggcgcgggaagguggagcucaucaaguucgugcggguccaguggcgccggccccagguggaguggcgccggcgccgguggggccccggccccggggccuccauggccggcagcgaggagcuggggcugcgcgaggacacccuccgggugcuggccgcguuccugcgccggggcgaggccgccggguccccgguccccaccccgcccagccccgcccaggaggagcccacggacuuccucucccgccugcggcgcugccugcccugcagccucggccgcggcgcggcccccuccgagagcccgcggcccugcucccugcccauccgccccugcuacgggcuggagccgggccccgccacccccgacuucuacgcccucguggcccagcggcuggagcagcuggugcaggagcagcucaagagcccgcccucccccgagcugcaggggcccccgagcaccgagaaggaggcgauccugcgccggcucgucgcccugcuggaggaggaggccgaggugaucaaccagaagcucgccuccgaccccgcccugcgcagcaagcuggugcggcucuccagcgacuccuucgcgcgccuggucgagcuguucugcagccgggacgacuccagccgccccagccgggccugccccggcccgcccccgcccucccccgagccccucgcccgccuggcccuggccauggagcucagccggcgcguggcgggccucgggggcacccuggccgggcuguccguggagcacguccacagcuucacgcccuggauccaggcccacggcgggugggagggcauccuggccgugucccccguggaccugaaccucccgcuggacuga

SEQ ID NO: 27217 - RNA, 1386 nt, Artificial Sequence
  derived and/or modified sequence opt1 from BCL2L13__Homo_sapiens__NP_001257656
augagcggcuccagcgggcccgccccgacccccgccgugaccaaggcgcgccggggcgaccugacgcuccagcacgggggcgggggccgccugggcccccgggucggggcccugaccgccgccggcgggcccugccgcaagcagcucccgcccccgccccuguccagccugcucggccaggggcccggccccggcgugcagcuggacaucgccucccagagccuggaccaggagauccuccugaaggugaagaccgagaucgaggaggagcugaagucccucgacaaggagaucagcgaggcguucaccuccacgggguucgaccggcacaccagccccgucuucucccccgccaacccggagagcuccauggaggacugccuggcccaccugggcgagaaggugagccaggagcucaaggagccccugcacaaggcccugcagaugcuccugucccagcccgugaccuaccaggcguuccgcgagugcacccuggagacgaccguccacgccagcggguggaacaagggcaccguguucucccucgagagcgaggaggaggaguaccccggcaucaccgccgaggacuccaacgacaucuacauccugccgagcgacaacagcggccagguguccccgcccgagagccccacggucaccaccuccuggcagagcgagucccugcccgugagccucuccgccagccaguccuggcacaccgagagccugcccgugucccuggggcccgagagcuggcagcagaucgccauggaccccgaggaggucaagucccucgacagcaacggggcgggcgagaaguccgagaacaacagcuccaacagcgacaucgugcacguggagaaggaggaggucccggaggggauggaggaggccgccguggccuccgugguccugcccgcccgggagcugcaggaggcgcuccccgaggcccccgccccgcugcugccccacaucacggccaccagccuccugggcacccgcgagcccgacaccgaggugaucacgguggagaaguccagcccggccaccagccuguucgucgagcucgacgaggaggaggugaaggcggccaccaccgagcccacggagguggaggaggucgugcccgcccuggagcccaccgagacccugcucuccgagaaggagaucaacgcccgggaggagagccuggucgaggagcuguccccggccagcgagaagaagcccgugccgcccuccgagggcaagagccgccucucccccgcgggggagaugaagcccaugccccugagcgagggcaaguccauccuccuguucgggggcgccgccgccguggcgauccuggccgucgccaucgggguggcccuggcccuccggaagaaguga

SEQ ID NO: 27218 - RNA, 759 nt, Artificial Sequence
  derived and/or modified sequence opt1 from BCL2L14__Homo_sapiens__NP_110393
augugcagcaccuccggcugcgaccuggaggagaucccccucgacgacgacgaccugaacaccaucgaguucaagauccuggccuacuacacgcgccaccacguguucaagagcaccccggcccucuucucccccaagcugcugcggacccgcagccucucccagcgggggcugggcaacugcagcgcgaacgaguccuggaccgaggucagcuggcccugccgcaacucccagagcuccgagaaggccaucaaccuggggaagaagaaguccagcuggaaggccuucuucggcgugguggagaaggaggacagccaguccacgcccgccaaggucagcgcccaggggcagcggacccucgaguaccaggacucccacagccagcaguggucccgcugccugagcaacguggagcagugccuggagcacgaggcgguggacccgaaggucaucagcaucgccaaccggguggccgagaucguguacuccuggcccccgccccaggccacccaggcgggcggcuucaagagcaaggagaucuucgucaccgaggggcucuccuuccagcugcagggccacgugcccguggccagcuccagcaagaaggacgaggaggagcagauccuggccaagaucgucgagcuccugaaguacuccggggaccagcuggagcgcaaggacacggccuucauccccaucccccucguggacaccagcauccagggcuucccccaggacgggcugauggccugcaucuga

SEQ ID NO: 27219 - RNA, 513 nt, Artificial Sequence
  derived and/or modified sequence opt1 from BCL2L1__Homo_sapiens__NP_001182
augagccaguccaaccgcgagcugguggucgacuuccucagcuacaagcugucccagaagggcuacagcuggucccaguucagcgacguggaggagaaccggaccgaggcccccgaggggaccgaguccgagauggagacgccgagcgccaucaacggcaaccccuccuggcaccuggcggacagccccgccgugaacggggccaccggccacuccagcucccucgacgcccgcgaggucauccccauggccgcggugaagcaggcccugcgggaggccggggacgaguucgagcugcgcuaccggcgcgccuucagcgaccucaccucccagcugcacaucaccccgggcacggcguaccagagcuucgagcaggacaccuucguggagcuguacggcaacaacgccgccgccgagucccggaaggggcaggagcgcuucaaccggugguuccucaccggcaugaccgucgccgggguggugcugcugggcagccucuucucccgcaaguga

SEQ ID NO: 27220 - RNA, 582 nt, Artificial Sequence
  derived and/or modified sequence opt1 from BCL2L2__Homo_sapiens__NP_004041
auggccacccccgccagcgcgccggacacccgcgcccugguggccgacuucgucggcuacaagcuccggcagaagggguacgugugcggcgccgggcccggcgaggggcccgccgcggacccccugcaccaggccaugcgcgccgccggcgacgaguucgagacgcgguuccgccggaccuucuccgaccuggcggcccagcuccacgugaccccgggcagcgcccagcagcgcuucacccaggucuccgacgagcuguuccagggcgggcccaacugggggcggcugguggccuucuucguguucggcgccgcgcucugcgccgagagcgucaacaaggagauggagccccuggugggccaggugcaggaguggauggucgccuaccuggagacgcgccucgccgacuggauccacuccagcgggggcugggccgaguucaccgcgcuguacggggacggcgcccuggaggaggcccggcgccuccgggaggggaacugggccuccgugcgcaccgugcugaccggcgccgucgcgcugggcgcccucgugacggugggggccuucuucgccagcaaguga

SEQ ID NO: 27221 - RNA, 1002 nt, Artificial Sequence
  derived and/or modified sequence opt1 from BCL2L2-PABPN1__Homo_sapiens__NP_001186793
auggccacccccgccagcgcgccggacacccgcgcccugguggccgacuucgucggcuacaagcuccggcagaagggguacgugugcggcgccgggcccggcgaggggcccgccgcggacccccugcaccaggccaugcgcgccgccggcgacgaguucgagacgcgguuccgccggaccuucuccgaccuggcggcccagcuccacgugaccccgggcagcgcccagcagcgcuucacccaggucuccgacgagcuguuccagggcgggcccaacugggggcggcugguggccuucuucguguucggcgccgcgcucugcgccgagagcgucaacaaggagauggagccccuggugggccaggugcaggaguggauggucgccuaccuggagacgcgccucgccgacuggauccacuccagcgggggcugggagcuggaggccaucaaggcgcgggugcgcgagauggaggaggaggccgagaagcugaaggagcuccagaacgagguggagaagcagaugaacaugagcccgccgcccgggaacgccggccccgucaucauguccaucgaggagaagauggaggccgacgcccgguccaucuacguggggaacguggacuacggcgcgaccgccgaggagcuggaggcccacuuccacggcugcgggagcgucaaccgcgugaccauccugugcgacaaguucuccggccaccccaagggguucgccuacaucgaguucagcgacaaggaguccgugcggaccagccucgcccuggacgagucccuguuccgcggccggcagaucaaggucauccccaagcgcacgaaccggcccgggaucagcaccaccgaccgcggcuucccccgggcgcgcuaccgggcccgcaccacgaacuacaacuccagccgcucccgguucuacagcggcuucaacagccgcccccgggggcgcguguaccggggccgcgcccgggccaccuccugguacagcccguacuga

SEQ ID NO: 27222 - RNA, 1365 nt, Artificial Sequence
  derived and/or modified sequence opt1 from BCL3__Homo_sapiens__XP_011525499
augccccgcugccccgccggcgccauggacgaggggcccguggaccugcggacccgccccaaggcggccggccuccccggggccgcccugccgcugcggaagcgcccccuccgggcccccagccccgagccggcggcgccccgcggcgccgccgggcuggucgugccccuggacccccuccggggcggcugcgaccugccggccgugcccgggccgccccacggccuggcccgccccgaggcccucuacuaccccggggcccugcugccccucuaccccacccgggccaugggcuccccguucccccuggucaaccugcccacgccccucuacccgaugaugugccccauggagcacccccugagcgcggacaucgccauggccacccgcgccgacgaggacggggacaccccgcugcacaucgccguggugcagggcaaccuccccgcgguccaccggcuggugaaccuguuccagcagggcgggcgcgagcucgacaucuacaacaaccugcggcagacgccccugcaccucgccgugaucaccacccugcccuccgucgugcgccugcucgugaccgccggcgccagcccgauggcccuggaccggcacgggcagaccgcggcccaccuggccugcgagcaccgcucccccacgugccuccgggcccugcuggacagcgccgcgcccggcacccucgaccuggaggcccgcaacuacgacggccugaccgcccuccacgucgccgugaacaccgagugccaggagacggugcagcugcugcucgagcgcggggcggacaucgacgccgucgacaucaaguccggccggagcccccugauccacgccguggagaacaacucccugagcauggugcagcuccugcugcagcacggggccaacgucaacgcccagauguacuccggcagcuccgcgcuccacagcgccuccgggcggggccugcugccgcucgugcgcacccuggugcgcagcggcgccgacuccagccugaagaacugccacaacgacacgccccugauggucgcccggucccgccgggugaucgacauccuccgcgggaaggccacccggcccgcgagcaccagccagcccgacccgucccccgaccgcagcgccaacaccucccccgagagcuccagccggcuguccagcaacggccugcucuccgccagccccuccagcuccccgagccaguccccgccccgcgacccgcccggguuccccauggccccgcccaacuucuuccugcccagccccuccccgcccgccuuccugcccuucgcgggcgugcuccgggggcccggccgccccgucccgcccagccccgcccccggcggguccuga

SEQ ID NO: 27223 - RNA, 1443 nt, Artificial Sequence
  derived and/or modified sequence opt1 from BCL6B__Homo_sapiens__NP_862827
augggcagccccgccgccccggagggggcgcugggcuacgugcgcgaguucacccggcacuccagcgacguccucgggaaccugaacgagcugcgccuccggggcauccugaccgacgugacgcugcucgucgggggccagccccugcgcgcccacaaggccgugcugaucgccugcuccggcuucuucuacagcaucuuccgggggcgcgccggcguggggguggacguccucucccugcccggcgggcccgaggcgcggggcuucgccccgcugcucgacuucauguacaccagccgccugcggcugucccccgccaccgcccccgcggugcucgccgccgccaccuaccugcagauggagcacgugguccaggccugccaccgcuucauccaggcgagcuacgagccccugggcaucucccuccggccgcuggaggccgagccgcccacgccgcccaccgcgcccccgcccgggagcccccgccgguccgagggccaccccgacccgcccaccgagagccgcuccugcagccaggggccgcccucccccgccagccccgaccccaaggccugcaacuggaagaaguacaaguacaucgugcugaacucccaggccagccaggccggcucccucgugggcgagcggagcagcgggcagcccugcccccaggcccgccugcccuccggcgacgaggccagcuccagcuccagcuccagcuccagcuccagcuccgaggaggggcccauccccggcccccagagccggcuguccccgaccgccgcgacgguccaguucaagugcggggcccccgccagcacccccuaccuccugaccucccaggcccaggacaccagcggcucccccagcgagcgcgcccggccgcugcccggcagcgaguucuucuccugccagaacugcgaggcgguggccgggugcagcuccggccucgacagccuggugcccggggacgaggacaagcccuacaagugccagcugugccgcuccagcuuccgguacaagggcaaccucgccucccaccgcacgguccacaccggggagaagccguaccacugcagcaucugcggcgcccgcuucaaccggcccgcgaaccugaagacccacucccgcauccacagcggcgagaagcccuacaagugcgagaccugcgggucccgguucguccagguggcccaccuccgcgcccacgugcugauccacacgggcgagaagcccuacccgugcccgaccugcgggacccgguuccgccaccuccagacccugaagucccacgugcggauccacacgggcgagaagcccuaccacugcgaccccugcgggcugcacuuccgccacaagagccagcugcggcugcaccuccgccagaagcacggcgccgccaccaacaccaaggugcacuaccacauccugggcgggcccuga

SEQ ID NO: 27224 - RNA, 2121 nt, Artificial Sequence
  derived and/or modified sequence opt1 from BCL6__Homo_sapiens__NP_001124317
auggccagccccgccgacuccugcauccaguucacccgccacgcgagcgacgugcugcugaaccugaaccggcugcgcucccgggacauccucaccgacgucgugaucguggucagccgcgagcaguuccgggcccacaagacggugcugauggccugcuccggccuguucuacagcaucuucaccgaccagcucaagugcaaccuguccgugaucaaccuggacccggagaucaaccccgagggguucugcauccuccuggacuucauguacaccagccgccugaaccuccgggagggcaacaucauggccgucauggccaccgcgauguaccugcagauggagcacgugguggacacgugccgcaaguucaucaaggccuccgaggccgagauggucagcgccaucaagccgccccgggaggaguuccugaacucccgcaugcucaugccccaggacaucauggcguaccgggggcgcgaggugguggagaacaaccugccccugcggagcgcccccggcugcgagucccgcgccuucgcccccagccucuacuccgggcugagcaccccgcccgccuccuacagcauguacucccaccuccccgucagcagccugcuguucuccgacgaggaguuccgggacgugcgcaugcccguggcgaacccguuccccaaggagcgggcccugcccugcgacagcgcccgccccgucccgggcgaguacucccggcccacccucgaggugagccccaacgugugccacuccaacaucuacagccccaaggagaccaucccggaggaggcccgcuccgacaugcacuacagcgucgccgagggccugaagcccgcggcccccuccgcccggaacgcccccuacuucccgugcgacaaggccagcaaggaggaggagcgccccuccagcgaggacgagaucgcgcugcacuucgagccgcccaacgcgccccucaaccgcaaggggcuggugagcccccagagcccccagaaguccgacugccagccgaacagccccacggaguccugcagcuccaagaacgccugcauccugcaggccagcggcagcccgcccgccaagucccccaccgaccccaaggccugcaacuggaagaaguacaaguucaucgugcucaacagccugaaccagaacgccaagcccgaggggcccgagcaggccgagcugggccggcucuccccgcgcgccuacaccgcgccgcccgccugccagccgcccauggagcccgagaaccuggaccugcagagccccaccaagcucuccgccagcggggaggacuccacgaucccccaggccagccggcugaacaacaucgucaaccgcuccaugaccggcagcccccgguccagcuccgagagccacagcccccuguacaugcacccgcccaagugcaccuccugcggcucccagagcccccagcacgccgagaugugccuccacaccgcggggcccacguuccccgaggagaugggcgagacccagagcgaguacuccgacagcuccugcgagaacggggccuucuucugcaacgagugcgacugccgcuucagcgaggaggccucccugaagcggcacacccugcagacccacagcgacaagcccuacaagugcgaccgcugccaggccuccuuccgguacaagggcaaccucgccagccacaagacggugcacaccggcgagaagccguaccgcugcaacaucugcggggcgcaguucaaccggcccgccaaccugaagacccacacccgcauccacuccggcgagaagcccuacaagugcgagacgugcggggcccgguucgugcaggucgcccaccuccgcgcccacgugcugauccacaccggcgagaagccguaccccugcgagaucugcgggacccgguuccgccaccuccagacccugaagucccaccuccggauccacacgggcgagaagcccuaccacugcgagaagugcaaccugcacuuccgccacaagucccagcugcggcugcaccuccgccagaagcacggcgcgaucaccaacaccaagguccaguaccgcgugagcgccaccgaccugcccccggagcugcccaaggccugcuga

SEQ ID NO: 27225 - RNA, 633 nt, Artificial Sequence
  derived and/or modified sequence opt1 from BCL7A__Homo_sapiens__NP_001019979
augagcggccgcuccgugcgggccgagacccgcagccgggccaaggacgacaucaagcgcgucauggcggccaucgagaaggugcggaagugggagaagaagugggugaccgucggggacacgucccugcgcaucuacaagugggugcccgugaccgagcccaaggucgacgacaagaacaagaacaagaagaagggcaaggacgagaagugcgggagcgaggugaccacccccgagaacuccagcucccccggcaugauggacaugcacgacgacaacagcaaccaguccagcaucgccgacgccucccccaucaagcaggagaacagcuccaacagcuccccggcccccgagcccaacagcgcggugcccuccgacgggacggaggccaaggucgacgaggcccaggccgacggcaaggagcacccgggcgcggaggacgccagcgacgagcagaacucccagagcagcauggagcacuccaugaacagcuccgagaagguggaccggcagcccagcggggacuccggccucgccgccgagaccagcgccaucucccaggaccuggagggggugccgcccagcaagaagaugaagcuggaggcgucccagcagaacagcgaggagauguga

SEQ ID NO: 27226 - RNA, 438 nt, Artificial Sequence
  derived and/or modified sequence opt1 from BCL7B__Homo_sapiens__NP_001184173
augagcggccgcuccgugcgggccgagacccgcagccgggccaaggacgacaucaagaaggucauggcggccaucgagaaggugcgcaagugggagaagaagugggugaccgucggggacacgucccugcggaucuucaagugggugcccgugaccgacagcaaggagaaggagaaguccaagagcaacuccagcgccgcccgcgagccgaacggcuuccccuccgacgccagcgcgaacuccagccuccugcuggaguuccaggagcccucccuccccagcuccgaggucgccgacgagccgcccacccugaccaaggaggagcccgugccccuggagacccagguggucgaggaggaggaggacagcggggccccgccccucaagcgguucugcguggaccagcccacggugccccagaccgccuccgagagcuga

SEQ ID NO: 27227 - RNA, 729 nt, Artificial Sequence
  derived and/or modified sequence opt1 from BCL7C__Homo_sapiens__NP_001273455
auggccggccgcaccgugcgggccgagacccgcagccgggccaaggacgacaucaagaaggucauggccacgaucgagaaggugcgccggugggagaagcgcugggugaccgucggggacaccucccugcggaucuucaagugggugcccguggucgacccgcaggaggaggagcgccggcgcgccggcgggggcgccgagcggagccgcgggcgggagcgccggggccgcggcgccagcccccgcgggggcgggccccucauccugcuggaccucaacgacgagaacuccaaccaguccuuccacagcgagggcucccugcagaaggggaccgagcccagcccgggcggcacgccccagcccucccggcccgugagcccggcggggccgcccgagggcgugcccgaggaggcccagccgccccggcuggggcaggagcgcgaccccggcggcaucaccgccggguccaccgacgagccgcccaugcucaccaaggaggagcccguccccgagcugcuggaggccgaggacagcggcgugcggaugacgcgccgcgcgcuccacgagaaggggcugaagaccgagccccugcggcgccuccugccccggcgcggccugcggaccaacgugcgccccuccagcauggccguccccgacacccgggcccccgggggcggcuccaaggccccgcgcgcgccccggacgaucccccaggggaagggccgcuga

SEQ ID NO: 27228 - RNA, 4500 nt, Artificial Sequence
  derived and/or modified sequence opt1 from BCL9L__Homo_sapiens__NP_872363
augcgcauccuggccaacaagacccggcucccccacccgcgccggcgcgaggcccccggcagccccccccuguccccgcgggggcacugcccccccgcgcccgccaagccgaugcaccccgagaacaagcugaccaaccacggcaagacggggaacggcggggcccagagccagcaccagaacgugaaccagggccccaccugcaacgucggcuccaagggggugggcgccgggaaccacggcgccaaggcgaaccagaucagccccuccaacagcucccucaagaacccgcaggccggggugccccccuucagcucccugaagggcaaggucaagcgcgaccggagcguguccguggacagcggcgagcagcgcgaggccgggacccccucccuggacagcgaggccaaggaggucgcgccgcgguccaagcgccggugcgugcucgagcgcaagcagcccuacagcggcgacgaguggugcuccgggcccgacagcgaggaggacgacaagcccaucggcgccacccacaacugcaacguggccgacccggccauggccgcgccccagcugggccccgggcagacgacccagcugccccucuccgagagcagcgucccgggcgccccccacgggccccccccgggccugcggcccgacgcccccgggggcggcgggggcgggggcggggugccgggcaagccccccucccaguucguguacgucuucaccacccaccuggccaacacggccgcggaggccgugcuccagggccgcgccgacagcauccuggccuaccaccagcagaacgugccccgggccaagcuggaccaggcgccgaaggucccccccacccccgagccgcucccccuguccacccccagcgccgggaccccccagucccagccgcccccccugcccccgcccccccccccggcccccggcagcgccccccccgcccucccgcccgaggggcccccggaggacuccagccaggaccuggcgcccaacuccgugggcgccgccagcacggggggcggcaccgggggcacccaccccaacacccccacggccaccaccgcgaacaacccgcugccccccgggggcgaccccuccagcgccccgggccccgcccuccugggggaggccgccgcgcccggcaacgggcagcgcucccuggugggcagcgaggggcucuccaaggagcagcuggagcaccgggagcgcagccugcagacccuccgggacaucgagcgccugcugcuccgguccggcgagacggagcccuuccugaagggcccgcccgggggcgccggggagggcgggccccccgcccaggccccgccccccccccagcagccgcccaccgccccccccagcggccugaagaaguacgaggagccgcuccaguccaugaucagccagacccagagccugggcgggcccccccuggagcacgagguccccggccacccgcccgggggcgacauggggcagcagaugaacaugaugauccagcgccucggccaggacucccugacccccgagcagguggcguggcgcaagcugcaggaggaguacuacgaggagaagcggcgcaaggaggagcagaucggccuccacgggagccggccgcugcaggacaugaugggcauggggggcaugauggugcgcgggcccccccccccguaccacuccaagcccggcgaccaguggccccccggcaugggggcccagcugcggggcccgauggacguccaggaccccaugcagcuccgcgggggcccccccuucccgggcccccgguuccccgggaaccagauccagcgcgugcccggcuucgggggcaugcagagcaugccgauggaggugcccaugaacgccaugcagcggcccguccgccccgggaugggcuggacggaggaccugccgcccaugggcgggcccuccaacuucgcccagaacaccaugcccuacccgggcgggcagggcgaggccgagcgguucaugaccccccgcgugcgggaggagcugcuccgccaccagcugcuggagaagcggagcauggggaugcagcgcccccucggcauggcgggcuccgggaugggccagagcauggagauggagcggaugaugcaggcccaccgccagauggaccccgccauguucccggggcagauggccggcggggagggccuggcgggcacccccauggggauggaguucggcgggggccggggccugcugucccccccgauggggcagagcggccuccgcgaggucgacccccccauggggcccggcaaccugaacaugaacaugaacgugaacaugaacaugaacaugaaccugaacgugcagaugacgccgcagcagcagaugcucaugucccagaagaugcgcgggcccggcgaccugaugggcccccaggggcugagccccgaggagauggcccggguccgcgcccagaacuccagcggcgugauggggggcccgcagaagaugcucaugcccucccaguuccccaaccaggggcagcagggcuucagcggcgggcagggccccuaccaggccaugucccaggacauggggaacacccaggacauguucagcccggaccagagcuccaugcccaugagcaacgugggcaccacccggcugucccacaugccccugcccccggccagcaacccccccgggacgguccacuccgcgcccaaccgcggccucggccggcgcccgagcgaccugaccaucuccaucaaccagauggggagccccggcauggggcaccugaagucccccacccucagccaggugcacuccccccuggugaccagcccguccgccaaccugaagagcccccagacgcccucccagauggucccgcuccccagcgccaacccccccggcccgcugaaguccccccaggugcuggggagcucccucagcgugcggagccccaccggcucccccagccgccugaaguccccgagcauggccguccccucccccggcuggguggccagccccaagaccgcgaugccgucccccggggugagccagaacaagcagcccccccugaacaugaacuccagcaccacccucuccaacauggagcagggcacgcugccgcccagcgggccccgguccagcuccagcgcccccccggccaacccccccuccggccugaugaaccccagccucccguucaccuccagccccgaccccacccccagccagaacccgcugucccugaugaugacccagaugagcaaguacgccaugcccuccagcacgccccucuaccacaacgccaucaagaccaucgcgaccuccgacgacgagcugcugccggaccgcccccuccugccccccccgccccccccccagggcagcgggccgggcaucuccaacagccagcccucccagaugcaccugaacagcgccgccgcccagucccccauggggaugaaccuccccggccagcagccgcugagccacgagcccccccccgcgaugcugccgucccccaccccccucgggagcaacaucccccugcacccgaacgcccagggcacgggcgggcccccccagaacuccaugaugauggcccccggcgggccggacagccugaacgcccccugcggccccguccccuccagcucccagaugaugccguuccccccccggcuccagcagccgcacggggccauggcgcccaccggcggcgggggcgggggccccgggcugcagcagcacuaccccagcggcauggcccugccgcccgaggaccuccccaaccagcccccgggccccaugcccccccagcagcaccugauggggaaggccauggccggccgcaugggggacgccuacccgcccggcgugcugcccgggguggcgagcguccucaacgaccccgagcuguccgaggugauccggccgacccccaccggcauccccgaguucgaccugagccgcaucauccccuccgagaagccgagcuccacgcuccaguacuuccccaagagcgagaaccagccccccaaggcccagccgcccaaccugcaccugaugaaccuccagaacaugauggccgagcagacccccucccggcccccgaaccugcccggccagcagggggugcagcgcggccugaacaugagcaugugccaccccgggcagaugucccuccugggccggaccggcgucccgccccagcaggggauggugccccacggccugcaccagggggugaugagccccccgcagggccucaugacccagcagaacuucaugcugaugaagcagcgcggggucggcggcgagguguacucccagcccccccacaugcugagcccccaggggucccucaugggcccgcccccccagcagaaccugauggugagccacccccugcggcagcgcuccgucagccucgacucccagaugggguaccugccggcccccggcgggauggccaaccugcccuucuga

SEQ ID NO: 27229 - RNA, 2610 nt, Artificial Sequence
  derived and/or modified sequence opt1 from BCLAF1__Homo_sapiens__NP_001070908
augggccgcagcaacucccggagccacuccagccgcuccaagagccggucccagagcuccagccgcucccggagccgcucccacagccggaagaagcgcuaccggucccgcagccggaccuacucccgcagccggucccgcgaccggauguacagccgcgacuaccggcgcgacuaccggaacaaccgcgggaugcggcgccccuacggcuaccgcgggcggggccgcggguacuaccagggcggcgggggccgguaccaccgcgggggcuaccggccgguguggaaccgccggcacagccgcagcccccggcgcgggcggagccgcucccggagccccaagcgccgguccgucagcucccagcgcagccggucccgcagccggcgcuccuaccgcagcucccggagcccccgcuccagcuccagccgguccagcagcccguacuccaagagccccguguccaagcgccggggcagccaggagaagcagaccaagaaggccgagggcgagccccaggaggagagcccccucaaguccaagucccaggaggagccgaaggacacguucgagcacgaccccagcgaguccaucgacgaguucaacaagagcuccgccaccagcggggacaucuggcccggccuguccgcguacgacaacagcccccgcuccccgcacagccccucccccaucgccacgcccccgagccagagcuccagcugcuccgacgcccccaugcugagcaccgugcacuccgccaagaacacccccagccagcacucccacagcauccagcacucccccgagcggagcggguccggcagcgucggcaacggguccagccgcuacuccccgagccagaacucccccauccaccacauccccagccggcgcucccccgccaagaccaucgcgccgcagaacgcgccccgggacgagagccgcggccggagcuccuucuaccccgacgggggcgaccaggagaccgccaagaccgggaaguuccugaagcgcuucacggacgaggagagccggguguuccuccuggaccgcggcaacacccgggacaaggaggccuccaaggagaagggcagcgagaaggggcgcgccgagggcgagugggaggaccaggaggcccuggacuacuucuccgacaaggagagcgggaagcagaaguucaacgacuccgagggcgacgacaccgaggagaccgaggacuaccggcaguuccgcaagagcgugcucgccgaccaggggaaguccuucgccacggccagccaccggaacaccgaggaggagggccugaaguacaaguccaaggucagccugaagggcaaccgcgaguccgacggguuccgcgaggagaagaacuacaagcucaaggagaccggcuacgugguggagcggcccagcaccacgaaggacaagcacaaggaggaggacaagaacuccgagcgcaucaccgucaagaaggagacccagagcccggagcaggucaaguccgagaagcugaaggaccuguucgacuacagcccgccccuccacaagaaccuggacgcgcgggagaaguccaccuuccgcgaggagagcccccugcggaucaagaugaucgccagcgacucccaccgccccgaggugaagcucaagauggcccccgugccccuggacgacagcaaccggccggccucccugacgaaggaccgccuccuggccagcacccuggugcacuccgugaagaaggagcaggaguuccggagcaucuucgaccacaucaagcucccccaggcguccaagagcaccuccgagagcuucauccagcacaucgucucccuggugcaccacgugaaggagcaguacuucaagagcgccgccaugacccugaacgagcgcuucacguccuaccagaaggccaccgaggagcacagcacccggcagaagucccccgagauccaccgccggaucgacaucagccccuccacccuccgcaagcacacgcggcuggccggggaggagcgcgucuucaaggaggagaaccagaagggcgacaagaagcugcggugcgacagcgcggaccuccgccacgacaucgaccggcgccgcaaggagcgguccaaggagcgcggggacagcaagggcagccgggaguccagcggcucccgcaagcaggagaagaccccgaaggacuacaaggaguacaagagcuacaaggacgacuccaagcacaagcgggagcaggaccacagccgcuccagcuccagcuccgccagccccuccagccccuccagccgggaggagaaggaguccaagaaggagcgcgaggaggaguucaagacccaccacgagaugaaggaguacagcggguucgccggcgugucccggccccgcgggaccuuccacgacgaccgggacgacggcguggacuacugggccaagcgcggccgggggcgcggcacguuccagcgggggcgcggccgguucaacuucaagaaguccgggagcuccccgaaguggacccacgacaaguaccagggcgacggcaucgucgaggacgaggaggagaccauggagaacaacgaggagaagaaggaccgccggaaggaggagaaggaguga

SEQ ID NO: 27230 - RNA, 1644 nt, Artificial Sequence
  derived and/or modified sequence opt1 from BCO1__Homo_sapiens__NP_059125
auggacaucaucuucggccgcaaccggaaggagcagcuggagcccgugcgcgccaaggucaccgggaagaucccggccuggcuccagggcacccugcugcggaacgggcccggcaugcacacggugggggagagccgcuacaaccacugguucgacggccucgcccugcugcacuccuucaccauccgggacggcgagguguacuaccgcagcaaguaccuccgguccgacaccuacaacaccaacaucgaggccaaccgcaucgucgugagcgaguucgggacgauggccuaccccgaccccugcaagaacaucuucuccaaggccuucagcuaccugucccacaccaucccggacuucaccgacaacugccugaucaacaucaugaagugcggcgaggacuucuacgccaccagcgagacgaacuacauccggaagaucaacccccagacccucgagacccuggagaagguggacuaccgcaaguacgucgcggugaaccuggccaccucccacccccacuacgacgaggccgggaacgugcucaacaugggcacgagcaucgucgagaaggggaagaccaaguacgugaucuucaagauccccgccaccgugccggagggcaagaagcagggcaagucccccuggaagcacaccgaggucuucugcagcauccccucccggagccugcugucccccagcuacuaccacuccuucggggugacggagaacuacgugaucuuccucgagcagccguuccgccuggacauccugaagauggcgaccgccuacauccggcgcaugagcugggccuccugccucgccuuccaccgggaggagaagaccuacauccacaucaucgaccagcgcacccggcagcccguccagacgaaguucuacaccgacgccauggugguguuccaccacgucaacgcguacgaggaggacggcugcaucguguucgacgugaucgccuacgaggacaacagccuguaccagcuguucuaccucgccaaccugaaccaggacuucaaggagaacagccgccugaccuccguccccacccuccggcgcuucgccgugccccugcacguggacaagaacgccgaggucgggacgaaccugaucaagguggcgagcaccaccgccaccgcccucaaggaggaggacggccaggucuacugccagccggaguuccuguacgagggccuggagcucccccgggugaacuacgcccacaacgggaagcaguaccgcuacguguucgccacgggcguccaguggucccccauccccaccaagaucaucaaguacgacauccugaccaagagcucccugaaguggcgcgaggacgacugcuggccggcggagccccucuucgugcccgcccccggggccaaggacgaggacgacggcgugauccugagcgccaucgucuccaccgacccgcagaagcugcccuuccuccugauccuggacgccaagagcuucacggagcucgcgcgggccuccguggacguggacaugcacauggaccugcacgggcuguucaucaccgacauggacugggacaccaagaagcaggccgccagcgaggagcagcgcgaccgggcguccgacugccacggcgcgccccucaccuga

SEQ ID NO: 27231 - RNA, 1620 nt, Artificial Sequence
  derived and/or modified sequence opt1 from BCO2__Homo_sapiens__NP_001243326
augggcaacacgccccagaagaaggccguguucgggcagugccgcggccugccgugcgucgccccgcuccugaccaccguggaggaggcgccccgggggaucagcgcccgcguguggggccacuuccccaaguggcugaacgggucccuccugcggaucggccccggcaaguucgaguucgggaaggacaaguacaaccacugguucgacggcauggcccugcuccaccaguuccgcauggccaaggggaccgucaccuaccggagcaaguuccugcaguccgacaccuacaaggccaacagcgcgaagaaccgcaucgugaucuccgaguucggcacgcuggcccuccccgaccccugcaagaacguguucgagcgguucaugagccgcuucgagcugcccgggaaggccgccgcgaugaccgacaacaccaacgucaacuacgugcgguacaagggcgacuacuaccugugcaccgagacgaacuucaugaacaagguggacaucgagacccucgagaagaccgagaaggucgacugguccaaguucaucgccgugaacggcgccaccgcccacccgcacuacgaccccgacgggacggccuacaacaugggcaacagcuucgggcccuacggcuucuccuacaaggugauccgcgugcccccggagaaggucgaccugggcgagaccauccacggggugcaggucaucugcagcaucgcguccaccgagaagggcaagcccagcuacuaccacuccuucgggaugacccggaacuacaucaucuucaucgagcagccccugaagaugaaccucuggaagaucgccacgagcaagauccgcggcaaggccuucuccgacgggaucagcugggagccccagugcaacacccgguuccacgugguggagaagcgcaccggccagcugcugccgggccgguacuacuccaagcccuucgucaccuuccaccagaucaacgccuucgaggaccaggggugcgugaucaucgaccucugcugccaggacaacggccgcacgcuggagguguaccagcugcagaaccuccggaaggccggggagggccuggaccagguccacaacagcgcggccaaguccuucccccgccgguucgugcugccccucaacgugagccugaacgccccggagggggacaaccugagcccccucuccuacaccagcgccuccgccgucaagcaggcggacggcaccaucuggugcagccacgagaaccugcaccaggaggaccuggagaaggagggcgggaucgaguucccccagaucuacuacgaccgcuucuccggcaagaaguaccacuucuucuacgggugcggcuuccggcaccucgugggggacagccugaucaaggucgacgugguguggcgcgaggacggcuucuaccccuccgagccggucuucgugcccgcccccggcaccaacgaggaggacgggggcgugauccugagcgucgugaucacgcccaaccagaacgaguccaacuuccuccuggugcuggacgccaagaacuucgaggagcucgggcgcgccgaggucccggugcagaugcccuacggcuuccacggcaccuucauccccaucuga

SEQ ID NO: 27232 - RNA, 5166 nt, Artificial Sequence
  derived and/or modified sequence opt1 from BCOR__Homo_sapiens__NP_001116855
augcugagcgccacgccccucuacggcaacgugcacuccuggaugaacagcgagcgcguccggaugugcggggccuccgaggaccgcaagauccuggugaacgacggcgacgccuccaaggcccggcuggagcugcgcgaggagaacccccugaaccacaacgugguggacgccuccaccgcccaccggaucgacgggcuggccgcgcuguccauggaccgcaccggccugauccgggaggggcugcgcgugcccggcaacaucguguacuccagccucugcggccugggguccgagaagggccgggaggccgccaccagcacccucggcgggcucggguucuccagcgagcgcaaccccgagaugcaguucaagcccaacacccccgagaccgucgaggccuccgcggugagcgggaagccgcccaacggcuucuccgccaucuacaagacgccgcccgggauccagaaguccgccguggccaccgccgaggcgcugggccuggaccggcccgccuccgacaagcagagcccccucaacaucaacggggccuccuaccugcgccugcccugggucaaccccuacauggagggcgccacccccgccaucuaccccuuccucgacagccccaacaaguacagccugaacauguacaaggcgcugcucccccagcaguccuacagccuggcccagccccuguacucccccgugugcaccaacggcgagcgguuccucuaccugcccccgccccacuacguggggccccacauccccagcucccuggccagccccaugcgccucuccacccccagcgccucccccgccaucccgccccugguccacugcgcggacaagagccugcccuggaagaugggcgugucccccgggaaccccguggacagccacgccuacccccacauccagaacuccaagcagccccggguccccagcgccaaggccgugaccuccggccuccccggggacaccgcccugcugcucccgcccagcccccgccccagcccccgggugcaccuccccacgcagcccgcggccgacaccuacagcgaguuccacaagcacuacgcccgcaucuccaccagcccgagcgucgcccuguccaagcccuacaugaccgugagcuccgaguuccccgcggcccggcucagcaacggcaaguaccccaaggccccggagggcggggagggcgcccagcccgugcccgggcacgcccgcaagacggcgguccaggaccggaaggacggcuccagcccgccccugcuggagaagcagaccgugaccaaggacgugaccgacaagccccucgaccuguccagcaaggucguggacgucgacgccuccaaggccgaccacaugaagaagauggcccccacggugcuggugcacagccgcgccggguccggccucguccugagcggcuccgagauccccaaggagacccugagcccgcccgggaacggcugcgcgaucuaccgcuccgagaucaucagcaccgcccccuccagcuggguggugccggggcccagccccaacgaggagaacaacggcaaguccaugagccucaagaacaaggcccuggacugggccaucccccagcagcgguccagcuccugcccgcgcaugggcggcaccgacgccgucaucacgaacgugagcggcuccgugagcuccgcggggcggcccgccagcgccucccccgcccccaacgcgaacgccgacggcaccaagaccagccgcuccagcgucgagaccacgccguccgugauccagcacguggggcagccgcccgccacccccgccaagcacagcuccagcaccuccagcaagggcgccaaggcgagcaacccggagcccuccuucaaggccaacgagaacggccugccgcccagcuccaucuuccucagcccgaacgaggccuuccggagcccgcccauccccuacccgcgcagcuaccugcccuaccccgcccccgaggggaucgccgucuccccgcugagccugcacggcaaggggcccguguacccccaccccgugcuccugccgaacggcucccuguuccccgggcaccucgcgcccaagccgggccugcccuacggccugcccaccgggcggcccgaguucgucacguaccaggacgcccucggccuggggauggugcacccgaugcugaucccccacacccccaucgagaucaccaaggaggagaagcccgagcgccggagccgcucccacgagcgggcccgcuacgaggacccgacccuccggaaccgcuucagcgagauccuggagacguccagcaccaagcugcaccccgacgugcccaccgacaagaaccucaagcccaacccgaacuggaaccagggcaagaccgucgugaaguccgacaagcugguguacgucgaccugcuccgggaggagcccgacgccaagaccgacacgaacgugagcaagcccuccuucgccgcggagagcguggggcaguccgccgagcccccgaagcccagcgucgagcccgcccugcagcagcaccgcgacuucaucgcccugcgggaggagcucggccgcaucagcgacuuccacgagaccuacaccuucaagcagcccguguucaccguguccaaggacagcguccuggcgggcacgaacaaggagaaccuggggcucccgguguccacccccuuccuggagccgccccugggcagcgacgggccggccgugaccuucggcaagacccaggaggaccccaagcccuucugcgucggguccgcgccgcccagcguggacgugacgcccaccuacaccaaggacggcgccgacgaggccgaguccaacgacggcaagguccucaagcccaagcccagcaagcuggcgaagcggaucgccaacuccgccggguacgugggcgaccgcuucaagugcgugaccacggagcuguacgccgacagcucccagcucagccgcgagcagcgggcccugcagauggaggggcugcaggaggacuccauccucugccugcccgcggccuacugcgagcgcgccaugaugcgguucagcgagcuggagaugaaggagcgcgagggcgggcaccccgccaccaaggacuccgagaugugcaaguucagccccgccgacugggagcggcucaagggcaaccaggacaagaagccgaaguccgucacccuggaggaggcgaucgccgagcagaacgagagcgagcgcugcgaguacuccgugggcaacaagcaccgggaccccuucgaggcccccgaggacaaggaccugcccguggagaaguacuucgucgagcgccagccggugagcgagccgcccgccgaccagguggccagcgacaugccccacuccccgacccuccgggucgaccgcaagcggaaggugagcggggacuccagccacacggagaccaccgcggaggaggugcccgaggacccccugcugaaggccaagcgccggcgcgucuccaagggccuccaccccaagaagcagcggcaccuccugcaccuccgcgagcggugggagcagcaggucagcgccgccgacgggaagccgggccgccagucccggaaggaggugacccaggcgacgcagcccgaggccaucccccagggcaccaacaucaccgaggagaagcccgggcgcaagcgggccgaggccaagggcaaccgcagcugguccgaggagagccugaagccguccgacaacgagcaggggcugcccgucuucagcggcagcccgcccaugaagucccucagcagcaccuccgccgggggcaagaagcaggcgcagccgagcugcgcccccgccucccggccgcccgccaagcagcagaagaucaaggagaaccagaagacggacgugcugugcgccgacgaggaggaggacugccaggcggccagccugcuccagaaguacaccgacaacagcgagaagcccuccggcaagcggcugugcaagaccaagcaccugaucccccaggagagccgccgggggcucccccugaccggcgaguacuacguggagaacgccgacgggaaggucacggugcgccgguuccgcaagcggcccgagcccuccagcgacuacgaccugucccccgccaagcaggagcccaagccguucgaccgccuccagcagcugcugcccgccagccaguccacccagcuccccugcagcuccagcccccaggagaccacccagucccggccgaugccgcccgaggcgcgccggcugaucgucaacaagaacgccggcgagacgcugcuccagcgcgccgcccggcugggguacgaggagguggugcuguacugccucgagaacaagaucugcgacgucaaccaccgcgacaacgcgggcuacugcgcccugcacgaggccugcgcccggggcuggcugaacaucgugcgccaccuccuggaguacggggccgacgugaacugcagcgcgcaggacggcacccggccccugcacgacgccgucgagaacgaccaccucgagaucgugcgccugcugcucuccuacggggccgacccgacccuggccaccuacagcggccggacgaucaugaagaugacccacuccgagcugauggagaaguuccucaccgacuaccugaacgaccugcaggggcgcaacgacgacgacgccagcggcaccugggacuucuacggcuccagcgugugcgagcccgacgacgaguccggguacgacguccucgcgaacccgcccggcccggaggaccaggacgacgacgacgacgccuacagcgacguguucgaguucgaguucagcgagacgccccugcugcccugcuacaacauccagguguccgucgcccaggggccccgcaacuggcuccugcugagcgacgugcucaagaagcugaagauguccagccggaucuuccgcugcaacuucccgaacguggagaucgucacgaucgccgaggccgaguucuaccgccagguguccgcgagccugcuguucuccugcagcaaggaccuggaggccuucaaccccgaguccaaggagcugcucgaccugguggaguucaccaacgagauccagacccugcucggcagcuccgucgaguggcugcaccccagcgaccuggccuccgacaacuacugguga

SEQ ID NO: 27233 - RNA, 5136 nt, Artificial Sequence
  derived and/or modified sequence opt1 from BCORL1__Homo_sapiens__NP_068765
augaucagcaccgcgccccuguacuccggcgugcacaacuggaccagcuccgaccgcauccggaugugcgggaucaacgaggagcggcgggcgccccucagcgacgaggaguccaccaccggcgacugccagcacuucgggagccaggaguucugcguguccagcuccuucagcaagguggagcugaccgccgugggcuccgggagcaacgcccgcggcgccgaccccgacggcuccgccaccgagaagcuggggcacaagagcgaggacaagcccgacgacccccagccgaagauggacuacgccggcaacgucgccgaggccgaggggcuccuggugccccuguccagccccggcgacgggcucaagcugcccgccuccgacagcgccgaggccuccaacagccgggccgacugcagcuggacgccgcugaacacccagauguccaagcaggucgacugcagccccgccggcgucaaggcccucgacucccgccagggcgugggggagaagaacaccuucauccuggccacccugggcacgggggugcccgucgagggcacccucccccuggugaccaccaacuucagcccgcugcccgcccccaucugcccgcccgcccccggcuccgccagcgugccccacuccguccccgacgccuuccaggugccgcucagcgugcccgcccccgucccccacuccgggcuggugccggugcaggucgccacgagcgugcccgcccccagcccgccccuggcccccgugcccgcccucgcccccgccccgcccagcguccccacccugaucuccgacagcaacccgcuguccgugagcgccuccgugcucguccccgugcccgccagcgccccgcccuccggccccgucccccugagcgcccccgcccccgcgccccugagcgugcccguguccgcgccgccccucgcccugauccaggcgcccgugccgcccagcgcccccacccuggugcucgcccccgugcccacccccguccuggccccgaugcccgccuccacgcccccggcggcccccgcgccgcccagcgugccgaugcccacccccacccccuccagcgggccgcccuccacccccacgcugauccccgccuucgccccgacccccgugcccgcgcccaccccggcccccaucuucacccccgcccccacgccgaugcccgccgccacccccgcggccauccccaccagcgccccgauccccgccuccuucagccucucccgggucugcuuccccgcggcccaggcccccgccaugcagaaggugccgcugagcuuccagcccggcaccgugcugacgcccucccagccgcucgucuacaucccgccgcccagcugcgggcagccccuguccguggccacccugcccaccacccucggcgugagcuccacgcugacccugcccguccuccccagcuaccugcaggaccgcugccugcccggcgugcucgcgagccccgagcugcgguccuaccccuacgccuucagcguggcccgcccccugaccuccgacagcaagcucgucucccuggaggugaaccggcugccgugcaccagccccuccgggagcacgaccacccagcccgcccccgacggcgugccggggccccucgccgacaccucccuggucaccgcgagcgccaaggugcugcccacgccccagccgcugcuccccgcccccuccggcagcuccgcgccgccccaccccgccaagaugcccagcgggaccgagcagcagaccgagggcaccuccgugacguucagcccccugaaguccccgccccagcuggagcgcgagauggcgagcccgcccgagugcuccgagaugccccucgaccugagcagcaaguccaaccggcagaagcugccccuccccaaccagcgcaagaccccgcccaugcccguccugacccccgugcacaccagcuccaaggcccugcucagcacggugcugucccggagccagcgcaccacccaggccgccggcgggaacgucaccuccugccugggcagcacguccagccccuucgugaucuuccccgagaucgugcggaacggggaccccuccaccugggucaagaacagcaccgcgcucaucuccaccauccccggcacguacguggggguggccaacccgguccccgccagccugcugcucaacaaggaccccaaccugggccugaaccgcgacccccggcaccucccgaagcaggagcccaucuccaucaucgaccagggcgagcccaaggggaccggcgcgaccugcgggaagaagggcagccaggccggcgcggaggggcagcccuccaccgugaagcgcuacacgccggcccggaucgcccccggccugcccgggugccagaccaaggagcugagccucuggaagcccaccggcccggccaacaucuacccccgcugcuccgugaacgggaagcccaccagcacgcagguccugccggugggcuggagccccuaccaccaggccucccugcucagcaucggcaucuccagcgcggggcagcugacccccucccagggcgcccccauccgcccgaccagcguggucuccgaguucagcggggugcccucccugagcuccagcgaggccgugcacggccuccccgaggggcagccccggccgggcggcuccuucguccccgagcaggaccccgugaccaagaacaagacgugccgcaucgccgccaagcccuacgaggagcaggucaacccgguccugcugacccucagcccccagaccgggacccuggcgcuguccgugcagcccagcggcggggacauccggaugaaccagggccccgaggaguccgagagccaccucugcuccgacagcacgccgaagauggaggggccccagggcgccugcggccugaagcuggccggggacaccaagcccaagaaccaggugcucgccaccuacaugagccacgagcugguccuggccacgccccagaaccucccgaagaugcccgagcugccccugcucccccacgacucccacccgaaggagcugauccuggacguggugcccagcucccgccggggcagcuccacggagcgcccccagcucgggagccaggucgaccugggccgggugaagauggagaaggucgacggggacgugguguucaaccuggcgaccugcuuccgcgccgacggccuccccgucgccccgcagcggggccaggccgaggugcgcgcgaaggccgggcaggcccgggugaagcaggaguccgucggcguguucgccugcaagaacaaguggcagcccgacgacgugaccgagagccugcccccgaagaagaugaagugcgggaaggagaaggacuccgaggagcagcagcugcagccccaggccaaggcggucgugcgcagcucccaccggcccaagugccgcaagcuccccagcgacccgcaggaguccaccaagaaguccccgcggggcgccagcgacagcggcaaggagcacaacggggugcgcggcaagcacaagcaccggaagcccaccaagcccgagucccagagccccgggaagcgcgccgacucccacgaggagggcagccuggagaagaaggccaagagcuccuuccgggacuucauccccgucgugcugagcacgcgcacccgcucccagagcggguccaucugcagcuccuucgccggcauggcggacagcgacaugggcucccaggagguguuccccaccgaggaggaggaggaggucacccccacgccggccaagcggcgcaaggugcggaagacccagcgcgacacccaguaccggagccaccacgcccaggacaagucccuccugagccaggggcgccggcaccuguggcgcgcccgggagaugcccuggcgcaccgaggccgcgcggcagaugugggacacgaacgaggaggaggaggaggaggaggaggagggccuccugaagcgcaagaagcggcgccggcagaagucccgcaaguaccagaccggggaguaccugaccgagcaggaggacgagcagcggcgcaagggccgggccgaccucaaggcccgcaagcagaagaccagcuccagccagucccuggagcaccggcugcgcaaccgcaaccuccugcugcccaacaaggugcaggggaucagcgacucccccaacggcuuccucccgaacaaccuggaggagcccgccugccuggagaacagcgagaagcccagcggcaagcggaagugcaagacgaagcacauggcgaccgucuccgaggaggccaaggacguggugcucuacugccugcagaaggacagcgaggacgucaaccaccgcgacaacgccggguacaccgcccugcacgaggccugcucccggggcuggaccgacauccucaacauccugcuggagcacggggcgaacgugaacugcagcgcccaggacggcacgcgccccgugcacgacgccgucgugaacgacaaccucgagaccaucuggcugcugcucuccuacggggccgacccgacccuggccaccuacagcggccagacggcgaugaagcuggccuccagcgacaccaugaagcgguuccucuccgaccaccugagcgaccugcagggccgcgccgagggggaccccggcguguccugggacuucuacagcuccagcguccucgaggagaaggacggguucgccugcgaccugcugcacaacccgcccggcuccagcgaccaggagggcgacgacccgauggaggaggacgacuucauguucgagcucuccgacaagccccugcugcccugcuacaaccuccaggugagcgugagccgggggcccugcaacugguuccuguucuccgacguccugaagcgccucaagcugagcucccggaucuuccaggcccgcuucccgcacuucgagaucaccaccaugcccaaggcggaguucuaccgccagguggccagcucccagcugcugacgcccgccgagcgcccgggcgggcucgacgaccgguccccgcccggcuccagcgagaccguggagcugguccgcuacgagcccgaccugcuccggcugcugggguccgagguggaguuccagagcugcaacuccuga

SEQ ID NO: 27234 - RNA, 3816 nt, Artificial Sequence
  derived and/or modified sequence opt1 from BCR__Homo_sapiens__NP_004318
augguggaccccgucggcuucgccgaggccuggaaggcgcaguucccggacagcgagccgccccgcauggagcugcgguccgugggggacaucgagcaggagcucgagcgcugcaaggccagcauccggcgccuggagcaggaggugaaccaggagcgguuccgcaugaucuaccugcagacccuccuggccaaggagaagaaguccuacgaccggcagcgcuggggcuuccggcgcgccgcccaggcgcccgacggggccagcgagccccgggccuccgccagccgcccccagcccgcgcccgccgacggcgccgacccgccgcccgccgaggagcccgaggcccggcccgacggggagggcucccccggcaaggcgcgccccgggaccgcccggcgccccggcgccgccgccagcggggagcgggacgaccgcggcccgcccgcguccgucgccgcccugcggagcaacuucgagcgcauccggaaggggcacggccagcccggcgccgacgccgagaagcccuucuacgugaacguggaguuccaccacgagcgcgggcucgucaaggugaacgacaaggagguguccgaccgcaucagcucccugggcagccaggcgaugcagauggagcggaagaagucccagcacggggccggcagcuccgucggcgacgccagccgcccgcccuaccgggggcgcuccagcgagagcuccugcggcguggacggggacuacgaggacgccgagcugaacccccgguuccucaaggacaaccugaucgacgccaacggcgggagccggcccccguggccgccccuggaguaccagcccuaccaguccaucuacgugggcggcaugauggagggggagggcaaggggccccuccugcgcagccaguccacgagcgagcaggagaagcgccugaccuggccccggcgcuccuacagcccccgguccuucgaggacugcggcgggggcuacaccccggacugcagcuccaacgagaaccucaccagcuccgaggaggacuucagcuccggccagagcucccgcgucagccccucccccacgaccuaccggauguuccgcgacaagagccggagccccucccagaacagccagcaguccuucgacagcuccagcccgcccacgccccagugccacaagcgccaccggcacugccccgugguggucuccgaggcgaccaucgugggggugcgcaagaccggccagaucuggccgaacgacggggagggcgccuuccacggggacgccgacggcagcuucggcaccccgcccggguacggcugcgccgcggaccgggccgaggagcagcgccgccaccaggacgggcugcccuacaucgacgacucccccagcuccagcccccaccuguccagcaagggccggggcucccgcgacgcccucgucagcggggcccuggaguccaccaaggccagcgagcuggaccucgagaagggccuggagaugcggaagugggugcugagcgggauccucgcguccgaggagaccuaccugagccaccuggaggcccuccugcugcccaugaagccccucaaggccgccgccacgaccucccagccggugcugaccagccagcagaucgagaccaucuucuucaagguccccgagcuguacgagauccacaaggaguucuacgacggccucuucccccgcgugcagcaguggucccaccagcagcgggugggggaccuguuccagaagcuggcgagccagcucggcgucuaccgcgccuucguggacaacuacggcgucgccauggagauggccgagaagugcugccaggccaacgcgcaguucgccgagaucuccgagaaccugcgggcccgcagcaacaaggacgccaaggaccccacgaccaagaacucccuggagacccuccuguacaagccgguggaccgggugacccgcagcacgcugguccuccacgaccugcugaagcacacccccgcgucccaccccgaccacccccuccugcaggacgcccugcggaucagccagaacuuccucuccagcaucaacgaggagaucaccccgcgccggcaguccaugaccgugaagaagggggagcaccgccagcugcugaaggacagcuucaugguggagcuggucgagggcgcccggaagcuccgccacguguuccuguucacggaccugcuccugugcaccaagcugaagaagcaguccgggggcaagacccagcaguacgacugcaagugguacaucccccucaccgaccugagcuuccagaugguggacgagcuggaggccguccccaacaucccgcucgugcccgacgaggagcuggacgcccugaagaucaagaucucccagaucaagaacgacauccagcgggagaagcgcgcgaacaaggggagcaaggccacggagcggcucaagaagaagcugagcgagcaggagucccugcuccugcugaugagccccuccauggccuuccgcgugcacagccggaacggcaaguccuacaccuuccucaucagcuccgacuacgagcgcgccgaguggcgcgagaacauccgggagcagcagaagaagugcuuccgcagcuucucccugaccagcgucgagcugcagaugcucaccaacuccugcgugaagcugcagacggugcacagcaucccccugaccaucaacaaggaggacgacgaguccccgggccucuacggguuccugaacgucaucgugcacagcgccaccggcuucaagcaguccagcaaccuguacugcacccucgagguggacuccuucggguacuucgucaacaaggcgaagacgcggguguaccgcgacaccgccgagcccaacuggaacgaggaguucgagaucgagcuggagggcagccagacccugcggauccucugcuacgagaagugcuacaacaagaccaagauccccaaggaggacggggaguccaccgaccgccugaugggcaagggccaggugcagcuggacccccaggcccuccaggaccgggacuggcagcgcacggucaucgccaugaacgggaucgaggugaagcugagcgugaaguucaacagccgggaguucucccugaagcgcaugccgagccggaagcagaccggcgucuucggggugaagaucgccguggucaccaagcgcgagcgguccaaggugcccuacaucgugcgccagugcgucgaggagaucgagcggcgcggcauggaggagguggggaucuaccgggugagcggcgucgcgaccgacauccaggcccucaaggccgccuucgacgugaacaacaaggacguguccgucaugaugagcgagauggacgugaacgcgaucgccggcacgcugaagcuguacuuccgcgagcuccccgagccccuguucaccgacgaguucuacccgaacuucgccgaggggaucgcccuguccgaccccguggccaaggagagcugcaugcucaaccugcugcucucccugcccgaggcgaaccugcucaccuuccuguuccugcucgaccaccugaagcgggucgccgagaaggaggccgugaacaagaugagccugcacaaccucgccaccguguucggccccacgcugcugcgcccguccgagaaggagagcaagcuccccgccaaccccucccagcccaucaccaugaccgacagcuggucccuggaggucaugagccagguccaggugcugcucuacuuccugcagcuggaggcgaucccggcccccgacuccaagcgccagagcauccucuucuccaccgagguguga

SEQ ID NO: 27235 - RNA, 1260 nt, Artificial Sequence
  derived and/or modified sequence opt1 from BCS1L__Homo_sapiens__NP_001073335
augccccugagcgacuucauccucgcccugaaggacaacccguacuucggcgccggguucggccuggugggggucggcaccgcgcucgcccuggcccgcaagggggugcagcugggccucguggccuuccggcgccacuacaugaucacccuggagguccccgcccgggaccgcuccuacgcguggcugcucagcuggcugacgcggcacuccacccgcacccagcaccugagcguggagaccuccuaccuccagcacgagagcggccggaucuccacgaaguucgaguucgugcccagccccgggaaccacuucaucugguaccgcggcaaguggauccgggucgagcgcucccgggagaugcagaugaucgaccugcagaccgggaccccgugggagagcgugaccuucacggcccugggcaccgaccgcaagguguucuucaacauccucgaggaggcccgggagcuggcccugcagcaggaggaggggaagaccgucauguacaccgcggugggcuccgaguggcgccccuucggcuacccccggcgccggcgcccccucaacagcgugguccugcagcaggggcuggccgaccggaucgugcgcgacgugcaggaguucaucgacaacccgaagugguacacggaccggggcauccccuaccgccgcggguaccuccuguacggcccgcccggcugcgggaaguccagcuucaucaccgcccuggccggcgagcucgagcacuccaucugccugcugagccucaccgacuccagccuguccgacgaccggcugaaccaccuccugagcgucgcgccccagcagagccuggugcuccuggaggacguggacgccgccuuccugucccgcgaccucgccgucgagaaccccgugaaguaccaggggcugggccggcugaccuucagcgggcuccugaacgcccuggacggcguggccuccacggaggcgcgcaucgucuucaugaccaccaaccacguggaccggcucgaccccgcccugauccgccccggccggguggaccugaaggaguacgucggguacugcagccacuggcagcucacccagauguuccagcgcuucuacccgggccaggcccccucccuggccgagaacuucgccgagcacgugcugcgggcgacgaaccagaucagccccgcccagguccagggguacuucaugcucuacaagaacgaccccgugggcgccauccacaacgccgagucccugcgccgguga

SEQ ID NO: 27236 - RNA, 1032 nt, Artificial Sequence
  derived and/or modified sequence opt1 from BDH1__Homo_sapiens__NP_976059
augcuggccacccgccugagccggccccugucccgccugccgggcaagacccucagcgccugcgaccgggagaacggggcgcgccggccccugcugcucggcuccacgagcuucauccccaucgggcgccggaccuacgccuccgccgccgagcccgugggcagcaaggccguccuggugaccgggugcgacuccggcuucggcuucagccuggcgaagcaccuccacuccaagggguuccugguguucgccggcugccugaugaaggacaaggggcacgacggcgucaaggagcucgacagccugaacuccgaccgccugcggaccgugcagcucaacgugugcagcuccgaggaggucgagaaggugguggagaucguccgcagcucccugaaggacccggagaaggggauguggggccuggugaacaacgccggcaucagcacguucggggagguggaguucaccucccucgagaccuacaagcaggucgccgaggugaaccuguggggcaccgugcggaugaccaagagcuuccugccccucauccgccgggcgaaggggcgcgucgugaacaucuccagcaugcugggccggauggccaaccccgcccgcagccccuacugcaucacgaaguucggcguggaggccuucuccgacugccugcgguacgagauguacccgcucggggucaaggugagcguggucgagcccggcaacuucaucgccgcgaccucccuguacagccccgaguccauccaggccaucgccaagaagaugugggaggagcugcccgagguggugcgcaaggacuacgggaagaaguacuucgacgagaagaucgccaagauggagaccuacugcagcuccggcagcacggacaccuccccggucaucgacgccgugacccacgcgcucaccgccacgacccccuacacccgguaccaccccauggacuacuacugguggcugcgcaugcagaucaugacccaccuccccggggccaucagcgacaugaucuacauccgguga

SEQ ID NO: 27237 - RNA, 624 nt, Artificial Sequence
  derived and/or modified sequence opt1 from BDH2__Homo_sapiens__XP_005263197
augggccgccuggacgggaaggugaucauccucaccgccgccgcgcagggcaucgggcaggccgccgcccuggccuucgcgcgggagggcgccaaggucaucgccaccgacaucaacgagagcaagcugcaggagcucgagaaguaccccgggauccagacgcgcgugcuggacgugaccaagaagaagcagaucgaccaguucgccaacgaggucgagcggcuggacguccucuucaacguggcgggcuucgugcaccacggcaccgugcuggacugcgaggagaaggacugggacuucuccaugaaccugaacgugcgcagcauguaccucaugaucaaggccuuccugccgaagaugcuggcccagaaguccgggaacaucaucaacaugagcuccgucgccagcuccgugaagggcaccguggacacgcccagccuccaggagcggauccaggcccgcgggaaccccgaggaggcgcggaacgacuuccugaagcgccagaagaccggccgguucgccaccgccgaggagaucgccaugcugugcgucuaccucgccuccgacgagagcgcguacgugaccgggaaccccgugaucaucgacggcggcuggucccuguga

SEQ ID NO: 27238 - RNA, 1062 nt, Artificial Sequence
  derived and/or modified sequence opt1 from BDKRB1__Homo_sapiens__NP_000701
auggccagcuccuggcccccgcucgagcuccagagcuccaaccagagccagcuguucccccagaacgccaccgcgugcgacaacgcccccgaggccugggaccugcuccaccgcgugcugcccaccuucaucaucuccaucugcuucuucggccugcucgggaaccuguucguccugcucguguuccugcugccgcggcgccagcucaacguggccgagaucuaccuggccaaccuggcggccagcgaccucgucuucgugcugggccugcccuucugggccgagaacaucuggaaccaguucaacuggcccuucggggcccuccugugccgggugaucaacggcgucaucaaggcgaaccuguucaucuccaucuuccucgugguggccaucagccaggaccgcuaccggguccuggugcaccccauggccucccgccggcagcagcgccggcgccaggcccgggugacgugcguccugaucuggguggucgggggccuccugagcaucccgaccuuccugcuccgcuccauccaggccgugcccgaccugaacaucaccgcgugcauccugcuccugccccacgaggccuggcacuucgcccggaucguggagcugaacauccucggcuuccugcugccccucgccgccaucguguucuucaacuaccacauccuggcgagccugcgcacccgggaggaggucucccgcacgcggugcgggggccgcaaggacagcaagaccaccgcccucauccugacccuggugguggccuuccucgucugcugggccccguaccacuucuucgccuuccuggaguuccuguuccaggugcaggcggugcgggggugcuucugggaggacuucaucgaccucggccugcagcuggccaacuucuucgccuucacgaacuccagccucaaccccgucaucuacguguucgucgggcgccuguuccggaccaaggugugggagcuguacaagcagugcacccccaagucccuggcccccaucagcuccagccaccgcaaggagaucuuccagcuguucuggcgcaacuga

SEQ ID NO: 27239 - RNA, 1176 nt, Artificial Sequence
  derived and/or modified sequence opt1 from BDKRB2__Homo_sapiens__NP_000614
auguucagccccuggaagaucuccauguuccugagcgugcgcgaggacuccgucccgaccaccgccagcuucuccgccgacaugcucaacgugacgcugcagggccccacccugaacgggaccuucgcgcagagcaagugcccccagguggaguggcucggcuggcugaacaccauccagcccccguuccuguggguccucuucgugcuggccacgcuggagaacaucuucgugcucuccgucuucugccugcacaagagcuccugcaccguggccgagaucuaccuggggaaccucgccgccgcggaccugauccuggccugcggccuccccuucugggccaucaccaucagcaacaacuucgacuggcuguucggggagacccugugccggguggucaacgccaucaucuccaugaaccucuacagcuccaucugcuuccugaugcuggugagcaucgaccgcuaccucgcgcuggugaagacgauguccaugggccggaugcgcggcguccggugggccaagcuguacagccucgugaucugggggugcacccugcugcucuccagccccaugcugguguuccgcaccaugaaggaguacuccgacgagggccacaacgucaccgccugcgugaucagcuaccccagccugaucugggagguguucacgaacaugcuccugaacgucgugggguuccugcucccgcuguccgugaucaccuucugcaccaugcagaucaugcagguccugcggaacaacgagaugcagaaguucaaggagauccagaccgagcgccgggccacggugcucgugcuggucgugcugcuccuguucaucaucugcuggcugcccuuccagaucagcaccuuccucgacacccugcaccgccugggcauccucuccagcugccaggacgagcggaucaucgacgucaucacccagaucgccuccuucauggcguacagcaacuccugccugaacccccugguguacgugaucgucgggaagcgcuuccggaagaaguccugggagguguaccagggcgugugccagaagggcgggugccgcagcgagcccauccagauggagaacagcaugggcacgcuccggaccuccaucagcgucgagcgccagauccacaagcugcaggacugggccgggucccggcaguga

SEQ ID NO: 27240 - RNA, 744 nt, Artificial Sequence
  derived and/or modified sequence opt1 from BDNF__Homo_sapiens__NP_001137280
augaccauccuguuccucaccauggugaucagcuacuucggcugcaugaaggccgcccccaugaaggaggcgaacauccgcgggcagggcgggcuggccuacccgggcguccggacgcacgggacccuggaguccgugaacggccccaaggccggcagccgcgggcucaccucccuggccgacaccuucgagcacgugaucgaggagcugcucgacgaggaccagaagguccggcccaacgaggagaacaacaaggacgccgaccuguacacgagccgcgugaugcuguccagccaggugccccucgagccgccccugcuguuccuccuggaggaguacaagaacuaccuggacgcggccaacauguccaugcggguccgccggcacagcgaccccgcccgccggggcgagcucuccgugugcgacagcaucuccgagugggugaccgccgcggacaagaagaccgccgucgacaugagcgggggcaccgugacggugcuggagaagguccccguguccaaggggcagcugaagcaguacuucuacgagaccaagugcaacccgaugggcuacaccaaggagggcugccgcgggaucgacaagcggcacuggaacagccagugccgcaccacgcaguccuacgugcgggcccucaccauggacagcaagaagcgcaucggcuggcgguucauccgcaucgacaccuccugcgucugcacccugacgaucaagcgggggcgcuga

SEQ ID NO: 27241 - RNA, 7875 nt, Artificial Sequence
  derived and/or modified sequence opt1 from BDP1__Homo_sapiens__NP_060899
auguuccggcgggcccggcugagcgugaagcccaacgugcggccgggcgugggggcccggggcuccaccgccagcaacccccagcgggggcgcgagagcccccggccgcccgaccccgccaccgacagcgccuccaagcccgccgagcccacggacgugcccaccguggacuucggcggggccgagccccaggagaaggccccgcgcagcuccaccgagaagaccggcggcgacaacgacguggaggagagcucccggagcuccagcacggugucccagcgccggaagcgcaucagcuccaccagcucccucgugaaguccuccgugagcgugcccagcgagucccacccccugagcaccaucaaccaggaggcgccccagcccaccgccacguccaccaaggagaagcagcccugcagcgaccgguaccgcaucuacaaggcccagaagcugcgggagaugcucaaggaggagcugcgcaaggagaagaagcaguggaagaacaaguacgcgaucaacgagucccagcggccgcccgaccgcagcaagaugaccaugcgggacuucaucuacuaccugcccgacaacaaccccaugaccuccagccucgagcaggagaagaagacggagaagccguccacccccguccagacccgcgagcaggaggggaaguccacccccaacgccgaggacaacgagauggaggaggagacggacgacggcccccugcuggugccgcgggugaaggucgccgaggacggguccaucauccucgacgaggagagccugaccguggaggugcugcgcaccaagggccccugcgucguggaggagaacgaccccaucuucgagcgcggguccaccacgaccuacagcuccuuccggaagaacuacuacagcaagcccugguccaacaaggagaccgacauguucuuccucgccaucagcauggugggcaccgacuucuccaugaucggccagcuguucccgcaccgcgcccggaucgagaucaagaacaaguucaagcgcgaggagaagacgaacggguggcggaucgacaaggcguuccaggagaagcgccccuucgacuucgacuucuucgcccaccuccugcagaagguccuggccgaggaggagaagcggaagcagaaguccgugaagaaccacagccugaaggagaagaaguccaccaagccccgcaagaacgugaaggucaagaagguggccugcgagggcgugaacaacgacccggacgagagcauguccagccggaucuccgacaccgagcgcagccagaaggacgcccagaccgucgaggaggagucccucacgcugagccgggaggacgcggagcaggucgcccuggaggucgaccucaaccagaagaagcgccggcgcaagaagcaggacggggccaacgagcugggcgugaacaaccugcucgagaacgccaccgugcaggccggccccuccaagggggagaagcacaagaacaagugccaggcgauccggcccgagcugaaggagggcgagugcagcaaggagcagaugcuguccugcacccagaacaucgacgggaucgucggcuucgccagcaccgagaagguggagaagcgcacggaccccauccucucccugagcaaccagcaggacgccaccuccguggccaccgagagcuccgagagcagcaccuccgaccugccgagcuucgaggucgggauccgggcccucugcgaggugaacaacgcggagggcuccugcaucgaggagcgcaacguggaccugaagaacaacagccuggagaucgaccagacggagaacgucaagcccaugcuccggggccgcuuccagcgccccaagcccaaccugucccgggccgggaagaaguccgugcugucccagggcaagaccgagagcgaguccaagaacagccacuccaagaccagcguggagaagaaccacgucgagaaggacaagaugaacacccucgacauccugcgcauggagaccacggagcgggagaacccggaggccgagaccguguccgugcugggggagaagaacugccuccaggagggcagccagcugaaggcccugcgccccguccaggugcgggggcgccuccagaagcccaagcccaacgcgggcaaggccgccgagcggaaggagauccugaucucccaggaggagaucggcgccaacguggagaagaacgagaacgagagcugcgccgaccgcgacaccccgcagcacauggaggaccagucccggaaggacuucgaggaggaggacgucauccugcagcccgagaagaacgacagcuuccagaacgugcagcccgacgagcccaaggugcucaacgagugccuguccguccaggagaacaacaaggcgaacaagcugaaccaggugccgauccuccgcacccgguuccagaagcccaagcccaacaucgggcgcggcacggggcggcgcgagaucagcagcaaggaggaggugcuggagaagauccuggucuccggcgagauggccgccgcccugcgggagaccgugcgccucgacaccagccccaaggagauggugccggccgagaucaacaccaaggagaugcaguccgaccugaaggagacggggcggcgcgcgaucagcccccgggagaagauccuggacgucaucgacgacaccaucgagauggagaccggccucaaggccaugggccgcgagaucugccugcgggagaagacccccgaggugaucgacgccacggaggagaucgacaaggaccuggaggaggccgggcgccgcgagaucagcccccagaagaacggcccggaggaggugaagccccucggggaggucgagaccgaccugaaggccaccggcaacgagagcagcccccgggagaagaccccggaggugacggacgcgaccgaggagaucgacaagaaccuggaggagaccggccgccggaagaucagcccccgcgagaacgggcccgaggaggugaagcccgucgacgagauggagaccgaccucaacgccacgggccgggaguccagcccgcgcgagaagacccccgaggugaucgacgccaccgaggagaucgaccuggaggagaccgagcgggaggugagcccccaggagaacgggcuggaggaggucaagccccucggcgagauggagacggaccugaaggccaccgggcgcgacagcuucccgcggggcaagacccccgaggugaucgacgcgaucgaggagaucgagaucgaccuggaggagaccgagcgcgagaucagcccccaggagaacggccucgaggaggugaagccccugggggagaugcagacggaccugaaggccaccggccgggagaucagcccgcgcgagaagacccccgaggucaucgacgccaccgaggagaucgacaaggaccucgaggagacggggcggcgcgagaucucccccgaggagaacggccccgaggaggugaagccgguggacgagauggagaccgaccugaagaccaccgggcgggagggcagcucccgcgagaagacgcgggaggucaucgacgccgccgaggugaucgagaccgaccuggaggagaccgagcgcgagaucagcccccaggagaacggccccgaggaggugaagcccgucgggaagauggagaccgaccucaaggagauccgggaggagaucucccagcgcgagaaggugcuggcggaguucagcgccauccgcgagaaggagaucgaccugaaggagaccggcaagcgggacaucccgaucauggagaaggugagcgggaagauggccgucguggaggagauggaggccgaccucaaggagacgggcaaggagaacuuccgcgagcggggguccgaggagaucugcgugaccgaggagaaggucgccgagcugaagcagaccggcaagaccgacaucagcccccgcgagaacgagcuggaggagacguccaccagccggcagaccgacacccaccucaugcaguccggcagcaacgacuucuccgcggugcccagccuggacauccagaacaucuccagcgagguccuguccaugaugcacacgcccguggaggagaagcgcaacagcgagaaggagguguccagccacuucucccacuucaagaucagcucccagacccacgagagcgacaagaccgagguccaggggauccaguccccggacgugcccgagcaguucagcgacaucaaccucagcaagucccugccccaggagcagaagccccuggagaucaagccggcccccuucgugcggagccgcuucaagcggcccaagccgaaccucgcccgcgccgcccugaagcgggagaccacggaguccgagaaguacaucuacgagaagaaguccgagaccaagaagauggagaccaucgucaugcaggagaacaacgagcagaccgacacgcugcccucccagcacgacgaggcgagccucaugaucucccgcgagaaggacacccugggccaccggaacgaggaggccgugauccugcccugcacccagaccgagcgcaaccucagccccuccaacagcugcgagccgaaggaggagucccagagcgcccccgugcagaagaacgacuccgucgugagcguggggacgaacaacgucaacaccuuccagcaggagaugaaggaguccgugauccagaccgcccgccaggugcgcggccggcugcagcgcccccggcccaacauccgcaagaccgggcagcggcagaucgucgacaagggcgaggcgaagggcaucaucaaggaggggcgcacgauccugccgaaggacgagaccgagaagaaggugcucaccgugagcaacucccagaucgagaccgagaucgagguccccagcuccgccgugcccgagcaccgcauguacgagaaccagagccaggugguccugguggagaaccugcacgugaacaagacgaacgagaccauccggcacgagaacaagcccuacgucccgagcuccgcccagaugacccgccggaaguuccagaaggccaagcccaaccucggccgcgcccacagcaagaaggaggagcccgugcuggagaaggugaccacggaccaguccaaggaggggaagcccgaggaccaccuccugcagaagggcgcgagcaacacccagcugcugcucaaggagaaggccgagcugcugaccucccucgaggucagcgcccggaaggacugcgugggcuccaaggagagcgcccuggccaagaucgacgcggagcuggaggagguggggccgucccgccgggucggcgaggagaccgugggggacaacagccccuccagcguggucgaggagcaguaccucaacaagcugacguccugcccccagccccugaacgagaccagcuacuccaagaucgcccucgacggcaagaccaccaucagcuccaccagcgaguacgagcgcaaccgcggggagcgccggucccacaagaaguucaagccgaacgugacgcgcggccggggcagcaagcgcgugcgggggaagaccagcaagaaggagccccgcgccuccaaggccaugcuggucacccugcgggccagccaggaggaggacgacgacgcggacgacuucgaguccgacuacgaggaggagagcuaccaccucgcccccgaggaggugaacaaggcccccguguucgucccggugggccugcgcucccccgagcccgugagcgcccagaucgaggagaccauggaggagcuggagaucacggucaacgugcccgacguggggugcaucgccgucguggagcacgagcucccgaacaccgacgugaccaccgaggagaugaagcaggaggagaaccuguccguccccuucgagaugacgaccagcgagcacauccaggacgagcccggcaccaacgacggguccaccgaggcggccaucacgcugcucaccaugggcgaccuggugcugcagagcgagaucuccagcgagcagggcgacgugggggucugcaucaucccgcacgugcacuccaaggacaagagccacauccccuccagccucgacaacgucaaccacaagaucgugcacgagugccaggagcuguccagccccgugaucaccaccagccccgccuccuucgaggagaacaagaucguccuggaggagcagagcucccgggaggagaucagccucauggagaaggugaaggagaacgccacgccgacccgcaacaccaucuccaaggugaccagcaaccugcgcauccggucccgccuggcgaagcccaagcccaaccucgagaagacgcugggcaccaaccggcuggacgacuaccaggaggucagcucccucugcgugaccaagggggccgagauggagacccagcgcgagacggagaagaacgccagcaaggccaccgagcuggagaacaagaaccugggccccgugaccaccgccgagaacaaggaccaguccaagcucgcgugcguccacgggaucaagggcacgagcaucuccagcgaggugaaccugaccgagcggaacgagaaccaggaggaguccagccaggaggugcacaugcuguccgucgccccgguggccagcuccgagaccggccccugcacccucgggcuggaccgcggccugggggagaacagcguggaggagccccagaucaaggacagcaagggcgacuccguccucacgcugcccgugccggaguacacccccaccagcauccccgaggugcagcaggagaacaucaucaacccccaggaccugaccgucaaccucguggccaacgugccgcaggacggcgaggacgagcaggccuucauccugacgcuggucgagauccccgcgaacgccguggaggaguucaccgacgccaccgcccaguucaugcccaacccccugcucccggcccccauccuggugaaguccgucaacaccgaggagcgcggggacaugagcaucugccugcccgcgacguccgugggccaggacgccauggggcucagcaucuccggccgcgacaacagcaagaagcccccggacaaccuggaccuggugucccggaagcgcuuccagugccggcucgacaagaacgaccacaucccgcccgccaagaagcgcagccugacccugcgggacgacugccaggaguacaccaccgagguccacuccaaggagcucaccaacguguucgaggagacgggggagagccacaagggccaggacaucuuccugaccuccggcagcacccugaccacgccggagccccagcgccagcaggucgaggccgcguuccagucccgggggagccgcucccccgacgccugcauggacaagaacgucccccagcucccgcaggacgagaugaucgugagcgacaaggaggagcggaccgacgccgcccccaagucccagcagauggacagccgcaccagcuccagcaaggccucccugagccggcccggccgccggccccugggguuccucucccugaucugcagcaagaacucccuggagagcgacgagccgaugcagguccacuccaagaagcgccucaagccccugauccccggccugcgcaagaagcucaagcggagcaaccccuucaacgagucccaggagaagaaccgcgagagcuccgaccugcugccgagccccuccgucaucaccacgcagagcgagaacaucuccagcuccgcgacccaggugagcugcgaccagccccuccugaaggagggguacaagagcgcccagaagcgggcgccccagggcgaggccaccaccguguccgaguacuucuucaacgacaucuucaucgaggucgacgagacggaguga

SEQ ID NO: 27242 - RNA, 627 nt, Artificial Sequence
  derived and/or modified sequence opt1 from BEAN1__Homo_sapiens__NP_001184154
augcgcuacgccugcagcuccagcgaggacuggcccccgccccuggacaucuccagcgacggcgacguggacgccaccguccuccgggagcuguaccccgacuccccgcccggggugagccugucccgccuccgguggagcgcgaugauguacaccggcuccuucacguacugggugcgcagcaugcugucccggcacaagcuggacgccauccucgggcgccugggcuacaccgccacccuggagagcgaguucucccucguccaggccaucagcaaggagaacgugaagcagaugguguucaagaucuuccugguccggguguccugcgaggccgugcugcgcaccgcggggacgcggaugcucgagcccggcaccgagaagcuggcccgcacccacagccggcacuccagcgagaagcgccuggucaagcccugcuccugccucgagggcgugcagcccgggccgggcagcgggggcccccagcaggggcccagcgagggcgugggcuccgagaccgcccuggccgaggggacggcgggccagcggagccugcccauggcccucuccccgagcgaggucuccaccgcccccaacagccugcccuccgggagccccgugcuguga

SEQ ID NO: 27243 - RNA, 1782 nt, Artificial Sequence
  derived and/or modified sequence opt1 from BEGAIN__Homo_sapiens__NP_001153003
auggagaagcugagcgcccuccaggagcagaagggcgagcugcgcaagcggcuguccuacaccacccacaagcucgagaagcuggagacggaguucgacagcacccgccacuaccuggagaucgagcuccggcgcgcccaggaggagcuggagaaggugaccgagaagcugcggcgcauccaguccaacuacauggcgcuccagcggaucaaccaggagcuggaggacaagcuguaccgcauggggcagcacuacgaggaggagaagcgggcccucagccacgagaucgucgcccugaacucccaccuccuggaggccaaggugaccaucgacaagcugagcgaggacaacgagcuguaccgcaaggacugcaaccucgccgcgcagcugcugcagugcucccagacguacggccgggugcacaaggucagcgagcuccccuccgacuuccaggagcgcgugagccugcacauggagaagcacgggugcucccugccgagcccccucugccaccccgccuacgccgacuccgugccgaccugcgucaucgccaaggugcuggagaagcccgaccccgcgagccuguccagccggcucuccgacgccagcgcccgcgaccuggccuucugcgacggcguggagaagcccgggccccggccgcccuacaagggcgacaucuacugcuccgacaccgcccuguacugccccgaggagcgccggcgcgaccggcgccccagcgucgacgcgccggugaccgacgugggcuuccuccgggcccagaacagcacggacuccgccgccgaggaggaggaggaggccgaggcggccgccuuccccgccggguuccagcacgaggccuuccccagcuacgcgggcucccugcccaccagcuccagcuacuccagcuucuccgccaccagcgaggagaaggagcacgcccaggccuccacccugacggccagccagcaggcgaucuaccucaacucccgcgacgagcuguucgaccgcaagccgcccgccaccaccuacgaggggagcccccgguucgccaaggccaccgcggccgucgccgcgccccuggaggccgagguggccccgggcuucgggcgcacgaugucccccuaccccgccgagaccuuccgguuccccgccagcccgggcccccagcaggcccucaugccgcccaaccuguggucccugcgcgccaagcccggcaccgcgcggcuccccggggaggacaugcgcggccaguggcggccccugagcguggaggacaucggggccuacuccuacccggucagcgccgccggccgcgccagccccugcuccuucagcgagcgguacuacggcggggcgggcgggucccccggcaagaaggccgacgggcgcgccagcccccuguacgccuccuacaaggcggacagcuucuccgagggcgacgaccucagccagggccaccuggccgagccgugcuuccugcgggccgggggcgaccucucccugagccccgggcgcuccgccgacccccugcccggcuacgccccgagcgagggcggggacggcgaccggcucggggugcagcugugcggcaccgcguccagccccgagcccgagcaggggucccgcgacagccuggagcccuccagcauggaggccagcccggagaugcaccccgccgcccggcugagcccccagcaggccuucccccgcacgggcggguccggccucucccggaaggacagccugaccaaggcgcagcuguacggcacccuccugaacuga

SEQ ID NO: 27244 - RNA, 2487 nt, Artificial Sequence
  derived and/or modified sequence opt1 from BEND3__Homo_sapiens__NP_001073919
augaacagcaccgaguucaccgaggacguggaggagguccugaaguccaucacggugaagguggagaccgaggccgaggacgccgcgcucgacugcagcgucaacucccgcaccagcgagaagcacuccguggacagcgugcugaccgcccugcaggacuccagcaagcggaagcagcucgucuccgacggccugcuggacagcgugcccggggugaagcgccggcgccucaucccggaggcccugcuggccggcaugcggaaccgcgagaacuccagccccugccaggggaacggcgagcaggccgggcggggccgcucccucggcaacgucuggcccggggaggaggagcccugcaacgacgcgacgaccccgagcuacaagaagccccuguacggcaucucccacaagaucauggagaagaagaacccgcccagcggggaccugcucaacguguacgagcuguucgagaaggccaacgccuccaacagccccuccagccugcggcuccugaacgagccccagaagcgcgacugcggcagcaccggggccggcaccgacaacgaccccaacaucuacuuccugauccagaagauguucuacaugcucaacacgcugaccuccaacaugagccagcugcacuccaagguggaccuccugagccuggaggucucccggaucaagaagcaggucagccccaccgagaugguggcgaaguuccagccgccgcccgaguaccagcucaccgccgccgagcugaagcagaucguggaccagucccugagcggcggggaccucgccugccgccugcuggugcagcuguuccccgagcuguucuccgacguggacuucagccggggcugcuccgccugcggguucgcggccaagcgcaagcuggagagccuccaccuccagcugauccggaacuacgucgagguguacuaccccuccgugaaggacacggccgucuggcaggccgagugccucccccagcugaacgacuucuucagccgcuucugggcccagcgggagauggaggacucccagcccagcggccagguggcguccuucuucgaggccgagcaggucgaccccggccacuuccuggacaacaaggaccaggaggaggcccucagccuggaccgcuccagcaccaucgccagcgaccacgugguggacacccaggaccugaccgaguuccucgacgaggccuccagcccgggggaguucgcggucuuccugcugcaccgccucuuccccgagcuguucgaccaccggaagcugggcgagcaguacuccugcuacggggacggcgggaagcaggagcucgacccccagcggcugcagaucauccgcaacuacacggagaucuacuuccccgacaugcaggaggaggaggccuggcugcagcagugcgcccagcgcaucaacgacgagcuggagggccucggccuggacgccgggagcgagggcgacccgccccgggacgacugcuacgacuccagcucccugcccgacgacaucagcguggugaaggucgaggacuccuucgagggggagcgccccggccggcgcagcaagaagaucuggcucgugccgaucgacuucgacaagcuggagaucccccagcccgacuucgaggugccgggggccgacugccugcucuccaaggagcagcugcggagcaucuacgaguccagccuguccaucggcaacuucgcgagccgccuccugguccaccuguuccccgagcuguucacccacgagaaccuccggaagcaguacaacugcuccggcagccuggggaagaagcagcucgaccccagccgcaucaagcugauccggcacuacgugcagcugcucuacccccgcgccaagaacgaccggguguggacccuggaguucgucggcaagcuggacgagcgcugccggcgccgggacaccgagcagcgccgguccuaccagcagcagcgcaaggugcacgugccggggcccgagugccgggaccucacgagcuacgccaucaaccccgagcgcuuccgcgaggaguucgaggggcccccgcugccgcccgagcgguccagcaaggacuucugcaagaucccccuggacgagcucgucgugcccucccccgacuuccccgugcccagcccguaccugcuguccgacaaggagguccgcgagaucgugcagcagagccucuccgugggcaacuucgccgcgcggcugcugguccgccucuuccccgagcuguucaccgccgagaaccugcggcuccaguacaaccacagcggcgccugcaacaagaagcagcuggaccccacccgccugcggcucauccgccacuacguggaggccguguaccccgucgagaagauggaggagguguggcacuacgagugcaucccguccaucgacgagcggugccgccggcccaaccgcaagaagugcgacauccugaagaaggccaagaagguggagaaguga

SEQ ID NO: 27245 - RNA, 1326 nt, Artificial Sequence
  derived and/or modified sequence opt1 from BEND4__Homo_sapiens__NP_001153019
auggaggaggagaugcagcccgccgaggagggcccgagcgugcccaagaucuacaagcagcgcucccccuacagcguccugaagaccuuccccuccaagcggccggcccucgcgaagcgcuacgagcggcccacccugguggagcugccccacgugcgcgcgcccccgcccccgcccccgcccuucgcgccccacgccgccgucagcaucuccagcuccgagcccccgccccagcaguuccaggcccagagcuccuacccgcccgggcccggccgggccgccgccgccgccagcuccagcucccccagcugcacgcccgccaccucccaggggcaccuccgcacccccgcccagccgccgcccgccagccccgcggccuccagcuccagcagcuucgccgccguggugcgguacggccccggggccgcggccgccgccggcaccggcgggacgggcuccgacagcgccucccuggagcugagcgcggagucccgcaugauccucgacgccuucgcccagcagugcagccggguccugucccugcucaacugcgggggcaagcugcuggacagcaaccacucccagagcaugaucuccugcgugaagcaggaggggagcuccuacaacgagcgccaggagcacugccacaucggcaagggcgugcacagccagaccuccgacaacgucgacaucgagaugcaguacaugcagcggaagcagcagaccagcgccuuccuccgcguguucaccgacucccugcagaacuaccugcucagcggguccuuccccacgcccaaccccagcagcgccuccgaguacggccaccuggcggacguggacccccugagcaccucccccguccacacccucgggggcuggaccagccccgccacguccgagagccacggccacccguccagcuccacccugcccgaggaggaggaggaggaggacgaggagggguacugcccccggugccaggagcuggagcaggaggugaucagccuccagcaggagaacgaggagcugcgccggaagcuggaguccauccccgugccgugccagaccguccucgacuaccugaagauggugcugcagcaccacaaccagcuccugaucccccagcccgccgaccagcccaccgagggcagcaagcagcugcucaacaacuacccgguguacaucacguccaagcagugggacgaggccgucaacagcuccaagaaggacgggcgccggcugcugcgcuaccucauccgguucguguucaccaccgacgagcugaaguacagcugcggccuggggaagcgcaagcggauccacuga

SEQ ID NO: 27246 - RNA, 1815 nt, Artificial Sequence
  derived and/or modified sequence opt1 from BEST1__Homo_sapiens__NP_001132915
auguucgagaagcugacccucuacugcgacagcuacauccagcugauccccaucuccuucgugcugggcuucuacgucacccucguggugacgcgcugguggaaccaguacgagaaccugccguggcccgaccggcugaugagccucgucuccggguucguggagggcaaggacgagcaggggcgccugcugcggcgcacccucauccgguacgccaaccugggcaacgugcugauccuccgcagcgucuccaccgccguguacaagcgguuccccagcgcgcagcaccuggugcaggccggguucaugacccccgccgagcacaagcagcuggagaagcucucccugccgcacaacauguucuggguccccugggugugguucgccaaccugagcaugaaggccuggcucggcggccgcauccgggaccccauccugcugcagucccuccugaacgagaugaacacgcugcgcacccagugcgggcaccucuacgcguacgacuggaucagcaucccccugguguacacccaggucgugaccguggccgucuacuccuucuuccugacgugccucgugggccggcaguuccugaacccggccaaggccuaccccgggcacgagcuggaccucgugguccccguguucaccuuccugcaguucuucuucuacgugggcuggcugaaggucgcggagcagcucaucaaccccuucggggaggacgacgacgacuucgagaccaacuggaucguggaccgcaaccuccaggugagccugcuggccgucgacgagaugcaccaggaccugccgcggauggagcccgacauguacuggaacaagcccgagccccagccgcccuacaccgccgccuccgcccaguuccgccgggcgagcuucaugggcuccacguucaacaucagccugaacaaggaggagauggaguuccagcccaaccaggaggacgaggaggacgcccacgccggcaucaucgggcgcuuccucggccugcagucccacgaccaccacccgccccgggccaacagccgcaccaagcugcucuggcccaagcgggagucccugcugcacgaggggcuccccaagaaccacaaggccgcgaagcagaacgugcgcggccaggaggacaacaaggccuggaagcugaaggccgucgacgccuucaagagcgccccgcuguaccagcggcccggcuacuacagcgcgccccagacgccccucucccccaccccgauguucuucccccuggagcccagcgccccguccaagcugcacagcgugaccgggaucgacaccaaggacaagucccugaagaccgugagcuccggcgccaagaaguccuucgagcuccugagcgagagcgacggggcccugauggagcaccccgaggucucccaggugcgccgcaagaccguggaguucaaccucacggacaugcccgagauccccgagaaccaccugaaggagccgcuggagcagagccccaccaacauccacaccacccucaaggaccacauggaccccuacugggcccuggagaaccgguccguccugcaccucaaccagggccacugcaucgcgcugugccccacgccggccagccuggcccucucccugcccuuccugcacaacuuccucggguuccaccacugccagagcacccuggaccugcgccccgcccucgcguggggcaucuaccuggccaccuucaccggcauccuggggaagugcuccggccccuuccucacgagcccgugguaccaccccgaggacuuccuggggcccggcgaggggcgguga

SEQ ID NO: 27247 - RNA, 1530 nt, Artificial Sequence
  derived and/or modified sequence opt1 from BEST2__Homo_sapiens__XP_005260020
augaccgugaccuacacggcccgcgucgccaacgcgcgguucggcggguucagccagcugcuccugcuguggcgcggcuccaucuacaagcuccuguggcgggagcugcucugcuuccugggguucuacauggcccugagcgccgccuaccgcuucgugcucaccgagggccagaagcgguacuucgagaagcuggugaucuacugcgaccaguacgccucccugauccccgucagcuucgugcucggguucuacgugacccuggucgugaaccgcugguggucccaguaccugugcaugccgcuccccgacgcgcugaugugcguggucgccggcaccgugcacggccgggacgaccgcgggcggcuguaccgccggacgcucaugcgcuacgccggccugagcgccgugcugauccuccgguccgucagcaccgcgguguucaagcgcuuccccaccaucgaccacguggucgaggccggguucaugacccgggaggagcgcaagaaguucgagaaccugaacuccagcuacaacaaguacugggugcccugcgugugguucuccaaccuggccgcccaggcccggcgcgagggccggauccgcgacaacagcgcgcucaagcugcugcucgaggagcugaacgucuuccgggggaagugcggcaugcuguuccacuacgacuggaucuccgugccgcucguguacacgcaggucgugaccaucgcccuguacagcuacuuccuggccugccucaucggccgccaguuccuggaccccgcccagggguacaaggaccacgaccuggaccucugcgugcccaucuucacccugcugcaguucuucuucuacgccggcuggcucaaggucgcggagcagcugaucaaccccuucggggaggacgacgacgacuucgagaccaacuuccugaucgaccgcaacuuccagguguccaugcucgccgucgacgagauguacgacgaccuggccgugcuggagaaggaccucuacugggacgccgccgaggcgcgggccccguacacggccgccaccguguuccagcugcgccagcccagcuuccagggcuccaccuucgacaucacccuggccaaggaggacaugcaguuccagcggcucgacggccuggacgggcccaugggcgaggcgcccggggacuuccugcagcgccugcucccggccggcgccgggauggucgccggcggcccccuggggcggcgccugagcuuccuccugcggaagaacuccugcgugagcgaggcgagcacgggcgccuccugcagcugcgccgugguccccgagggggccgcccccgagugcuccugcggcgacccgcugcucgaccccgggcugcccgagcccgaggcgccgccgcccgccggccccgagccccugacccucauccccggccccguggagcccuucagcaucgugaccaugccggggccccgcggccccgccccgcccuggcugcccucccccaucggggaggaggaggagaaccuggccuga

SEQ ID NO: 27248 - RNA, 357 nt, Artificial Sequence
  derived and/or modified sequence opt1 from BET1__Homo_sapiens__NP_005859
augcgccgggccggccugggggagggcgugcccccggggaacuacggcaacuacggguacgccaacagcggcuacuccgcgugcgaggaggagaacgagcgccucaccgagagccugcgguccaaggucaccgccaucaagagccuguccaucgagaucggccacgaggugaagacgcagaacaagcuccuggccgagauggacagccaguucgacuccaccaccggguuccugggcaagaccauggggaagcucaagauccugagccgcggcucccagacgaagcugcucugcuacaugaugcuguucagccuguucguguucuucaucaucuacuggaucaucaagcuccgguga

SEQ ID NO: 27249 - RNA, 336 nt, Artificial Sequence
  derived and/or modified sequence opt1 from BET1L__Homo_sapiens__NP_001092257
auggccgacugggcccgcgcgcagagccccggcgccguggaggagauccuggaccgggagaacaagcgcauggccgacucccucgccagcaaggucacccggcugaagucccuggcccucgacaucgaccgcgacgcggaggaccagaaccgguaccuggacgggauggacagcgacuucaccuccaugacgagccugcucaccggcuccgugaagcgcuucagcaccauggcccgguccgggcaggacaaccgcaagcugcugugcggcauggccguggggcucaucgucgccuucuucauccugagcuacuuccugucccgggcgcgcaccuga

SEQ ID NO: 27250 - RNA, 378 nt, Artificial Sequence
  derived and/or modified sequence opt1 from BEX1__Homo_sapiens__NP_060946
auggagagcaaggagaagcgcgccgugaacucccugagcauggagaacgccaaccaggagaacgaggagaaggagcaggucgcgaacaagggcgagccccucgcccugccgcuggacgccggggaguacugcgugccccggggcaaccgccggcgcuuccgggugcgccagcccauccuccaguaccggugggacaugaugcaccgccugggggagccccaggcccggaugcgcgaggagaacauggagcggaucggcgaggagguccgccagcugauggagaagcuccgggagaagcagcugucccacagccugcgcgccguguccaccgacccgccccaccacgaccaccacgacgaguucugccucaugcccuga

SEQ ID NO: 27251 - RNA, 483 nt, Artificial Sequence
  derived and/or modified sequence opt1 from BEX2__Homo_sapiens__NP_001161871
augcagaagaugguggucugcggcgccaagugcugcggggacgcgccccacguggagaaccgcgaggaggagaccgcccggaucggcccgggggugauggagagcaaggaggagcgcgcccugaacaaccucaucgucgagaacgugaaccaggagaacgacgagaaggacgagaaggagcaggucgccaacaagggcgagccccuggcccugccccucaacguguccgaguacugcgugccccgggggaaccgccggcgcuuccgggugcgccagccgauccugcaguaccggugggacaucaugcaccgccugggcgagccccaggcccggaugcgcgaggagaacauggagcggaucggcgaggagguccgccagcucauggagaagcugcgggagaagcagcugagccacucccuccgcgcggugagcaccgacccgccccaccacgaccaccacgacgaguucugccugaugcccuga

SEQ ID NO: 27252 - RNA, 363 nt, Artificial Sequence
  derived and/or modified sequence opt1 from BEX4__Homo_sapiens__NP_001073894
auggagagcaaggaggagcuggccgccaacaaccucaacggcgagaacgcgcagcaggagaacgagggcggggagcaggcccccacccagaacgaggaggagucccgccaccucgggggcggggagggccagaagccgggcgggaacauccggcgcggccgggugcgccggcugguccccaacuuccgcugggccauccccaaccggcacaucgagcacaacgaggcccgcgacgacguggagcgguucguggggcagaugauggagaucaagcgcaagacccgggagcagcagaugcgccacuacaugcgguuccagacgcccgagccggacaaccacuacgacuucugccugauccccuga

SEQ ID NO: 27253 - RNA, 1353 nt, Artificial Sequence
  derived and/or modified sequence opt1 from BFAR__Homo_sapiens__NP_057645
auggaggagccccagaaguccuacgugaacaccauggaccuggagcgcgacgagccgcucaagagcaccggcccccagaucagcgucuccgaguucagcugccacugcugcuacgacauccuggugaaccccacgacccugaacugcgggcacuccuucugccggcacugccucgcccuguggugggccagcuccaagaagaccgagugccccgagugccgcgagaagugggagggcuucccgaaggugagcauccugcuccgggacgcgaucgagaagcuguuccccgacgccauccgccugcgguucgaggacauccagcagaacaacgacaucguccagucccucgccgccuuccagaaguacgggaacgaccagaucccccuggcccccaacaccggccgcgcgaaccagcagaugggcgggggcuucuucagcggggugcugacggcccucaccggcguggccgucgugcugcugguguaccacugguccagccgggaguccgagcacgaccuccugguccacaaggccguggcgaaguggaccgccgaggaggugguccuguggcucgagcagcuggggccgugggccagccuguaccgcgagcgguuccucuccgagcgcgugaacggccggcugcugcucacccugacggaggaggaguucagcaagacccccuacaccaucgagaacuccagccaccgccgggccauccugauggagcucgagcgcgugaaggcccugggggucaagccgccccagaaccugugggaguacaaggcggugaaccccggccggucccucuuccugcuguacgcccucaagagcagcccccgccugucccugcucuaccuguaccuguucgacuacaccgacacguuccuccccuucauccacaccaucugcccccugcaggaggacagcuccggcgaggacaucgugaccaagcugcucgaccugaaggagccgaccuggaagcaguggcgggaguuccuggucaaguacagcuuccuccccuaccagcugaucgccgaguucgccugggacuggcuggaggugcacuacuggacgucccgcuuccucaucaucaacgccaugcugcugagcgugcuggagcuguucuccuucuggcggaucuggagccgcuccgagcucaagaccgucccccagcggauguggagccacuucuggaagguguccacccaggggcuguucguggcgauguucuggccccucaucccgcaguucgucugcaacugccuguucuacugggcccuguacuucaaccccaucaucaacaucgaccucguggucaaggagcugcgccgccuggagacccaggugcucuga

SEQ ID NO: 27254 - RNA, 1623 nt, Artificial Sequence
  derived and/or modified sequence opt1 from BFSP1__Homo_sapiens__NP_001155177
auguacgagaacgagugcgagugccagcugcuccugaaggagaugcuggagcgccucaacaaggaggccgacgaggcccugcugcacaaccuccggcugcagcuggaggcgcaguuccuccaggacgacaucagcgccgccaaggaccgccacaagaagaaccugcuggaggugcagaccuacaucagcauccuccagcagaucauccacaccacgcccccggccagcaucgucaccuccggcaugcgggaggagaagcugcugaccgagcgcgagguggccgcgcuccggagccagcuggaggaggggcgcgaggugcugucccaccuccaggcccagcgggucgagcugcaggcccagaccacgacccuggagcaggccaucaagagcgcgcacgagugcuacgacgacgagauccagcucuacaacgagcagaucgagacccugcgcaaggagaucgaggagaccgagcgggugcuggagaaguccagcuacgacugccgccagcucgccguggcccagcagacgcugaagaacgagcuggaccgguaccaccgcaucaucgagaucgagggcaaccggcucaccuccgccuucaucgagacccccaucccccuguucacccagagccacggggucucccugagcacgggcuccgggggcaaggaccucacccgcgcccugcaggacaucaccgcggccaagccccggcagaaggcccugccgaagaacgugccccgccggaaggagaucaucaccaaggacaagacgaacggcgcccucgaggacgcgccccugaaggggcuggaggacaccaagcucgugcaggucgugcugaaggaggagagcgaguccaaguucgagagcgaguccaaggaggugagcccccugacccaggagggcgccccggaggacguccccgacgggggccagaucuccaagggguucggcaagcucuaccgcaaggugaaggagaaggugcggagccccaaggagcccgagaccccgacggagcuguacaccaaggagcgccacguccuggugaccggcgacgccaacuacguggacccccgguucuacgucagcuccaucaccgccaagggcgggguggccgugagcgucgccgaggacuccgugcucuacgacggccagguggagcccagccccgaguccccgaagccgccccuggagaacgggcaggucggccugcaggagaaggaggacgggcagcccaucgaccagcagcccaucgacaaggagaucgagcccgacggcgcggagcucgaggggcccgaggagaagcgcgagggcgaggagcgcgacgaggagagccggcgccccugcgccauggugacgccgggggccgaggagcccuccauccccgagcccccgaagcccgccgccgaccaggacggcgcggagguccugggcacccggagccgcucccugcccgagaaggggccgcccaaggcccucgccuacaagaccguggagguggucgagagcaucgagaagaucuccaccgagagcauccagacguacgaggagaccgccgugaucguggagaccaugaucggcaagaccaaguccgacaagaagaaguccggggagaaguccagcuga

SEQ ID NO: 27255 - RNA, 1248 nt, Artificial Sequence
  derived and/or modified sequence opt1 from BFSP2__Homo_sapiens__NP_003562
augagcgagcgccggguggucguggaccugcccaccuccgccagcuccagcaugccgcuccagcgccggcgcgccuccuuccggggcccccgcagcuccagcucccuggagagcccgcccgcgucccggaccaacgccaugagcgggcuggugcgcgcccccggcgucuacguggggacggcccccuccggcugcaucgggggccucggcgcccgggugacccgccgggcgcuggggaucagcuccgucuuccugcagggccuccgcagcuccgggcuggccaccgugcccgcccccggccuggagcgggaccacggggccguggaggaccucggcggcugccuggucgaguacauggcgaaggugcacgcccuggagcaggucagccaggagcucgagacccagcugcgcaugcaccuggaguccaaggccacgcggagcgggaacuggggcgcccuccgcgccagcugggcguccagcugccagcaggucggggaggccgugcuggagaacgcccggcugaugcuccagaccgagaccauccaggccggcgccgacgacuucaaggagcgcuacgagaacgagcagccguuccggaaggcggccgaggaggagaucaacucccuguacaaggugaucgacgaggccaaccugaccaagauggaccucgagagccagaucgagucccugaaggaggagcugggcagccucucccgcaacuacgaggaggacgugaagcugcugcacaagcagcucgccgggugcgagcuggagcagauggacgcccccaucggcacggggcuggacgacauccucgagaccauccggauccagugggagcgcgacguggagaagaaccgcguggaggcgggcgcccugcugcaggccaagcagcaggccgaggucgcccacaugagccagacccaggaggagaagcucgcggccgcccugcggguggagcugcacaacaccuccugccaggugcagagccuccaggccgagacggagucccugcgcgcgcugaagcgggggcucgagaacacccugcacgacgccaagcacuggcacgacauggagcugcagaaccucggcgccgucgugggccgccuggaggccgagcugcgggagauccgcgccgaggcggagcagcagcagcaggagcgggcccaccuccuggcccgcaagugccagcugcagaaggacguggccagcuaccacgcccuccuggaccgggaggaguccggguga

SEQ ID NO: 27256 - RNA, 303 nt, Artificial Sequence
  derived and/or modified sequence opt1 from BGLAP__Homo_sapiens__NP_954642
augcgcgcccugacccuccuggcccugcucgcgcuggccgcccugugcaucgccggccaggccggggcgaagcccagcggcgccgaguccagcaagggggccgccuucguguccaagcaggagggcagcgaggucgugaagcggccgcgccgguaccucuaccaguggcugggggcgcccgugcccuaccccgacccgcuggagccccgccgggaggucugcgagcucaaccccgacugcgacgagcuggccgaccacaucggcuuccaggaggccuaccgccgguucuacggccccguguga

SEQ ID NO: 27257 - RNA, 1107 nt, Artificial Sequence
  derived and/or modified sequence opt1 from BGN__Homo_sapiens__NP_001702
auguggccccuguggcgccucgugagccugcuggcccucucccaggcccugccguucgagcagcggggcuucugggacuucacccuggacgacgggcccuucaugaugaacgacgaggaggcgagcggcgccgacaccuccgggguccucgaccccgacagcgugacgcccaccuacuccgccaugugcccguucggcugccacugccaccuccgcgugguccagugcagcgaccuggggcugaaguccgugcccaaggagaucagccccgacaccacccugcuggaccuccagaacaacgacaucuccgagcugcggaaggacgacuucaagggccugcagcaccucuacgcccuggugcuggucaacaacaagaucagcaagauccacgagaaggccuucagcccccuccgcaagcugcagaagcuguacaucuccaagaaccaccucguggagaucccgcccaaccugcccuccagccugguggagcuccggauccacgacaaccgcauccggaagguccccaagggcguguucuccgggcugcgcaacaugaacugcaucgagaugggcgggaacccgcuggagaacagcggcuucgagcccggggcguucgacggccucaagcugaacuaccugcggaucuccgaggccaagcucacgggcauccccaaggaccugcccgagacccugaacgagcuccaccuggaccacaacaagauccaggccaucgagcuggaggaccuccugcgcuacagcaagcuguaccggcucgggcugggccacaaccagauccgcaugaucgagaacgggucccugagcuuccucccgacccugcgggagcugcaccucgacaacaacaagcuggcccgcgugcccagcggccugcccgaccucaagcugcugcaggucguguaccugcacuccaacaacaucaccaaggugggcgucaacgacuucugccccaugggguucggcgugaagcgggcguacuacaacgggaucagccucuucaacaacccggugcccuacugggagguccagcccgccacguuccgcugcgugaccgaccggcuggccauccaguucggcaacuacaagaaguga

SEQ ID NO: 27258 - RNA, 570 nt, Artificial Sequence
  derived and/or modified sequence opt1 from BHLHA15__Homo_sapiens__NP_803238
augaagaccaagaaccggcccccgcgccgccgggcccccgugcaggacaccgaggccacgcccggcgaggggacccccgacggcagccugccgaaccccgggcccgagcccgcgaagggccugcgcucccggccggcccgcgccgccgcccgggcgcccggggagggccgccggcgccggcccggccccagcgggccgggcgggcgccgggacuccagcauccagcgccggcuggaguccaacgagcgcgagcggcagcgcaugcacaagcugaacaacgccuuccaggcccuccgggaggugaucccccacgugcgcgccgacaagaagcugagcaagaucgagacccugacccucgcgaagaacuacaucaagucccugacggccaccauccugaccaugagcuccagccggcuccccggccuggaggggcccggcccgaagcuguaccagcacuaccagcagcagcagcaggucgccggcggggcccucggcgccaccgaggcgcagccccaggggcaccuccagcgcuacuccacgcagauccacagcuuccgcgagggcaccuga

SEQ ID NO: 27259 - RNA, 708 nt, Artificial Sequence
  derived and/or modified sequence opt1 from BHLHA9__Homo_sapiens__NP_001157877
augcugcgcggcgcccccgggcucggccugaccgcccggaagggggcggaggacagcgccgaggaccugggcgggccgugccccgagcccggcggcgacuccggggugcucggcgccaacggggccagcugcucccgcggcgaggccgaggagcccgcggggcggcgccgggcccgcccgguccggagcaaggcccgccggauggccgcgaacgugcgcgagcggaagcgcauccuggacuacaacgaggccuucaacgcccugcggcgcgcccuccggcacgaccugggcggcaagcgccuguccaagaucgccacccuccggcgcgcgauccaccggaucgccgcccugagccuggugcuccgcgccucccccgcgccccgggggcccugcggccaccuggagugccacgggccggccgcccgcggcgacacgggcgacaccggggccagcccgccgccgcccgccggccccucccuggcccgccccgacgcggcccggcccagcguccccuccgcgccccgcugcgccagcugcccgccccacgcgccccucgcccggcccuccgccguggccgaggggcccggccuggcccaggccagcgggggcuccuggcgccggugccccggcgccagcuccgccgggcccccgcccuggccccgcggcuaccugcggagcgcccccgggaugggccacccccgcuccuga

SEQ ID NO: 27260 - RNA, 1644 nt, Artificial Sequence
  derived and/or modified sequence opt1 from BHLHB9__Homo_sapiens__NP_001135999
auggccggcaccaagaacaagacccgcgcccaggcgaagacggagaagaaggccgccauccaggccaaggccggggcggagcgggaggccaccggcgugguccgccccguggccaagacccgggccaaggcgaaggccaagaccgggagcaagacggacgccguggccgagaugaaggccgucuccaagaacaaggugguggcggagaccaaggagggcgcccugagcgagccgaagacccucgggaaggccaugggcgacuucacccccaaggccggcaacgaguccacgagcuccacgugcaagaacgaggccgggaccgacgcgugguucugggccggcgaggaggccaccaucaacagcugguucuggaacggggaggaggccggcaacuccuucagcaccaagaacgacaagcccgagaucggggcccaggucugcgcggaggagcuggagcccgccgccggcgccgacugcaagccgcgcuccggcgccgaggaggaggaggaggagaacgugaucgggaacugguucugggagggcgacgacaccagcuucgaccccaaccccaagcccgugucccggaucgucaagccgcagcccguguacgagaucaacgagaagaaccgccccaaggacuggagcgaggugaccaucuggcccaacgcgccggccgucacccccgccgugcugggguuccggucccaggcccccagcgaggcguccccgcccagcuacaucgugcucgccuccgccgaggagaacgccugcagccugcccgucgccacggcgugccgccccucccggaacacccgcagcugcagccagcccaucccggagugccgguucgacuccgaccccugcauccagaccaucgacgagauccgccggcagauccgcauccgggaggugaacggcaucaagcccuucgccugccccugcaagauggagugcuacauggacagcgaggaguucgagaagcuggugucccuccucaagagcaccacggacccgcugauccacaagaucgcccgcaucgccaugggcguccacaacgugcaccccuucgcccaggaguucaucaacgaggugggggucgugacccucaucgagucccugcugagcuuccccucccccgagaugcggaagaagaccgugaucacccucaacccgcccagcggcgacgagcgccagcggaagaucgagcugcacgucaagcacaugugcaaggagacgauguccuucccccugaacagcccggggcagcaguccggccucaagauccuggggcagcugaccaccgacuucgugcaccacuacaucgucgcgaacuacuucagcgagcuguuccaccuccuguccagcggcaacugcaagacccgcaaccuggugcugaagcugcuccugaacauguccgagaaccccacggccgcccgggacaugaucaacaugaaggcccuggccgcgcucaagcugaucuucaaccagaaggaggccaaggccaaccuggugagcggcgucgccaucuucaucaacaucaaggagcacauccgcaagggguccaucgugguggucgaccaccucagcuacaacacccugauggcgaucuuccgcgaggugaaggagaucaucgagaccauguga

SEQ ID NO: 27261 - RNA, 1146 nt, Artificial Sequence
  derived and/or modified sequence opt1 from BHLHE22__Homo_sapiens__NP_689627
auggagcgcggcaugcaccugggggccgccgcggccggcgaggacgaccucuuccugcacaagagccuguccgccagcaccuccaagcggcucgaggccgccuuccgcagcacgcccccggggauggaccugucccuggcgcccccgccccgggagcgccccgccagcuccagcuccagcccccucggcugcuucgagcccgccgaccccgagggggccggccugcugcucccgccgcccggcgggggcgggggcggguccgcgggcagcggcgggggcgggggcggcggggugggcguccccgggcugcuggugggcuccgccggggugggcggcgaccccagccucuccagccugcccgccggggccgcccugugccucaaguacggcgaguccgcgagccggggguccgucgccgagagcagcggcggggagcagucccccgacgacgacagcgacggccgcugcgagcuggugcugcgggccggcguggccgacccccgcgccuccccgggggcgggcgggggcggggccaaggccgccgagggcugcagcaacgcccaccuccacggcggggcguccgucccgcccggcgggcugggcggcgggggcgggggcgggagcuccagcggcuccagcggcgggggcgggggcuccgggagcggcuccggcgggagcuccagcuccagcuccagcagcuccaagaaguccaaggagcagaaggcccugcggcucaacaucaacgcccgcgagcggcgccggaugcacgaccugaacgacgcccuggacgagcuccgcgccgugauccccuacgcgcacagccccagcgugcggaagcuguccaagaucgccacccugcuccuggccaagaacuacauccugaugcaggcccaggcgcucgaggagaugcgccggcuggucgccuaccugaaccagggccaggccaucagcgccgccucccuccccagcuccgcggccgccgccgccgcggccgccgcccugcaccccgcccugggggcguacgagcaggccgccggcuaccccuucagcgccgggcucccgcccgcggccuccugccccgagaagugcgcccuguucaacagcguguccagcucccugugcaagcagugcaccgagaagcccuga

SEQ ID NO: 27262 - RNA, 726 nt, Artificial Sequence
  derived and/or modified sequence opt1 from BHLHE23__Homo_sapiens__NP_542173
augagcauccggcccccgggcgagccgcccucccccgggggcgccgccauggcggagcucaagagccuguccggggacgccuaccuggcccugagccacggcuacgccgccgcggccgccgggcucgccuacggcgcggcccgcgagcccgaggccgcccgcggcuacgggacccccggccccgggggcgaccugcccgccgcgccggcgccccgggcccccgcccaggccgccgaguccagcggggagcaguccggcgacgaggacgacgccuucgagcagcgccggcgccggcgcggccccgggagcgccgccgacggccggcgccggccgcgcgagcagcggucccugcgccucagcaucaacgcccgggagcgccggcgcaugcacgaccugaacgacgcgcuggacgggcuccgggccgugauccccuacgcccacucccccagcguccgcaagcuguccaagaucgccacccugcuccuggccaagaacuacauccugaugcaggcgcaggcccucgacgagaugcggcgccugguggccuuccugaaccagggccagggccucgccgcgcccgugaacgccgccccgcugacgcccuucgggcaggccaccgucugccccuucagcgccggcgcggcccuggggcccugcccggacaagugcgccgccuucuccggcacccccagcgcccucugcaagcacugccacgagaagcccuga

SEQ ID NO: 27263 - RNA, 1239 nt, Artificial Sequence
  derived and/or modified sequence opt1 from BHLHE40__Homo_sapiens__NP_003661
auggagcgcauccccagcgcccagccgccgcccgccugccugcccaaggcgcccggccucgagcacggggaccugcccggcauguaccccgcccacauguaccagguguacaagucccggcgcgggaucaagcggagcgaggacuccaaggagaccuacaagcugccccaccgccucaucgagaagaagcggcgcgaccggaucaacgagugcaucgcccagcugaaggaccugcucccggagcaccugaagcugaccacgcucggccaccuggagaaggccgucgugcuggagcucacccugaagcacgugaaggcccugaccaaccucaucgaccagcagcagcagaagaucaucgcgcugcagagcgggcugcaggccggcgagcucuccggccgcaacgucgagaccgggcaggagauguucugcagcggcuuccagacgugcgcccgggaggugcugcaguaccuggccaagcacgagaacacccgcgaccucaaguccagccagcuggugacccaccuccaccgggucguguccgagcugcugcagggcgggaccagccgcaagcccuccgaccccgcgcccaaggugauggacuucaaggagaagccgagcucccccgccaaggggagcgagggccccggcaagaacugcguccccgugauccagcggacguucgcccacuccagcggggagcaguccggcagcgacaccgacaccgacuccggguacggcggcgagagcgagaagggggaccugcgcagcgagcagccgugcuucaaguccgaccacggccggcgcuucaccaugggggagcggaucggcgccaucaagcaggagagcgaggagccgcccacgaagaagaaccgcaugcagcucuccgacgacgaggggcacuucaccagcuccgaccugaucagcucccccuuccugggcccccacccccaccagccgcccuucugccuccccuucuaccugaucccgcccagcgccaccgcguaccugcccaugcucgagaagugcugguaccccaccuccgugcccguccuguaccccggccugaacgccagcgccgccgcccucuccagcuucaugaacccggacaagaucuccgcgccccugcugaugccccagcggcuccccagcccgcugcccgcccaccccuccguggacagcuccgugcugcuccaggcccugaagcccaucccgccccugaaccucgagacgaaggacuga

SEQ ID NO: 27264 - RNA, 1449 nt, Artificial Sequence
  derived and/or modified sequence opt1 from BHLHE41__Homo_sapiens__NP_110389
auggacgagggcaucccccaccuccaggagcgccagcugcuggagcaccgggacuucaucgggcuggacuacagcucccuguacaugugcaagccgaagcgcagcaugaagcgggacgacaccaaggacaccuacaagcugccccaccgccugaucgagaagaagcggcgcgaccggaucaacgagugcaucgcccagcucaaggaccugcugcccgagcaccucaagcugacgacccugggccaccucgagaaggccgugguccuggagcugacccucaagcaccugaaggcgcugaccgcccucacggagcagcagcaccagaagaucaucgcccugcagaacggggagcgcucccucaagagccccauccaguccgaccuggacgccuuccacagcggcuuccagaccugcgccaaggaggugcugcaguaccugucccgguucgagagcuggaccccgcgcgagccccggugcgugcagcucaucaaccaccuccacgcggucgccacccaguuccugcccacgccccagcugcugacccagcaggucccgcuguccaaggggaccggcgcccccagcgccgcgggcuccgccgccgcccccugccucgagcgcgccgggcagaagcuggagccccuggcguacugcgugccggugauccagcggacccagcccagcgccgagcucgccgccgagaacgacacggacaccgacuccggcuacgggggcgaggccgaggcgcgccccgaccgggagaaggggaagggcgccggcgccagccgcgugaccaucaagcaggagcccccgggggaggacucccccgcccccaagcggaugaagcuggacagccgcggcgggggcuccggcgggggccccgggggcggggccgcggccgccgccgccgcgcugcucggcccggaccccgccgccgccgcggcccugcugcggcccgacgccgcccuccugagcucccugguggccuucggcgggggcgggggcgcgcccuucccgcagcccgccgccgccgccgcgcccuucugccuccccuucugcuuccugagcccgagcgccgccgccgccuacguccagcccuuccuggacaaguccgggcucgagaaguaccuguaccccgcggccgccgccgcgccguucccccugcucuaccccggcauccccgccccggccgccgccgcggccgccgccgccgcggccgccgccgccgcggccgccuuccccugccugagcuccgugcugagcccgccgcccgagaaggccggcgcggccgccgccacccugcucccccacgagguggccccgcugggggcgccccacccccagcacccccacggccgcacgcaccuccccuucgccgggccccgggagcccggcaaccccgaguccagcgcccaggaggaccccucccagcccgggaaggaggccccguga

SEQ ID NO: 27265 - RNA, 900 nt, Artificial Sequence
  derived and/or modified sequence opt1 from BHMT2__Homo_sapiens__NP_001171476
auggcccccgccggccgcccgggggcgaagaagggcauccuggagcggcucgagagcggggagguggucaucggcgacggguccuuccugaucacccuggagaagcgcggcuacgugaaggccggccucuggacccccgaggccgugaucgagcaccccgacgccguccggcagcugcacauggaguuccugcgcgccgggagcaacgugaugcagacguucaccuucuccgcgagcgaggacaacauggaguccaaguacuucgagcacguggaggaggccgucugggccguggaggugcucaaggagagcgaccggcccgucgccgugaccaugugcaucggcccggagggggacaugcacgacaucacccccggcgagugcgcggugcgccuggucaaggccggggccuccaucgugggcgugaacugccgguucggccccgacacgagccugaagaccauggagcucaugaaggaggggcuggagugggccggccugaaggcccaccucaugguccagccccugggguuccacgcgccggacugcggcaaggagggcuucguggaccugcccgaguaccccuucgggcucgagucccgcguggccacccggugggacauccagaaguacgcccgcgaggccuacaaccugggcguccgguacaucgggggcugcugcggguucgagcccuaccacauccgcgccaucgcggaggagcuggccccggagcggggcuuccucccgcccgccagcgagaagcacggcuccugggggagcggccuggacaugcacaccaagcccuggauccgcgcccgggcccgccgggaguacugggagaaccugcuccccgcguccgggcgccccuucugccccagccuguccaagcccgacuucuga

SEQ ID NO: 27266 - RNA, 1221 nt, Artificial Sequence
  derived and/or modified sequence opt1 from BHMT__Homo_sapiens__NP_001704
augcccccggugggcgggaagaaggccaagaagggcauccuggagcgccucaacgccggggagaucgucaucggcgacgggggcuucguguucgcgcuggagaagcggggcuacgugaaggccgggcccuggacccccgaggccgccgucgagcaccccgaggccgugcgccagcugcaccgggaguuccuccgcgcgggcagcaacgugaugcagaccuucacguucuacgccuccgaggacaagcuggagaaccgggggaacuacguccuggagaagaucagcggccaggaggugaacgaggccgccugcgacaucgcgcgccagguggccgacgagggggacgcccucgucgccggcggcgugucccagaccccgagcuaccuguccugcaagagcgagaccgaggugaagaaggucuuccugcagcagcucgagguguucaugaagaagaacguggacuuccugaucgccgaguacuucgagcacgucgaggaggcggugugggccguggagacccugaucgccuccgggaagcccgucgccgccacgaugugcaucggccccgagggggaccuccacggcgugcccccgggcgagugcgcggugcggcuggucaaggccggggccagcaucaucggcgugaacugccacuucgaccccaccaucucccugaagaccgugaagcucaugaaggaggggcuggaggccgcccgccugaaggcgcaccucaugagccagccccuggccuaccacacccccgacugcaacaagcagggcuucaucgaccugccggaguuccccuucgggcucgagccccgggucgccacgcgcugggacauccagaaguacgcccgggaggccuacaaccugggcgugcgcuacaucggcgggugcugcggcuucgagcccuaccacauccgggcgaucgccgaggagcuggccccggagcgcggguuccucccgcccgccuccgagaagcacggcagcuggggguccggccuggacaugcacaccaagcccuggguccgggcgcgcgcccggaaggaguacugggagaaccugcgcaucgccagcggccggcccuacaaccccuccaugagcaagcccgacggguggggcgugaccaaggggaccgccgagcucaugcagcagaaggaggccacgaccgagcagcagcugaaggagcuguucgagaagcagaaguucaagucccaguga

SEQ ID NO: 27267 - RNA, 2925 nt, Artificial Sequence
  derived and/or modified sequence opt1 from BICC1__Homo_sapiens__NP_001073981
auggccgcccagggcgagcccggguaccuggcggcccagagcgacccgggcuccaacagcgagcgcuccaccgacagccccgugcccggguccgaggacgaccucgucgccggcgccacccugcacagccccgagugguccgaggagcgguuccgcguggaccggaagaagcuggaggccaugcuccaggcggccgccgaggggaagggccgcagcggcgaggacuucuuccagaagaucauggaggagacgaacacccagaucgccuggccguccaagcugaagaucggggccaagagcaagaaggacccccacaucaagguguccggcaagaaggaggacgucaaggaggccaaggagaugaucaugagcgugcuggacaccaaguccaaccgggugacccucaagauggacgucagccacacggagcacucccacgugaucgggaagggcgggaacaacaucaagaaggugauggaggagaccggcugccacauccacuuccccgacagcaaccgcaacaaccaggccgagaaguccaaccaggucagcaucgccggccagcccgccgggguggaguccgcgcgggugcgcauccgggagcugcugccgcucguccugauguucgagcugcccaucgccggcauccuccagcccgugcccgacccgaacagccccagcauccagcacaucucccagaccuacaacaucagcguguccuucaagcagcgcagccggauguacggggccaccgucaucgugcgcggcucccagaacaacacgagcgccgugaaggagggcaccgccaugcugcuggagcaccucgcggggucccuggccagcgccauccccgucuccacccagcuggacaucgccgcccagcaccaccucuucaugaugggccggaacgggagcaacaucaagcacaucaugcagcgcaccggcgcgcagauccacuuccccgacccguccaacccccagaagaaguccacgguguaccugcaggggaccaucgaguccgugugccuggcccggcaguaccucaugggcugccugccccugguccucauguucgacaugaaggaggagaucgagguggacccccaguucaucgcccagcugauggagcagcuggacguguucaucagcaucaagccgaagcccaagcagcccuccaagagcgucaucgugaaguccgucgagcgcaacgcccucaacauguacgaggcccggaagugccugcugggccucgagagcuccggggugaccaucgcgaccagccccagcccggccuccugccccgccggccuggccugccccagccuggacauccucgcguccgccgggcugggccugacggggcucggccugcugggccccaccacccucagccugaacaccuccacgaccccgaacagccugcucaacgcccugaacuccagcgugagcccccugcagagccccuccagcgggaccccgucccccacccucugggccccgccccuggccaacacgagcuccgcgaccggcuucagcgccaucccccaccugaugauccccuccaccgcccaggccacccucacgaacauccugcugagcgggguccccaccuacggccacaccgcccccagcccgccgcccgggcugacccccguggacgugcacaucaacuccaugcagacggagggcaagaagaucagcgcggcccucaacggccacgcccagucccccgacaucaaguacggggccaucagcaccuccagccugggcgagaagguccuguccgccaaccacggggaccccagcauccagaccuccggcagcgagcagaccucccccaagagcucccccacggagggcugcaacgacgcguucguggagguggggaugccgcgcagccccucccacagcggcaacgccggggaccucaagcagaugaugugccccuccaaggucagcugcgccaagcggcagaccguggagcugcugcagggcaccaagaacucccaccuccacagcaccgaccgccugcugagcgaccccgagcucuccgccaccgagagcccgcuggcggacaagaaggcccccggguccgagcgggccgccgagcgcgccgcggccgcccagcagaacagcgagcgcgcccaccuggcgccccgguccagcuacgugaacaugcaggcguucgacuacgagcagaagaagcuccuggccacgaaggccaugcugaagaagcccgucgugaccgaggugcgcaccccgaccaacacgugguccggccucggcuucagcaaguccaugcccgccgagaccaucaaggagcugcggcgcgccaaccacgucagcuacaagcccaccaugaccacgaccuacgagggguccagcaugucccugagccgguccaacagccgcgagcaccucggcgggggcuccgagagcgacaacuggcgggaccgcaacgggaucggcccgggcucccacagcgaguucgcggccagcaucgggucccccaagcggaagcagaacaagagcaccgagcacuaccuguccagcuccaacuacauggacugcaucagcucccugaccggcagcaacgggugcaaccucaacuccagcuucaagggcuccgaccugcccgagcuguucagcaagcucgggcugggcaaguacacggacguguuccagcagcaggagaucgaccugcagaccuuccucacccugaccgaccaggaccugaaggagcucggcaucacgaccuucggggcccgccggaagaugcugcuggccaucuccgagcucaacaagaaccgccggaagcuguucgagagccccaacgcgcgcaccuccuuccuggagggcggggccagcggccggcucccgcgccaguaccacuccgacaucgccagcguguccgggcggugguga

SEQ ID NO: 27268 - RNA, 2508 nt, Artificial Sequence
  derived and/or modified sequence opt1 from BICD1__Homo_sapiens__NP_001003398
auggccgccgaggaggugcugcagaccgucgaccacuacaagaccgagaucgagcgccucacgaaggagcugaccgagaccacccacgagaagauccaggcggccgaguacggccugguggugcucgaggagaagcugacgcugaagcagcaguacgacgagcucgaggccgaguacgacagccugaagcaggagcuggagcagcucaaggaggccuucgggcaguccuucagcauccaccggaaggucgccgaggacggcgagacccgcgaggagacccugcugcaggaguccgcgagcaaggaggccuacuaccucgggaagauccuggagaugcagaacgagcugaagcagucccgggccguggugaccaacguccaggccgagaacgagcgccucacggcgguggugcaggaccugaaggagaacaacgagauggucgagcugcagcggauccgcaugaaggacgagauccgggaguacaaguuccgcgaggcccggcuccugcaggacuacaccgagcuggaggaggagaacaucacccuccagaagcuggugagcacccugaagcagaaccagguggaguacgagggccucaagcacgagaucaagcgcuucgaggaggagacgguccugcugaacucccagcucgaggacgccauccggcugaaggagaucgccgagcaccagcuggaggaggcccucgagacccugaagaacgagcgcgagcagaagaacaaccugcggaaggagcucagccaguacaucucccugaacgacaaccacaucagcaucuccguggacgggcugaaguucgcggaggacggcagcgagcccaacaacgacgacaagaugaacggccacauccacgggccgcucgugaagcugaacggcgacuaccgcacccccacccugcggaagggggagucccucaaccccgucagcgaccuguucuccgagcugaacaucagcgagauccagaagcucaagcagcagcugaugcaggucgagcgcgagaaggccauccugcucgccaaccugcaggagucccagacgcagcuggagcacaccaagggcgcccucaccgagcagcacgagcgggugcaccgccugaccgagcacgugaacgccaugcgggggcugcagagcuccaaggagcugaaggcggagcucgacggcgagaagggccgcgacagcggggaggaggcccacgacuacgagguggacaucaacggccuggagauccuggagugcaaguaccggguggccgucacggaggugaucgaccucaaggccgagaucaaggcccugaaggagaaguacaacaagagcguggagaacuacaccgacgagaaggcgaaguacgaguccaagauccagauguacgacgagcaggucaccagccuggagaagaccacgaaggaguccggggagaagauggcccacauggagaaggagcuccagaagaugaccagcaucgccaacgagaaccacuccacccugaacaccgcccaggacgagcuggugacguucagcgaggagcucgcccagcuguaccaccacgucugccugugcaacaacgagacccccaaccgcgugaugcucgacuacuaccgccagucccgggugacccgcagcggcucccugaagggcccggacgacccccgggggcugcucagcccccgccuggcgcggcgcggcgucuccagccccguggagacccggacguccagcgagccgguggccaaggaguccaccgaggccagcaaggagcccucccccaccaagacccccacgaucagcccggucaucaccgccccgcccuccagccccgugcuggacaccagcgacauccgcaaggagcccaugaacaucuacaaccucaacgcgaucauccgggaccagaucaagcaccuccagaaggccguggaccgcucccugcagcugagccggcagcgcgccgccgcccgggagcuggcgcccaugaucgacaaggacaaggaggcccugauggaggagauccucaagcugaagucccugcucagcaccaagcgcgagcagaucgccacccugcgggccguccugaaggccaacaagcagacggcggagguggcccucgccaaccugaagaacaaguacgagaacgagaaggccauggugaccgagaccaugaccaagcugcgcaacgagcucaaggcccugaaggaggacgcggccacguucuccagccugcgggccauguucgccacccgcugcgacgaguacgucacccagcucgacgagaugcagcggcagcuggcggccgccgaggacgagaagaagacccugaacacgcuccugcgcauggccauccagcagaagcuggcccucacccagcgccuggaggaccuggaguucgaccacgagcagucccggcgcagcaaggggaagcucggcaaguccaagaucgggagccccaagaucguguccagccugcugcccccguaccggcacuccgcgcacaacuga

SEQ ID NO: 27269 - RNA, 2568 nt, Artificial Sequence
  derived and/or modified sequence opt1 from BICD2__Homo_sapiens__NP_001003800
augagcgcccccuccgaggaggaggaguacgcccgccuggugauggaggcgcagccggaguggcuccgggccgaggucaagcgccugagccacgagcuggccgagaccacccgggagaagauccaggccgccgaguacggccucgcggugcuggaggagaagcaccagcugaagcuccaguucgaggagcuggagguggacuacgaggccauccgcuccgagauggagcagcugaaggaggccuucgggcaggcccacacgaaccacaagaaggucgcggccgacggcgagagccgggaggagucccucauccaggagagcgccuccaaggagcaguacuacgugcgcaaggugcuggagcugcagaccgagcucaagcagcugcggaacguccugaccaacacccagagcgagaacgagcgccucgccuccguggcccaggagcugaaggagaucaaccagaacguggagauccagcgggggcgccugcgggacgacaucaaggaguacaaguuccgcgaggcgcggcuccugcaggacuacagcgagcuggaggaggagaacaucucccuccagaagcaggucagcgugcugcgccagaaccagguggaguucgagggccugaagcacgagaucaagcggcucgaggaggagacggaguaccugaacucccagcuggaggacgccauccgccucaaggagaucagcgagcggcagcuggaggaggcccuggagacccucaagaccgagcgcgagcagaagaacucccugcggaaggagcugagccacuacauguccaucaacgacagcuucuacaccucccaccuccacgucagccuggacgggcugaaguucagcgacgacgccgccgagcccaacaacgacgcggaggcccucgugaacggcuucgagcacggcgggcuggccaagcugccccucgacaacaagacguccacccccaagaaggagggccuggccccgcccagccccucccuggugagcgaccuccuguccgagcugaacaucagcgagauccagaagcucaagcagcagcugaugcagauggagcgcgagaaggccgggcugcucgcgacccugcaggacacccagaagcagcuggagcacacgcggggcucccugagcgagcagcaggagaaggucacccgccucaccgagaaccuguccgcccugcgccggcuccaggccagcaaggagcgccagaccgcccuggacaacgagaaggaccgggacucccacgaggacggggacuacuacgagguggacaucaacggccccgagauccuggccugcaaguaccacguggcggucgccgaggccggcgagcuccgcgagcagcugaaggcccugcggagcacgcacgaggcgcgcgaggcccagcacgccgaggagaaggggcgguacgaggccgagggccaggcccucaccgagaaggugucccugcuggagaaggcgagccgccaggaccgggagcuccuggcccgccuggagaaggagcucaagaagguguccgacgucgccggggagacccagggcagccuguccguggcccaggacgagcuggugaccuucagcgaggagcucgccaaccuguaccaccacgucugcaugugcaacaacgagacgccgaaccgggugaugcuggacuacuaccgcgagggccagggcggggcggggcggaccucccccggcgggcgcaccagccccgaggcccggggccgccggagccccauccuccugccgaagggccugcucgcccccgaggccgggcgcgccgacggcgggaccggcgacuccagccccucccccgggagcucccugccgagcccccuguccgacccccggcgcgagcccaugaacaucuacaaccucaucgcgaucauccgcgaccagaucaagcaccuccaggccgccgucgaccggacgaccgagcugagccgccagcggaucgccucccaggagcugggcccggcgguggacaaggacaaggaggcccugauggaggagauccugaagcucaagagccugcuguccaccaagcgcgagcagaucaccacgcuccggaccgugcugaaggccaacaagcagaccgccgaggucgcccuggcgaaccucaagagcaaguacgagaacgagaaggccauggugaccgagacgaugaugaagcugcgcaacgagcugaaggcccucaaggaggacgccgccaccuucuccagccugcgggcgauguucgccacccgcugcgacgaguacaucacccagcuggacgagaugcagcggcagcucgccgccgccgaggacgagaagaagacgcugaacucccugcuccgcauggcgauccagcagaagcuggcccugacccagcggcucgagcugcuggagcucgaccacgagcagacccgccggggccgcgccaaggccgcgcccaagaccaagcccgccacccccagcgugucccacacgugcgccugcgccagcgaccgggccgaggggaccggccuggcgaaccaggucuucugcagcgagaagcacuccaucuacugcgacuga

SEQ ID NO: 27270 - RNA, 588 nt, Artificial Sequence
  derived and/or modified sequence opt1 from BID__Homo_sapiens__NP_001187
auggacugcgaggugaacaacggcagcucccugcgcgacgagugcaucaccaaccuccuggucuucggguuccugcagagcugcuccgacaacagcuuccggcgcgagcucgacgcccugggccacgagcugcccgugcucgccccgcagugggagggguacgacgagcugcagaccgacggcaaccgguccagccacucccgccuggggcggaucgaggcggacagcgagucccaggaggacaucauccgcaacaucgcccggcaccucgcccaggugggcgacagcauggaccgcuccaucccgcccggccuggucaacgggcuggcccuccagcugcggaacacgagccgcuccgaggaggaccggaaccgcgaccuggccaccgcgcucgagcagcugcugcaggccuacccccgggacauggagaaggagaagaccaugcucgugcuggcccugcuccuggccaagaagguggcgagccacacccccucccugcuccgcgacgucuuccacacgaccgugaacuucaucaaccagaaccugcggaccuacgugcgcagccuggcccggaacggcauggacuga

SEQ ID NO: 27271 - RNA, 1365 nt, Artificial Sequence
  derived and/or modified sequence opt1 from BIN1__Homo_sapiens__NP_004296
auggccgagaugggcagcaagggggugaccgccggcaagaucgcguccaacguccagaagaagcugacccgcgcccaggagaaggugcuccagaagcuggggaaggccgacgagacgaaggacgagcaguucgagcagugcgugcagaacuucaacaagcagcugaccgagggcacccggcuccagaaggaccugcgcaccuaccuggccagcgucaaggccaugcacgaggcguccaagaagcucaacgagugccugcaggagguguacgagcccgacuggccggggcgggacgaggccaacaagaucgccgagaacaacgaccugcucuggauggacuaccaccagaagcugguggaccaggcccugcucacgauggacaccuaccugggccaguuccccgacaucaagagccgcaucgcgaagcggggccgcaagcuggucgacuacgacuccgcccggcaccacuacgagagccuccagaccgccaagaagaaggacgaggccaagaucgccaaggcggaggaggagcugaucaaggcccagaagguguucgaggagaugaacguggaccugcaggaggagcuccccucccuguggaacagccgcgucggguucuacgugaacaccuuccaguccaucgccggccuggaggagaacuuccacaaggagaugagcaagcucaaccagaaccugaacgacgugcuggucgggcucgagaagcagcacggcuccaacacguucaccgugaaggcccagccccggaagaaguccaagcuguucagccgccugcggcgcaagaagaacagcgacaacgccccggcgaaggggaacaagucccccagcccgcccgacggcucccccgccgccacccccgagauccgggugaaccacgagcccgagcccgccggcggggccaccccgggcgcgacgcuccccaagagccccucccagcccgccgaggccagcgaggucgccgggggcacccagccggccgcgggcgcccaggagcccggggagaccgccgccagcgaggcggccuccagcucccugcccgccgugguggucgagaccuuccccgccacggugaacggcaccguggagggcgggagcggggccggccgccuggaccucccgcccggcuucauguucaagguccaggcgcagcacgacuacaccgccaccgacacggacgagcugcagcugaaggccggggacguggugcucgucauccccuuccagaaccccgaggagcaggacgagggcuggcugaugggggugaaggaguccgacuggaaccagcacaaggagcuggagaagugccggggcgucuucccggagaacuucaccgagcgcgugcccuga

SEQ ID NO: 27272 - RNA, 1620 nt, Artificial Sequence
  derived and/or modified sequence opt1 from BIN2__Homo_sapiens__NP_001276936
auggugcugcagaagcucggcaaggccgucgagaccaaggacgagcgcuucgagcagagcgccuccaacuucuaccagcagcaggcggaggggcacaagcuguacaaggaccugaagaacuuccucagcgccgugaaggugaugcacgaguccagcaagcgggucuccgagacccugcaggagaucuacagcuccgagugggacggccacgaggagcugaaggccaucguguggaacaacgaccuccugugggaggacuacgaggagaagcuggccgaccaggccgugcgcacgauggagaucuacgucgcgcaguucagcgagaucaaggagcggaucgccaagcgcgggcggaagcucguggacuacgacuccgcccgccaccaccuggaggccgugcagaacgcgaagaagaaggacgaggccaagaccgccaaggccgaggaggaguucaacaaggcccagaccgucuucgaggaccugaaccaggagcuccuggaggagcugcccauccucuacaacagccggaucggcugcuacgugaccaucuuccagaacaucuccaaccugcgcgacguguucuaccgggagaugagcaagcugaaccacaaccucuacgaggucauguccaagcuggagaagcagcacagcaacaagguguucguggucaaggggcuguccagcuccagccgccggucccucgugaucagcccgcccgugcgcacggcgaccgucagcagcccccugaccucccccaccuccccgagcacgcugucccucaagagcgaguccgagagcguguccgccaccgaggaccuggcccccgacgccgcccagggcgaggacaacagcgagaucaaggagcugcucgaggaggaggagaucgagaaggagggcuccgaggcgagcuccagcgaggaggacgagccccugcccgccugcaacgggccggcccaggcccagcccucccccaccaccgagcgggccaagagccaggaggaggugcugcccuccagcacgaccccgucccccggcggggcgcucagccccagcggccagcccuccagcuccgccaccgaggucgugcugcgcacccggacggccagcgagggguccgagcagccgaagaagcgcgccagcauccagcggaccuccgccccgcccagccgcccgcccccgccccgggcgaccgccagcccccgccccuccuccggcaacauccccagcucccccaccgccagcggcgggggcucccccacgagcccccgggccucccuggggaccggcaccgcgagcccccgcaccagccucgaggugucccccaacccggagccgcccgagaagcccguccgcacgcccgaggccaaggagaacgagaacauccacaaccagaaccccgaggagcugugcaccagccccacccugaugaccucccagguggccagcgagcccggcgaggccaagaagauggaggacaaggagaaggacaacaagcucaucuccgccaacagcuccgaggggcaggaccagcugcaggucagcauggugccggagaacaacaaccugacggcgcccgagccccaggaggagguguccaccagcgagaacccccagcucuga

SEQ ID NO: 27273 - RNA, 762 nt, Artificial Sequence
  derived and/or modified sequence opt1 from BIN3__Homo_sapiens__NP_061158
augagcuggauccccuucaagaucggccagccgaagaagcagaucgugcccaagaccgucgagcgcgacuucgagcgggaguacgggaagcugcagcagcucgaggagcagacccgccggcugcagaaggacaugaagaaguccacggacgccgaccuggccaugagcaaguccgcggugaagaucagccucgaccugcuguccaacccccucugcgagcaggaccaggaccugcugaacauggugaccgcccucgacaccgccaugaagcgcauggacgccuucaaccaggagaaggucaaccagauccagaagaccgugaucgagccccugaagaaguucggcagcguguucccgucccugaacauggccgucaagcggcgcgagcaggcgcuccaggacuaccggcgccugcaggccaagguggagaaguacgaggagaaggagaagacggggcccgugcuggccaagcuccaccaggcccgggaggagcugcgccccguccgggaggacuucgaggcgaagaaccgccagcugcucgaggagaugccccgguucuacggcagccgccuggacuacuuccagccguccuucgagagccugauccgggcccaggugguguacuacuccgagaugcacaagaucuucggggaccucagccaccagcuggaccagcccggccacuccgacgagcagcgcgagcgggagaacgaggccaagcugagcgagcuccgcgcccuguccaucgucgccgacgacuga

SEQ ID NO: 27274 - RNA, 1857 nt, Artificial Sequence
  derived and/or modified sequence opt1 from BIRC2__Homo_sapiens__NP_001243092
augcacaagaccgccagccagcgccuguuccccggcccguccuaccagaacaucaagagcaucauggaggacuccaccauccucagcgacuggacgaacuccaacaagcagaagaugaaguacgacuucagcugcgagcuguaccggauguccaccuacagcaccuuccccgccggggugcccgucuccgagcgcagccuggcgcgggccggcuucuacuacaccggggugaacgacaaggugaagugcuucugcugcggccucaugcuggacaacuggaagcugggggacucccccauccagaagcacaagcagcucuacccgagcugcuccuucauccagaaccuggucagcgccucccugggcagcacguccaagaacaccagccccaugcgcaacuccuucgcccacagccucagccccacccuggagcacuccagccuguucuccggcagcuacuccagccucucccccaacccgcugaacagccgggccguggaggacaucuccagcucccgcaccaaccccuacagcuacgcgauguccacggaggaggcccgguuccugaccuaccacauguggccccucaccuuccugagccccuccgagcuggcccgcgccggguucuacuacaucggcccgggggaccggguggcgugcuucgccugcggcgggaagcucagcaacugggagcccaaggacgacgccauguccgagcaccgccggcacuuccccaacugccccuuccuggagaacagccuggagacccuccgcuucuccaucagcaaccugagcaugcagacgcacgccgcccggaugcgcaccuucauguacuggccguccagcguccccgugcagcccgagcagcuggcguccgccggcuucuacuacgugggccggaacgacgacgucaagugcuucugcugcgacgggggccuccgcugcugggagagcggggacgaccccuggguggagcacgccaagugguucccgcggugcgaguuccugauccgcaugaagggccaggaguucguggacgagauccagggccgguacccccaccuccuggagcagcugcuguccaccagcgacaccacgggggaggagaacgccgacccgcccaucauccacuucggccccggggaguccagcuccgaggacgccgucaugaugaacacccccguggucaagagcgcgcucgagaugggcuucaaccgcgaccuggugaagcagaccgugcaguccaagauccugaccacgggggagaacuacaagaccgugaacgacaucgucagcgcccuccugaacgccgaggacgagaagcgggaggaggagaaggagaagcaggccgaggagauggccuccgacgaccugagccucauccgcaagaaccgcauggcgcuguuccagcagcugaccugcgugcuccccauccuggacaaccugcucaaggccaacgugaucaacaagcaggagcacgacaucaucaagcagaagacccagaucccccugcaggcccgggagcugaucgacacgauccucgucaagggcaacgccgccgcgaacaucuucaagaacugccugaaggagaucgacuccacccuguacaagaaccucuucguggacaagaacaugaaguacaucccgaccgaggacgugagcggccugucccuggaggagcagcugcgccggcuccaggaggagcggaccugcaaggucugcauggacaaggaggugagcgucguguucauccccugcgggcaccugguggucugccaggagugcgcccccagccugcgcaagugcccgaucugccgcggcaucaucaaggggacggugcggaccuuccucuccuga

SEQ ID NO: 27275 - RNA, 1815 nt, Artificial Sequence
  derived and/or modified sequence opt1 from BIRC3__Homo_sapiens__NP_892007
augaacaucguggagaacagcaucuuccuguccaaccucaugaaguccgccaacaccuucgagcugaaguacgaccugagcugcgagcucuaccgcaugagcaccuacuccacguuccccgccggcgucccggugagcgagcggucccuggcgcgcgccggguucuacuacaccggcgugaacgacaaggucaagugcuucugcugcgggcugaugcucgacaacuggaagcggggcgacagccccaccgagaagcacaagaagcuguaccccuccugccgcuucgugcagagccugaacuccgugaacaaccucgaggccaccagccagcccacguucccguccagcgucaccaacuccacccacagccugcugcccgggaccgagaacuccggcuacuuccggggcagcuacuccaacagccccagcaaccccgugaacucccgcgccaaccaggacuucagcgcccucaugcgguccagcuaccacugcgcgaugaacaacgagaacgcccgccugcugacguuccagaccuggccgcucaccuuccugucccccaccgaccuggccaaggccggguucuacuacaucggccccggggaccggguggcgugcuucgccugcggcgggaagcucagcaacugggagcccaaggacaacgccauguccgagcaccuccgccacuucccgaagugccccuucaucgagaaccagcugcaggacacgagccgguacaccgucuccaaccugagcaugcagacccacgccgcccgcuucaagaccuucuucaacuggcccuccagcgugcuggugaaccccgagcagcuggcguccgccggcuucuacuacgucggcaacagcgacgacgugaagugcuucugcugcgacgggggccuccggugcugggaguccggggacgacccgugggugcagcacgccaagugguucccccgcugcgaguaccugauccggaucaagggccaggaguucauccgccagguccaggccagcuacccccaccuccuggagcagcugcuguccacgagcgacucccccggcgacgagaacgccgagagcagcaucauccacuucgagccgggggaggaccacuccgaggacgcgaucaugaugaacacccccgugaucaacgccgccguggagaugggcuucagccggucccucgucaagcagaccgugcagcgcaagauccuggccaccggggagaacuaccggcuggugaacgaccucguccuggaccugcucaacgccgaggacgagauccgcgaggaggagcgggagcgcgcgacggaggagaaggagagcaacgaccugcugcucauccgcaagaaccggauggcccuguuccagcaccugaccugcgugauccccauccucgacucccugcugaccgccggcaucaucaacgagcaggagcacgacgugaucaagcagaagacccagacgagccuccaggcccgcgagcugaucgacaccauccuggucaaggggaacaucgccgcgaccguguuccggaacucccuccaggaggccgaggccguccuguacgagcaccuguucgugcagcaggacaucaaguacauccccaccgaggacgugagcgaccugccggucgaggagcagcuccgccggcugcaggaggagcgcacgugcaaggugugcauggacaaggagguguccaucgucuucauccccugcggccaccugguggugugcaaggacugcgcccccagccuccggaagugccccaucugccgcuccaccaucaagggcaccguccggaccuuccugagcuga

SEQ ID NO: 27276 - RNA, 414 nt, Artificial Sequence
  derived and/or modified sequence opt1 from BIRC5__Homo_sapiens__NP_001012270
augggcgcccccacccugccgcccgccuggcagcccuuccucaaggaccaccgcaucagcaccuucaagaacuggcccuuccuggaggggugcgcgugcacgccggagcggauggccgaggccggcuucauccacugccccaccgagaacgagcccgaccuggcccagugcuucuucugcuucaaggagcucgaggggugggagcccgacgacgacccgaugcagcgcaagcccaccauccggcgcaagaaccugcggaagcugcgccggaagugcgccgugcccuccagcuccuggcuccccuggaucgaggcgagcggccgcuccugccuggucccggaguggcugcaccacuuccagggccucuuccccggggccaccagccugcccgugggcccccuggccauguccuga

SEQ ID NO: 27277 - RNA, 14574 nt, Artificial Sequence
  derived and/or modified sequence opt1 from BIRC6__Homo_sapiens__NP_057336
auggugaccggcgggggcgccgcgccgcccgggaccgugaccgagccccugcccagcgugaucgugcucuccgcgggccgcaagauggccgccgccgccgccgccgccagcgggcccggcugcagcagcgccgccggcgccggggccgccggcguguccgaguggcuggugcugcgggacgggugcaugcacugcgacgccgacggccugcacagccuguccuaccaccccgcgcugaacgccauccuggccgugaccagccgcgggaccaucaaggugaucgacggcaccuccggcgccacccugcaggccagcgcgcuguccgccaagcccgggggccaggugaagugccaguacaucagcgccguggacaaggucaucuucguggacgacuacgccguggggugccggaaggaccugaacggcauccugcugcuggacaccgcccugcagacccccgucuccaagcaggacgacguggugcagcuggagcugcccgucaccgaggcgcagcagcugcugagcgccugccuggagaagguggacaucuccagcaccgagggcuacgaccuguucaucacccagcugaaggacgggcugaagaacaccucccacgagaccgccgccaaccacaagguggccaagugggcgaccgucaccuuccaccucccccaccacgugcucaaguccaucgccuccgccaucgugaacgagcucaagaagaucaaccagaacgucgccgcgcugcccguggccagcagcgugauggaccgccuguccuaccuccugcccagcgcccggcccgagcugggcgucgggcccggccgcuccguggaccggagccucauguacuccgaggccaaccgccgggagaccuucaccagcuggccccacgucggguaccgcugggcccagcccgaccccauggcgcaggccggcuucuaccaccagcccgccuccagcggcgacgaccgggccaugugcuucacgugcuccgugugccuggugugcugggagcccaccgacgagcccuggagcgagcacgagcgccacucccccaacugccccuucgucaagggggagcacacccagaacgugccccugagcgugacccucgccaccucccccgcgcaguuccccugcaccgacggcaccgaccggaucagcugcuucggguccggcagcugcccccacuuccuggccgccgccaccaagcgcgggaagaucugcaucugggacgucuccaagcugaugaaggugcaccucaaguucgagaucaacgccuacgaccccgcgaucgugcagcagcugauccugagcggcgaccccuccagcggcgucgacagccggcgccccacgcucgccuggcuggaggacuccagcuccugcagcgacaucccgaagcuggagggggacuccgacgaccuccuggaggacagcgacuccgaggagcacagccgguccgacagcgugaccggccacaccucccagaaggaggccauggaggugagccuggacaucaccgcccucuccauccugcagcagcccgagaagcugcagugggagaucgucgcgaacgugcucgaggacacggugaaggaccuggaggagcugggggccaaccccugccugaccaacagcaaguccgagaagaccaaggagaagcaccaggagcagcacaacaucccguuccccugccuccuggccggcgggcugcucaccuacaagagccccgccacgucccccaucagcagcaacucccaccgcagccuggacggccugucccggacccagggcgagagcaucuccgagcaggggagcaccgacaacgaguccugcaccaacagcgagcucaacuccccgcugguccgccggacgcugcccgugcuccugcuguacagcaucaaggaguccgacgagaaggccggcaagaucuucagccagaugaacaacaucauguccaagagccuccacgacgacggguucaccgugccccagaucaucgagauggagcuggacucccaggagcagcugcuccugcaggacccgcccgucaccuacauccagcaguucgcggacgccgccgccaaccugaccagccccgacuccgagaaguggaacagcguguuccccaagcccggcacccucgugcagugccugcgccugccgaaguucgccgaggaggagaaccucugcaucgacuccaucacgcccugcgcggacggcauccaccuccuggucgggcuccggaccugccccguggagagccugagcgccaucaaccagguggaggcccugaacaaccucaacaagcugaacuccgcccugugcaaccggcgcaagggcgagcucgagagcaaccuggccgucgugaacggggcgaacaucuccgugauccagcacgagagccccgccgacguccagaccccgcugaucauccagcccgagcagcggaacguguccggcggguaccucgugcuguacaagaugaacuacgccacccgcaucgucacgcuggaggaggagcccaucaagauccagcacaucaaggacccccaggacaccaucaccagccucauccugcugccgcccgacauccucgacaaccgggaggacgacugcgaggagcccaucgaggacaugcagcugaccuccaagaacggcuucgagcgcgagaagacgagcgacaucuccacccugggccaccucgugaucaccacccagggcggguacgugaagauccuggaccugagcaacuucgagauccucgccaaggucgagcccccgaagaaggaggggacggaggagcaggacaccuucguguccgugaucuacugcagcggcaccgaccggcugugcgcgugcaccaagggcggggagcugcacuuccuccagaucggcgggacgugcgacgacaucgacgaggccgacauccuggucgacggcucccugagcaaggggaucgagcccuccagcgagggcuccaagccccucagcaacccguccagccccgggaucagcggcguggaccugcugguggaccagcccuucacccucgagauccugaccucccuggucgagcucacccgcuucgagacgcugacgccccgcuucagcgccaccgugccgcccugcuggguggagguccagcaggagcagcagcagcgccggcacccccagcaccuccaccagcagcaccacggcgacgccgcccagcacacccgcacguggaagcuccagaccgacuccaacagcugggacgagcacguguucgagcuggugcugcccaaggcgugcauggucgggcacguggacuucaaguucgugcucaacuccaacaucaccaacaucccgcagauccaggucacccugcugaagaacaaggcccccggccucgggaaggugaacgcccugaacaucgagguggagcagaacggcaagcccagccuggucgaccucaacgaggagaugcagcacauggacguggaggagucccagugccugcggcugugccccuuccucgaggaccacaaggaggacauccugugcgggccggucuggcuggccagcggccucgaccuguccggccacgccgggaugcugacgcucaccagccccaagcuggugaagggcauggccggcgggaaguaccgcuccuuccugauccacgugaaggccgucaacgagcgggggaccgaggagaucugcaacgggggcaugcgccccguggugcggcuccccagccugaagcaccaguccaacaagggguacagccuggccucccuccuggccaaggucgccgcgggcaaggagaaguccuccaacgugaagaacgagaacaccagcgggacgcgcaaguccgagaaccugcggggcugcgaccuccugcaggaggugagcgucaccauccgccgcuucaagaagaccagcaucuccaaggagcgggugcagcgcugcgccaugcugcaguucagcgaguuccacgagaagcuccugaacacccugugccggaagacggacgacggccagaucaccgagcacgcccagucccucgugcuggacacccugugcuggcuggccgggguccacagcaacggcccgggguccagcaaggagggcaacgagaaccuccuguccaagacccgcaaguuccugagcgacaucgugcgggugugcuucuucgaggccgggcgcuccaucgcgcacaagugcgcccgguuccucgcccugugcaucagcaacggcaagugcgaccccugccagcccgccuucggccccguccugcucaaggcgcugcuggacaacauguccuuccucccggccgccaccaccggcgggagcguguacugguacuucgugcugcugaacuacgucaaggacgaggaccucgccgggugcuccaccgccugcgcgagccugcugaccgccgugucccgccagcuccaggaccggcugacccccauggaggcccugcuccagacgcgcuacgggcuguacagcucccccuucgaccccgugcuguucgaccucgagaugagcggguccagcugcaagaacgucuacaacagcuccaucggcgugcagagcgacgagaucgaccuguccgacgugcugagcggcaacgggaaggucuccagcugcaccgccgccgagggcuccuucaccagccucaccgggcugcuggagguggagccgcuccacuucacgugcguguccaccagcgacggcacccggaucgagcgcgacgacgcgauguccagcuucggcgucacccccgccgucgggggccuguccagcgggacggugggcgaggccuccaccgcccugagcuccgccgcgcaggucgcccuccagagccugucccacgccauggccagcgcggagcagcagcuccaggugcuccaggagaagcagcagcagcugcugaagcuccagcagcagaaggccaagcuggaggccaagcugcaccagaccaccgccgccgcggccgccgccgccagcgcgguggggcccguccacaacuccgugcccagcaacccgguggccgcccccggcuucuucauccaccccuccgacgucaucccgcccacgcccaagaccacgccccuguucaugaccccgccccugacgccgcccaacgaggccgugagcguggucaucaacgccgagcuggcgcagcuguucccgggcuccgugaucgacccgcccgccgugaaccuggccgcccacaacaagaacagcaacaagucccggaugaacccccuggggagcggccucgcgcuggccaucucccacgccagccacuuccugcagccgccgccccaccaguccaucaucaucgagcgcaugcacagcggggcccggcgcuucgucacccucgacuucggccggcccauccugcugaccgacgugcucaucccgaccugcggggaccuggccucccugagcaucgacaucuggacgcucggcgaggagguggacggccgccggcuggucguggcgaccgacaucuccacccacagccugauccuccacgaccugaucccgccgcccgugugccgcuucaugaagaucaccgucaucgggcgguacggcuccacgaacgcccgcgccaagaucccgcugggguucuacuacggccacaccuacauccuccccugggagagcgagcugaagcugaugcacgacccccucaagggggagggcgagagcgccaaccagcccgagaucgaccagcaccuggccaugaugguggcgcugcaggaggacauccagugccgcuacaaccucgccugccaccggcuggagacccugcuccaguccaucgaccugccgccccugaacagcgccaacaacgcccaguacuuccuccgcaagcccgacaaggccguggaggaggacucccgggucuucagcgcguaccaggacugcauccagcugcagcugcagcucaaccuggcccacaacgccgugcagcgccugaaggucgcccucggcgccucccggaagaugcugagcgagaccuccaaccccgaggaccugauccagacgagcuccaccgagcagcuccgcaccaucauccgguaccugcuggacacccuccugagccugcuccacgcguccaacgggcacagcgugccggccgugcugcaguccacguuccacgcccaggccugcgaggagcuguucaagcaccucugcaucagcggcacccccaagauccgccugcacaccgggcugcuccugguccagcugugcggcggggagcggugguggggccaguuccucuccaacgugcugcaggagcuguacaacagcgagcagcuccugaucuucccccaggaccgcguguucaugcugcuguccugcaucggccagcggagccucuccaacagcgggguccuggagagccugcucaaccugcuggacaaccuccuguccccgcugcagccccagcuccccaugcaccgccggaccgagggcgugcuggacauccccaugaucagcuggguggucaugcuggugucccgccuccuggacuacguggcgaccgucgaggacgaggccgccgccgccaagaagccgcugaacgggaaccaguggagcuucaucaacaacaaccuccacacgcagucccugaaccggagcuccaagggcagcuccagccuggaccgccucuacucccggaagauccgcaagcagcuggugcaccacaagcagcagcugaaccuccugaaggcgaagcagaaggcccugguggagcagauggagaaggagaagauccagagcaacaagggcuccagcuacaagcuccuggucgagcaggccaagcugaagcaggccaccuccaagcacuucaaggaccucauccggcugcgccgcaccgccgaguggagccgguccaaccuggacaccgaggugacgaccgcgaaggagagccccgagaucgagccccuccccuucacccuggcccacgagcgcugcaucuccgugguccagaagcugguccuguuccugcugagcauggacuucacgugccacgccgaccuccugcuguucgugugcaagguccucgcccggaucgccaacgcgacgcgcccgaccauccaccugugcgagaucgugaacgagccccagcuggagcggcuccugcugcuccugguggggaccgacuucaaccgcggcgacaucagcuggggcggcgccugggcccaguacucccugaccugcaugcuccaggacauccuggccggggagcugcucgcgcccgucgccgccgaggccauggaggagggcacggugggcgacgacgugggggccaccgcgggcgacagcgacgacucccugcagcagagcuccguccagcugcucgagaccaucgacgagccccugacccacgacaucacgggggccccgccccugagcucccucgagaaggacaaggagaucgaccuggagcugcuccaggaccugauggagguggacaucgacccccuggacaucgaccucgagaaggacccccuggccgccaagguguucaagccgaucagcuccaccugguacgacuacuggggcgccgacuacgggaccuacaacuacaaccccuacaucggcggccuggggauccccgucgcgaagcccccggccaacaccgagaagaacggcagccagacgguguccgugagcgucucccaggcccucgacgcccggcuggagguggggcuggagcagcaggccgagcucaugcugaagaugaugagcacccuggaggcggacuccauccuccaggcccugaccaacaccagccccacgcugucccagagccccaccggcaccgacgacucccuccucgggggccugcaggccgccaaccagaccagccagcucaucauccagcugagcuccgugcccaugcugaacgucugcuucaacaagcuguucagcaugcuccaggugcaccacgugcagcuggagucccuccugcagcuguggcucacgcugagccugaacuccagcuccaccggcaacaaggagaacggggcggacaucuuccucuacaacgccaaccgcaucccggucaucagccugaaccaggccuccaucaccagcuuccugaccgugcucgccugguaccccaacacgcugcugcggaccuggugccucgugcugcacucccugacccugaugaccaacaugcagcucaacagcggcuccagcuccgccaucgggacgcaggagagcaccgcgcaccuccuggucuccgaccccaaccucauccacgugcuggugaaguuccugagcggcaccuccccgcacgggaccaaccagcacagcccccaggucggccccacggccacccaggccaugcaggaguuccucacccgccuccaggugcaccugagcagcacgugcccccagaucuucagcgaguuccuccugaagcugauccacauccucuccaccgagcggggcgccuuccagaccgggcagggcccgcuggacgcccaggugaagcugcucgaguucacccuggagcagaacuucgaggucgugagcguguccaccaucagcgcggucaucgaguccgugaccuuccugguccaccacuacaucacgugcagcgacaaggugaugucccgcagcggguccgacagcuccgugggcgcccgggccugcuucggcggccuguucgccaaccugauccgccccggcgacgccaaggcggucugcggggagaugacccgggaccagcugauguucgaccuccugaagcuggugaacauccucgugcagcugccccugagcggcaaccgcgaguacuccgcccgggucagcgugaccaccaacacgaccgacuccgugagcgacgaggagaaggucuccgggggcaaggacggcaacgggagcagcaccuccgugcagggcagccccgccuacguggccgaccucguccuggccaaccagcagaucaugucccagauccugagcgcgcucgggcugugcaacuccagcgccauggccaugaucaucggcgccuccgggcugcaccucaccaagcacgagaacuuccacggcggccuggacgcgaucagcgugggggacggccuguucacgauccucaccacccuguccaagaaggccagcaccgugcacaugaugcugcagccgauccucacguacauggccugcggguacaugggccgccaggggucccuggcgaccugccagcugagcgagccccuccugugguucauccugcggguccucgacaccuccgacgcccugaaggcguuccacgacaugggcggcgugcagcugaucugcaacaacauggugaccagcacgcgcgccaucgucaacaccgcccgguccauggugagcaccaucaugaaguuccucgacuccgggcccaacaaggccguggacagcacccugaagacgcgcauccuggccagcgagcccgacaacgcggagggcauccacaacuucgccccgcucgggaccaucaccuccagcucccccaccgcccagcccgccgagguccugcugcaggccacgcccccgcaccgccgggcgcgcagcgccgccugguccuacaucuuccuccccgaggaggccuggugcgaccugaccauccaccuccccgcggccgugcuccugaaggagauccacauccagccccaccuggccagccucgcgaccugcccguccagcguguccgucgaggugagcgccgacggcgugaacaugcugccccuguccacccccgucgugacgagcggccucaccuacaucaagauccagcuggugaaggcggaggucgccuccgccgugugccugcggcuccaccgcccccgggacgccagcacccuggggcugucccagaucaagcuccugggccugaccgccuucgggacgaccagcuccgcgaccgugaacaacccguuccuccccagcgaggaccaggucuccaagaccagcaucggcuggcugcgccugcuccaccacugccugacccacaucagcgaccuggaggggaugauggccuccgccgccgcccccacggcgaaccuccugcagaccugcgccgcccugcucaugagccccuacugcggcaugcacuccccgaacaucgagguggugcuggucaagaucggccugcagagcacccggaucgggcucaagcugaucgacauccugcuccgcaacugcgccgccuccggcagcgaccccaccgaccugaacagcccccuccuguucgggcggcugaacggccugagcuccgacagcacgaucgacauccucuaccagcuggggaccacccaggacccgggcaccaaggaccgcauccaggcgcugcugaaguggguguccgacagcgcccggguggccgccaugaagcgcuccggccggaugaacuacaugugccccaacagcuccacggucgaguacgggcuccugaugcccagccccucccaccuccacugcguggcggccauccucuggcacagcuacgagcugcugguggaguacgaccucccggcccugcuggaccaggagcuguucgagcugcuguucaacugguccaugagccuccccugcaacaugguccugaagaaggccguggacagccugcucugcuccaugugccacgugcaccccaacuacuucagccugcugaugggcuggauggggaucacgcccccgcccguccagugccaccaccgccucuccaugaccgacgacagcaagaagcaggaccuguccagcucccugaccgacgacagcaagaacgcccaggcgccccucgcccugacggagucccaccuggccacccucgccagcuccagccagucccccgaggccaucaagcagcugcuggacagcggccuccccucccugcuggugcggagccucgcguccuucugcuucagccacaucuccagcagcgaguccaucgcccagagcaucgacaucucccaggacaagcugcgccggcaccacgugccccagcagugcaacaagaugcccaucaccgccgaccuggucgcccccauccuccgcuuccugaccgagguggggaacagccacaucaugaaggacuggcugggcggcuccgaggugaacccgcucuggacggcccugcuguuccuccugugccacagcggguccaccagcggcucccacaaccugggggcgcagcagaccagcgcccgguccgccagccucuccagcgccgcgaccacgggccugaccacccagcagcgcaccgccaucgagaacgccacggucgccuucuuccugcagugcaucuccugccaccccaacaaccagaagcucauggcccaggugcugugcgagcuguuccagaccagcccccagcgcgggaaccuccccaccuccggcaacaucagcggcuucauccggcgccuguuccugcagcucaugcuggaggacgagaaggucaccauguuccugcaguccccgugcccccucuacaaggggcggaucaacgcgacgagccacgugauccagcaccccauguacggcgccgggcacaaguuccgcacccugcaccuccccgugagcaccacccucuccgacguccuggaccgggugagcgacacgccguccaucaccgccaagcugaucagcgagcagaaggacgacaaggagaagaagaaccacgaggagaaggagaaggugaaggccgagaacggcuuccaggacaacuacuccgucgugguggccagcggccucaagucccagagcaagcgcgcggucuccgccacgccgccccggcccccgagccgccgggggcgcaccauccccgacaagaucggcuccacgagcggggccgaggccgccaacaagaucaucaccgugcccguguuccaccuguuccacaagcugcucgcgggccagccgcugcccgccgagaugacccuggcccagcuccugacccugcucuacgaccggaagcugccccagggguaccgcuccaucgaccugaccgucaagcucggcagccgggugaucacggaccccucccugagcaagaccgacuccuacaagcgccugcacccggagaaggaccacggcgaccuccuggccagcugccccgaggacgaggcgcugacccccggggacgagugcauggacggcauccucgacgagucccugcuggagaccugccccauccagagcccgcuccagguguucgccgggaugggcgggcuggcccugaucgccgagcggcuccccaugcuguaccccgaggucauccagcaggucagcgcccccguggucacguccaccacccaggagaagccgaaggacagcgaccaguucgagugggugaccaucgagcaguccggcgagcugguguacgaggcgcccgagacggucgccgccgagccgccgcccaucaagagcgccgugcagaccaugucccccauccccgcccacagccucgcggccuucggccuguuccugcgccuccccggguacgccgaggugcugcugaaggagcggaagcacgcccagugccuccugcgccugguccucggcgugaccgacgacggggagggcucccacauccugcagagccccuccgccaacgugcugcccacccugcccuuccacguccuccggagccuguucuccacgacgccccugaccaccgacgacggggugcuccugcgccggauggcgcuggagaucggcgcccuccaccugauccuggugugccucagcgcccugucccaccacagcccgcgcguccccaacuccagcgugaaccagacggagccccagguguccagcagccacaaccccaccuccaccgaggagcagcagcuguacugggccaagggcaccggguucggcacggggagcaccgccuccggcugggacgucgagcaggcgcucaccaagcagcgccuggaggaggagcacgugaccugccugcuccaggugcuggccagcuacaucaacccggucuccagcgccgugaacggcgaggcccaguccagccacgagacgcgggggcagaacuccaacgcgcugcccagcgugcuccuggagcugcucucccagagcugccugauccccgccauguccagcuaccugcgcaacgacuccguccucgacauggcccggcacgugccgcuguaccgcgcccugcucgagcugcugcgggccaucgcgagcugcgccgccauggugccccuccugcugccccucuccaccgagaacggcgaggaggaggaggagcagagcgagugccagaccuccgucgggacccugcuggccaagaugaagacgugcguggacaccuacaccaaccgccuccggagcaagcgcgagaacgugaagaccggcgucaagcccgacgccagcgaccaggagccggaggggcugacgcugcucgugcccgacauccagaagaccgcggagaucguguacgccgccaccaccucccugcggcaggccaaccaggagaagaagcugggcgaguacagcaagaaggccgcgaugaagcccaagccccucuccguccucaagagccuggaggagaaguacguggccgugaugaagaagcuccaguucgacacguucgagauggucuccgaggacgaggacggcaagcugggguucaaggugaacuaccacuacaugagccaggucaagaacgccaacgacgccaacuccgcggcccgcgcccggcgccuggcccaggaggccgugacccucagcaccucccugccgcugagcuccagcuccagcguguucguccggugcgacgaggagcgccucgacaucaugaaggugcugaucaccggccccgcggacacccccuacgccaacgggugcuucgaguucgacguguacuucccccaggacuacccguccuccccgccccuggucaaccucgagacgaccggcgggcacuccgugcgguucaaccccaaccuguacaacgacggcaaggugugccugagcauccucaacaccuggcacggccgcccggaggagaaguggaacccccagaccuccagcuuccugcagguccuggugagcgugcagucccucauccuggucgccgagcccuacuucaacgagcccggguacgagcggagccgcggcacgccguccgggacccagagcucccgggaguacgacggcaacauccgccaggccaccgugaagugggccaugcuggagcagauccgcaaccccagccccugcuucaaggaggugauccacaagcacuucuaccucaagcgggucgagaucauggcgcagugcgaggaguggaucgccgacauccagcaguacuccagcgacaagcgcguggggcggaccaugucccaccacgccgccgcccugaagcgccacacggcgcagcugcgggaggagcuccugaagcugcccugcccggagggccucgaccccgacaccgacgacgcccccgaggugugccgcgccaccaccggcgccgaggagacgcugaugcacgaccaggucaagccgagcuccagcaaggagcugcccuccgacuuccagcucuga

SEQ ID NO: 27278 - RNA, 843 nt, Artificial Sequence
  derived and/or modified sequence opt1 from BIRC7__Homo_sapiens__NP_071444
augggccccaaggacagcgccaagugccugcaccgcgggccgcagcccucccacugggccgcgggcgacgggcccacccaggagcggugcggcccccgcagccucggguccccggugcugggccuggacacgugccgggccugggaccacgucgacggccagauccucgggcagcugcgcccccugaccgaggaggaggaggaggagggcgccggggccacccucagccggggccccgccuuccccgggaugggcuccgaggagcugcgccuggcgagcuucuacgacuggccgcucaccgccgaggugccgcccgagcugcuggccgccgcgggcuucuuccacaccgggcaccaggacaaggugcggugcuucuucugcuacggcgggcuccaguccuggaagcgcggcgacgaccccuggacggagcacgccaagugguuccccagcugccaguuccugcugcgguccaagggccgcgacuucguccacagcgugcaggagacccacucccagcuccuggggagcugggaccccugggaggagcccgaggacgccgcccccguggccccguccguccccgcgagcggcuaccccgagcugcccaccccgcggcgcgaggugcaguccgagagcgcccaggagcccggggcccgggacguggaggcccagcuccgccggcugcaggaggagcggaccugcaaggucugccuggaccgcgccguguccaucguguucguccccugcggccaccucgugugcgcggagugcgcccccgggcugcagcugugcccgaucugccgcgcccccgugcggagccgcguccggacguuccucuccuga

SEQ ID NO: 27279 - RNA, 846 nt, Artificial Sequence
  derived and/or modified sequence opt1 from BIVM__Homo_sapiens__NP_001153068
augggcgccgggaaccugccgcccaucacccaggaggaggcccuccacauccugggcuuccagccgcccuucgaggacauccgcuucgggcccuucaccggcaacacgacccugaugcggugguuccgccagaucaacgaccacuuccacgugaaggggugcagcuacguccucuacaagccccacggcaagaacaagaccgcgggcgagaccgccuccggggcccugagcaagcugacgcggggccucaaggacgagucccuggccuacaucuaccacugccagaaccacuacuucugccccaucggguucgaggccacccccgugaaggcgaacaaggccuucagccgcggcccccugagcccccaggagguggaguacuggauccucaucggggaguccucccggaagcaccccgccauccacugcaagaagugggccgacaucgucaccgaccugaacacccagaaccccgaguaccuggacauccgccaccucgagcggggccugcaguaccgcaagacgaagaagcccaccuucuucagcucccaggugggcgggaaccugcacugcaucaucgcguuccagcggcucaacuggcagcgcuucggccuguggaacuucccguucgggaccauccggcaggagagccagccgcccacccacgcccagggcaucgccaaguccgagagcgaggacaacaucuccaagaagcagcacggccgccuggggcggagcuucuccgccagcuuccaccaggacuccgccuggaagaagaugagcuccauccacgagcgccggaacagcggcuaccagggguacagcgacuacgacggcaacgacuga

SEQ ID NO: 27280 - RNA, 264 nt, Artificial Sequence
  derived and/or modified sequence opt1 from BLCAP__Homo_sapiens__NP_001161292
auguacugccugcaguggcuccugcccgugcugcucaucccgaagccccugaaccccgcccugugguucagccacuccauguucaugggcuucuaccuccugagcuuccugcucgagcgcaagcccugcaccaucugcgcccuggucuuccuggcggcccucuuccugaucugcuacuccugcugggggaacugcuuccuguaccacugcagcgacuccccgcuccccgagagcgcccacgaccccggcgugguggggaccuga

SEQ ID NO: 27281 - RNA, 327 nt, Artificial Sequence
  derived and/or modified sequence opt1 from BLID__Homo_sapiens__NP_001001786
auggugacccugcuccccaucgagggccaggagauccacuucuucgagauccuggagagcgagugcguccuguacaccggguggaucgagcgcgccuccggcagcuccaucuacccggaggccaaggcgcggcucccccuggaggcccugcucgggagcaacaaggagcccaugcugcccaaggagacggugcugucccucaagcgcuacaaccugggcagcuccgccaugaagcggaacgugccggggcacguccugcagcgccccagcuaccucacccggauccaggugacccugcugugcaacuccagcgccgaggcccucuga

SEQ ID NO: 27282 - RNA, 1518 nt, Artificial Sequence
  derived and/or modified sequence opt1 from BLK__Homo_sapiens__NP_001706
augggccuggugagcuccaagaagcccgacaaggagaagccgaucaaggagaaggacaaggggcaguggagcccccucaaggucuccgcccaggacaaggacgccccgccccugccgccccuggugguguucaaccaccucaccccgccgccgcccgacgagcaccuggacgaggacaagcacuucgucguggcgcuguacgacuacaccgccaugaacgaccgcgaccuccagaugcugaagggcgagaagcuccaggugcugaaggggacgggcgacugguggcuggcccggagccuggucaccgggcgcgagggcuacgugcccuccaacuucguggcccgggucgagagccucgagauggagcgcugguucuuccggucccagggccgcaaggaggccgagcggcagcugcuggcgcccaucaacaaggccgggagcuuccucauccgcgaguccgagaccaacaagggcgccuucagccuguccgugaaggacgugaccacgcagggggagcugaucaagcacuacaagauccggugccucgacgagggcggguacuacaucagcccccgcaucaccuuccccucccugcaggcccugguccagcacuacagcaagaagggcgacggccucugccagcggcugacccugcccugcgugcgccccgcgccccagaaccccugggcccaggacgagugggagaucccccggcagucccuccgccuggugcggaagcuggggagcggccaguucggggaggucuggaugggcuacuacaagaacaacaugaagguggccaucaagacccucaaggagggcacgaugucccccgaggccuuccugggggaggccaacgugaugaaggcgcugcagcacgagcgccucguccggcuguacgccguggugaccaaggagcccaucuacaucgucaccgaguacauggcccgcggcugccugcucgacuuccugaagaccgacgaggggagccggcugucccucccccgccugaucgacaugagcgcccagaucgccgagggcauggcguacaucgagcggaugaacagcauccaccgcgaccugcgcgccgccaacauccucguguccgaggcccugugcugcaagaucgccgacuucgggcuggcgcggaucaucgacagcgaguacacggcccaggagggcgccaaguuccccaucaaguggaccgcccccgaggccauccacuucggcguguucaccaucaaggcggacgucugguccuucggggugcuccugauggaggucgugaccuacggccgcgugccguaccccgggaugagcaaccccgaggucauccggaaccuggagcgcggcuaccggaugccccgcccggacacgugcccgcccgagcucuaccgcggggugaucgccgagugcuggcggucccggcccgaggagcgccccaccuucgaguuccugcagagcgugcuggaggacuucuacaccgccaccgagcggcaguacgagcuccagcccuga

SEQ ID NO: 27283 - RNA, 1368 nt, Artificial Sequence
  derived and/or modified sequence opt1 from BLMH__Homo_sapiens__NP_000377
augagcuccagcggccugaacuccgagaagguggccgcccucauccagaagcugaacagcgacccccaguucguccuggcgcagaacguggggaccacccacgaccuccuggacaucugccugaagcgcgccacggugcagcgggcccagcacgucuuccagcacgccgugccgcaggagggcaagcccaucaccaaccagaaguccagcgggcgcugcuggaucuucuccugccucaacgugaugcggcugcccuucaugaagaagcugaacaucgaggaguucgaguucagccaguccuaccucuucuucugggacaaggucgagcgcugcuacuucuuccugagcgccuucguggacaccgcgcagcggaaggagcccgaggacggccgccuggugcaguuccuccugaugaacccggccaacgacgggggccagugggacaugcuggucaacaucguggagaaguacggcgugauccccaagaagugcuuccccgaguccuacaccacggaggccacccggcgcaugaacgacauccucaaccacaagaugcgggaguucugcauccgccugcggaaccugguccacagcggggccaccaagggcgagaucuccgcgacccaggacgugaugauggaggagaucuuccgcguggucugcaucugccucgggaacccgcccgagacguucaccugggaguaccgggacaaggacaagaacuaccagaagaucggccccaucacgccccuggaguucuaccgcgagcacgugaagccccuguucaacauggaggacaagaucugccucgugaacgacccgcggccccagcacaaguacaacaagcuguacaccgucgaguaccugagcaacauggucgggggccgcaagacccucuacaacaaccagcccaucgacuuccugaagaagaugguggccgccuccaucaaggacggcgaggccgugugguucgggugcgacgugggcaagcacuucaacagcaagcuggggcucuccgacaugaaccuguacgaccacgagcugguguucggcgucagccucaagaacaugaacaaggccgagcggcugaccuucggcgagucccugaugacccacgcgaugaccuucacggccgugagcgagaaggacgaccaggacggggccuucaccaaguggcgcgucgagaacagcuggggcgaggaccacgggcacaagggcuaccucugcaugaccgacgagugguucuccgaguacguguacgagguggucguggaccggaagcacgugcccgaggagguccuggccgugcuggagcaggagccgaucauccuccccgccugggaccccaugggggcgcuggccgaguga

SEQ ID NO: 27284 - RNA, 4254 nt, Artificial Sequence
  derived and/or modified sequence opt1 from BLM__Homo_sapiens__NP_001274175
auggccgccgugccccagaacaaccugcaggagcagcucgagcgccacagcgcgcggacccugaacaacaagcugucccucagcaagccgaaguucuccggcuucaccuucaagaagaagacgagcuccgacaacaacgucagcgugaccaacguguccgucgccaagacccccgugcugcgcaacaaggacgugaacgucaccgaggacuucagcuucuccgagccccugcccaacacgaccaaccagcagcgggugaaggacuucuucaagaacgccccggccgggcaggagacccagcgcggcgggagcaagucccuccugcccgacuuccugcagacccccaaggagguggucugcacgacccagaacacccccaccgugaagaagucccgggacacggcccucaagaagcuggaguucuccagcuccccggacagccuguccaccaucaacgacugggacgacauggacgacuucgacaccagcgagaccuccaagagcuucgugacgccgccccagagccacuucguccgcguguccaccgcgcagaaguccaagaagggcaagcggaacuucuucaaggcccagcucuacaccaccaacacggugaagaccgaccugcccccgcccagcagcgaguccgagcagaucgaccugaccgaggagcagaaggacgacagcgaguggcucuccagcgacgucaucugcaucgacgacgggcccaucgccgaggugcacaucaacgaggacgcccaggaguccgacagccugaagacccaccuggaggacgagcgcgacaacuccgagaagaagaagaaccucgaggaggcggagcugcacagcacggagaaggugcccugcaucgaguucgacgacgacgacuacgacaccgacuucgucccgcccucccccgaggagaucaucagcgccuccagcuccagcuccaagugccugagcacccucaaggaccuggacaccagcgaccggaaggaggacgugcuguccacgagcaaggaccuccuguccaagcccgagaagaugagcaugcaggagcugaaccccgagaccuccaccgacugcgacgcccgccagaucagccuccagcagcagcugauccacgugauggagcacaucugcaagcugaucgacaccauccccgacgacaagcucaagcugcuggacugcggcaacgagcuccugcagcagcggaacauccgccggaagcugcucacggaggucgacuucaacaaguccgacgccagccugcugggcucccucuggcgcuaccggcccgacagccuggacgggcccauggagggcgacuccugcccgaccgggaacagcaugaaggagcugaacuucucccaccuccccagcaacuccgugagccccggcgacugccugcugaccaccacgcucgggaagaccggcuucuccgccacccgcaagaaccuguucgagcggccccuguucaacacccaccuccagaaguccuucgugagcagcaacugggcggagaccccgcgccugggcaagaagaacgagagcuccuacuuccccgggaacguccugacgagcaccgccgugaaggaccagaacaagcacaccgccuccaucaacgaccuggagcgggagacccagcccagcuacgacaucgacaacuucgacaucgacgacuucgacgacgacgacgacugggaggacaucaugcacaaccucgccgccuccaagagcuccacggcggccuaccagccgaucaaggagggccgccccaucaagagcgucuccgagcggcugagcuccgccaagaccgacugccugcccgugagcuccaccgcccagaacaucaacuucagcgaguccauccagaacuacaccgacaagagcgcccagaaccucgcgucccgcaaccugaagcacgagcgcuuccagagccugagcuucccccacacgaaggagaugaugaagaucuuccacaagaaguucgggcuccacaacuuccggaccaaccagcuggaggccaucaacgccgcccugcucggcgaggacugcuucauccugaugccgaccggcgggggcaagucccugugcuaccagcuccccgccugcgugagccccggggucaccguggugaucagcccccugcgcagccugaucgucgaccaggugcagaagcucacgucccuggacaucccggcgaccuaccugaccggcgacaagaccgacagcgaggccacgaacaucuaccuccagcuguccaagaaggaccccaucaucaagcugcucuacgugacccccgagaagaucugcgccagcaaccggcugaucuccacccuggagaaccucuacgagcgcaagcugcuggcccgguucgucaucgacgaggcgcacugcgugagccagugggggcacgacuuccgccaggacuacaagcggaugaacaugcuccgccagaaguuccccuccgugccggucauggcccugaccgccacggccaacccccgggugcagaaggacauccugacccagcucaagauccugcgcccccagguguucagcauguccuucaaccggcacaaccugaaguacuacguccuccccaagaagccgaagaagguggccuucgacugccuggaguggauccgcaagcaccaccccuacgacagcggcaucaucuacugccugucccggcgcgagugcgacaccauggcggacacccuccagcgggacggccuggccgcccuggccuaccacgccgggcucagcgacuccgcgcgcgacgaggugcagcagaaguggaucaaccaggacggcugccaggucaucugcgccacgaucgccuucgggaugggcaucgacaagcccgacgugcgguucgugauccacgccagccugcccaaguccgucgagggguacuaccaggagagcggccgcgccggccgggacggggagaucagccacugccuccuguucuacaccuaccacgacgugacccgccugaagcgccugaucaugauggagaaggacggcaaccaccacacccgggagacgcacuucaacaaccucuacuccauggugcacuacugcgagaacaucaccgagugccgccggauccagcugcuggcguacuucggggagaacggcuucaacccggacuucugcaagaagcaccccgacgucagcugcgacaacugcugcaagaccaaggacuacaagacccgcgacgugacggacgacgugaaguccaucguccgguucgugcaggagcacagcuccagccaggggaugcgcaacaucaagcacgugggccccuccggccgguucaccaugaacaugcucgucgacaucuuccuggggagcaaguccgccaagauccagagcggcaucuucgggaagggcuccgccuacagccgccacaacgccgagcggcuguucaagaagcucauccuggacaagauccuggacgaggaccucuacaucaacgcgaacgaccaggccaucgccuacgugaugcugggcaacaaggcccagaccgugcugaacgggaaccucaaggucgacuucauggagaccgagaacuccagcuccgugaagaagcagaaggcccugguggcgaaggucagccagcgcgaggagauggugaagaagugccugggcgagcucacggaggugugcaagucccuggggaaggucuucggcgugcacuacuucaacaucuucaacaccgugacccugaagaagcucgccgagagccuguccagcgaccccgagguccugcuccagaucgacggggugaccgaggacaagcuggagaaguacggcgccgaggugaucagcguccugcagaaguacuccgaguggaccagcccggccgaggacuccagccccggcaucucccucagcuccagccgggggcccggccgcuccgccgcggaggagcuggacgaggagaucccggugagcucccacuacuucgccagcaagacgcggaacgagcgcaagcggaagaagaugcccgccucccagcgcagcaagcggcgcaagaccgccuccagcggguccaaggccaagggcgggagcgcgaccugccggaagaucuccagcaagaccaagagcuccagcaucaucggcuccagcuccgccagccacacgucccaggccaccagcggcgccaacuccaagcuggggaucauggcgccgcccaagcccaucaaccgccccuuccucaagcccagcuacgccuucuccuga

SEQ ID NO: 27285 - RNA, 1302 nt, Artificial Sequence
  derived and/or modified sequence opt1 from BLNK__Homo_sapiens__NP_001107566
auggacaagcugaacaagaucaccgugcccgccagccagaagcuccgccagcugcagaagaugguccacgacaucaagaacaacgagggcgggaucaugaacaagaucaagaagcugaaggugaaggccccgcccuccgugccccggcgcgacuacgcgagcgagucccccgccgacgaggaggagcaguggagcgacgacuucgacuccgacuacgagaacccggacgagcacagcgacuccgagauguacgucaugcccgccgaggagaacgccgacgacagcuacgagcccccgcccguggagcaggagacccggcccgugcaccccgcccuccccuucgcgcgcggcgaguacaucgacaaccgguccagccagcgccacuccccgcccuucagcaagacgcugcccuccaagcccagcuggccguccgagaaggcccggcugaccagcacccuccccgcccugaccgcccugcagaagccccaggugcccccgaagcccaaggggcuccuggaggacgaggcggacuacgucgugcccgucgaggacaacgacgagaacuacauccaccccacggaguccagcuccccgccgcccgagaagggccgcaacagcggggccugggagaccaagagcccgccgcccgccgcccccagcccccugccccgggccggcaagaagcccaccacgccccucaagaccacccccguggcgucccagcagaacgccuccagcgugugcgaggagaagcccauccccgccgagcgccaccggggcuccagccaccgccaggaggccguccagucccccguguucccgcccgcccagaagcagauccaccagaagcccaucccccugccgcgguucaccgagggcgggaaccccaccguggacgggccccugcccagcuucuccagcaacuccacgaucagcgagcaggaggcgggcguccucugcaagccgugguacgccggggccugcgaccgcaaguccgccgaggaggcccugcaccggagcaacaaggacggcuccuuccugauccgcaagagcuccggccacgacagcaagcagcccuacacccucgugguguucuucaacaagcgggucuacaacauccccgugcgcuucaucgaggcgaccaagcaguacgcccuggggcggaagaagaacggcgaggaguacuucggguccguggccgagaucauccgcaaccaccagcacagcccccugguccucaucgacagccagaacaacaccaaggacuccacgcggcugaaguacgccgugaaggugagcuga

SEQ ID NO: 27286 - RNA, 288 nt, Artificial Sequence
  derived and/or modified sequence opt1 from BLOC1S2__Homo_sapiens__NP_001269365
augcgccugccccgcaagagccucgagguggccaccuccgaggacuacaagcugcuggagaacaugaacaagcucaccagccugaaguaccuggagaugaaggacaucgccaucaacaucucccggaaccucaaggaccugaaccagaaguacgcgggccugcagccguaccucgaccagaucaacgugaucgaggagcaggucgccgcccuggagcaggccgccuacaagcuggacgcguacagcaagaagcucgaggccaaguacaagaagcuggagaagcgguga

SEQ ID NO: 27287 - RNA, 609 nt, Artificial Sequence
  derived and/or modified sequence opt1 from BLOC1S3__Homo_sapiens__NP_997715
auggccagccagggccgccggcgccggccccugcgccggccggagaccgugguccccggggaggccaccgagacggacuccgagcgcagcgcguccagcuccgaggaggaggagcucuaccugggccccagcgggcccacccggggccgcccgaccgggcugcggguggccggcgaggccgccgagaccgacuccgagcccgagcccgagcccgagccgacggccgcgccccgcgaccucccgccccuggugguccagcgggagagcgccgaggaggccuggggcaccgaggaggcccccgcgcccgcccccgcccgcucccugcuccagcugcggcuggccgagagccaggcccgccucgaccacgacguggcggccgccguguccggggucuaccggcgcgccggccgggacguggccgcgcuggccagccgccuggccgccgcccaggcggccgggcucgccgccgcccacuccgugcggcuggcgcgcggcgaccugugcgcccucgccgagcggcuggacaucgucgccgggugccgccugcuccccgacauccgcggcgugccgggcaccgagcccgagaaggaccccgggccccgggcguga

SEQ ID NO: 27288 - RNA, 654 nt, Artificial Sequence
  derived and/or modified sequence opt1 from BLOC1S4__Homo_sapiens__NP_060836
auggagggcagcuucuccgacgggggcgcccugcccgaggggcucgccgaggaggcggagccgcagggcgccgccuggagcggggacuccggcaccgugagccagucccacagcuccgccagcggccccugggaggacgagggggccgaggacggcgcgcccgggcgcgaccugccccugcuccggcgcgccgccgccggcuacgcggccugccugcugccgggggccggcgcccggcccgaggucgaggcccucgacgcgucccuggaggaccugcucacccgcguggacgaguucgugggcaugcuggacaugcugcgcggggacagcucccacgucgugagcgagggcgugccccggauccacgccaaggccgccgagaugcggcgcaucuacucccggaucgaccgccucgaggccuucguccggauggugggcgggcgcguggcgcggauggaggagcaggucacgaaggccgaggccgagcugggcaccuucccccgcgccuucaagaagcugcuccacaccaugaacgugccgagccuguucuccaagagcgcccccucccggccccagcaggcgggguacgaggcccccgugcuguuccgcaccgaggacuacuucccgugcugcagcgagcggccccagcucuga

SEQ ID NO: 27289 - RNA, 372 nt, Artificial Sequence
  derived and/or modified sequence opt1 from BLOC1S5__Homo_sapiens__NP_001186251
auggagaagcgcggccugcgggagaugcgcgugcucgagaaccugaagaacaugauccacgagaccaacgagcacacccugcccaagugccgggacacgaugcgcgacagccucucccagguccugcagcggcugcaggccgccaacgacagcgugugccgccuccagcagcgggagcaggagcgcaagaagauccacuccgaccaccugguggcgagcgagaagcagcacaugcugcagugggacaacuucaugaaggagcagccgaacaagcgggccgaggucgacgaggagcaccgcaaggccauggagcggcucaaggagcaguacgccgagauggagaaggaccuggccaaguucuccaccuucuga

SEQ ID NO: 27290 - RNA, 519 nt, Artificial Sequence
  derived and/or modified sequence opt1 from BLOC1S6__Homo_sapiens__NP_036520
augagcgugcccggcccguccagccccgacggggcccugacccgcccgcccuacugccucgaggccggcgagcccacccccgggcuguccgacacgagccccgacgagggccugaucgaggaccucaccaucgaggacaaggcggucgagcagcuggccgaggggcugcucucccacuaccugcccgaccugcagcggagcaagcaggcccuccaggagcugacccagaaccagguggugcugcucgacacccuggagcaggagaucuccaaguucaaggagugccacagcaugcuggacaucaacgcccucuucgccgaggcgaagcacuaccacgccaagcuggucaacauccgcaaggagaugcugaugcuccacgagaagacguccaagcugaagaagcgggcccugaagcuccagcagaagcgccagaaggaggagcuggagcgggagcagcagcgcgagaaggaguucgagcgggagaagcagcugaccgcccgcccggcgaagcggauguga

SEQ ID NO: 27291 - RNA, 891 nt, Artificial Sequence
  derived and/or modified sequence opt1 from BLVRA__Homo_sapiens__XP_011513776
augaacgccgagcccgagcgcaaguucggcguggucguggugggggucggccgggccgggagcgugcgcaugcgggaccugcgcaacccccaccccuccagcgcguuccucaaccugaucggcuucgugucccggcgcgagcuggggagcaucgacggcguccagcagaucucccucgaggacgcccugagcucccaggagguggagguggccuacaucugcagcgaguccagcucccacgaggacuacauccggcaguuccugaacgccggcaagcacguccucguggaguaccccaugacccugagccuggccgcggcccaggagcucugggagcuggccgagcagaaggggaaggugcugcacgaggagcacgucgagcuccugauggaggaguucgccuuccugaagaaggagguggugggcaaggaccuccugaaggggucccuccuguucaccgcgggcccccuggaggaggagcgcuucggguucccggccuucagcggcaucucccggcugacguggcucgucagccuguucggcgagcugucccucgugagcgccacccuggaggagcgcaaggaggaccaguacaugaagaugaccgugugccuggagaccgagaagaaguccccgcucagcuggaucgaggagaaggggcccggccugaagcggaaccgcuaccugagcuuccacuucaaguccgggagccucgagaacguccccaacgugggcgugaacaagaacaucuuccugaaggaccagaacaucuucguccagaagcugcucggccaguucuccgagaaggagcuggccgccgagaagaagcggauccugcacugccucgggcuggcggaggagauccagaaguacugcugcagccgcaaguga

SEQ ID NO: 27292 - RNA, 621 nt, Artificial Sequence
  derived and/or modified sequence opt1 from BLVRB__Homo_sapiens__NP_000704
auggccgugaagaagaucgccaucuucggcgcgaccgggcagaccggccugacgacccucgcccaggccguccaggccggguacgaggugaccgugcugguccgcgacagcucccggcugcccagcgagggcccgcgccccgcccacgugguggucggggacgugcuccaggcggccgacguggacaagaccgucgccggccaggacgccgugaucgugcugcugggcacgcggaacgaccucucccccaccaccgucaugagcgagggggcgcgcaacaucguggccgccaugaaggcccacggcguggacaaggucguggccugcaccuccgcguuccugcugugggaccccacgaaggugccgccccggcuccaggccgucaccgacgaccacauccgcaugcacaaggugcugcgggagagcgggcugaaguacguggccgucaugccgccccacaucggcgaccagccccucaccggggccuacaccgugacgcuggacggccgcggccccucccgggugaucagcaagcacgaccuggggcacuucaugcuccgcugccugaccaccgacgaguacgacggccacuccaccuaccccagccaccaguaccaguga

SEQ ID NO: 27293 - RNA, 1203 nt, Artificial Sequence
  derived and/or modified sequence opt1 from BLZF1__Homo_sapiens__NP_003657
augaccaccaagaaccuggagacgaaggugaccgucaccagcucccccauccgcggcgccggggacggcauggagaccgaggagccgcccaagagcguggaggugacguccgggguccagagccggaagcaccacucccuccagagccccuggaagaaggccgugcccuccgagagcccgggcgugcugcagcuggggaagaugcucaccgagaaggcgauggaggucaaggccgugcgcauccuggugcccaaggccgccaucacccacgacauccccaacaagaacaccaaggucaagucccugggccaccacaagggcgaguuccucgggcagagcgagggcgugaucgagcccaacaaggagcuguccgaggugaagaacguccuggagaagcucaagaacagcgagcggcgccugcugcaggacaaggaggggcucuccaaccagcugcgggugcagacggaggugaaccgcgagcugaagaagcuccuggucgccagcgugggcgacgaccugcaguaccacuucgagcggcucgcgcgcgagaagaaccagcugauccuggagaacgaggcccucgggcggaacaccgcccagcuguccgagcagcuggagcgcaugagcauccagugcgacguguggcgguccaaguuccucgccagccgcgucauggcggacgagcugaccaacucccgggccgcccugcagcgccagaaccgggacgcccacggcgccauccaggaccuccugagcgagcgcgagcaguuccggcaggagaugaucgcgacccagaagcugcucgaggagcugcuggugagccuccaguggggccgcgagcagacguacuccccgagcgugcagccccacuccaccgccgagcuggcccugaccaaccacaagcucgccaaggccgucaacagccaccuccuggggaacgugggcaucaacaaccagaagaagauccccuccaccguggaguucugcagcacgcccgcggagaagauggccgagaccguccugcggauccuggacccggugaccugcaaggaguccagccccgacaaccccuucuucgaguccagccccaccacgcugcucgccaccaagaagaacaucgggcgcuuccacccguacacccgguacgagaacaucaccuucaacugcugcaaccacugccgcggcgagcugaucgcccuguga

SEQ ID NO: 27294 - RNA, 492 nt, Artificial Sequence
  derived and/or modified sequence opt1 from BMF__Homo_sapiens__NP_001003942
auggagcccagccagugcguggaggagcuggaggacgacgucuuccagccggaggacggcgagcccgugacccagcccgggucccuccugagcgccgaccuguucgcccagucccuccuggacugcccccugagccgccuccagcuguucccgcugacccacugcugcggccccgggcuccggcccacgucccaggaggacaaggcgacccagacccugagccccgccuccccgagccagggcgugaugcugcccugcggggucaccgaggagccccagcgccucuucuacggcaacgccggcuaccggcugccccugccggccuccuuccccgccgugcuccccaucggggagcagcccccggagggccaguggcagcaccaggcggagcaccagcagaaccagaaccgcgugugguggcagauccugcuguuccuccacaaccuggcccugaacggggaggagaaccggaacggcgccgggccccgcuga

SEQ ID NO: 27295 - RNA, 981 nt, Artificial Sequence
  derived and/or modified sequence opt1 from BMI1__Homo_sapiens__NP_005171
augcaccgcaccacccggaucaagaucacggagcugaacccccaccucaugugcgugcugugcggcggguacuucaucgacgccaccaccaucaucgagugccugcacagcuucugcaagaccugcaucguccgcuaccucgagacguccaaguacugcccgaucugcgacguccaggugcacaagacccggccccugcugaacauccgcagcgacaagacccuccaggacaucguguacaagcuggugcccggccuguucaagaacgagaugaagcggcgccgggacuucuacgccgcgcaccccuccgccgacgccgccaacgggagcaacgaggaccgcggcgagguggccgacgaggacaagcggaucaucaccgacgacgagaucaucucccucagcaucgaguucuucgaccagaaccgccuggaccggaaggucaacaaggacaaggagaaguccaaggaggaggugaacgacaagcgcuaccugcggugcccggcggccaugacggugaugcaccuccgcaaguuccugcggagcaagauggacauccccaacaccuuccagaucgacgucauguacgaggaggagccccugaaggacuacuacacccucauggacaucgccuacaucuacaccuggcgccggaacgggccccugccgcugaaguaccgcgugcggcccacgugcaagcgcaugaagaucucccaccagcgggacggccucaccaacgccggcgagcuggagagcgacuccgggagcgacaaggcgaacucccccgccggcgggauccccagcaccuccagcugccugccgucccccagcacccccgugcagagcccccacccgcaguucccccacaucuccagcacgaugaacggcaccuccaacagccccuccgggaaccaccagagcuccuucgccaaccgcccccgcaagagcuccgucaacggcagcuccgccaccagcuccggcuga

SEQ ID NO: 27296 - RNA, 1275 nt, Artificial Sequence
  derived and/or modified sequence opt1 from BMP10__Homo_sapiens__NP_055297
augggcagccuggugcucacccugugcgcccuguucugccucgccgcguaccuggucuccgggagccccaucaugaaccuggagcaguccccgcucgaggaggacaugagccuguucggcgacguguucuccgagcaggacgggguggacuucaacacccugcuccagagcaugaaggacgaguuccugaagacgcugaaccucuccgacauccccacccaggacagcgccaaggucgacccgcccgaguacaugcuggagcuguacaacaaguucgccaccgaccgcaccuccaugcccagcgccaacaucauccgguccuucaagaacgaggaccucuucagccagcccguguccuucaacggccugcgcaaguacccccuccuguucaacgugagcaucccccaccacgaggaggucaucauggccgagcugcggcuguacacgcucgugcagcgcgaccggaugaucuacgacgggguggaccgcaagaucaccaucuucgagguccuggaguccaagggcgacaacgagggcgagcggaacaugcuggugcucgugagcggggagaucuacggcaccaacuccgagugggagaccuucgacgucacggacgcgauccgccgguggcagaaguccgggagcagcacccaccagcuggaggugcacaucgagagcaagcacgacgaggccgaggacgccuccagcggccgccuggagaucgacaccuccgcccagaacaagcacaacccgcuccugaucguguucagcgacgaccaguccagcgacaaggagcggaaggaggagcugaacgagaugaucucccacgagcagcuccccgagcuggacaaccuggggcucgacagcuucuccagcggccccggcgaggaggcgcugcugcagaugcgcuccaacaucaucuacgacagcaccgcccggauccgccggaacgccaaggggaacuacugcaagcgcacgccccucuacaucgacuucaaggagaucggcugggacuccuggaucaucgccccgcccggguacgaggccuacgagugccggggcgucugcaacuacccccuggcggagcaccugacccccaccaagcacgccaucauccaggcccucgugcaccugaagaacagccagaaggccuccaaggccugcugcgugccgaccaagcuggagcccaucagcauccucuaccuggacaagggcgucgugacguacaaguucaaguacgaggggauggcgguguccgagugcggcugccgcuga

SEQ ID NO: 27297 - RNA, 1179 nt, Artificial Sequence
  derived and/or modified sequence opt1 from BMP15__Homo_sapiens__NP_005439
auggugcugcucagcauccugcgcauccuguuccucugcgagcugguccuguucauggagcaccgggcccagauggccgagggcgggcaguccagcaucgcgcuccuggccgaggcccccacccugccgcucaucgaggagcugcuggaggagucccccggcgagcagccccgcaagccccggcuccuggggcacagccugcgcuacaugcucgagcuguaccggcgcuccgccgacagccacggccacccgcgggagaaccgcaccaucggggccaccauggugcggcuggugaagccccucaccaacgucgcgcgcccccaccggggcaccuggcacauccagauccugggcuucccccugcgcccgaaccgggggcucuaccagcuggugcgcgccaccguggucuaccggcaccaccuccagcugacgcgcuucaaccuguccugccacguggagcccugggugcagaagaaccccaccaaccacuuccccagcuccgagggcgacagcuccaagccgagccugauguccaacgccuggaaggagauggacaucacccagcucguccagcagcgguucuggaacaacaaggggcaccgcauccugcggcugcgcuucaugugccagcagcagaaggacagcggcgggcucgagcuguggcacggcaccuccagccuggacaucgccuuccuccugcuguacuucaacgacacgcacaaguccauccggaaggcgaaguuccucccccgcggcauggaggaguucauggagcgcgagagccugcugcggcgcacccggcaggccgacgggaucuccgccgaggugaccgccagcagcuccaagcacagcggccccgagaacaaccagugcucccuccaccccuuccagaucagcuuccgccagcuggggugggaccacuggaucaucgccccgcccuucuacacccccaacuacugcaagggcacgugccugcgggugcuccgcgacggccugaacucccccaaccacgcgaucauccagaaccugaucaaccagcucgucgaccagagcgugccgcggcccuccugcgugcccuacaaguacguccccaucagcgugcugaugaucgaggccaacggguccauccuguacaaggaguacgagggcaugaucgccgagagcugcacgugccgcuga

SEQ ID NO: 27298 - RNA, 2193 nt, Artificial Sequence
  derived and/or modified sequence opt1 from BMP1__Homo_sapiens__NP_001190
augcccggcguggcccgccugccgcuccugcuggggcuccugcugcucccccggcccggccgcccccuggaccuggccgacuacaccuacgaccucgcggaggaggacgacagcgagccgcugaacuacaaggaccccugcaaggccgccgccuuccugggggacaucgcccucgacgaggaggaccugcgggcguuccagguccagcaggccguggaccugcgccggcacaccgcccgcaaguccagcaucaaggccgcggugcccggcaacaccuccacccccagcugccaguccaccaacgggcagccgcagcggggcgccugcggccgcuggcgggggcgcagccggucccgccgggccgccaccagccgccccgagcgggucuggcccgacggcgugauccccuucgugaucgggggcaacuucacggggucccagcgcgccgucuuccggcaggcgaugcgccacugggagaagcacacgugcgugaccuuccucgagcggaccgacgaggacagcuacaucguguucaccuaccgcccgugcggcugcugcuccuacgucggccggcgcgggggcgggccccaggccaucagcaucggcaagaacugcgacaaguucggcaucguggugcacgagcuggggcacgucgugggcuucuggcacgagcacacccgccccgaccgggaccgccacguguccaucguccgggagaacauccagcccgggcaggaguacaacuuccugaagauggagccgcaggagguggagagccucggcgagaccuacgacuucgacuccaucaugcacuacgcccgcaacaccuucagccgggggaucuuccuggacacgaucgugcccaaguacgaggucaacggcgugaagccgcccaucggccagcgcacccggcuguccaagggggacaucgcccaggcccgcaagcucuacaagugccccgcgugcggcgagacccugcaggacagcaccgggaacuucuccagccccgaguaccccaacggcuacagcgcccacaugcacugcguguggcggaucuccgucacgcccggggagaagaucauccugaacuucaccagccucgaccuguaccgcucccggcugugcugguacgacuacguggaggugcgcgacggcuucuggcggaaggccccgcuccgcggccgguucugcgggagcaagcugcccgagcccaucgucuccaccgacagccgccuguggguggaguuccgguccagcuccaacugggucggcaagggguucuucgccguguacgaggccaucugcggcggggacgugaagaaggacuacggccacauccagagccccaacuacccggacgacuaccgccccuccaaggucugcaucuggcggauccaggugagcgagggcuuccacguggggcucaccuuccaguccuucgagaucgagcgccacgacagcugcgcguacgacuaccuggagguccgcgacggccacuccgagagcuccacgcugaucgggcgguacugcggcuacgagaagcccgacgacaucaagagcaccuccagccgccucuggcugaaguucgugagcgacggcuccaucaacaaggccggguucgccgugaacuucuucaaggaggucgacgagugcagccggccgaaccgcggcgggugcgagcagcggugccugaacacccucggcuccuacaagugcagcugcgaccccggguacgagcuggcccccgacaagcgccggugcgaggccgcgugcggcggcuuccugaccaagcucaacggguccaucacgagccccggcuggccgaaggaguacccgcccaacaagaacugcaucuggcagcugguggcccccacccaguaccgcaucucccugcaguucgacuucuucgagaccgaggggaacgacgugugcaaguacgacuucgucgaggugcggagcggccucaccgccgacuccaagcugcacgggaaguucugcggcagcgagaagcccgaggugaucacgucccaguacaacaacaugcgcgucgaguucaagagcgacaacaccguguccaagaagggcuucaaggcccacuucuucagcgagaagcggcccgcgcugcagccgccccgcgggcggccccaccagcucaaguuccgcgugcagaagcggaaccgcacgccccaguga

SEQ ID NO: 27299 - RNA, 1191 nt, Artificial Sequence
  derived and/or modified sequence opt1 from BMP2__Homo_sapiens__NP_001191
augguggccggcacccgcugccugcucgcccugcugcucccccagguccugcucgggggcgcggccgggcuggugccggagcugggccggcgcaaguucgccgccgccagcuccgggcggcccagcucccagcccagcgacgaggugcuguccgaguucgagcuccgccugcugagcauguucggccucaagcagcggcccaccccgucccgcgacgcggucgugccgcccuacaugcuggaccuguaccggcgccacagcggccagcccgggucccccgcccccgaccaccggcucgagcgcgccgccagccgggcgaacacggugcgcuccuuccaccacgaggagagccuggaggagcugcccgagaccuccggcaagaccacccggcgcuucuucuucaaccucagcuccauccccacggaggaguucaucaccagcgccgagcugcaggucuuccgggagcagaugcaggacgcccuggggaacaacuccagcuuccaccaccgcaucaacaucuacgagaucaucaagccggccaccgccaacuccaaguuccccgugacccggcuccuggacacgcgccuggugaaccagaacgcgagccggugggagagcuucgacgucacccccgccgugaugcgcuggaccgcccagggccacgccaaccacggguucguggucgagguggcccaccucgaggagaagcagggcguguccaagcggcacguccgcaucagccgcucccugcaccaggacgagcacagcuggucccagauccggccccugcucgugaccuucggccacgacgggaagggccacccgcugcacaagcgcgagaagcggcaggcgaagcacaagcagcgcaagcggcucaagagcuccugcaagcgccacccccuguacguggacuucagcgacgucggguggaacgacuggaucguggccccgcccggcuaccacgccuucuacugccacggcgagugccccuucccccuggccgaccaccugaacuccacgaaccacgccaucgugcagacccucgucaacagcgugaacuccaagauccccaaggcgugcugcgugcccaccgagcugagcgccaucuccaugcuguaccucgacgagaacgagaaggucgugcugaagaacuaccaggacauggucguggaggggugcggcugccgguga

SEQ ID NO: 27300 - RNA, 1989 nt, Artificial Sequence
  derived and/or modified sequence opt1 from BMP2K__Homo_sapiens__NP_060063
augaagaaguucagccgcaugcccaaguccgagggcgggagcggcgggggcgccgccgggggcggcgccgggggcgcgggggccggcgccgggugcggcuccggcgggagcuccgugggcguccggguguucgccguggggcgccaccaggucacccuggaggagagccucgcggagggcggcuucuccaccguguuccuggugcggacgcacgggggcauccgcugcgcccugaagcggauguacgucaacaacaugccggaccucaacgugugcaagcgcgagaucaccaucaugaaggagcugagcgggcacaagaacaucgugggcuaccuggacugcgccgucaacuccaucagcgacaacgugugggaggugcucauccugauggaguacugccgggccgggcaggucgugaaccagaugaacaagaagcugcagaccggcuucaccgagcccgaggugcuccagaucuucugcgacacgugcgaggcggucgcccgccugcaccagugcaagacccccaucauccaccgggaccugaagguggagaacauccuccugaacgacggcgggaacuacgugcugugcgacuucggcuccgccaccaacaaguuccucaacccccagaaggacggggucaacgugguggaggaggagaucaagaaguacaccacgcugagcuaccgcgccccggagaugaucaaccuguacggcgggaagcccaucaccaccaaggccgacaucugggcgcucggcugccugcuguacaagcucugcuucuucacccugcccuucggcgagucccaggucgccaucugcgacgggaacuucacgauccccgacaacagccgguacucccgcaacauccacugccugauccgguucaugcucgagccggaccccgagcaccgccccgacaucuuccaggugagcuacuucgccuucaaguucgccaagaaggacugccccguguccaacaucaacaacagcuccaucccgagcgcccugcccgagcccaugaccgcgagcgaggccgccgcccggaagucccagaucaaggcccgcaucaccgacaccaucggccccacggagaccagcaucgcgccgcggcagcgccccaaggccaacuccgccaccaccgccacgcccagcguccugaccauccaguccagcgccacccccgugaagguccucgcgccgggggaguucggcaaccaccggcccaagggggcccugcgccccggcaacggccccgagauccugcucgggcagggcccgccccagcagccgccccagcagcaccgggugcugcagcagcugcagcagggggacuggcgccuccagcagcugcaccuccagcaccgccacccccaccagcagcagcagcagcagcagcagcagcagcagcagcagcagcagcagcagcagcagcagcagcagcagcagcagcagcagcaccaccaccaccaccaccaccaccuccugcaggacgccuacaugcagcaguaccagcacgccacccagcagcagcagaugcugcagcagcaguuccugaugcacuccguguaccagccccagcccagcgcgucccaguacccgacgaugaugccccaguaccagcaggccuucuuccagcagcagaugcuggcccagcaccagcccagccagcagcaggccucccccgaguaccugaccagcccgcaggaguucucccccgcccucgucagcuacaccuccagccugcccgcccaggugggcaccaucauggacuccagcuacuccgcgaaccggagcguggccgacaaggaggccaucgccaacuucacgaaccagaagaacaucagcaacccgcccgacauguccggcuggaaccccuucggggaggacaacuucagcaagcugaccgaggaggagcuccuggaccgcgaguucgaccugcuccgguccagcaagggccaccugaaggcguacuucgccucccaguga

SEQ ID NO: 27301 - RNA, 1320 nt, Artificial Sequence
  derived and/or modified sequence opt1 from BMP3__Homo_sapiens__XP_006714354
auggccggcgccagccgccuccuguuccuguggcuggggugcuucugcgugucccucgcgcagggcgagcggcccaagccgcccuuccccgagcugcgcaaggccguccccggggaccggaccgccggcgggggcccggacagcgagcugcagccccaggacaagguguccgagcacaugcuccgccuguacgaccgguacagcaccgugcaggccgcccgcacgcccggcucccuggagggcgggagccagcccuggcggccgcgccuccugcgggaggggaacaccguccgcuccuuccgggcggccgccgccgagacccuggagcgcaagggccucuacaucuucaaccugaccagccugacgaaguccgagaacauccucagcgcgacccuguacuucugcaucggggagcugggcaacaucucccucagcugccccguguccggcgggugcagccaccacgcccagcggaagcacauccagaucgaccuguccgccuggacccugaaguucagccgcaaccagucccagcuccugggccaccugagcguggacauggccaagucccaccgggacaucaugagcuggcucagcaaggacaucacccagcugcugcgcaaggccaaggagaacgaggaguuccucaucggguucaacaucacguccaagggccggcagcugcccaagcgccggcugcccuucccggagcccuacauccucgucuacgcgaacgacgccgccaucagcgagcccgaguccguggugagcucccugcagggccaccgcaacuuccccaccgggaccgucccgaagugggacagccacauccgggccgcccuguccaucgagcgccgcaagaagcggagcaccggcgugcuccugccccugcagaacaacgagcuccccggggcggaguaccaguacaagaaggacgaggugugggaggagcgcaagcccuacaagacgcugcaggcccaggccccggagaaguccaagaacaagaagaagcagcggaagggcccccaccgcaagagccagacccugcaguucgacgagcagacccucaagaaggcccggcgcaagcaguggaucgagccccggaacugcgcccgccgguaccugaagucccugaagcccagcaaccacgcgaccauccaguccaucguccgcgccguggggguggucccgggcauccccgagcccugcugcgugcccgagaagaugagcucccucagcauccuguucuucgacgagaacaagaacgugguccugaagguguacccgaacaugacgguggaguccugcgccugccgguga

SEQ ID NO: 27302 - RNA, 1227 nt, Artificial Sequence
  derived and/or modified sequence opt1 from BMP4__Homo_sapiens__NP_001193
augauccccggcaaccgcaugcugauggugguccuccugugccaggugcugcucgggggcgccagccacgccucccugaucccggagaccgggaagaagaagguggcggagauccagggccacgccgggggccggcgcagcggccagucccacgagcugcuccgggacuucgaggccacccugcugcagauguucgggcuccgccggcgcccccagcccagcaaguccgccgucauccccgacuacaugcgggaccuguaccgccugcagagcggcgaggaggaggaggagcagauccacuccacggggcucgaguacccggagcggcccgccagccgcgcgaacaccgugcgguccuuccaccacgaggagcaccuggagaacauccccggcaccagcgagaacuccgccuuccgcuuccuguucaaccucagcuccauccccgagaacgaggugaucagcuccgccgagcugcggcuguuccgcgagcaggucgaccaggggccggacugggagcggggcuuccaccgcaucaacaucuacgaggugaugaagccgcccgccgaggugguccccggccaccucaucacccggcugcuggacacgcgccucgugcaccacaacgugacccggugggagaccuucgacgucagccccgcggugcugcgcuggacccgggagaagcagcccaacuacgggcuggccaucgaggugacgcaccuccaccagacccgcacccaccagggccagcacguccgcaucucccggagccugccccagggguccggcaacugggcccagcugcgcccccuccuggugaccuucggccacgacgggcggggccacgcccugacgcgccggcgccgggccaagcgcagcccgaagcaccacagccagcgggcgcgcaagaagaacaagaacugccggcgccacucccucuacguggacuucagcgacgucggguggaacgacuggaucguggccccgcccggcuaccaggccuucuacugccacggggacugccccuucccccuggccgaccaccugaacuccaccaaccacgccaucgugcagacccucgucaacagcgugaacuccagcauccccaaggcgugcugcgugcccaccgagcuguccgccaucagcaugcuguaccucgacgaguacgacaaggucgugcugaagaacuaccaggagauggucguggagggcugcggcugccgguga

SEQ ID NO: 27303 - RNA, 1365 nt, Artificial Sequence
  derived and/or modified sequence opt1 from BMP5__Homo_sapiens__NP_066551
augcaccugaccguguuccuccugaagggcaucgucggguuccuguggagcugcugggugcucgugggcuacgccaagggcgggcugggggacaaccacguccacuccagcuucaucuaccgccggcugcgcaaccacgagcggcgcgagauccagcgggagauccucuccauccugggccugccccaccgcccgcggcccuucagccccggcaagcaggccuccagcgcgccccucuucaugcuggaccuguacaacgccaugaccaacgaggagaacccggaggaguccgaguacagcgugcgcgccucccucgccgaggagacgcgcggggcccggaagggcuaccccgcgagccccaacggguacccccggcgcauccagcugucccggaccaccccgcugaccacgcagagcccgccccucgccucccugcacgacaccaacuuccugaacgacgccgacauggugaugagcuucgucaaccucguggagcgcgacaaggacuucucccaccagcggcgccacuacaaggaguuccgguucgaccugacccagaucccccacggcgaggccgugaccgcggccgaguuccgcaucuacaaggaccggagcaacaaccgcuucgagaacgagacgaucaagaucuccaucuaccagaucaucaaggaguacaccaaccgggacgccgaccuguuccuccuggacacccgcaaggcccaggcccuggacgucggguggcucguguucgacaucaccgugacgagcaaccacugggucaucaacccccagaacaaccugggccugcagcucugcgcggagaccggcgacgggcgcuccaucaacgucaagagcgccggccugguggggcggcagggcccccagagcaagcagcccuucaugguggccuucuucaaggccuccgaggugcugcuccgcagcgugcgggccgcgaacaagcgcaagaaccagaaccggaacaaguccagcucccaccaggacagcucccgcaugagcuccgucggcgacuacaacaccagcgagcagaagcaggccugcaagaagcacgagcuguacguguccuuccgggaccugggguggcaggacuggaucaucgcccccgagggcuacgccgccuucuacugcgacggggagugcagcuucccgcucaacgcgcacaugaacgccaccaaccacgccaucgugcagacgcugguccaccugauguuccccgaccacgugcccaagcccugcugcgccccgaccaagcucaacgccaucuccgugcuguacuucgacgacagcuccaacgucauccugaagaaguaccgcaacauggugguccggagcugcggcugccacuga

SEQ ID NO: 27304 - RNA, 1542 nt, Artificial Sequence
  derived and/or modified sequence opt1 from BMP6__Homo_sapiens__NP_001709
augcccggccuggggcgccgggcccaguggcucugcuggugguggggccugcugugcagcugcugcgggccgccgccccuccggccgccccugcccgccgcggccgccgccgccgcgggcgggcagcugcucggcgacggcgggucccccggccggaccgagcagcccccgcccagcccccaguccagcuccggguuccuguaccgccggcugaagacccaggagaagcgcgagaugcagaaggagauccucagcgugcugggccugccccaccggccccgcccccuccacgggcugcagcagccccagcccccggcccugcggcagcaggaggagcagcagcagcagcagcagcucccccgcggcgagcccccgcccggccggcugaaguccgcgccccuguucaugcucgaccuguacaacgcccugagcgccgacaacgacgaggacggggccuccgagggcgagcgccagcagagcuggccccacgaggccgccuccagcucccagcggcgccagcccccgcccggggccgcgcacccccucaaccgcaagagccugcuggcccccggcuccggcagcgggggcgccuccccgcucacgagcgcccaggacuccgccuuccugaacgacgcggacauggucaugagcuucgugaaccugguggaguacgacaaggaguucagcccccgccagcggcaccacaaggaguucaaguucaaccucucccagauccccgagggggaggucgugaccgccgccgaguuccgcaucuacaaggacugcgugaugggcagcuucaagaaccagaccuuccugaucuccaucuaccagguccugcaggagcaccagcaccgggacagcgaccucuuccugcuggacacccgcguggugugggccuccgaggagggguggcucgaguucgacaucacggccaccagcaaccugugggucgugaccccgcagcacaacaugggccugcagcucuccguggucacccgggacggcgugcacgugcacccccgcgcggccgggcuggucggccgcgacgggcccuacgacaagcagcccuucaugguggccuucuucaaggugagcgagguccacgugcggacgacccgcuccgccagcucccggcgccggcagcagagccgcaaccgguccacccagagccaggacguggcccgcgucuccagcgcguccgacuacaacagcuccgagcugaagaccgccugccggaagcacgagcucuacgugagcuuccaggaccugggcuggcaggacuggaucaucgccccgaagggguacgccgcgaacuacugcgacggcgagugcagcuucccccugaacgcccacaugaacgccacgaaccacgccaucgugcagacccucguccaccugaugaaccccgaguacgugcccaagccgugcugcgcccccaccaagcugaacgcgaucuccguccucuacuucgacgacaacagcaacgugauccugaagaaguaccgcaacauggugguccgggccugcggcugccacuga

SEQ ID NO: 27305 - RNA, 1296 nt, Artificial Sequence
  derived and/or modified sequence opt1 from BMP7__Homo_sapiens__NP_001710
augcacgugcgcagccugcgggccgccgcgccccacuccuucgucgcccucugggccccgcuguuccugcuccgcagcgcccuggccgacuucucccuggacaacgaggugcacagcuccuucauccaccggcgccuccggagccaggagcgccgggagaugcagcgcgagauccuguccauccugggccucccccaccggccccgcccccaccuccaggggaagcacaacagcgcgccgauguucaugcuggaccuguacaacgccauggccguggaggagggcgggggccccgggggccagggcuucuccuaccccuacaaggccgucuucagcacccaggggcccccgcuggcgucccugcaggacagccacuuccucaccgacgccgacauggugauguccuucgugaaccuggucgagcacgacaaggaguucuuccacccccgguaccaccaccgcgaguuccgguucgaccugagcaagauccccgagggcgaggccgugacggccgccgaguuccgcaucuacaaggacuacauccgggagcgcuucgacaacgagaccuuccggaucuccguguaccagguccuccaggagcaccuggggcgcgagagcgaccuguuccuccuggacucccggacccugugggcgagcgaggagggcuggcucguguucgacaucaccgccacguccaaccacuggguggucaacccccgccacaaccuggggcugcagcucagcguggagacccuggacggccagagcaucaacccgaagcuggccggccucaucgggcggcacggcccccagaacaagcagcccuucaugguggccuucuucaaggccaccgagguccacuuccgcuccauccgcagcaccggguccaagcagcggagccagaaccgcuccaagacgcccaagaaccaggaggcgcugcggauggccaacguggccgagaacagcuccagcgaccagcgccaggccugcaagaagcacgagcuguacguguccuuccgggaccucggcuggcaggacuggaucaucgccccggagggcuacgcggccuacuacugcgagggggagugcgccuucccccugaacagcuacaugaacgccaccaaccacgccaucguccagacccuggugcacuucaucaaccccgagaccgugcccaagccgugcugcgcgcccacgcagcucaacgccaucuccguccuguacuucgacgacagcuccaacgugauccugaagaaguaccgcaacauggugguccgggccugcggcugccacuga

SEQ ID NO: 27306 - RNA, 837 nt, Artificial Sequence
  derived and/or modified sequence opt1 from BMP8B__Homo_sapiens__XP_011540326
augaccgcccugcccggcccgcucuggcugcuggggcucgcccugugcgcgcugggcgggggcgggcccggccuccgcccgcccccgggcugcccccagcggcgccugggggcccgggagcgccgggacgugcagcgcgagauccuggccguccucggccugcccgggcggccccgcccgcgggccccgcccgccgcgagccgccugcccgccuccgcgccccucuucaugcuggaccuguaccacgccauggccggcgacgacgacgaggacggggcccccgccgagcggcgccucggccgggccgaccuggugaugagcuucgugaacauggucgagcgcgaccgggcccugggccaccaggagccccacuggaaggaguuccgcuucgaccucacccagauccccgcgggggaggccgugacggccgccgaguuccggaucuacaaggugcccuccauccaccuccugaaccgcacccugcacgucagcauguuccagguggugcaggagcaguccaaccgggagagcgaccuguucuuccuggaccuccagacccugcgcgccggcgacgagggguggcugguccucgacgugaccgcggccuccgacugcuggcugcugaagcggcacaaggaccucggccugcgccuguacguggagacggaggacggcgagaccuggaccggguggggcuggaccaaggacagccgccuccagauguggaagcugcggcugucccgcacgcccuggguccucagccugcacgcccccgggcccgcccaggccccggcggagcggccccugcucugccugcugcagggccacugccccuga

SEQ ID NO: 27307 - RNA, 2058 nt, Artificial Sequence
  derived and/or modified sequence opt1 from BMPER__Homo_sapiens__NP_597725
augcugugguucagcggcgugggggcccucgccgagcgcuacugccggcgcucccccggcaucacgugcugcguccugcugcuccugaacugcagcggggugccgaugucccuggcgagcuccuuccucaccggcagcguggccaagugcgagaacgagggggagguccugcagauccccuucaucaccgacaaccccugcaucaugugcgugugccugaacaaggaggugaccugcaagcgggagaagugccccguccucucccgcgacugcgcccuggccaucaagcagcggggcgccugcugcgagcagugcaagggcugcaccuacgaggggaacaccuacaacagcuccuucaaguggcagagcccggcggagcccugcgugcugcgccagugccaggagggcguggucacggaguccggggugcggugcgugguccacugcaagaacccccucgagcaccugggcaugugcugcccgaccugcccggggugcguguucgagggcgugcaguaccaggagggcgaggaguuccagcccgaggggagcaagugcaccaagugcuccugcaccggcgggcgcacgcagugcguccgggaggugugccccauccugagcugcccccagcaccucucccacaucccgcccggccagugcugccccaagugccugggccagcgcaagguguucgaccugcccuucgggagcugccucuuccgguccgacgucuacgacaacggcagcuccuuccuguacgacaacugcaccgccugcacgugccgcgacagcaccguggugugcaagcggaagugcagccaccccgggggcugcgaccaggggcaggagggcugcugcgaggagugccugcuccgcgucccgcccgaggacaucaaggugugcaaguucggcaacaagaucuuccaggacggggagaugugguccagcaucaacugcaccaucugcgccugcgugaagggccggaccgagugccgcaacaagcagugcauccccaucuccagcugcccccaggggaagauccugaaccggaagggcugcugccccaucugcaccgagaagcccggggucugcaccguguucggcgacccccacuacaacacguucgacggccgcaccuucaacuuccaggggaccugccaguacguccugaccaaggacugcuccagcccggccucccccuuccaggugcucgugaagaacgacgcgcggcgcacgcggagcuucuccuggaccaagagcgucgagcuggugcugggcgagucccgcgugagccuccagcagcaccugaccguccgcuggaacgggucccggaucgcccugcccugccgcgcgccccacuuccacaucgaccucgacggcuaccugcugaaggugaccacgaaggccgggcucgagaucagcugggacggcgacuccuucguggaggucauggccgccccgcaccugaagggcaagcugugcgggcucugcggcaacuacaacgggcacaagcgggacgaccugaucggcggcgacgggaacuucaaguucgacguggacgacuucgccgagagcuggcgcguggaguccaacgaguucugcaaccggccccagcgcaagcccgucccggagcugugccagggcaccgugaaggugaagcuccgggcccaccgcgagugccagaagcucaagagcugggaguuccagaccugccacuccaccgucgacuacgccacguucuaccggagcugcgugaccgacaugugcgagugccccgugcacaagaacugcuacugcgagagcuuccuggccuacacccgcgcgugccagcgggaggggaucaagguccacugggagccccagcagaacugcgccgccacccagugcaagcacggcgccguguacgacacgugcgggcccggcugcaucaagaccugcgacaacuggaacgagaucggcccgugcaacaagcccugcguggccgggugccacugccccgcgaaccugguccugcacaagggccgcugcaucaagcccgugcugugcccgcagcgguga

SEQ ID NO: 27308 - RNA, 1599 nt, Artificial Sequence
  derived and/or modified sequence opt1 from BMPR1A__Homo_sapiens__NP_004320
augccccagcuguacaucuacauccgccuccugggcgccuaccuguucaucaucagccgggugcaggggcagaaccucgacuccaugcugcacggcaccgggaugaaguccgacagcgaccagaagaaguccgagaacggcgucacccuggccccggaggacacgcuccccuuccugaagugcuacugcagcgggcacugccccgacgacgcgaucaacaacacgugcaucaccaacggccacugcuucgccaucaucgaggaggacgaccagggcgagaccacccuggccagcgggugcaugaaguacgagggcuccgacuuccagugcaaggacagccccaaggcccagcuccgccggaccaucgagugcugccgcaccaaccugugcaaccaguaccugcagccgacccucccgcccguggugaucgggcccuucuucgacggcuccauccgguggcugguccugcucaucagcauggccgugugcaucaucgcgaugaucaucuucuccagcugcuucugcuacaagcacuacugcaaguccaucagcucccgccggcgcuacaaccgggaccuggagcaggacgaggccuucauccccgugggggagagccugaaggaccucaucgaccagucccagagcuccggcagcggcagcgggcugccccugcucguccagcgcacgaucgccaagcagauccagauggugcgccaggugggcaaggggcgguacggcgaggucuggaugggcaaguggcgcggggagaagguggccgugaaggucuucuucaccaccgaggaggcguccugguuccgggagaccgagaucuaccagacggugcugaugcggcacgagaacauccugggcuucaucgccgccgacaucaaggggaccggcagcuggacccagcucuaccugaucaccgacuaccacgagaacgggucccuguacgacuuccucaagugcgccacgcuggacacccgcgcccugcucaagcuggcguacagcgccgccugcggccugugccaccuccacaccgagaucuacggcacccaggggaagcccgccaucgcccaccgggaccugaaguccaagaacauccugaucaagaagaacggcagcugcugcaucgcggaccucgggcuggccgugaaguucaacuccgacacgaacgaggucgacgugccccugaacacccgcgugggcaccaagcgguacauggccccggagguccucgacgagagccugaacaagaaccacuuccagcccuacaucauggccgacaucuacuccuucgggcugaucaucugggagauggcccgccggugcaucaccggcggcaucguggaggaguaccagcuccccuacuacaacauggugcccagcgacccguccuacgaggacaugcgcgaggucgugugcgugaagcgccugcggcccaucgucagcaaccgcuggaacuccgacgagugccugcgggcggugcucaagcugaugagcgagugcugggcccacaaccccgccucccgccugacggcccuccggaucaagaagacccuggccaagauggucgagagccaggacgugaagaucuga

SEQ ID NO: 27309 - RNA, 1509 nt, Artificial Sequence
  derived and/or modified sequence opt1 from BMPR1B__Homo_sapiens__NP_001243721
augcugcuccgcagcgccggcaagcugaacguggggaccaagaaggaggacggcgaguccaccgcccccacgccgcggcccaagguccugcgcugcaagugccaccaccacugccccgaggacagcgugaacaacaucugcuccaccgacggguacugcuucaccaugaucgaggaggacgacagcggccuccccguggucaccuccgggugccugggccuggagggcagcgacuuccagugccgggacacgccgaucccccaccagcgccgguccaucgagugcugcaccgagcgcaacgagugcaacaaggaccuccaccccacccugcccccgcugaagaaccgggacuucguggacgggcccauccaccaccgcgcgcuccugaucagcgugaccgucugcucccugcuccuggugcugaucauccucuucugcuacuuccgguacaagcgccaggagacgcggccccgcuacagcaucggccuggagcaggacgagaccuacaucccgcccggggagucccugcgggaccucaucgagcagagccaguccagcggcuccgggagcggccugccccugcucgugcagcgcaccaucgccaagcagauccagauggucaagcagaucggcaaggggcgguacggcgagguguggauggggaaguggcgcggcgagaagguggccgucaagguguucuucaccacggaggaggccuccugguuccgggagaccgagaucuaccagaccgugcugaugcgccacgagaacauccugggcuucaucgccgcggacaucaaggggaccggcagcuggacgcagcucuaccugaucaccgacuaccacgagaacgggucccuguacgacuaccucaagagcaccacccuggacgccaagagcaugcugaagcucgccuacuccagcgucuccggccugugccaccuccacacggagaucuucagcacccaggggaagcccgccaucgcgcaccgggaccugaaguccaagaacauccuggugaagaagaacgggaccugcugcaucgccgaccugggccucgccgugaaguucaucagcgacaccaacgaggucgacaucccgcccaacacgcgcgugggcaccaagcgguacaugccgcccgaggugcuggacgagucccugaaccgcaaccacuuccagagcuacaucauggccgacauguacuccuucggccucauccugugggaggucgcccgccggugcgugagcgggggcaucguggaggaguaccagcugcccuaccacgaccucguccccuccgaccccagcuacgaggacaugcgcgagaucgugugcaucaagaagcugcggcccuccuuccccaaccgcuggagcuccgacgagugccugcggcagauggggaagcucaugaccgagugcugggcgcacaacccggccagccgccugaccgcccugcgggucaagaagacgcucgccaagauguccgagagccaggacaucaagcuguga

SEQ ID NO: 27310 - RNA, 3117 nt, Artificial Sequence
  derived and/or modified sequence opt1 from BMPR2__Homo_sapiens__NP_001195
augaccagcucccugcagcgccccuggcgggugccguggcuccccuggaccauccugcuggucagcacggccgccgcgucccagaaccaggagcgccucugcgccuucaaggaccccuaccagcaggaccugggcaucggggagagccggaucucccacgagaacggcaccauccugugcagcaagggguccacgugcuacggccucugggagaaguccaagggggacaucaaccuggugaagcagggcugcuggagccacaucggcgacccccaggagugccacuacgaggagugcguggucaccaccaccccgcccagcauccagaacgggaccuaccgcuucugcugcugcuccaccgaccugugcaacgugaacuucacggagaacuucccgccgcccgacaccacgccccucagcccgccccacuccuucaaccgggacgagaccaucaucaucgcccuggccagcguguccguccuggccgugcucaucguggcgcugugcuucggcuaccgcaugcugaccggggaccggaagcagggccuccacagcaugaacaugauggaggccgccgccuccgagcccagccuggaccuggacaaccucaagcugcuggagcucaucgggcgcggccgguacggcgcggucuacaaggggucccuggacgagcgccccguggccgugaaggucuucagcuucgccaaccggcagaacuucaucaacgagaagaacaucuaccgcgugccccugauggagcacgacaacaucgcccgguucaucgugggcgacgagcgcgucaccgccgacgggcggauggaguaccuccuggugauggaguacuaccccaacggcagccugugcaaguaccucucccugcacaccagcgacuggguguccagcugccgccuggcgcacuccgucacccggggccucgccuaccugcacacggagcugccccgcggggaccacuacaagcccgccaucagccaccgggaccucaacucccgcaacgugcuggugaagaacgacgggaccugcgucaucagcgacuucgggcuguccaugcggcucaccggcaaccgccuggugcgccccggggaggaggacaacgccgccaucagcgaggugggcaccauccgguacauggcgcccgagguccuggagggcgccgugaaccuccgcgacugcgaguccgcccugaagcaggucgacauguacgcccuggggcucaucuacugggagaucuucaugcggugcacggaccuguucccgggcgagagcgugcccgaguaccagauggccuuccagaccgagguggggaaccaccccaccuucgaggacaugcagguccuggugucccgcgagaagcagcggcccaaguucccggaggcguggaaggagaacagccucgccgugcgcucccugaaggagaccaucgaggacugcugggaccaggacgccgaggcccggcugacggcccagugcgcggaggagcgcauggccgagcucaugaugaucugggagcggaacaagagcgucucccccaccgugaaccccaugagcaccgccaugcagaacgagcgcaaccugucccacaaccggcgcgugcccaagaucggcccguaccccgacuacagcagcuccagcuacaucgaggacuccauccaccacaccgacagcaucgucaagaacaucuccagcgagcacuccaugagcuccacgccccugaccaucggggagaagaaccggaacagcaucaacuacgagcgccagcaggcccaggcgcggaucccgucccccgagaccagcgugaccucccugagcacgaacaccaccaccacgaacaccaccggccucacccccuccaccggcaugacgaccaucagcgagaugcccuacccggacgagaccaaccugcacaccacgaacguggcccaguccaucgggcccacccccgucugccugcagcucaccgaggaggaccuggagaccaacaagcuggaccccaaggagguggacaagaaccucaaggagagcagcgacgagaaccugauggagcacucccugaagcaguucagcggcccggacccccucuccagcacguccagcucccugcuguacccccucaucaagcuggccguggaggccaccgggcagcaggacuucacccagaccgccaacggccaggcgugccugauccccgacguccucccgacgcagaucuacccccugcccaagcagcagaaccugcccaagcgcccgaccagccucccccugaacaccaagaacuccaccaaggagccccggcugaaguucgggagcaagcacaaguccaaccucaagcaggucgagacgggcguggccaagaugaacaccaucaacgccgccgagccccacguggugaccgugaccaugaacggcgucgccgggcgcaaccacagcgugaacucccacgcggccacgacccaguacgccaacggcaccgugcugagcgggcagaccacgaacaucgucacccaccgggcccaggagaugcugcagaaccaguucaucggcgaggacacccgccucaacaucaacuccagcccggacgagcacgagccccugcugcgccgggagcagcaggccggccacgacgagggggugcucgaccgccugguggaccggcgcgagcggccccuggagggcgggcgcaccaacuccaacaacaacaacagcaaccccugcuccgagcaggacguccucgcgcagggcgugccgagcacggccgccgaccccgggcccagcaagccgcggcgcgcccagcggcccaacucccuggaccugagcgcgaccaacgugcucgacggcuccagcauccagaucggcgaguccacccaggacggcaagagcggcuccggggagaagaucaagaagcgcgucaagacccccuacagccugaagcgguggcgccccuccacgugggugaucagcaccgagucccuggacugcgaggugaacaacaacggcagcaaccgggccguccacuccaagagcuccaccgccguguaccucgccgagggcgggaccgccacgaccauggugagcaaggacaucggcaugaacugccuguga

SEQ ID NO: 27311 - RNA, 3849 nt, Artificial Sequence
  derived and/or modified sequence opt1 from BMS1__Homo_sapiens__NP_055568
auggaggccaaggaccagaagaagcaccgcaagaagaacagcggccccaaggccgcgaagaagaagaagcggcugcuccaggaccugcagcugggggacgaggaggacgcccgcaagcggaacccgaaggccuucgccgugcaguccgccguccgcauggcgcggagcuuccaccgcacccaggaccucaagaccaagaagcaccacauccccgugguggaccggacgccccuggagcccccgcccaucgucgugguggucaugggcccgcccaagguggggaaguccacccugauccagugccucauccgcaacuucacccggcagaagcugaccgagauccgcggccccgugacgaucgucagcgggaagaagcggcgccugaccaucaucgagugcggcugcgacaucaacaugaugaucgaccucgccaagguggccgaccuggugcugaugcucaucgacgccuccuucggcuucgagauggagaccuucgaguuccugaacaucugccagguccacggguuccccaagaucaugggcgugcugacccaccucgacagcuucaagcacaacaagcagcugaagaagacgaagaagcggcugaagcaccgcuucuggaccgagguguaccccggggcgaagcuguucuaccucuccggcaugguccacggggaguaccagaaccaggagauccacaaccugggccgguucaucaccgugaugaaguuccgcccccucaccuggcagacgagccacccguacauccuggccgaccggauggaggaccugaccaaccccgaggacauccgcaccaacaucaagugcgaccggaaggugucccucuacggcuaccugcgcggggcccaccugaagaacaagagccagauccacaugcccggcgucggggacuucgccguguccgacaucagcuuccuccccgacccgugcgcccugcccgagcagcagaagaagcggugccugaacgagaaggagaagcucguguacgcgccccuguccggcgucggcggggugcuguacgacaaggacgccguguacgucgaccucggcgggagccacguguuccaggacgaggucggccccacccacgagcuggugcagucccugaucagcacgcacuccaccaucgacgccaagauggccagcucccgcgugacccucuucagcgacagcaagccgcugggguccgaggacaucgacaaccagggccugaugaugcccaaggaggagaagcagauggaccucaacaccggccgcaugcggcgcaaggccaucuucggggacgaggacgagagcggcgacuccgacgacgaggaggacgacgagaugagcgaggacgacgggcuggagaacggcuccagcgacgaggaggcggaggaggaggagaacgccgagaugacggaccaguacauggccgucaaggggaucaagcggcgcaagcuggagcucgaggaggacuccgagauggaccugcccgccuucgccgacagcgacgacgaccuggagcgguccagcgcggaggagggcgaggccgaggaggccgacgaguccagcgaggaggaggacugcaccgccggcgagaaggggaucuccggcagcaaggccgcgggggagggcuccaaggccgggcucagccccgccaacugccaguccgaccgcgugaaccuggagaagucccugcucaugaagaaggccgcgcugccgaccuucgacagcggccacugcaccgccgaggagguguucgccagcgaggacgagagcgaggaguccagcucccugagcgccgaggaggaggacuccgagaacgaggaggccauccggaagaagcugagcaagcccucccaggucagcuccggccagaagcucgggccccagaacuucaucgacgagacgagcgacaucgagaaccugcugaaggaggaggaggacuacaaggaggagaacaacgacuccaaggagaccagcggcgcgcucaaguggaaggaggaccugucccgcaaggccgccgaggccuuccugcggcagcagcaggccgcgcccaaccuccgcaagcugaucuacgggaccgugaccgaggacaacgaggaggaggacgacgacacgcuggaggagcucggcggccuguuccgggugaaccagccggaccgcgagugcaagcacaaggccgacagccuggacugcucccgguuccucgucgaggcgccccacgacugggaccuggaggaggugaugaacagcauccgcgacugcuucgugaccgggaagugggaggacgacaaggacgccgccaagguccuggccgaggacgaggagcucuacggcgacuucgaggaccuggagaccggggacgugcacaagggcaaguccgggcccaacacccagaacgaggacaucgagaaggaggugaaggaggagaucgacccggacgaggaggagagcgccaagaagaagcaccuggacaagaagcggaagcucaaggagauguucgacgccgaguacgacgagggcgagagcacguacuucgacgaccugaagggcgagaugcagaagcaggcccagcugaaccgcgcggaguucgaggaccaggacgacgaggcccggguccaguacgagggguuccgccccggcauguacgugcggaucgagaucgagaacgugcccugcgaguucguccagaacuucgacccccacuacccgaucauccucgggggccuggggaacuccgagggcaacgugggcuacgugcagaugcgccugaagaagcaccgcugguacaagaagauccucaagagccgggaccccaucaucuucuccgucggguggcgccgguuccagaccaucccccuguacuacaucgaggaccacaacggccgccagcggcugcucaaguacacgccccagcacaugcacugcggggccgccuucuggggcccgaucacgccccaggggaccggcuuccuggccauccagagcguguccggcaucaugcccgacuuccgcaucgcggccaccggggugguccuggaccucgacaagagcaucaagaucgugaagaagcugaagcugaccggcuuccccuacaagaucuucaagaacaccuccuucaucaaggggauguucaacagcgcccucgagguggccaaguucgagggcgccgucauccggaccguguccgggauccgcggccagaucaagaaggcgcugcgggccccggagggcgccuuccgcgccagcuucgaggacaagcugcucauguccgacaucguguucaugcggaccugguaccccgucagcauccccgccuucuacaaccccgugaccucccugcugaagccggugggggagaaggacaccuggagcggcaugcgcaccacggggcagcuccggcuggcgcacggcguccgccugaaggccaacaaggacucccucuacaagcccauccugcggcagaagaagcacuucaacagccugcacauccccaaggcccuccagaaggcccugcccuucaagaacaagccgaagacccaggcgaaggccggcaaggugcccaaggaccgccggcgccccgccgugauccgggagccccacgagcgcaagauccuggcccuccuggacgcccuguccaccguccacagccagaagaugaagaaggcgaaggagcagcggcaccuccacaacaaggagcacuuccgcgccaagcagaaggaggaggaggagaagcugaagcgccagaaggaccugcggaagaagcuguuccgcauccaggggcagaaggagcggcgcaaccagaaguccagccucaagggcgccgaggggcagcugcaguga

SEQ ID NO: 27312 - RNA, 2028 nt, Artificial Sequence
  derived and/or modified sequence opt1 from BMX__Homo_sapiens__NP_001712
auggacaccaagagcauccuggaggagcuccugcugaagcgcucccagcagaagaagaagaugagccccaacaacuacaaggagcggcuguucgugcugaccaagacgaaccuguccuacuacgaguacgacaagaugaagcgcggcagccggaagggguccaucgagaucaagaagauccgcugcgucgagaaggugaaccucgaggagcagaccccgguggagcggcaguaccccuuccagaucgucuacaaggacggccugcuguacguguacgccagcaacgaggagucccgcagccaguggcucaaggcccugcagaaggagauccgggggaacccccaccuccucgugaaguaccacuccggcuucuucgucgacgggaaguuccugugcugccagcagagcugcaaggcggcccccggcugcacccugugggaggccuacgccaaccuccacaccgccgugaacgaggagaagcaccgcgugccgacguuccccgaccggguccugaagaucccccgcgcggugcccgugcugaagauggacgccccguccagcuccaccacccucgcccaguacgacaacgagagcaagaagaacuacggcucccagccgcccagcuccagcaccucccuggcccaguacgacagcaacagcaagaagaucuacgggucccagcccaacuucaacaugcaguacaucccccgggaggacuuccccgacugguggcagguccgcaagcucaagagcuccagcuccagcgaggacguggcguccagcaaccagaaggagcggaacgugaaccacacgaccuccaagaucagcugggaguuccccgaguccagcuccagcgaggaggaggagaaccuggacgacuacgacugguucgccggcaacaucucccgcagccaguccgagcagcugcugcggcagaaggggaaggagggcgccuucaugguccgcaacagcucccagguggggauguacaccgugagccucuucagcaaggccgucaacgacaagaagggcaccgugaagcacuaccacgugcacacgaacgccgagaacaagcuguaccuggcggagaacuacugcuucgacuccauccccaagcucauccacuaccaccagcacaacagcgccggcaugaucacccggcugcgccacccggucuccaccaaggccaacaaggugcccgacagcgugucccuggggaacggcaucugggagcucaagcgggaggagaucacccugcugaaggagcucgggagcggccaguucggcgucgugcagcuggggaaguggaagggccaguacgacgucgccgugaagaugaucaaggagggguccaugagcgaggacgaguucuuccaggaggcccagacgaugaugaagcugucccaccccaagcucgugaaguucuacggcgucugcagcaaggaguaccccaucuacaucgugaccgaguacaucuccaacgggugccugcugaacuaccuccgcagccacggcaagggccuggagccgucccagcugcucgagaugugcuacgacgugugcgaggggauggcguuccuggagagccaccaguucauccaccgggaccuggccgcccgcaacugccucgucgaccgcgaccugugcgugaagguguccgacuucggcaugacccgguacguccuggacgaccaguacgugagcuccguggggaccaaguuccccgucaaguggagcgcccccgagguguuccacuacuucaaguacagcuccaagagcgacgugugggccuucggcauccucaugugggaggucuucucccuggggaagcagcccuacgaccuguacgacaacagccagguggugcugaaggucucccagggccaccgccucuaccggccgcaccuggcgagcgacacgaucuaccagaucauguacuccugcuggcacgagcugcccgagaagcgccccaccuuccagcagcuccugagcuccaucgagccccugcgggagaaggacaagcacuga

SEQ ID NO: 27313 - RNA, 2964 nt, Artificial Sequence
  derived and/or modified sequence opt1 from BNC1__Homo_sapiens__NP_001288135
augcgcugccggaacauguucuucagcuucaaggccucccugugcggcugcggggccgcgaccgcccccagccucaccgccaucuccugcacgcugaacugcagcugccaguccuucaagccgggcaagaucaaccaccgccagugcgaccagugcaagcacggguggguggcccacgcccugagcaagcuccggaucccgcccauguaccccaccucccaggucgagaucgugcagagcaacguggucuucgacaucuccagccugaugcuguacggcacccaggcgaucccggugcgccucaagauccugcuggaccggcuguucuccgugcugaagcaggacgagguccugcagauccuccacgcccuggacuggacccugcaggacuacauccgcggguacgugcuccaggacgccagcggcaaggugcuggaccacugguccaucaugacgagcgaggaggaggucgccacccugcagcaguuccuccgguucggcgagaccaaguccaucguggagcugauggcgauccaggagaaggaggagcagagcaucaucaucccgcccuccaccgccaacguggacauccgcgccuucaucgagagcugcucccaccggagcagcucccugcccacgcccgucgacaaggggaaccccagcuccauccaccccuucgagaaccucaucagcaacaugaccuucaugcugcccuuccaguucuucaacccgcugccgcccgcccucaucggcucccugcccgagcaguacaugcuggagcaggggcacgaccagagccaggaccccaagcaggaggugcacggccccuuccccgacuccagcuuccucaccuccagcuccacccccuuccagguggagaaggaccagugccugaacugcccggacgccaucacgaagaaggaggacagcacccaccuguccgacagcuccagcuacaacaucgucaccaaguucgagcgcacccagcucucccccgaggcgaaggugaagcccgagcggaacagccuggggacgaagaagggccgcguguucugcaccgccugcgagaagaccuucuacgacaagggcacccugaagauccacuacaacgccguccaccucaagaucaagcacaagugcacgaucgaggggugcaacaugguguucuccagccugcggagccgcaaccggcacuccgccaaccccaacccgcgccugcacaugcccaugaaccggaacaaccgcgacaaggaccuccggaacagccugaaccuggccuccagcgagaacuacaagugccccggcuucaccgugaccucccccgacugccgcccgccgcccagcuaccccggguccggcgaggacagcaagggccagcccgcguuccccaacaucgggcagaacggcguccucuuccccaaccugaagaccgugcagccggugcugcccuucuaccggucccccgccacgcccgccgaggucgccaacaccccggggauccuccccagccugccccugcucuccagcuccauccccgagcagcugaucagcaacgagaugccguucgacgcccugcccaagaagaagucccgcaagagcuccaugcccaucaagaucgagaaggaggcgguggagaucgccaacgagaagcgccacaaccucagcagcgacgaggacaugccccugcaggucguguccgaggacgagcaggaggccugcagcccgcagucccaccgggugagcgaggagcagcacguccaguccggcgggcugggcaagcccuuccccgagggcgagcgccccugccaccgggagagcgugaucgaguccagcggggccaucucccagaccccggagcaggccacccacaacagcgagcgcgagacggagcagacccccgcgcugaucauggugccccgggaggucgaggacggcgggcacgagcacuacuucacccccggcauggagccccaggugcccuucuccgacuacauggagcuccagcagcgccugcuggccgggggccucuucagcgcccuguccaaccggggcauggccuuccccugccuggaggacagcaaggagcucgagcacguggggcagcacgcgcuggcccgccagaucgaggagaaccgguuccagugcgacaucugcaagaagaccuucaagaacgccugcuccgucaagauccaccacaagaacaugcacgugaaggagaugcacacgugcaccguggagggcugcaacgccaccuucccgagccgccggucccgcgaccggcacagcuccaaccugaaccuccaccagaaggcccugagccaggaggcgcuggagagcuccgaggaccacuuccgcgccgccuaccuccugaaggacgucgccaaggaggccuaccaggacguggcguucacccagcaggccagccagacguccgugaucuucaaggggaccagccggaugggcucccuggucuaccccaucacccaggugcacagcgccucccucgagagcuacaacuccgggccccugagcgagggcaccauccuggaccucuccaccacgagcuccaugaaguccgagagcagcucccacagcuccugggacagcgacggcgugagcgaggaggggaccguccugauggaggacuccgacggcaacugcgaggggagcucccuggugcccggcgaggacgaguacccgaucugcgugcucauggagaaggccgaccagagccuggccucccugcccagcggccuccccaucacgugccaccugugccagaagaccuacuccaacaaggggaccuuccgcgcgcacuacaagaccguccaccuccggcagcuccacaagugcaaggugcccggcugcaacaccauguucagcuccgugcgcagccggaaccgccacucccagaacccgaaccugcacaagagccuggccuccagccccucccaccuccaguga

SEQ ID NO: 27314 - RNA, 3300 nt, Artificial Sequence
  derived and/or modified sequence opt1 from BNC2__Homo_sapiens__NP_060107
auggcccaccugggccccaccccgccgccccacagccugaacuacaaguccgaggaccgccugagcgagcaggacuggcccgccuacuucaaggugcccugcugcggggucgacaccucccagaucgagagcgaggaggcggagguggacgugcgggagcgcgagacgcagcgggaccgcgagcccaagcgggcccgcgaccugacccuccgggacuccugcaccgacaacagcaugcaguucggcacccgcacgaccaccgccgagcccggguucaugggcaccuggcagaacgccgacacgaaccugcuguuccggaugucccagcaggccauccgcugcacccucgucaacugcacgugcgagugcuuccagcccgggaagaucaaccugcggaccugcgaccagugcaagcacggcuggguggcgcacgcccuggacaagcucagcacccagcaccuguaccacccgacccagguggagaucguccaguccaacgugguguucgacaucagcucccugaugcucuacggcacccaggccguccccgugcgccugaagauccugcucgaccggcuguucagcgugcugaagcaggaggagguccuccacauccugcacgggcugggcuggacccuccgcgacuacgugcggggguacauccugcaggacgccgcgggcaaggugcuggaccgcugggccaucaugucccgggaggaggagaucaucacgcuccagcaguuccugcgcuucggggagaccaagagcaucgucgagcugauggccauccaggagaaggagggccaggccguggccgugcccuccagcaagaccgacuccgacauccggaccuucaucgagagcaacaaccgcacgcggucccccagccuccuggcgcaccuggagaacagcaacccguccagcauccaccacuucgagaacauccccaacucccucgccuuccugcugcccuuccaguacaucaaccccgucagcgccccgcuccugggccugccgcccaacgggcuccugcuggagcagcccggccuccgccugcgcgagcccucccugagcacccagaacgaguacaacgaguccagcgaguccgaggugagccccacccccuacaagaacgaccagacccccaaccggaacgcccucacguccaucaccaacguggagccgaagaccgagcccgccugcgucagccccauccagaacuccgcgcccgugagcgaccugaccaagacggagcacccgaaguccagcuuccgcauccaccggaugcgccggaugggguccgccagccgcaagggccggguguucugcaacgccugcggcaagaccuucuacgacaaggggacccugaagauccacuacaacgccguccaccucaagaucaagcaccgcugcaccaucgagggcugcaacaugguguucuccagccugcggagccgcaaccggcacuccgccaaccccaacccccgccugcacaugccgaugcuccggaacaaccgcgacaaggaccugauccgggcgacgagcggggccgccacccccgucaucgccuccaccaagagcaaccuggcccugaccucccccggccggcccccgaugggguucacgaccccgccccucgaccccgugcugcagaacccccugcccagccagcucguguucuccggccugaagaccguccagcccgugcccccguucuaccgcagccugcucacccccggcgagaugguguccccgcccaccagccugcccacgucccccaucauccccaccagcgggaccaucgagcagcacccgcccccgcccuccgagcccgucgugcccgcggugaugauggccacccacgagcccagcgccgaccuggcccccaagaagaagccgcgcaaguccagcaugcccgucaagaucgagaaggagaucaucgacacggcggacgaguucgacgacgaggacgacgaccccaacgacggcggggccguggugaacgacaugucccacgacaaccacugccacagccaggaggagaugagccccggcauguccgucaaggacuucagcaagcacaaccggacccgcugcaucucccgcaccgagauccggcgcgccgacagcaugaccuccgaggaccaggagccggagcgggacuacgagaacgagagcgaguccagcgagcccaagcucggggaggaguccauggagggcgacgagcacauccacagcgagguguccgagaaggugcugaugaacagcgagcgccccgacgagaaccacuccgagcccagccaccaggacgucaucaaggugaaggaggaguucacggacccgaccuacgacauguucuacaugucccaguacggccuguacaacgggggcggggccagcauggccgcgcuccacgaguccuucaccagcucccugaacuacggcagcccccagaaguucagccccgagggggaccugugcuccagccccgacccgaagaucugcuacgugugcaagaaguccuucaagagcuccuacagcgucaagcuccacuaccggaacgugcaccugaaggagaugcacgugugcaccgucgccggcugcaacgccgccuuccccucccgccggagccgcgaccggcacuccgccaacaucaaccugcaccgcaagcuccugacgaaggagcuggacgacaugggccucgacagcucccagcccagccuguccaaggaccugcgggacgaguuccucgugaagaucuacggggcgcagcaccccaugggccuggacgugcgcgaggacgccagcuccccggccgggaccgaggacagccaccugaacggcuacggccgggggauggccgaggacuacaugguccucgaccuguccaccaccagcucccugcagagcagcuccagcauccacuccagccgcgaguccgacgccggcagcgacgaggggauccuccuggacgacaucgacggcgcguccgacagcggggaguccgcccacaaggccgaggcccccgcgcugcccggcagccucggcgccgagguguccgggagccugauguucuccagccuguccggcagcaacgggggcaucaugugcaacaucugccacaagauguacuccaacaaggggacgcuccgggugcacuacaagaccguccaccuccgcgagaugcacaagugcaaggugcccggcugcaacaugauguucagcuccgugcggagccgcaaccggcacagccagaacccgaaccugcacaagaacauccccuucaccuccgucgacuga

SEQ ID NO: 27315 - RNA, 687 nt, Artificial Sequence
  derived and/or modified sequence opt1 from BNIP1__Homo_sapiens__NP_001196
auggccgcgccccaggacgugcacguccgcaucugcaaccaggagaucgugaaguucgaccuggaggugaaggcccucauccaggacauccgggacugcagcggcccgcuguccgcccugaccgagcucaacaccaaggucaaggagaaguuccagcagcugcgccaccggauccaggaccuggagcagcucgccaaggagcaggacaaggagagcgagaagcagcugcugcuccaggagguggagaaccacaagaagcagaugcuguccaaccaggccagcuggcgcaaggccaaccugacgugcaagaucgcgaucgacaaccucgagaaggccgagcugcugcagggcggggaccuccugcggcagcgcaagaccaccaaggagucccuggcccagaccagcuccacgaucaccgagagccucauggggaucucccggaugauggcccagcagguccagcagagcgaggaggcgaugcagucccuggugaccagcucccgcaccauccuggacgccaacgaggaguucaagagcauguccggcacgauccagcucgggcggaagcugaucaccaaguacaaccgccgggagcugaccgacaagcuccugaucuuccuggcccucgcccuguuccuggccaccgugcucuacaucgugaagaagcgccuguuccccuuccuguga

SEQ ID NO: 27316 - RNA, 1308 nt, Artificial Sequence
  derived and/or modified sequence opt1 from BNIP2__Homo_sapiens__NP_004321
augcugugcggcuuccaggaggacgccacgcccccgcccccgccccgcccccggcgccuccaccggcgccugccccggcccgaggagguggggaugcugagccugcccccgggccuccugaccgucuccgggagcgccgcggccgccgacgccgugccccuccgccccggcgacugggccgggguguccaccgcggaccggggcgagcgcgcgccccugggcccggccuucugcgaccuggccgucagccccaccucccccgccuggcgcggggaggaggacgagggcgccaaggccagcuccggggacaucggcagccucgacuaccaggaguucgugguggacaucgagucccggcugcggauggagggggucgagcugaaggaggaguggcaggacgaggacuuccccaucccgcuccccgaggacgacagcaucgaggccgacauccuggccaucaccggccccgaggaccagcccggcucccuggaggugaacgggaacaaggugcgcaagaagcucauggcgccggacaucagccugacccuggaccccuccgacggcagcguccucuccgacgaccuggacgagagcggggagaucgaccuggacggccucgacacgcccuccgagaacagcaacgaguucgagugggaggacgaccugcccaagccgaagaccaccgaggugauccggaagggcuccaucaccgaguacacggccgccgaggagaaggaggacgggcgccgguggcgcauguuccggaucggcgagcaggaccaccgcguggacaugaaggccaucgagcccuacaagaaggucaucagccacgggggcuacuacggggacggccugaacgccaucgugguguucgcggucugcuucaugcccgagagcucccagcccaacuaccgguaccucauggacaaccuguucaaguacgugaucggcacccuggagcuccugguggccgagaacuacaugaucgucuaccugaacggggccaccacccgccggaagaugccgagccucggcuggcugcgcaagugcuaccagcagaucgaccgccggcugcgcaagaaccucaagucccugaucaucgugcaccccagcugguucauccggacgcugcucgccgugacccgccccuucaucuccagcaaguucucccagaagauccgguacgucuucaaccuggccgagcuggcggagcucgugccgauggaguacguggggauccccgagugcaucaagcaggucgaccaggagcugaacggcaagcaggacgagcccaagaacgagcaguga

SEQ ID NO: 27317 - RNA, 780 nt, Artificial Sequence
  derived and/or modified sequence opt1 from BNIP3__Homo_sapiens__NP_004043
augggcgacgccgccgcggacccgcccgggcccgcccugcccugcgaguuccuccgccccggcugcggggccccgcugagccccggcgcccagcuggggcggggcgcccccaccuccgcguucccgccgcccgccgccgaggcccaccccgcggcccgccggggccuccgcagcccccagcugcccuccggggccaugagccagaacggcgcccccgggaugcaggaggagucccugcagggcagcuggguggagcuccacuucuccaacaacgggaacggcggcagcguccccgccuccgugagcaucuacaacggggacauggagaagauccugcuggacgcgcagcacgaguccggccggagcuccagcaaguccagccacugcgacagcccgccccgcucccagacgccccaggacaccaaccgggccuccgagaccgacacccacagcaucggggagaagaacagcucccagagcgaggaggacgacaucgagcgccggaaggagguggaguccauccucaagaagaacagcgacuggaucugggacugguccagccgccccgagaacaucccgcccaaggaguuccuguucaagcaccccaagcggaccgccacgcuguccaugcgcaacaccagcgucaugaagaagggcggcaucuucuccgccgaguuccucaagguguuccugcccagccugcuccugucccaccuccuggccaucgggcugggcaucuacaucgggcggcgccugaccaccagcacguccaccuucuga

SEQ ID NO: 27318 - RNA, 660 nt, Artificial Sequence
  derived and/or modified sequence opt1 from BNIP3L__Homo_sapiens__NP_004322
augagcucccaccugguggagcccccgccgccccuccacaacaacaacaacaacugcgaggagaacgagcagagccugcccccgcccgccggccugaacuccagcugggucgagcuccccaugaacuccagcaacgggaacgacaacggcaacgggaagaacggcgggcuggagcacgugcccuccagcuccagcauccacaacggcgacauggagaagauccugcucgacgcccagcacgaguccggccagagcuccagccgcggguccagccacugcgacucccccagcccccaggaggacggccagaucauguucgacguggagaugcacaccucccgggaccacagcagccaguccgaggaggaggucguggagggggagaaggagguggaggcgcugaagaaguccgccgacugggucagcgacuggagcucccgccccgagaacaucccgcccaaggaguuccacuuccggcaccccaagcgcagcgugucccugagcaugcggaaguccggcgccaugaagaagggcgggaucuucagcgccgaguuccucaagguguucauccccucccuguuccugagccacguccucgcccugggccuggggaucuacaucggcaagcgccucuccacccccagcgcguccacguacuga

SEQ ID NO: 27319 - RNA, 1032 nt, Artificial Sequence
  derived and/or modified sequence opt1 from BNIPL__Homo_sapiens__XP_011507538
augggcaccauccaggaggccgggaagaagaccgacgugggcguccgcgagaucgccgaggcgcccgagcugggggccgcccuccggcacggcgagcuggagcugaaggaggaguggcaggacgaggaguucccccgccuccugcccgaggaggccgggacgagcgaggaccccgaggaccccaagggcgacucccaggccgcggccggcaccccgagcacccuggcccucugcgggcagcggcccaugcgcaagcggcuguccgcccccgagcugcgccucagccugaccaagggccccgggaacgacggcgcguccccgacgcagagcgcccccuccagccccgacggguccagcgaccuggagaucgacgagcucgagacccccuccgacagcgagcagcuggacuccggccacgaguucgagugggaggacgagcugccgcgggccgagggccucgggaccagcgagaccgccgagcgccugggccgggggugcaugugggacgugacgggcgaggacggccaccacuggcgcguguuccggauggggccccgcgagcagcgggucgacaugaccgugaucgagcccuacaagaaggugcugucccacggcggguaccacggcgacgggcucaacgccgucauccuguucgcgagcugcuaccugccccgcuccagcaucccgaacuacaccuacgugauggagcaccucuuccgguacauggugggcacccuggagcugcucgucgccgagaacuaccugcuggugcaccucuccggcgggacgagccgcgcccaggugccgccccugagcuggauccggcagugcuaccgcacccuggaccggcgccuccggaagaaccugcgcgcccuggucguggugcacgcgaccugcuccaaguucacccgcaagauccgguuccucgacagccugggcgagcuggcccagcucaucucccuggaccagguccacauccccgaggccgugcgccagcuggaccgggaccuccacgggagcggcgggacguga

SEQ ID NO: 27320 - RNA, 3348 nt, Artificial Sequence
  derived and/or modified sequence opt1 from BOC__Homo_sapiens__NP_001288790
augcugcgcggcaccaugaccgccuggcgggggaugcgccccgaggugacgcucgccugccugcugcucgcgaccgccggcugcuucgccgaccugaacgaggucccccaggugaccgugcagcccgccagcaccguccagaagcccgggggcacggugauccuggggugcguggucgagcccccgcggaugaacgugaccuggcgccucaacggcaaggagcugaacggcuccgacgacgcccugggggugcucaucacccacggcacccuggucaucacggcgcugaacaaccacaccguggggcgguaccagugcguggcccgcaugcccgccggcgccgucgcgagcgugcccgccaccgugacccucgccaaccugcaggacuucaagcuggacguccagcacgugaucgagguggacgaggggaacacggccgucaucgccugccaccuccccgagucccacccgaaggcccaggugcgguacagcgugaagcaggaguggcuggaggccucccgcggcaacuaccugaucaugcccagcggcaaccuccagaucgucaacgccucccaggaggacgaggggauguacaagugcgccgccuacaaccccgugacccaggaggugaagaccagcggcuccagcgaccggcugcgcguccggcgcuccaccgcggaggccgcccggaucaucuacccgcccgaggcccagacgaucaucgugaccaaggggcagagccugauccucgagugcgucgccuccggcaucccgccgccccgcgugaccugggcgaaggacggcagcuccgugaccggguacaacaagacgcgguuccugcugagcaaccuccugaucgacaccaccuccgaggaggacagcggcaccuaccgcugcauggccgacaacggggucggccagcccggggccgccgugauccuguacaacgugcaggucuucgagccgcccgaggugacgauggagcucucccagcuggugauccccuggggccagagcgccaagcugaccugcgagguccggggcaacccgccgcccagcgugcucuggcugcgcaacgcggugccccugaucuccagccagcggcuccgccugucccggcgcgcgcugcgcguccucagcauggggcccgaggacgagggcguguaccagugcauggccgagaacgaggugggguccgcccacgcggucgugcagcugcggaccagccgccccuccaucacgccccggcuguggcaggacgccgagcucgccaccggcacgccgcccgugagccccuccaagcuggggaaccccgagcagaugcugcgcggccagcccgcccucccccggccgcccaccagcgucggccccgccagcccccagugccccggggagaagggccagggggcgcccgccgaggccccgaucauccuguccagcccccgcaccuccaagaccgacuccuacgagcugguguggcggccccgccacgagggcagcgggcgggcccccauccucuacuacguggucaagcaccgcaagcaggucaccaacuccagcgacgacuggaccaucuccggcaucccggccaaccagcaccggcugacccugacgcgccucgaccccggcagccuguacgagguggagauggcggccuacaacugcgccggggagggccagaccgccauggugaccuuccggaccgggcgccggcccaagcccgagaucauggccagcaaggagcagcagauccagcgcgacgacccgggcgcgagcccccaguccuccagccagcccgaccacggccggcugagcccgcccgaggcccccgaccgccccaccaucuccacggccuccgagaccagcguguacgugaccuggaucccccgggggaacggcggguucccgauccaguccuuccgcgucgaguacaagaagcugaagaaggugggcgacuggauccucgccaccagcgcgaucccgcccucccgccugagcguggagaucacggggcuggagaagggcaccuccuacaaguuccggguccgcgcccucaacaugcugggcgagagcgagcccuccgcccccagccggcccuacgugguguccggguacagcggccgcgucuacgagcggcccguggccgggccguacaucaccuucaccgacgccgugaacgagacgaccaucaugcugaaguggauguacauccccgcgagcaacaacaacacccccauccacggcuucuacaucuacuaccgccccaccgacuccgacaacgacagcgacuacaagaaggacauggucgagggggacaaguacuggcacuccaucagccaccuccagccggagacguccuacgacaucaagaugcagugcuucaacgagggcggcgagagcgaguucuccaacgugaugaucugcgagaccaaggcccgcaagagcuccgggcagcccggccggcugccgccgcccacccuggccccgccccagccgccccuccccgagaccaucgagcggcccguggggacgggcgccauggucgcccgcagcuccgaccugcccuaccugaucgugggggugguccucggcagcaucgugcugaucaucgugaccuucauccccuucugccuguggcgggcgugguccaagcagaagcacaccaccgaccucggcuucccccgcagcgcccugccgcccuccugccccuacacgauggucccccucgggggccugcccgggcaccaggccagcggccagcccuaccuguccgggaucagcggccgggccugcgccaacggcauccacaugaaccgcgggugccccuccgcggccgugggcuaccccgggaugaagccccagcagcacugcccgggcgagcugcagcagcagagcgacaccagcucccuccugcggcagacccaccugggcaacggguacgacccccagagccaccagaucacccgcggccccaaguccagccccgacgagggguccuuccucuacacgcugccggacgacagcacccaccagcugcuccagccccaccacgacugcugccagcggcaggagcagcccgccgccgugggccaguccgggguccgccgggcgcccgacagcccggugcuggaggccgugugggacccgcccuuccacuccgggccgcccugcugccugggccucguccccguggaggaggucgacagccccgacuccugccaggugagcggcggcgacuggugcccccagcaccccgugggggccuacgucggccaggagcccgggaugcagcugucccccggcccccuggugcgcgugagcuucgagaccccgccccucaccaucuga

SEQ ID NO: 27321 - RNA, 519 nt, Artificial Sequence
  derived and/or modified sequence opt1 from BOD1L2__Homo_sapiens__NP_001244893
auggccgacggcgggggcgggggcagcgggggcgccggccccgcguccacccgcgccagcgggggcgggggcccgaucaaccccgccucccugccgcccggggacccccagcucaucgccaucaucgugggccagcucaagagccggggccuguucgacuccuuccgccgggacugcaaggccgacgucgacaccaagcccgcguaccagaaccucagccagaaggccgacaacuucguguccacgcaccuggacaagcaggaguggaacccgcccgccaacgacaaccagcugcacgacgggcuccgccagagcgugguccaguccggccggagcgaggccgggguggaccgcaucuccagccagguggucgaccccaagcugaaccacaucuuccggccccagaucgagcagaucauccacgaguuccugguggcgcagaaggaggccgccgugcccgcccugcccccggagcccgagggccaggacccgcccgcccccucccaggacaccagcuga

SEQ ID NO: 27322 - RNA, 639 nt, Artificial Sequence
  derived and/or modified sequence opt1 from BOK__Homo_sapiens__NP_115904
auggaggugcugcgccggagcuccgucuucgccgccgagaucauggacgcguucgaccgcagccccaccgacaaggagcucguggcccaggccaaggcccugggccgggaguacgugcacgcccgccugcuccgggcggggcuguccuggagcgccccggagcgcgccgcccccguccccggccggcuggcggaggugugcgccgugcuccugcgccugggggacgagcucgagaugauccggcccuccgucuaccgcaacguggcccggcagcugcacaucagccugcaguccgagccgguggucaccgacgccuuccucgccguggcgggccacaucuucagcgccgggaucacguggggcaagguggucucccuguacgccguggccgccggccuggcgguggacugcguccgccaggcccagcccgccauggugcacgcccucguggacugccugggggaguucguccggaagacccuggccaccuggcuccgccggcgcggcggguggaccgacgugcugaagugcguggucagcacggaccccggccugcggucccacuggcucguggcggcccugugcagcuucgggcgcuuccugaaggccgccuucuucgugcuccugcccgagcgguga

SEQ ID NO: 27323 - RNA, 306 nt, Artificial Sequence
  derived and/or modified sequence opt1 from BOLA3__Homo_sapiens__NP_001030582
auggccgccuggagccccgcggccgccgccccgcugcuccgcggcauccgggggcugccccugcaccaccgcauguucgccacccagaccgagggcgagcuccgggugacgcagauccugaaggagaaguucccccgcgcgaccgccaucaaggucaccgacaucuccgggaccaagcggcgcaaccagcgggacgccuggaucgccgacaucuaccugugcccccagacgcucaccaccccguggcugcaccgcugcugcugccugcggcccuggaugaacuucaccgacaucauccuccccuga

SEQ ID NO: 27324 - RNA, 525 nt, Artificial Sequence
  derived and/or modified sequence opt1 from BOLL__Homo_sapiens__NP_001271287
augaccgagcuggaguaccccaagggcagcuccaucaugccggccgccgggaccauguaccucacgaccagcaccggcuaccccuacaccuaccacaacgggguggcguacuuccacacgcccgaggucaccuccgugcccccgcccuggcccagccgcuccgugugcagcucccccgucaugguggcccagccgaucuaccagcagcccgccuaccacuaccaggccaccacccaguaccugcccggccaguggcaguggagcgugccccagccguccgccagcuccgcgcccuuccuguaccuccagcccagcgaggucaucuaccagcccguggagaucgcccaggacgggggcugcgugccgccgccccugucccugauggagacgagcguccccgagcccuacuccgaccacggcgugcaggccaccuaccaccagguguacgcccccagcgcgaucaccaugcccgcccccgucaugcagccggagcccaucaagaccgugugguccauccacuacuga

SEQ ID NO: 27325 - RNA, 2241 nt, Artificial Sequence
  derived and/or modified sequence opt1 from BOP1__Homo_sapiens__NP_056016
auggccggcagccgcggggccggccggaccgcggcccccuccgugcgcccggagaagcggcgcagcgagcccgagcuggagcccgagcccgagccggagccgccccuccugugcaccagcccccugucccacuccacggggagcgacuccggcgucagcgacuccgaggagagcguguucuccgggcucgaggacagcggcuccgacagcuccgaggacgacgacgagggcgacgaggagggggaggacggcgcccuggacgacgaggggcacagcggcaucaagaagaccaccgaggagcagguccaggccuccacccccugcccccggacggagauggccagcgcgcgcaucggggacgaguacgccgaggacuccagcgacgaggaggacauccggaacaccgugggcaacgugccccuggagugguacgacgacuucccccacgugggcuacgaccucgacgggcgccggaucuacaagccgcugcgcacccgggacgagcuggaccaguuccucgacaagauggacgaccccgacuacuggcgcaccguccaggaccccaugacgggccgggaccugcgccugaccgacgagcaggucgcccucgugcggcgccugcagagcgggcaguucggcgacgugggcuucaaccccuacgagccggccguggacuucuucuccggggacgugaugauccaccccgucaccaaccggcccgcggacaagcgcagcuucauccccucccugguggagaaggagaaggugagccggaugguccacgccaucaagaugggcuggauccagccgcgccggccccgcgaccccacccccuccuucuacgaccucugggcccaggaggacccgaacgccgugcuggggcgccacaagaugcacgugcccgcccccaagcuggcgcuccccggccacgccgagagcuacaacccgccgcccgaguaccugcuguccgaggaggagcggcucgccugggagcagcaggagcccggggagcgcaagcugagcuuccugccccggaaguuccccucccuccgcgccguccccgccuacggccgguucauccaggagcgcuucgagcggugccuggaccuguaccucugcccgcgccagcggaagaugcgcgugaacguggaccccgaggaccugauccccaagcugccccggccgcgcgaccuccagcccuuccccacgugccaggcgcuggucuaccggggccacagcgaccuggugcgcugccucuccgugagccccgggggccaguggcuggucuccgggagcgacgacggcucccugcggcucugggagguggccaccgcccgcugcguccggaccgugccggucgggggcguggucaagagcguggccuggaaccccucccccgccgugugccugguggcggccgccguggaggacagcguccugcuccugaaccccgcccugggcgaccgccucguggccggguccaccgaccagcugcugagcgcguucgugccgcccgaggagccgccccuccagcccgcccgguggcuggaggccagcgaggaggagcgccaggucggccugcgccuccggaucugccacgggaagcccgugacccaggugacguggcacggccgcggggacuaccuggccgucgugcuggcgacccagggccacacccaggugcugauccaccagcucucccggcgccggagccagucccccuuccgccggagccacggccagguccagcgcguggccuuccaccccgcccggccguuccugcugguggccucccagcgcagcguccggcucuaccaccuccugcgccaggagcugacgaagaagcugaugcccaacugcaaguggguguccagccuggccgugcaccccgcgggggacaacgucaucugcggcuccuacgacagcaagcucgugugguucgaccuggaccuguccaccaagccguaccggaugcuccgccaccacaagaaggcccugcgggccguggccuuccacccccgcuacccccuguucgccagcggguccgacgacggcagcgucaucgugugccacggcaugguguacaacgaccuccugcagaacccccugcucgucccggugaaggugcugaaggggcacguccugacccgggaccucggcgugcuggacgugaucuuccaccccacccagcccugggucuucuccagcggggcggacggcacggugcgccuguucaccuga

SEQ ID NO: 27326 - RNA, 1905 nt, Artificial Sequence
  derived and/or modified sequence opt1 from BORA__Homo_sapiens__NP_001273675
auggagcgcuuccuguuccccgccccggaccuccccgcccggagcccccuggugaacggcuccagccagggggucggcguggaggagcgcgggacccggaaguccggccacguggggcugggcgcgacgcccccgagccacuccauccagggcagccgccuccaccugaaccugcccgaggucgacuccuucccgccccaccccgccaaguucagccucugcgccaugggggacgugaaggaguccaagaugcagaucacccccgagacccccggccggauccccgugcugaacccguucgagagccccuccgacuacagcaaccugcacgagcagacccucgccucccccagcgucuucaaguccaccaagcugcccacgccggggaaguuccgcuggagcaucgaccagcuggccgugaucaaccccguggagaucgaccccgaggacauccaccggcaggcgcucuaccugucccacagccgcaucgacaaggacgucgaggacaagcggcagaaggccaucgaggaguucuucaccaaggacgugaucgugcccuccccguggaccgaccacgagggcaagcagcugagccagugccacagcuccaagugcaccaacaucaacagcgacucccccgucgggaagaagcucacgauccacagcgagaaguccgacgccgccugccagacccugcugagccuccccguggacuucaaccuggagaacauccugggcgacuacuuccgcgcggacgaguucgccgaccagucccccggcaaccucagcuccagcucccugcggcgcaagcuguuccucgacgggaacggcagcaucuccgacagccugccguccgccagccccgggagcccccacuccggcgugcagaccucccuggagauguucuacagcaucgaccucagccccgucaagugccgguccccgcugcagacccccagcuccggccaguucagcuccagccccauccaggccuccgccaagaaguacagccugggguccaucacgagcccgucccccaucagcucccccaccuucagccccaucgaguuccagaucggcgagaccccgcucuccgagcagcgcaaguucaccgugcacagccccgacgcguccagcgggacgaacagcaacggcaucaccaaccccugcauccggucccccuacaucgacgggugcagcccgaucaagaacuggucccccaugcgccugcagauguacagcggcggcacccaguaccggaccuccgugauccagauccccuucacgcuggagacccagggggaggacgaggaggacaaggagaacauccccagcaccgacgucuccagcccggccauggacgccgccggcauccaccuccgccaguucuccaacgaggccagcacccacgggacgcaccugguggugaccgcgauguccgucacccagaaccagagcuccgccagcgagaaggagcuggcccuccugcaggacguggagcgggagaaggacaacaacaccguggacauggucgaccccaucgagaucgccgacgagacgaccuggaucaaggagcccguggacaacggcucccugcccaugaccgacuucgucagcgggaucgccuucuccaucgagaacagccacaugugcauguccccgcucgcggagagcagcgugauccccugcgaguccagcaacauccagauggacuccggcuacaacacccagaacugcggcagcaacaucauggacacggugggggccgaguccuacugcaaggagagcgacgcccagaccugcgaggucgaguccaagagccaggccuucaacaugaagcaggaccacaccacccagcgcugcuggaugaagacggccucccccuuccagugcagcucccccuga

SEQ ID NO: 27327 - RNA, 780 nt, Artificial Sequence
  derived and/or modified sequence opt1 from BPGM__Homo_sapiens__NP_001280014
augagcaaguacaagcugaucaugcuccgccacggcgagggggccuggaacaaggagaaccgguucugcuccuggguggaccagaagcugaacagcgagggcauggaggaggcccgcaacugcgggaagcagcugaaggcgcucaacuucgaguucgaccuggucuucaccuccgugcugaaccggagcauccacaccgccuggcucauccuggaggagcugggccaggagugggugcccgucgaguccagcuggcgccucaacgagcggcacuacggggcccugaucggccugaaccgcgagcagauggcccucaaccacggcgaggagcagguccggcuguggcgccgguccuacaacgugacgccgccgcccaucgaggagagccaccccuacuaccaggagaucuacaacgaccgccgguacaaggugugcgacgugccccuggaccagcucccccgcuccgagagccugaaggacgugcuggagcggcuccugcccuacuggaacgagcgcaucgcccccgagguccugcgggggaagaccauccucaucuccgcgcacggcaacagcucccgcgcccugcugaagcaccucgaggggaucagcgacgaggacaucaucaacaucacccugccgaccggcgugcccauccugcucgagcuggacgagaaccugcgggccguggggccccaccaguuccucggcgaccaggaggccauccaggcggccaucaagaaggucgaggaccagggcaaggugaagcaggccaagaaguga

SEQ ID NO: 27328 - RNA, 771 nt, Artificial Sequence
  derived and/or modified sequence opt1 from BPIFA1__Homo_sapiens__NP_057667
auguuccagaccggcgggcugaucguguucuacggccuccuggcccagaccauggcccaguucgggggccugcccgucccgcucgaccagacgcugccccugaacgugaaccccgcgcucccccugagcccgaccgggcuggccggcucccucaccaacgcccugagcaacggccugcucuccgggggccugcuggggauccucgagaaccugccccugcucgacauccugaagcccggcgggggcaccagcggcgggcugcucggcgggcugcugggcaaggugacguccgucauccccggccucaacaacaucaucgacaucaaggugaccgacccgcagcugcuggagcucgggcuggugcagagccccgacggccaccgccuguacgucaccaucccccucgggaucaagcuccaggugaacacgccccuggugggcgccucccugcugcggcuggccgucaagcucgacaucaccgcggagauccuggccgugcgcgacaagcaggagcggauccaccuggugcucggggacugcacccacagcccgggcucccugcagaucagccugcucgacggccuggggccccugcccauccagggccuccuggacucccugaccgggauccucaacaagguccugcccgagcuggugcagggcaacgugugcccgcuggucaacgaggugcuccgcgggcuggacaucacccuggugcacgacaucgucaacaugcucauccacggccugcaguucgugaucaagguguga

SEQ ID NO: 27329 - RNA, 750 nt, Artificial Sequence
  derived and/or modified sequence opt1 from BPIFA2__Homo_sapiens__NP_542141
augcugcagcucuggaagcuggugcugcucugcggcguccugaccgggaccagcgagucccugcucgacaaccugggcaacgaccugagcaacgugguggacaagcucgagcccguccugcacgaggggcuggagacgguggacaacacccucaagggcauccuggagaagcugaagguggaccucgggguccugcagaaguccagcgccuggcagcuggccaagcagaaggcgcaggaggccgagaagcuccugaacaacgugaucuccaagcugcucccgaccaacaccgacaucuucggccugaagaucagcaacucccugauccucgacgugaaggccgagcccaucgacgacggcaaggggcugaaccugagcuuccccgucacggccaacgugaccguggccggccccaucaucgggcagaucaucaaccucaaggcgucccuggaccugcucaccgccgucaccaucgagacggacccgcagacccaccagcccguggccgugcugggcgagugcgccagcgaccccaccuccaucagccugucccuccuggacaagcacagccagaucaucaacaaguucgucaacuccgugaucaacacccucaagagcacgguguccagccugcugcagaaggagaucugcccccugauccgcaucuucauccacucccucgacgucaacgugauccagcaggucguggacaacccgcagcacaagacccagcugcagacccugaucuga

SEQ ID NO: 27330 - RNA, 657 nt, Artificial Sequence
  derived and/or modified sequence opt1 from BPIFA3__Homo_sapiens__NP_001035904
augaugugcccccuguggcgccuccugaucuuccugggccuccuggcccugccgcucgcgccccacaagcagcccuggcccgggcuggcccaggcccaccgggacaacaagagcacccuggcccgcaucaucgcccagggccucaucaagcacaacgccgagucccggauccagaacauccacuucggggaccgccugaacgcgagcgcccagguggccccgggccuggucggguggcucaucuccggccggaagcaccagcagcagcaggagagccgcuccuucgacaacaacaucgugaagaugugcgcccacaugagcaucguggucgaguucuggcuggagaaggacgaguucggccggcgcgaccuggugaucgggaagugcgacgcggagcccuccagcgugcacgucgccauccucaccgaggccaucccgcccaagaugaaccaguuccuguacaaccugaaggagaaccuccagaaggugcugccccacaugguggagucccaggucugcccccugaucggcgagauccucgggcagcuggacgugaagcugcucaagagccugaucgagcaggaggccgcccacgagcccacgcaccacgagaccucccagcccagcgcgugccaggccggcgaguccccgagcuga

SEQ ID NO: 27331 - RNA, 1455 nt, Artificial Sequence
  derived and/or modified sequence opt1 from BPIFB1__Homo_sapiens__NP_149974
auggccggccccuggaccuucacccugcucugcgggcugcuggccgcgacgcucauccaggccacccugagcccgaccgccgugcugauccucggccccaaggucaucaaggagaagcugacccaggagcugaaggaccacaacgccacguccauccuccagcagcugccccugcucagcgccaugcgcgagaagcccgccgggggcaucccggugcuggggucccuggugaacaccguccucaagcacaucaucuggcugaaggugaucaccgcgaacauccugcagcuccaggugaagcccagcgccaacgaccaggagcugcuggucaagaucccccucgacaugguggccggcuucaacaccccgcuggugaagacgaucgucgaguuccacaugaccaccgaggcgcaggccaccauccggauggacacguccgccagcggcccgacccgccuggugcucuccgacugcgccaccagccacgggucccugcggauccagcugcuccacaagcugagcuuccuggugaacgcccucgcgaagcaggucaugaaccugcuggugcccucccuccccaaccuggugaagaaccagcugugccccgucaucgaggccagcuucaacggcauguacgccgaccuccugcagcuggugaaggugccgaucucccucagcaucgaccgccuggaguucgaccugcucuaccccgccaucaagggggacaccauccagcuguaccugggcgccaagcuccuggacucccaggggaaggucacgaagugguucaacaacagcgcggccucccugaccaugcccacccucgacaacauccccuucagccugaucgugucccaggacguggucaaggccgccguggccgcggugcugagcccggaggaguucaugguccugcucgacagcgugcugcccgaguccgcccaccggcucaagagcuccaucggccugaucaacgagaaggccgccgacaagcugggcagcacccagaucgucaagauccugacgcaggacacccccgaguucuucaucgaccaggggcacgccaagguggcgcagcucaucgugcuggaggucuuccccuccagcgaggcccugcgcccccucuucacccugggcaucgaggccuccagcgaggcccaguucuacaccaagggggaccagcugauccucaaccugaacaacaucuccagcgaccggauccagcugaugaacuccggcaucggcugguuccagcccgacgugcucaagaacaucaucacggagaucauccacagcauccugcugcccaaccagaacgggaagcuccgcuccggcgugcccgucagccuggugaaggcgcugggguucgaggccgccgaguccagccucaccaaggacgcccuggugcugaccccggccucccucuggaagcccagcucccccgucagccaguga

SEQ ID NO: 27332 - RNA, 1377 nt, Artificial Sequence
  derived and/or modified sequence opt1 from BPIFB2__Homo_sapiens__NP_079503
auggccugggccagccgccugggccuccugcuggcgcuccugcugcccguggucggggccuccaccccgggcaccguggugcggcucaacaaggccgcccugagcuacgucuccgagaucgggaaggcgccccugcagcgcgcccuccaggugacggugccccacuuccuggacuggagcggcgaggcccugcagcccacccggauccgcauccucaacguccacgugccgcggcugcaccugaaguucaucgccggguucggcgugcgccuccuggccgcggccaacuucaccuucaaggucuuccgggcccccgagccccuggagcucacccugcccguggagcugcucgccgacacgcgcgugacccaguccagcauccggaccccggucguguccaucagcgccugcucccuguucagcggccacgcgaacgaguucgacggguccaacagcaccucccacgcccugcucgugcugguccagaagcacaucaaggccgugcugagcaacaagcucugccuguccaucagcaaccuggugcagggcgucaacgugcaccucgggacgcugaucggccugaaccccguggggcccgagucccagauccgcuacagcauggucuccgugcccaccgugaccagcgacuacaucagccucgaggucaacgccgugcuguuccugcucggcaagccgaucauccugcccaccgacgccacgcccuucguccugccccggcacgugggcaccgagggguccauggcgaccgugggccucagccagcagcuguucgacuccgcccugcuccugcugcagaaggccggggcccucaaccuggacaucaccggccagcugcgcagcgacgacaaccuccugaacacguccgcccugggccggcugaucccggaggucgcgcgccaguuccccgagcccaugcccguggugcucaagguccggcugggggccaccccgguggccaugcugcacaccaacaacgccacccuccgccugcagcccuucguggagguccuggccacggcgagcaacuccgccuuccagagccucuucucccuggacgugguggucaaccugcggcuccagcugagcguguccaaggugaagcugcagggcaccaccagcguccucggggacgugcagcugaccguggccuccagcaacgucggcuucaucgacacggaccaggugcgcacccugauggggaccguguucgagaagccccuccuggaccaccugaacgcccuccuggcgaugggcaucgcccugcccggcgucgugaaccuccacuacguggccccggagaucuucgucuacgagggguacguggugaucuccagcggccuguucuaccaguccuga

SEQ ID NO: 27333 - RNA, 1524 nt, Artificial Sequence
  derived and/or modified sequence opt1 from BPIFC__Homo_sapiens__NP_777592
augugcaccaagaccauccccgugcuguggggcugcuuccuccuguggaaccuguacgucagcuccagccagacgaucuacccggggaucaaggcccgcaucacccagcgggcccucgacuacggcgugcaggcggggaugaagaugaucgagcagaugcugaaggagaagaagcugcccgaccucuccggcagcgagucccuggaguuccugaagguggacuacgucaacuacaacuucagcaacaucaagaucuccgccuucagcuuccccaacaccucccucgccuucgugcccggggugggcaucaaggcccugaccaaccacggcacggccaacaucagcaccgacuggggguucgaguccccgcuguuccaggacaccggcggggcggaccucuuccugagcggcgucuacuucaccgggaucaucauccugacgcgcaacgacuucggccaccccacccucaagcugcaggacugcuacgcccagcugucccacgcccacgugagcuucuccggcgagcucagcgugcuguacaacuccuucgccgagcccauggagaagcccauccugaagaaccucaacgagaugcugugcccgaucaucgcgagcgaggucaaggcccugaacgccaaccucuccacccuggaggugcugaccaagaucgacaacuacacgcuccuggacuacagccugaucagcucccccgagaucaccgagaacuaccucgaccugaaccugaaggggguguucuacccccucgagaaccugaccgacccgcccuucagccccguccccuucgugcugcccgagcgguccaacagcaugcucuacaucggcaucgccgaguacuucuucaaguccgccagcuucgcgcacuucaccgccgggguguucaacgucacgcuguccaccgaggagaucagcaaccacuucgugcagaacucccagggccugggcaacgugcucagccgcaucgccgagaucuacauccugucccagccguucaugguccggaucauggccaccgagccgcccaucaucaaccugcagcccgggaacuucacccucgacauccccgccagcaucaugaugcugacgcagcccaagaacuccaccguggagaccaucgugagcauggacuucgucgcguccaccagcgugggccuggugauccucgggcagcgccuggucugcucccugagccucaaccgguuccgccuggcccugcccgaguccaaccggagcaacaucgaggugcugcgcuucgagaacauccucagcuccauccugcacuucggcguccugccccucgccaacgccaagcugcagcagggguucccgcugagcaacccccacaaguuccucuucgugaacuccgacaucgaggugcuggagggcuuccugcucaucagcacggaccugaaguacgagaccuccagcaagcagcagcccuccuuccacgucugggagggccugaaccucaucagccggcaguggcgcgggaaguccgcccccuga

SEQ ID NO: 27334 - RNA, 1464 nt, Artificial Sequence
  derived and/or modified sequence opt1 from BPI__Homo_sapiens__NP_001716
augcgcgagaacauggcccggggccccugcaacgccccgcgcugggcgagccugauggugcucgucgccaucgggaccgccgugaccgccgccgugaaccccggcgucguggugcggaucucccagaaggggcuggacuacgcgagccagcagggcacggccgcccugcagaaggagcucaagcgcaucaagauccccgacuacuccgacagcuucaagaucaagcaccuggggaagggccacuacuccuucuacagcauggacauccgggaguuccagcugcccuccagccagaucuccauggucccgaacgugggccucaaguucagcaucuccaacgccaacaucaagaucagcgggaaguggaaggcgcagaagcgcuuccugaagauguccggcaacuucgaccugagcaucgaggggauguccaucagcgccgaccucaagcugggcuccaaccccaccagcgggaagcccaccaucacgugcuccagcugcagcucccacaucaacagcgugcacguccacaucuccaagagcaaggugggcuggcugauccagcuguuccacaagaagaucgaguccgcccuccggaacaagaugaacagccaggugugcgagaaggucaccaacuccgugagcuccgagcugcagcccuacuuccagacccucccggugaugaccaagaucgacagcgucgccggcaucaacuacgggcugguggccccgcccgcgaccacggccgagacccuggacgugcagaugaagggcgaguucuacuccgagaaccaccacaacccgccgcccuucgccccgcccgucauggaguuccccgccgcccacgaccgcaugguguaccucgggcugagcgacuacuucuucaacaccgcgggccugguguaccaggaggccggcguccucaagaugacccugcgggacgacaugauccccaaggaguccaaguuccgccugacgaccaaguucuucgggaccuuccuccccgagguggccaagaaguuccccaacaugaagauccagauccacgugagcgccuccaccccgccccaccugagcguccagcccacgggccugaccuucuaccccgccguggacguccaggcguucgccgugcuccccaacuccagccuggccucccuguuccucaucgggaugcacaccaccggcagcauggaggugagcgccgaguccaaccggcuggucggggagcugaagcucgaccgccugcugcucgagcugaagcacagcaacaucggccccuuccccguggagcugcuccaggacaucaugaacuacaucgugcccauccugguccugccccgggugaacgagaagcuccagaagggcuucccccugcccacgccggcccgcgugcagcuguacaacgucgugcuccagccccaccagaacuuccugcuguucggggcggacguggucuacaaguga

SEQ ID NO: 27335 - RNA, 762 nt, Artificial Sequence
  derived and/or modified sequence opt1 from BPNT1__Homo_sapiens__NP_001273078
augagcaucugcuccagccuggcccgcaaguuccccaagcucaccaucaucggcgaggaggaccugccguccgaggagguggaccaggagcugaucgaggacagccagugggaggagauccucaagcagcccugccccucccaguacagcgccaucaaggaggaggaccuggucguguggguggacccccuggacgggaccaaggaguacacggagggccuccuggacaacgucaccgugcugaucgggaucgcguacgagggcaaggccaucgccggggugaucaaccagccguacuacaacuacgaggccggccccgacgccguccucggccggaccaucuggggcgugcuggggcugggggcguucggcuuccagcucaaggaggugcccgccgggaagcacaucaucaccacgacccgcucccacagcaacaagcuggucaccgacugcguggccgccaugaaccccgacgcggugcugcgggucggcggcgccgggaacaagaucauccagcucaucgagggcaaggccuccgccuacguguucgccagcccggggugcaagaagugggacacgugcgcgcccgaggugauccugcacgccgucggcggcaagcugaccgacauccacgggaacgugcuccaguaccacaaggacgugaagcacaugaacuccgccggcguccuggccacccugcgcaacuacgacuacuacgccagccgggugcccgaguccaucaagaacgcgcucgugcccuga

SEQ ID NO: 27336 - RNA, 8712 nt, Artificial Sequence
  derived and/or modified sequence opt1 from BPTF__Homo_sapiens__NP_004450
augcgcggccggcgcgggcggcccccgaagcagcccgccgcccccgcggccgagcgcugcgcccccgccccgcccccccccccgcccccccccaccagcggcccgaucgggggccugcggucccgccaccgggggagcucccgcggccggugggccgcggcccaggccgagguggcccccaagacccgccucagcuccccccggggcgggagcuccagccgccggaagcccccgcccccccccccggcgccccccuccacgagcgcccccggccgcgggggccgggggggcggcgggggccgcaccgggggcggcgggggcgggggccaccuggcccggaccaccgccgcccgccgggcggucaacaaggugguguacgacgaccacgaguccgaggaggaggaggaggaggaggacauggucagcgaggaggaggaggaggaggacggggacgccgaggagacgcaggacuccgaggacgacgaggaggacgagauggaggaggacgacgacgacagcgacuacccggaggagauggaggacgacgacgacgacgccuccuacugcaccgagagcuccuuccgcagccacuccaccuacagcagcacccccggccggcgcaagccccgcgugcaccggccccgcuccccgauccuggaggagaaggacauccccccccucgaguucccgaagagcuccgaggaccugauggugcccaacgagcacaucaugaacgucaucgccaucuacgaggugcugcggaacuucggcacggugcuccgccugagccccuuccgguucgaggacuucugcgccgcgcuggucucccaggagcagugcacccucauggccgagaugcacguggugcugcugaaggccguccuccgcgaggaggacaccagcaacaccacguucgggcccgccgaccugaaggacuccgugaacagcacccuguacuucaucgacggcaugaccuggccggaggugcuccgggucuacugcgaguccgacaaggaguaccaccacgugcugcccuaccaggaggccgaggacuaccccuacgggcccguggagaacaagaucaagguccugcaguuccucguggaccaguuccugaccacgaacaucgcgcgcgaggagcugaugagcgagggcgugauccaguacgacgaccacugccgggucugccacaagcucggggaccugcugugcugcgagaccugcuccgccguguaccaccucgagugcgugaagccgccccuggaggagguccccgaggacgaguggcagugcgaggugugcgucgcccacaaggugcccggcgugaccgacugcgucgccgagauccagaagaacaagccguacauccgccacgagcccaucggcuacgaccggagccgccggaaguacugguuccugaaccgccggcucaucaucgaggaggacaccgagaacgagaacgagaagaagaucugguacuacuccacgaaggugcagcuggccgagcugaucgacugccucgacaaggacuacugggaggcggagcugugcaagauccuggaggagaugcgcgaggagauccaccggcacauggacaucaccgaggaccucaccaacaaggcccgcgggagcaacaaguccuuccuggccgccgcgaacgaggagauccuggagagcauccgggccaagaagggcgacaucgacaacgugaagucccccgaggagaccgagaaggacaagaacgagacggagaacgacagcaaggacgccgagaagaaccgcgaggaguucgaggaccagucccucgagaaggacagcgacgacaagacccccgacgacgacccggagcaggggaagagcgaggagcccaccgaggucggcgacaaggggaacuccgugagcgccaaccugggcgacaacaccacgaacgccaccuccgaggagaccagccccuccgagggccgcagccccguggggugccuguccgagaccccggacagcuccaacauggcggagaagaaggucgccagcgagcucccccaggacgugcccgaggagcccaacaagacgugcgaguccagcaacaccuccgccaccaccacgagcauccagccgaaccuggagaacuccaacagcuccagcgagcugaacagcucccagagcgaguccgccaaggccgcggacgaccccgagaacggcgagcgggagagccacacccccguguccauccaggaggagaucgucggggacuucaagagcgagaaguccaacggcgagcucagcgaguccccgggcgccgggaagggcgccagcggguccacccgcaucaucacccggcugcgcaaccccgacagcaagcugucccagcucaagagccagcagguggccgccgcggcccacgaggccaacaagcuguucaaggagggcaaggaggugcuggucgugaacucccagggggagaucagccggcucuccaccaagaaggaggugaucaugaagggcaacaucaacaacuacuucaagcugggccaggaggggaaguaccgcgucuaccacaaccaguacagcacgaacuccuucgcccugaacaagcaccagcaccgggaggaccacgacaagcgccggcaccuggcgcacaaguucugccucacccccgccggcgaguucaaguggaacgggagcgugcacggcagcaaggugcugaccaucuccacccugcgccucacgaucacccagcuggagaacaacauccccagcuccuuccugcacccgaacugggccagccaccgggccaacuggaucaaggccguccagaugugcuccaagccccgcgaguucgcgcucgcccuggccauccuggagugcgccgugaagcccguggucaugcuccccaucuggcgggagagccuggggcacacccgccugcaccggaugaccuccaucgagcgcgaggagaaggagaaggugaagaagaaggagaagaagcaggaggaggaggagacgaugcagcaggccaccugggugaaguacaccuucccggucaagcaccagguguggaagcagaagggcgaggaguaccgggugaccggcuacgggggcuggagcuggaucuccaagacgcacgucuaccgcuucgugcccaagcuccccgggaacaccaacgugaacuaccggaagagccuggagggcaccaagaacaacauggacgagaacauggacgaguccgacaagcgcaagugcagccggucccccaagaagaucaagaucgagccggacagcgagaaggacgaggucaagggguccgacgcggccaagggcgccgaccagaacgagauggacaucagcaagaucaccgagaagaaggaccaggacgugaaggagcugcucgacuccgacagcgacaagcccugcaaggaggagcccauggagguggacgacgacaugaagacggagucccacgucaacugccaggagagcagccagguggacguggucaacguguccgagggcuuccaccugcgcaccagcuacaagaagaagaccaaguccagcaagcuggacgggcuccuggagcgccggaucaagcaguucacccuggaggagaagcagcgccucgagaagaucaagcuggagggcgggaucaagggcaucgggaagacguccaccaacagcuccaagaaccugagcgagucccccgugaucaccaaggccaaggagggcugccagagcgacuccaugcggcaggagcagagcccgaacgccaacaacgaccagcccgaggaccucauccagggcugcuccgagagcgacuccagcguccugcgcauguccgaccccagccacaccacgaacaagcuguaccccaaggaccgggugcucgacgacguguccauccgcagcccggagaccaagugccccaagcagaacagcaucgagaacgacaucgaggagaaggucuccgaccuggcgagccgggggcaggagcccuccaagagcaagaccaagggcaacgacuucuucaucgacgacuccaagcuggccagcgccgacgacaucgggacccucaucugcaagaacaagaagccccugauccaggaggaguccgacacgaucgugagcuccagcaaguccgcccugcacagcuccgugccgaagagcaccaacgaccgcgacgcgaccccccucucccgggccauggacuucgagggcaagcugggcugcgacagcgaguccaacagcacccuggagaacuccagcgacacggucagcauccaggacuccagcgaggaggacaugaucgugcagaacuccaacgagagcaucuccgagcaguuccgcacccgggagcaggacguggagguccucgagccccugaagugcgagcuggugagcggggaguccaccggcaacugcgaggaccgccuccccgucaaggggaccgaggccaacggcaagaagccgagccagcagaagaagcuggaggagcggcccgugaacaagugcuccgaccagaucaagcugaagaacacgaccgacaagaagaacaacgagaaccgcgagagcgagaagaaggggcagcggaccuccaccuuccagaucaacggcaaggacaacaagcccaagaucuaccucaagggcgagugccugaaggagaucagcgagucccgcguggucagcgggaacguggagccgaaggugaacaacaucaacaagaucauccccgagaacgacaucaagucccugaccgucaaggagagcgccauccggcccuucaucaacggcgacgugaucauggaggacuucaacgagcgcaacuccagcgagacgaagucccaccuccugagcagcuccgacgccgaggggaacuaccgggacagccuggagacccuccccuccaccaaggagagcgacuccacccagacgaccaccccgagcgcguccugccccgagagcaacuccgugaaccaggucgaggacauggagaucgagaccagcgaggugaagaaggugacguccagccccaucaccuccgaggaggagagcaaccuguccaacgacuucaucgacgagaacggccugcccaucaacaagaacgagaacgucaacggggagagcaagcgcaagaccgugaucaccgaggugacgaccaugaccuccaccgucgccacggagagcaagaccgugaucaagguggagaagggcgacaagcagaccgucgugagcuccaccgagaacugcgccaagagcacggugaccaccaccacgaccaccgucaccaagcucuccacgccgagcaccggcggguccguggacaucaucagcgugaaggagcaguccaagaccgucgugaccacgaccgugaccgacagccugaccacgaccggcgggacccuggucaccuccaugaccgugagcaaggaguacuccacgcgcgacaaggugaagcucaugaaguucagccggcccaagaagacccgcuccggcaccgcccugcccagcuaccggaaguucgucaccaaguccagcaagaaguccaucuucgugcugcccaacgacgaccucaagaagcuggcccgcaaggggggcauccgggaggugccguacuucaacuacaacgcgaagcccgcccuggacaucuggcccuaccccagcccgcgccccacguucggcaucaccuggcgguaccgccuccagaccgucaagucccuggccggggugagccugaugcuccggcugcugugggccagccuccgcugggacgacauggccgcgaaggccccccccggcgggggcaccacgcggaccgagaccuccgagaccgagaucacgaccaccgagaucaucaagcgccgggacgugggcccguacgggauccgcagcgaguacugcauccggaagaucaucugccccaucggcguccccgagacccccaaggagacgccgaccccccagcgcaaggggcugcgguccagcgcccugcgccccaagcggcccgagaccccgaagcagaccggccccgugaucaucgagacguggguggccgaggaggagcucgagcugugggagauccgcgccuucgcggagcgggucgagaaggagaaggcccaggccguggagcagcaggccaagaagcgccuggagcagcagaagcccaccgugaucgcgaccuccaccacgagcccgaccuccagcaccaccuccacgaucagccccgcccagaaggucaugguggcccccaucuccgggagcgugaccaccggcaccaagaugguccucacgaccaaggugggcucccccgccaccgugaccuuccagcagaacaagaacuuccaccagacguucgccaccugggucaagcaggggcagagcaacuccggcguggugcagguccagcagaaggugcuggggaucaucccgagcuccaccggcaccagccagcagacguucaccuccuuccagccccgcaccgcgaccgucaccauccggcccaacacgagcgggagcggcggcaccaccuccaacagccaggugaucaccgggccccagauccgcccgggcaugacggugauccggaccccccugcagcaguccacccucgggaaggccaucauccgcacccccgucauggugcagcccggcgccccgcagcaggugaugacgcagaucauccgggggcagcccgucagcaccgccguguccgcccccaacaccgugagcuccacccccggccagaagagccugacguccgcgaccagcaccuccaacauccagagcuccgccagccagccgccccgcccccagcagggccaggucaagcugaccauggcccagcucacgcagcugacccaggggcacggcgggaaccagggccugaccguggugauccaggggcagggccagaccacgggccagcuccagcugaucccccagggggucaccgugcugccgggccccgggcagcagcucaugcaggccgccaugcccaacggcaccgugcagcgguuccuguucaccccccuggcgacgaccgccaccaccgccuccacgaccaccaccacggucagcaccaccgccgcgggcaccggggagcagcgccaguccaagcucagcccgcagaugcaggugcaccaggacaagacgcugccccccgcccaguccagcagcgugggcccggccgaggcccagccccagaccgcccagcccuccgcgcagccccagccgcagacccagccccagagccccgcccagcccgagguccagacccagccggaggugcagacccagacgaccguguccagccacguccccuccgaggcccagcccacccacgcccagagcuccaagccccagguggccgcgcagagccagccgcaguccaacgugcaggggcagagccccguccgggugcagucccccagccagacccgcauccggcccuccacgccgagccagcugucccccggccagcagagccaggugcagaccaccaccucccagcccauccccauccagccgcacacgagccuccagauccccucccaggggcagccccagagccagccccaggucgugaugaagcacaacgccgugaucgagcaccugaagcagaagaagagcaugaccccggccgagcgcgaggagaaccagcggaugaucgucugcaaccaggugaugaaguacauccuggacaagaucgacaaggaggagaagcaggccgccaagaagcgcaagcgggaggaguccguggagcagaagcgcagcaagcagaacgcgaccaagcucuccgcccugcuguucaagcacaaggagcagcugcgggccgagauccucaagaagcgcgcccugcuggacaaggaccuccagaucgagguccaggaggagcugaagcgggaccugaagaucaagaaggagaaggaccucaugcagcuggcgcaggccaccgccguggccgcccccugcccccccgugacgccggcgccccccgccccgcccgccccccccccgagccccccccccccgcccgccguccagcacaccggccugcucuccacccccacccugcccgccgcgagccagaagcgcaagcgcgaggaggagaaggacuccagcuccaagagcaagaagaagaagaugaucuccacgaccagcaaggagaccaagaaggacaccaagcuguacugcaucugcaagacgccguacgacgaguccaaguucuacaucggcugcgaccggugccagaacugguaccacgggcgcugcgugggcauccuccagagcgaggccgagcugaucgacgaguacgugugcccccagugccaguccaccgaggacgccaugaccguccugaccccccucacggagaaggacuacgaggggcugaagcgggugcugcgcagccuccaggcccacaagauggccuggcccuuccuggagccgguggaccccaacgacgcgcccgacuacuacggcgucaucaaggagcccauggaccuggccaccauggaggagcgggugcagcgccgguacuacgagaagcucaccgaguucguggccgacaugaccaagaucuucgacaacugccgcuacuacaacccguccgacagccccuucuaccagugcgccgagguccuggaguccuucuucgugcagaagcugaagggguucaaggccagccggagccacaacaacaagcuccaguccacggcgagcuga

SEQ ID NO: 27337 - RNA, 321 nt, Artificial Sequence
  derived and/or modified sequence opt1 from BPY2__Homo_sapiens__NP_004669
augaugacccuggugccccgcgcccggacccgcgccggccaggaccacuacagccacccgugcccccgguucucccagguccuccugacggaggggaucaugaccuacugccugaccaagaaccucagcgacgugaacauccugcaccgccugcucaagaacggcaacgugcggaacacccugcugcaguccaaggucgggcuccugacguacuacgugaagcuguaccccggcgaggugacccuccugacccgccccagcauccagaugcggcugugcugcaucaccggguccgucagccgcccgcggucccagaaguga

SEQ ID NO: 27338 - RNA, 2301 nt, Artificial Sequence
  derived and/or modified sequence opt1 from BRAF__Homo_sapiens__NP_004324
auggccgcccugagcggcgggggcgggggcggggcggagcccggccaggcccucuucaacggcgacauggagccggaggccggggccggcgccggggcggccgccuccagcgccgcggaccccgccauccccgaggagguguggaacaucaagcagaugaucaagcugacccaggagcacaucgaggcccugcucgacaaguucggcggggagcacaacccgcccuccaucuaccuggaggccuacgaggaguacaccagcaagcuggacgcccuccagcagcgcgagcagcagcugcuggagucccucggcaacggcacggacuucagcgucuccagcuccgcgagcauggacaccgugaccuccagcuccagcuccagccuguccgugcugcccagcucccucagcgucuuccagaaccccaccgacguggcccggagcaaccccaaguccccgcagaagcccaucgugcgcgucuuccugcccaacaagcagcggacgguggugcccgcccgcugcggggucaccgugcgggacagccugaagaaggcccucaugaugcgcggccugaucccggagugcugcgccguguaccggauccaggacggggagaagaagcccaucggcugggacaccgacaucuccuggcugaccggcgaggagcuccacgucgaggugcuggagaacgugccccugacgacccacaacuucguccgcaagaccuucuucacccucgcguucugcgacuucugccggaagcugcuguuccagggguuccgcugccagacgugcggcuacaaguuccaccagcggugcagcaccgaggugccccucaugugcgugaacuacgaccagcuggaccugcuguucgucuccaaguucuucgagcaccacccgaucccccaggaggaggccagccuggccgagaccgcccugaccuccgggagcucccccagcgcccccgcguccgacagcaucggcccgcagauccucacgucccccagccccuccaagagcauccccaucccgcagcccuuccgccccgccgacgaggaccaccggaaccaguucgggcagcgcgaccgguccagcuccgcccccaacgugcacaucaacaccaucgagccggugaacaucgacgaccugauccgcgaccagggcuuccggggcgacgggggcagcaccaccgggcugagcgccacgccgcccgccucccuccccggcagccugaccaacgucaaggcgcugcagaagucccccgggccccagcgcgagcgcaagagcuccagcuccagcgaggaccggaaccggaugaagacccucggccgccgcgacuccagcgacgacugggagauccccgacggccagaucaccguggggcagcggaucggcuccgggagcuucggcacgguguacaaggggaaguggcacggcgacgucgccgugaagaugcugaacgucaccgccccgacgccccagcagcugcaggccuucaagaacgaggugggcgugcuccgcaagacccggcacgucaacauccugcuguucaugggguacuccaccaagccccagcucgcgaucgugacccaguggugcgagggcagcucccuguaccaccaccuccacaucaucgagaccaaguucgagaugaucaagcucaucgacaucgcccgccagaccgcccaggggauggacuaccugcacgccaagagcaucauccaccgggaccugaaguccaacaacaucuuccuccacgaggaccugacggugaagaucggcgacuucggccuggccaccgucaagagccgcuggagcgggucccaccaguucgagcagcugagcggcuccauccucuggauggcgcccgaggugauccggaugcaggacaagaacccguacagcuuccaguccgacguguacgccuucgggaucguccuguacgagcugaugaccggccagcuccccuacagcaacaucaacaaccgcgaccagaucaucuucaugguggggcggggcuaccugucccccgaccugagcaaggugcgcuccaacugccccaaggccaugaagcggcucauggccgagugccugaagaagaagcgcgacgagcggccgcuguucccccagauccucgccagcaucgagcugcuggcgcgcucccuccccaagauccaccggagcgccuccgagcccagccugaaccgcgccggcuuccagaccgaggacuucucccuguacgccugcgccagcccgaagacgcccauccaggccgggggcuacggggcguuccccguccacuga

SEQ ID NO: 27339 - RNA, 1779 nt, Artificial Sequence
  derived and/or modified sequence opt1 from BRAP__Homo_sapiens__NP_006759
augagcgugucccuggucgugauccgccuggagcuggccgagcacagccccgugccggccggcuucggguucuccgcggccgccggcgagaugagcgacgaggagaucaagaagaccacccuggccuccgccgucgcgugccucgagggcaagagccccggggagaagguggccaucauccaccagcaccuggggcggcgcgagaugacggacgugaucaucgagaccaugaaguccaaccccgacgagcugaagaccaccgucgaggagcgcaagagcuccgaggccagccccacggcccagcgguccaaggaccacagcaaggagugcaucaacgcggccccggacucccccagcaagcagcuccccgaccagaucuccuucuucagcggcaaccccuccguggagaucgugcacggcaucaugcaccuguacaagaccaacaagaugaccagccugaaggaggacguccggcgcuccgccaugcucugcauccugaccgugccggccgccaugacgagccacgaccugaugaaguucguggcgcccuucaacgaggucaucgagcagaugaagaucauccgggacagcacccccaaccaguacauggugcucaucaaguuccgcgcccaggccgacgccgacuccuucuacaugaccugcaacgggcggcaguucaacagcaucgaggacgacgugugccagcuggucuacguggagcgcgccgaggugcugaaguccgaggacggcgcgagccuccccgucauggaccugaccgagcugccgaagugcacggugugccucgagcggauggacgaguccgugaacgggauccugaccacccugugcaaccacagcuuccacucccagugccuccagcgcugggacgacaccacgugccccgucugccgguacugccagacccccgagcccguggaggagaacaagugcuucgagugcggcgugcaggagaaccuguggaucugccugaucugcgggcacaucggcugcggccgcuacgucagccggcacgccuacaagcacuucgaggagacccagcacaccuacgccaugcagcucacgaaccaccgcgugugggacuacgccggggacaacuacguccaccggcugguggccuccaagaccgacggcaagaucgugcaguacgagugcgagggggacacgugccaggaggagaagaucgacgcgcugcagcucgaguacagcuaccugcugaccucccagcucgagagccagcgcaucuacugggagaacaagaucguccggaucgagaaggacaccgccgaggagaucaacaacaugaagaccaaguucaaggagaccaucgagaagugcgacaaccuggagcacaagcugaacgaccuccugaaggagaagcaguccguggagcgcaagugcacccagcugaacacgaagguggccaagcucaccaacgagcugaaggaggagcaggagaugaacaagugccugcgggccaaccagguccuccugcagaacaagcugaaggaggaggagcgcgugcucaaggagaccugcgaccagaaggaccugcagaucaccgagauccaggagcagcugcgcgacgugauguucuaccucgagacgcagcagaagaucaaccaccucccggccgagacccggcaggagauccaggagggccagaucaacaucgcgauggccagcgccuccagccccgccuccagcggcggguccggcaagcugcccagccgcaaggggcggagcaagcgcggcaaguga

SEQ ID NO: 27340 - RNA, 2466 nt, Artificial Sequence
  derived and/or modified sequence opt1 from BRAT1__Homo_sapiens__NP_689956
auggaccccgagugcgcccagcugcuccccgcccugugcgcggugcuggucgacccccgccagcccguggccgacgacacgugccucgagaagcugcuggacugguucaagaccgugaccgagggcgagagcuccgucgugcuccugcaggagcaccccugccugguggagcuccugagccacguccugaaggugcaggaccucuccagcggggugcuguccuucagccugcggcucgccggcaccuucgccgcccaggagaacugcuuccaguaccugcagcagggggagcugcucccgggccuguucggggagcccggcccccugggccgcgcgaccugggccguccccaccgugcgguccggguggauccagggccuccgcagccuggcccagcacccguccgcccugcgguuccucgcggaccacggggccguggacacgaucuucagccugcagggcgacuccagccuguucgucgccuccgccgccagccagcuccuggugcacgugcuggcgcucuccaugcgcgggggcgccgagggccagcccugccugcccgggggcgacuggcccgccugcgcccagaagaucauggaccacgucgaggagagccugugcuccgccgcgaccccgaaggugacccaggcccucaacgugcugaccacgaccuucgggcggugccagagccccuggaccgaggcccuguggguccgccucagcccccggguggccugccugcuggagcgcgaccccaucccggccgcgcacagcuucguggaccuccugcugugcgucgcccggagccccguguucuccagcuccgacggcagccucugggagaccguggcccgcgcccuguccugccugggccccacgcacauggggccccucgcccugggcauccugaagcucgagcacugcccgcaggcgcugcggacccaggccuuccagguccugcugcagccccucgccugcgugcugaaggccaccguccaggcgcccgggcccccgggccugcucgacgggaccgccgacgacgccacgaccguggacacccugcuggccagcaaguccagcugcgccggccuccugugccgcacccuggcgcaccucgaggagcugcagccccugccccagcggcccuccccguggccccaggccagccuccugggcgccacggugaccguccugcgccucugcgacggguccgccgcccccgcgagcuccgugggcgggcaccugugcggcacccuggccgggugcgugcggguccagcgcgccgcccucgacuuccugggcacccugagccagggcacggggccgcaggagcucgugacccaggcccuggcggugcugcucgagugccuggagucccccggcagcucccccaccguccugaagaaggccuuccaggccacccuccgguggcugcugagcucccccaagacgccggggugcagcgaccucggcccccugaucccccaguuccugcgcgagcuguuccccgugcuccagaagcggcugugccacccgugcugggaggugcgcgacagcgcccucgaguuccugacccagcugucccgccacuggggcgggcaggcggacuuccggugcgcccuccuggccagcgaggucccccagcuggcccuccagcugcugcaggaccccgaguccuacgugcgcgccagcgcggugaccgccaugggccagcucuccagccaggggcugcacgcccccaccuccccggagcacgccgaggcccggcagagccuguuccucgagcugcugcacauccucuccgucgacagcgagggcuucccccgccgggcggugaugcaggucuucacggaguggcugcgcgacgggcacgccgacgccgcccaggacaccgagcaguucguggccaccgugcugcaggcggccucccgggaccucgacugggaggugcgcgcccagggccuggagcuggcccucgucuuccugggccagacccuggggccgccccggacgcacugccccuacgcgguggcccuccccgagguggcccccgcccagccccugaccgaggcccugcgcgcgcucugccacgucggccuguucgacuucgccuucugcgcccuguucgacugcgaccggccgguggcccagaaguccugcgaccuccugcuguuccuccgcgacaagaucgccuccuacagcucccugcgggaggcgcgcgggagccccaacaccgccuccgccgaggccacccugccccgguggcgcgccggcgagcaggcgcagcccccgggggaccaggagcccgaggccgugcucgccaugcugcggagccuggaccucgagggccugcgcagcacccuggccgaguccagcgaccacgucgagaaguccccgcagagccuccugcaggacaugcuggccacgggcggguuccuccagggcgacgaggcggacugcuacuga

SEQ ID NO: 27341 - RNA, 5592 nt, Artificial Sequence
  derived and/or modified sequence opt1 from BRCA1__Homo_sapiens__NP_009225
auggaccugagcgcccuccgcguggaggagguccagaacgugaucaacgccaugcagaagauccuggagugccccaucugccuggagcucaucaaggagccgguguccaccaagugcgaccacaucuucugcaaguucugcaugcugaagcugcucaaccagaagaagggccccagccagugcccccugugcaagaacgacaucaccaagcggucccugcaggagagcacgcgcuucucccagcucgucgaggagcugcugaagaucaucugcgcguuccagcucgacaccgggcuggaguacgccaacagcuacaacuucgccaagaaggagaacaacucccccgagcaccugaaggacgaggugagcaucauccaguccaugggcuaccggaaccgcgccaagcggcuccugcagagcgagccggagaaccccucccugcaggagaccagccucuccgugcagcugagcaaccuggggaccguccgcacgcuccggaccaagcagcgcauccagccccagaagaccuccguguacaucgagcugggcagcgacuccagcgaggacaccgugaacaaggccacguacugcuccgucggggaccaggagcugcuccagaucaccccccagggcacccgggacgagaucagccuggacagcgcgaagaaggccgccugcgaguucuccgagaccgacgugacgaacaccgagcaccaccagccgagcaacaacgaccugaacaccaccgagaagcgcgccgcggagcggcaccccgagaaguaccagggcuccagcguguccaaccuccacgucgagcccugcgggacgaacacccacgccagcucccugcagcacgagaacagcucccugcuccugaccaaggaccgcaugaacguggagaaggccgaguucugcaacaagagcaagcagcccggccuggcccggucccagcacaaccgcugggccgggagcaaggagaccugcaacgaccggcgcacgccguccaccgagaagaagguggaccucaacgcggacccccugugcgagcggaaggaguggaacaagcagaagcugcccugcagcgagaacccccgcgacaccgaggacgucccguggaucacccucaacuccagcauccagaaggugaacgagugguucucccggagcgacgagcugcugggcuccgacgacagccacgacggggagagcgaguccaacgccaagguggccgacguccucgacgugcugaacgagguggacgaguacagcggcuccagcgagaagaucgaccugcucgccuccgacccccacgaggcccugaucugcaagagcgagcgcguccacuccaagagcguggaguccaacaucgaggacaagaucuucggcaagacguaccggaagaaggcgagccugcccaaccucucccacgugaccgagaaccugaucaucggggccuucgucaccgagccccagaucauccaggagcgcccgcugaccaacaagcucaagcgcaagcggcgccccacgagcggccugcaccccgaggacuucaucaagaaggccgaccuggccgugcagaagacccccgagaugaucaaccaggggaccaaccagaccgagcagaacggccaggucaugaacaucacgaacuccggccacgagaacaagaccaagggggacagcauccagaacgagaagaacccgaaccccaucgagucccuggagaaggagagcgccuucaagaccaaggcggagcccaucuccagcagcaucuccaacauggagcucgagcugaacauccacaacagcaaggcccccaagaagaaccggcugcgccggaaguccagcacccgccacauccacgcccucgagcugguggugucccggaaccugagcccgcccaacugcacggagcuccagaucgacuccugcagcuccagcgaggagaucaagaagaagaaguacaaccagaugcccguccgccacucccggaaccugcagcugauggagggcaaggagccggccaccggggccaagaagagcaacaagcccaacgagcagaccuccaagcgccacgacagcgacaccuuccccgagcucaagcugaccaacgcgcccggcuccuucacgaagugcagcaacaccuccgagcugaaggaguucgugaacccgagccucccccgggaggagaaggaggagaagcuggagaccgugaaggucuccaacaacgccgaggaccccaaggaccugaugcucagcggggagcgcgugcugcagaccgagcggagcguggaguccagcuccaucagccugguccccggcacggacuacggcacccaggaguccaucagccuccuggagguguccacccuggggaaggccaagaccgagccgaacaagugcgugagccagugcgccgcguucgagaaccccaagggccucauccacgggugcuccaaggacaaccgcaacgacacggagggcuucaaguacccccuggggcacgaggucaaccacagccgggagaccuccaucgagauggaggagagcgagcuggacgcccaguaccuccagaacaccuucaagguguccaagcgccagagcuucgcccccuucuccaacccgggcaacgccgaggaggagugcgccaccuucagcgcgcacuccggcagccugaagaagcagucccccaaggugacguucgagugcgagcagaaggaggagaaccaggggaagaacgagagcaacaucaagcccguccagaccgugaacaucaccgccggcuuccccguggucgggcagaaggacaagccgguggacaacgccaagugcagcaucaagggcgggucccgguucugccugagcucccaguuccgcggcaacgagaccggccucaucacgcccaacaagcacgggcugcugcagaaccccuaccggauccccccgcucuuccccaucaagagcuucgugaagaccaagugcaagaagaaccugcuggaggagaacuucgaggagcacuccaugagccccgagcgcgagaugggcaacgagaacauccccuccaccgucagcaccaucucccgcaacaacauccgggagaacguguucaaggaggccagcuccagcaacaucaacgaggugggguccagcacgaacgaggucggcuccagcaucaacgagaucggcuccagcgacgagaacauccaggccgagcucgggcgcaaccggggcccgaagcugaacgcgaugcugcgccucggggugcugcagcccgagguguacaagcagucccugcccggcagcaacugcaagcacccggagaucaagaagcaggaguacgaggaggucgugcagaccgugaacaccgacuucagccccuaccucaucuccgacaaccuggagcagcccauggggagcucccacgccagccaggucugcuccgagacccccgacgaccugcucgacgacggcgagaucaaggaggacacgagcuucgccgagaacgacaucaaggaguccagcgccguguucuccaagagcgugcagaagggcgagcugucccggagcccgucccccuucacccacacccaccuggcccagggguaccgccggggcgcgaagaagcucgagagcuccgaggagaaccugagcuccgaggacgaggagcugcccugcuuccagcaccuccuguucgggaaggucaacaacauccccagccaguccacccgccacagcacgguggccaccgagugccugagcaagaacaccgaggagaaccuccugucccugaagaacagccucaacgacugcuccaaccaggugauccuggccaaggccagccaggagcaccaccuguccgaggagaccaagugcagcgcgucccucuucagcucccagugcagcgagcuggaggaccugacggccaacaccaacacccaggacccguuccucaucggcuccagcaagcagaugcggcaccaguccgagagccagggggucggccuguccgacaaggagcuggugagcgacgacgaggagcgcggcaccgggcucgaggagaacaaccaggaggagcaguccauggacagcaaccugggcgaggccgccuccgggugcgagagcgagacgagcguguccgaggacugcagcggccuguccagccaguccgacauccucaccacccagcagcgggacaccaugcagcacaaccugaucaagcugcagcaggagauggccgagcucgaggcgguccuggagcagcacgggagccagcccuccaacagcuaccccuccaucaucagcgacuccagcgcccuggaggaccuccgcaaccccgagcaguccaccagcgagaaggccgugcugacgucccagaagagcuccgaguacccgaucagccagaaccccgagggccugagcgccgacaaguucgagguguccgccgacagcuccaccagcaagaacaaggagcccggcgucgagcgguccagccccuccaagugcccgagccucgacgaccgcugguacaugcacuccugcagcgggucccugcagaaccggaacuaccccagccaggaggagcugaucaaggugguggacgucgaggagcagcagcucgaggaguccggcccccacgaccugaccgagaccagcuaccugccccgccaggaccucgaggggacgccguaccuggaguccggcaucagccuguucuccgacgaccccgagagcgaccccuccgaggaccgggcgcccgagagcgcccgcguggggaacaucccgagcuccaccagcgcccucaaggugccccagcugaaggucgccgaguccgcccagagccccgcggccgcccacaccaccgacacggccggcuacaacgcgauggaggaguccgugagccgggagaagcccgagcugaccgccuccaccgagcgcgugaacaagcggaugagcauggucguguccggccucaccccggaggaguucaugcuggucuacaaguucgcccgcaagcaccacaucacgcugaccaaccucaucaccgaggagaccacgcacguggugaugaagaccgacgccgaguucgucugcgagcgcacccugaaguacuuccuggggaucgccggcgggaaguggguggugagcuacuucugggucacccaguccaucaaggagcggaagaugcucaacgagcacgacuucgaggugcgcggcgacguggucaacggccggaaccaccaggggcccaagcgcgcgcgggagagccaggaccgcaagaucuuccggggccuggagaucugcugcuacgggcccuucacgaacaugccgaccgaccagcuggaguggauggugcagcugugcggcgccuccguggucaaggagcucagcuccuucacccuggggaccggcgugcaccccaucguggucgugcagcccgacgccuggacggaggacaacggcuuccacgccaucgggcagaugugcgaggcccccguggucacccgcgagugggugcuggacagcguggcgcucuaccagugccaggagcuggacaccuaccugaucccgcagaucccccacucccacuacuga

SEQ ID NO: 27342 - RNA, 10257 nt, Artificial Sequence
  derived and/or modified sequence opt1 from BRCA2__Homo_sapiens__NP_000050
augcccaucggcagcaaggagcggcccaccuucuucgagaucuucaagacccggugcaacaaggccgaccuggggcccaucagccucaacugguucgaggagcugagcagcgaggcgccgcccuacaacagcgagcccgccgaggagagcgagcacaagaacaacaacuacgagcccaaccuguucaagacgccccagcggaagcccagcuacaaccagcucgccuccacccccaucaucuucaaggagcagggccugacccugccccucuaccagagccccgugaaggagcuggacaaguucaagcuggaccucgggcggaacguccccaacucccgccacaagagccugcggaccgugaagaccaagauggaccaggccgacgacguguccugcccgcugcucaacagcugccuguccgagagccccguggugcugcagugcacccacgugacgccccagcgggacaaguccguggugugcggcagccucuuccacacccccaaguucgugaaggggcggcagacccccaagcacaucuccgagagccugggcgccgagguggaccccgacauguccuggagcagcucccuggccacgccgcccacccucagcuccaccgugcugaucgugcgcaacgaggaggccagcgagaccgucuucccgcacgacaccaccgccaacgugaaguccuacuucagcaaccacgacgagucccugaagaagaacgaccgguucaucgccagcgugaccgacuccgagaacaccaaccagcgcgaggccgcgagccacggcuucgggaagaccuccggcaacagcuucaaggucaacuccugcaaggaccacaucggcaaguccaugcccaacgugcucgaggacgagguguacgagaccgucguggacaccuccgaggaggacagcuucucccugugcuucagcaagugccggaccaagaaccugcagaaggugcgcaccuccaagacccggaagaagaucuuccacgaggccaacgccgacgagugcgagaaguccaagaaccaggucaaggagaaguacagcuucguguccgagguggagcccaacgacaccgacccccucgacagcaacgucgccaaccagaagccguucgaguccggcagcgacaagaucuccaaggaggugguccccagccuggccugcgaguggucccagcugacgcucagcgggcugaacggcgcgcagauggagaagaucccccugcuccacaucuccagcugcgaccagaacaucuccgagaaggaccugcuggacaccgagaacaagcgcaagaaggacuuccucaccagcgagaacucccugccccggaucagcucccugcccaagagcgagaagccccucaacgaggagaccguggugaacaagcgcgacgaggagcagcaccuggagucccacacggacugcauccuggccgucaagcaggccaucagcggcaccagccccguggccuccagcuuccaggggaucaagaaguccaucuuccggauccgcgagagcccgaaggagaccuucaacgccuccuucagcggccacaugaccgaccccaacuucaagaaggagacggaggcguccgagagcgggcucgagauccacaccgugugcucccagaaggaggacagccugugccccaaccugaucgacaacggcuccuggcccgccaccaccacgcagaacagcgucgcccucaagaacgccggccugaucuccacccugaagaagaagaccaacaaguucaucuacgccauccacgacgagaccagcuacaaggggaagaagaucccgaaggaccagaaguccgagcucaucaacugcagcgcgcaguucgaggccaacgccuucgaggcgccccucaccuucgccaacgcggacuccggccugcuccacagcuccgugaagcggagcugcagccagaacgacuccgaggagcccacgcugagccugaccuccagcuucgggaccauccugcgcaagugcucccggaacgagaccugcagcaacaacacggugaucucccaggaccucgacuacaaggaggccaagugcaacaaggagaagcugcagcuguucaucacccccgaggccgacagccucuccugccugcaggagggccagugcgagaacgaccccaagagcaagaaggucuccgacaucaaggaggaggugcuggccgcggccugccaccccgugcagcacagcaaggucgaguacuccgacaccgacuuccagagccagaagucccuccuguacgaccacgagaacgccagcacccugauccucacgcccaccuccaaggacgugcugagcaaccuggugaugaucucccgcgggaaggagagcuacaagaugagcgacaagcucaagggcaacaacuacgaguccgacgucgagcugaccaagaacauccccauggagaagaaccaggacgugugcgcccugaacgagaacuacaagaacguggagcuccugccgcccgagaaguacaugcgcgucgccagccccucccggaaggugcaguucaaccagaacaccaaccugcgcgugauccagaagaaccaggaggagacgaccagcaucuccaagaucaccgucaaccccgacagcgaggagcuguucuccgacaacgagaacaacuucguguuccagguggcgaacgagcggaacaaccuggcccugggcaacaccaaggagcuccacgagacggaccugaccugcgucaacgagccgaucuucaagaacagcaccauggugcuguacggggacaccggcgacaagcaggccacccagguguccaucaagaaggaccucgucuacgugcuggccgaggagaacaagaacagcgugaagcagcacaucaagaugacccuggggcaggaccucaaguccgacaucagccugaacaucgacaagauccccgagaagaacaacgacuacaugaacaagugggccggccugcucgggcccaucuccaaccacagcuucggcggcuccuuccgcaccgcgagcaacaaggagaucaagcuguccgagcacaacaucaagaaguccaagauguucuucaaggacaucgaggagcaguaccccaccagccuggccugcgucgagaucgugaacacgcucgcccuggacaaccagaagaagcugagcaagccgcagagcaucaacaccguguccgcccaccuccagagcuccgucguggugagcgacugcaagaacucccacaucacgccccagaugcuguucagcaagcaggacuucaacuccaaccacaaccugacccccagccagaaggccgagaucacggagcucuccaccauccuggaggagagcgggucccaguucgaguucacccaguuccggaagcccagcuacauccugcagaaguccaccuucgaggucccggagaaccagaugacgauccucaagaccaccagcgaggagugccgcgacgcggaccugcacgugaucaugaacgcccccuccaucggccagguggacagcuccaagcaguucgaggggaccgucgagaucaagcggaaguucgccggccugcucaagaacgacugcaacaagagcgccuccggguaccugacggacgagaacgaggugggcuuccgcggcuucuacagcgcgcacgggaccaagcugaacgugagcaccgaggcccuccagaaggccgucaagcuguucuccgacaucgagaacaucagcgaggagaccuccgccgaggugcaccccaucagccuguccagcuccaagugccacgacagcguggucuccauguucaagaucgagaaccacaacgacaagaccgugagcgagaagaacaacaagugccagcucauccugcagaacaacaucgagaugacgaccggcaccuucguggaggagaucaccgagaacuacaagcggaacacggagaacgaggacaacaaguacaccgccgcgucccgcaacagccacaaccuggaguucgacggguccgacagcuccaagaacgacaccgucugcauccacaaggacgagaccgaccuccuguucacggaccagcacaacaucugccugaagcucagcggccaguucaugaaggagggcaacacccagaucaaggaggaccuguccgaccugaccuuccucgagguggccaaggcccaggaggccugccacgggaacaccagcaacaaggagcagcugacggccaccaagaccgagcagaacaucaaggacuucgagaccuccgacacguucuuccagaccgcgagcggcaagaacaucagcguggccaaggaguccuucaacaagaucgucaacuucuucgaccagaagccggaggagcugcacaacuucagccucaacuccgagcugcacagcgacauccggaagaacaagauggacauccuguccuacgaggagaccgacaucgugaagcacaagauccucaaggagagcguccccguggggaccggcaaccagcuggugacguuccaggggcagcccgagcgcgacgagaagaucaaggagcccacccugcucggcuuccacaccgccuccggcaagaaggucaagaucgccaaggagagccuggacaaggugaagaaccuguucgacgagaaggagcaggggaccuccgagaucacgagcuucucccaccagugggccaagacccucaaguaccgggaggcgugcaaggaccuggagcuggccugcgagaccaucgagaucaccgccgccccgaagugcaaggagaugcagaacagccucaacaacgacaagaaccugguguccaucgagacggucgugccgcccaagcugcucagcgacaaccugugccgccagaccgagaaccugaagaccuccaagagcaucuuccucaaggugaagguccacgagaacguggagaaggagaccgcgaagucccccgccacgugcuacaccaaccagagcccguacagcgugaucgagaacuccgcccuggccuucuacaccagcugcucccggaagaccagcgucucccagacgagccugcucgaggccaagaaguggcugcgcgagggcaucuucgacgggcagcccgagcggaucaacaccgcggacuacgugggcaacuaccuguacgagaacaacuccaacagcaccaucgccgagaacgacaagaaccaccucuccgagaagcaggacaccuaccugagcaacuccagcauguccaacagcuacuccuaccacagcgacgagguguacaacgacuccggguaccugagcaagaacaagcucgacuccggcaucgagcccguccugaagaacguggaggaccagaagaacaccagcuucagcaaggugaucuccaacgucaaggacgccaacgccuacccccagacggugaacgaggacaucugcguggaggagcuggucaccagcuccagcccgugcaagaacaagaacgccgcgaucaagcucuccaucagcaacuccaacaacuucgagguggggccgcccgccuuccgcaucgccagcgggaagaucgugugcgucucccacgagaccaucaagaaggugaaggacaucuucaccgacagcuucuccaaggugaucaaggagaacaacgagaacaagagcaagaucugccagacgaagaucauggccggcugcuacgaggcccuggacgacuccgaggacauccugcacaacagccuggacaacgacgagugcuccacccacagccacaaggucuucgcggacauccaguccgaggagauccuccagcacaaccagaacaugagcgggcuggagaagguguccaagaucagccccugcgacgugagccuggagaccuccgacaucugcaagugcagcaucggcaagcuccacaaguccgucagcuccgccaacacgugcgggaucuucagcacggccuccggcaagagcguccagguguccgacgccagccugcagaacgcccggcaggucuucuccgagaucgaggacagcaccaagcaggucuucuccaaggugcuguucaagagcaacgagcacuccgaccagcucacccgcgaggagaacaccgcgauccgcacgccggagcaccugaucagccagaagggcuucuccuacaacgucgugaacagcuccgccuucagcggguucagcaccgccuccggcaagcaggucagcauccuggaguccagccuccacaaggucaagggggugcuggaggaguucgaccugauccggaccgagcacucccuccacuacagccccaccucccgccagaacgugagcaagauccugccccgggucgacaagcgcaaccccgagcacugcgugaacuccgagauggagaagacgugcagcaaggaguucaagcuguccaacaaccucaacguggagggcgggagcuccgagaacaaccacagcaucaaggucuccccguaccugagccaguuccagcaggacaagcagcagcuggugcucggcaccaaggugucccuggucgagaacauccacgugcugggcaaggagcaggccagccccaagaacgugaagauggagaucgggaagaccgagaccuucuccgacguccccgugaagacgaacaucgaggucugcagcaccuacagcaaggacuccgagaacuacuucgagaccgaggcgguggagaucgccaaggccuucauggaggacgacgagcucaccgacagcaagcugcccucccacgccacgcacagccuguucacgugcccggagaacgaggagauggugcucuccaacagccggaucggcaagcgccgcggggagccccugauccuggucggcgagcccuccaucaagcgcaaccuccugaacgaguucgaccggaucaucgagaaccaggagaagucccugaaggccuccaagagcacccccgacggcaccaucaaggaccgccgccucuucaugcaccacgugucccuggagccgaucacgugcgugcccuuccgcaccaccaaggagcggcaggagauccagaaccccaacuucaccgcgccggggcaggaguuccugagcaagucccaccucuacgagcaccugacgcuggagaaguccuccagcaaccucgccgucuccggccaccccuucuaccaggugagcgccacccgcaacgagaagaugcggcaccugaucaccaccgggcgccccacgaagguguucgugccgcccuucaagaccaagucccacuuccaccggguggagcagugcgugcgcaacaucaaccuggaggagaaccggcagaagcagaacaucgacggccacgggagcgacgacagcaagaacaagaucaacgacaacgagauccaccaguucaacaagaacaacuccaaccaggccgccgcggucaccuucaccaagugcgaggaggagccccucgaccugaucacgagccugcagaacgcccgcgacauccaggacaugcggaucaagaagaagcagcgccagcgcguguucccccagcccggcucccucuaccuggccaagaccagcacccugccgcggaucucccucaaggccgccgugggcgggcagguccccagcgcgugcucccacaagcagcuguacaccuacggcgugagcaagcacugcaucaagaucaacuccaagaacgccgagagcuuccaguuccacaccgaggacuacuucgggaaggagucccuguggacgggcaaggggauccagcucgccgacggcggcuggcugauccccagcaacgacgggaaggccggcaaggaggaguucuaccgcgcgcugugcgacacccccgggguggacccgaagcucaucucccggaucugggucuacaaccacuaccgcuggaucaucuggaagcuggccgccauggagugcgccuuccccaaggaguucgccaaccggugccugagccccgagcgcgugcuccugcagcugaaguaccgguacgacaccgagaucgaccgcucccggcgcagcgcgaucaagaagaucauggagcgggacgacaccgccgccaagacgcucgugcugugcgucuccgacaucaucagccugagcgccaacaucuccgagaccagcuccaacaagaccagcuccgccgacacccagaagguggcgaucaucgagcucacggacggcugguacgccgugaaggcccagcuggacccgccccugcucgccguccugaagaacgggcgccugaccgugggccagaagaucauccuccacggcgccgagcugguggggagccccgacgcgugcacgccccuggaggcccccgagucccucaugcugaagaucagcgccaacuccacccggcccgcccgcugguacacgaagcugggcuucuuccccgacccccggcccuucccgcucccccugagcucccuguucagcgacgggggcaacgucggcugcguggacgugaucauccagcgcgcguaccccauccaguggauggagaagaccuccagcgggcucuacaucuuccggaacgagcgcgaggaggagaaggaggccgccaaguacgucgaggcccagcagaagcggcuggaggcccuguucaccaagauccaggaggaguucgaggagcacgaggagaacaccacgaagcccuaccucccgucccgcgcgcugacccgccagcagguccgggcccugcaggacggcgccgagcucuacgaggccgugaagaacgccgcggaccccgccuaccuggagggguacuucagcgaggagcagcugcgcgcccucaacaaccaccggcagaugcugaacgacaagaagcaggcccagauccagcuggagauccgcaaggccauggaguccgcggagcagaaggagcagggccucagccgggacgucaccaccguguggaagcugcgcaucguguccuacagcaagaaggagaaggacagcgucauccuguccaucuggcggcccagcuccgaccucuacagccugcugacggaggggaagcgcuaccggaucuaccaccucgccaccuccaagagcaaguccaagagcgagcgcgccaacauccagcuggccgccaccaagaagacccaguaccagcagcugccgguguccgacgagauccucuuccagaucuaccagccccgggagccccugcacuucagcaaguuccuggaccccgacuuccagccguccugcagcgagguggaccucaucggcuucgucguguccguggucaagaagacgggccuggcgcccuucguguaccugagcgacgagugcuacaaccugcucgccaucaaguucuggaucgaccugaacgaggacaucaucaagccccacaugcugaucgccgccuccaaccuccaguggcgccccgagagcaaguccgggcugcugacccucuucgcgggcgacuucagcguguucuccgccagcccgaaggaggggcacuuccaggagaccuucaacaagaugaagaacaccgucgagaacaucgacauccugugcaacgaggccgagaacaagcugaugcacauccuccacgccaacgaccccaaguggagcacgcccaccaaggacugcaccuccggccccuacaccgcccagaucaucccggggacgggcaacaagcugcugaugagcucccccaacugcgagaucuacuaccagagcccccucucccugugcauggcgaagcgcaagagcguguccacccccgugagcgcccagaugaccuccaagagcugcaagggcgagaaggagaucgacgaccagaagaacugcaagaagcgccgggcccuggacuuccucucccgccugccgcugccgccgcccgucagcccgaucugcaccuucgugucccccgccgcccagaaggcguuccagccgccccggagcugcgggacgaaguacgagaccccgaucaagaagaaggagcucaacagcccccagaugacccccuucaagaaguucaacgagaucagccugcuggaguccaacagcaucgccgacgaggagcucgcccugaucaacacccaggcccugcucuccggcagcaccggggagaagcaguucaucagcguguccgagagcacgcgcaccgccccgaccuccagcgaggacuaccugcggcugaagcgccggugcaccacgucccucaucaaggagcaggagagcucccaggcgagcaccgaggagugcgagaagaacaagcaggacaccaucaccacgaagaaguacaucuga

SEQ ID NO: 27343 - RNA, 876 nt, Artificial Sequence
  derived and/or modified sequence opt1 from BRCC3__Homo_sapiens__NP_001018065
auggccgugcaggucgugcaggccgugcaggcgguccaccuggagagcgacgccuuccucgugugccugaaccacgcccuguccaccgagaaggaggaggugaugggccucugcaucggggagcugaacgacgacacccgcagcgacuccaaguucgccuacacgggcaccgagaugcggaccgucgccgagaagguggacgcggugcgcaucguccacauccacagcgugaucauccugcggcgcuccgacaagcggaaggaccgcguggagaucagccccgagcagcucuccgccgccagcaccgaggccgagcggcuggcggagcugacggggcgcccgaugcgggucgugggcugguaccacucccacccccacaucaccguguggcccagccacgucgacgugcgcacccaggccauguaccagaugauggaccagggguucgugggccucaucuucuccugcuucaucgaggacaagaacaccaagacgggccggguccuguacacgugcuuccagagcauccaggcccagaaguccagcgaguacgagcgcaucgagauccccauccacaucgugccgcacgugaccaucgggaaggucugccuggaguccgccguggagcuccccaagauccugugccaggaggagcaggacgccuaccggcgcauccacagccugacccaccucgacuccgugaccaagauccacaacggcagcgucuucaccaagaaccugugcucccagaugagcgcggugagcgggccccugcuccaguggcuggaggaccggcuggagcagaaccagcagcaccuccaggagcugcagcaggagaaggaggagcugaugcaggagcucuccagccuggaguga

SEQ ID NO: 27344 - RNA, 3570 nt, Artificial Sequence
  derived and/or modified sequence opt1 from BRD1__Homo_sapiens__NP_001291737
augcgccggaagggccgcugccaccgggggagcgccgcccgccaccccuccagcccgugcuccgugaagcacagccccacccgggagacccugacguacgcgcaggcccagcgcauggucgagaucgagaucgagggccggcuccaccgcaucuccaucuucgacccccuggagaucauccuggaggacgaccucaccgcccaggagaugagcgagugcaacuccaacaaggagaacagcgagcggcccccggugugccugcgcaccaagcggcacaagaacaaccgcgugaagaagaagaacgaggcccugcccuccgcccacgggacccccgcgagcgccuccgcccuccccgagccgaagguccggaucguggaguacagcccgcccuccgcgccccgccggccgcccguguacuacaaguucaucgagaaguccgccgaggagcuggacaacgaggucgaguacgacauggacgaggaggacuacgccuggcuggagaucgugaacgagaagcgcaagggcgacugcgugcccgccgucucccagagcauguucgaguuccucauggaccgguucgagaaggagucccacugcgagaaccagaagcagggggagcagcagagccugaucgacgaggacgccgugugcugcaucugcauggacggcgagugccagaacuccaacgugauccuguucugcgacaugugcaaccucgccguccaccaggagugcuacggcgugcccuacauccccgaggggcaguggcugugccgccacugccugcagagccgggcgcgccccgccgacugcgugcucugccccaacaagggcggggccuucaagaagacggacgacgaccgguggggccacgucgugugcgcccuguggauccccgaggugggguucgccaacaccgucuucaucgagccgaucgacggcgugcgcaacaucccgcccgcgcgcuggaagcugaccugcuaccucugcaagcagaagggcgugggggccugcauccagugccacaaggccaacugcuacaccgccuuccacgucacgugcgcccagaaggcgggccuguacaugaagauggagcccgugaaggagcugaccgggggcggcaccaccuucagcgugcggaagacggccuacugcgacguccacaccccgcccgggugcacccgccggccccucaacaucuacggcgacguggagaugaagaacggggucugccgcaaggagagcagcgugaagaccgugcgguccacgagcaagguccgcaagaaggccaagaaggccaagaaggcccuggcggagcccugcgccgugcugcccaccgugugcgcccccuacaucccgccccagcggcucaaccgcaucgccaaccaggucgcgauccagcggaagaagcaguucguggagcgcgcccacuccuacuggcugcugaagcggcucagccgcaacggcgcgccccugcugcggcgccuccaguccagccugcagucccagcggagcucccagcagcgcgagaacgacgaggagaugaaggccgccaaggagaagcugaaguacuggcagcggcuccgccacgaccuggagcgggcccgccugcucaucgagcugcugcgcaagcgggagaagcucaagcgcgagcaggucaagguggagcaggucgccauggagcugcggcugacgccccucaccgugcugcugcgcagcgugcucgaccagcugcaggacaaggaccccgcccggaucuucgcccagccggugucccugaaggaggugcccgacuaccucgaccacaucaagcaccccauggacuucgccaccaugcgcaagcggcuggaggcgcagggguacaagaaccugcacgaguucgaggaggacuucgaccugaucaucgacaacugcaugaaguacaacgcccgcgacaccgucuucuaccgggccgccgugcgccuccgggaccagggcggcgugguccugcgccaggcccggcgcgagguggacagcaucgggcuggaggaggcguccggcaugcaccuccccgagcggccggccgccgcgccccgccggcccuucagcugggaggacguggaccgccugcuggaccccgccaaccgggcccaccucgggcuggaggagcagcugcgcgagcuccuggacaugcuggaccugaccugcgccaugaaguccagcggcucccggagcaagcgcgccaagcuccugaagaaggagaucgcccuccugcgcaacaagcugagccagcagcacucccagccgcuccccaccgggcccggccuggagggcuucgaggaggacggggcggcccugggccccgaggccggggaggagggcgacaagagcccgcccaagcucgagcccuccgacgcccugccccugccgagcaacuccgagacgaacagcgagccgcccacccucaagcccgucgagcugaaccccgagcaguccaagcuguucaagcgggugaccuucgacaacgagagccacuccgccugcacccagagcgcgcucguguccgggcgcccgcccgagcccacgcgggccagcuccggcgacguccccgccgccgccgcgagcgccguggccgagcccgccuccgacgugaaccgccggaccagcguccuguucugcaaguccaagagcgugagcccgcccaaguccgcgaagaacaccgagacccagcccacgagcccccagcugggcaccaagaccuuccucuccgugguccugccccgccuggagacccuccugcagccgcggaagcgcagccgguccacgugcggggacagcgagguggaggaggagucccccggcaagcgccuggacgccgggcucaccaacggcuucggcggggcccggagcgagcaggagcccggcgggggccuggggcgcaaggccacgccccggcgccggugcgccuccgagagcuccaucagcuccagcaacuccccgcugugcgacagcuccuucaacgcgcccaagugcggccgcggcaagcccgcccucgugcggcgccacacccuggaggaccggagcgagcugaucuccugcaucgagaacgggaacuacgccaaggccgcccgcaucgcggccgaggucggccagagcagcauguggaucuccaccgacgccgccgccagcgugcucgagccccugaagguggucugggcgaagugcuccggguacccgagcuaccccgcccugaucaucgaccccaagaugccccgcgugccgggccaccacaacggggugaccauccccgccccgccccucgacguccugaagaucggcgagcacaugcagaccaaguccgacgagaagcuguuccucgugcuguucuucgacaacaagcggagcuggcaguggcugcccaaguccaagauggugccccucggcaucgacgagaccaucgacaagcugaagaugauggaggggcgcaacagcuccauccggaaggccguccgcaucgccuucgaccgggcgaugaaccaccugagccgcgugcacggcgagcccaccuccgaccucagcgacaucgacuga

SEQ ID NO: 27345 - RNA, 2406 nt, Artificial Sequence
  derived and/or modified sequence opt1 from BRD2__Homo_sapiens__NP_001106653
augcugcagaacgugacgccccacaacaagcuccccggcgaggggaacgccggccugcuggggcucggccccgaggccgcggcccccgggaagcgcauccggaagcccagccugcuguacgagggcuucgaguccccgaccauggccagcguccccgcccuccagcugacccccgccaacccgcccccgcccgagguguccaaccccaagaagcccggccgcgugaccaaccagcugcaguaccuccacaaggucgugaugaaggcgcuguggaagcaccaguucgccuggcccuuccggcagcccguggacgccgucaagcuggggcuccccgacuaccacaagaucaucaagcagccgauggacaugggcaccaucaagcgccggcuggagaacaacuacuacugggccgcgagcgagugcaugcaggacuucaacaccauguucacgaacugcuacaucuacaacaagcccaccgacgacaucgugcugauggcccagacccucgagaagaucuuccugcagaagguggccuccaugccccaggaggagcaggagcuggucgugaccauccccaagaacagccacaagaagggggccaagcucgccgcgcugcagggcuccgugacgagcgcccaccaggucccggccguguccagcgugucccacaccgcccuguacacgcccccgcccgagauccccaccaccguccucaacaucccccaccccagcgugaucuccagcccccugcugaagucccuccacagcgccgggccgccccugcuggcggugaccgccgcgcccccggcccagccccucgccaagaagaagggcgucaagcgcaaggccgacaccaccacgcccacccccaccgccauccuggccccgggcucccccgccagcccgcccgggucccuggagcccaaggccgcgcggcucccgcccaugcgccgggagagcggccgccccaucaagccgccccggaaggaccugcccgacagccagcagcagcaccaguccagcaagaaggggaagcuguccgagcagcucaagcacugcaacggcauccugaaggagcugcucagcaagaagcacgccgccuacgccuggcccuucuacaagcccguggacgcguccgcccugggccugcacgacuaccacgacaucaucaagcaccccauggaccucagcaccgugaagcgcaagauggagaaccgggacuaccgcgacgcccaggaguucgccgccgacguccggcugauguucuccaacugcuacaaguacaacccgcccgaccacgacgugguggcgauggcccgcaagcugcaggacgucuucgaguuccgguacgccaagaugcccgacgagccccucgagcccgggccccugccggugagcacggccaugccgcccggccuggccaaguccagcuccgagagcuccagcgaggaguccagcuccgagagcuccagcgaggaggaggaggaggaggacgaggaggacgaggaggaggaggagagcgaguccagcgacuccgaggaggagcgcgcgcaccggcucgccgagcugcaggagcagcugcgcgccguccacgagcagcucgccgcccugagccaggggcccaucuccaagcccaagcggaagcgcgagaagaaggagaagaagaagaagcgcaaggcggagaagcaccggggccgcgccggggccgacgaggacgacaagggcccccgggcgccccgcccgccccagcccaagaaguccaagaaggccagcggcagcgggggcggguccgccgcccugggccccagcggguucggcccguccggcgggagcggcaccaagcugcccaagaaggccaccaagaccgccccgcccgcgcuccccacgggguacgacuccgaggaggaggaggagagccggcccauguccuacgacgagaagcgccagcugagccuggacaucaacaagcuccccggcgagaagcuggggcggguggugcacaucauccaggcccgcgagcccucccugcgggacagcaacccggaggagaucgagaucgacuucgagacccucaagcccagcacccugcgcgagcuggagcgguacguccucuccugccugcgcaagaagccccggaagcccuacaccaucaagaagccggugggcaagacgaaggaggagcuggcccucgagaagaagcgcgagcuggagaagcggcugcaggacgugagcggccagcucaacuccaccaagaagccgcccaagaaggccaacgagaagaccgagagcuccagcgcccagcaggucgcggugucccgccugagcgccuccagcuccagcuccgacagcuccagcuccagcuccagcagcuccagcuccgacaccagcgacuccgacagcggguga

SEQ ID NO: 27346 - RNA, 2181 nt, Artificial Sequence
  derived and/or modified sequence opt1 from BRD3__Homo_sapiens__NP_031397
augagcaccgccaccacgguggcccccgcgggcaucccggccacccccgggcccgucaaccccccgccccccgagguguccaaccccagcaagccgggccgcaagaccaaccagcugcaguacaugcagaacguggucgugaagacccucuggaagcaccaguucgccuggcccuucuaccagcccguggacgccaucaagcugaaccugcccgacuaccacaagaucaucaagaacccgauggacauggggacgaucaagaagcggcucgagaacaacuacuacugguccgccagcgagugcaugcaggacuucaacaccauguucaccaacugcuacaucuacaacaagcccaccgacgacaucguccugauggcgcaggcccuggagaagaucuuccuccagaagguggcccagaugccccaggaggagguggagcugcugcccccggcccccaagggcaaggggcgcaagcccgcggccggcgcccaguccgccggcacgcagcaggucgccgcggugagcuccgugagccccgccaccccguuccaguccgucccccccaccgugagccagacccccgugaucgccgccacgccgguccccaccaucaccgccaacgugaccuccgugcccguccccccggcggccgccccccccccgcccgccacgcccaucgugcccguggucccgcccaccccccccguggugaagaagaagggggucaagcggaaggccgacaccaccacgccgaccaccagcgcgaucaccgccucccgcagcgaguccccccccccccucagcgacccgaagcaggccaagguggucgcccggcgcgaguccggcgggcggcccaucaagccccccaagaaggaccuggaggacggcgaggugccgcagcacgccgggaagaagggcaagcugagcgagcaccuccgcuacugcgacuccauccugcgggagaugcugagcaagaagcacgcggccuacgccuggcccuucuacaagcccguggacgccgaggcgcucgagcugcacgacuaccacgacaucaucaagcaccccauggaccugagcacggucaagcgcaagauggacggccgggaguacccggacgcccagggguucgccgccgacgugcgccucauguucuccaacugcuacaaguacaacccccccgaccacgagguggucgccauggcgcggaagcugcaggacguguucgagaugcgcuucgccaagaugcccgacgagccgguggaggcccccgcccugcccgccccggcggcccccauggucagcaagggcgccgaguccagccgguccagcgaggaguccagcuccgacagcggguccagcgacuccgaggaggagcgcgccacccggcucgccgagcugcaggagcagcugaaggcggugcacgagcagcucgccgcccugagccaggcccccgugaacaagcccaagaagaagaaggagaagaaggagaaggagaagaagaagaaggacaaggagaaggagaaggagaagcacaaggucaaggcggaggaggagaagaaggccaagguggccccgcccgccaagcaggcccagcagaagaaggcgcccgccaagaaggccaacuccaccaccacggccggccgccagcugaagaagggcgggaagcaggccagcgcguccuacgacagcgaggaggaggaggagggccuccccauguccuacgacgagaagcggcagcugagccuggacaucaaccgccucccgggggagaagcugggccgggugguccacaucauccagagccgcgagcccucccugcgcgacagcaaccccgacgagaucgagaucgacuucgagacccucaagcccaccacccugcgggagcuggagcgcuacgugaaguccugccuccagaagaagcagcggaagccguucagcgccuccgggaagaagcaggccgccaagagcaaggaggagcuggcccaggagaagaagaaggagcuggagaagcgccuccaggacguguccggccagcugagcuccagcaagaagcccgcgcggaaggagaagcccggcuccgcccccagcgggggcccgucccgccugagcuccagcuccagcagcgaguccgggagcuccagcuccagcggcuccagcuccgacagcuccgacagcgaguga

SEQ ID NO: 27347 - RNA, 4089 nt, Artificial Sequence
  derived and/or modified sequence opt1 from BRD4__Homo_sapiens__XP_011526156
augagcgccgaguccggccccgggacccgccugcggaaccucccggugaugggcgacgggcuggagaccagccagauguccacgacccaggcccaggcgcagccccagcccgccaacgccgccagcaccaaccccccgccccccgagaccuccaaccccaacaagccgaagcgccagacgaaccagcugcaguaccuccugcgggucgugcugaagacccucuggaagcaccaguucgccuggcccuuccagcagcccguggacgcggucaagcugaaccugcccgacuacuacaagaucaucaagaccccgauggacaugggcaccaucaagaagcgccucgagaacaacuacuacuggaacgcccaggagugcauccaggacuucaacacgauguucaccaacugcuacaucuacaacaagcccggggacgacaucgugcugauggccgaggcccuggagaagcucuuccugcagaagaucaacgagcugcccaccgaggagaccgagaucaugaucgugcaggcgaagggccggggccgcgggcggaaggagacgggcaccgccaagcccggggucagcaccgugccgaacaccacgcaggccuccacccccccccagacccagaccccccagccgaaccccccccccgugcaggccacgccgcaccccuuccccgccgucacccccgaccucaucgugcagaccccggugaugaccgucgugcccccccagccgcugcagacgcccccccccgugccgccccagccccagcccccgcccgcgcccgccccccagccgguccagagccacccccccaucaucgccgccaccccccagccggugaagaccaagaagggcgugaagcgcaaggccgacaccacgacccccaccaccaucgaccccauccacgagcccccgucccugccccccgagcccaagacgaccaagcucgggcagcggcgcgagagcucccggccggucaagccccccaagaaggacgugccggacagccagcagcaccccgcgcccgagaaguccagcaagguguccgagcagcugaagugcugcagcggcauccugaaggagauguucgccaagaagcacgccgccuacgccuggcccuucuacaagccggucgacguggaggcgcucggccugcacgacuacugcgacaucaucaagcaccccauggacauguccaccaucaagagcaagcuggaggcccgcgaguaccgggacgcccaggaguucggggccgacgugcgccucauguucuccaacugcuacaaguacaacccccccgaccacgaggucguggccauggcgcggaagcugcaggacgucuucgagaugcgcuucgccaagaugccggacgagcccgaggagcccgugguggccgucagcagccccgccgugccgccccccaccaagguggucgcgcccccguccagcuccgacagcuccagcgacuccagcuccgacagcgacuccagcacggacgacuccgaggaggagcgggcccagcgccuggccgagcuccaggagcagcugaaggccgugcacgagcagcuggccgcgcucagccagccccagcagaacaagcccaagaagaaggagaaggacaagaaggagaagaagaaggagaagcacaagcggaaggaggagguggaggagaacaagaaguccaaggccaaggagcccccgcccaagaagaccaagaagaacaacagcuccaacagcaacgucuccaagaaggagcccgcccccaugaagagcaagccgccccccaccuacgagagcgaggaggaggacaagugcaagcccauguccuacgaggagaagcgccagcugagccuggacaucaacaagcucccgggcgagaagcuggggcggguggugcacaucauccagucccgcgagcccagccugaagaacuccaaccccgacgagaucgagaucgacuucgagacccucaagccgagcacccugcgcgagcuggagcgguacgucacguccugccuccgcaagaagcggaagccccaggccgagaagguggacgugaucgccggcagcuccaagaugaagggcuucagcuccagcgaguccgagagcuccagcgaguccagcagcuccgacagcgaggacuccgagaccgagauggcgcccaagagcaagaagaaggggcaccccggccgcgagcagaagaagcaccaccaccaccaccaccagcagaugcagcaggccccggcccccgucccccagcagcccccgccccccccccagcagccgcccccccccccgcccccccagcagcagcagcagcccccgcccccccccccgccccccuccaugccccagcaggccgccccggcgaugaagagcuccccccccccguucaucgccacccaggugcccgugcuggagccccagcugcccgggagcgucuucgacccgaucggccacuucacccagcccauccuccaccugccccagcccgagcugccgccccaccucccccagcccccggagcacuccacgcccccccaccugaaccagcacgccguggugagccccccggcccugcacaacgcgcucccccagcagcccucccggcccagcaaccgcgccgccgcccugccgcccaagcccgcccggcccccggcggucucccccgcccugacccagaccccccugcucccgcagccccccauggcccagcccccgcaggugcugcuggaggacgaggagccccccgcccccccgcucaccagcaugcagaugcagcuguaccugcagcagcuccagaaggugcagccccccacgccccugcugccguccgucaaggugcagagccagcccccccccccgcuccccccccccccgcaccccuccgugcagcagcagcugcagcagcagccccccccgcccccccccccgcagccccagcccccgccccagcagcagcaccagccccccccgcgccccguccaccugcagcccaugcaguucagcacccacauccagcagcccccgcccccccaggggcagcagcccccgcaccccccccccggccagcagccgccccccccccagccggccaagccccagcaggugauccagcaccaccacuccccccggcaccacaagagcgaccccuacagcaccggccaccuccgcgaggcgccguccccccugaugauccacagcccccagaugucccaguuccagagccugacccaccagucccccccgcagcagaacgugcagcccaagaagcaggagcuccgggccgccagcgucgugcagccccagccgcugguggucgugaaggaggagaagauccacucccccaucauccgcagcgagcccuucucccccagccugcggccggagccccccaagcaccccgaguccaucaaggccccggugcaccucccccagcgccccgagaugaagcccgucgacguggggcggccggugauccgcccccccgagcagaacgcccccccgcccggcgcgcccgacaaggacaagcagaagcaggagcccaagacgccggucgcccccaagaaggaccugaagaucaagaacauggggagcugggccucccuggugcagaagcaccccaccacccccagcuccaccgccaagagcuccagcgacuccuucgagcaguuccggcgcgcggcccgggagaaggaggagcgcgagaaggcccucaaggcccaggccgagcacgcggagaaggagaaggagcgccugcggcaggagcgcaugcggagccgcgaggacgaggacgcccuggagcaggcccggcgcgcccacgaggaggcccggcgccggcaggagcagcagcagcagcagcgccaggagcagcagcagcagcagcagcagcaggcggccgccguggccgccgcggccacgccgcaggcccagagcucccagccccagagcaugcucgaccagcagcgggagcuggcccgcaagcgggagcaggagcgccggcgccgggaggccauggcggccaccaucgacaugaacuuccaguccgaccugcucagcaucuucgaggagaaccuguucuga

SEQ ID NO: 27348 - RNA, 1959 nt, Artificial Sequence
  derived and/or modified sequence opt1 from BRD7__Homo_sapiens__NP_001167455
augggcaagaagcacaagaagcacaagagcgacaagcaccuguacgaggaguacguggagaagccccucaagcugguccugaaggucgggggcaacgaggugaccgagcucuccaccgggagcuccggccacgacagcucccuguucgaggacaagaacgaccacgacaagcacaaggaccgcaagcggaagaagcgcaagaagggggagaagcagaucccgggcgaggagaagggccggaagcgccggcgcgugaaggaggacaagaagaagcgggaccgcgaccggguggagaacgaggccgagaaggaccugcagugccacgcccccgugcgccucgaccugccgcccgagaagccccugacgagcucccucgcgaagcaggaggaggucgagcagacgccccugcaggaggcccugaaccagcucaugcggcagcugcagcgcaaggaccccagcgccuucuucuccuuccccgugaccgacuucaucgccccgggguacagcaugaucaucaagcaccccauggacuucuccaccaugaaggagaagaucaagaacaacgacuaccagagcaucgaggagcugaaggacaacuucaagcucaugugcaccaacgccaugaucuacaacaagcccgagaccaucuacuacaaggcggccaagaagcugcugcacuccggcaugaagauccucagccaggagcggauccagucccugaagcagagcaucgacuucauggccgaccugcagaagacccgcaagcagaaggacgggaccgacacgucccagagcggcgaggacgggggcugcuggcagcgggagcgcgaggacuccggcgacgccgaggcgcacgccuucaagagccccagcaaggagaacaagaagaaggacaaggacaugcucgaggacaaguucaaguccaacaaccuggagcgggagcaggagcagcuggaccgcaucgugaaggagagcgggggcaagcucacccggcgccuggucaacucccagugcgaguucgagcggcgcaagccggacgggaccaccacgcugggccuccugcaccccguggaccccaucgugggcgagcccggguacugcccgguccgccugggcaugaccaccgggcggcuccagagcggcgugaacacccugcagggguucaaggaggacaagcgcaacaaggugacgcccguccuguaccucaacuacggccccuacuccagcuacgcgccccacuacgacuccaccuucgccaacaucagcaaggacgacuccgaccugaucuacagcaccuacggcgaggacuccgaccugccgagcgacuucuccauccacgaguuccucgcgaccugccaggacuaccccuacgugauggccgacagccugcuggacgugcucacgaagggcgggcacucccggacccugcaggagauggagaugagccugcccgaggacgaggggcacacccgcacccucgacacggccaaggagauggagcagaucaccgaggucgagcccccgggccggcuggacuccagcacccaggaccgccugaucgcccucaaggccgugaccaacuucggggugcccgucgagguguucgacuccgaggaggccgagaucuuccagaagaagcuggacgagacgacccggcugcuccgcgagcugcaggaggcccagaacgagcggcugagcacccgcccgccgcccaacaugaucugccugcucggccccagcuaccgggagaugcaccuggccgagcaggucaccaacaaccugaaggagcucgcccagcaggucacgcccggcgacaucguguccaccuacggggugcgcaaggccaugggcaucagcauccccucccccgugauggagaacaacuucguggaccugaccgaggacaccgaggagcccaagaagacggacgucgccgagugcgggcccggcgggagcuga

SEQ ID NO: 27349 - RNA, 2601 nt, Artificial Sequence
  derived and/or modified sequence opt1 from BRD8__Homo_sapiens__NP_001157798
auggccaccggcaccgggaagcacaagcugcucagcacgggccccaccgagccgugguccauccgcgagaagcugugccuggccagcuccgugaugcggagcggggaccagaacugggucuccgugagccgcgcgaucaagcccuucgccgagcccggccggcccccggacugguucucccagaagcacugcgccagccaguacuccgagcuccuggagaccaccgagacgcccaagcgcaagcgcggggagaagggcgagguggucgagaccguggaggacgugaucguccggaagcugaccgccgagcggguggaggagcucaagaaggugaucaaggagacccaggagcgcuaccggcgccugaagcgggacgccgagcugauccaggcgggccacauggacagccgccucgacgagcugugcaacgacaucgccacgaagaagaagcuggaggaggaggaggccgaggucaagcggaaggccaccgacgcggccuaccaggcccgccaggccgugaagaccccgccccggcgccuccccaccgugaugguccggucccccaucgacagcgccucccccgggggcgacuacccccugggggaccugacgccgaccaccauggaggaggcgaccagcggcgugacgcccgggacccuccccuccacccccgugaccagcuucccgggcauccccgacacgcugccgcccggcuccgcgccccuggaggcccccaugacccccgucaccgacgacagcccccagaagaagaugcucgggcagaaggccaccccgccgcccagcccccugcuguccgagcuccugaagaagggcagccugcuccccacgagcccccgccuggugaacgaguccgagauggccguggccuccgggcaccugaacagcaccggcguccuccuggaggugggcggggugcugcccaugauccacggcggggagauccagcagaccccgaacaccgucgccgccucccccgccgccagcgugucccagcccgacaacugcgugcccauggaggcggucggcgacccgcacacggugaccgucagcauggacuccagcgagaucuccaugaucaucaacagcaucaaggaggagugcuuccgguccgggguggccgaggcccccgugggcagcaaggcccccuccaucgacggcaaggaggagcucgaccuggccgagaagauggacaucgcggucagcuacaccggggaggagcuggacuucgagaccgugggcgacaucaucgccaucaucgaggacaagguggacgaccaccccgagguccucgacguggccgccguggaggcggcccuguccuucugcgaggagaacgacgacccgcagagccugcccgggcccugggagcaccccauccagcaggagcgcgacaagccggucccccuccccgcccccgagaugacggugaagcaggagcggcuggacuucgaggagaccgagaacaagggcauccacgagcugguggacauccgcgagccguccgccgagaucaaggucgagcccgccgagcccgagcccgugaucagcggggcggagaucguggccggcgucgugccggccaccagcauggagccgcccgagcuccgcucccaggaccuggacgaggagcugggcagcaccgccgccggggagaucguggaggcggacgucgccaucggcaagggggacgagacgccccucaccaacgugaagaccgaggccucccccgagagcaugcugucccccagccacggcuccaaccccaucgaggacccgcuggaggccgagacccagcacaaguucgagaugagcgacucccucaaggaggagagcgggaccaucuucggcucccagaucaaggacgcccccggcgaggacgaggaggaggacggggugagcgaggcggccucccuggaggagcccaaggaggaggaccagggcgagggguaccugagcgagauggacaacgagcccccggucuccgagagcgacgacggcuucuccauccacaacgccacgcuccagagccacacccuggccgacagcauccccuccagccccgcguccagccaguucuccgugugcagcgaggaccaggaggccauccaggcccagaagaucuggaagaaggccaucaugcugguguggcgggccgcggccaaccaccgcuacgccaacgucuuccugcagcccgugaccgacgacaucgccccgggcuaccacuccaucgugcagcggcccauggaccucagcaccaucaagaagaacaucgagaacgggcugauccgcuccacggccgaguuccagcgggacaucaugcugauguuccagaacgcggucauguacaacagcuccgaccacgacguguaccacauggccguggagaugcagcgcgacguccucgagcagauccagcaguuccuggccacccagcugaucaugcagaccagcgaguccggcaucagcgccaagucccuccgggggcgcgacagcacccggaagcaggacgccuccgagaaggacggcgggacgcgcggccggcgcugcgcgaucgaggccgacaugaagaugaagaaguga

SEQ ID NO: 27350 - RNA, 1248 nt, Artificial Sequence
  derived and/or modified sequence opt1 from BRE__Homo_sapiens__NP_004890
augagccccgagguggcccugaaccgcaucucccccaugcucagccccuucaucuccagcguggugcggaacggcaagguggggcuggacgccaccaacugccugcgcaucaccgaccucaaguccggcugcacgagccugacccccgggcccaacugcgaccgguucaagcugcacaucccguacgcgggcgagacccucaagugggacaucaucuucaacgcccaguaccccgagcugccgcccgacuucaucuucggggaggacgccgaguuccugcccgaccccuccgcccuccagaaccuggccagcuggaaccccuccaaccccgagugccugcuccuggucgugaaggagcuggugcagcaguaccaccaguuccagugcagccgccuccgggaguccagccgccugauguucgaguaccagacccugcucgaggagccgcaguacggcgagaacauggagaucuacgcgggcaagaagaacaacuggacgggggaguucuccgcccgguuccugcugaagcuccccgucgacuucagcaacauccccaccuaccugcugaaggacgugaacgaggaccccggcgaggacguggcccuccuguccgucagcuucgaggacaccgaggccacccagguguacccgaagcuguaccucagcccccgcaucgagcacgcgcucgggggcuccuccgcccugcacauccccgccuuccccgggggcggcugccugaucgacuacgugccgcaggucugccaccuccugacgaacaaggugcaguacgugauccagggguaccacaagcggcgcgaguacaucgccgccuuccugagccacuucggcaccggggucguggaguacgacgcggagggcuucaccaagcugacccugcuccugauguggaaggacuucugcuuccuggugcacaucgaccucccccuguucuucccccgggaccagcccacgcugaccuuccagagcgucuaccacuucaccaacuccggccagcucuacagccaggcccagaagaacuacccguacagcccccgcugggacgggaacgagauggccaagcgggccaagggcugccaggggucccgcgacgccugcucccccugggagcagguccuggcguucgccguggccaagaccggcugcaagcugcuccagccccagcggaacuggccgagcucccgcgggccgcccuggcgggccagcgagggcgagcgcacggcccaguga

SEQ ID NO: 27351 - RNA, 1755 nt, Artificial Sequence
  derived and/or modified sequence opt1 from BRF1__Homo_sapiens__NP_001229715
auggccgugagccgccaccugacccggggccgcaagauggcccacgucaucgcggccugccucuaccuggugugccggaccgaggggacgccccacaugcugcucgaccuguccgaccugcuccaggugaacgucuacgugcugggcaagaccuuccugcuccuggcccgcgagcugugcaucaacgccccggccaucgaccccugccucuacaucccccgguucgcgcaccuccuggaguucggggagaagaaccacgaggugagcaugaccgcccugcgccugcugcagcggaugaagcgcgacuggaugcacaccggccggcgccccuccgggcucugcggcgccgcccugcuggucgcggcccggaugcacgacuuccgccggacggugaaggaggugaucagcgucgugaaggugugcgaguccacccuccgcaagcggcugaccgaguucgaggacaccccgacgagccagcugaccaucgacgaguucaugaagaucgaccucgaggaggagugcgacccgcccuccuacaccgccggccagcgcaagcugcggaugaagcagcuggagcagguccucagcaagaagcuggaggagguggagggggagaucuccagcuaccaggacgccaucgagaucgagcuggagaacucccgccccaaggccaagggcgggcucgcgagccuggccaaggacggcuccaccgaggacacggccagcucccugugcggggaggaggacaccgaggacgaggagcucgaggccgccgcgagccaccugaacaaggaccuguaccgggagcuccugggcggcgcccccggguccagcgaggccgccggcucccccgaguggggcgggcgcccgcccgcccugggcagccuccuggacccccugcccaccgcggccagccucgggaucuccgacagcauccgggagugcaucuccagccaguccagcgaccccaaggacgccuccggcgacggggagcuggaccugagcggcaucgacgaccucgagaucgaccgccgcgaccuguccaugccccggugcgccaaggccaagagccagccgcacuuccccgugcuggcgcaguacauccucaacgaguccgaggcccgcgucaaggccgagcuguggaugcgggagaacgccgaguaccugcgcgagcagcgggagaaggaggcgcgcaucgccaaggagaaggagcuggggaucuacaaggagcacaagcccaagaaguccugcaagcggcgcgagcccauccaggccagcaccgcccgggaggccaucgagaagaugcucgagcagaagaagaucagcuccaagaucaacuacagcgugcugcgcggccuguccagcgcgggcgggggcuccccgcaccgggaggacgcccagcccgagcacagcgccagcgcccgcaagcucucccggcgccggacgcccgccagccgcuccggggcggaccccgugaccagcgucggcaagcggcugcgcccgcugguguccacccagcccgccaagaagguggccaccggggaggcccuccugcccagcucccccacgcugggcgccgagccggcgcggccccaggccguccucguggagagcggccccguguccuaccacgccgacgaggaggccgacgaggaggagccggacgaggaggacggggagcccugcgucagcgcgcugcagaugaugggcuccaacgacuacgggugcgacggcgacgaggacgacggguacuga

SEQ ID NO: 27352 - RNA, 1260 nt, Artificial Sequence
  derived and/or modified sequence opt1 from BRF2__Homo_sapiens__NP_060780
augcccggccgcgggcggugccccgacugcggcagcaccgagcugguggaggacucccacuacagccagucccagcuggucugcagcgacugcgggugcguggugaccgagggcguccugaccaccaccuucuccgacgaggggaaccugcgcgaggugaccuacagccgguccacgggcgagaacgagcaggucagccgcucccagcagcggggccuccgccgggugcgcgaccugugccgggugcugcagcucccgcccaccuucgaggacaccgccguggccuacuaccagcaggcguaccgccacagcgggauccgggccgcccgccugcagaagaaggagguccuggugggcugcugcgugcucaucacgugccggcagcacaacuggccccugaccaugggggccaucugcacccugcucuacgccgaccuggacgucuucuccagcaccuacaugcagaucgugaagcugcucggccuggacgugcccucccugugccucgcggagcuggucaagaccuacugcagcuccuucaagcuguuccaggccagccccuccgugcccgccaaguacguggaggacaaggagaagaugcucagccgcacgaugcagcuggucgagcuggccaacgagaccuggcucgugaccgggcggcacccccugccggugaucaccgcggccacguuccuggccuggcagucccuccagcccgccgaccgccugagcugcagccuggcccgguucugcaagcucgcgaacgucgaccugcccuaccccgccuccagccgccugcaggagcuccuggccgugcugcuccggauggccgagcagcuggccuggcugcgcgugcuccggcuggacaagcgcuccgucgugaagcacaucggcgaccugcuccagcaccgccagagccugguccgguccgcguuccgcgacggcaccgccgagguggagacccgggagaaggagccgcccggguggggccaggggcagggcgagggcgagguggggaacaacagccugggccucccccaggggaagcgccccgccuccccggcccugcugcucccgcccugcaugcucaagagccccaagcggaucugccccgucccgcccguguccaccgugacgggcgacgagaacaucagcgacuccgagaucgagcaguaccugcgcacgccccaggagguccgggacuuccagcgcgcccaggcggcccggcaggccgccaccagcgugcccaacccgcccuga

SEQ ID NO: 27353 - RNA, 756 nt, Artificial Sequence
  derived and/or modified sequence opt1 from BRI3BP__Homo_sapiens__NP_542193
augggcgcccgcgccagcgggggcccccuggcgcgggccgggcuccugcugcuccugcugcuccugcugcuccugggccugcucgccccgggggcccagggcgcccgcggccgcgggggcgcggagaagaacuccuaccggcggaccgugaacaccuucagccaguccgucagcucccuguucggggaggacaacgugcgcgccgcccagaaguuccuggcccggcucacggagcgcuucgugcugggcgucgacauguucguggagacccuguggaagguguggaccgagcuccuggacguccuggggcucgacgugagcaaccugucccaguacuucagccccgcguccgugagcuccagccccgcccgggcccugcuccuggucggcguggugcugcucgccuacugguuccugucccugacccucggcuucacguucagcguccugcacgugguguucgggcgcuucuucuggaucguccggguggugcuguucuccaugagcugcgucuacauccuccacaaguacgagggcgagcccgagaacgccgugcugccgcugugcuucguggucgcgguguacuucaugaccgggcccaugggcuucuacuggcgcuccagccccuccggccccagcaacccgagcaaccccuccguggaggagaagcucgagcaccuggagaagcagguccggcugcucaacauccgccugaaccgggugcuggagagccucgaccgcuccaaggacaaguga

SEQ ID NO: 27354 - RNA, 297 nt, Artificial Sequence
  derived and/or modified sequence opt1 from BRI3__Homo_sapiens__NP_001152963
auggaccacaagccccugcuccaggagcgcccgcccgccuacaaccuggaggccggccagggggacuacgcgugcggcccccacggguacggcgccauccccgccgccccgcccccgccgcccuaccccuaccuggugaccgggauccccacccaccacccccgggucuacaacauccacagccgcacggugacccgguaccccgccaacuccaucguggucgugggcggcugccccgugugccgccaccagcggagcuccuggcucuacaccuacccccugcgcgucugcaccuga

SEQ ID NO: 27355 - RNA, 2286 nt, Artificial Sequence
  derived and/or modified sequence opt1 from BRINP1__Homo_sapiens__NP_055433
augaacuggcgcuucguggagcugcucuacuuccuguucaucuggggccggaucagcguccagcccucccaccaggagccggccgggaccgaccagcacgugagcaaggaguucgacuggcugaucuccgaccgcggccccuuccaccacagccgguccuaccucagcuucguggagcgccaccggcagggguucaccacgcgcuacaagaucuaccgggaguucgcccgcuggaagguccggaacaccgcgaucgagcgccgggaccuggugcgccaccccgugccccugaugccggaguuccagcgguccauccgccuccugggccggcgccccaccacccagcaguucaucgacacgaucaucaagaaguacgggacccaccuccucaucagcgccacccugggcggcgaggaggcccugaccauguacauggacaagucccggcucgaccgcaagagcgggaacgccacgcaguccgucgaggcccugcaccagcuggcgagcuccuacuucguggaccgggacggcaccaugcgccggcuccacgagauccagaucagcaccggggccaucaaggugaccgagacgcgcaccggcccccuggggugcaacuccuacgacaaccuggacagcgucuccagcgugcuccugcaguccaccgagagcaagcugcaccuccagggccugcagaucaucuucccccaguaccugcaggagaaguucgugcagagcgcccucuccuacaucaugugcaacggcgagggggaguaccugugccagaacagccagugccgcugccagugcgccgaggaguucccgcagugcaacugccccaucaccgacauccagaucauggaguacacgcuggcgaacauggccaaguccugggccgaggccuacaaggaccucgagaacagcgacgaguucaaguccuucaugaagcggcugcccagcaaccacuuccugaccaucggcuccauccaccagcacugggggaacgacugggaccuccagaaccgcuacaagcugcugcagagcgccaccgaggcgcagcggcagaagauccagcgcaccgcccggaagcuguucggccuguccguccgcugccggcacaaccccaaccaccagcugccgcgcgagcggacgauccagcaguggcucgcccgcgugcagagccugcuguacugcaacgagaacggcuucugggggaccuuccucgagucccagcggagcugcgugugccacggcuccaccacccugugccagcgccccauccccugcgucaucgggggcaacaacagcugcgccaugugcucccuggccaacaucagccucugcggguccugcaacaagggcuacaagcuguaccggggccgcugcgagccccagaacguggacagcgagcgguccgagcaguucaucagcuucgagacggaccuggacuuccaggaccucgagcugaaguaccugcuccagaagauggacagccgccuguacgugcacaccaccuucaucuccaacgagauccggcuggacaccuucuucgacccgcgcuggcggaagcgcaugagccugacgcucaaguccaacaagaaccgcauggacuucauccacauggucaucgggaugagcaugcggaucugccagaugcgcaacuccagccuggaccccauguucuucguguacgugaaccccuucuccggcagccacuccgagggguggaacaugcccuucggcgaguucggguacccgcggugggagaagauccgccugcagaacagccagugcuacaacuggacccuccugcugggcaaccgguggaagaccuucuucgagaccguccacaucuaccuccgcucccggacgcgccugcccacccugcuccggaacgagaccggccaggggcccguggaccugagcgaccccuccaagcgccaguucuacaucaagaucagcgacgugcaggucuucggcuacucccugcgguucaacgcggaccuccugcgcagcgccgugcagcaggucaaccaguccuacacccagggcgggcaguucuacagcagcuccagcgugaugcugcuccugcuggacauccgggaccgcaucaaccggcucgccccgcccguggcccccgggaagccccagcuggaccuguucuccugcaugcucaagcaccgccugaagcugacgaacagcgagaucauccgggucaaccacgcccucgaccuguacaacaccgagauccugaagcaguccgaccagaugaccgcgaagcucugcuga

SEQ ID NO: 27356 - RNA, 2352 nt, Artificial Sequence
  derived and/or modified sequence opt1 from BRINP2__Homo_sapiens__NP_066988
augcgcuggcagugcggcacccgguuccgcgggcugcggcccgccguggccccguggaccgcgcuccuggcccugggccuccccggguggguccuggccgugagcgccacggccgcggccgugguccccgagcagcacgccuccguggccggccagcacccccuggacuggcuccugaccgaccgcgggccguuccaccgggcgcaggaguacgccgacuucauggagcgcuaccggcagggcuucaccacccgcuaccggaucuaccgcgaguucgcccgguggaaggugaacaaccuggcccucgagcgcaaggacuucuucagccugccccugccccucgcccccgaguucauccggaacauccgccugcugggccggcgcccgaaccuccagcaggucacggagaaccugaucaagaaguacgggacccacuuccugcucuccgcgacccugggcggggaggagagccugaccaucuucguggacaagcagaagcucggccggaagacggagaccaccgggggcgccuccaucaucggcgggagcggcaacuccaccgccgugagccuggagacgcugcaccagcucgccgccuccuacuucaucgaccgcgagagcacccugcggcgccugcaccacauccagaucgcgaccggggccaucaaggucaccgagacgcggaccggcccccucggcugcuccaacuacgacaaccuggacagcguguccagcgugcugguccagucccccgagaacaaggugcagcuccuggggcuccaggugcugcugcccgaguaccugcgcgagcgcuucgucgccgccgcccucagcuacaucacgugcuccagcgagggcgagcuggugugcaaggagaacgacugcuggugcaagugcuccccgaccuuccccgagugcaacugccccgacgcggacauccaggccauggaggacagccugcuccagauccaggacagcugggccacccacaaccggcaguucgaggaguccgaggaguuccaggcccugcugaagcgccuccccgacgaccgguuccugaacagcaccgccaucucccaguucugggcgauggacaccagccugcagcaccgcuaccagcagcucggggccggccugaaggugcuguucaagaagacccaccggauccuccgccggcuguucaaccugugcaagcgcugccaccggcagccgcgcuuccggcugcccaaggagcgcucccucagcuacugguggaaccggauccagucccugcuguacugcggggagagcacguuccccggcaccuuccucgagcagucccacagcugcacgugccccuacgaccaguccagcugccagggcccgauccccugcgcccugggggagggccccgccugcgcgcacugcgcccccgacaacuccacccgcugcgggagcugcaacccgggcuacguccuggcccaggggcucugccggcccgagguggccgagucccuggagaacuuccugggccucgagaccgaccugcaggaccuggagcucaaguaccugcugcagaagcaggacagccgcaucgaggugcacuccaucuucaucagcaacgacaugcggcucggcuccugguucgaccccagcuggcgcaagcggaugcugcugacccucaagagcaacaaguacaagcccgggcugguccacgugaugcuggcccucucccugcagaucugccugaccaagaacagcacccucgagccggugauggcgaucuacgucaaccccuucggcgggucccacagcgaguccugguucaugcccgugaacgagggcagcuucccggacugggagcgcacgaacgucgacgccgccgcccagugccagaacuggaccaucacccuggggaaccgcuggaagaccuucuucgagacggugcacguguaccugcggucccgcaucaagagccucgacgacuccagcaacgagaccaucuacuacgagccccuggagaugaccgaccccuccaagaaccugggcuacaugaagaucaacacccuccaggucuucggcuacagccugcccuucgacccggacgccauccgggaccugauccuccagcuggacuaccccuacacccaggggucccaggacagcgcgcugcuccagcugaucgagcugcgcgaccgggugaaccagcucuccccgcccggcaaggugcgccuggaccuguucagcugccuccugcggcaccgccugaagcucgccaacaacgaggucgggcggauccaguccagccugcgcgccuucaacagcaagcugcccaaccccguggaguacgagacgggcaagcucugcuccuga

SEQ ID NO: 27357 - RNA, 2301 nt, Artificial Sequence
  derived and/or modified sequence opt1 from BRINP3__Homo_sapiens__NP_950252
augaucuggcgcagccgggccggcgccgagcuguucucccucauggcgcugugggaguggaucgcccugagccuccacugcugggugcuggccgucgccgccguguccgaccagcacgcgaccagccccuucgacuggcugcucuccgacaaggggccguuccaccgcagccaggaguacaccgacuucguggaccggucccgccagggcuucagcacgcgguacaagaucuaccgcgaguucgggcgguggaaggucaacaaccuggccguggagcgccggaacuuccugggcagcccccucccccuggcccccgaguucuuccgcaacauccggcugcucgggcgccggccgacccugcagcagaucaccgagaaccugaucaagaaguacggcacccacuuccuccuguccgccacgcugggcggggaggagucccucaccaucuucguggacaagcgcaagcugagcaagcgggcggagggcuccgacagcaccaccaacuccagcuccgucacgcuggagacccuccaccagcuggccgccagcuacuucaucgaccgcgacuccacccugcggcgccuccaccacauccagaucgccagcaccgccaucaaggugacggagacccggaccgggccccugggcugcagcaacuacgacaaccuggacuccgugagcuccguccucgugcagagccccgagaacaagauccagcugcaggggcuccaggugcuccugcccgacuaccugcaggagcgcuucguccaggcggcccucuccuacaucgccugcaacagcgagggcgaguucaucugcaaggagaacgacugcuggugccacugcggcccgaaguuccccgagugcaacugccccuccauggacauccaggccauggaggagaaccugcugcggaucaccgagacguggaaggccuacaacagcgacuucgaggaguccgacgaguucaagcuguucaugaagcgccugcccaugaacuacuuccugaacaccagcaccaucaugcaccucuggaccauggacuccaacuuccagcgccgguacgagcagcuggagaacagcaugaagcagcuguuccucaaggcgcagaagaucgugcacaagcuguucucccugagcaagcgcugccacaagcagccgcucaucucccugccccggcagcgcacgagcaccuacuggcugacccggauccaguccuuccucuacugcaacgagaacgggcugcugggcagcuucuccgaggagacccacagcugcacgugccccaacgaccagguggucugcaccgccuuccugcccugcaccgugggggacgccagcgccugccugaccugcgccccggacaaccgcacgcggugcgggaccugcaacaccggcuacaugcugucccagggccugugcaagcccgagguggcggagagcaccgaccacuacaucggcuucgagacggaccuccaggaccuggagaugaaguaccugcuccagaagaccgaccgccggaucgagguccacgccaucuucaucuccaacgacaugcgccugaacagcugguucgaccccuccuggcggaagcgcaugcugcucacccucaagagcaacaaguacaaguccagccuggugcacaugauccucgggcugucccugcagaucugccucaccaagaacagcacgcuggagcccgugcuggccgucuacgugaacccguucggcgggucccacagcgaguccugguucaugcccgugaacgagaacagcuuccccgacugggagcggaccaagcucgaccugccccugcagugcuacaacuggacccucacccugggcaacaaguggaagaccuucuucgagacgguccacaucuaccugcgcucccggaucaagagcaacggcccgaacgggaacgaguccaucuacuacgagccccucgaguucaucgaccccagccgcaaccugggcuacaugaagaucaacaacauccagguguucggguacagcaugcacuucgaccccgaggccauccgggaccugauccuccagcuggacuacccguacacccagggcucccaggacagcgcccugcuccagcugcuggagauccgcgaccgggucaacaagcucuccccgcccgggcagcgccgccuggaccuguucagcugccuccugcggcaccgccugaagcucuccaccagcgagguggugcggauccaguccgcgcugcaggccuucaacgccaagcugcccaacaccauggacuacgacacgaccaagcucugcagcuga

SEQ ID NO: 27358 - RNA, 3750 nt, Artificial Sequence
  derived and/or modified sequence opt1 from BRIP1__Homo_sapiens__NP_114432
augagcuccauguggagcgaguacaccaucggcggggugaagaucuacuuccccuacaaggccuacccgucccagcuggccaugaugaacagcauccuccgcggccugaacuccaagcagcacugccugcucgagagccccaccggguccggcaagagccuggcgcugcucugcuccgcccuggccuggcagcagagccuguccgggaagcccgccgacgagggcgucagcgagaaggccgaggugcagcucuccugcugcugcgcgugccacagcaaggacuucacgaacaacgacaugaaccagggcaccucccggcacuucaacuaccccagcaccccgcccuccgagcgcaacgggaccagcuccacgugccaggacagccccgagaagaccacccuggccgccaagcugagcgccaagaagcaggcguccaucuaccgggacgagaacgacgacuuccagguggagaagaagcgcauccggccccucgagaccacgcagcagauccgcaagcggcacugcuucggcaccgagguccacaaccuggacgccaagguggacagcgggaagaccgugaagcugaacuccccgcucgagaagaucaacagcuucagcccccagaagccgcccggccacugcagccgcugcugcugcuccaccaagcaggggaacagccaggaguccagcaacacgaucaagaaggaccacaccggcaaguccaagauccccaagaucuacuucggcacccggacccacaagcagaucgcccagaucacgcgcgagcugcggcgcaccgccuacagcgggguccccaugaccauccuguccagccgggaccacacgugcgugcaccccgagguggucggcaacuucaaccgcaacgagaagugcauggagcuccuggacgggaagaacggcaaguccugcuacuucuaccacggcgugcacaagaucagcgaccagcacacccugcagaccuuccaggggaugugcaaggccugggacaucgaggagcucgugucccugggcaagaagcugaaggcgugccccuacuacaccgcccgggagcucauccaggacgccgacaucaucuucugcccguacaacuaccugcuggacgcccagauccgcgagagcauggaccucaaccugaaggagcaggucgugauccuggacgaggcccacaacaucgaggacugcgcgcgggaguccgccagcuacagcgugaccgagguccagcuccgcuucgcccgggacgagcuggacuccauggugaacaacaacauccgcaagaaggaccacgagccccugcgggccgugugcugcagccucaucaacuggcuggaggccaacgcggaguaccuggucgagcgcgacuacgaguccgccugcaagaucuggagcgggaacgagaugcuccugacgcugcacaagaugggcaucaccaccgccaccuuccccauccuccaggggcacuucuccgccgugcugcagaaggaggagaagaucagccccaucuacggcaaggaggaggcccgcgaggugccggucaucuccgcgagcacgcagaucaugcugaagggccucuucauggugcuggacuaccuguuccggcagaacucccgcuucgccgacgacuacaagaucgccauccagcagaccuacagcuggaccaaccagaucgacaucuccgacaagaacgggcuccuggugcugcccaagaacaagaagcggagccgccagaagaccgccguccacgugcucaacuucuggugccugaaccccgcggucgccuucuccgacaucaacggcaaggugcagacgaucgugcugaccagcgggacccugucccccaugaaguccuucuccagcgagcucggcgucaccuucacgauccagcuggaggccaaccacaucaucaagaacagccagguguggguggggaccaucggcuccggcccgaaggggcggaaccugugcgccaccuuccagaacaccgagaccuucgaguuccaggacgaggucggcgcccuccugcugagcgugugccagacggugucccaggggauccucugcuuccugcccagcuacaagcugcucgagaagcugaaggagcgcuggcuguccaccggccucuggcacaaccuggagcuggucaagaccgugaucguggagccccagggcggggagaagaccaacuucgacgagcuccugcaggucuacuacgacgcgaucaaguacaagggcgagaaggacggggcccugcucguggccgugugccggggcaaggucagcgaggggcuggacuucuccgacgacaacgcccgcgccgugaucacgaucggcauccccuucccgaacgugaaggaccugcaggucgagcucaagcggcaguacaacgaccaccacagcaagcugcgcggccugcuccccgggcggcagugguacgagauccaggcguaccgcgcccugaaccaggcccugggccggugcauccgccaccggaacgacuggggcgcccucauccugguggacgaccgcuuccggaacaaccccucccgcuacaucagcgggcuguccaagugggugcggcagcagauccagcaccacagcaccuucgaguccgcccucgagagccuggcggaguucuccaagaagcaccagaagguccugaacgugagcaucaaggaccgcaccaacauccaggacaacgaguccacccucgaggugacgagccugaaguacuccaccagcccguaccugcucgaggccgccagccaccugucccccgagaacuucgucgaggacgaggccaagaucugcgugcaggagcugcagugccccaagaucaucaccaagaacagcccccucccguccagcaucaucucccgcaaggagaagaacgaccccguguuccuggaggaggcggggaaggccgagaagaucgucaucagccgguccaccagccccacguucaacaagcagaccaagcgcguguccuggagcuccuucaacagccugggccaguacuucaccggcaagauccccaaggccaccccggagcucggguccagcgagaacuccgccagcuccccgccccgguucaagacggagaagauggagagcaagaccgugcugcccuucaccgacaagugcgaguccagcaaccugaccgucaacacgagcuucggcuccugcccccagagcgagaccaucaucuccagccucaagaucgacgccacccugacccgcaagaaccacuccgagcacccccugugcagcgaggaggcgcucgaccccgacaucgagcugucccuggugagcgaggaggacaagcaguccacgagcaaccgggacuucgagaccgaggccgaggacgaguccaucuacuucacccccgagcucuacgacccggaggacaccgacgaggagaagaacgaccuggccgagacggaccgcgggaaccggcuggccaacaacagcgacugcauccucgccaaggaccuguucgagauccgcaccaucaaggagguggacuccgcgcgggaggucaaggccgaggacugcaucgacaccaagcugaacggcauccuccacaucgaggagagcaagaucgacgacaucgacgggaacgugaagaccacguggaucaacgagcuggagcugggcaagacccacgagaucgagaucaagaacuucaagcccucccccagcaagaacaagggcauguuccccggguucaaguga

SEQ ID NO: 27359 - RNA, 228 nt, Artificial Sequence
  derived and/or modified sequence opt1 from BRK1__Homo_sapiens__NP_060932
auggccggccaggaggaccccgugcagcgcgagauccaccaggacugggccaaccgggaguacaucgagaucaucaccagcuccaucaagaagaucgcggacuuccugaacagcuucgacauguccugccgcagccggcucgccacccugaacgagaagcugacggcccucgagcgccggaucgaguacaucgaggcccgcgucaccaagggggagacccugaccuga

SEQ ID NO: 27360 - RNA, 873 nt, Artificial Sequence
  derived and/or modified sequence opt1 from BRMS1__Homo_sapiens__NP_001020128
augcccgugcagccgcccagcaaggacaccgaggagauggaggccgagggcgacuccgccgcggagaugaacggggaggaggaggagagcgaggaggagcgcuccggcagccagaccgaguccgaggaggagagcuccgagauggacgacgaggacuacgagcggcgccggagcgagugcgucuccgagaugcuggaccucgagaagcaguucagcgagcugaaggagaagcuguuccgcgagcggcucucccagcugcgccugcggcucgaggaggugggggccgagcgcgcccccgaguacacggagccccugggcgggcugcagcggagccucaagauccgcauccagguggccggcaucuacaagggcuucugccuggacgucauccggaacaaguacgagugcgagcugcagggggccaagcagcaccucgaguccgagaagcugcugcucuacgacacccugcagggcgagcugcaggagcgcauccagcggcucgaggaggaccgccagagccuggaccuguccagcgaguggugggacgacaagcuccacgcgcggggguccagccgcuccugggacagccugccgcccagcaagcggaagaaggcgccccugguguccggccccuacaucguguacaugcuccaggagaucgacauccuggaggacuggaccgccaucaagaaggcccgcgccgccgucagcccgcagaagcggaaguccgacgaccgccggacccaccgcccccugcgcgugugccccgcccggcuccuguggugcugcugggcccugccccuccaccuggcccuggcguggacgccgccccuccccagcucccgccccgcccagcuguggccguggagcuga

SEQ ID NO: 27361 - RNA, 972 nt, Artificial Sequence
  derived and/or modified sequence opt1 from BRMS1L__Homo_sapiens__NP_115728
augcccgugcacagccgcggcgacaagaaggagaccaaccaccacgacgagauggaggucgacuacgccgagaacgagggguccagcuccgaggacgaggacaccgagagcuccagcguguccgaggacggcgacagcuccgagauggacgacgaggacugcgagcggcgccggauggagugccuggacgagaugagcaaccucgagaagcaguucacggaccugaaggaccagcuguacaaggagcgccucucccagguggacgccaagcugcaggaggucaucgcggggaaggccccggaguaccuggagccccucgccacccugcaggagaacaugcagauccggaccaagguggccggcaucuaccgcgagcugugccucgagagcgugaagaacaaguacgagugcgagauccaggccucccggcagcacugcgagagcgagaagcugcugcucuacgacaccguccaguccgagcuggaggagaagauccgccggcuggaggaggaccgccacagcaucgacaucacguccgagcucuggaacgacgagcugcagagccggaagaagcgcaaggaccccuucucccccgacaagaagaagccggugguggucagcgggcccuacaucguguacaugcugcaggaccucgacauccuggaggacuggaccaccauccggaaggcgauggccacccugggcccccaccgcgugaagacggagcccccggucaagcucgagaagcaccuccacagcgcccgguccgaggagggccgccuguacuacgacggggagugguacauccggggccagaccaucugcaucgacaagaaggacgagugccccaccagcgccgugaucaccacgaucaaccacgacgaggugugguucaagcgccccgacggguccaagagcaagcuguacaucucccagcugcagaagggcaaguacagcaucaagcacuccuga

SEQ ID NO: 27362 - RNA, 1200 nt, Artificial Sequence
  derived and/or modified sequence opt1 from BRS3__Homo_sapiens__NP_001718
auggcccagcgccagccccacagcccgaaccagacccugaucuccaucaccaacgacacggagagcuccagcuccguggucagcaacgacaacaccaacaagggcugguccggggacaacagccccggcaucgaggcccucugcgcgaucuacaucaccuacgccgugaucaucuccguggggauccugggcaacgccauccugaucaaggucuucuucaagaccaagagcaugcagacggugcccaacaucuucaucaccucccucgccuucggggaccugcugcuccugcugaccugcgugcccgucgacgccacccacuaccucgcggagggcuggcuguucggccggaucgggugcaaggugcugagcuucauccgccucacguccgugggcgucagcguguucacccugaccauccuguccgccgaccgguacaaggccguggucaagccgcucgagcgccagcccagcaacgccauccugaagaccugcgugaaggcggggugcguguggaucgucuccaugaucuucgcccugcccgaggccaucuucagcaacguguacacguuccgggaccccaacaagaacaugaccuucgaguccugcaccagcuacccggugagcaagaagcuccugcaggagauccacucccugcucugcuuccuggucuucuacaucaucccccugagcaucaucuccguguacuacagccucaucgcccgcacccuguacaaguccacgcugaacauccccaccgaggagcagagccacgcccggaagcagaucgagucccgcaagcggaucgcgcgcaccgugcucguccugguggcccuguucgcccucugcuggcugcccaaccaccuccuguaccuguaccacagcuucaccucccagacguacguggacccgagcgccaugcacuucaucuucaccaucuucucccggguccuggccuucagcaacuccugcgugaaccccuucgcgcucuacuggcugagcaaguccuuccagaagcacuucaaggcccagcuguucugcugcaaggccgagcgccccgagcccccggucgccgacaccagccucaccacgcuggccgugaugggcaccgugcccgggaccggcuccauccagaugagcgagaucuccgucaccagcuucacgggcugcagcgugaagcaggcggaggaccgguucuga

SEQ ID NO: 27363 - RNA, 2337 nt, Artificial Sequence
  derived and/or modified sequence opt1 from BRSK1__Homo_sapiens__NP_115806
augagcuccggcgccaaggaggggggcgggggcagccccgccuaccaccugccgcacccccacccccaccccccgcagcacgcgcaguacguggggcccuaccgccucgagaagacccugggcaagggccagaccgggcuggucaagcucggcgugcacugcaucacggggcagaagguggccaucaagaucgucaaccgggagaagcuguccgagagcgugcugaugaagguggagcgcgagaucgccauccucaagcugaucgagcacccccacguccugaagcuccacgacguguacgagaacaagaaguaccuguaccuggugcucgagcacgucuccggcggggagcuguucgacuaccuggugaagaagggccggcucacccccaaggaggcccgcaaguucuuccggcagaucgugagcgcccuggacuucugccacuccuacagcaucugccaccgcgaccugaagccggagaaccuccugcuggacgagaagaacaacauccggaucgcggacuucggcauggccucccuccaggucggggacagccugcuggagaccuccugcggcagcccccacuacgccugccccgaggugaucaagggggagaaguacgacggccgccgggccgacaugugguccugcggcgugauccucuucgcgcugcuggucggggcccuccccuucgacgacgacaaccugcgccagcugcucgagaaggugaagcggggcguguuccacaugccgcacuucaucccccccgacugccagagccugcugcgcgggaugaucgaggucgagcccgagaagcggcucucccuggagcagauccagaagcacccgugguaccugggcgggaagcacgagcccgaccccugccucgagcccgccccgggccgccggguggccaugcgcagccugcccuccaacggcgagcuggaccccgacgugcucgagagcauggccucccuggggugcuuccgggaccgcgagcggcugcaccgcgagcuccggagcgaggaggagaaccaggagaagaugaucuacuaccugcugcucgaccgcaaggagcgcuaccccagcugcgaggaccaggaccugccgccccggaacgacgucgaccccccccgcaagcggguggacuccccgaugcugagccgccacggcaagcggcgccccgagcggaaguccauggaggugcucagcaucaccgacgcggggggcgggggcucccccgucccgacgcgccgggcccuggagauggcccagcacagccagcgcucccggagcguguccggcgccagcaccgggcuguccagcuccccccugagcuccccccgcagccccgucuucuccuucagcccggagcccggcgccggggacgaggcgcggggcgggggcucccccaccagcaagacccagacgcuccccagccgcggcccgcgggggggcggggccggcgagcagcccccccccccguccgcccgcagcaccccccugcccggccccccgggguccccccggagcuccggcgggaccccccugcacagcccccuccacaccccgcgcgccucccccacgggcacccccgggaccacccccccgcccagccccggcggcggggugggcggggccgcguggcggucccgccugaacagcauccgcaacuccuuccugggcagcccgcgguuccaccgccggaagaugcaggugcccacggccgaggagauguccagccucacccccgaguccagccccgagcuggccaagcgcuccugguucgggaacuucaucagccuggacaaggaggagcagaucuuccucguccugaaggacaagccgcugagcuccaucaaggccgacaucgugcacgccuuccucagcauccccucccugagccacuccgugcugagccagaccuccuuccgggcggaguacaaggccagcggcggccccuccgucuuccagaagcccgugcgcuuccagguggacaucagcuccagcgaggggccggagcccuccccccggcgcgacggcagcgggggcgggggcaucuacuccgucaccuucacgcucaucagcggccccucccggcgcuucaagcgggugguggagaccauccaggcccagcugcugagcacccacgaccagccguccguccaggcccucgcggacgagaagaacggggcccagacccgccccgccggcgcccccccccggagccugcagccgccccccgggcgccccgacccggagcugagcuccagcccccggcgcggcccccccaaggacaagaagcuccuggccacgaacgggaccccgcugcccuga

SEQ ID NO: 27364 - RNA, 2211 nt, Artificial Sequence
  derived and/or modified sequence opt1 from BRSK2__Homo_sapiens__NP_001243556
augaccagcaccggcaaggacgggggcgcccagcacgcccaguacguggggcccuaccgccuggagaagacgcucggcaaggggcagaccggccuggucaagcugggcgugcacugcgugaccugccagaaggucgcgaucaagaucgugaaccgggagaagcucuccgagagcgugcugaugaaggucgagcgcgagaucgccauccugaagcucaucgagcacccgcacgugcugaagcugcacgacguguacgagaacaagaaguaccucuaccugguccuggagcacguguccgggggcgagcuguucgacuaccuggugaagaaggggcggcugacccccaaggaggcccgcaaguucuuccggcagaucaucagcgcccucgacuucugccacucccacagcaucugccaccgcgaccugaagcccgagaaccugcuccuggacgagaagaacaacauccggaucgccgacuucggcauggcgucccugcaggucggggacagccuccuggagacguccugcggcagcccccacuacgccugcccggaggugauccgcggcgagaaguacgacgggcggaaggccgacgugugguccugcggcgucauccuguucgcccuccuggugggggcgcugcccuucgacgacgacaaccuccgccagcugcuggagaaggugaagcggggcgucuuccacaugccccacuucaucccgcccgacugccagagccuccugcgcggcaugaucgagguggacgccgcccggcgccugacccucgagcacauccagaagcacaucugguacaucgggggcaagaacgagcccgagcccgagcagcccaucccgcggaaggugcagauccgcucccugcccagccuggaggacaucgaccccgacguccucgacuccaugcacagccuggggugcuuccgggaccgcaacaagcugcuccaggaccugcuguccgaggaggagaaccaggagaagaugaucuacuuccuccugcuggaccggaaggagcgcuaccccagccaggaggacgaggaccucccgccccggaacgagaucgacccgccccgcaagcgcguggacucccccaugcugaaccggcacggcaagcgccggcccgagcgcaagagcauggaggugcugagcgucaccgacgggggcucccccgugcccgcccggcgcgccaucgagauggcgcagcacggccagcggagccgcuccaucagcggggccuccagcggccucuccaccagcccgcuguccagcccccgggucacgccccaccccuccccgcgcgggagcccccugcccaccccgaagggcacccccgugcacacccccaaggagucccccgccgggacgccgaaccccaccccgcccagcucccccagcgugggcggcguccccuggcgggcccgccugaacuccaucaagaacagcuuccucgggagcccccgguuccaccgccggaagcuccaggugcccaccccggaggagaugagcaaccugacccccgagagcucccccgagcucgccaagaaguccugguucggcaacuucaucucccuggagaaggaggagcagaucuucguggucaucaaggacaagccccugagcuccaucaaggcggacaucgugcacgccuuccucagcaucccgucccugagccacuccgugaucagccagacguccuuccgcgccgaguacaaggccaccgggggccccgccgucuuccagaagcccgugaaguuccagguggacaucaccuacaccgagggcggggaggcgcagaaggagaacggcaucuacagcgucacguucacccugcucuccgggcccagccggcgcuucaagcgggugguggagaccauccaggcccagcugcuguccacccacgacccgcccgccgcccagcaccucagcgacacgaccaacugcauggagaugaugaccggccgccuguccaagugcgggagcccccugagcaacuucuucgacgucaucaagcagcuguucuccgacgagaagaacggccaggccgcgcaggcccccagcaccccggccaagcgcuccgcccacggcccccucggggacagcgcggccgccggccccgggccgggcggggacgccgaguaccccacgggcaaggacaccgccaagaugggcccgcccaccgcgcggcgcgagcagcccuga

SEQ ID NO: 27365 - RNA, 363 nt, Artificial Sequence
  derived and/or modified sequence opt1 from BRWD1__Homo_sapiens__NP_001007247
auggccgagcccagcuccgcccgccggcccgugccccugaucgagagcgagcucuacuuccugaucgcgcgcuaccuguccgccggccccugccggcgcgccgcccagguccucgugcaggagcuggagcaguaccagcugcuccccaagcggcuggacugggaggggaacgagcacaaccgcagcuacgaggagcuggugcucuccaacaagcacgucgccccggaccaccuccugcagaucugccagcggaucggccccaugcuggacaaggagaucccgcccagcaucucccgcgugaccagccugcugggggcgggccggcagucccuccugcgcaccgccaaggggacgcugaucuga

SEQ ID NO: 27366 - RNA, 5409 nt, Artificial Sequence
  derived and/or modified sequence opt1 from BRWD3__Homo_sapiens__NP_694984
auggccgccgcgcccacgcagaucgaggccgagcuguacuaccugaucgcccgcuuccugcagagcggccccugcaacaagagcgcccaggugcuggugcaggagcucgaggagcaccagcugaucccccggcgccuggacugggaggggaaggagcaccggcgcagcuucgaggaccucguggccgcgaacgcccacaucccgcccgacuaccugcugaagaucugcgagcggaucggcccccuccuggacaaggagaucccccaguccgugcccgggguccagacccugcucggcguggggcgccagagccugcugcgggacgccaaggacugcaaguccacgcucuggaacggcagcgccuucgcggcccugcaccgcggccggccgcccgagcugcccgugaacuacgucaagccgcccaacguggugaacaucaccuccgcccgccagcucaccgggugcagccgguucggccacaucuuccccuccagcgccuaccagcacaucaagaugcacaagcgcauccuggggcaccuguccagcgucuacugcguggccuucgaccgguccggccgccggaucuucaccgggagcgacgacugccucgugaagaucugggcgacggacgacggccgccugcuggccacccuccggggccacuccgccgagaucagcgacauggccgucaacuacgagaacacccugaucgccgcgggguccugcgacaagguggugcgcgucuggugccugcggaccugcgcccccguggccgugcuccagggccacagcgccuccaucacgagcauccaguucugccccagcaccaaggggaccaaccgcuaccugaccuccacgggcgccgacggcaccaucugcuucuggcaguggcacgucaagaccaugaaguuccgggaccgccccgugaaguucaccgagcgcagccggcccggggugcagaucuccugcagcuccuucagcuccggcgggauguucaucacgaccggcagcaccgaccacgucauccgcaucuacuaccugggguccgaggugcccgagaagaucgcggagcucgagagccacaccgacaagguggucgccgugcaguucugcaacaacggcgacucccugcgguucgucagcggcucccgcgacgggacggcccggaucuggcaguaccagcagcaggaguggaaguccaucgugcuggacauggccaccaagaugaccggcaacaaccuccccuccggggaggacaagaucaccaagcugaaggugacgauggucgccugggaccgcuacgacaccaccgugaucaccgcggugaacaacuuccugcucaaggucuggaacagcaucacgggccagcugcugcacacccucuccgggcacgacgacgagguguucgugcuggaggcccaccccuucgaccagcggaucauccugagcgccggccacgacggcaacaucuucaucugggaccucgaccgcgggaccaagauccggaacuacuucaacaugaucgagggccaggggcacggcgccgucuucgacugcaaguucuccccggacgggaaccacuucgcgugcaccgacagccacggccaccuccuccuguucggcuucgggugcagcaaguacuacgagaagauccccgaccagauguucuuccacacggacuaccgcccccugauccgggacgccaacaacuacgugcuggacgagcagacccagcaggcgccccaccucaugccgccgcccuuccugguggacgucgacggcaacccccacccgaccaaguuccagcgccuggugcccgggcgggagaacugcaaggacgagcagcugaucccccagcucggcuacguggccaacggcgacggggaggucguggagcaggucaucggccagcagaccaacgaccaggacgaguccauccuggacgggaucauccgcgagcugcagcgggagcaggaccuccgccugaucaacgagggcgacgucccgcaccuccccgugaaccgggccuacagcgugaacggggcgcuccgcucccccaacauggacaucagcuccagccccaacauccggcugcgccgccacuccagccagaucgagggcguccggcagaugcacaacaacgccccgcgcucccagauggccacggagcgggaccugauggccuggagccgccgggugguggucaacgagcucaacaacggcgugucccgcgugcaggaggagugccggaccgccaagggggacaucgagaucagccuguacaccgucgagaagaagaagaagcccuccuacaccacccagcgcaacgacuacgagcccagcugcggccggucccugcgccggacgcagcgcaagcggcagcacaccuaccagacccgcagcaacaucgagcacaacucccaggcgagcugccagaacagcggggugcaggaggacuccgacagcuccagcgaggaggacgagaccgugggcacguccgacgccagcgucgaggaccccgugguggaguggcaguccgagagcuccagcuccgacagcuccagcgaguacuccgacuggaccgccgacgccgggaucaaccuccagccgcccaagcggcagacccgccagaccacgcggaagaucugcagcuccagcgacgaggagaaccugaagucccuggaggagcgccagaagaagcccaagcagacccggaagaagaagggcggccucgucagcaucgccggggagcccaacgaggagugguucgcgccgcaguggauccuggacaccaucccccgccggagccccuucgugccccagaugggcgacgagcugaucuacuuccgccaggggcacgaggccuacgugcgcgccguccggaaguccaagaucuacagcgugaaccuccagaagcagccguggaacaagauggaccugcgcgagcaggaguucgugaagaucgucggcaucaaguacgagguggggccgcccacccugugcugccucaagcuggccuuccuggaccccaucuccggcaagaugacgggcgagagcuucuccaucaaguaccacgacaugccggacgugaucgacuuccucguccugcaccaguucuacaacgaggcgaaggagcggaacuggcagaucggggaccgcuuccggagcaucaucgacgacgccuggugguucggcaccguggagucccagcagcccuuccagcccgaguaccccgacagcuccuuccagugcuacagcgugcacugggacaacaacgagcgcgagaagauguccccgugggacauggagcccauccccgaggggaccgccuucccggacgaggucggcgccggggugcccgugagccaggaggagcugaccgcccuccuguacaagccccaggagggcgaguggggcgcgcacucccgggacgaggagugcgagcgcgucauccaggggaucaaccaccuccugagccuggacuucgccucccccuucgccgugccgguggaccugagcgccuacccccuguacugcacggucguggccuaccccaccgaccugaacaccauccggcgccggcuggagaaccgcuucuaccggcgcaucuccgcgcucaugugggagguccgguacaucgagcacaacgcccgcaccuucaacgagcccgacagcccgaucgugaaggccgccaagaucgugacggacguccugcugcgguucaucggcgaccaguccugcaccgacauccucgacaccuacaacaagaucaaggccgaggagcgcaacagcaccgacgcggaggaggacacggagaucguggaccuggacagcgacgggcccggcaccuccagcggccggcgcgugaagugccgcgggcggcgccagucccugaagugcaaccccgacgccuggaagaagcagugcaaggagcuccugagccugaucuacgagcgggaggacuccgagcccuuccgccagccggccgaccuccugagcuaccccggccaccaggagcaggagggggaguccagcgaguccgucgugcccgagcggcagcaggacagcucccugagcgaggacuaccaggacgugaucgacacccccgucgacuucuccaccgugaaggagacgcucgaggccggcaacuacgggagcccgcuggaguucuacaaggacgugcgccagaucuucaacaacuccaaggcguacaccagcaacaagaagucccggaucuacagcaugaugcugcgccucuccgcccuguucgagagccacaucaagaacaucaucagcgaguacaaguccgccauccagagccagaagcggcgccggccccgcuaccggaagcgccugcgguccagcuccagcucccucagcuccagcggcgcccccucccccaagggcaagcagaagcagaugaagcugcagccgaagaacgaccagaacaccagcgucucccacgcccgcaccagcucccccuucagcucccccgugagcgacgcggccgaggggcugucccucuaccugcuggacgacgagcccgacggcccguucagcagcuccagcuucgggggcuacucccggagcgggaacucccacgaccccggcaaggccaagagcuuccgcaaccgggugcuccccgucaagcaggaccacucccuggacggcccccugacgaacggggacggccgcgagccgcggaccgggaucaagcgcaagcuccugagcgccuccgaggaggacgagaacaugggcggggaggacaaggagaagaaggagaccaaggagaagucccaccugagcaccagcgaguccggcgagcucggcagcucccugagcuccgagagcacgugcggguccgacagcgacagcgaguccaccagccgcaccgaccaggacuacguggacggcgaccacgacuacuccaaguucauccagacccggcccaagcgcaagcugcggaagcagcacgggaacggcaagcgcaacuggaagacccggggcaccgggggccgcgggcgguggggccgcugggggcgguggagccgcggcggccgggggcgcggcgggcggggccgcgggucccggggccgcggcgggggcgggacccggggccgcgggcggggccgcggcgggcgcggcgccagccgcggggccacccgggccaagcgggcccgcaucgccgacgacgaguucgacaccauguucuccggccgguucagccgccucccccggaucaagacgcgcaaccaggggcggcgcaccgugcuguacaacgacgacuccgacaacgacaacuucgucagcaccgaggacccgcugaaccucggcaccucccggagcggccgcgugcggaagaugacggagaaggcccgcgugucccaccugaugggguggaacuacuga

SEQ ID NO: 27367 - RNA, 1389 nt, Artificial Sequence
  derived and/or modified sequence opt1 from BSCL2__Homo_sapiens__NP_001116427
augagcaccgagaagguggaccagaaggaggaggccggcgagaaggaggucugcggggaccagaucaagggccccgacaaggaggaggagccgcccgccgcggccucccacgggcagggcuggcgccccgggggccgggccgcccgcaacgcccggcccgagccgggcgcgcgccaccccgcccugcccgccauggugaacgacccgcccgugcccgcccuccugugggcgcaggaggucggccaggugcuggccgggcgggcccgccggcuccugcugcaguucgggguccucuucugcaccauccugcugcuccugugggugagcguguuccuguacggcuccuucuacuacagcuacaugcccacggugucccaccucagccccguccacuucuacuaccgcaccgacugcgacuccagcaccaccucccugugcagcuucccgguggccaacgugucccugacgaagggcgggcgggaccgcguccucauguacggccagcccuaccgggugacccuggagcuggagcuccccgagagccccgugaaccaggaccuggggauguuccuggucaccaucuccugcuacacccgcggcgggcggaucaucagcacguccagccgcuccgugaugcuccacuaccggagcgaccugcugcagaugcucgacacccugguguucuccagccugcuccuguucggcuucgccgagcagaagcagcugcucgaggucgagcuguacgcggacuaccgcgagaacagcuacgugccgaccaccggcgccaucaucgagauccacuccaagcggauccagcuguacggggccuaccuccgcauccacgcccacuucacgggccugcgguaccugcucuacaacuuccccaugaccugcgccuucaucgggguggcgagcaacuucaccuuccuguccgucaucgugcuguucagcuacaugcaguggguguggggcgggaucuggccccgccaccgguucucccuccaggucaacauccgcaagcgcgacaacagccggaaggaggugcagcgccggaucuccgcccaccagcccggcccggagggccaggaggagagcacgccccaguccgacgucaccgaggacggggagagccccgaggaccccuccggcaccgaggggcagcugagcgaggaggagaagccggaccagcagccccuguccggcgaggaggagcucgagcccgaggccagcgacggguccggcagcugggaggacgccgcccugcugaccgaggcgaaccuccccgccccggcccccgccuccgccagcgcgcccgugcuggagacccugggcuccagcgagccggccgggggcgcccuccgccagcggcccacgugcagcuccagcuga

SEQ ID NO: 27368 - RNA, 1158 nt, Artificial Sequence
  derived and/or modified sequence opt1 from BSG__Homo_sapiens__NP_001719
auggccgccgcccuguucgugcugcugggcuucgcccugcucgggacccacggcgccagcggggccgccggcuucguccaggcgccccugucccagcagcgcugggucgggggcagcguggagcugcacugcgaggccgugggcuccccggugcccgagauccaguggugguucgaggggcagggccccaacgacacgugcagccagcucugggacggggcccggcuggaccgcgugcacauccacgccaccuaccaccagcacgcggccuccaccaucagcaucgacacccuggucgaggaggacaccggcacguacgagugccgggccuccaacgaccccgaccgcaaccaccucacccgggccccgcgcgugaagugggugcgggcccaggcggucgugcuggugcuggagcccgggaccgucuucaccacgguggaggaccucggcagcaagauccugcugaccugcucccucaacgacagcgccaccgaggugaccggccaccgcuggcugaagggcggggucgugcugaaggaggacgcccuccccgggcagaagacggaguucaagguggacuccgacgaccaguggggcgaguacagcugcgucuuccugcccgagccgaugggcaccgccaacauccagcugcacgggccgccccgggugaaggccgugaaguccagcgagcacaucaacgagggcgagaccgcgaugcucgucugcaaguccgagagcgugccgcccgugaccgacugggccugguacaagaucacggacuccgaggacaaggcccugaugaacgggagcgagucccgcuucuucgucagcagcucccagggccggagcgagcugcacaucgagaaccucaacauggaggccgaccccgggcaguaccgcugcaacggcaccuccagcaagggcuccgaccaggccaucaucacccugcgggugcgcagccaccuggcggcccucuggcccuuccuggggaucgucgccgaggugcuggugcucgucaccaucaucuucaucuacgagaagcggcgcaagcccgaggacgugcuggacgacgacgacgccggcuccgcgccccucaagagcuccgggcagcaccagaacgacaagggcaagaacgugcggcagcgcaacagcuccuga

SEQ ID NO: 27369 - RNA, 11781 nt, Artificial Sequence
  derived and/or modified sequence opt1 from BSN__Homo_sapiens__NP_003449
augggcaacgaggugagccuggaggggggcgccggggacggcccccucccgcccgggggcgccggccccgggcccggcccggggcccggccccggggcgggcaagcccccguccgcccccgccggcgggggccagcugcccgccgccggggcggcccgcagcaccgccguccccccggugcccggccccggccccgggccgggccccgggcccggccccggguccaccagccggcgccuggacccgaaggagccccucggcaaccagcgggccgcgucccccacgcccaagcaggccagcgccaccaccccgggccacgaguccccccgcgagacccgggcccaggggcccgccggccaggaggcggacgggccccgccggacgcugcagguggacagccgcacccagcgguccggccgcagcccguccgucagccccgaccggggguccacccccaccagcccguacuccgugccccagaucgccccccugcccagcuccacgcucugcccgaucugcaagaccagcgaccugaccuccacccccagccagcccaacuucaacacgugcacccagugccacaacaaggugugcaaccagugcggcuucaaccccaacccgcaccugacccaggucaaggaguggcucugccugaacugccagaugcagcgcgcccugggcauggacaugaccacggccccccggagcaagucccagcagcagcuccacagccccgcccugucccccgcgcacagcccggccaagcagccccuggggaagcccgaccaggagcgcucccggggccccgggggcccgcagcccgggagccgccaggccgagaccgcccgggccaccuccgugcccggccccgcgcaggccgccgccccgcccgaggugggccgcgucagcccccagcccccgcagcccaccaagcccuccacggccgagccgcggccccccgcgggggaggcccccgccaagagcgccaccgcggugccggccggccucggggccaccgagcagacccaggagggccugacgggcaagcuguucgggcucggcgccucccugcugacccaggccagcacccucauguccgugcagcccgaggcggacacccaggggcagcccgcccccagcaagggcacgccgaagaucgucuucaacgacgccuccaaggaggccgggcccaagccccugggcagcggccccgggccgggccccgcccccggggcgaagaccgagcccggcgcccgcauggggccgggcuccggccccggggcccugcccaagaccggcgggaccacgagccccaagcacggccgggccgagcaccaggccgcguccaaggccgccgccaagccgaagaccaugcccaaggagcgcgcgaucugcccccucugccaggccgagcugaacguggggagcaagagccccgccaacuacaacaccugcaccacgugccgccugcaggugugcaaccucugcggcuucaacccgaccccccaccuggucgagaagaccgaguggcugugccucaacugccagaccaagcggcugcuggagggcucccucggggagcccaccccccugccgccccccacgagccagcagccgcccgugggcgccccccaccgcgccuccgggaccagcccccugaagcagaagggcccgcaggggcucggccagcccuccggcccccugcccgcgaaggccagcccgcuguccaccaaggccagcccccuccccuccaaggccagcccccaggccaagccgcugcgggcguccgagcccagcaagacccccuccagcgugcaggagaagaagacgcgcguccccaccaaggccgagccgaugcccaagccccccccggagaccacccccacgcccgccacccccaaggugaaguccggggugcggcgcgccgagccggccacccccgucgugaaggcggugcccgaggcccccaagggcggggaggccgaggaccuggucggcaagccguacagccaggacgccucccggagcccccagagccucuccgacaccggcuacagcuccgacgggaucagcuccagccaguccgagaucacgggcgugguccagcaggagguggagcagcuggacagcgcgggggugaccggcccccacccgcccucccccagcgagauccacaaggucggguccagcaugcgcccccugcuccaggcccagggccuggccccguccgagcggagcaagccccuguccagcggcaccggggaggagcagaagcagcgcccccacucccucagcaucacccccgaggccuucgacuccgacgaggagcuggaggacauccuggaggaggacgaggacagcgccgaguggcggcgccggcgcgagcagcaggacacggcggagagcuccgacgacuucggcagccagcugcggcacgacuacguggaggacuccagcgaggggggccucuccccgcugcccccccagcccccggcccgcgccgccgagcugaccgacgaggacuucaugcggcgccagauccucgagaugagcgccgaggaggacaaccuggaggaggacgacaccgcgaccuccgggcggggccuggccaagcacggcacgcagaaggggggcccccgcccccgccccgagccgagccaggagcccgccgcccuccccaagcggcgccugccccacaacgccaccaccggguacgaggagcugcucccggagggcggguccgcggaggccaccgacggcagcggcacgcugcaggggggccugcggcgcuucaagaccaucgagcucaacuccaccgggagcuacggccacgagcuggaccugggccaggggcccgaccccucccucgaccgggagcccgagcuggagauggagagccugaccggcuccccggaggaccgcagccggggggagcacuccagcacgcuccccgccuccacccccagcuacaccagcggcaccuccccgacgagccuguccagccuggaggaggacuccgacagcucccccagccgccggcagcgccucgaggaggccaagcagcagcggaaggcccgccaccggucccacgggccccugcugcccaccaucgaggacagcuccgaggaggaggagcuccgcgaggaggaggagcugcugcgggagcaggagaagaugcgcgagguggagcagcagcggauccgcagcaccgcgcggaagacccgccgggacaaggaggagcuccgcgcccagcgccggcgcgagcgguccaagacgccgcccagcaaccugucccccaucgaggacgccagccccaccgaggagcugcgccaggccgcggagauggaggagcuccaccgguccagcugcuccgaguacagcccgagccccucccuggacagcgaggccgaggcccuggacggcggccccucccgccucuacaagagcggguccgaguacaaccugcccaccuucaugagccuguacuccccgaccgagacccccagcggcuccagcacgacccccuccagcgggcggccccucaaguccgccgaggaggccuacgaggagaugaugcgcaaggcggagcugcugcagcggcagcagggccaggccgccggggcccgcggcccgcacggcgggcccagccagcccaccggcccccgggggcucggcuccuucgaguaccaggacaccacggaccgcgaguacgggcaggccgcgcagccggccgccgagggcacccccgccagccugggcgccgcggucuacgaggagauccugcagaccucccagagcaucgugcggaugcgccaggccuccagccgggaccucgccuucgccgaggacaagaagaaggagaagcaguuccugaacgcggagagcgccuacauggaccccaugaagcagaacgggggcccccugaccccggggacgucccccacccagcucgccgcccccgugagcuucuccacccccaccagcuccgacagcuccggcgggcgcgucaucccggacgugcgggugacgcagcacuucgccaaggagacccaggacccccugaagcugcacagcucccccgcgagcccguccagcgccuccaaggagaucggcaugcccuucagccagggccccgggacccccgccaccacggccgucgccccgugccccgcgggccucccccgcggguacaugacccccgccuccccggccggcagcgagcggucccccagccccuccagcaccgcccacagcuacggccacucccccaccacggccaacuacgggagccagaccgaggaccugccgcaggcgcccuccggccuggccgccgccgggcgcgcggcccgcgagaagccccucagcgccuccgacggcgaggggggcaccccccagccgagccgggccuacuccuacuucgccagcuccagccccccccugucccccagcuccccgagcgagucccccaccuucagccccggcaagauggggccccgcgcgacggccgaguucuccacccagaccccgagccccgcccccgccagcgacaugccccgguccccgggcgcccccacccccagcccgaugguggcgcaggggacgcagaccccccaccgccccuccaccccccggcugguguggcaggagagcucccaggaggccccguucauggucaucacccucgccagcgacgccuccagccagacgcgcauggugcacgccuccgcgagcaccuccccccugugcagccccaccgagacccagcccacgacccacggcuacucccagaccaccccgcccagcgugucccagcugccccccgagccgcccgggccccccggcuucccgcggguccccagcgccggcgccgacgggccccucgcccuguacggcuggggggcccugcccgcggagaacaucucccucugccgcaucagcuccgugccgggcaccagccggguggagcccgggccccgcacgcccggcaccgccgucguggaccugcggaccgccgugaagccgacccccaucauccugacggaccagggcauggaccucaccagccuggccgucgaggcgcgcaaguacgggcuggcccucgaccccauccccggccggcaguccaccgccgugcagccgcuggugaucaaccugaacgcccaggagcacaccuuccucgccacggcgaccaccgucagcaucaccauggccuccagcguguucauggcccagcagaagcagcccguggucuacggggaccccuaccagucccgccuggacuucggccaggggggcggcagcccggugugccuggcccaggugaagcaggucgagcaggccgugcagacggcgcccuaccgguccgggccccgcggccggccccgcgaggccaaguucgcccgguacaaccucccgaaccagguggccccccuggcccgccgggacguccugaucacccagauggggaccgcgcagagcaucggccucaagcccggccccgugccggagcccggggccgagccccaccgcgccacccccgccgagcugcgcucccacgcgcugccgggcgcccggaagccccacacgguggucgugcagaugggggagggcaccgccgggaccgugaccacgcuccugcccgaggagcccgccggcgcccuggaccucaccggcaugcgcccggagagccagcuggcgugcugcgacauggucuacaagcugcccuucggguccagcugcaccggcaccuuccaccccgcccccuccgugccggagaagagcauggccgacgccgccccccccgggcaguccagcucccccuucuacggcccgcgggaccccgagcccccggagccccccacguaccgcgcgcaggggguggucggccccggcccgcacgaggagcagcggcccuacccccaggggcuccccggccgccuguacagcuccaugagcgacaccaaccuggccgaggccgggcucaacuaccacgcccagcggaucggccagcuguuccaggggccgggccgcgacagcgccauggaccuguccagccucaagcacuccuacagccugggcuucgcggacgggcgguaccugggccaggggcuccaguacggcuccgugaccgaccugcgccaccccaccgaccugcuggcccacccccuccccaugcggcgcuacagcuccgugagcaacaucuacuccgaccaccgguacggcccgcgcggggacgccgucggcuuccaggaggccagccuggcgcaguacuccgccacgaccgcccgggagaucagccgcaugugcgccgcccugaacuccauggaccaguacgggggccggcacgggagcggcggcgggggccccgaccucgugcaguaccagccccagcacgggcccggccuguccgcgccgcagagccuggugccccuccgccccgggcugcugggcaaccccaccuucccggagggccaccccucccccgggaaccucgcccaguacggccccgccgccgggcagggcaccgccguccggcagcugcugccgagcacggcgaccgugcgcgccgccgacgggaugaucuacuccaccaucaacacccccaucgccgccacgcuccccaucaccacccagcccgcgagcguccugcgcccgauggugcggggcggcauguaccgccccuacgccagcgggggcaucaccgccgugccccugacgucccucacccgggucccgaugaucgccccccgcgugccccuggggcccaccggccuguaccgguacccggcccccagccgcuuccccaucgcguccagcgugcccccggccgaggggcccgucuaccucggcaagcccgccgccgcgaaggcccccggcgccgggggcccgucccggcccgagaugcccgugggggccgcccgcgaggagccccugccgaccaccacgcccgcggccaucaaggaggccgccggcgcccccgcgcccgccccgcuggccggccagaagccccccgccgacgccgcgcccgggggcgggagcggcgcccucucccggccgggguucgagaaggaggaggccagccaggaggagcgccagcggaagcagcaggagcagcugcugcagcucgagcgcgagcggguggagcuggagaagcugcgccagcuccggcugcaggaggagcuggagcgcgagcgggucgagcuccagcgccaccgggaggaggagcagcugcuggugcagcgcgagcuccaggagcugcagaccaucaagcaccacgugcugcagcagcagcaggaggagcggcaggcccaguucgcgcuccagcgcgagcagcuggcccagcagcgccugcagcucgagcagauccagcagcugcagcagcagcugcagcagcagcucgaggagcagaagcagcggcagaaggcccccuuccccgccgccugcgaggcgcccggccgcggcccgccccuggccgccgccgagcuggcccagaacgggcaguacuggcccccgcucacccacgcggccuucaucgccauggccggccccgaggggcugggccagccccgggagcccguccugcaccgcgggcucccguccagcgccuccgacaugagccugcagaccgaggagcagugggaggcgucccggagcggcaucaagaagcgccacuccaugccccggcugcgcgacgccugcgagcucgagagcggcacggagcccugcguggugcggcgcaucgccgacuccagcguccagaccgacgacgaggacggggagucccgguaccugcugagccgccggcgccgggcccgccggagcgccgacugcuccgugcagaccgacgacgaggacagcgcggagugggagcagcccgugcgccggcgccgcucccggcucccgcgccacagcgacuccggcagcgacuccaagcacgacgccaccgccagcuccagcuccgccgcggccacgguccgggccaugagcuccguggggauccagaccaucagcgacugcuccgugcagaccgagcccgaccagcugccccgcgucagccccgccauccacaucaccgccgcgacggacccgaagguggagaucgugcgguacaucuccgcccccgagaagaccggccgcggggagagccuggccugccagaccgagcccgacggccaggcccagggcgucgccgggccccagcucgugggcccgaccgcgaucucccccuaccugcccgggauccagaucgugacgcccggcccgcugggccgguucgagaagaagaagcccgacccccucgagaucggguaccaggcccaccugcccccggagagccugagccagcucgucucccgccagccccccaagagcccgcaggugcuguacucccccgugagcccccuguccccccaccggcuccuggacaccagcuucgccuccagcgagcgccugaacaaggcccacgucuccccgcagaagcacuucaccgccgacagcgcgcuccggcagcagacccugccccgccccaugaagacgcugcagcggucccucagcgaccccaagccgcugucccccaccgccgaggagagcgccaaggagcgcuucucccuguaccagcaccagggcgggcucggcagccagguguccgcccugccccccaacagccuggugcggaaggucaagcgcacccucccgagccccccccccgaggaggcgcaccugccgcuggccgggcaggccuccccccagcucuacgccgccagccugcugcagcggggccucaccggccccacgaccgugcccgcgaccaaggccucccugcugcgcgagcucgaccgggaccugcgccugguggagcacgagagcaccaagcuccggaagaagcaggccgagcuggacgaggaggagaaggagaucgacgccaagcugaaguaccucgagcuggggaucacgcagcgcaaggagucccuggccaaggaccgcggcgggcgggacuacccgccccuccgcggccugggggagcaccgggacuaccugagcgacuccgagcucaaccagcugcgccugcagggcugcaccacccccgcgggccaguucgucgacuuccccgccaccgccgccgccccggcgacgcccagcgggcccaccgccuuccagcagccccgguuccagccgcccgccccccaguacuccgccggcagcgggggcccgacccagaacggguuccccgcgcaccaggcccccaccuaccccggcccguccacguaccccgcccccgccuuccccccgggcgccagcuaccccgcggagcccgggcugcccaaccagcaggccuuccgcccgaccggccacuacgccgggcagacccccaugcccaccacccaguccacgcucuuccccgugccggccgacagccgggccccccugcagaagccccgccagaccucccuggcggaccucgagcagaaggugcccaccaacuacgaggucaucgccagcccgguggugcccauguccagcgcccccuccgagaccagcuacagcggccccgccgucuccagcggguacgagcagggcaaggugccggaggugccccgggccggcgaccgcggguccgucagccagucccccgcgcccacguacccgagcgacucccacuacaccagccuggagcagaacgugccccggaacuacgugaugaucgacgacaucuccgagcugaccaaggacagcaccuccacggcccccgacagccagcgccucgagccgcugggccccggguccagcggccggcccggcaaggagcccggggagccgggcguccuggacgggcccacccuccccugcugcuacgcccgcggcgaggaggaguccgaggaggacagcuacgacccccgggggaagggcggccaccugcgcuccauggagagcaacgggcggccggccuccacccacuacuacggcgacagcgacuaccgccacggggcccggguggagaaguacggccccgggcccaugggccccaagcacccgagcaagucccuggcgcccgccgccaucagcuccaagcgcagcaagcaccgcaagcagggcauggagcagaagaucuccaaguucagccccaucgaggaggccaaggacguggaguccgaccucgcgagcuaccccccgcccgccgucuccagcucccuggugagccgggggcgcaaguuccaggacgagaucaccuacggccugaagaagaacgucuacgagcagcagaaguacuacgggauguccagccgggacgccguggaggacgaccgcaucuacggcggguccagccggucccgcgcccccagcgccuacuccggcgagaagcucagcagccacgacuucuccggcugggggaagggcuacgagcgggagcgcgaggcgguggagcggcugcagaaggccgggcccaagccgagcucccugagcauggcccacucccgcguccggccccccaugcgcagccaggccuccgaggaggagagccccguguccccgcucggccggccccgccccgccggcgggccgcugccccccggcggggacacgugcccccaguucugcagcucccacagcaugccggacgugcaggagcacgucaaggacggcccccgggcgcacgccuacaagcgcgaggagggguacauccuggacgacucccacugcguggugagcgacuccgaggccuaccaccucggccaggaggagaccgacugguucgacaagccccgggacgcccgcagcgaccgguuccgccaccacggcgggcacgccgucuccagcuccagccagaagcggggccccgcgcgccacagcuaccacgacuacgacgagccgcccgaggaggggcuguggccccacgacgagggcgggcccggccgccacgccuccgccaaggagcaccggcacggcgaccacgggcgccacagcggccggcacaccggggaggagccgggccgccgggccgcgaagccccacgcccgcgaccuggggcggcacgaggcccgcccccacucccagcccagcuccgccccggccaugcccaagaagggccagcccggcuaccccagcuccgcggaguacagccagccgucccgggccagcuccgccuaccaccacgccagcgacuccaagaaggggagccgccaggcccacuccggccccgcggcccuccagagcaaggccgagccccaggcccagccccagcugcaggggcggcaggccgcgccgggcccccagcagucccagagccccuccagccgccagauccccagcggggccgccucccggcagccgcagacccagcagcagcagcagggccugggccuccagcccccccagcaggcccugacgcaggcgcgccugcagcagcagagccagccgaccacccggggguccgcccccgccgccagccagcccgccggcaagccccagccggggcccuccaccgcgacgggcccccagcccgccggcccgccccgcgccgagcagaccaacgggagcaagggcaccgccaaggccccccagcaggggcgggcgccccaggcccagccggcccccggccccgggcccgccggcgugaaggccggcgcgcgcccggggggcacccccggggcccccgccggccagcccggggccgacggcgaguccguguucagcaagauccucccgggcggggccgcggagcaggccggcaagcugacggaggccgucuccgccuucgggaagaaguucagcuccuucugguga

SEQ ID NO: 27370 - RNA, 399 nt, Artificial Sequence
  derived and/or modified sequence opt1 from BSPH1__Homo_sapiens__NP_001121798
augggcagccugaugcuccuguucguggagaccacccgcaacuccagcgccugcaucuuccccgucauccugaacgagcucuccagcacgguggagaccaucacccacuucccggaggugaccgacggggagugcgucuuccccuuccacuacaagaacggcacguacuacgacugcaucaaguccaaggcccggcacaaguggugcagccugaacaagaccuacgagggguacuggaaguucugcuccgcggaggacuucgccaacugcguguuccccuucugguaccgccggcugaucuacugggagugcaccgacgacggcgaggccuucgggaagaaguggugcagccucaccaagaacuucaacaaggaccgcaucuggaaguacugcgaguga

SEQ ID NO: 27371 - RNA, 1209 nt, Artificial Sequence
  derived and/or modified sequence opt1 from BSPRY__Homo_sapiens__NP_060158
augagcgccgagggcgccgagcccgggccgggcuccgggagcggccccgggcccggcccccugugcccggagcacggccaggcgcucuccugguucugcgggagcgagcgccggcccgugugcgccgccugcgccggccucgggggccgcugccgggggcaccgcauccggcgcgccgaggagcgggcggaggagcugcgcaacaagaucgucgaccagugcgagcggcugcagcugcaguccgccgccaucaccaaguacguggccgacgugcugcccggcaagaaccagcgcgcggucagcauggccuccgccgcccgggagcucgugauccagcgccugagccuggugcggucccucugcgagagcgaggagcagcgccugcuggagcagguccacggcgaggaggagcgggcccaccaguccauccucacccagcgcgugcacugggcggaggcccugcagaagcuggacacgauccggaccgggcucgugggcaugcugacccaccuggacgaccuccagcugauccagaaggagcaggagaucuucgagcgcaccgaggaggccgaggggauccuggacccccaggagagcgagaugcucaacuucaacgagaagugcacgcgguccccgcugcugacccagcucugggccaccgccguccugggcagccuguccggcaccgaggacauccgcaucgacgagcggacggugagccccuuccuccagcuguccgacgaccgcaagacccugaccuucagcaccaagaaguccaaggcgugcgccgacgggcccgagcgcuucgaccacuggcccaacgcccucgccgccacgagcuuccagaacggccugcacgcguggauggugaacguccagaacagcugcgccuacaagguggggguggccuccggccaccucccgcggaaggggagcggcuccgacugccgccugggccacaacgccuucagcugggucuucucccgguacgaccaggaguuccgcuucagccacaacgggcagcacgagccccugggccugcuccgggggcccgcccagcugggcguggugcuggaccuccagguccaggagcugcuguucuacgagcccgcguccgggaccgugcucugcgcccaccacgugagcuucccgggcccccuguuccccgucuucgccguggccgaccagaccaucuccaucgugcgcuga

SEQ ID NO: 27372 - RNA, 957 nt, Artificial Sequence
  derived and/or modified sequence opt1 from BST1__Homo_sapiens__NP_004325
auggccgcccagggcugcgcggccagccgccugcuccagcugcugcuccagcugcugcuccugcugcuccugcuggccgccgggggcgcccgggcgcgcuggcgcggggagggcaccuccgcccaccuccgggacaucuuccuggggcggugcgccgaguaccgcgcccugcucagccccgagcagcggaacaagaacugcaccgcgaucugggaggccuucaagguggcccuggacaaggacccgugcuccguccugcccagcgacuacgaccucuucaucaaccugucccgccacagcaucccccgggacaagucccuguucugggagaacagccaccuccuggugaacuccuucgccgacaacacgcgccgguucaugccccugagcgacgugcucuacggccgcgucgccgacuuccuguccuggugccggcagaagaacgacagcggccuggacuaccaguccugcccgaccagcgaggacugcgagaacaaccccguggacuccuucuggaagcgcgcgagcauccaguacuccaaggacagcuccggggugauccacgucaugcucaacggcagcgagcccaccggggccuaccccaucaagggcuucuucgccgacuacgagaucccgaaccugcagaaggagaagaucacccggaucgagaucugggugaugcacgagaucgggggccccaacguggagagcugcggcgagggguccaugaagguccuggagaagcgccucaaggacaugggcuuccaguacagcugcaucaacgacuaccggcccgugaagcugcugcagugcguggaccacuccacgcaccccgacugcgcccucaagagcgccgcggccgccacccagcgcaaggccccgucccuguacaccgagcagcgggccgggcugaucaucccccucuuccugguccuggcgagccgcacccagcucuga

SEQ ID NO: 27373 - RNA, 543 nt, Artificial Sequence
  derived and/or modified sequence opt1 from BST2__Homo_sapiens__NP_004326
auggccagcaccuccuacgacuacugccgcgugcccauggaggacggcgacaagcggugcaagcugcuccuggggaucggcauccugguccuccugaucaucgugauccugggggugccgcucaucaucuucaccaucaaggccaacagcgaggccugccgcgacggccugcgggccgucauggagugccgcaacgugacgcaccuccugcagcaggagcugaccgaggcccagaagggguuccaggacguggaggcccaggccgcgaccugcaaccacaccgucauggcccugauggccucccucgacgccgagaaggcgcagggccagaagaagguggaggagcuggagggcgagaucacgacccugaaccacaagcuccaggacgccagcgccgagguggagcggcugcgccgggagaaccagguccuguccgugcgcaucgccgacaagaaguacuaccccagcucccaggacagcuccagcgccgcggcgccccagcuccugaucgugcugcucgggcuguccgcccugcuccaguga

SEQ ID NO: 27374 - RNA, 702 nt, Artificial Sequence
  derived and/or modified sequence opt1 from BSX__Homo_sapiens__NP_001091639
augaaccugaacuucaccagcccccuccacccggccuccagccagcgccccaccuccuucuucaucgaggacauccugcugcacaagcccaagccccuccgggagguggccccggaccacuucgcgagcucccuggccagccgcgucccccugcucgacuacggcuacccccugaugcccacgccgacccugcucgcgccccacgcccaccacccccugcacaagggggaccaccaccaccccuacuuccugaccaccuccggcaugccggugcccgcccucuucccccacccccagcacgccgagcugccggggaagcacugccggcgccggaaggcccgcacgguguucagcgacucccagcugagcggccucgagaagcgguucgagauccagcgcuaccuguccacccccgagcgggucgagcuggccaccgcccucagccuguccgagacccaggugaagacgugguuccagaaccgccggaugaagcacaagaagcagcugcgcaagagccaggacgagcccaaggcgcccgacgggccggagucccccgagggcagcccccggggcuccgaggccgccaccgccgccgaggcgcgccucagccugcccgccgggccguucgugcugaccgagcccgaggacgaggucgacaucggcgacgagggggagcucggcuccgggccccacgugcuguga

SEQ ID NO: 27375 - RNA, 1428 nt, Artificial Sequence
  derived and/or modified sequence opt1 from BTBD10__Homo_sapiens__XP_011518706
auggccggccgcccccacccguacgacgggaacagcuccgaccccgagaacugggaccggaagcugcacagccgcccccggaagcucuacaagcacuccagcaccuccagccgcaucgccaagggcgggguggaccacaccaagaugucccugcacggcgcgagcgggggccacgagcggucccgcgaccggcgccggagcuccgaccgcagccgggacuccagccacgagcgcaccgagucccagcugacccccugcauccggaacgucaccagcccgacccgccagcaccacguggagcgggagaaggaccacuccagcucccgccccagcagcccccggccccagaaggccuccccgaacggcagcaucuccagcgccgggaacuccagccgcaacuccagccaguccagcuccgacggcagcugcaagacggccggggagaugguguucgucuacgagaacgccaaggagggcgcgcggaacauccgcaccuccgagcgggugacccucaucguggacaacacccgcuucgucguggaccccagcaucuucacggcccagcccaacaccaugcuggggcgcauguucggcuccggccgggagcacaacuucacccgccccaacgagaagggggaguacgagguggccgagggcaucgggagcaccgucuuccgggccauccuggacuacuacaagacgggcaucauccgcugcccggacggcaucuccauccccgagcuccgggaggcgugcgacuaccugugcaucagcuucgaguacuccaccaucaagugccgcgaccugagcgcccucaugcacgagcugagcaacgacggggcccggcgccaguucgaguucuaccuggaggagaugauccucccccugaugguggccuccgcccagagcggcgagcgggagugccacaucgugguccugaccgacgacgacgugguggacugggacgaggaguacccgccccagaugggggaggaguacucccagaucaucuacagcaccaagcucuaccgcuucuucaaguacaucgagaaccgggacgucgcgaaguccgugcugaaggagcgcggccugaagaagauccggcucgggaucgagggcuaccccacguacaaggagaaggugaagaagcgccccggcgggcggcccgaggucaucuacaacuacgugcagcgcccguucauccggaugagcugggagaaggaggagggcaagucccgccacguggacuuccagugcgucaagagcaaguccaucaccaaccuggccgccgccgccgcggacaucccccaggaccagcugguggugaugcaccccacgccccaggucgacgagcucgacauccugccgauccacccgcccagcgggaacuccgaccuggaccccgacgcccagaaccccaugcucuga

SEQ ID NO: 27376 - RNA, 1926 nt, Artificial Sequence
  derived and/or modified sequence opt1 from BTBD11__Homo_sapiens__NP_001017523
augcgcaagcugcggcccaaggacagccgcgagccggcccccggcucccccgugcggagcgggugccuccagcgccugucccacuacagcggcauccagcggcccuuccugguccucccgccccugauggaguggauccgcguggccguggcgcacgccgggcaccggcgcuccuucagcauggacuccgacgacguccggcaggccgcccgccugcuccugcccggcguggacugcgagccccggcagcugcgcgccgacgacugcuucugcgcgagccggaagcucgacgccguggccaucgaggccaaguucaagcaggaccugggguuccgcaugcugaacugcggccggaccgaccucgucaagcaggcggugucccugcugggcccggacgggaucaacaccaugagcgagcagggcaugacgccccucauguacgccugcgugcgcggggacgaggccaugguccagaugcugcuggacgccggcgccgaccucaacguggagguggucuccacgccccacaaguaccccagcgugcacccggagacccggcacuggaccgcgcugaccuucgccgugcugcacgggcacauccccgucgugcagcuccugcuggacgccggcgccaagguggagggcuccgucgagcacggggaggagaacuacagcgagacgccccuccagcuggccgcggccgugggcaacuucgagcuggugucccuccugcuggagcgcggggccgacccccucaucggcaccauguaccggaacggcaucagcaccaccccgcagggggacaugaacuccuucagccaggccgccgcgcacggccaccgcaacgucuuccggaagcugcuggcccagcccgagaaggagaaguccgacauccucagccuggaggagauccuggccgaggggaccgaccucgccgagaccgccccgccgccccugugcgcgagccgcaacuccaaggccaagcugcgcgcccuccgggaggccauguaccacagcgcggagcacggcuacguggacgugaccaucgacauccgcuccaucgggguccccuggacgcugcacaccuggcuggagagccuccggaucgccuuccagcagcaccgccggccccugauccagugccugcucaaggaguucaagaccauccaggaggaggaguacaccgaggagcuggugacgcagggccugccccucauguucgagauccugaaggccuccaagaacgaggucaucagccagcagcugugcgugaucuucacccacugcuacggccccuaccccauccccaagcugaccgagaucaagcgcaagcagaccucccggcucgacccccacuuccugaacaacaaggagaugagcgacgugacguuccuggucgaggggcgcccguucuacgcccacaaggugcuccuguucaccgccagcccccgguucaaggcgcugcucuccuccaagcccaccaacgacgggaccugcaucgagaucggcuacgugaaguacagcaucuuccagcuggucaugcaguaccuguacuacggcgggccggagucccuccugaucaagaacaacgagaucauggagcugcucagcgccgccaaguucuuccagcuggaggcccugcagcgccacugcgagaucaucugcgccaaguccaucaacacggacaacugcguggacaucuacaaccacgcgaaguuccucggcgugaccgagcugagcgccuacugcgagggcuacuuccugaagaacaugaugguccucaucgagaacgaggccuucaagcagcugcuguacgacaagaacggggagggcaccgggcaggacgugcuccaggaccugcagcggacccuggccauccgcauccaguccauccaccucagcuccagcaagggcagcguggucuga

SEQ ID NO: 27377 - RNA, 1521 nt, Artificial Sequence
  derived and/or modified sequence opt1 from BTBD16__Homo_sapiens__NP_653188
augaucaugagcaacacccacaaggcccgccuggagcggcgcgugaccggcuccacgaaccgguggcgccuccccaagcagccguucagcggggaccugcugucccucagccagaugugcaaggcccuguccaucgacuucgaggaggcgcugcggaaccccgaccgccucugcaucagccagauccagaaguucuucuucgagaacuucaagaacaaggacauccaguccggcgaggccgacgucauccuggagugccugggguucaagugggagcuccaccagccccagcuguuccagagcgagacccuggccaagcucuaccugaaggcccuggcccagggcaccacccacccccuccgggagcuggaggagcugcuccgcgcgcaguccccgaagaagacgaaggagaagucccccgccaagcggaucaucaucagccugaagaucaacgacccccuggugaccaagguggccuucgccaccgcgcucaagaaccuguacaugagcgaggucgagaucaaccuggaggaccuccugggggugcuggccuccgcccacauccuccaguucagcggccuguuccagcgcugcguggacgucaugaucgcccggcugaagcccuccaccaucaagaaguucuacgaggccggcugcaaguacaaggaggagcagcucacgaccgggugcgagaaguggcuggagaugaaccuggugccgcucggcgggacccagauccaccuccacaagaucccccaggaccugcugcacaaggugcucaagagcccccgccuguucaccuucuccgaguuccaccuccugaagacgaugcugcugugggucuuccugcagcugaacuacaagauccaggcgauccccaccuacgagaccgugaugaccuucuucaagagcuucccggagaacugcugcuuccucgaccgggacaucggccgcucccugcggccccuguuccucugccugcgccugcacgggaucacgaagggcaaggaccuggaggugcuccggcaccugaacuucuuccccgagagcuggcuggaccaggucaccgugaaccacuaccacgcccucgagaacggcggggacauggugcaccugaaggaccugaacacccaggccguccgcuucggccuccuguucaaccaggagaacaccacguacagcaagaccaucgcccuguacggguucuucuucaagaucaagggccucaagcacgacaccaccuccuacagcuucuacaugcagcggaucaagcacacggaccuggagucccccagcgccguguacgagcacaaccacgugucccugcgcgcggcccggcucgucaaguacgagauccgcgccgaggcccugguggacggcaaguggcaggaguuccgcaccaaccagaucaagcagaaguucgggcugaccaccagcuccugcaagagccacacgcucaagauccagaccgugggcaucccgaucuacgucuccuucgccuucaucuuccccgcgagcuga

SEQ ID NO: 27378 - RNA, 1158 nt, Artificial Sequence
  derived and/or modified sequence opt1 from BTBD1__Homo_sapiens__NP_001011885
auggccagccugggccccgccgcggccggggagcaggccuccggcgccgaggccgagccggggcccgcggggcccccgcccccgcccagccccuccagccucgggccccugcugccccuccagcgcgagccccuguacaacuggcaggccaccaaggccucccugaaggagcgguucgccuuccucuucaacagcgagcugcuguccgacgugcgcuucguccucggcaagggccggggcgcggccgccgccggcgggccccagcgcaucccggcccaccgguucgugcuggcggccggcagcgccguguucgacgccauguucaacgggggcauggccaccacguccgcggagaucgagcugcccgacgucgagcccgccgccuuccucgcccugcugcgcuuccucuacagcgacgaggugcagaucggccccgagaccgugaugaccacccuguacacggccaagaaguacgcggucccggcccuggaggcccacugcguggaguuccucaccaagcaccuccgggccgacaacgccuucaugcugcugacccaggcgcgccuguucgacgagccccagcuggccucccucugccuggacaccaucgacaagagcacgauggacgccaucuccgccgagggguucaccgacaucgacaucgacacccugugcgcggugcucgagcgggacacccugagcauccgcgagucccggcuguucggcgccgucgugcgcugggccgaggccgagugccagcggcagcagcuccccgugacguucgggaacaagcagaagguccugggcaaggcccugagccucauccgcuucccccugaugaccaucgaggaguucgcggccggcccggcccaguccgggauccugagcgaccgggagguggugaaccucuuccugcacuucaccgucaaccccaagccccgcguggaguacaucgaccggccccgcugcugccugcggggcaaggagugcugcaucaaccgcuuccagcaggucgagucccgguggggguacagcggcaccagcgaccgcauccgcucccucaacaugcgcaagagcaagccgugggaccggaugauccccgcccugguggugauggggcagcugacgcacuccggcagcugcucccggaaccccuga

SEQ ID NO: 27379 - RNA, 1578 nt, Artificial Sequence
  derived and/or modified sequence opt1 from BTBD2__Homo_sapiens__NP_060267
auggccgccggcgggagcggcgggcgcgcguccugcccgcccggcgugggggucggccccggcaccgggggcagccccgggcccuccgccaacgccgccgccaccccggcgcccggcaacgccgccgccgcggccgccgccgccgcggccgccgccgccgcgcccgggcccacgccgcccgccccgcccggccccggcaccgacgcccaggccgccggggcggagcgggccgaggaggccgccggccccggggccgcggcccugcagcgcgaggccgccuacaacuggcaggcgagcaagcccaccgugcaggagcgguucgccuuccucuucaacaacgaggugcugugcgacguccacuuccuggugggcaagggccucuccagccagcgcauccccgcccaccgguucgugcuggccgucggguccgccguguucgacgcgauguucaacggcgggauggccaccacgagcaccgagaucgagcugccggacguggagcccgccgccuuccucgcccugcugaaguuccucuacuccgacgagguccagaucggccccgagaccgugaugaccacgcuguacaccgcgaagaaguacgccgugcccgcccuggaggcccacugcgucgaguuccucaagaagaaccugcgcgccgacaacgcguucaugcugcucacccaggcccggcuguucgacgagccgcagcuggccagccucugccuggagaacaucgacaagaacaccgccgacgcgaucacggccgagggguucaccgacaucgaccuggacacccucguggccgugcuggagcgcgacacccugggcauccgggagguccgccucuucaacgccguggugcggugguccgaggccgagugccagcgccagcagcugcaggucacgcccgagaaccggcgcaaggugcugggcaaggcgcucgggcugauccgguucccccugaugaccaucgaggaguucgccgccggccccgcccagagcgggauccucguggaccgcgaggucgugucccuguuccugcacuucaccgugaacccgaagccccgggucgaguucaucgaccgcccccggugcugccuccgcggcaaggagugcagcaucaaccgguuccagcaggucgagucccgcuggggguacagcggcaccuccgaccgcauccgguucagcgugaacaagcgcaucuucguggugggcuucgggcuguacggcuccauccacgggcccacggacuaccaggucaacauccagaucauccacaccgacagcaacaccgugcugggccagaacgacaccggguucagcugcgacggcuccgccagcacguuccgggugauguucaaggagccggucgaggugcuccccaacgugaacuacaccgcgugcgccacccugaagggccccgacucccacuacgggaccaagggccugcgcaaggucacgcacgagagcccgaccaccggggccaagaccugcuucacguucugcuacgccgccggcaacaacaacggcaccuccguggaggacgggcagauccccgaggugaucuucuacaccuga

SEQ ID NO: 27380 - RNA, 1386 nt, Artificial Sequence
  derived and/or modified sequence opt1 from BTBD3__Homo_sapiens__NP_001269480
auggccgccgacaucuucccccgcaagaagccggcgaacagcuccagcaccuccgugcagcaguaccaccagcagaaccugagcaacaacaaccucauccccgcccccaacuggcagggccuguaccccaccauccgggagcgcaacgccaugauguucaacaacgaccugauggccgacguccacuucgugguggggccgcccggcgggacgcagcggcuccccggccacaaguacguccuggccgugggguccagcguguuccacgcgauguucuacggcgagcuggccgaggacaaggacgagauccgcauccccgacgucgagccggccgccuuccucgcgaugcugaaguacaucuacugcgacgagaucgaccuggccgccgacaccgugcucgccacccuguacgccgcgaagaaguacaucgugccccaccuggcccgggccugcgucaacuuccucgagaccucccugagcgccaagaacgccugcgugcugcucucccagagcugccuguucgaggagcccgaccugacgcagcgcugcugggaggugaucgacgcgcaggccgagcucgcccugaaguccgagggcuucugcgacaucgacuuccagacccuggagagcauccuccggcgcgagacccugaacgccaaggagaucgucguguucgaggccgcgcugaacugggccgagguggagugccagcggcaggaccucgcccuguccaucgagaacaagcgcaagguccuggggaaggcccucuaccugauccggauccccaccauggcccuggacgacuucgcgaacggcgccgcccagagcggggugcucacgcugaacgagaccaacgacaucuuccugugguacaccgccgcgaagaagccggagcuccaguucguguccaaggcccgcaagggccuggucccccagcggugccaccgcuuccagagcugcgccuaccgguccaaccaguggcgcuaccgggggcgcugcgacagcauccaguucgccguggacaagcggguguucaucgccggcuucggccuguacggguccagcugcggcagcgcggaguacuccgccaagaucgagcucaagcgccagggggucgugcugggccagaaccugagcaaguacuucuccgacggcagcuccaacaccuuccccgugugguucgaguaccccguccagaucgagccggacacguucuacaccgccagcgugauccucgacgggaacgagcuguccuacuucggccaggaggggaugaccgagguccagugcggcaaggugaccgugcaguuccagugcagcuccgacagcacgaacgggaccggcguccagggcgggcagauccccgagcugaucuucuacgccuga

SEQ ID NO: 27381 - RNA, 1749 nt, Artificial Sequence
  derived and/or modified sequence opt1 from BTBD9__Homo_sapiens__NP_001165889
augugccgcgcccugcucuacggcgggaugcgggagagccagcccgaggccgagaucccgcugcaggacaccaccgcggaggccuucacgaugcugcucaaguacaucuacaccggccgcgccacccugaccgacgagaaggaggaggugcugcucgacuuccugucccuggcccacaaguacggguuccccgagcucgaggacagcacguccgaguaccugugcaccauccugaacauccagaacgucugcaugaccuucgacguggccagccucuacucccugcccaagcugaccugcaugugcugcauguucauggaccggaacgcgcaggaggugcucagcuccgagggcuuccugagccuguccaagacggcccuccugaacaucguccugcgcgacagcuucgccgcccccgagaaggacaucuuccucgcgcugcugaacuggugcaagcacaacuccaaggagaaccacgccgagaucaugcaggccgugcggcucccgcugaugagccugaccgagcuccugaacgugguccgccccuccgggcugcucagccccgacgccauccuggacgccaucaaggugcgguccgagagccgcgacauggaccugaacuaccggggcaugcucauccccgaggagaacaucgcgaccaugaaguacggcgcccagguggucaagggggagcugaaguccgcccugcucgacggcgacacccagaacuacgaccuggaccacggguucagccgccacccgaucgacgacgacugccgguccggcaucgagaucaagcuggggcagcccagcaucaucaaccacauccgcauccuccugugggaccgggacagccgcuccuacagcuacuucaucgagguguccauggacgagcuggacugggugcgggucaucgaccacagccaguaccucugccgcuccuggcagaagcuguacuuccccgcccgggugugcagcggcgacggcgugucccuguggugcccccucuggagccgcacgccggagcugaagcaguccagccugcucgggcugcccaagugccgguacauccgcaucgucggcacccacaacaccgugaacaagaucuuccacaucguggccuucgagugcauguucaccaacaagacguucacccuggagaaggggcugaucguccccauggagaacguggcgaccaucgccgacugcgccuccgugaucgagggcgucagccggucccgcaacgcccuccugaacggcgacaccaagaacuacgacugggacagcggguacacgugccaccagcugggcuccggggccaucguggugcagcucgcgcagcccuacaugaucggcagcauccgccugcugcucugggacugcgacgaccgguccuacagcuacuacgucgagguguccaccaaccagcagcaguggaccauggucgccgaccgcaccaaggugagcugcaagagcuggcaguccgugacguucgagcggcagccggccagcuucauccgcaucgucgggacccacaacaccgccaacgagguguuccacugcgugcacuucgagugccccgagcagcaguccagccagaaggaggagaacuccgaggagagcggcaccggcgacacgucccuggccgggcagcagcuggacagccacgcgcuccgggcccccuccggcagcucccugcccagcuccccggggagcaacucccgcagccccaaccggcagcaccaguga

SEQ ID NO: 27382 - RNA, 537 nt, Artificial Sequence
  derived and/or modified sequence opt1 from BTC__Homo_sapiens__NP_001720
auggaccgcgccgcccggugcagcggcgcguccagccugccccuccugcuggcccucgcccuggggcuggugauccuccacugcgucguggccgacggcaacuccacccgcagcccggagaccaacgggcugcugugcggcgaccccgaggagaacugcgccgcgacgaccacccaguccaagcggaaggggcacuucagccgcugccccaagcaguacaagcacuacugcaucaagggccggugccgcuucguggucgccgagcagacccccuccugcgugugcgacgagggcuacaucggggcccggugcgagcgcguggaccucuucuaccugcggggcgaccgcgggcagauccuggucaucugccucaucgccgugaugguggucuucaucauccuggugaucggcgugugcacgugcugccacccgcugcggaagcgccggaagcgcaagaagaaggaggaggagauggagacccucgggaaggacaucacccccaucaacgaggacaucgaggagaccaacaucgcguga

SEQ ID NO: 27383 - RNA, 1632 nt, Artificial Sequence
  derived and/or modified sequence opt1 from BTD__Homo_sapiens__NP_000051
auggcccacgcccacauccagggcgggcgccgggccaagagccgcuucguggucugcaucauguccggcgcgcggagcaagcuggcccucuuccugugcgggugcuacgugguggcccugggcgcccacaccggggaggaguccgucgcggaccaccacgaggccgaguacuacguggccgccguguacgagcaccccagcauccucucccugaacccgcuggcgcucaucagccgccaggaggcccuggagcugaugaaccagaaccucgacaucuacgagcagcaggucaugaccgccgcccagaaggacgugcagaucaucguguuccccgaggacggcauccacggcuucaacuucacgcggaccuccaucuaccccuuccuggacuucaugcccagcccgcaggucgugcgcuggaaccccugccuggagccccaccgguucaacgacaccgaggugcuccagcgccuguccugcauggccauccgcggggacauguuccuggucgcgaaccucggcaccaaggagcccugccacagcuccgacccgcggugccccaaggacgggcgguaccaguucaacacgaacgugguguucagcaacaacggcacccuggucgaccgcuaccggaagcacaaccuguacuucgaggccgccuucgacgugccccucaagguggaccugaucaccuucgacacccccuucgccgggcgcuucggcaucuucacgugcuucgacauccuguucuucgacccggccauccggguccuccgcgacuacaaggugaagcacguggucuaccccaccgcguggaugaaccagcugccccugcucgccgccaucgagauccagaaggccuucgccguggcguucggcaucaacgugcuggccgccaacguccaccaccccgugcuggggaugaccggcuccgggauccacaccccgcucgagagcuucugguaccacgacauggagaaccccaagucccaccugaucaucgcccaggucgccaagaaccccgugggccugaucggcgcggagaacgccacgggggagaccgaccccagccacuccaaguuccucaagauccugagcggcgacccguacugcgagaaggacgcccaggaggugcacugcgacgaggccaccaaguggaacgucaacgcgccgcccaccuuccacuccgagaugauguacgacaacuucacgcuggugcccgugugggggaaggagggcuaccuccacgucugcagcaacgggcugugcugcuaccugcucuacgagcggcccacccugagcaaggagcuguacgcccucggcguguucgacggccugcacaccgugcacgggaccuacuacauccaggucugcgcccuggugcgcugcggcgggcucggcuucgacacgugcgggcaggagaucaccgaggccaccggcaucuucgaguuccaccuguggggcaacuucuccaccagcuacaucuucccccuguuccucacguccgggaugacccuggaggugcccgaccagcugggcugggagaacgaccacuacuuccuccgcaagagccggcuguccagcgggcuggucaccgccgcgcuguacggccggcucuacgagcgcgacuga

SEQ ID NO: 27384 - RNA, 621 nt, Artificial Sequence
  derived and/or modified sequence opt1 from BTF3__Homo_sapiens__NP_001032726
augcgccggaccggcgcccccgcccaggcggacagccgcgggcggggccgcgcccgcgggggcugccccgggggcgaggccacccugucccagcccccgccccggggcgggacgcggggccaggagccgcagaugaaggagaccaucaugaaccaggagaagcucgccaagcugcaggcccaggugcgcaucgggggcaaggggaccgcgcggcgcaagaagaaggucgugcaccggaccgccacggccgacgacaagaagcugcaguucagccucaagaagcugggcgugaacaacaucuccggcaucgaggaggucaacauguucaccaaccaggggaccgugauccacuucaacaaccccaaggugcaggccagccuggcggccaacaccuucacgaucaccggccacgccgagaccaagcagcucaccgagaugcugcccuccauccugaaccagcucggggccgacagccugacgucccugcgccggcucgccgaggcgcugcccaagcagagcgucgacggcaaggccccgcuggccaccggcgaggacgacgacgacgaggugcccgaccucguggagaacuucgacgaggccuccaagaacgaggccaacuga

SEQ ID NO: 27385 - RNA, 516 nt, Artificial Sequence
  derived and/or modified sequence opt1 from BTG1__Homo_sapiens__NP_001722
augcaccccuucuacacccgcgccgccaccaugaucggcgagaucgcggccgccgugagcuucaucuccaaguuccugcggacgaaggggcucaccagcgagcgccagcugcagaccuucucccagagccugcaggagcuccuggccgagcacuacaagcaccacugguucccggagaagcccugcaagggcuccggguaccggugcauccgcaucaaccacaagauggacccccugaucggccaggccgcgcagcggaucgggcucagcucccaggagcuguuccgccugcuccccagcgagcugacccugugggucgacccguacgagguguccuaccggaucggcgaggacggcagcaucugcgugcucuacgaggccucccccgccgggggcagcacgcagaacuccaccaacguccagaugguggacagccgcaucuccugcaaggaggagcugcugcucgggcggaccagccccuccaagaacuacaacaugaugaccgugagcggcuga

SEQ ID NO: 27386 - RNA, 477 nt, Artificial Sequence
  derived and/or modified sequence opt1 from BTG2__Homo_sapiens__NP_006754
augagccacggcaaggggaccgacaugcugcccgagaucgccgccgcggugggcuuccucuccagccugcugcgcacccgggggugcgucuccgagcagcgccucaagguguucagcggcgcccugcaggaggcccugacggagcacuacaagcaccacugguucccggagaagcccuccaaggggagcggcuaccggugcauccgcaucaaccacaagauggaccccaucaucucccggguggccagccagaucggccucucccagccccagcugcaccagcugcucccgagcgagcugacccugugggucgaccccuacgagguguccuaccgcaucggggaggacggcagcaucugcgugcucuacgaggaggcgccccuggccgccuccugcgggcugcugaccugcaagaaccagguccuccugggccggagcucccccagcaagaacuacgugauggccguguccagcuga

SEQ ID NO: 27387 - RNA, 891 nt, Artificial Sequence
  derived and/or modified sequence opt1 from BTG3__Homo_sapiens__NP_001124386
augaagaacgagaucgccgccguggucuucuucuucacccgccuggugcggaagcacgacaagcucaagaaggaggccguggagcgcuucgccgagaagcugacccugauccuccaggagaaguacaagaaccacugguaccccgagaagcccagcaagggccaggccuaccggugcauccgcgucaacaaguuccagcggguggaccccgacgugcugaaggccugcgagaacuccugcauccuguacagcgaccucgggcugcccaaggagcugacgcucugggucgaccccugcgaggugugcugccgccgggacggcguguccccgugcuggcccgacugcagccagacccccgaccuggucauccggcccccguggccgcccaaggcccuggacuaccgccgcgagccccuccggcccgcguccagcuuccugaucauguacggggagaagaacaacgccuucaucguggccuccuucgagaacaaggacgagaacaaggacgagaucagccgcaaggugacccgggcccuggacaaggucaccuccgacuaccacagcggcuccagcuccagcgacgaggagacguccaaggagauggaggugaagcccagcuccgugaccgcggccgccagccccgucuaccagaucuccgagcucaucuucccgccccugcccauguggcacccccugccccgcaagaagccggggauguaccggggcaacggccaccagaaccacuacccgccgcccgugcccuucggguaccccaaccagggccgcaagaacaagcccuaccggcccauccccgugaccugggucccgccgcccgggaugcacugcgaccgcaaccacuggaucaacccccacaugcucgcgccccacuga

SEQ ID NO: 27388 - RNA, 672 nt, Artificial Sequence
  derived and/or modified sequence opt1 from BTG4__Homo_sapiens__NP_060059
augcgcgacgagaucgccaccaccguguucuucgucacgcggcuggugaagaagcacgacaagcucagcaagcagcagaucgaggacuucgccgagaagcugaugaccauccuguucgagaccuaccgcucccacuggcacagcgacugccccuccaagggccaggcguuccggugcauccgcaucaacaacaaccagaacaaggacccgauccucgagcgggccugcguggagagcaacgucgacuucucccaccuggggcugcccaaggagaugaccaucuggguggaccccuucgaggugugcugccgcuacggcgagaagaaccaccccuucacggucgccagcuucaaggggcggugggaggagugggagcucuaccagcagaucuccuacgccgugagccgcgccuccagcgacguguccagcggcaccuccugcgacgaggagagcugcuccaaggagccgcgggucauccccaaggugagcaaccccaaguccaucuaccagguggagaaccugaagcagcccuuccagagcuggcugcagaucccgcgcaagaagaacgucguggacgggcgggugggccuccugggcaacaccuaccacgggucccagaagcaccccaagugcuaccgccccgcgaugcaccggcuggaccgcauccucuga

SEQ ID NO: 27389 - RNA, 1980 nt, Artificial Sequence
  derived and/or modified sequence opt1 from BTK__Homo_sapiens__NP_000052
auggccgccgugauccuggagagcaucuuccucaagcgcucccagcagaagaagaagaccagcccccugaacuucaagaagcggcuguuccuccugaccguccacaagcuguccuacuacgaguacgacuucgagcgcggccggcgcgggagcaagaagggcuccaucgacguggagaagaucacgugcguggagaccgucgugccggagaagaacccgccgcccgagcggcagaucccccgccgcggggaggagagcuccgagauggagcagaucagcaucaucgagcgguuccccuaccccuuccagguggucuacgacgagggcccccucuacguguucucccccaccgaggagcugcggaagcgcuggauccaccagcugaagaacgugauccgguacaacagcgaccucguccagaaguaccaccccugcuucuggaucgacgggcaguaccugugcugcucccagaccgcgaagaacgccaugggcugccagauccuggagaaccgcaacggcagccucaagcccggguccagccaccggaagacgaagaagccccugccgcccacccccgaggaggaccagauccugaagaagccccucccgcccgagcccgccgccgcccccguguccaccagcgagcugaagaagguggucgcgcuguacgacuacaugccgaugaacgccaacgaccuccagcugcgcaagggcgacgaguacuucauccuggaggaguccaaccuccccugguggcgggcccgcgacaagaacgggcaggagggcuacauccccagcaacuacgugaccgaggccgaggacuccaucgagauguacgagugguacagcaagcacaugacgcggagccaggcggagcagcugcugaagcaggaggggaaggagggcggcuucaucgugcgcgacuccagcaaggccgggaaguacaccgucuccguguucgccaagagcaccggcgacccccagggggugauccggcacuacgucgugugcuccaccccgcagagccaguacuaccucgccgagaagcaccuguucuccacgauccccgagcugaucaacuaccaccagcacaacagcgccggccucaucucccgccugaaguaccccgugagccagcagaacaagaacgcgcccuccaccgccggccugggguacggcagcugggagaucgacccgaaggaccucaccuuccugaaggagcuggggaccggccaguucggggucgugaaguacggcaaguggcggggccaguacgacguggccaucaagaugaucaaggagggguccaugagcgaggacgaguucaucgaggaggccaaggucaugaugaaccucucccacgagaagcuggugcagcuguacggcgucugcacgaagcagcgccccaucuucaucaucaccgaguacauggccaacgggugccuccugaacuaccugcgcgagaugcggcaccgcuuccagacccagcagcuccuggagaugugcaaggacgugugcgaggcgauggaguaccuggagagcaagcaguuccuccaccgggaccuggccgcccgcaacugccuggugaacgaccagggcgucgugaagguguccgacuucgggcucagccgguacguccuggacgacgaguacaccuccagcgugggcagcaaguuccccgugcgcugguccccgcccgagguccugauguacagcaaguucuccagcaaguccgacaucugggccuucggcgugcucaugugggagaucuacagccuggggaagaugcccuacgagcgguucacgaacuccgagaccgccgagcacaucgcgcagggccugcgccuguaccggccccaccucgccagcgagaagguguacaccaucauguacuccugcuggcacgagaaggccgacgagcgcccgaccuucaagauccugcugagcaacauccucgacgucauggacgaggaguccuga

SEQ ID NO: 27390 - RNA, 726 nt, Artificial Sequence
  derived and/or modified sequence opt1 from BTLA__Homo_sapiens__NP_001078826
augaagacccugcccgccaugcucggcaccgggaagcuguucuggguguucuuccugaucccguaccucgacaucuggaacauccacggcaaggagagcugcgacguccagcuguacaucaagcgccaguccgagcacagcauccuggccggggaccccuucgagcucgagugccccgugaaguacugcgcgaaccggccccacgugacguggugcaagcugaacggcacgaccugcgucaagcuggaggaccgccagaccuccuggaaggaggagaagaacaucagcuucuucauccuccacuucgagccggugcugcccaacgacaacggguccuaccggugcagcgccaacuuccaguccaaccugaucgagagccacuccaccacccucuacgugaccggcaagcagaacgagcugagcgacaccgccggccgcgagaucaaccuggucgacgcccaccucaaguccgagcagacggaggccagcacccggcagaacucccaggugcugcugagcgagaccgggaucuacgacaacgaccccgaccucugcuuccgcaugcaggagggcuccgagguguacagcaaccccugccuggaggagaacaagccggggaucgucuacgcgucccugaaccacagcgugaucggccccaacucccggcucgcccgcaacgugaaggaggcccccaccgaguacgccagcaucugcguccggagcuga

SEQ ID NO: 27391 - RNA, 1581 nt, Artificial Sequence
  derived and/or modified sequence opt1 from BTN1A1__Homo_sapiens__NP_001723
auggccguguuccccagcuccggccugccgcgcugccuccugacccugauccuccugcagcugcccaagcucgacagcgcccccuucgacgucaucgggcccccggagcccauccuggcgguggugggcgaggacgccgagcugcccugccggcucucccccaacgccagcgccgagcaccuggagcugcgcugguuccggaagaaggucuccccggccgugcucgugcaccgcgacgggcgggagcaggaggcggagcagaugcccgaguaccgcggccgggccacccugguccaggacgggaucgccaagggccgcguggcccugcggauccgcggcgugcgggucagcgacgacggggaguacacgugcuucuuccgcgaggacggcuccuacgaggaggcgcucgugcaccugaagguggccgcccuggggagcgacccccacaucuccaugcagguccaggagaacggcgagaucugccucgagugcaccagcguggggugguaccccgagccccaggugcaguggcggaccuccaagggcgagaaguuccccagcaccuccgagagccgcaaccccgacgaggagggccuguucacggucgccgccuccgugaucauccgggacaccagcgcgaagaacguguccugcuacauccagaaccugcuccuggggcaggagaagaaggucgagaucagcauccccgccuccagccugccgcgccucacccccuggaucguggccguggccgucauccugauggugcugggccuccugaccaucgggagcaucuucuucacguggcggcuguacaacgagcgcccccgggagcgccggaacgaguucuccagcaaggagcgccuccuggaggagcugaaguggaagaaggccacccuccacgcgguggacgucacccuggaccccgacaccgcccacccgcaccuguuccucuacgaggacuccaagagcgugcgccuggaggacucccggcagaagcugcccgagaagacggagcgcuucgacagcuggcccugcguccucggccgggagaccuucaccuccggccgccacuacugggagguggaggugggggaccggaccgacugggccaucggcgucugccgcgagaacgugaugaagaagggguucgaccccaugacgccggagaacggcuucugggccguggagcuguacgggaacggcuacugggcccugaccccgcuccggacgccccugccccuggcgggcccgccccgccgggucgggaucuuccucgacuacgagagcggcgacaucuccuucuacaacaugaacgacgggagcgacaucuacaccuucuccaacgugaccuucagcggcccccugcgcccguucuucugccugugguccagcgggaagaagccccucaccaucugccccaucgccgacggccccgagcgggugaccgucaucgccaacgcccaggaccuguccaaggagaucccgcugagccccaugggcgaggacuccgcgccccgcgacgccgacacccugcacagcaagcucauccccacgcagccgucccagggggcccccuga

SEQ ID NO: 27392 - RNA, 1401 nt, Artificial Sequence
  derived and/or modified sequence opt1 from BTN2A1__Homo_sapiens__NP_001184162
auggaggugcgcugguuccggagccaguucucccccgccgucuucguguacaagggcgggcgcgagcggaccgaggagcagauggaggaguaccgcggccggaccacguucgugagcaaggacaucucccgcgggagcgucgcccuggugauccacaacaucaccgcgcaggagaacggcaccuaccggugcuacuuccaggaggggcgcuccuacgacgaggccauccuccaccugguggucgccggccugggcagcaagccgcucaucuccaugcgggggcacgaggacggcgggauccgccuggagugcaucagccggggcugguaccccaagccccugaccguguggcgcgaccccuacgggggcguggccccggcccucaaggaggucuccaugcccgacgcggacggccuguucauggugacgaccgccgugaucauccgggacaagagcguccgcaacauguccugcagcaucaacaacacccugcucgggcagaagaaggaguccgugaucuucauccccgagagcuucaugcccuccgugagcccgugcgccgucgcccugcccaucaucguggugauccugaugauccccaucgcggucugcaucuacuggaucaacaagcuccagaaggagaagaagauccuguccggcgagaaggaguucgagcgggagacccgcgagaucgcccugaaggagcucgagaaggagcgggugcagaaggaggaggagcuccaggugaaggagaagcugcaggaggagcugcgcuggcggcgcacguuccugcacgccgucgacguggugcuggaccccgacaccgcccacccggaccucuuccugagcgaggaccggcgcuccguccgccggugccccuuccgccaccugggggagagcgugcccgacaaccccgagcgguucgacagccagccgugcguccucggccgcgaguccuucgccagcggcaagcacuacugggagguggagguggagaacgucaucgaguggaccgugggggugugccgggacuccgucgagcgcaagggcgaggugcugcugaucccccagaacggguucuggacccucgagaugcacaagggccaguaccgggcggugagcucccccgaccgcauccugccccugaaggagagccucugccgggucgggguguuccuggacuacgaggccggcgacguguccuucuacaacaugcgcgaccggagccacaucuacacgugcccgcgcuccgccuucagcguccccgugcggcccuucuuccgccugggcugcgaggacucccccaucuucaucugcccggcccucaccggggccaacggcgugaccguccccgaggaggggcugacccugcaccgggugggcacgcaccagagccucuga

SEQ ID NO: 27393 - RNA, 1572 nt, Artificial Sequence
  derived and/or modified sequence opt1 from BTN2A2__Homo_sapiens__NP_001184166
auggagcccgccgccgcgcugcacuucagccucccggccucccugcugcuccugcugcuccugcugcuccugagccugugcgcccucguguccgcccaguucaccgucgugggccccgccaaccccauccuggcgauggugggggagaacaccacgcugcgcugccaccucagccccgagaagaacgccgaggacauggagguccggugguuccgcucccaguucagcccggccguguucguguacaagggcgggcgggagcgcaccgaggagcagauggaggaguaccggggccgcaucaccuucgucuccaaggacaucaaccgggggagcguggcccuggugauccacaacgucaccgcgcaggagaacggcaucuaccgcugcuacuuccaggagggccgguccuacgacgaggccauccugcgccucgugguggccgggcugggcagcaagccccugaucgagaucaaggcccaggaggacggguccaucuggcucgagugcaucagcggcgggugguaccccgagccccugacggucuggcgggacccguacggcgagguggugcccgcccugaaggaggucuccaucgcggacgccgacggccucuucauggugaccaccgccgugaucauccgcgacaaguacguccggaacgugagcugcuccgugaacaacacccugcuggggcaggagaaggagacggucaucuucauccccgagagcuucaugcccuccgccagcccguggaugguggcccucgcggugauccugaccgccucccccuggauggucagcaugaccgugauccuggccgucuucaucaucuucauggccgugagcaucugcugcaucaagaagcuccagcgcgagaagaagauccuguccggcgagaagaagguggagcaggaggagaaggagaucgcccagcagcugcaggaggagcuccgguggcgccggaccuuccugcacgcggccgacgucgugcuggaccccgacacggcccaccccgagcuguuccucagcgaggaccgccgguccgugcgccgggggccguaccgccagcgcguccccgacaaccccgagcgguucgacagccagcccugcgugcugggcugggaguccuucgccagcggcaagcacuacugggagguggaggucgagaacgugaugguguggaccgucggggugugccgccacuccguggagcggaagggcgagguccuccugaucccgcagaacggguucuggacccuggagauguucggcaaccaguaccgcgcccucagcucccccgagcggauccugccccugaaggagagccucugccgcguggggguguuccuggacuacgaggcgggcgacgucuccuucuacaacaugcgggaccgcagccacaucuacacgugcccccgguccgccuucaccgugccggugcgccccuucuuccggcugggcagcgacgacucccccaucuucaucugccccgcccucaccggggccagcggcgucauggugccggaggaggggcugaagcugcaccgcgugggcacccaccagucccuguga

SEQ ID NO: 27394 - RNA, 1386 nt, Artificial Sequence
  derived and/or modified sequence opt1 from BTN3A1__Homo_sapiens__NP_001138480
augaagauggccagcuuccuggccuuccuccugcugaacuuccgcgugugccuccugcugcuccagcugcugaugccccacuccgcgcaguucagcguccucggcccguccgggcccauccuggccauggugggcgaggacgccgaccugcccugccaccucuuccccaccaugagcgccgagaccauggagcugaaguggguguccagcucccugcggcaggucgugaacguguacgccgacgggaaggaggucgaggaccgccagagcgcgccguaccggggccgcacguccauccuccgggacgggaucaccgccggcaaggccgcccugcgcauccacaacgugaccgcgagcgacuccggcaaguaccugugcuacuuccaggacggggacuucuacgagaaggcccucguggagcugaaggucgccgacggcguggggcuguacgccguggccgcgagcgucaucaugcggggcuccagcggggagggcguguccugcaccauccgcagcucccuccugggccuggagaagacggccagcaucuccaucgccgaccccuucuuccggagcgcccagcgcuggaucgccgcgcucgccgggacccugcccgugcugcuccugcugcucggcggggccggcuacuuccuguggcagcagcaggaggagaagaagacccaguuccggaagaagaagcgcgagcaggagcugcgggagauggccuggagcaccaugaagcaggagcaguccacgcgcgucaagcuccuggaggagcugcgguggcgcagcauccaguacgccucccggggcgagcgccacagcgcguacaacgaguggaagaaggcccucuucaagcccgccgacgugauccuggacccgaagaccgccaaccccauccugcucguguccgaggaccagcggagcguccagcgcgccaaggagccccaggaccugcccgacaacccggagcgguucaacuggcacuacugcgugcuggggugcgaguccuucaucagcggccgccacuacugggagguggaggucggggaccgcaaggaguggcacaucggcgugugcuccaagaacgugcagcggaaggggugggucaagaugacccccgagaacggcuucuggaccaugggccucacggacgggaacaaguaccgcacccugaccgagccccggaccaaccugaagcuccccaagccgcccaagaaggugggcgucuuccuggacuacgagacgggggacaucagcuucuacaacgcgguggacggcucccacauccacaccuuccuggacgugagcuucuccgaggcccucuaccccgucuuccgcauccugacccuggagcccaccgcccugacgaucugcccggccuga

SEQ ID NO: 27395 - RNA, 1005 nt, Artificial Sequence
  derived and/or modified sequence opt1 from BTN3A2__Homo_sapiens__NP_001184175
augaagauggccagcucccuggccuuccuccugcugaacuuccacgugagccuccugcugguccagcuccugacccccugcuccgcgcaguucagcgugcugggcccguccgggcccauccucgccauggugggcgaggacgccgaccugcccugccaccuguuccccaccaugagcgccgagacgauggagcucaagugggucuccagcucccugcgccagguggugaacgucuacgccgacgggaaggagguggaggaccggcagagcgcgccguaccgcggccggaccuccauccugcgcgacgggaucaccgccggcaaggccgcccuccggauccacaacgugaccgcgagcgacuccggcaaguaccugugcuacuuccaggacggggacuucuacgagaaggcccuggucgagcucaagguggccgcccugggcagcaaccugcacguggaggucaagggguacgaggacggcgggauccaccucgagugccgcuccacgggcugguacccccagccccagauccaguggagcaacgccaagggcgagaacauccccgcgguggaggccccgguggucgccgacggggugggccuguacgagguggccgccuccgucaucaugcgcgggggcagcggcgaggggguguccugcaucauccggaacagccugcucggccuggagaagaccgcgagcaucuccaucgccgaccccuucuuccggagcgcccagcccuggaucgccgcccuggcggggacccuccccauccugcugcuccugcuggccggcgccuccuacuuccucuggcgccagcagaaggagaucaccgcccugagcuccgagaucgagagcgagcaggagaugaaggagaugggguacgccgcgacggagcgggagaucucccugcgcgagagccuccaggaggagcugaagcggaagaagauccaguaccugacccgcggcgaggaguccagcuccgacaccaacaagagcgccuga

SEQ ID NO: 27396 - RNA, 1755 nt, Artificial Sequence
  derived and/or modified sequence opt1 from BTN3A3__Homo_sapiens__NP_008925
augaagauggccagcucccuggccuuccuccugcugaacuuccacgugagccucuuccugguccagcugcucacccccugcuccgcgcaguucagcgugcugggcccguccgggcccauccuggccauggugggcgaggacgccgaccuccccugccaccuguuccccaccaugagcgccgagacgauggagcugcgcugggucuccagcucccuccgccagguggugaacgucuacgccgacgggaaggagguggaggaccggcagagcgcgccguaccggggccgcaccuccauccugcgggacgggaucaccgccggcaaggccgcccugcgcauccacaacgugaccgcgagcgacuccggcaaguaccucugcuacuuccaggacggggacuucuacgagaaggcccuggucgagcugaagguggccgcccucggcagcgaccugcacaucgaggugaagggguacgaggacggcgggauccaccuggagugccgguccacgggcugguacccccagccccagaucaaguggagcgacaccaagggcgagaacauccccgccgucgaggcgccggugguggccgacggggucggccucuacgccguggccgccuccgugaucaugcgcgggagcuccggcggcggggucagcugcaucauccggaacagccugcugggccucgagaagaccgcguccaucagcaucgccgaccccuucuuccgcuccgcccagcccuggaucgccgcccuggcggggacccugcccaucagccuccugcugcucgccggcgccuccuacuuccuguggcggcagcagaaggagaagaucgcccugagccgcgagacggagcgggagcgcgagaugaaggagaugggguacgccgcgaccgagcaggagaucucccuccgggagaagcugcaggaggagcugaaguggcgcaagauccaguacauggcccggggcgagaagucccucgccuaccacgaguggaagauggcccuguucaagccggcggacgugauccuggaccccgacaccgccaacgccauccuccuggugagcgaggaccagcgcagcguccagcgggccgaggagccccgcgaccugcccgacaacccggagcgguucgaguggcgcuacugcgugcucggcugcgagaacuucaccuccgggcgccacuacugggagguggaggucggcgaccggaaggaguggcacaucggggugugcagcaagaacgucgagcgcaagaagggcugggugaagaugacgcccgagaacggguacuggaccaugggccugaccgacggcaacaaguaccgggcccugaccgagccccgcacgaaccucaagcugcccgagccgccccggaagguggggaucuuccuggacuacgagaccggcgagaucuccuucuacaacgcgaccgacgggagccacaucuacaccuucccccacgccuccuucagcgagccccucuacccggucuuccgcauccugacgcuggagcccaccgcccugaccaucugccccauccccaaggagguggaguccagcccggaccccgaccucgugcccgaccacucccuggagaccccgcugacgcccggccucgccaacgagagcggggagccccaggccgaggucaccagccugcugcuccccgcgcacccgggcgccgaggugucccccagcgccaccaccaaccagaaccacaagcugcaggcccggacggaggcccuguacuga

SEQ ID NO: 27397 - RNA, 1449 nt, Artificial Sequence
  derived and/or modified sequence opt1 from BTNL2__Homo_sapiens__NP_001291490
augguggacuuccccggcuacaaccugagcggggccgucgccuccuuccucuucauccugcugaccaugaagcagagcgaggacuuccgcgugaucggcccggcgcaccccauccucgccggggugggcgaggacgcccugcugaccugccagcuccugcccaagcggacgaccaugcacgucgaggugcgcugguaccgguccgagcccagcaccccgguguucguccaccgcgacgggguggaggugaccgagaugcagauggaggaguaccggggcugggucgaguggaucgagaacggcaucgccaaggggaacguggcccugaagauccacaacauccagcccuccgacaacggccaguacuggugccacuuccaggacgggaacuacugcggcgagacgagccuccugcugaagguggcggggcucggcuccgcccccagcauccacauggagggccccggggaguccggcguccagcuggugugcaccgcccgcgggugguucccggagccccagguguacugggaggacauccggggcgagaagcugcucgccgucagcgagcaccgcauccaggacaaggacggccuguucuacgcggaggccacccugguggugcggaacgccuccgccgagagcgucuccugccucgugcacaaccccgugcugaccgaggagaaggggagcgucaucucccugcccgagaagcuccagacggagcuggccagccugaaggugaacggcccgucccagcccauccucgugcgcgucggggaggacauccagcugaccugcuaccugagccccaaggcgaacgcccaguccauggaggugcggugggaccgcagccaccgguaccccgccguccacguguacauggacggcgaccacguggccggggagcagauggccgaguaccgcggccggaccguccucgugagcgacgcgaucgacgagggccgccugacccugcagauccucuccgcccggccgagcgacgacgggcaguaccgcugccuguucgagaaggacgacguguaccaggaggccucccuggaccucaaggucgugagccugggcuccagcccccugaucacgguggaggggcaggaggacggcgagaugcagcccaugugcuccagcgacgggugguucccccagccgcacguccccuggcgggacauggagggcaagaccauccccuccagcucccaggcccucacccagggcagccacgggcuguuccacgugcagacccugcuccgcgugacgaacaucuccgccgucgacgugaccugcagcaucuccauccccuuccugggcgaggagaagaucgcgaccuucagccuguccgagagccggaugaccuuccucuggaagacgcugcuggugugggggcuccugcuggccgucgccgugggccucccgcgcaagcgcuccuga

SEQ ID NO: 27398 - RNA, 1740 nt, Artificial Sequence
  derived and/or modified sequence opt1 from BTRC__Homo_sapiens__NP_001243785
auggaccccgccgaggccgugcugcaggagaaggcgcucaaguucaugugcagcaugccgcgcucccuguggcugggcugcagcucccucgccgacagcaugcccucccugcggugccuguacaaccccgggaccggcgcccucaccgccuuccagacguacaacagcugcgcccgccugugccugaaccaggagaccgucugccucgcguccaccgccaugaagaccgagaacugcguggccaagacgaagcuggccaacgggaccagcuccaugaucgugcccaagcagcggaagcugagcgcguccuacgagaaggagaaggagcucugcgucaaguacuucgagcaguggagcgaguccgaccagguggaguucguggagcaccugaucagccagaugugccacuaccagcacggccacaucaacuccuaccugaagccgaugcuccagcgcgacuucaucaccgcccugcccgcccgggggcuggaccacaucgccgagaacauccucagcuaccuggacgccaagucccugugcgcggccgagcucgucugcaaggagugguaccgcgugaccagcgacggcaugcuguggaagaagcugaucgagcggauggugcgcacggacucccucuggcggggccuggccgagcgccggggguggggccaguaccuguucaagaacaagccgcccgacgggaacgccccgcccaacagcuucuaccgcgcccucuaccccaagaucauccaggacaucgagaccaucgagagcaacuggcggugcggccgccacucccugcagcggauccacugccgcagcgagaccuccaagggggucuacugccugcaguacgacgaccagaagaucgugagcggccuccgggacaacaccaucaagaucugggacaagaacacgcuggagugcaagcgcauccugaccggccacaccggguccgugcucugccugcaguacgacgagcgggucaucaucaccggcagcuccgacagcacggugcgcgugugggacgucaacaccggggagaugcugaacacccucauccaccacugcgaggcggugcugcaccuccgguucaacaacggcaugauggugaccugcuccaaggaccgcagcaucgccgucugggacauggccucccccacggacaucacccugcgccgggugcuggugggccaccgcgccgccgucaacgugguggacuucgacgacaaguacaucgucagcgcguccggggaccggaccaucaagguguggaacaccagcacgugcgaguucguccgcacccugaacggccacaagcgggggaucgccugccuccaguaccgcgaccggcuggugguguccggcagcuccgacaacaccauccgccugugggacaucgagugcggggccugccuccggguccuggagggccacgaggagcuggugcgcugcauccgguucgacaacaagcgcaucgugagcggcgccuacgacgggaagaucaaggucugggaccucguggccgcgcuggacccccgggcccccgccggcacccugugccugcgcacgcucguggagcacuccgggcgggucuuccgccugcaguucgacgaguuccagaucgugagcagcucccacgacgacaccauccugaucugggacuuccucaacgaccccgccgcgcaggccgagcccccgcggagccccucccgcaccuacaccuacaucagccgguga

SEQ ID NO: 27399 - RNA, 3153 nt, Artificial Sequence
  derived and/or modified sequence opt1 from BUB1B__Homo_sapiens__NP_001202
auggccgccgugaagaaggagggcggggcgcugagcgaggccaugucccucgagggcgacgagugggagcugagcaaggagaacguccagccccugcgccaggggcggaucauguccacccuccagggcgcccuggcccaggagagcgccugcaacaacacccugcagcagcagaagcgcgcguucgaguacgagauccgguucuacacggggaacgacccgcucgacgugugggaccgcuacaucuccuggaccgagcagaacuacccccagggcggcaaggagagcaacauguccacccugcuggagcgggccguggaggcccuccagggggagaagcgcuacuacagcgacccccgguuccugaaccuguggcucaagcugggccgccugugcaacgagccccucgacauguacuccuaccugcacaaccaggggaucggcgucagccuggcccaguucuacaucuccugggcggaggaguacgaggcccgggagaacuuccgcaaggccgacgccaucuuccaggaggggauccagcagaaggccgagccgcucgagcggcugcagagccagcaccgccaguuccaggcgcgggugucccgccagacccugcucgcccuggagaaggaggaggaggaggagguguucgagagcuccgucccccagcggagcacgcuggccgagcucaaguccaagggcaagaagaccgcccgcgcccccaucauccgggugggcggggcgcugaaggcccccagccagaaccgcggccugcagaacccguucccccagcagaugcagaacaacucccggaucaccguguucgacgagaacgccgacgaggccagcaccgccgagcucagcaagcccacgguccagcccuggaucgcgccgcccaugccccgcgccaaggagaacgagcugcaggccgggcccuggaacaccggccggucccuggagcaccgcccgcgcggcaacaccgccagccucaucgccgugcccgcggugcugcccuccuucacccccuacgucgaggagacggcccagcagccggugaugacccccugcaagaucgagcccagcaucaaccacauccuguccacccggaagcccgggaaggaggagggcgacccgcuccagcgcgugcagagccaccagcaggccuccgaggagaagaaggagaagaugauguacugcaaggagaagaucuacgccggggucggcgaguucagcuucgaggagauccgggcggagguguuccgcaagaagcugaaggagcagcgggaggccgagcugcucaccuccgccgagaagcgcgccgagaugcagaagcagaucgaggagauggagaagaagcugaaggagauccagacgacccagcaggagcggaccggggaccagcaggaggagaccaugcccacgaaggagaccaccaagcugcagaucgccagcgagucccagaagauccccggcaugacccucagcuccagcgugugccaggucaacugcugcgcgcgcgagacgucccuggccgagaacaucuggcaggagcagccccacagcaagggcccguccgugcccuucagcaucuucgacgaguuccugcucuccgagaagaagaacaagagcccgcccgccgacccgccccgggugcuggcccagcgccggccccuggccguccucaagaccagcgaguccaucaccagcaacgaggacgugucccccgacgugugcgacgaguucaccgggaucgagccccugagcgaggacgcgaucaucacgggcuuccgcaacgucaccaucugccccaaccccgaggacacgugcgacuucgcccgggccgcccgcuucguguccaccccguuccacgagaucaugagccugaaggaccuccccuccgaccccgagcggcugcugcccgaggaggaccuggacgucaagaccagcgaggaccagcagaccgccugcgggaccaucuacucccagacccucagcaucaagaagcuguccccgaucaucgaggacagccgcgaggcgacgcacuccagcggcuucuccgggagcuccgccagcguggccagcaccuccagcaucaagugccugcagauccccgagaagcucgagcugaccaacgagaccuccgagaaccccacccagagccccuggugcucccaguaccggcgccagcugcucaagagccugccggagcuguccgccagcgcggagcucugcaucgaggaccggcccaugcccaagcuggagaucgagaaggagaucgagcugggcaacgaggacuacugcaucaagcgcgaguaccucaucugcgaggacuacaagcuguucuggguggcgccccgcaacuccgccgagcugacggucaucaaggugagcucccagccggugcccugggacuucuacaucaaccucaagcugaaggagcggcugaacgaggacuucgaccacuucugcagcugcuaccaguaccaggacggcugcaucgucuggcaccaguacaucaacugcuucacccuccaggaccugcugcagcacuccgaguacaucacccacgagaucaccgugcucaucaucuacaaccugcugacgaucguggagaugcuccacaaggccgagaucguccacggggaccugagcccccgcugccugauccuccggaaccgcauccacgaccccuacgacugcaacaagaacaaccaggcccugaagaucguggacuucuccuacagcguggaccugcggguccagcucgacguguucacccuguccggcuuccgcaccgugcagauccuggaggggcagaagauccucgccaacugcagcuccccguaccaggucgaccuguucggcaucgccgaccuggcccaccuccugcuguucaaggagcaccuccagguguucugggacgggagcuucuggaagcugagccagaacaucuccgagcugaaggacggcgagcucuggaacaaguucuucgugcggauccugaacgccaacgacgaggccaccgucagcgugcugggcgagcucgcggccgagaugaacgggguguucgacacgaccuuccagucccaccugaacaaggcccuguggaaggucggcaagcucaccagccccggggcccugcuguuccaguga

SEQ ID NO: 27400 - RNA, 3198 nt, Artificial Sequence
  derived and/or modified sequence opt1 from BUB1__Homo_sapiens__NP_001265545
auggacacccccgagaacgugcugcaguacauccagugggucgaggagaacuucccggagaacaaggaguaccucaucacccugcuggagcaccucaugaaggaguuccuggacaagaagaaguaccacaacgacccccgcuucaucagcuacugccugaaguucgccgaguacaacuccgaccuccaccaguucuucgaguuccuguacaaccacggcaucgggacgcugagcuccccccucuacaucgccugggcgggccaccuggaggcccagggggagcugcagcacgccagcgccgugcuccagcggggcauccagaaccaggccgagccccgcgaguuccugcagcagcaguaccggcuguuccagacccgccucaccgagacccaccugccggcgcaggcccggacguccgagccccugcacaacgugcagguccucaaccagaugaucaccagcaaguccaaccccgggaacaacauggccugcaucagcaagaaccagggcuccgagcugagcggcgugaucuccagcgccugcgacaaggaguccaacauggagcgccgggugaucaccaucagcaaguccgaguacagcguccacuccagccuggcguccaagguggacguggagcaggucgugauguacugcaaggagaagcucauccgcggggagagcgaguucagcuucgaggagcugcgggcccagaaguacaaccagcgccggaagcacgagcagugggugaacgaggaccgccacuacaugaagcggaaggaggccaacgccuucgaggagcagcugcucaagcagaagauggacgagcugcacaagaagcugcaccaggucguggagaccucccacgaggaccuccccgccagccaggagcgcuccgaggugaacccggcgcggaugggccccagcgucgggucccagcaggagcugcgcgcccccugccugcccgugacguaccagcagaccccggugaacauggagaagaacccccgggaggccccccccgucgugccgccccucgccaacgccaucagcgcggcccuggugucccccgccaccagccaguccaucgcccccccggucccccugaaggcccagaccgugacggacagcauguucgcgguggccuccaaggacgccggcugcgucaacaagagcacccacgaguucaagccccaguccggggccgagaucaaggagggcugcgagacccacaagguggccaacaccagcuccuuccacacgacccccaacaccagccucggcaugguccaggcgaccccguccaaggugcagcccagccccacggugcacaccaaggaggcccugggguucaucaugaacauguuccaggcccccacccugccggacaucuccgacgacaaggacgaguggcagagccucgaccagaacgaggacgccuucgaggcgcaguuccagaagaacguccgcagcuccggcgccuggggggugaacaagaucaucagcucccugagcuccgccuuccacguguucgaggacggcaacaaggagaacuacggccugccccagcccaagaacaagccgaccggggcccggacguucggcgagcgcagcgucucccggcuccccagcaagcccaaggaggaggugccccacgccgaggaguuccuggacgacuccaccgugugggggauccgcugcaacaagacccuggcgccgagccccaagucccccggcgacuucaccagcgccgcccagcucgccuccacgcccuuccacaagcugccggucgagagcgugcacauccuggaggacaaggagaacguggucgccaagcagugcacccaggcgacccucgacuccugcgaggagaacaugguggugcccagccgcgacgggaaguucucccccauccaggagaagagccccaagcaggcccugagcucccacauguacagcgccucccugcuccggcugagccagccggccgccggcggcguccugaccugcgaggcggagcuggggguggaggccugccgccucacggacaccgacgccgccaucgcggaggacccccccgacgccaucgccggccugcaggccgaguggaugcagauguccagccuggggaccguggacgcccccaacuucaucgucggcaacccgugggacgacaagcucaucuucaagcugcuguccgggcucagcaagcccguguccagcuaccccaacaccuucgaguggcagugcaagcugcccgcgaucaagccgaagacggaguuccagcugggcuccaagcucguguacguccaccaccugcugggcgagggggccuucgcccagguguacgaggccacccagggcgaccucaacgacgccaagaacaagcagaaguucgugcugaagguccagaagcccgcgaaccccugggaguucuacaucgggacccagcugauggagcggcucaagcccagcaugcagcacauguucaugaaguucuacuccgcccaccuguuccagaacggcagcgugcuggugggggagcucuacuccuacggcacccugcugaacgccaucaaccucuacaagaacaccccggagaaggucaugccccagggccuggugaucagcuucgccaugcgcaugcuguacaugaucgagcaggugcacgacugcgagaucauccacggggacaucaagcccgacaacuucauccucggcaacggguuccuggagcaggacgacgaggacgaccuguccgccggccucgcgcugaucgaccugggccagagcaucgacaugaagcucuucccgaaggggacgaucuucaccgccaagugcgagaccuccggcuuccagugcgucgagaugcugagcaacaagcccuggaacuaccagaucgacuacuucgggguggccgccaccguguacugcaugcuguucggcacguacaugaaggucaagaacgaggggggcgagugcaagcccgagggccucuuccggcgccugccccaccuggacauguggaacgaguucuuccacgugaugcucaacaucccggacugccaccaccugcccagccuggaccuccugcggcagaagcugaagaagguguuccagcagcacuacaccaacaagauccgcgcgcuccggaaccgccugaucguccugcuccuggagugcaagcggucccgcaaguga

SEQ ID NO: 27401 - RNA, 981 nt, Artificial Sequence
  derived and/or modified sequence opt1 from BUB3__Homo_sapiens__NP_001007794
augaccggcagcaacgaguucaagcugaaccagcccccggaggacgggaucuccagcgugaaguucucccccaacaccagccaguuccuccuggucuccagcugggacacguccgugcgccuguacgacgugcccgccaacagcaugcggcucaaguaccagcacaccggcgccguccuggacugcgcguucuacgaccccacccacgccugguccgggggccuggaccaccagcucaagaugcacgaccugaacaccgaccaggagaaccugguggggacgcacgacgccccgauccgcugcguggaguacugccccgaggucaacgugauggugaccggcagcugggaccagaccgucaagcucugggacccccggacccccugcaacgccggcacguucucccagccggagaagguguacacccugagcguguccggggaccgccugaucgucggcaccgccgggcggcgcgugcucgugugggaccugcggaacaugggcuacguccagcagcgccgggagagcucccugaaguaccagacccgcugcauccgggcguuccccaacaagcagggguacgugcucagcuccaucgagggccgcguggccgucgaguaccuggaccccagccccgaggugcagaagaagaaguacgccuucaagugccaccggcugaaggagaacaacaucgagcagaucuacccggugaacgccaucuccuuccacaacauccacaacacguucgcgaccggcgggagcgacggcuucgucaacaucugggaccccuucaacaagaagcgccucugccaguuccaccgguaccccaccagcaucgccucccuggccuucagcaacgacgggaccacgcuggccaucgccuccagcuacauguacgagauggacgacaccgagcaccccgaggacggcaucuucauccgccaggugaccgacgcggagaccaagccgaaguccacguga

SEQ ID NO: 27402 - RNA, 1458 nt, Artificial Sequence
  derived and/or modified sequence opt1 from BUD13__Homo_sapiens__NP_001153208
auggccgccgcgccgccccugagcaaggccgaguaccucaagcgcuaccuguccggcgccgacgccgggguggaccggggcagcgaguccgggcgcaagcggcgcaagaagcggcccaagcccggcggggccggcggcaaggggaugcgcaucgucgacgacgacgugagcuggaccgcgaucuccaccacgaagcuggagaaggaggaggaggaggacgacggcgaccuccccguggucgccgaguucguggacgagcggcccgaggaggugaagcagauggaggccuuccgcagcuccgccaaguggaagcugcucgggggccacaacgaggaccugcccagcaaccggcacuuccgccacgacacccccgacuccagcccccggcgcguccggcacgggacccccgaccccagcccccgcaaggaccggcacgacacccccgacccgagcccccgccgggcgcgccacgacacgcccgaccccuccccgcugcggggcgcccgccacgacagcgacaccuccccgccccggcgcauccgccacgacagcuccgacaccagcccgccccggcgcgcccggcacgacucccccgaccccagcccgccccgccggccccagcacaacagcuccggcgacugccagaaggccaccgacagcgaccuguccagcccccgccacaagcagucccccgggcaccaggacagcgacuccgaccucagcccgccccggaaccgcccccggcaccgcuccagcgacuccgaccugagcccgccccggcgccggcagcgcacgaaguccagcgacuccgaccuguccccgccccggcgcucccagccgcccggcaagaaggccgcgcacauguacagcggggccaagaccggccucgugcugaccgacauccagcgggagcagcaggagcugaaggagcaggaccaggagaccauggccuucgaggccgaguuccaguacgccgagacgguguuccgcgacaaguccggccggaagcgcaaccucaagcuggagcgccuggagcagcggcgcaaggcggagaaggacagcgagcgggacgagcucuacgcccagugggggaagggccuggcccagagccgccagcagcagcagaacgucgaggacgccaugaaggagaugcagaagccccuggcccgguacaucgacgacgaggaccucgaccgcaugcugcgggagcaggagcgcgagggggaccccauggcgaacuucaucaagaagaacaaggccaaggagaacaagaacaagaaggugcggccccgcuacuccggccccgccccgccgcccaaccgguucaacaucuggcccggguaccgcugggacggcguggaccggagcaacggcuucgagcagaagcgcuucgcccggcuggccuccaagaaggcggucgaggagcucgccuacaaguggagcguggaggacauguga

SEQ ID NO: 27403 - RNA, 435 nt, Artificial Sequence
  derived and/or modified sequence opt1 from BUD31__Homo_sapiens__NP_003901
augcccaaggugaagcgcagccggaaggccccgcccgacggcugggagcugaucgagcccacccucgacgagcuggaccagaagaugcgcgaggccgagaccgagccccacgaggggaagcggaaggucgagucccuguggccgaucuuccgcauccaccaccagaagacgcgguacaucuucgaccucuucuacaagcgcaaggcgaucagccgggagcuguacgaguacugcaucaaggagggcuacgccgacaagaaccugaucgccaaguggaagaagcagggguacgagaaccucugcugccugcgcugcauccagacccgggacaccaacuucggcaccaacugcaucugccgcgugcccaaguccaagcuggagguggggcggaucaucgagugcacgcacugcggcugccgcggcugcagcggguga

SEQ ID NO: 27404 - RNA, 1083 nt, Artificial Sequence
  derived and/or modified sequence opt1 from BVES__Homo_sapiens__XP_011533700
augaacuacaccgagagcagcccccugcgcgaguccaccgccaucggcuucacgccggagcucgaguccaucauccccgugcccagcaacaagacgaccugcgagaacuggcgggagauccaccaccuggucuuccacguggccaacaucugcuucgcgguggggcuggucauccccaccacccuccaccuccacaugaucuuccugcgcggcaugcugacccuggggugcacccuguacaucgugugggccacccucuaccggugcgcccuggacaucaugaucuggaacuccguguuccugggcgucaacauccuccaccugagcuaccugcucuacaagaagcgcccggugaagaucgagaaggagcuguccgggauguaccggcgccuguucgagccccuccgggugccgcccgaccuguuccgccggcugacgggccaguucugcaugauccagacccucaagaagggccagaccuacgccgccgaggacaagaccagcgucgacgaccgccuguccauccugcucaaggggaagaugaaggugagcuaccggggccacuuccugcacaacaucuaccccugcgcguucaucgacucccccgaguuccgcagcacgcagaugcacaagggggagaaguuccaggugaccaucaucgccgacgacaacugccgguuccugugcuggucccgcgagcggcucaccuacuuccuggagagcgagcccuuccuguacgagaucuuccgcuaccucaucggcaaggacaucaccaacaagcuguacucccugaacgaccccacgcucaacgacaagaaggccaagaagcuggagcaccagcugagccucugcacccagaucuccaugcuggagaugcggaacagcaucgccuccagcagcgacuccgacgacgggcugcaccaguuccuccgcggcaccagcuccaugagcucccugcacgucagcuccccgcaccagcgggcgagcgccaagaugaagcccaucgaggagggcgccgaggacgacgacgacguguucgagcccgccucccccaacacccugaaggugcaccagcucccguga

SEQ ID NO: 27405 - RNA, 1314 nt, Artificial Sequence
  derived and/or modified sequence opt1 from BYSL__Homo_sapiens__NP_004044
augcccaaguucaaggccgcccgcggcgucgggggccaggagaagcacgcgccgcuggccgaccagauccucgccgggaacgccgugcgggccggcgugcgcgagaagcggcgcgggcggggcaccggcgaggcggaggaggaguacguggggccccgccugagccggcgcauccugcagcaggcccggcagcagcaggaggagcucgaggccgagcacggcaccggggacaagcccgccgcgccccgcgagcggacgacccgccugggcccgcggaugccccaggacggguccgacgacgaggacgaggaguggcccacccuggagaaggccgccaccaugacggccgccggccaccacgcggaggucgugguggaccccgaggacgagcgcgccaucgagauguucaugaacaagaacccgcccgcccggcgcacccucgccgacaucaucauggagaagcugaccgagaagcagaccgaggucgagacggugaugagcgagguguccggcuuccccaugccccagcuggacccgcggguccucgagguguaccgcggggugcgggagguccugagcaaguaccgcuccggcaagcugcccaaggccuucaagaucauccccgcgcucagcaacugggagcagauccuguacgugaccgagcccgaggccuggaccgccgccgccauguaccaggcgacccggaucuucgccuccaaccugaaggagcgcauggcccagcgcuucuacaaccucgugcugcugccgcggguccgcgacgacguggccgaguacaagcggcucaacuuccaccuguacauggcccugaagaaggcccucuucaagcccggggcgugguucaagggcauccugaucccccugugcgagagcggcacgugcacccuccgcgaggccaucaucgugggguccaucaucaccaagugcagcauccccguccugcacuccagcgccgcgaugcugaagaucgccgagauggaguacuccggcgccaacagcaucuuccuccggcugcugcucgacaagaaguacgcccugccguaccgcgugcuggacgcccucguguuccacuuccugggguuccggaccgagaagcgcgagcugcccguccucuggcaccagugccugcugacgcucgugcagcgguacaaggcggaccuggccaccgaccagaaggaggcccugcucgagcugcugcgccuccagccccacccccagcuguccccggagauccggcgcgagcugcagagcgccgugccccgggacgucgaggacgugcccaucaccgucgaguga

SEQ ID NO: 27406 - RNA, 5547 nt, Artificial Sequence
  derived and/or modified sequence opt1 from BZRAP1__Homo_sapiens__NP_001248764
auggagcagcugaccacccucccccgccccggcgaccccggggccauggagcccugggcccugcccaccuggcacuccuggacccccggccgcggcggggagcccuccagcgccgcccccuccaucgccgacacgccgcccgccgcccugcagcuccaggagcugcggagcgaggaguccagcaagcccaagggggacggguccagccggcccgugggcgggaccgaccccgagggcgccgaggccugccugcccucccucgggcagcaggccagcuccagcggccccgccugccagcgccccgaggacgaggagguggaggcguuccugaaggccaagcugaacauguccuucggggaccggcccaaccucgagcugcugcgcgcccucggcgagcugcggcagcgcugcgccauccugaaggaggagaaccagaugcuccggaaguccuccuuccccgagaccgaggagaaggugcgccggcugaagcgcaagaacgccgagcuggcggugaucgccaagcggcucgaggagcgcgcccggaagcugcaggagaccaaccugcgcguggugagcgcgccccugccccggcccggcaccucccuggagcugugccgcaaggcccucgcgcggcagcgcgcccgggaccugagcgagaccgccuccgcccugcucgccaaggacaagcagaucgcggcccugcagcgcgagugccgcgagcugcaggcccggcucacgcugguggggaaggagggcccccaguggcugcacgugcgcgacuucgaccggcuccugcgcgagagccagcgggaggugcugcgccuccagcggcagaucgcccugcgcaaccagcgggagacccugccccugccgcccagcuggccgcccgggcccgcccugcaggcgcgcgccggcgcccccgcccccggcgcgcccggggaggccacgccccaggaggacgccgacaaccugcccgugauccucggcgagcccgagaaggagcagcgggugcagcagcuggaguccgagcugagcaagaagcgcaagaagugcgagucccucgagcaggaggcccggaagaagcagcgccggugcgaggagcuggagcugcagcuccgccaggcccagaacgagaacgcgcggcugguggaggagaacagccgccuguccgggcgggccaccgagaaggagcaggucgagugggagaacgccgagcugcgcggccagcuccugggggugacgcaggagcgcgacagcgcccugcggaagucccagggccuccagagcaagcuggagucccuggagcagguccucaagcacaugcgcgagguggcccagcggcgccagcagcuggagguggagcacgagcaggcgcggcugagccuccgcgagaagcaggaggaggugcggcgccugcagcaggcccaggccgaggcccagcgggagcacgagggcgccgugcagcugcucgaguccacccuggacagcaugcaggcgcgcguccgggagcuggaggagcagugccgcucccagaccgagcaguucagccuccuggcccaggagcugcaggccuuccggcuccaccccgggccccuggaccugcucaccuccgcccuggacugcggcagccugggggacugcccgcccccgcccugcugcugcuccaucccgcagcccugccgcggcagcgggcccaaggaccucgaccugcccccgggcucccccggccggugcacgcccaagagcagcgagcccgcgccggccacccugaccggggugccccgccggaccgccaagaaggccgagucccucagcaacuccagccacuccgagagcauccacaacucccccaagagcugccccacgccggagguggacaccgccuccgaggucgaggagcuggaggcggacagcgugucccugcuccccgccgcccccgagggcagccgcgggggcgcccggauccagguguuccuggcccgcuacuccuacaaccccuucgaggggccgaacgagaaccccgaggcggagcugccccucaccgccggcgaguacaucuacaucuacggcaacauggacgaggacggguucuucgagggcgagcugauggacgggcggcgcggccuggucccgagcaacuucguggagcgcgucuccgacgacgaccuccugaccagccugccgcccgagcucgccgaccugucccacagcagcggccccgagcuguccuuccucagcgucgggggcgggggcuccagcuccgggggccagagcuccgugggccggagccagccgcgccccgaggaggaggacgccggggacgagcugucccugagccccucccccgagggccucggggagccgcccgccguccccuacccccggcgccugguggugcugaagcagcucgcgcacagcgucgugcuggccugggagccgccgcccgagcaggucgagcugcacggcuuccacaucugcgucaacggggagcuccggcaggcccugggccccggcgccccgcccaaggcggugcuggagaaccucgaccugugggccgggccccugcacaucuccgugcaggcccucacgagccgcggcuccagcgacccccugcggugcugccuggccgucggggcccgcgcgggcguggugccgucccagcuccggguccaccgccugaccgccaccagcgccgagaucaccugggugcccgggaacuccaaccuggcccacgccaucuaccucaacggcgaggagugcccgcccgcgagcccgagcacguacugggccaccuucugccaccuccggcccggcacccccuaccaggcccagguggaggcccagcugcccccgcaggggcccugggagcccggcugggagcgccucgagcagcgggccgcgacccugcaguucacgacccugccggccgggccgcccgacgcgccccuggacguccagaucgagccgggccccucccccgggauccugaucaucagcuggcugcccgugaccaucgacgccgccggcaccuccaacggcgugcgcgucacgggguacgcgaucuacgccgacggccagaagaucauggagguggccagcccgaccgccggguccgugcucgucgagcugagccagcugcagcuccuccaggugugccgggagguggucgugcgcaccaugagcccccacggcgagagcgcggacuccauccccgcccccaucaccccggcccuggcccccgccagccuccccgcgcggguguccugccccagcccgcaccccucccccgaggcccgcgcgccccuggccagcgccuccccgggccccggggaccccagcagcccccugcagcacccggcgccccucggcacccaggagccgcccggggccccgcccgccagccccucccgggagauggccaagggcagccacgaggacccgcccgcccccugcagccaggaggaggcgggggccgccguccugggcacguccgaggagcgcaccgccagcaccuccacccugggcgagaaggaccccgggccggcggcccccagccucgccaagcaggaggccgaguggacggccggcgaggcgugccccgccuccagcuccacccagggggcccgcgcccagcaggcccccaacaccgagaugugccagggcggggacccgggcagcggccugcggccccgcgcggagaaggaggacaccgccgagcugggggugcaccucgugaacucccuggucgaccacggccggaacagcgaccuguccgacauccaggaggaggaggaggaggaggaggaggaggaggaggaggagcucgggagccgcacgugcuccuuccagaagcaggucgccggcaacagcauccgggagaacggggccaagucccagcccgaccccuucugcgagaccgacagcgacgaggagauccuggagcagauccuggagcucccgcugcagcaguucugcuccaagaagcuguucagcauccccgaggaggaggaggaggaggaggaggacgaggaggaggagaaguccggcgccggcugcagcagccgcgaccccgggcccccggagcccgcgcugcucggccuggggugcgacuccggccagccccggcgccccggccagugcccgcugagccccgaguccagccgggccggggacugccucgaggacaugcccggccuggucgggggcuccagccgccggcgcgggggcggcucccccgagaagccgcccagccggcgccggcccccggacccccgcgagcacugcucccggcugcucagcaacaacgggccccaggccuccggccgccuggggcccacccgggagcgcggcgggcugccggucaucgagggcccccggaccggccucgaggccagcgggcgcggccgccuggggcccucccggcgcugcagccggggccgcgcgcuggagcccgggcucgccuccugccugagcccgaagugccuggagaucuccaucgaguacgacagcgaggacgagcaggaggccggcuccggcgggaucagcaucacgagcuccugcuaccccggcgacggggaggccuggggcaccgccaccguggggcggccccgcggcccgcccaaggcgaacagcggccccaagcccuacccccggcuccccgccugggagaagggggagcccgagcgccggggccgcuccgccaccgggcgggccaaggagccccugagccgcgccacggagaccggcgaggcgcggggccaggacggguccggccgccgggggccccagaagcgcggcgugcggguccugcgcccgagcaccgccgagcucgugcccgcccggucccccagcgagacccuggccuaccagcaccuccccgugcgcaucuucgucgcccucuucgacuacgacccgguguccaugagccccaaccccgacgcgggggaggaggagcugcccuuccgcgagggccagauccugaagguguucggcgacaaggacgccgacggguucuaccagggcgagggcggcgggcggacgggcuacaucccgugcaacauggucgccgagguggccguggacucccccgccggccgccagcagcuccugcagcggggguaccugagccccgacauccuccuggagggcuccgcgcacaccaccgggccgccgcccaagccccgccggagcaagaaggccgaguccgagggcccggcccagcccugccccgggcccccgaagcugguccccagcgccgaccucaaggcgccccacuccaugguggccgccuucgacuacaacccccaggagagcuccccgaacauggacguggaggccgagcugcccuuccgcgccggcgacgucaucaccguguucggcgggauggacgacgacggcuucuacuacggggagcugaacggccagcgggggcucguccccagcaacuuccuggagggccccggcccggaggccgggggccuggaccgcgagccccggacgccccaggccgagagccagcgcacccggcgccggcgcgugcagugcuga

SEQ ID NO: 27407 - RNA, 1260 nt, Artificial Sequence
  derived and/or modified sequence opt1 from BZW1__Homo_sapiens__NP_001193996
augaacaaccagaagcagcagaagcccacccugagcggccagcgcuucaagacccggaagcgcgacgagaaggagcgguucgacccgacgcaguuccaggacugcaucauccaggggcucaccgagaccggcaccgaccuggaggccguggccaaguuccuggacgcguccggggccaagcucgacuaccgccgguacgccgagacgcuguucgacauccuggucgccggcgggaugcucgcccccggcggcacccuggcggacgacaugaugcgcaccgacgugugcguguucgccgcccaggaggaccuggagaccaugcaggccuucgcgcaggucuucaacaagcucauccggcgcuacaaguaccuggagaagggguucgaggacgaggugaagaagcugcuccuguuccugaagggcuucagcgaguccgagcggaacaagcucgccaugcugacgggggugcugcucgccaacggcacccugaacgccagcauccugaacucccucuacaacgagaaccuggucaaggagggggugagcgccgcguucgccgugaagcuguucaaguccuggaucaacgagaaggacaucaacgccgucgccgccagccuccgcaagguguccauggacaaccggcugauggagcuguuccccgcgaacaagcagagcguggagcacuucaccaaguacuucaccgaggccggccucaaggagcuguccgaguacguccgcaaccagcagacgaucggcgcccggaaggagcugcagaaggagcuccaggagcagaugagccgcggggaccccuucaaggacaucauccuguacgugaaggaggagaugaagaagaacaacaucccggagcccguggucaucggcaucgugugguccagcgugauguccaccgucgaguggaacaagaaggaggagcugguggccgagcaggccaucaagcaccucaagcaguacagcccccugcuggcggccuucaccacccaggggcaguccgagcucacgcugcugcucaagauccaggaguacugcuacgacaacauccacuucaugaaggccuuccagaagaucgugguccuguucuacaaggccgaggugcugagcgaggagcccauccucaagugguacaaggacgcccacguggcgaagggcaaguccgucuuccuggagcagaugaagaaguucguggaguggcugaagaacgccgaggaggagagcgagagcgaggccgaggagggcgacuga

SEQ ID NO: 27408 - RNA, 627 nt, Artificial Sequence
  derived and/or modified sequence opt1 from C10orf107__Homo_sapiens__XP_005269657
auggacuucagcaucauccaguacuccaaguucaugacccugcucgccaugagccugcagaaccugaagacccuccacaugucccuggaggagagcaucaaguggcugggcgaggugauggccgagaucgggcccacgcacucccagaaguccgaggacuggaacaucuucgacgucaagcaggcgaacgccaucaucgacuaccucaagaucagccuguuccagcacuacaagcuguacgaguucauguucuacagcgcccgcgaggagaucgugaucggcaccgagcaggucaucgagguggugaaguccgccugcgggccguuccccaacccccucgaggagggcaucagcuucgacaucuacuccaccuucaucgagcccccgaccauccuggacacggagaugaagcggcuggaccaggagcaggggcccgaggagagccagcccgagaccgacaccuccgacauggacccccucgugggcuucaccaucgaggacgucaagagcgugcuggaccaggugacggacgacauccugaucggcauccagaccgagaucaacgagaagcuccagauccaggaggaggccuucaacgcgcgcaucgagaagcugaagaaggccuga

SEQ ID NO: 27409 - RNA, 639 nt, Artificial Sequence
  derived and/or modified sequence opt1 from C10orf10__Homo_sapiens__NP_008952
augcgcagccggcugcugcuguccguggcccaccuccccaccauccgcgagaccacggaggagaugcugcugggcgggccgggccaggagcccccgcccagccccucccuggacgacuacguccggagcaucucccgccucgcccagcccaccagcgugcuggacaaggcgaccgcccaggggcagccccggcccccgcaccgccccgcccaggccugccggaagggccgccccgccgugucccugcgggacaucaccgcgcgcuucagcgggcagcagcccacgcucccgauggccgacaccgucgacccccuggacuggcuguucggcgagucccaggagaagcagcccagccagcgggaccucccccgccggaccggcccguccgccgggcuguggggcccccaccgccagauggacagcuccaagcccaugggggcgccccggggccgccugugcgaggcccggaugccggggcacagccucgcccgcccgccccaggacggccagcaguccagcgaccugcgguccuggaccuucggccagagcgcccaggccauggccucccgccaccggccccgccccagcagcgugcugcgcacgcucuacucccaccuccccgugauccacgagcuguga

SEQ ID NO: 27410 - RNA, 468 nt, Artificial Sequence
  derived and/or modified sequence opt1 from C10orf113__Homo_sapiens__NP_001010896
auggccaagagcgagcgccggaucuacuccauggagagcauggcccccgagaucuccgaggacaucggcugcccgcuggcguacaugcgcgagagcgugugcgcccuccugaucaaccaguccuucuucagcugcgucgccgagauguacauccccgacaugaaccggcccgggaaggccgagcgccgggccgagaagggccugcggcccccgcgcaagcucgugggggagacccgccggcugcaguccuggcccacccuggcgcgcuggcuccggcgcgugagcuucucccuguacaagccgcccauccaggccgcccccgagcccgaccccggcaacugggccaagagcccccggcugucccucgggccggagggcaucacgaagggcaagcacggguucaaguuccagggcaucaaggagaaguucaacgucagcaagaaggugcugaagaugaccuuccuguga

SEQ ID NO: 27411 - RNA, 597 nt, Artificial Sequence
  derived and/or modified sequence opt1 from C10orf11__Homo_sapiens__NP_114413
auggagaaguaccugagccucuccggcaaccacagcuccaacaagcgcagccuggaggggcuguccgccuuccggagccucgaggagcugauccuggacaacaaccagcucggcgacgaccuggugcugcccgggcucccgcgccugcacacccugacccucaacaagaaccggaucacggaccuggagaaccugcucgaccaccuggccgaggucacccccgcgcuggaguaccucucccugcugggcaacguggccugccccaacgagcucgugagccuggagaaggacgaggaggacuacaagcgcuaccggugcuucguccuguacaagcuccccaaccugaaguuccuggacgcccagaaggugacccgccaggagcgggaggaggcccucgugcgcggggucuucaugaagguggugaagccgaaggccuccagcgaggacgucgcguccagccccgagcggcacuacacgccccugcccuccgccagccgcgagcugaccucccaccagggcgugcucggcaagugccgguacguguacuacgggaagaacagcgagggcaaccgcuucauccgggacgaccagcuguga

SEQ ID NO: 27412 - RNA, 1749 nt, Artificial Sequence
  derived and/or modified sequence opt1 from C10orf2__Homo_sapiens__NP_001157284
augugggugcugcuccgcagcggcuacccccugcggauccugcucccgcugcgcggggaguggaugggccggcgcgggcugccccggaaccucgcccccgggcccccgcgccggcgcuaccggaaggagacccugcaggcccuggacaugcccguccuccccgugaccgcgacggagauccgccaguaccugcggggccacggcauccccuuccaggacggccacuccugccugcgcgcccucagcccguucgccgaguccagccagcugaaggggcagaccggcgugaccaccuccuucagccuguucaucgacaagacgaccgggcacuuccucugcaugaccucccuggccgagggcagcugggaggacuuccaggccuccgucgaggggcggggcgacggcgcgcgcgagggguuccugcucagcaaggcccccgaguucgaggacuccgaggaggugcggcgcaucuggaaccgggccaucccccugugggagcugcccgaccaggaggaggugcagcucgccgacaccauguucggccugacgaaggucaccgacgacacccugaagcgcuucagcgugcgguaccuccgcccggcgcggucccugguguuccccugguucagccccgggggcuccggccugcgcgggcucaagcugcuggaggccaagugccagggcgacggggucagcuacgaggagaccacgaucccccgcccguccgccuaccacaaccucuucggccugccccugaucagccggcgcgacgccgagguggugcucaccucccgggagcuggacagccuggcccucaaccagagcaccgggcugcccacccugacgcucccccgcggcacgaccugccugccgcccgcgcugcuccccuaccuggagcaguuccggcgcaucgucuucuggcugggcgacgaccuccgguccugggaggccgccaagcuguucgcccgcaagcugaaccccaagcggugcuuccucgugcgcccgggggaccagcagccccggccccuggaggcccugaacggcggguucaaccugagccgcauccuccggaccgcgcugcccgccuggcacaaguccaucgugagcuuccgccagcugcgggaggagguccucggcgagcuguccaacguggagcaggccgccgggcugcgcuggagccgguucccggaccucaaccgcauccugaagggccaccggaagggcgagcugaccguguucaccgggcccaccggcuccgggaagaccacguucaucagcgaguacgcccucgaccugugcucccagggcgucaacacccugugggggagcuucgagaucuccaacgugcgccucgcgcgcgugaugcugacccaguucgccgagggccggcuggaggaccagcucgacaaguacgaccacugggccgaccgcuucgaggaccugccccuguacuucaugaccuuccacggccagcagagcauccggacggucaucgacaccaugcagcacgccguguacguguacgacaucugccacgucaucaucgacaaccuccaguucaugauggggcacgagcagcuguccaccgaccgcaucgccgcgcaggacuacaucaucggcguguuccggaaguucgccaccgacaacaacugccacgucacgcuggugauccacccgcgcaaggaggacgacgacaaggagcuccagaccgccagcaucuucggguccgccaaggugagcggccuguga

SEQ ID NO: 27413 - RNA, 321 nt, Artificial Sequence
  derived and/or modified sequence opt1 from C10orf32__Homo_sapiens__NP_001129672
augauggccaccggcacccccgagagccaggcccgcuucgggcaguccgugaagggccugcucacggagaaggucacgaccugcgggaccgacgugaucgcgcugaccaagcagguccugaagggcagccgguccagcgagcuccuggggcaggccgcccgcaacauggugcugcaggaggacgccauccuccacuccgaggacagccugcggaagauggccaucaucaccacccaccuccaguaccagcaggaggcgauccagaagaacguggagcaguccagcgaccugcaggaccagcugaaccaccuccugaaguga

SEQ ID NO: 27414 - RNA, 366 nt, Artificial Sequence
  derived and/or modified sequence opt1 from C10orf35__Homo_sapiens__NP_660349
auggugcgcauccuggccaacggcgagaucguccaggacgacgacccccgggugcgcaccaccacgcagccgccccgggggagcaucccccgccaguccuucuucaaccggggccacggggcgcccccgggcgggcccggcccccgccagcagcaggccggcgcccggcucggggccgcccagagccccuucaacgaccugaaccgccagcuggugaacaugggcuucccgcaguggcaccucgggaaccacgccgucgagcccgugaccuccauccugcuccuguuccugcugaugaugcucggcgugcgggggcugcugcucgucggccugguguaccuggugagccaccucucccagcgcuga

SEQ ID NO: 27415 - RNA, 936 nt, Artificial Sequence
  derived and/or modified sequence opt1 from C10orf54__Homo_sapiens__NP_071436
augggcgugcccaccgcccuggaggccgggagcuggcgcuggggcucccuccuguucgcgcuguuccucgccgccagccuggggccggucgccgccuucaagguggcgacccccuacucccuguacgugugccccgagggccagaacgucacgcugaccugccggcugcuggggcccguggacaagggccacgacgugaccuucuacaagaccugguaccgcagcucccggggcgagguccagacgugcagcgagcgccggccgauccgcaaccucaccuuccaggaccugcaccuccaccacgggggccaccaggccgccaacaccucccacgaccucgcccagcggcacgggcuggagagcgcguccgaccaccacggcaacuucagcaucaccaugcgcaaccugacgcuccuggacuccgggcuguacugcugccucgugguggagauccggcaccaccacagcgagcaccgcguccacggcgccauggagcuccaggugcagaccggcaaggacgcccccuccaacugcguggucuaccccagcuccagccaggacuccgagaacaucaccgccgccgcgcuggccaccggggccugcaucgugggcauccugugccugccccugauccuccugcugguguacaagcagcggcaggccgccagcaaccgccgggcgcaggagcucguccgcauggacuccaacauccaggggaucgagaacccgggcuucgaggccagcccgcccgcccagggcauccccgaggccaaggugcggcacccccugagcuacguggcccagcgccagcccuccgagagcgggcggcaccuccuguccgagcccagcacgccccuguccccgcccggccccggggacgucuucuuccccagccuggacccggugcccgacucccccaacuucgaggugaucuga

SEQ ID NO: 27416 - RNA, 558 nt, Artificial Sequence
  derived and/or modified sequence opt1 from C10orf67__Homo_sapiens__NP_714925
augauggcccuggugcgggaccggcgcgcccacuacgucaugagcaucgugauccggugggugcacugcuucuccagcucccuccgcggcaccuucgggacccggugggaggcgaugaaggccaaggccacggagcugcgcgucugcugcgcccggcgcaagcgggaggcccgcgaguucaagcccccgcagaugcggggcagcacccgccugaacaucuccgacgaccucaagaucggguucuucagcaccgaccacgcgacccagacggacuccagcgagauccuguccgugaaggagcugagcuccagcacccagaagcucgcccagaugaugaagucccuccagguggacuucggcuuccugaagcagcugcugcagcugaaguucgaggaccggcucaaggaggagagccugucccuguucaccauccuccacgaccgcauccuggagaucgagaagcacuaccagcagaacgaggacaagaugcgcaagagcuucaaccagcagcuggccgacgccaucgcggucaucaaggggauguaccagccccucuga

SEQ ID NO: 27417 - RNA, 465 nt, Artificial Sequence
  derived and/or modified sequence opt1 from C10orf82__Homo_sapiens__NP_653262
auggagcccagcaagaccuucaugcgcaaccugccgaucacccccggcuacuccggguucgugcccuuccucagcugccagggcauguccaaggaggacgacaugaaccacugcgucaagacguuccaggagaagacccagcgguacaaggagcagcugcgcgagcugugcugcgccguggccaccgcgcccaagcucaagccggugaacagcgaggagaccguccugcaggcccugcaccaguacaaccuccaguaccacccccugauccuggagugcaaguacgugaagaagccccuccaggagcccccgauccccgggugggccggcuaccugccccgggccaaggugacggaguucgggugcggcacccgcuacaccgucauggccaagaacugcuacaaggacuuccuggagaucaccgagcgggcgaagaaggcccaccucaagcccuacgaggaguga

SEQ ID NO: 27418 - RNA, 1338 nt, Artificial Sequence
  derived and/or modified sequence opt1 from C10orf88__Homo_sapiens__NP_079218
auggagacccgcaccgaggacggcgggcugacgcggcgccccacccucgccagcuccugggacguggccggcggggcgcugacccacagccugcuccugacccgggccggccuggggcccggcgacuucgacugggaggagcuccuggccccgcccgcccccggccaggaccuggucauccucaagcgcaaccacaacaacaaggacgagaaccccugcuuccuguaccugcggugcgggcccgacggcggggaggagaucgccuccaucggcauccucagcuccgcgcgcaacauggagguguaccugggggaggaguacugcggcacgagccggggcaagaacgugugcaccguccuggacgacuccgagcacgagaagaucauccucuacaagaagaaccugaagcuggagagcuccacccacgccugcaagaucaagcuccugagcuucggggagcgccagugcguguucaucuccaagguggucgugcacaugcggagcguguucgccaacuccagcaccuccagccccgcccugggcucccgcaucgaccucgacaagguccagacgaucauggagagcaugggguccaagcugagccccggcgcgcagcagcugauggacauggugcggugccagcagcgcaacugcaucccgaucggcgagcagcuccagagcgugcuggggaacuccggcuacaagcacaugaucgggcugcagagcuccagcacccucggcacccugaacaaguccagcuccacccccuuccccuuccggacggggcugaccagcggcaacgucaccgagaaccuccagaccuacaucgacaaguccacgcagcugcccggcggggagaacagcaccaagcuggacgagugcaaggugaugccgcagaaccacuccuuccucgagaacgaccugaagaacgccauggccagcuuccugcccaagaagguguccgacaacagcaacauccccaacuccgagcuccugcccuuccugcagaaccucugcagccaggucaaccaccuccacgugggcaacaagaccgagugccaggagaacaucaccaagcacggggagcgcauccugggcguggggauggaggagcaguccaucugcagcuaccuggagaagauccuguccaagaacauggagcugauggagaagaagcucauggacuacaucgaccagcggauccacgagcugcaggagcacaucgacgacaagaucgcccugcuccuggaccugcugcagaacccgaacagcccgcccacgggcaucccccuccgccacuacgacagcggcgagcggcuguccaacggggagcgcuga

SEQ ID NO: 27419 - RNA, 2100 nt, Artificial Sequence
  derived and/or modified sequence opt1 from C10orf90__Homo_sapiens__NP_001004298
augcugaagcucagcggcgaggggcugcgcgacuccuaccacagccggcgcgaccagaucgcccugaagaaccuccaguccgacgugaccgaggccaagagcgacuucaccaaggagacgcuggcgucccagaacaccaagaugaucagcuccaucgucaucagccagaugaucgacgagaacaagucccgggagaaccgcgccagccugccccucccgugcgccaucgcccagucccgggcccaccacgcgaagcagagccuggccaaccgcuccggcgugaacauccaccgggccuucgcccugcuccccgggcgccugggcauccccgcgcccagcgacgagcgggggccggaggccgagcugccgcccaaggaggagcgccccugcggcggcccccggcgcggguucgccuccaucaccaucaccgcccggcgcgugggcccgcccgcccgggcgcucgucugggggacggccggcgacagccugugccccaagugccgcgccgaggacacccuguuccaggccccgcccgcccucgcgaacggggcccaccccggccggcaccagcgcuccuucgccugcaccgaguucagccggaacuccagcguggugcgccugaagguccccgaggcccacaccggccugugcgagcggcgcaaguacugggugacgcacgccgacgacaaggagaccagcuucucccccgacacgccccucagcgggaaguccccgcugguguucagcuccugcguccaccuccgcgugagccagcagugccccgacuccaucuacuacguggacaagagccuguccguccccaucgagccgccccagaucgcgagccccaagaugcaccgguccgugcugagccugaaccucaacugcuccagccaccgccugaccgccgacggcguggacgggcuggucaaccgggagcccaucuccgaggcccucaagcaggagcugcuggagggcgaccaggaccucgugggccagcgcuggaaccccgggcugcaggagagccaccugaaggagacccccucccuccggcgcgugcaccugggcaccggggccugccccuggagcggcuccuucccgcuggagaacaccgagcucgccaacgucggggcgaaccaggugaccgugcggaagggcgagaaggaccacacgacccacugccacgccagcgaccacgccaaccagcugagcauccacauccccggcugguccuaccgcgccguccacaccaagguguucagcggguccagcaagcggcagcagggcgaggugugcaugaccgucuccgcgcccccgguggagcagaagcccacgcgccacuuccugcccaucggggacagcucccccagcgacgacugccucucccgggaccugagcgagccgaccgagcgccggcaccaguccuuccugaagccccgcauccucuuccccggcuuccugugcccccugcaggacgucugcgccagccuccaggaggacaacggggugcagaucgaguccaaguucccgaagggcgacuacacgugcugcgaccugguggucaagaucaaggagugcaagaaguccgaggaccccaccacccccgagcccagcccggccgcccccagccccgcgccccgggacggcgccggguccccgggccugagcgaggacugcagcgagucccagcagacccccgcccgcagccucacccugcaggaggcccuggaggugcggaagccccaguucaucucccgcagccaggagcggcugaagaagcucgagcacauggugcagcagcgcaaggcccagcgcaaggaggaccugcggcagaagcagucccugcuccccauccgcaccagcaagaagcaguucacgaucccgcacccccuguccgacaaccuguucaagcccaaggagcggugcaucagcgagaaggagaugcacaugcgcuccaagcggaucuacgacaaccuccccgaggucaagaagaagaaggaggagcagcgcaagcgggugauccugcagagcaaccgccugcgggccgagguguucaagaagcagcuccuggaccagcugcuccagcgcaacgcggucuga

SEQ ID NO: 27420 - RNA, 537 nt, Artificial Sequence
  derived and/or modified sequence opt1 from C11orf21__Homo_sapiens__NP_001136418
auggccagcuuccugguguggccccuccgcaccgcccugcggggcgggaaguccugggcgggcccgggggucggcugcgggggcgacggcgcccgcgggggcggggagcugagccucuccaaccuggaccugcccggcgccggggaggccggccucgagcaccacccccugcugggccaccucuucaucagcgccgugccccgguggccgcaccuguccagccaguccgggguggagccgcccgaccgcuggaccggcacgcccggguggcccagccgggaccaggaggcgcccggcuccaugaugccgcccgccgccgcccagcccagcgcgcacggcgcccuggucccgcccgccaccgcccacgagcccguggaccaccccgcccuccacuggcuggcgugcugcugcugccugucccuccccgggcagcugccccuggccauccgccucggcugggaccuggaccuggaggccgggcccagcuccggcaagcucugcccgcgggcccgccgguggcagccccugcccagcuga

SEQ ID NO: 27421 - RNA, 3969 nt, Artificial Sequence
  derived and/or modified sequence opt1 from C11orf30__Homo_sapiens__NP_064578
augcccguggucuggccgacccugcucgaccugagccgcgacgagugcaagcggauccugcgcaagcucgagcuggaggccuacgccggcgugaucuccgcgcugcgggcccagggggaccucaccaaggagaagaaggaccugcugggcgagcucagcaaggugcuguccaucagcacggagcgccaccgggccgagguccgccgggccgugaacgacgagcgccugaccaccaucgcccacaacauguccgggcccaacagcuccagcgagugguccaucgagggccggcgccucgugccccugaugccccggcuggucccgcagaccgcguucacggugaccgccaacgccguggccaacgcggccauccagcacaacgccagccuccccguccccgccgagaccggguccaaggagguggugugcuacagcuacaccuccacgaccagcacccccaccuccacgccgguccccagcggcuccaucgccaccgucaagagcccccgccccgcguccccggccagcaacgugguggugcugcccagcggcuccaccguguacgucaagagcguguccugcagcgacgaggacgagaagccccggaagcgccggcgcaccaacuccagcuccagcucccccgugguccugaaggaggugccgaaggccgugguccccgugagcaagacgaucaccguccccguguccgggagccccaagauguccaacaucaugcagagcaucgccaacucccucccgccccacaugagccccgugaagaucaccuucaccaagcccuccacgcagaccaccaacaccacgacccagaaggucaucaucgugaccaccagcccguccagcacguucgugcccaacauccugagcaagucccacaacuacgccgcggucaccaagcuggugcccaccagcgugaucgccuccaccacgcagaagcccccggucgugaucaccgccagccaguccagccucguguccaacagcuccagcggcuccagcuccagcacccccucccccaucccgaacaccgucgccgugacggccguggucagcuccacccccagcguggugaugagcaccgucgcgcaggggguguccaccagcgccaucaagauggccuccacccggcugcccagccccaagucccuggugagcgccccgacgcagauccucgcccaguuccccaagcagcaccagcagucccccaagcagcagcuguaccagguccagcagcagacccagcagcaggucgcgcagcccagcccggugucccaccagcagcagccccagcagagcccccugcccccgggcaucaagcccaccauccagaucaagcaggaguccggggugaagaucaucacccagcagguccagcccagcaagauccuccccaagccggugacggccacccugcccaccuccagcaacucccccaucaugguggugagcuccaacggcgccaucaugaccacgaagcuggugaccacccccaccggcacgcaggccaccuacacccgcccgaccgucagccccuccaucgggcggauggcggccacgcccggcgccgccaccuacgugaagaccaccagcgggagcaucaucacggugguccccaagucccucgccacccugggcggcaagaucaucagcuccaacaucgugagcgggaccaccacgaagaucaccaccaucccgaugaccuccaagcccaacgugaucgucgugcagaagacgaccggcaaggggaccaccauccagggccugcccgggaagaacguggucacgacccuccugaacgcgggcggcgagaagaccauccagaccgugccgacgggggccaagcccgccauccugaccgccacccgccccaucaccaagaugaucgugacccagcccaagggcaucgggagcacgguccagccggccgcgaagaucauccccaccaagaucguguacggccagcaggggaagacccaggugcucaucaagcccaagcccgucaccuuccaggccacggugguguccgagcagacccggcagcuggucaccgagacccugcagcaggccagccgcguggccgaggccggcaacuccagcauccaggagggcaaggaggagccgcagaacuacacggacuccagcuccagcuccaccgagagcucccagagcucccaggacagccagcccgugguccacgugaucgcgagccgccggcaggacugguccgagcacgagaucgccauggagaccagccccaccaucaucuaccaggacgucuccagcgagucccagagcgccacguccaccaucaaggcccuccuggagcugcagcagaccaccgugaaggagaagcucgagagcaagccccgccagccgacgaucgaccugucccagauggcggugcccauccagaugacccaggagaagcggcacagccccgagucccccagcaucgccgucguggaguccgagcugguggccgaguacaucaccaccgagcgcacggacgaggggaccgaggucgccuucccgcuccuggugagccaccggucccagccccagcagcccagccagccccagcgcacccugcuccagcacguggcccagucccagaccgcgacgcagaccagcgucguggugaaguccaucccggccagcagccccggcgccaucacccacaucaugcagcaggcccuguccagccacaccgccuucacgaagcacuccgaggagcuggggaccgaggagggcgaggucgaggagauggacacccuggacccccagaccgggcuguucuaccggagcgcgcugacgcagucccagagcgccaagcagcagaagcugucccagcccccgcucgagcagacccagcuccaggugaagacccugcagugcuuccagaccaagcagaagcagacgauccaccuccaggccgaccagcugcagcacaagcugccccagaugccccagcucagcauccgccaccagaagcugacgccccugcagcaggagcaggcccagccgaagcccgacgugcagcacacccagcaccccauggucgccaaggaccggcagcucccgacccugauggcgcagccgccccagaccguggugcagguccuggccgugaagaccacccagcagcuccccaagcugcagcaggcccccaaccagcccaagaucuacgugcagccccagacgccccagucccagaugagccugccggccuccagcgagaagcagaccgcgucccaggucgagcagcccaucaucacccagggcagcuccgugaccaagaucaccuucgagggccgccagccgcccaccgugacgaagaucaccgggggcagcuccguccccaagcucaccagccccgugaccuccaucagccccauccaggccagcgagaagacggccguguccgacauccugaagaugagccugauggaggcccagaucgacaccaacgucgagcacaugaucguggacccgcccaagaaggcccucgcgaccuccaugcugaccggggaggccggcagccugcccuccacgcacaugguggucgccggcauggccaacagcacgccccagcagcagaagugccgggaguccugcagcucccccagcaccgugggguccagccucaccacccgcaagaucgacccgcccgccgugcccgcgaccggccaguucaugcggauccagaacgucgggcagaagaaggccgaggagucccccgccgagaucaucauccaggccaucccgcaguacgccauccccugccacagcuccagcaacgugguggucgagcccuccggccugcuggagcucaacaacuucaccagccagcagcuggacgacgaggagaccgcgauggagcaggacaucgacuccagcacggaggacgggaccgagcccagcccgucccagagcuccgccgagcgcagcuga

SEQ ID NO: 27422 - RNA, 711 nt, Artificial Sequence
  derived and/or modified sequence opt1 from C11orf53__Homo_sapiens__NP_940900
augcccggcagcccggugaccuccggguacuacggcguccgccggagcuuccuguccgacagcgacuuccacaacuccaagcaguucagcaacgacguguacaccuccagcguggggaagcccuuccccugcgaguccagcgccggccagucccacgccgcgcuccuggagcccuacuucccgcaggagcccuacggggacuaccgcccgcccgcccugacgcccaacgccggcagccucuucuccgccagcccccugccgccccuccugcccccgcccuuccccggcgaccccgcccacuuccuguuccgggacuccugggagcagacccugcccgacgggcucagccagcccgaccccgucuccgcggacgcccugcugacccucccgcccagcaccuccugccugagccagcuggagagcggcuccaucgcccagcaccgcgggagcuccuggggcagcucccucgccggggcgcagagcuacucccugcacgcccuggaggaccuccaccacacgcccggcuaccccaccccgccgcccuaccccuucacccccuucaugaccgugagcaacgaccugccgcccaaggugggcccccugucccccgacgaggaggccgacacggggagccuccacgaccccucccccugggucaaggaggacggcagcaucgccuggggguccuacgagugccggcgcgccuacuga

SEQ ID NO: 27423 - RNA, 942 nt, Artificial Sequence
  derived and/or modified sequence opt1 from C11orf65__Homo_sapiens__NP_689800
augcccuggaaggaggagagcgaguucaccaagcaggacaaggccgcccgcgugauccagcaggcguggaaguccuuccugaacgucgccaucuuccagcacuucaagagccucaucgaccugcggcgccagggcgagccgcggcagaucgugaaguacaucaaccccaaggaggccgagcugcucgacgccgccgcggggauccacgugcgcuuccggcugggcggggucaaguucccgcccgacaucuacuacaagaucuucacccaccgccccaucgaggaccugugcgccaacagcccccggaacuacgccaagcuccccgccaagcacacgagccacaacaagaacgaccaccuccaggaggaggaccacuccggcugguaccaccgcaucgagaacaacggguggcggcccgugagcgacaccuucuggcuguccaccgacggcaugguggucgaggacaagaaggagagcgaguuccacuucuccaagcugaagcgccggcaggaccuggagaagaagcgcaagcugcggaagaucgaguggaugcgccagauguacuacagcggcucccucgaggcgaaguccacccaccacgagacgcuggggcugauccacaccgccaccaagggccucauccgggccuucgaggacgggggcaucgacuccgugauggagugggagguggacgagguccugaacuggaccaacacgcugaacuucgacgaguacaucgccagcuggaaggagaucgccaccuccaacagcuccgcgaacuucaagggguuccgcuucaaccaggcccagaagaacaucuacaacuacggcggcgacaucagcaagaugcagauggggaucccggacgacaccuacuacgagaacguguaccaggagcccaacgugacccggcucacgcccgacuccaccuacggccuguga

SEQ ID NO: 27424 - RNA, 882 nt, Artificial Sequence
  derived and/or modified sequence opt1 from C11orf68__Homo_sapiens__NP_001129107
auggccgccgcggccgccgccgccguggcgggcgucgggcgcggcgggggcggggccgagccccggcaggagcgcagccgggcccgcggcugggccggcguggagcgguccgaggggcgcagccggauggagccgggcgaggagcuggaggaggaggggucccccggcgggcgcgaggacggcuucaccgcggagcaccucgccgccgaggccauggccgcggacauggaccccuggcugguguucgacgcccggaccacgcccgccaccgagcuggacgccuggcucgccaaguacccgcccagccaggucacccgcuacggcgaccccgggucccccaacagcgagccggugggcuggaucgcgguguacgggcagggcuacucccccaacagcggcgacguccaggggcugcaggccgccugggaggcccugcagaccuccggccggcccaucacgcccgggacccuccgccagcuggccaucacccaccacgugcugagcggcaaguggcucaugcaccuggcgccgggguucaagcuggaccacgccugggccggcaucgcccgggccguggucgagggccagcuccagguggcgaaggugagcccccgcgccaaggagggcgggcggcaggucaucugcguguacaccgacgacuucacggaccgccugggggugcuggaggccgacuccgccauccgggcggccggcaucaagugccuccugaccuacaagcccgacgucuacaccuaccuggggaucuaccgcgccaaccgguggcaccucugccccacccuguacgagucccgcuuccagcugggcggcagcgcccgggggucccgcgugcucgaccgcgccaacaacguggagcugacguga

SEQ ID NO: 27425 - RNA, 594 nt, Artificial Sequence
  derived and/or modified sequence opt1 from C11orf73__Homo_sapiens__NP_057485
auguucggcugccugguggccgggcgccucguccagaccgccgcgcagcaggucgccgaggacaaguucguguucgaccugcccgacuacgagagcaucaaccacguggugguguucaugcugggcaccaucccguuccccgaggggaugggcggguccgucuacuucagcuaccccgacuccaacggcaugcccguguggcagcuccugggcuucgugacgaacgggaagccgagcgccaucuucaagaucuccggccucaagagcggggagggcucccagcaccccuucggggccaugaacaucguccggacccccagcguggcccagaucggcaucuccguggagcugcuggacagcauggcgcagcagacccccgucggcaacgccgccguguccagcguggacuccuucacccaguucacgcagaagaugcuggacaacuucuacaacuucgccagcuccuucgcggucagccaggcccagaugaccccgucccccagcgagauguucauccccgccaacguggugcucaagugguacgagaacuuccagcgccggcuggcccagaacccccuguucuggaagaccuga

SEQ ID NO: 27426 - RNA, 444 nt, Artificial Sequence
  derived and/or modified sequence opt1 from C11orf74__Homo_sapiens__NP_001263656
augagcgcccacauguccggccuggagaucauggacgaggaccagcucaucaaggacgugcuggacaaguuccugaacugccacgagcagaccuacgacgaggaguuccucaacaccuucacgcaccugagccaggaccugcuccugcugcccggggaggucgagcaggacguguccaccagcaucccguccugcauccccuucguggcccagcccccgaccugcgaggucaagcccaagcccagcgugaagcgcauggacaagcagaccgaggagauccucggcgacgaggugcagcuguucucccuggacgaggaguucgacuacgacaacgucaugcucacgagcaaguucucccccgcggagaucgagaacaucaaggagcugugcaagcagcagaagcggaaggacaccagccccgaccuggagaaguccugcgacuga

SEQ ID NO: 27427 - RNA, 1536 nt, Artificial Sequence
  derived and/or modified sequence opt1 from C11orf80__Homo_sapiens__NP_001289013
auggugcugaagaaguuccucaaggagauccagagcauccugcccggcaucuccgccaagcugaccuggaccagcgaggagggguccuacagccaggacaugacgggcgucaccccguuccagaugaucuucgagguggacgagaagccccgcacccucaugaccgacugccuggugaucaagcacuuccugcggaagaucaucaugguccaccccaaggugcgcuuccacuucuccgugaaggucaacgggauccucagcacggagaucuucggcguggagaacgagcccacccugaaccuggggaacggcaucgcccuccugguggacucccagcacuacgucagccggccgaacuucggcaccaucgagucccacugcagccgcauccaccccgugcuggggcaccccgugaugcuguucauccccgaggacgucgcgggcauggaccugcugggggagcucauccugaccccggccgccgcccugugccccucccccaaggugagcuccaaccagcucaaccggaucagcuccgugagcaucuuccuguacggcccccuggggcucccgcugauccuguccacgugggagcagcccaugaccaccuucuucaaggacaccagcucccucgucgacuggaagaaguaccaccugugcaugauccccaaccuggaccucaaccuggaccgcgaccuggugcuccccgacgugagcuaccaggucgagagcuccgaggaggaccagagccagacgauggacccgcagggccagacccugcuccucuuccuguucguggacuuccacuccgccuuccccgugcagcagauggagaucuggggcgucuacacccugcucaccacgcaccugaacgcgauccugguggagagccacuccgugguccaggggagcauccaguucaccguggacaagguccucgagcagcaccaccaggccgccaaggcccagcagaagcugcaggcgucccugagcguggccgugaacuccaucaugagcauccucaccggcuccacccggagcuccuuccgcaagaugugccugcagacgcugcaggccgccgacacccaggaguuccggaccaagcuccacaaggucuuccgcgagaucacccagcaccaguuccugcaccacugcagcugcgaggugaagcagcugacgcucgagaagaaggacuccgcccaggggaccgaggacgcgcccgacaacagcucccuggagcugcuggccgacaccagcggccaggccgagaacaagcggcucaagcgcggcagcccccggaucgaggagaugcgcgcccugcgguccgcccgcgcgccgagccccuccgaggccgcgccccggcgccccgaggccaccgccgccccgcugacgccccgggggcgcgagcaccgggaggcccacggccgcgcccucgcccccgggcgcgccagccugggcucccggcuggaggacgugcucuggcugcaggaggucagcaaccuguccgaguggcucagccccuccccggggcccuga

SEQ ID NO: 27428 - RNA, 1035 nt, Artificial Sequence
  derived and/or modified sequence opt1 from C11orf87__Homo_sapiens__XP_011541119
augggccccaaggggagcgacgccgugcagggcgggcgcgucuggaccggccgggagcgcaagggcggccugcggacccgcagcccccggggcgggcccgagugggugcucggccgcguggggucccggcgccggcaccagccccgcggccggcgcaaggaggagucccggcgcagcgggaaccuggucccccugcagcggaagggcgagcgcggcgacguguucgagguggucuccgcccggaucagccgcgcgccgcucacgcccuggucccccugccugcccgccguggccccgcuggugcucgggagccuggcccacccccugccccuccagggcgccguccucgggggcgugggcuccgugcuguuccuggcggggcggaacggcguccccaagcgcgggagccuggugggccuggccccgcccucccccgcccccaugagcgcccgggcgccgaaggagcuccgccuggcccugccgcccugccuccugaaccgcaccuucgccucccccaacgccagcggguccggcaacaccggcgcccgggggcccggcgcgguggggagcgggaccugcaucacgcaggucgggcagcagcuguuccaguccuucagcuccacccucgugcugaucgugcuggucacccucaucuucugccugaucgugcugagccucagcaccuuccacauccacaagcgccggaugaagaagcgcaagaugcagcgggcccaggaggaguacgagcgcgaccacugcuccggcagccggggcgggggcgggcugccccgccccggccggcaggcccccacgcacgccaaggagacccgccuggagcggcagccgcgcgacucccccuucugcgcccccagcaacgcguccagccucuccagcuccagccccgggcugccgugccagggccccugcgcgcccccgcccccgccgcccgccuccagcccccagggcgcccacgccgccuccagcugccuggacaccgccggggagggccuccugcagaccgugguccuguccuga

SEQ ID NO: 27429 - RNA, 2037 nt, Artificial Sequence
  derived and/or modified sequence opt1 from C11orf95__Homo_sapiens__NP_001138408
auggagcccggcggggaccaccgcagccgguccagcggcgggcgcggcgggccgggccccgccguggccuccgcgcggggccgccggcugccccccgccgggagcuccggcagcgccgagccggaggaggacgaggggggccaggaccuccagcuggaggggggcgcccugggcuccugggggagcgccccccuccccuccagccgcgcgcggggccccgccuccagcgggcgcaaguacuccgaccacugcgaggcccgggccagccgcccgggcaagucccggauccccggccgcgaccaccggcgcuacuaccacgaccacuggcggcuggaguaccugauggacuucaaccccgcgcgccacgggauggucugcauggugugcggcagcucccucgccacccugaagcugagcaccaucaagcggcacauccgccagaagcaccccuacucccuccacuggagcccgcgggagaaggaggugaucagcaacuccugggacgcccaccuggggcugggcgccugcggggaggccgagggccucggcguccagggggcggaggaggaggaggaggaggaggaggaggaggaggaggagggcgccggggugcccgccugcccccccaagggcccggggaaggcccccgccggcggcgggugccgccggcagcgccgcggcgggcccguggcgccccgggcccgccggcugcgccugagcgccucccggcgcgccggcgggagccggggccucggcgcccgccggcuggagcgccggcugaaggagucccuccagaacugguuccgcgcggagugccugauggacuacgacccgcgggggaaccgccuggucugcauggccugcggccgggcccuccccagccugcaccuggacgacauccgcgcccacgugcucgaggugcaccccgggucccugggccugagcggcccccagcgguccgcccuccugcaggcgugggggggccagccggaggcccugagcgagcucacgcaguccccccccggggacgaccuggccccccaggaccugaccggcaagagccgcgacuccgccagcgcggccggggccccguccagccaggaccucuccccccccgacgucaaggaggaggccggcugggugccggagcggcccggccccgccgaggaggaggaggagcuggaggagggggagggcgagcgcgcgggggugcccggccgcagcccgcgggggcgcgcccaccggcgccacccccaggagcgguggcgccuggaguaccucauggagcuggacggcggccggcgcgggcuggucugcggcgugugcgggggcgcccucgccucccugaagaugagcaccaucgagcggcacauccgccggcgccaccccgggagcacccggcugggcggccccgugcaggcccucaucgcgcgcgagugguccgagaaggccgcccaccugcuggcccucgggccgccccggcccgagagcccccagggcccgaucccccccgggacggccgcggccuccgacgagggcgggggcgacgaggaggaggagcccgaggaggaggaggaggaguggggcgacgucccgcugagccccggggccccccuggagcgccccgccgaggaggaggaggacgaggaggacggccaggagccggggggccucgcgcugcccccccccccgccccccccgcccccccccccgccccggucccgcgagcagcggcgcaacuaccagccccgguggcgcggcgaguaccugauggacuacgacgggagccgccggggccuggugugcauggugugcgggggcgcccucgccacccugaaggucuccaccaucaagcgccacauccugcaggugcaccccuucagcauggacuucaccccggaggagcggcagacgauccucgaggccuacgaggaggccgcgcugcgcugcuacgggcacgagggcuucggcccccccgcccccgccccgcgggacgggggcgccgaccugaaguccggggccgugugccgcgcguga

SEQ ID NO: 27430 - RNA, 1131 nt, Artificial Sequence
  derived and/or modified sequence opt1 from C12orf10__Homo_sapiens__NP_067653
augggccaccaguuccugcgcgggcuccugacccugcuccugcccccgccgccccuguacacccggcaccgcaugcucggccccgagagcgugcccccgcccaagcggucccgcagcaagcugauggccccgccccggaucgggacgcacaacggcaccuuccacugcgacgaggcccuggcgugcgcccuccugcgccugcuccccgaguaccgggacgccgagaucguccgcacccgggaccccgagaagcuggccuccugcgacaucgugguggacgucgggggcgaguacgacccccgccggcaccgcuacgaccaccaccagcggagcuucaccgagacgauguccagccugucccccggcaagcccuggcagaccaagcucagcuccgccgggcugaucuaccugcacuucggccacaagcuccuggcgcagcugcucgggaccagcgaggaggacuccauggugggcacccuguacgacaagauguacgagaacuucguggaggaggucgacgccguggacaacgggaucagccagugggccgagggcgagccccgcuacgcccugacgaccacccucuccgcgcggguggcccgccugaaccccaccuggaaccacccggaccaggacacggaggccggcuucaagcgggccauggaccugguccaggaggaguuccuccagcgccuggacuucuaccagcacagcuggcugcccgcccgggcgcucguggaggaggcccuggcccagcgcuuccagguggaccccuccggggagaucgucgagcuggccaagggcgccugccccuggaaggagcaccucuaccaccuggagagcgggcuguccccgcccguggcgaucuucuucgugaucuacaccgaccaggccggccaguggcggauccagugcguccccaaggagccccacagcuuccagucccgccucccgcugcccgagcccuggcgcggccugcgggacgaggcccucgaccaggugagcgggauccccggcugcaucuucgugcacgccagcggguucaucggcgggcaccacacccgcgagggcgcccuguccauggcgcgggccacccuggcccagcgcagcuaccucccgcagaucuccuga

SEQ ID NO: 27431 - RNA, 1083 nt, Artificial Sequence
  derived and/or modified sequence opt1 from C12orf42__Homo_sapiens__NP_940923
augagcaccgugaucugcaugaagcagcgcgaggaggaguuccugcucaccauccggcccuucgccaaccgcaugcagaaguccccgugcuacauccccaucgucagcuccgccacgcugugggaccggagcacccccuccgcgaagcacauccccugcuacgagcgcaccagcgugccgugcucccgguucaucaaccacaugaagaacuucagcgagucccccaaguuccgcagccugcacuuccucaacuuccccguguuccccgagcggacccagaacuccauggccugcaagcgccugcugcacacgugccaguacaucgucccgcggugcagcguguccaccgugagcuucgacgaggaguccuacgaggaguuccgcagcucccccgcccccagcuccgagaccgacgaggcgccccucaucuucaccgcccggggcgagacggaggagcgcgcccgcggggccccgaagcaggccuggaacagcagcuuccuggagcagcuggucaagaagcccaacugggcccacuccgugaaccccgugcaccucgaggcgcagggcauccacaucagccggcacacccggcccaaggggcagccgcuguccagccccaagaagaacuccggcagcgccgcccgccccuccaccgccaucgggcugugccggcgcagccagacccccggcgcccuccaguccacgggcccgagcaacaccgagcuggagcccgaggagcggauggcgguccccgccggggcccaggcccaccccgacgacauccagucccgccugcucggcgccagcgggaacccggugggcaagggggcgguggccauggcccccgagaugcugcccaagcacccccacaccccgcgggaccgccgcccccaggccgacaccucccugcacggcaaccucgccggcgcgccccugccgcugcucgccggggccagcacgcacuuccccuccaagcggcugaucaaggucugcagcuccgccccgccccgccccacccggcgcuuccacaccgugugcagccaggcccugucccggcccguggucaacgcgcaccuccacuga

SEQ ID NO: 27432 - RNA, 666 nt, Artificial Sequence
  derived and/or modified sequence opt1 from C12orf43__Homo_sapiens__NP_001273127
auguucugccagaaccccggcgccgccaacagccagcuguccaccagccagccgucccuccgccacaaggugaacgagcacgagcaggacgggaacgagcugcagaccacgcccgaguuccgggcgcacgucgccaagaagcugggcgcccuccuggacagcuucaucaccaucuccgaggccgccaaggagcccgcgaaggccaaggugcagaagguggcccuggaggacgacggguuccgccucuucuucaccagcguccccggcgggcgggagaaggaggaguccccgcagccccgccggaagcgccagcccagcuccagcuccagcgaggacuccgacgaggaguggcggcgcugccgggaggccgcggugagcgccuccgacauccugcaggagagcgccauccacucccccggcaccguggagaaggaggccaagaagaagcgcaagcugaagaagaaggccaagaaggucgcgagcguggacuccgccguggccgccacgaccccgaccagcauggccaccguccagaagcagaaguccggcgagcucaacggggaccaggugagccugggcacgaagaagaagaagaaggcgaagaaggccagcgagaccucccccuucccgcccgccaagagcgccaccgccauccccgcgaacuga

SEQ ID NO: 27433 - RNA, 1245 nt, Artificial Sequence
  derived and/or modified sequence opt1 from C12orf50__Homo_sapiens__NP_689802
auggagaugcagcagaacugcagcaucuccugcuucugggagacccagccccugggcugcgugaagaucagcugcaucuucuaccacuccaagccgcgcaacaucaacggccucuuccugccgcccagcuccaacaucacccugcagaaggagauccaggaggggaucccccuccagagccagucccaggagccccugaagccccaggagaacaucagccggcccauccaccacccccugguccucaagacgaacuucgaggaggaggaggagguggacgagcagaacgacgccuccagccuguggaccaagaccccggaggagaucgaggagaagcgcgccaucaaggagaugugcuacaaguccggggaguacuaccgguuccacaccccgcccgacauccugagcuccaagagcaugacgcccaccgcggagaagcagcucgagaagccccuggagaacggcuccgagcugcaggagggggacagccucaccgugcccaccaagcugucccaguacgagcgccagggcgagaucaagacgagccugcacggcaagcccaagaccgacaucgccgccuucgagaacgggggcggggacugcuacgucccccagcgggugaucuuccucggcguggacgaguccgaggcccugaccgaggagaaggagaucaccaucagcaagugcagcaacacgaaggacaacaaggacuccccgcaccccaagcacagccugaccacccgccucguccccaccacgcacgugcugaacgccaccgagaacaucuccaugaagugccgggaggaccccagcuccaugaacgacgugcagccggucaagaagccccacuucaagggggugaagaagcgcaaguggaucuacgacgagccccagaacuuccccaacagcggcaugcagcgggcggugcaggccccgcgcccccagaacaagauguccuaccaccggaacaacaagaaccgcaacgccgagaacgccagcuacauccacguccagcgggacgcggugcgcaccguggcccugaacgcccccucccggagccgccccacccacggcuccuacaacaagguccacgccaaccgggagccgaagcccaaccucagccccgacaaguacacguccaccagcuacaacgacuccgccuggcgcaagcggaucccguucagcaagaccuacuccaagagcgagaagaucuaccccgagccccgccggaacggguccaaguga

SEQ ID NO: 27434 - RNA, 381 nt, Artificial Sequence
  derived and/or modified sequence opt1 from C12orf57__Homo_sapiens__NP_001288763
auggccagcgccuccacccagcccgcggcccugagcgccgagcaggccaaggugguccucgccgaggugauccaggcguucuccgcccccgagaacgccgugcgcauggacgaggcccgggacaacgcgugcaacgacaugggcaagaugcugcaguucguccugcccguggccacccagauccagcaggaggugaucaaggccuacggguucagcugcgacggcgaggggguccucaaguucgcccgccuggugaaguccuacgaggcccaggaccccgagaucgcgagccuguccggcaagcucaaggcccuguuccugcccccgaugacgcucccgccccacgggcccgccgccggcggcagcguggccgcguccuga

SEQ ID NO: 27435 - RNA, 813 nt, Artificial Sequence
  derived and/or modified sequence opt1 from C12orf5__Homo_sapiens__NP_065108
auggcccgcuucgcccugaccgugguccggcacggcgagacccgcuucaacaaggagaagaucauccaggggcagggcguggacgagccccucagcgagacgggguucaagcaggcggccgccgccggcaucuuccugaacaacgugaaguucacccacgccuucuccagcgaccugaugcggaccaagcagaccaugcacgggauccucgagcgcuccaaguucugcaaggacaugacggucaaguacgacagccggcugcgcgagcggaaguacggcgugguggagggcaaggcgcuguccgagcuccgcgccauggccaaggccgcgcgggaggagugcccggucuucaccccgcccgggggcgagacccuggaccaggugaagaugcgcgggaucgacuucuucgaguuccugugccagcucauccugaaggaggccgaccagaaggagcaguucagccagggcucccccagcaacugccuggagaccucccucgccgagaucuucccccuggggaagaaccacagcuccaaggugaacagcgacuccggcauccccggccuggccgccagcguccucguggugucccacggggcguacaugcggagccuguucgacuacuuccugacggaccucaagugcucccugcccgccacccugagccgcuccgagcucaugagcgucacccccaacaccggcaugagccuguucaucaucaacuucgaggaggggcgggaggugaagccgacggugcagugcaucugcaugaaccugcaggaccaccucaacggccugaccgagacccgcuga

SEQ ID NO: 27436 - RNA, 501 nt, Artificial Sequence
  derived and/or modified sequence opt1 from C12orf65__Homo_sapiens__NP_001181924
augagcaccgugggccuguuccacuuccccaccccgcucacgcgcaucugccccgcccccugggggcugcggcugugggagaagcucacccugcugucccccggcaucgccgucaccccggugcagauggcggggaagaaggacuaccccgcccuccugagccuggacgagaacgagcucgaggagcaguucgugaagggccacgggcccggcggccaggccaccaacaagacguccaacugcgucgugcugaagcacauccccagcgggaucguggucaagugccaccagacccgcuccguggaccagaaccggaagcuggcccgcaagauccuccaggagaagguggacgucuucuacaacggcgagaacagcccggugcacaaggagaagcgggaggccgcgaagaagaagcaggagcgcaagaagcgggccaaggagacccuggagaagaagaagcugcucaaggagcugugggaguccagcaagaaggugcacuga

SEQ ID NO: 27437 - RNA, 1407 nt, Artificial Sequence
  derived and/or modified sequence opt1 from C12orf66__Homo_sapiens__NP_001287869
augggcgagagcaucccccuggccgccccggugcccgucgagcaggcggugcucgagaccuucuucucccaccuggggaucuucagcuacgacaaggccaaggacaacguggagaaggagcgcgaggccaacaaguccgccggcgggagcuggcugucccuccuggccgcgcuggcccaccucgccgccgcggagaaggucuaccacagccugaccuaccugggccagaagcucgggggccaguccuucuucagccggaaggacuccauccgcacgaucuacaccagccugcacaacgagcugaagaagguggugaccggccgcggggcccucggcgggaccgcgccccacgucgaggagcugcugucccaccucagcgagcagcugugcuucuucgugcaggcccggauggagaucgccgacuucuacgagaagauguacacgcuguccacccagaaguucaucaacgccgaggagcucgugggccugcuggacgccaucaugaagaaguacagcucccgguuccaccaccccauccucagcccgcuggaguccagcuuccagcuggaggucgacgugcucugccaccuccugaaggcccaggcccagguguccgaguggaaguuccugcccagccuggucaaccugcacagcgcccacaccaagcuccagaccugggggcagaucuucgagaagcagcgcgagacgaagaagcaccuguucggcggccagucccagaaggcggugcagccgccccaccuguuccucuggcugaugaagcugaagaacaugcuccuggccaaguucagcuucuacuuccacgaggcccugucccggcagaccaccgccagcgagaugaagacccucacggccaaggcgaaccccgacuucuucgggaagaucuccagcuucauccgcaaguacgacgccgccaacgugucccugaucuucgacaaccggggcagcgaguccuuccaggggcacggcuaccaccacccccacagcuaccgcgaggcccccaagggcgucgaccaguaccccgccguggugucccugccgagcgaccggcccgucaugcacuggcccaacgugaucaugaucaugaccgaccgcaccuccgaccucaacagccuggagaaggugguccacuucuacgacgacaaggugcaguccaccuacuuccugacgcggcccgagccgcacuucaccaucgugaucaucuucgagagcaagaaguccgagcgcgacagccacuucaucuccuuccucaacgaggucagccuggcgcugaagaaccccaagguguucgccagccucaagcccggguccaagggcagcugcuaccagugcaacuacuucgucgccuucugccugaacuacuccaagcugcugcuccagcggaaguga

SEQ ID NO: 27438 - RNA, 192 nt, Artificial Sequence
  derived and/or modified sequence opt1 from C12orf75__Homo_sapiens__NP_001138671
augggcugcgggaacagcaccgccaccuccgccggcgcggggcagggccccgccggggccgccaaggacgugacggaggagagcgucaccgaggacgacaagcgccggaacuacggcggcguguacguggggcugccguccgaggccgucaacauggugagcucccagaccaagaccgugcgcaagaacuga

SEQ ID NO: 27439 - RNA, 438 nt, Artificial Sequence
  derived and/or modified sequence opt1 from C12orf77__Homo_sapiens__NP_001094809
augauccccaagcuggccaccccgcgcgacaucagccuccuggugaucaaggaggccuccagccgggcgcgcaacaacauccagauccuggacccccucgaccacaucgcccggcugaccaacuacacgcugaccuccugcuucagcuccaacaagguccccaccaugcccggcagccucccgaccggguccaagcagggcaacgugcagacgcuggacagcauccgcuggaugcccgccacccccgugcccgccccggagugccaccagaaguacgccaucuccaccgagaccgcguuccccacgcugagcaccuucaugaacaccgagaaguccgucaaggggagcaacgccgacuucaccaagcggaacccccgcuggcgguuccucuucggcaucuacugcucccugcaccacgccaugacgaucuucaucuga

SEQ ID NO: 27440 - RNA, 735 nt, Artificial Sequence
  derived and/or modified sequence opt1 from C14orf166__Homo_sapiens__NP_057123
auguuccgccggaagcugaccgcccucgacuaccacaaccccgccggcuucaacugcaaggacgagaccgaguuccgcaacuucaucguguggcuggaggaccagaagauccggcacuacaagaucgaggaccgcgggaaccugcggaacauccacagcuccgacuggccgaaguucuucgagaaguaccuccgcgacgucaacugccccuucaagauccaggaccggcaggaggcgaucgacuggcugcugggccucgccgugcgccuggaguacggggacaacgccgagaaguacaaggaccuggugcccgacaacagcaagacggccgacaacgccaccaagaacgcggagccccucaucaaccuggacgucaacaacccggacuucaaggccggcgugauggcccuggccaaccuccugcagauccagcggcacgacgacuaccuggugaugcucaaggcgauccgcauccugguccaggagcggcugacccaggacgccguggccaaggccaaccagaccaaggaggggcuccccguggcccuggacaagcacauccugggcuucgacacgggcgacgcgguccucaacgaggccgcccagauccugcgccugcuccacaucgaggagcugcgggagcugcagaccaagaucaacgaggccaucguggccgugcaggcgaucaucgccgaccccaagaccgaccaccgccucgggaaggucggccgguga

SEQ ID NO: 27441 - RNA, 378 nt, Artificial Sequence
  derived and/or modified sequence opt1 from C14orf177__Homo_sapiens__NP_872366
augcaccgcaaggagcccggcgcccggcuggaggccacccgcggggcggcccggccgcacaagcagggcaccaagcccaugaucacgcgccccagcgugucccagcucggggagggcaagugccccagcucccagcaccuccagagccugcggcacaacaagcagcacgcccugacccugaccaaggcccgcugcugcggggagugcuccacgugcuucugcaccgaggagaaguccgagugccagcggcacgaggagaccagcccgggcagcugcaaccaccagaucauguccgccagcaccaucuccgcguucugcgccacgccccgcuucaagcagcuguucaagggcaccgucgagcagaugagccagauguga

SEQ ID NO: 27442 - RNA, 423 nt, Artificial Sequence
  derived and/or modified sequence opt1 from C14orf1__Homo_sapiens__NP_009107
augagccgcuuccugaacgugcuccgguccuggcuggucauggugagcaucaucgccaugggcaacacccugcaguccuuccgcgaccacaccuuccucuacgagaagcuguacacggggaagcccaaccuggugaacggccuccaggcccggaccuucgggaucuggacccugcugagcuccgucauccgcugccucugcgcgaucgacauccacaacaagacccuguaccacaucacgcuguggaccuuccuccuggcccugggccacuuccucagcgagcuguucguguacgggaccgccgccccgaccaucggcgugcuggcgccccucauggucgccuccuucagcauccugggcaugcugguggggcuccgguaccuggagguggagcccgucucccgccagaagaagcggaacuga

SEQ ID NO: 27443 - RNA, 537 nt, Artificial Sequence
  derived and/or modified sequence opt1 from C15orf32__Homo_sapiens__NP_694585
augaacaagcgcaccagcguggacgccuccaaggaggaccugcaccccgccgacccgcagagcggcgagggggucccgcccaaccggaagaacaccaagacgagcccccgcggcgaggggaccgcgccgcccuucagcgcccggcccugcguguggacccucugcgagaugcuguccauccuggcccucgugggcguccugcaccccuucuaccgcuccaacaaccagguguaccagaagcugaagacccaccuccggugccaguccagccgcguggacgggcugaugcugaagcccacgcuccugacccccucccagcucaagagccccgagggccaccugauccugcccaccuucaaccaccuggucauccggcacauccucgacccgaagcagaucuucugcguggccgacgugugcaccgacugcaaguucaacugcggcuccaucgagcgccaccagaagcggcaccugaugcgcgucagccaggacugggagcaccugauccgguaccgcaaccagaucugccucuccuga

SEQ ID NO: 27444 - RNA, 846 nt, Artificial Sequence
  derived and/or modified sequence opt1 from C15orf41__Homo_sapiens__XP_011520412
augauccugaccaaggcccaguacgacgagaucgcccagugccucgugagcgugcccccgacccgccagucccugcggaagcugaagcagcgcuuccccagccagucccaggcgacgcuccugagcaucuucucccaggaguaccagaagcacaucaagcggacccacgccaagcaccacaccagcgaggccaucgaguccuacuaccagcgcuaccugaacggcgucgugaagaacggggccgcccccguccuccuggaccuggcgaacgagguggacuacgcccccagccucauggcccggcugauccuggagcgcuuccuccaggagcacgaggagaccccgcccuccaagagcaucaucaacuccaugcugcgggaccccagccagauccccgacggcgugcuggccaaccaggucuaccagugcaucgugaacgacugcugcuacgggccgcucguggacugcaucaagcacgcgaucggccacgagcacgagguccugcugcgcgaccuccugcuggagaagaaccucuccuuccuggacgaggaccagcugcgggccaagggguacgacaagacgcccgacuucauccuccaggugcccguggccgucgagggccacaucauccacuggaucgagagcaaggccuccuucggcgacgagugcagccaccacgccuaccugcacgaccaguucugguccuacuggaaccgcuucgggcccggccuggugaucuacugguacggguucauccaggagcucgacugcaaccgggagcgcggcauccugcugaaggcgugcuucccgaccaacaucgugacccucugccacagcaucgccuga

SEQ ID NO: 27445 - RNA, 252 nt, Artificial Sequence
  derived and/or modified sequence opt1 from C15orf48__Homo_sapiens__NP_922946
augagcuucuuccagcugcucaugaagcgcaaggagcugaucccccugguggucuucaugaccguggccgccggcggggcguccagcuucgccguguacucccucuggaagaccgacgucauccuggaccggaagaagaacccggagcccugggagacgguggaccccaccgugccccagaagcugaucaccaucaaccagcaguggaagccgaucgaggagcuccagaacguccagcgcgugaccaaguga

SEQ ID NO: 27446 - RNA, 540 nt, Artificial Sequence
  derived and/or modified sequence opt1 from C15orf53__Homo_sapiens__NP_997327
auggagcugcagggcgcccaggaggaccucgggaucagccuguccagcccccgccggaaccacgagacccgcccgggcuccaaggccaaggggcggagcuccaucugccugcaggcgagcguguggauggccggcgggaagcuccgccugcgggccuccgagcaccugacccagggccaccagcaggagcuccgcgacuggaaccugggcgaggacgccagccuccuguucuccaagagccccuucggggccggcaagcugauccaggcgcccgcccacgucuuccggcagugcugggugcaggggaacgccuggaucuccugcaucacgaaguucgacagcaagcgcucccccgagguggccagcuccccgagcuaccugaccgucccccggcgcagcccccuccccguguuccugcggccguccgaccgcugcgugugcggcgggugcuaccugggcaaguccacccggcgccgggcgugccagagccuccugagcgacccccugggcgucaccuuccccacgcagacccgccccuga

SEQ ID NO: 27447 - RNA, 882 nt, Artificial Sequence
  derived and/or modified sequence opt1 from C15orf59__Homo_sapiens__XP_005254426
augaacauccgcggcgcccccgaccuggggcagccgagcgacgaccccuccagcggcggggagcgggagcgcauccggcagcgcaugaagauggugaucggccagcucgaggggauccugcgggagcugaaggaggucgccaaggagcuccgcgagguggugucccagaucgacaagcugaccagcgacuucgacuucgagcuggagcccgacgacuggaccacggcgaccgucuccagcaccuccagcuccgacaaggccggcaugggcgggcccuucgaccucggccaccuggacuucaugaccgccgacauccugagcgacuccugggaguucugcagcuuccucgacguguccacgccgagcgacuccguggacgggcccgagagcacccggcccggcgccgggcccgacuaccgccugaugaacggcggcaccccgauccccaacgggccccgggucgagacccccgacuccagcuccgaggaggccuucggcgcggggccgacggugaagucccagcugccccagcgcacccccggcacccgggagcgcgugcgguucagcgacaagguccucuaccacgcccugugcugcgacgacgaggagggcgacggggagcaggagguggaggaggaggaggugggccugcccccggagcccgcccacaccgaggcccacgcggggccccacaagcccuccccggcccccuacaagagccgccggagcccccucacgagccgccacuccggcagcacccuggcccccgagcagacccggcgcgucacccggaacuccagcacgcagaccguguccgacaagagcacccagaccgugcugccguacacggccacccgccagaaggcccgggggaagaacuga

SEQ ID NO: 27448 - RNA, 828 nt, Artificial Sequence
  derived and/or modified sequence opt1 from C16orf72__Homo_sapiens__NP_054836
auggaggagcgcaaggaggagggcgaggccgagauccaggagcacgggcccgagcacugguucagcaagugggagcggcagugccuggccgaggcggagcaggacgagcagcucccgcccgagcugcaggaggaggccgccgccgccgcgcagcccgagcacaagcagcagaagcuguggcaccucuuccagaacuccgccaccgccguggcccagcuguacaaggaccgcgucugccagcagcccggccugagccucugggugcccuuccagaacgcggccaccgccgugacgaaccuguacaaggaguccgucgacacccaccagcggagcuucgacaucgggauccagaucggcuaccagcgccggaacaaggacgugcuggccugggugaagaagcgccggcgcaccauccggcgcgaggaccucaucuccuuccugugcgggaaggucccgccgccccggaacagccgcgccccgccccggcugaccguggugucccccaaccgcgcgacgagcaccgagaccuccagcuccgucgagaccgaccuccagcccuuccgggaggccaucgcccugcacggccugagcggcgccauggccuccaucagcgugcgcuccagcacgcccgggucccccacccacgugagcuccggcagcaacgcgagccggcgccggaacgggcuccacgacgucgaccugaacaccuucaucuccgaggagauggcccugcaccucgacaacggcgggacccgcaagcggacgagcgcccagugcggcgacgugaucaccgacucccccacccacaagcgcaaccgcaugaucuga

SEQ ID NO: 27449 - RNA, 231 nt, Artificial Sequence
  derived and/or modified sequence opt1 from C16orf74__Homo_sapiens__NP_996850
augggccugaagaugagcugccucaagggguuccagaugugcguguccagcuccagcuccagccacgacgaggcccccguccugaacgacaagcaccuggacgugccggacaucaucaucaccccgcccacccccacgggcaugaugcucccccgcgaccugggguccaccguguggcuggacgagaccggcagcugccccgacgacggggagaucgaccccgaggccuga

SEQ ID NO: 27450 - RNA, 798 nt, Artificial Sequence
  derived and/or modified sequence opt1 from C16orf78__Homo_sapiens__NP_653203
augagcgagcagcagauggaccugaaggaccucaugcccaccaagcgcaaguacauguggaagaccgccgaggaccggcgcauguccgaccugacgugcgugcuggaguggcucgagcggcgccagggcaagaagaagcaggccccggagaagcagaagcccaaggucgugaccgugcugaagcggaacaagaagaaggaggagaagaaggggaagggccugaugaccgcgcgcgggggcaaccggcgcgacaccgagacgagccagcaggcccucgggaagcgguuccgcaaggacgccgccuccuaccggagccuguacggcgucgagcagaagggcaagcaccuguccauggugcccgggagcuacaucaaggacggccccaagaaguccgacaccgacaucaaggacgccguggacccggagagcacccagcgccccaaccccuuccggcgccaguccaucguccucgaccccaugcugcaggaggggaccuucaacagccagcgggcgacguucauccgcgacugguccaacaagaugccggacauggccuacgagcggaagcucaagagccugauggagaaguccaccgagcccaagauggagaccaugcgcaugcugaagcccgaggaggugcugagcugccgguaccuccgccuguccaaggagaacauccggacccugcucaagcugugcaaggacgccggcaugaacguggacauccacccccacauggucgaggaggacaucgacgccaagaagguguucacggggaucccgagcauggcgcuguga

SEQ ID NO: 27451 - RNA, 720 nt, Artificial Sequence
  derived and/or modified sequence opt1 from C16orf95__Homo_sapiens__NP_001182053
augcgcgccagccgguccccgcccagcccccgccggugccaccaccaccacgaggccaccggcgcggccuccggggccgccgccggcgggcccggcgcggggugcgugggccugugccgccucgcccugacccccagcgcccaggacggccggaacuccacguuccagaccuacaagaaggaggucugccugccgcgccacagcaugcaccccgggcccugggccaucugcugcgagugccagacccgguucggcgggcgccuccccgugucccggguggaggcggcccugccguacugggucccccugagccuccgcccccggaagcagucccagaagaccgugcaguuccccaucccgcagacggccaagaugugccccugccugugccaccgcuucggcgggcggcugcccaugccccgcgaccaggccgugaugccguacugggucccccaggugcuccggagccagcagcagaucgugcgccggcagcagucccugaagggcauccaggcgccccugcucgacgccugcugcuggcacaacugcuggcgcaucugcggcgacgagugccugcugagcaaguuccagcagcuccaggcccccuaccaggaccagcugccggcccccgccgcccggcugcucccccuggggcugcucacccugcugcaggcgaucccccgcgucaucauggccauccggcagugcuucggcguguga

SEQ ID NO: 27452 - RNA, 666 nt, Artificial Sequence
  derived and/or modified sequence opt1 from C17orf51__Homo_sapiens__NP_001106905
augggcgagaagucccgccggaaggggcccgcgccccgccacgccgacggcaagcuggggcggaccugcgaccaccccuacgcccccugguccuucacccccagcucccgcgccccgacggccugggugcggccgcccugccccgucugggccagccgccuccaggagcacucccccgagccccggcgcgcccgggcgccgcccacccgccgggcccaggccgcccuguacgcgcccgcccugcgccuccgggaccaccuggaccgcuucagcauccugaugaccuccugcaccagcuggcuccaggcgccccaggcccccggccugugccgggacgagcaguccagccgcaucuccgugccccagcugagcggggccccgauccuccugcccgaccuggagggcacgaagcucuccaacuuccaggagagcagcccccugccccacaagcacgagcggaaggacaagcgcagcaccccggaggaggagggccgguccgcccccgagaagaucauccagagccugaagcucugccccgggggccaccgccccgccucccugagcagcgggugcccggccggcugccggcuguccuucaaccucccgcccagcaugcugcuguccgugcagaagugcugcaugcccagcucccucaagaccugcuga

SEQ ID NO: 27453 - RNA, 1944 nt, Artificial Sequence
  derived and/or modified sequence opt1 from C17orf53__Homo_sapiens__NP_076937
auggccugcagccugcagaagcuguucgccguggaggaggaguucgaggacgaggacuuccuguccgcggucgaggacgccgagaaccgcuucaccggcagccugcccgugaacgccgggcggcuccgcccgguguccagccggccccaggagaccguccaggcccaguccagccgccugcugcuccugcaccccacggcccccuccgaggcgcugggccucccggaccuggaccugugccuccccgccagcuccacccccagcgccgacucccggcccagcugcaucggggccgcgccgcugcgccccguguccaccagcuccagcuggaucggcaaccagcggcgcgugaccgucacggaggugcugcgggagaccgcccgcccccaguccagcgcccuccacccccugcugaccuucgagucccagcagcagcaggucgggggcuucgagggcccggagcaggacgaguucgacaaggugcucgccagcauggagcuggaggagcccgggauggagcuggagugcggcgugagcuccgaggccauccccauccuccccgcgcagcagcgggaggggagcgugcuggccaagaaggcccgcgucguggaccuguccggcagcugccagaaggggccggugcccgccauccacaaggccggcaucauguccgcgcaggacgagagccucgaccccgucauccagugccggacgccccgcccgccccugcggcccggcgccguggggcaccuccccgugccgaccgcccucaccguccccacccagcagcugcacugggaggugugcccccagcgcucccccgugcaggcccugcagccgcuccaggccgcgcggggcaccauccagagcagcccccagaaccgcuuccccugccagccguuccagagccccuccagcuggcuguccgggaaggcccaccucccccggccccgcacgccgaacagcuccugcagcacccccucccggaccagcuccggccuguucccccgcaucccccugcagccgcaggcccccgucagcagcaucggcucccccguggggacccccaagggcccgcagggggcccugcagacgcccaucgugaccaaccaccucguccagcuggugaccgccgcgagccgcacgccccagcagcccacccacccguccacccgggccaagacccgccgguuccccggccccgccgggauccugccccaccagcagagcggccgcucccucgaggacaucauggucagcgccccgcagacccccacgcacggcgcgcuggccaaguuccagaccgagaucguggccuccagccaggccuccguggaggaggacuucgggcggggccccuggcugaccaugaaguccacccucgggcuggacgagcgcgaccccuccugcuuccugugcacguacagcaucgucauggugcuccggaagcaggccgcgcugaagcagcugccgcgcaacaaggugcccaacauggccgucaugaucaagucccucacccggagcaccauggacgccuccgugguguucaaggaccccaccggcgagaugcaggggacgguccaccgccugcugcuggagaccugccagaacgagcucaagccgggcagcgugcugcugcucaagcagaucggcguguucucccccagccugcggaaccacuaccugaacgucacccccaacaaccucgugcacaucuacagccccgacuccggggacggcagcuuccugaagccgucccagcccuuccccaaggacagcggguccuuccagcacgacguggccgccaagcccgaggagggcuuccgcaccgcgcagaaccuggaggccgaggccagcccggaggaggagcuccccgaggccgacgaccuggacgggcugcucuccgagcugcccgaggacuucuucugcggcacgagcuccuga

SEQ ID NO: 27454 - RNA, 711 nt, Artificial Sequence
  derived and/or modified sequence opt1 from C17orf64__Homo_sapiens__NP_859058
auggaggccagcgacggccagggcggggagggggacaagccccuggagcaggucaccaacguguccugccucgagaccagcuccagcgccuccccggcgcgcgacagccugaugcggcacgccaagggccuggaccaggacacguucaagaccugcaaggaguaccuccgcccccugaagaaguuccugcggaagcuccaccucccccgcgaccugccccagaagaagaagcugaaguacaugaagcagucccugguggugcugggggaccacaucaacaccuuccuccagcacuacugccaggccugggagaucaagcacuggcggaagaugcuguggcgcuucaucagccuguucuccgagcucgaggccaagcagcugcggcgccuguacaaguacaccaagagcucccagccggccaaguuccucgucacguucugcgcgagcgacgcccccgagcggucccugcuggccgaccgcgaggacagccuccccaagcugugccacgccuggggccugcacuccaacaucagcggcaugaaggagcggcucuccaacaugcagacccccgggcagggcagcccgcugcccgggcagccccgcucccaggaccacgugaagaaggacagccugcgggagcucagccagaagcccaagcugaagcgcaagcggaucaaggaggcgccggagacccccgagaccgagcccuga

SEQ ID NO: 27455 - RNA, 1140 nt, Artificial Sequence
  derived and/or modified sequence opt1 from C17orf96__Homo_sapiens__NP_001124149
auggagacccugugccccgccccgcgccucgccgugcccgcgagcccccggggcucccccugcagcccgaccccccgcaagcccugccgggggacgcaggaguucuccccccugugccugcgcgcccucgccuucugcgcccuggccaagccgcgggcgagcucccugggccccgggcccggcgagcucgccgcccgcagccccguccugcgggggccgcaggccccccugcgccccggcggcugggcgcccgacgggcucaagcaccugugggccccgaccggccggcccggggugcccaacaccgccgccggcgaggacgccgacguggcggccugcccccgccggggggaggaggaggagggcggcgggggcuucccgcacuucgggguccgcuccugcgccccccccggccggugccccgccccgccccacccccgcgagagcaccacguccuucgccagcgcgcccccgcggcccgcccccggccuggagccgcagcgcgggcccgccgccucccccccccaggagccgagcucccggccccccagccccccggccggccucuccaccgagcccgcggggcccggcaccgccccccgcccguuccugcccgggcagcccgccgagguggacggcaaccccccgcccgccgcccccgaggcgcccgccgccagcccguccaccgccagccccgcgcccgccgcccccggcgaccugcggcaggagcacuucgaccgccucauccggcgcuccaagcuguggugcuacgccaagggguucgcccuggacacgccgagccuccgccggggccccgagcgccccccggcgaaggggcccgcccggggcgccgccaagaagcgccggcugcccgcccccccgccccgcaccgcgcagccccggcgccccgccccgacccugcccaccacgagcaccuucucccuccugaacugcuuccccugccccccggcccugguggucggggaggacggcgaccucaagcccgccagcucccugcggcugcagggcgacagcaagccccccccggcccacccccucuggcgcuggcagauggggggccccgcggugcccgagccgcccgggcugaaguucuggggcaucaacauggacgaguccuga

SEQ ID NO: 27456 - RNA, 1602 nt, Artificial Sequence
  derived and/or modified sequence opt1 from C18orf54__Homo_sapiens__NP_001275909
auggccaagagcaagaccaagcaccgccugugcucccaggagagcuccgugagcgcccuccuggcguccugcacccugagcggcuccaacagcuccaacagcgacggguccuuccacuacaaggacaagcucuaccggagcgccucccaggcccugcaggccuacaucgacgacuucgaccugggccagaucuaccccggggccagcacgggcaagaucaacaucgacgaggacuucaccaacaugucccaguucugcaacuacaucuacaagccgaacaacgcguucgagaaccucgaccacaagaagcacagcaacuucaucuccugccgccggcacaccgucaacgacaucgacagcaugucccugaccacggacgaccugcuccgccugcccgccgacgggagcuucagcuacaccuacgugggccccucccaccggaccagcaagaagaacaagaagugccgcggccggcuggggucccucgacaucgagaagaacccccacuuccagggcccguacaccagcauggggaaggacaacuucgugacgcccgucauccgcuccaacaucaacggcaagcagugcgggcggcugaagaaccccaagcugaugaaccgcaccaacaacugcaucagcgaguccagccucuccuuccccaagaaguccuccuucaaggacagcuccgagcacagccuggagaagaacuacccgcgguggcugaccucccagaaguccgaccucaacgugagcggcaucaccagcauccccgacuucaaguaccccguguggcugcacaaccaggaccugcuccccgacgccaacucccagcgcgucuaccagaucuucaaggacgaccagugcagcccgcggcacagccaccaggcccagggcacgucccgccugaucaacaagcuggacugcuucgaguacgcguucgagcccagcaacuucuccaacagccucuccgacgacaaggagcuggugaacgaguacaagugcgacuucgagcacagccagugccagugcgagaacccccugcuccccgggcaguccaccaagccguucagcggcgacaagaucgagcugcugauccucaaggccaagcggaaccuggagcagugcaccgaggagcugcccaaguccaugaagaaggacgacagccccugcucccucgacaagcuggaggccgaccgcagcugggagaacauccccgugaccuucaaguccccgguccccgugaacagcgacgacagcccccagcagacgagccgggccaaguccgccaagggggugcuggaggacuuccucaacaacgacaaccagagcugcacccugagcggcggcaagcaccacgggcccgucgaggcgcugaagcagaugcuguucaaccuccaggccgugcaggagcgcuucaaccagaacaagaccaccgacccgaaggaggagaucaagcaggucuccgaggacgacuucagcaagcugcagcucaaggaguccaugauccccaucacgcggagccugcagaaggcccugcaccaccucucccgccugcgggaccugguggacgacaccaacggcgagcgcagccccaagauguga

SEQ ID NO: 27457 - RNA, 1686 nt, Artificial Sequence
  derived and/or modified sequence opt1 from C18orf8__Homo_sapiens__NP_001263271
augggcgaggaggacuacuaccuggagcucugcgagcgccccgugcaguucgagaaggccaacccggucaacugcguguucuucgacgaggccaacaagcaggucuucgcggugcggagcgggggcgccaccggggugguggucaagggccccgacgaccgcaaccccaucuccuuccggauggacgacaagggggaggugaagugcaucaaguucagccuggagaacaagauccuggccgugcagcgcaccuccaagacggucgugcuccccgagaagcggagccugaagcugcucaagucccacaaccugaacgugaacugguacauguacugcccggagagcgccgucauccugcucuccaccaccgugcuggagaacgugcugcagcccuuccacuuccgcgccggcaccaugagcaagcuccccaaguucgagaucgagcugcccgcggccccgaaguccacgaagcccagccuguccgagcgggacaucgccauggccaccaucuacggccagcucuacguccuguuccugcgccaccacagccggaccuccaacagcaccggggcggagguggugcucuaccaccucccccgcgagggcgccugcaagaagaugcacauccugaagcugaaccggacggggaaguucgcccugaacgucguggacaaccugguggucgugcaccaccaggacaccgagaccuccgugaucuucgacaucaagcuccgcggcgaguucgacgggagcgucaccuuccaccaccccgugcugccggcccgguccauccagcccuaccagauccccaucacgggccccgccgcggucaccagccaguccccggugcccugcaagcuguacagcagcuccuggaucguguuccagcccgacaucaucaucagcgccucccagggcuaccucuggaaccugcaggucaagcuggagcccaucgugaaccuccugccggacaaggggcgccugauggacuuccuccugcagcggaaggagugcaagauggugauccugagcgucugcucccagaugcucagcgaguccgaccgcgccagccugcccgugaucgccaccguguucgacaagcugaaccacgaguacaagaaguaccucgacgccgagcaguccuacgcgauggccgucgaggccggccagagccgguccagcccccugcugaagcgccccgugcggacccaggccgugcucgaccaguccgacgucuacacgcacgugcugagcgccuucguggagaagaaggagaugccgcacaaguucgucaucgcggugcugauggaguacauccgcucccucaaccaguuccagaucgccgugcagcacuaccugcacgagcuggucaucaagacccucgugcagcacaaccuguucuacaugcugcaccaguuccugcaguaccacgugcucagcgacuccaagccccuggccugccugcuccugagccuggaguccuucuacccgcccgcccaccagcucagccuggacaugcugaagaugcuccagagccggcugaagacgaccugcuucuccauccaguacagcgccuuccugaacuccgagaccagcgucugcgagggggcgcccaucucccaccagggcaacaccgugaagaacaugcuccuguucagcaaccgcuuccuggagaccaagcucuga

SEQ ID NO: 27458 - RNA, 459 nt, Artificial Sequence
  derived and/or modified sequence opt1 from C19orf12__Homo_sapiens__NP_001026896
auggagcgccucaagagccacaagcccgccaccaugaccaucaugguggaggacaucaugaagcugcugugcucccugagcggcgagcggaagaugaaggccgcggucaagcacuccgggaagggcgcccucgugacgggggccauggccuucgugggcgggcuggucggcggcccgcccgggcuggccgugggcggggcggugggcgggcuccugggcgccuggaugaccagcggccaguucaagcccgucccccagauccugauggagcucccgcccgccgagcagcagcgccuguucaacgaggccgcggccaucauccggcaccuggaguggaccgacgccgugcagcucaccgcccuggugaugggguccgaggcccugcagcagcagcuccuggcgaugcuggucaacuacgugacgaaggagcuccgcgccgagauccaguacgacgacuga

SEQ ID NO: 27459 - RNA, 648 nt, Artificial Sequence
  derived and/or modified sequence opt1 from C19orf18__Homo_sapiens__NP_689687
auggacaaggugcagagcggcuuccugauccucuuccuguuccugauggagugccagcuccaccugugccugcccuacgccgacgggcuccacccgaccggcaacaucaccgggcugcccggcuccaagcgcagccagccgccccggaacaucacgaaggagcccaaggucuucuuccacaagacccagcugcccgggauccagggcgccgcgucccgcagcaccgccgccucccccaccaaccccaugaaguuccuccggaacaaggccaucauccgccaccggccggcccuggugaaggugauccugaucagcuccgucgcguucagcaucgcccucaucugcggcauggccaucuccuacaugaucuaccgccuggcccaggcggaggagcggcagcagcuggagagccucuacaagaaccugcgcaucccccugcucggggacgaggaggagggcuccgaggacgagggggagagcacgcaccuccugcccgagaacgagaacgagcuggagaaguucauccacuccgugaucaucagcaagcgguccaagaacaucaagaagaagcugaaggaggagcagaacagcgugaccgagaacaagaccaagaacgccucccacaacggcaagauggaggaccuguga

SEQ ID NO: 27460 - RNA, 399 nt, Artificial Sequence
  derived and/or modified sequence opt1 from C19orf24__Homo_sapiens__NP_060384
augggcccccgcgugcugcagccgccccuccugcugcuccugcuggcccuccugcuggccgcgcuccccugcggggccgaggaggccagcccccugcggcccgcccaggucacccugagcccgccgcccgccgugaccaacggcucccagcccggggcgccccacaacuccacgcacacccgcccgcccggcgccagcggguccgcccucacccggagcuucuacgugauccugggcuucugcggccugaccgcccucuacuuccugauccgcgcguuccggcugaagaagccccagcgccggcgcuacgggcuccuggccaacacggaggaccccaccgagauggccucccuggacagcgacgaggagaccgucuucgagucccggaaccuccgcuga

SEQ ID NO: 27461 - RNA, 1362 nt, Artificial Sequence
  derived and/or modified sequence opt1 from C19orf26__Homo_sapiens__NP_689982
augcagcccaccgccaccauggccacggcggccaccaccaccacgaccaccaccgccacgguggcccugaccaccagcugggacaacgccaccggccgccccacggcggagcccgaccccauccucgacaacuacguccugcuggugguggucaugucccucuucgucgggggcacccugguggugcugagcggggugcuccugcugugcaagcggugcugggacgugcaccagcgccucaaccgggccauggaggaggccgagaagaccaccacgaccuaccuggacaacggcacccaccccgcccaggacccggacuuccgcggggaggaccccgagugccaggacgcggagaccgagcgguuccuguccacgagcuccaccggccgccgggucagcuucaacgaggccgcccucuucgagcagucccgcaagacccaggacaagggccggcgcuacacccugacggagggggacuuccaccaccugaagaacgcccggcucacccaccuccaccucccgccccugaagaucgugaccauccacgagugcgacagcggcgaggccuccagcgcgaccacgccccaccccgccaccucccccaaggccacccuggccaucuuccagcccccggggaaggcccugaccggccgcagcguggggcccuccagcgcgcugcccggcgaccccuacaacuccgccgccggcgccacggacuucgccgagaucagcccguccgcgagcuccgacagcggggagggcaccagccuggacgccgggacccgguccaccaaggccggcggccccggggccgccgcgggccccggggaggccggccccgggagcggcgccggcacgguccugcaguuccucacccgccugcggcgccacgccucccuggacggggcgagcccguacuucaaggugaagaaguggaagcucgagcccucccagcgggccgccagccuggacacccgcggcucccccaagcggcaccacuuccagcgccagcgggccgccagcgaguccaccgagcaggaggagggggacgcgccccaggaggacuucauccaguacaucgcccgcgccggcgacgccguggccuucccgcacccccgccccuuccuggcgagcccgccgcccgcccucgggcgguacuucuccgucgacggcggcgcccgcgggggccccguggggcccugcccgcccagcccgccgccccggcgcccccgggagcgcucccccggccccguggacacccggagccccgccuccagcgggaaggccccgccccgcggcggccugacgggggcgaccucccccgccuggacccggggcgggaagcagggcgagaccggcuga

SEQ ID NO: 27462 - RNA, 321 nt, Artificial Sequence
  derived and/or modified sequence opt1 from C19orf33__Homo_sapiens__NP_277055
auggaguucgaccugggcgccgcccucgagcccaccagccagaagccgggggugggcgccgggcacggcggggaccccaagcugagcccccacaagguccagggccgcuccgaggccggcgccgggcccggcccgaagcaggggcaccacuccagcuccgacagcuccagcuccagcuccgacagcgacaccgacgugaagucccacgccgccggcagcaagcagcacgaguccauccccgggaaggcgaagaagcccaaggugaagaagaaggagaagggcaagaaggagaagggcaagaagaaggaggcgccccacuga

SEQ ID NO: 27463 - RNA, 648 nt, Artificial Sequence
  derived and/or modified sequence opt1 from C19orf40__Homo_sapiens__NP_689479
auggagaagaacccgcccgacgacaccggccccgugcacgucccccuggggcacaucguggccaacgagaaguggcgcggcagccagcucgcccaggagaugcaggggaagaucaagcugaucuucgaggacggccugacccccgacuucuaccucuccaaccggugcugcauccuguacgugacggaggcggaccuggucgccgggaacggcuaccgcaagcggcucgugcgcgugcggaacagcaacaaccugaagggcaucgucgugguggagaagacccgcauguccgagcaguacuucccggcccugcagaaguucaccguccucgaccuggggauggugcugcuccccguggccagccagauggaggccuccugccuggucauccagcuggugcaggagcagaccaaggagcccagcaagaacccccuccugggcaagaagcgggcgcugcuccuguccgagccgagccugcuccgcacggugcagcagauccccggggucggcaaggugaaggcgccccugcugcuccagaaguuccccuccauccagcagcugagcaacgccuccaucggggagcuggagcaggucgugggccaggccguggcccagcagauccacgccuucuucacccagccgcgguga

SEQ ID NO: 27464 - RNA, 1518 nt, Artificial Sequence
  derived and/or modified sequence opt1 from C19orf45__Homo_sapiens__XP_011526294
auggccaccggcgcccugcuccccugcagccgcccgugccccaugucccggcuggacuuccugaaggcgagccacuucucccucgggcccgaccugcgccugcacgagggcaccaugcggacgaccagccaccgcgacuucgccuaccccgccgccacccgggagccgcccucccuccagccccccccggcccugcuguuccccauggacccccgcugggaccgggaggagcgcgugagcgaggcgcaccgggccuuccccccgcccuccaccccccccugggagcuccugcaggcccaggcccgcgagcggacgcuggcgaugcaggccgggaaccuccaccugcacgaggacgcccacgccggcaucgggcugagcaacgcccacgcggccuacggcuggccggagcuccccgcccgcacccgggagcgcauccggggcgcccgccugaucuucgaccgggacucccugccccccggggaccgcgacaagcuccggaucccgcccaccacccaccaggcccuguuccccccccacgacgcgcgcccgcagccccgggcccccagcugccaccugggcgggcccaacacgcucaagugggacuacacccgccaggacggcaccuccuaccagcgccaguuccaggcccugccggggccccccgcccugcggugcaagcgcgccagcuccggcgucgagcucggcgacugcaagaucagcuacggguccaccugcagcgagcagaagcaggcguaccggccgcaggaccugcccgaggaccgcuacgacaaggcccaggccacggcccacauccacugcgugaacauccggcccggcgacgggcuguuccgcgaccggaccaccaaggccgagcacuucuacgcgcgcgagcccgagccguucgugcuccaccacgaccagacccccgagucccacauccugaagggcaacuggugccccggccccgggagccuggacacguucaugcaguacuucuacggccagccgcccccccccacccagccgcccucccggcacgucccccacgagaagcuccagagccacgugacccugggggagcccaagcugcucaagcgcuucuucaagaccacgaugggcagcgacuacugcccguccgaguggcggcaggugcagaaggcccccaaccugcaccugcagcagagcuaccucccccgcgggaccggcgaguucgacuuccugaccaugaaccagaagaugcugaagccccaccggaccccgcccgcccccgucacggaggagaugcuccagcgcugcaaguacucccacauggagcccccgcugggcgggcugcgguucuucagcacccaguacaaggacgaguuccccuucaaguaccagggccccgccgcgcuccgccugaagaacccgcaggagggguucgugccccugggcaccccccaccagcgggggugccgcgagaagaucgacccccucgugccgcagccccccauguaccugugccccucccagcaguga

SEQ ID NO: 27465 - RNA, 354 nt, Artificial Sequence
  derived and/or modified sequence opt1 from C19orf48__Homo_sapiens__NP_001277083
augaccgugcuggaggccguccucgagauccaggccaucaccggcagccgccugcuguccauggugcccgggcccgcgcggccgcccggcagcugcugggaccccacgcagugcacccgcaccuggcuccugucccacaccccgcggcgccgguggaucagcgggcugccccgcgccuccugccggcucggcgaggagcccccgccccugcccuacugcgaccaggccuacggggaggagcugagcauccgccaccgggagacgugggccuggcucucccgcaccgacaccgccuggcccggcgcgcccggcgugaagcaggcccggauccugggggagcugcuccuggucuga

SEQ ID NO: 27466 - RNA, 1914 nt, Artificial Sequence
  derived and/or modified sequence opt1 from C19orf57__Homo_sapiens__NP_077299
augaccaagcgcaagaagcugcggaccagcggcgaggggcucugcccgcccaagccccugaagaacccccgccugggcgacuucuacggggacccccaguccagcaugcucggcugccugcaccaccccgaggagcccgaggggaagcugggccccgugcccuccacgcagcagcacggcgaggagccggggaaggccgucagcuccagccccgacgaggagaccggcucccccugccggcuccugcgccagcccgagaaggagccggcgccccugccgcccagccagaacuccuucgggcgguucgugccccaguucgccaagagccgcaagaccgugacccggaaggaggagaugaaggacgaggaccgcggcuccggggccuucagccucgagacgaucgccgaguccagcgcccagucccccggcugccagcugcuggucgagacccucggcgugccccugcaggaggccaccgagcugggggaccccacccaggcggacagcgcccggccggagcaguccagccagucccccgugcaggccguccccggcagcggggacagccagcccgacgacccgcccgaccgcggcacgggccucuccgccagccagcgggcgucccaggaccaccugagcgagcagggggccgacgacuccaagcccgagaccgaccgcgugcccggcgacgggggccagaaggagcaccucccgagcaucgacuccgagggggagaagcccgaccggggcgcgccccaggagggcggggcccagcgcaccgccggcgccgggcugccgggcgggccccaggaggagggcgacggcgugcccugcacccccgccagcgccccgacguccgggcccgcccccggccuggggcccgccagcuggugccuggagccgggcuccgucgcgcaggggagccccgacccccagcagacccccucccggaugggccgcgagggcgaggggacccacagcucccucggcugcagcucccuggggaugguggugaucgccgaccugagcaccgacccgacggagcucgaggagcgggcccuggaggucgccggccccgacggccaggccuccgcgaucagccccgccagcccccgccggaaggccgccgacgggggccaccgccgggcccugccggggugcaccucccucaccggcgagaccacgggggagagcggcgaggcgggccaggacgggaagccgcccggcgacgugcugguggggcccaccgccucccuggcccucgcccccggcagcggggaguccaugaugggcgcgggcgacagcgggcacgccucccccgacaccggccccugcgucaaccagaagcaggagcccgggccggcccaggaggaggccgagcugggcgggcagaaccuggagcgcgaccucgagggcuuccgcgugagcccccaggccuccgugguccuggagcaccgggagaucgcggacgacccccugcaggagccgggcgcccagcaggggauccccgacaccacgagcgagcucgccggccagcgcgaccaccucccccacuccgccgaccaggggaccugggccgacagccuggcgguggagcuggacuuccugcuggacucccagauccaggacgcccucgacgccagcgacuucgaggcgcccccggagcagcuguuccccuccggcaacaagcccgggcccugcuggccgggccccagcucccacgccaacggcgaccccguggccgucgccaaggcccagcccagccggcugaucauggggacccaccgcgaccucgaggccuucaagcggcugaacuaccgcaagaccaagcugggcgggaaggcgccgcuccccuaccccagcaagggccccggcaacaucccgcgcggggacccgcccuggcgggagcuguga

SEQ ID NO: 27467 - RNA, 2763 nt, Artificial Sequence
  derived and/or modified sequence opt1 from C19orf68__Homo_sapiens__NP_955373
auggagcgccccgagccgccgcccggcaccgccgccgggcaggaggagcaggagcugcgggagcgcgcguucuucagcugggccgaguucucccgguucuucgacgccuggugccagcagcgccucgcccuguucuucgucaagagcuccaugcaccuggcccggugccgcugggcgagcgcgccgccccucuacacccugaucgacguccugaaguacuccuacgugcggcucgugugcaaggacguccgcgcccccagccggcccgccgugggcccgccccagcccgggugccccgcguucaucaucgugaagcugagcccccugcgcgaccggcucgucgugacggagugccagcugacccacucccaccccgccugcccccuggaguucgccuacuacuuccgccccggccaccuccuggccaacgccugccugcccgugcggaccaccaacaagaucuccaagcaguucgucgcgccggccgacgugcgccggcuccugagcuacugcaaggggcgcgaccacggcgugcuggacgcccuccacguccuggagggccuguuccggacggaccccgaggccaaggugaagcucguguucgucgaggaccaggccgugguggagaccgucuucuuccugaccucccgcacccgggcgcugcuccgccgguucccccgcaugcugcugguggaccgccuccccgggcugcagggcgcccuggaccuccuggccgugcugugcgucgacgggagcggccgggcccgccaggccgcgugcugcguggcccggccggggacgcccucccuccugcgcuucgcccuggccagccuccugcaguccgcccccgacgugaagggccggguccgcugccugaccgcgggccccgagguggccgcccagcucccggccguccggcagcugcugcccugcgcgcgcgugcagaucugccgggcccaggggcucgagacccuguucagcaaggcccaggagcugggcggggccggccgcgaggaccccggccucuggucccggcugugccgccuggccggggcgagcucccccgccgccuacgacgaggcccucgccgagcugcacgcgcacggcccggccgccuucguggacuacuucgagcggaacugggagccccgccgggacaugugggugcgcuuccgggccuucgaggccgcgcgcgaccuggacgccugcgcccuggugcgggggcaccgccgccggcuccugcgccggcugagccccagccgcggcguggcccagugccuccgggaccuggucgcgaugcagugggccgacgccgccggggaggccgugccggagggccccgacggcgggggccccuggcuggaggacgagcccgggcgcggcgcgcagggggagaacgagcgggugcgcggccucgagaccggcgacuggggcggggccccgaaggagggguccaucuggcggggcgcccagauggagaaggagugggcccgcgcccuggagacgcgggacuggggcggggcgcaguucgagggcgagaaggggcgcgcccugcagauccgggacuggcgcggcgggcggcucgagaaccagaagccccgcggccuggagggcgggguccugcggggcagcaagcucgagaaggggcaccuccgcggccccgagauccgggacuggcgcgggccccagcuggagggcgagaaggacuggggccuggagggguacguguggcggggcucccagcuggaggaccaggcccugcgcgggcucgagggcuacaccuggcgcguggcccagcuggaggaccggcgcagcaccaccgaccugcgggggacgcaguucgacuacgagcgcguccggucccucgagggcagcccguggcgcggcgcccagcugcacgacgagcgggccgggggccugcgcaccgccgaguggaaggggccccaguccgagguggagaagggccgggggcucgaggugcgcaaccugcggggcaucccccuggagaagucccucgagcuggcccccgagaacggcgaccagcgcgggccgcagugggaggacgagcggcgccggggccccgagaucgccgaggagcgcggggcgcgggucggcgugaagcgccggcgcgggcuggaggacaucgugcucguccagcugggcgacacccgcgugaccggcauggagaacggggacggcgggggcgcccggagcgugggccccaagagccgcgccgggcggggcauggaguggggcgacgccggcgggcgcugccuggggcucggcaacggggucguguccggcacgcccguggggaccguccuggagggcagcccggagugggccgcggcccgguccgagcaccuggccgccggggacggccuccaggagggcggggaggacggcccccgcgagcccaagcggcugugccggcccccgggggaggaggagguggacugggagccccuggccaaguuccgcgcggccugcggccccgagcucgccgaccugguggccgaggagcuggccuucgcgcgccagcacgggacccggggcuuccacuggaccggcgccggguucgcccucaaggacggcacgagcgacuucuuccuggacggggcccugacccgcugcuccugcagcauccacgccgcgcggcgccuccccugccggcaccuguucgccgcccgccugcucaccggcgccgcgcuguuccacauggaccugcuccgggacugcuggggccgcgccccggagcccuga

SEQ ID NO: 27468 - RNA, 426 nt, Artificial Sequence
  derived and/or modified sequence opt1 from C1D__Homo_sapiens__NP_775269
auggccggcgaggagaucaacgaggacuaccccguggagauccacgaguaccugagcgccuucgagaacuccaucggggcggucgacgagaugcucaagaccaugaugagcgugucccgcaacgagcugcugcagaagcucgacccgcuggagcaggccaagguggaccuggucagcgccuacacccucaacuccauguucuggguguaccuggccacgcagggcgugaaccccaaggagcaccccgucaagcaggagcuggagcggauccgcguguacaugaaccgggugaaggagaucaccgacaagaagaaggccgggaagcucgaccgcggcgcggccagccgguucgucaagaacgcccugugggagcccaaguccaagaacgccagcaagguggcgaacaaggggaaguccaagagcuga

SEQ ID NO: 27469 - RNA, 957 nt, Artificial Sequence
  derived and/or modified sequence opt1 from C1GALT1C1__Homo_sapiens__NP_689905
augcugagcgaguccagcuccuuccucaagggcgugaugcuggggagcaucuucugcgcccugaucaccaugcucggccacauccgcaucgggcacggcaaccggaugcaccaccacgagcaccaccaccuccaggcccccaacaaggaggacauccugaagaucuccgaggacgagcgcauggagcugagcaaguccuuccgggucuacugcaucauccuggugaagccgaaggacgugagccugugggcggccgucaaggagaccuggacgaagcacugcgacaaggccgaguucuucuccagcgagaacgugaagguguucgaguccaucaacauggacaccaacgacauguggcucaugaugcgcaaggccuacaaguacgccuucgacaaguaccgggaccaguacaacugguucuuccuggcgcgccccaccaccuucgccaucaucgagaaccugaaguacuuccuccugaagaaggaccccagccagcccuucuaccuggggcacacgaucaaguccggcgaccucgaguacgucggcauggagggcgggaucgugcugagcguggaguccaugaagcggcugaacagccuccugaacaucccggagaagugccccgagcagggcgggaugaucuggaagaucuccgaggacaagcagcuggccgucugccucaaguacgccgggguguucgcggagaacgccgaggacgccgacggcaaggacguguucaacaccaagagcgucggccuguccaucaaggaggccaugaccuaccaccccaaccaggugguggaggggugcugcagcgacauggccgucaccuucaacggccugacgcccaaccagaugcacgugaugauguacgggguguaccgccuccgggcguucggccacaucuucaacgacgcccuggucuuccugccgcccaacggcagcgacaacgacuga

SEQ ID NO: 27470 - RNA, 1116 nt, Artificial Sequence
  derived and/or modified sequence opt1 from C1GALT1__Homo_sapiens__XP_005249869
augagcgagauccacuuccgcgagauggccuccaagagcuggcugaacuuccucaccuuccugugcggcuccgccaucggguuccugcucugcagccagcuguucuccauccugcucggcgagaagguggacacccagcccaacguccugcacaacgacccgcacgcgcggcacagcgacgacaacgggcagaaccaccuggagggccagaugaacuucaacgccgacuccagccagcacaaggacgagaacacggacaucgccgagaaccucuaccagaaggugcgcauccugugcugggugaugaccgggccccagaaccuggagaagaaggccaagcacgucaaggccaccugggcgcagcggugcaacaagguccucuucauguccagcgaggagaacaaggacuuccccgccgugggccugaagaccaaggagggccgcgaccagcuguacuggaagacgaucaaggccuuccaguacgugcacgagcacuaccucgaggacgccgacugguuccugaaggcggacgacgacaccuacgugauccuggacaaccuccgguggcugcuguccaaguacgaccccgaggagccgaucuacuucgggcgccgguucaagcccuacgugaagcagggcuacaugagcgggggcgccggguacguccucuccaaggaggcccugaagcgcuucguggacgccuucaagaccgacaagugcacccacagcuccagcaucgaggaccuggcccucggccggugcauggagaucaugaacguggaggcgggcgacucccgcgacacgaucgggaaggagaccuuccaccccuucguccccgagcaccaccugaucaagggcuaccugccgcggaccuucugguacuggaacuacaacuacuacccgcccguggaggggcccggcugcugcagcgaccucgccguguccuuccacuacgucgacagcaccacgauguacgagcuggaguaccugguguaccaccuccgccccuacggcuaccuguaccgguaccagcccacccugcccgagcgcauccucaaggagaucagccaggccaacaagaacgaggacaccaaggugaagcuggggaaccccuga

SEQ ID NO: 27471 - RNA, 1737 nt, Artificial Sequence
  derived and/or modified sequence opt1 from C1orf106__Homo_sapiens__NP_001136041
auggagagcaaggacgagguguccgacaccgacagcggcaucauccugcaguccgggcccgacagcccggucucccccaugaaggagcucacccacgccgugcacaagcagcagcgcgcccuggaggcgcggcuggaggccugccucgaggagcugcgccggcugugccuccgcgaggccgagcugacgggcacccugcccgccgaguacccccucaagccgggggagaaggcccccaaggugcggcgccggaucggcgcggccuacaagcuggacgacugggcccugcaccgcgaggacccccucagcucccuggagcggcagcuggcccuccagcugcagaucaccgaggcggcccgccggcugugccucgaggagaaccugagccgccaggcccggcgccagcggaagcacuccaugcugcaggaggagaagaagcuccaggagcugcagcgcugccuggucgagcggcgccggaacagcgagcccccgcccgccgccgcgcucccccuggggcgcgagcuguccgccagcgacgacuccagccucuccgacggccugcugcucgaggaggaggagagccaggugcccaagccgccgcccgagucccccgccccgcccagccggccccugccgccccagacccuggagggccuccagcccacggggcccgaggccggcucccccgagcgcgcccccgugcagaacagccccuggaaggagaccagccuggaccaccccuacgagaagccccgcaaguccagcgagccgugguccgagagcuccagccccgcgaccacgccccaggacgggccguccgccagcucccuguggcuccuggagcccgccagcuaccacgucgugcccauccggggcgugcccgggcaguggcagggccgcaccuccgccccggccacccccgagauccagggccggcgcgggcagagccagucccugcgggucgacagcuuccgcgcgggccccgaggggcggggccgcuccgccuucccccggcgccggccgacccacuacaccgugacggugcccgacagcugcuuccccgccaccaagcccccgcucccccacgccgccugccacuccugcagcgaggacuccggcagcgacgucagcuccaucagccaccccaccucccccgggagcuccagcccggacaucuccuuccugcagccccugagcccgcccaagacccaccgccaccggggcgcgugggugcccgccgggucccgcgagcucguggcccaccaccccaagcugcugcucccgcccggcuacuuccccgccgggcgguacgucgugguggcggagagcccccugcccccgggcgagugggagcugcgccgggccgcccccggccccgccuacgaggaggaggggacgccccuccgcuaccagcggcuggucccgucccgcagccgcaucgugcggacccccucccugaaggacagccccgccggccgcgggcuguccaaggcggccgugagcgaggagcucaagugguggcacgagcgggcccgccugcgguccacccgcccccacagccuggaccggcagggcgccuuccgcguccggagccucccgcuggggcgcgagggcuucggccgggcccuggggccccgcgcccaggugcccaccgugugcguccuccggcgcucccccgacggcgcgccggugcaggucuucgugcccgagaagggggagaucaucagccagguguga

SEQ ID NO: 27472 - RNA, 798 nt, Artificial Sequence
  derived and/or modified sequence opt1 from C1orf109__Homo_sapiens__NP_001289959
augagcgagaagcgccggcgccuggacgcccggaacccccucaagcaggagaccgcccugucccgccugccguucccccggggcaaccaggggcuccugcagaaggcggaggccggccgcgcccgguggcugacccccgugauccccgcccucuggaagacggaggccgggggcagcccggagaagaugacccaggaccgcccccugcuggcgguccaggaggcccucaagaagugcuuccccgugguggaggagcagcaggggcuguggcaguccgcccugcgggacugccagccccuccugagcucccugagcaaccucgccgagcagcugcaggcggcccagaaccugcgcuucgaggacgucccggcccuccgggccuuccccgaccugaaggagcgccugcggcgcaagcagcucguggccggcgacaucgugcuggacaagcugggcgagcggcucgcgauccugcugaagguccgcgacaugguguccagccacguggagcgggucuuccagaucuacgagcagcacgccgacaccguggggaucgacgccgugcuccagcccuccgccgucagccccuccguggccgacaugcuggaguggcugcaggacaucgagcgccacuaccgcaagagcuaccucaagcggaaguaccugcuguccagcauccaguggggcgaccucgcgaacauccaggcccugccgaaggccugggaccggaucuccaaggacgagcaccaggaccuggugcaggacauccuccugaacgucagcuucuuccuggaggaguga

SEQ ID NO: 27473 - RNA, 909 nt, Artificial Sequence
  derived and/or modified sequence opt1 from C1orf110__Homo_sapiens__NP_848645
auggagcgccacauggugcggggccagcuguacaagcacuucgaccucgagcgcaagaacgccaagcaggccgaggcgcggcuggaccagcgccugcagcggcucaaggucaucugccuguaccacgugaagcugcucaccugggagcagcgccagcugcagaaggagcugcagcggcuccagcaggccgagaccaugaagaagaaguucagcuccuaccuggggaacggcuuccagaagcgccccgaggacgugcuggucuucagcccccaggggcggcagaagcaccgcgcgccccaggccaagaagaugcgggcccucgccacgcgcauggcccaggacacgugcaaguccaagagccaggugccgcccucccacgacgccggccugaaggaccccaugaaguccaagaagcagccccugagccagaacaaccggaccgccugcuucaucaaggagcagccccaggcgcaggagaaggacagcgugaaccccuccaaggacgucgacccgagcaaggggaucuccgugcccugccagaaccaggaggugagcaccaacaccaucgagcagggccccuccagcucccccgccagcgacuccggcauggccugcgccgacgagacccgcagcaaggacgucgcccucaagccggacgggaacaccggcaagcagaucccgcccaagcacauggagugcgcgggguccuucgagggcgaguucaccaagcccacguuccuggagcugcucagcaaggcccggaacgcccacuaccugcgccaccgggugccgcccgagagcgagcgccugcucuccaucggggagaucuucggccacggcgagagcuccagcucccgggccgggaaggagugcgagaaccgcgugcccagcaaguuccugccccuguga

SEQ ID NO: 27474 - RNA, 2736 nt, Artificial Sequence
  derived and/or modified sequence opt1 from C1orf112__Homo_sapiens__XP_005245374
augagccaggagggcgccgugcccgccuccgcggucccgcuggaggagcucagcuccuggcccgaggagcugugccgccgggagcugcccagcgugcucccccgccugcugucccucagccagcacuccgacagcuggaucgagcacauccagauccugaagaucaucguggagauguuccugccgcacaugaaccaccucacccuggagcagaccuucuucucccagguccugcccaagacggugaagcuguucgacgacaugauguacgagcugaccagccaggcccgggggcuguccagccagaaccucgagauccagaccacccugcgcaacauccugcagacgauggugcagcuccugggcgcccugaccgggugcguccagcacaucugcgccacccaggaguccaucauccucgagaacauccagagccugcccuccagcgugcugcacaucaucaaguccaccuucgugcacugcaagaacagcgaguccgucuacagcggcugccuccaccuggugagcgaccugcuccaggcccuguucaaggaggcguacucccugcagaagcagcucauggagcugcuggacauggugugcauggacccccucgucgacgacaacgacgacauccugaacauggugaucgugauccacagccugcucgacaucugcuccgucaucagcuccauggaccacgccuuccacgccaacacguggaaguucaucaucaagcagagccugaagcaccaguccaucaucaagagccagcugaagcacaaggacaucaucaccucccucugcgaggacauccuguucagcuuccacuccugccugcagcucgccgagcagaugacccagagcgacgcgcaggacaacgccgacuaccggcuguuccagaagacccugaagcucugccgcuucuucgccaacucccugcugcacuacgccaaggaguuccucccguuccugagcgacuccugcugcacgcugcaccagcuguaccuccagauccacagcaaguucccgcccucccuguacgccacccggaucagcaaggcgcaccaggaggagaucgccggggccuuccuggugacccucgacccccugaucucccagcugcucaccuuccagcccuucaugcaggucgugcuggacagcaagcuggaccuccccugcgagcugcaguucccccagugccugcuccuggugguggucauggacaagcugcccagccagccgaaggaggugcagacgcucuggugcaccgacucccaggugagcgagaccaccacgcgcaucucccugcugaaggccgucuucuacagcuucgagcagugcuccggcgagcucagccugcccgugcaccuccagggccucaaguccaaggggaaggccgaggucgcggugacccuguaccagcacgugugcguccaccugugcaccuucaucaccagcuuccaccccucccucuucgccgagcuggacgccgcccugcucaacgccgugcugagcgcgaacaugaucacgucccugcucgccauggacgccuggugcuuccuggcccgguacggcaccgccgagcugugcgcgcaccacgugaccaucgucgcccaccucaucaagagcugccccggggagugcuaccagcugaucaaccuguccauccuccugaagcgccuguucuucuucauggccccgccccaccagcucgaguucauccagaaguucagccccaaggaggccgagaaccugccccuguggcagcacaucuccuuccaggcgcucccgcccgagcugcgggagcagaccgugcacgaggugacgaccgucggcaccgccgagugccgcaaguggcugagccggucccgcacccucggggagcuggagagccugaacacggugcucagcgcccugcuggccgugugcaacuccgccggcgaggcgcucgacaccggcaagcagaccgccaucaucgaggucgugagccagcugugggccuuccugaacaucaagcaggucgccgaccagcccuacgugcagcagaccuucucccuccugcugccccuccugggguucuucauccagacgcuggacccgaagcucauccugcaggccgugacccugcagaccagccuccugaagcuggagcuccccgacuacgugcggcuggcgaugcuggacuucgucuccagccucggcaagcuguucauccccgaggccauccaggaccgcauccugccgaaccucuccugcauguucgcccugcugcucgccgaccggagcuggcugcuggagcagcacacccucgaggccuucacccaguucgcggaggggacgaaccacgaggagaucgugccccagugccuguccagcgaggagaccaagaacaagguggucuccuuccuggagaagaccggcuucguggacgagaccgaggccgccaagguggagcgcgucaagcaggagaagggcaucuucugggagcccuucgccaacgugacgguggaggaggcgaagcggagcucccuccagcccuacgccaagcgcgcccggcaggaguucccgugggaggaggaguaccgcagcgcccugcacaccaucgccggggcgcuggaggccaccgagucccuccugcagaagggccccgcccccgccuggcugagcauggagauggaggcccuccaggagcgcauggacaagcugaagcgguacauccacacccugggguga

SEQ ID NO: 27475 - RNA, 429 nt, Artificial Sequence
  derived and/or modified sequence opt1 from C1orf115__Homo_sapiens__NP_078985
augaccgugggcgcccgccugcggagcaaggccgaguccagccuccugcgccgggggccccgcggccgggggcgcaccgagggcgacgaggaggcggccgccauccuggagcaccucgaguacgccgacgaggccgaggcggccgccgaguccgggacgagcgccgcggacgagcggggcccgggcacccgcggggcccggcgcguccacuucgcccugcugcccgagcgguacgagccccucgaggagcccgccccguccgagcagccccgcaagcgguaccgccggaagcugaagaaguacggcaagaacguggggaaggugaucaucaagggcugccgcuacgucgugaucgggcugcagggcuucgccgcggccuacagcgcccccuucgccguggccaccuccgucgugagcuucgugcgguga

SEQ ID NO: 27476 - RNA, 1929 nt, Artificial Sequence
  derived and/or modified sequence opt1 from C1orf127__Homo_sapiens__XP_011539059
augagcaccuuccccaccuccagccacuccggccuguucagccccuccagcgggcaccucaucccccugugccugaucccgccccuccuguccagcgugcccacgcuggccaugcgcuuccggaacgcccgcgacaaggagaaguucgcguucgccggccggugcugggucuccuuccagcccgagagcgaggugcucgugcacauccccaagcagcgccuggggcuggucaagcggggcuccuacaucgaggagacccucagccugcgcuuccugcgggugcaccaguccaacaucuucauggugaccgagaacaaggacuucgucguggugagcauccccgccgccgggguccuccaggugcagcgcugccaggaggugggcggcaccccggggacgcaggccuucuaccgggucgaccugucccuggaguucgcggagauggccgcccccgugcucuggaccguggagagcuucuuccagugcgucggcuccgggaccgagagccccgccuccaccgcggcccugcgcacgacccccagcccgcccagccccggccccgagaccccgcccgccggggugccgcccgccgccuccagccaggugugggcggccggccccgccgcccaggaguggcugucccgggaccuccugcaccgccccagcgacgcccuggcgaaggcccggcucuggcugcacccccugcccauggucuccagcaaggaguccggcccgcaggaggugagcaaggggcucggccccuuccugcagaccgccaagcccgcccgccgggggcagacguccgccagcauccugccccgcgugguccaggcgcagcggggcccgcagcccccgcccggcgaggccgggauccccggccaccccacgcccccggccacccuccccuccgagcccguggagggggugcaggccagccccuggcgcccgcggcccguccugcccacccaccccgcccugacccucccgguguccagcgacgcguccagccccuccccgcccgcgccccgccccgagcggcccgagagccugcuggucuccggccccagcgugacccucaccgaggggcugggcaccgugcgcccggagcaggaccccgccaagagccccggcagcccccugcuccugcgcgggcuguccuccggcgacgucgccgccccggagcccaucaugggggagcccggccaggccagcgaggaguuccagccgcucgcccggcccuggcgcgccacgcuggccgcggaggagcuggugucccaccggagccccggggagccccaggagaccugcuccggcaccgagguggagcgcccgcggcagaccggccccgggcucccccgcgagggcgcccgggggcacauggaccugagcuccagcgagcccucccaggacaucgagggcccggggcugagcauccuccccgcccgcgacgccacguucuccacccccagcguccggcagcccgacccguccgccuggcugagcuccggccccgagcugaccggcaugccccgcgugcggcucgcggcgccccuggccgugcugccgauggagccccugccgcccgagcccguccgccccgccgcccuccugacccccgaggccagcagcgucgggggccccgaccaggcccgguaccuggaguccgccccgggguggcccgugggccaggaggaguggggcguggcccacacgagcuccccgcccagcacccagacccucucccugugggcgcccaccggggugcugcuccccagccugguggagcuggaguaccccuuccaggccggccgcggggccucccuccagcaggagcugacggagccgacccuggcccucagcgccgagucccaccggccgcccgagcugcaggacagcgucgagggccuguccgagcgccccagccgguga

SEQ ID NO: 27477 - RNA, 1416 nt, Artificial Sequence
  derived and/or modified sequence opt1 from C1orf141__Homo_sapiens__XP_011539768
auggccgagaagauccuggagaagcucgacgugcuggacaagcaggccgagaucauccuggcgcgccggaccaagaucaaccgccuccagagcgagggccggaagaccaccauggccaucccccugaccuucgacuuccagcuggaguucgaggaggcccucgccaccuccgccagcaaggcgaucuccaagaucaaggaggacaagagcugcuccaucaccaagagcaagaugcacgucuccuucaagugcgagccggagccccgcaagagcaacuucgagaaguccaaccugcggcccuucuucauccagacgaacgugaagaacaaggagagcgaguccaccgagcccguggaggagcaccucaagagccgcuccauccggccguaccuguaccugaaggacaccaccgagauggagaacgccgggccccugaacguccucuacagccagcaccgccaggccugccggcgcucccugggcagcacggacuucucccccauguucaacauccagagcaacgcccacaagaaggagaaggacuccacccuguucaccgcgcagaucgagaagaagccccggaagccgcucgacagcguggggcugcuggagggcgaccgcaacaagcggaagaaguccccgcagaugaacgacuucaacaucaaggagaacaagagcgugcgcaacuaccagcucagcaaguaccgguccguccgcaagaagucccugcugccccucugcuucgaggacgagcugaagaacccccacgccaagaucgugaacgugagccccaccaagacggucaccagccacauggagcagaaggacaccaaccccaucaucuuccacgacaccgaguacgugcggaugcugcuccugacgaagaaccgcuucuccagccacccccuggagaacgagaacaucuacccccacaagcggaccaacuucauccucgagcgcaacugcgagauccugaaguccaucaucgggaaccagagcaucucccuguucaagccgcagaagaccaugcccaccgugcagcggaaggacauccagauccccaugagcuucaaggccggccacacgaccgucgacgacaagcucaagaagaagaccaacaagcagacccuggagaaccgcuccuggaacacgcuguacaacuucagccagaacuucuccagccucaccaagcaguucgugggcuaccuggacaaggccgugauccacgagauguccgcccagaccgggaaguucgagcgcauguucagcgcgggcaagcccaccuccaucccgacgagcagcgcccugcccgucaagugcuacuccaagcccuucaaguacaucuacgagcucaacaacgugacgccccuggacaaccugcucaaccugagcaacgagauccugaacgccuccuga

SEQ ID NO: 27478 - RNA, 4485 nt, Artificial Sequence
  derived and/or modified sequence opt1 from C1orf167__Homo_sapiens__XP_011539574
augaagcgccggcugagcggcgugcgcacccggcagaacaagggggaccagcucggcgggggccgcgcccaccugaucaagcagacccggccccugacggucgaguggaccaaggacaccccggugcccgagcccauggagcuccgcuccgacgccagccacaaggagaacgugucccccaagccggcggcccugcccaagcccgagcagcggcgcuuccggcgcagccuggggaucggccucuccggccggcacgaccaguggguccccgggugccagguggagcgcggcgggccggccgccacccccagccccggcgccgugcuggaccaggagcccugccggguccagacgaaccuggcguccccggggccccgccucggccuggcccugaaggacaccaccggccagcucgugaacagcuccuucuggcagcagagcaaccugcagucccuggcccggcgccggcaggggaaggcccgcgaguucgcgauccagcagagcaaccucuccaucaacgagaccagcagcccccaccugugccccgagccgggcggguccuccggcccccacaagcugcccuggggcccccuccugagccaggagccgcuggcccggcccuccagcugccuccgccagagcgggcugcccgcccccggcacgccguccggggacuuccggcccaccgaggccuucgcgccccuggacggccacacccagcccgggcuccgcagcuggggcggccugggguccuggcgcagccggcuggugggcgagccgcucacccuggaggaccuggccguccccucccagaaccagacgcaggcccccagccgcgccgccgugcaccagcuccuggccuccgugcacugccuggcgcaggaggccgcccggcuccgcugccaggccccgcaggagccgcccggggccguccagcaggaccuguggaccggcgggggccagcccuucagcgcgcacccccagcccucccagcccgugcuggccagcuccgacggccggcgccggcgccuccgggggcaccgcgagaccgccgccuuccuggagacccccgccagccuguccgacagcugggcgcaguccaagcucaugagcccggagacgacccugggcacccggaccaaggacucccugaaccccgagcaggggcucccgcccgcccacccccugggcagcggggacuccugcagccccuggagccaggacggccgcgcccagcggggcgaccccucccugccccgcggggugggcagccgggggacggacccgugcuccagcgccuucuccaacaccgcguggggcgucagccccaagcagaagggcgaggagggggcgccccgcgagcgggugcaccgcgaggaggagcggaccgccuuccaccucuccgacaccgugcccgccagcuccgccagcaagaacaaggcccagaacaucacggccccggaguccgaggccaucugcuggcagcugcugagccgcugcuuccgcuccuggcggcaccucgucaagcgccagcgggagcccgccgccgcggccguggcccugggccgcuggcagcugcugcggaagugccuccaggcccuguggcugcgcgaggcccagcucgaggcggccugggggcaguacaccaaggugcugcugguccggagcuuccgcgaguggcggaaccucgcccugcagcagaagcagguccagccccacaugcaggccggccccggguccccgcccagccgccgggcgcagggcaagggccugucccucgggcgcagcaccgugguggaccccgcccagcggagccgccuggagcacaccuccccgggcagccugcgggaggaggagaucgcccagcgccuccugucccacccccggcagcgcacggacagccggcacgagcgcgugcagauccugcaggcccuccagcuggccgucuucuuccuguggugccagcagaagaagcgggcgcgccaggagcgcgagacccuccggaaggccacccgcgccacccagcggacgggguccuucccccaggccuggcacagcaccgccgcgggcguggccuggguggcgccccuguccccgcagcaccagcgcgccuggcugugccggugcuucggggccuggcagcaguucguccagcgcggcagccgguaccgcgaccaccucgccgaccggcgcaccggcacccugcggaagugccuggagcagugggugcgcaugaagcagcuccgggaguccgacggggccaaggugacgcagcugagccugugccgccagaaggccggccgggaggccgucuacaccgcggggcccggcgccugcgggcucggcgccgugggccaggcccaggggcagcaggagcagggccgcgggucccugcaggacgccugcuggacccuggcgcucugcugggcccugcugcucuggaagaugcggcuguuccagcgccagugggccaacagcuucuuccagggccugcagcagcggaugcuccagcgcucccugcgcugguggcaccuccgggcccuggggcccgacgccaccagcuccugcaccaagacgcccagcgcgcuggagccgcuguccagcuccacccuccaggacagccuggagaaggugccccgcgcccccacccugcccgacacccuccagggcagccugcugugggccgccggccagcggcagcaggggcagugccuccugcuguggcaggcccgcgcgcagcaguuccagggcacggcccggugguaccagcacacccgccagcggcgcaucuuccucuccuggagccggugggccaccgcccagugggccuggcgcgagcuggcgucccaccgggccugggaccggaccugccgcgccguccuggggcucuggcgccagcggcugcugcagagccgccucguggaguggugggcccaggagcggggcuggcgccuggcgcgggacgcccugugccacuggcacuccugcuggcagggccagcaguuccuccacgagaagugccagacgugggugcagguccaccuccaggggcugcagaaggugguguuccgcagcuggcagcaggccgccgcccaccagcggugcaccgucacccgcccggagcagcugcugcugcaguccuacuuccaggcguggugcgagguggugcgcgacaccggcguccuccgggcccagcaccaggccuuccaggacgggcugcgccggcgcgcccugggcgccguguucgcgacguggcgggaggcccaggagguggccgccggggcccaggagcagcgcgucgcgcaggccagccucgcccgguggcgcuccugcggccagcagggccaggaggacgggcagcagaagaaggcccgggcgccccaggccuuccccgccuggcccguggccccgggcaugcaccacgaggcccagcagcaggcgggggagagcgccggcgcccaggccgcccagugcuggaccuggugcugggcgcugugggugcacgaguccugccgcgggcaggucagccgggcccacgccuccuggaagccccgcgccugggugcuggaggccagcgugcaguccgcgguccggggcggcgugcagcgcgccauccucacccagcugcggcccgccgagcugcgccgguuccuccgcaccgugcagcugcggguccgccuggggcuccccggcgccgggaagacgcgcagcugcuggacccaggcgaccgagcuggugccgcccgcccccucccugcagugcagccucggcgggcggcgcaagccccggggcaccgccugggcccagcgcugccgggagcacucccugugcccggccuuccagcuguggccccaguggcccggccagagcagcugggugcccgggcucccgcuguggacgcgcgaccagggcccccgggcgcacuccagccccgagccgcgcgccugcaaggcccaguccaaggcccacaagcggcgccugcgggcccgcagcugccggauccucgagaagcaggcgcaggcccacggguccgcccugcugcucgcccugaagggccacgacgcccugggccaccaggaggagguccccgcggcccccgugccccgcgggaccgccagccgggccgccggcuucccggcgggccaggugcccggguccgggauggccgcccucggcggcugcccccgcgggcgggccgcgggcgccgaccccgcccagggggucgccccggagaugggccuggccgacgugguggcggccgaccccgccaccgccagcggguccgccgucaccgcggccggccgcugggccuucaagaaguggcaccagcggcuggccgcccgcagcccccggcgcggcgcggccuccagcccccgcccgugguccaagcccgggcccaagggccccgagagcgggcaggaggccgcccgggcgccgcgcggcugggggcugggcgccgagcacggcgcccagcuccagcuguga

SEQ ID NO: 27479 - RNA, 708 nt, Artificial Sequence
  derived and/or modified sequence opt1 from C1orf204__Homo_sapiens__NP_001127705
augggcaugcuggcccccgggccgcuccagggccgccggccccgcaaggggcacaagggccaggaggacgccguggcgcccgggugcaaggccagcggccggggcucccgcgucacccaccuccugggguaccccacccagaacgugagccggucccugcgccggaaguacgccccgccgcccugcggcgggcccgaggacguggcccuggccccgugcacggcggccgccgccugcgaggcgggccccagccccgucuacgugaaggugaaguccgccgagcccgccgacugcgccgaggggccgguccagugcaagaacggccugcucgugagcagcccccacugcgaggagcccugcgcccacuccugcgcgcaccccggccugccgccccaccuggugcacaagcucccccuguccuaccugcagacccaggacaccgacgccgccagccgccggaucaacgcgccccucgccgccgggugguccuggcugcgccuguggcucgucacccuggccagcggcguggacuucccccagguguccgccuggaugcgggcccugcccagccccgacugccccgggcuccgcacgaccggcgagcagaugcagaagcugcugcucaaggagaacaaggucaagacccggaaguccaagcgccggagcggcgaggggucccaccugaccacgagcauccuggagcaguga

SEQ ID NO: 27480 - RNA, 819 nt, Artificial Sequence
  derived and/or modified sequence opt1 from C1orf226__Homo_sapiens__NP_001078844
auguucgagaaccugaacaccgcccucacccccaagcugcaggccagccgcuccuucccccaccugagcaagcccguggcgcccggcuccgcgccccucgggagcggcgagcccgggggccccgggcugugggucggcuccagccagcaccugaagaaccucggcaaggccaugggggccaaggugaacgacuuccugcggcgcaaggagcccuccagccugggcuccgugggggucacggagaucaacaagaccgccggcgcccagcucgccagcgggaccgacgccgcccccgaggcguggcuggaggacgagcgguccgugcugcaggagaccuucccgcgccucgacccgcccccgcccaucacgcggaagcgcacgccccgggcccugaagaccacccaggacaugcugaucagcucccagcccgugcucagcucccuggaguacggcaccgagcccagcccgggccaggcccaggacuccgcccccaccgcccagcccgacguccccgcggacgccagccagccggaggccaccauggagcgcgaggagcgggggaaggugcugcccaacggcgaggugucccucagcguccccgaccugauccacaaggacagccaggacgaguccaagcugaagaugaccgagugccgccgggccagcucccccagccucaucgagcgcaacggguucaagcugucccugagcccgaucucccucgccgagagcugggaggacggcuccccgccgccccaggcgcggacgagcucccuggacaacgagggcccccaccccgaccugcucagcuucgaguga

SEQ ID NO: 27481 - RNA, 1323 nt, Artificial Sequence
  derived and/or modified sequence opt1 from C1orf228__Homo_sapiens__XP_011539646
augaccagcaucaaggagcaggccgccaucucccgccugcucagcuuccugcaggagugggacaacgcgggcaagguggcccggucccacauccuggacaaguucaucgagaccaaccaggggaagacggcccccgagcucgagcaggaguucagccagggcgccucccuguuccugguccgccucaccaccagccugcggaucaccuacaugacggacuccugccuggagaagcuccugcgcagcaucgggaucuuccuguccgccgugagcuccaaccgguaccucaucgaguuccuggaggugggcgggguccugacccuccuggagauccugggccucgagaagaucaaggaggaggcgaagaaggagagcgugaagcugcuccaggugaucgccaacuccggccgcaccuacaaggagcucaucugcgagagcuacgggguccgguccaucgccgaguuccuggccaagagcaaguccgaggagacccaggaggagguccaggugcugcucgacagccuggugcacggcaacccgaaguaccagaaccagguguacaaggggcugaucgcgcuccugcccugcgagucccccaaggcccagcagcugagccuccagacgcugcgcaccgcccagcccaucaucggcaccacccacccgagcaucguggacugcguccugaaggugcucgggacgaugcaccuggaggugcaguacgaggccaucgagcugaucaaggaccucgucggcuacgacgugcggcaggcccugcugaagggccucguggcgcugcugauccccuccgucaaggagaucagcaagcuccaggccaagauccuguccgaccccagcgugcugcagcucacccccucccugccgauguuccugcagcaggccgccgccgcgaaggccaucggggugcucgcccgcaacgacaugagcaucgccgaggagcugcuguaccugcgggucgugcgcggccucauggccgcgauggggaacaccgaccacuccaacagccagcggcuggccucccugacccucgagugcuucgugcagauguucccccuggucgccgagcacgugcgcaagugcaugggcgaggagcuguaccagcuguuccugagcaacgccgaggaccuguacaugaagaucgacuccauccaggccgacauccucgcggccaacacggucaacgugaccaaggcccugugccugcacggcagcuccuacagcaugaacacccucuacgggucccgggacagcgcccagauggcguaccugacccacuucgaggaggacguggaguccaaggaguga

SEQ ID NO: 27482 - RNA, 1296 nt, Artificial Sequence
  derived and/or modified sequence opt1 from C1orf27__Homo_sapiens__NP_001157717
augggccgcaccuacaucguggaggagaccgucgggcaguaccugagcaacaucaaccuccagggcaaggccuucguguccgggcugcugaucggccagugcagcucccagaaggacuacgugauccucgccacgcggacgcccccgaaggaggagcagagcgagaaccugaagcaccccaaggcgaagcuggacaaccucgacgaggagugggccaccgagcacgccugccaggucucccgcaugcugcccgggggccugcucgugcugggcguguucaucaucaccacccuggagcucgccaacgacuuccagaacgcccugcggcgccugauguucgcggucgagaaguccaucaaccggaagcgccucuggaacuucaccgaggaggaggugagcgagcgggugacccugcacaucugcgccagcaccaagaagaucuucugccgcacguacgacauccacgaccccaaguccagcgcccggccggccgacuggaaguaccaguccgggcugagcuccagcuggcucucccuggagugcaccguccacaucaacauccacaucccccugagcgcgaccuccgugagcuacacccucgagaagaacacgaagaacggccugacccgcugggccaaggagaucgagaacgggguguaccugaucaacggccaggucaaggacgaggacugcgaccuccuggaggggcagcugcucaacuccgaccaccggagcaccgccaccgugcagaucugcagcggcuccgugaaccugaagggcgccgucaagugccgcgccuacauccacagcuccaagcccaaggugaaggacgcggugcaggccgucaagcgggacauccugaacacgguggccgaccgcugcgagaugcuguucgaggaccuccugcucaacgagauccccgagaagaaggacagcgagaaggaguuccacgugcugccguaccgggucuucgugccccugcccggguccaccgugaugcucugcgacuacaaguucgacgacgagagcgccgaggagauccgcgaccacuucauggagaugcuggaccacaccauccagaucgaggaccuggagaucgccgaggagaccaacacggcgugcauguccagcuccaugaacagccaggccucccucgacaacaccgacgacgagcagcccaagcagccgaucaagaccaccaugcugcugaagauccagcagaacaucggcgucaucgccgccuucacgguggccguccucgcggccgggaucagcuuccacuacuucuccgacuga

SEQ ID NO: 27483 - RNA, 330 nt, Artificial Sequence
  derived and/or modified sequence opt1 from C1orf61__Homo_sapiens__NP_001307383
augggcacccuggggagcaucuucucccccggcgccgggggcuucugcaccacgcucccgcccagcuuccugcgcguggacgaccgggccaccuccagcaccaccgacuccagccgcgcgcccuccagcccccggccgcccggguccacgagccacugcggcaucuccacccgcugcaccgagcggugccugugcguccucccccugcgcaccagccaggugcccgacgugauggccccgcagcacgaccaggagcccaagcggcgcauguacuucaucuggcugggcuggauccccuccgacaagcccagccagcucacggagcgguga

SEQ ID NO: 27484 - RNA, 588 nt, Artificial Sequence
  derived and/or modified sequence opt1 from C1orf86__Homo_sapiens__XP_011539224
auggaggccgcccgccggccccgccugggccucagccggcgccggccgcgccccgccgggggccccuccgggggccggcccugguuccugcucgggggcgacgagcgcgagcggcugugggccgagcugcugcgcaccgugagcccggagcucauccuggaccacgagguccccucccugcccgccuuccccggccaggagccgcggugcgggcccgagcccaccgagguguucacggugggccccaagaccuucagcuggaccccguucccgcccgaccucugggggcccggccgcuccuaccggcugcugcacggggccggcggccaccucgagagccccgcccgcucccugccccagcggcccgcgcccgacccgugccgcgcgccccgggucgagcagcagcccagcguggagggggccgccgcgcugcgcuccugccccaugugccagaaggaguucgccccgcggagcaagaacuccagcggcaugcgccggcaccgcucccccaagcucgccgccaacaacaacaacaacaagcgcaaggggcgggcccgcuggcugacccccgugauccccgcgcuguga

SEQ ID NO: 27485 - RNA, 762 nt, Artificial Sequence
  derived and/or modified sequence opt1 from C1QB__Homo_sapiens__XP_011540361
augaugaugaagauccccuggggcagcaucccggugcugaugcuccugcugcuccuggggcugaucgacaucucccaggcccagcucagcugcaccggcccgcccgccauccccgggauccccggcauccccgggacccccggccccgacggccagccggggacgcccggcaucaagggggagaagggccugcccgggcuggcgggcgaccacggcgaguucggggagaagggcgaccccgggaucccgggcaaccccggcaaggucgggcccaagggccccauggggccgaagggcgggcccggcgcccccggcgcccccgggccgaagggcgaguccggggacuacaaggccacccagaagaucgccuucagcgcgacccgcaccaucaacgugccccuccggcgcgaccagacgauccgguucgaccacgugaucaccaacaugaacaacaacuacgagccccgcuccggcaaguucacgugcaagguccccgggcuguacuacuucaccuaccacgccagcucccggggcaaccugugcgugaaccucaugcgcggccgggagcgcgcccagaagguggucaccuucugcgacuacgccuacaacaccuuccaggugaccaccgggggcauggugcugaagcuggagcagggggagaacgucuuccuccaggcgacggacaagaacagccugcugggcauggagggggccaacuccaucuucagcggcuuccuccuguucccggacauggaggccuga

SEQ ID NO: 27486 - RNA, 849 nt, Artificial Sequence
  derived and/or modified sequence opt1 from C1QBP__Homo_sapiens__NP_001203
augcugccccugcugcgcugcgugccgcggguccugggcagcuccguggccgggcuccgcgccgcggcccccgccagccccuuccggcagcugcugcagcccgccccgcgccucugcacccggcccuucggccugcuguccgugcgcgccgggagcgagcggcgccccggccuccugcggccccgcgggccgugcgcgugcggcugcggcugcgggucccugcacaccgacggcgacaaggccuucgucgacuuccucagcgacgagaucaaggaggagcggaagauccagaagcacaagacgcugcccaagauguccgggggcugggagcuggagcucaacgggaccgaggccaagcuggugcgcaagguggccggcgagaagaucaccgucaccuucaacaucaacaacagcaucccgcccacguucgacggcgaggaggagcccucccaggggcagaagguggaggagcaggagcccgagcugaccagcacccccaacuucguggucgaggugaucaagaacgacgacggcaagaaggcgcucgugcuggacugccacuaccccgaggacgaggucgggcaggaggacgaggccgaguccgacaucuucagcauccgggagguguccuuccagagcaccggcgaguccgaguggaaggacacgaacuacacccugaacaccgacagccucgacugggcccuguacgaccaccugauggacuuccucgccgaccgcggcguggacaacaccuucgccgacgagcuggucgagcuguccacggcgcucgagcaccaggaguacaucaccuuccuggaggaccucaagagcuucgugaagucccaguga

SEQ ID NO: 27487 - RNA, 777 nt, Artificial Sequence
  derived and/or modified sequence opt1 from C1QL1__Homo_sapiens__NP_006679
augcugcucgugcuggucgugcugauccccgugcucgucagcuccggcgggcccgagggccacuacgagaugcuggggaccugccgcauggugugcgaccccuaccccgcccggggccccggggccggcgcgcgcaccgacggcggggacgcccugagcgagcaguccggcgccccgccgcccagcacgcucgugcaggggccccagggcaagcccgggcggaccggcaagcccggcccgcccgggccgcccggcgaccccgggccgcccggccccgucggcccgcccggggagaagggcgagcccgggaagcccggcccgcccgggcugcccggcgccggcggguccggcgccaucagcaccgcgaccuacacgaccgugccccgcguggccuucuacgccgggcugaagaacccccacgagggcuacgagguccucaaguucgacgacguggugaccaaccuggggaacaacuacgacgccgcguccggcaaguucacgugcaacauccccggcaccuacuucuucaccuaccacguccugaugcgcgggggcgacgggaccagcaugugggccgaccucugcaagaacggccaggugcgggccuccgccaucgcccaggacgcggaccagaacuacgacuacgccagcaacuccgugauccugcaccuggacgccggggacgaggucuucaucaagcucgacggcggcaaggcccacgggggcaacagcaacaaguacuccaccuucagcggguucaucaucuacuccgacuga

SEQ ID NO: 27488 - RNA, 768 nt, Artificial Sequence
  derived and/or modified sequence opt1 from C1QL3__Homo_sapiens__NP_001010908
auggugcugcuccuggucauccugauccccgugcucgugagcuccgccggcaccagcgcccacuacgagaugcuggggaccugccgcauggucugcgacccguacggcgggacgaaggcgcccuccaccgccgccacccccgaccggggccugaugcagagccuccccaccuucauccaggggccgaagggcgaggccggccgccccgggaaggccggcccccgggggcccccgggcgagcccgggccgcccggccccaugggcccgcccggggagaagggcgagcccgggcgccagggccugcccggcccgcccggggcgcccggccugaacgccgccggggccaucuccgcggccacguacagcaccgugcccaagaucgccuucuacgccggccucaagcggcagcacgagggguacgaggugcugaaguucgacgacgucgugaccaaccugggcaaccacuacgaccccaccacgggcaaguucacgugcuccauccccgggaucuacuucuucaccuaccacgugcucaugcgcggcggggacggcaccagcaugugggccgaccugugcaagaacaaccagguccgggcguccgccaucgcccaggacgccgaccagaacuacgacuacgccagcaacuccguggugcugcaccucgagcccggggacgaggucuacaucaagcuggacggcggcaaggcgcacgggggcaacaacaacaaguacagcaccuucuccggguucaucaucuacgccgacuga

SEQ ID NO: 27489 - RNA, 846 nt, Artificial Sequence
  derived and/or modified sequence opt1 from C1QTNF1__Homo_sapiens__NP_112230
augggcagccgcgggcagggccugcuccuggccuacugccugcuccuggccuucgcguccgggcuggugcucagccgggucccccacgugcagggcgagcagcaggagugggaggggaccgaggagcugccguccccgcccgaccacgccgagcgcgccgaggagcagcacgagaaguaccggcccagccaggaccagggccugcccgccucccgcugccuccggugcugcgaccccggcaccagcauguaccccgccacggcggugccccagaucaacaucaccauccugaagggggagaagggcgaccgcggggaccggggccugcaggggaaguacggcaagaccggcuccgccggggcccgcggccacaccgggccgaagggccagaagggcagcaugggggcccccggcgagcggugcaagucccacuacgcggccuucagcgucgggcgcaagaagcccaugcacuccaaccacuacuaccagacggugaucuucgacaccgaguucgugaaccucuacgaccacuucaacauguucaccggcaaguucuacugcuacguccccgggcuguacuucuucagccugaacgugcacaccuggaaccagaaggagacguaccuccacaucaugaagaacgaggaggagguggucauccuguucgcccaggugggcgaccgguccaucaugcagagccagucccugaugcucgagcugcgcgagcaggaccagguguggguccggcuguacaagggcgagcgcgagaacgccaucuucagcgaggagcucgacaccuacaucaccuucuccggguaccuggugaagcacgccaccgagccguga

SEQ ID NO: 27490 - RNA, 741 nt, Artificial Sequence
  derived and/or modified sequence opt1 from C1QTNF3__Homo_sapiens__NP_112207
augcuguggcgccagcucaucuacuggcagcugcuggcccucuucuuccugcccuucugccugugccaggacgaguacauggagagcccgcagaccggcgggcucccccccgacugcuccaagugcugccacggcgacuacagcuuccggggguaccagggccccccggggccccccggccccccgggcauccccgggaaccacggcaacaacgggaacaacggcgccaccgggcacgagggcgcgaagggcgagaagggggacaagggcgaccuggggccccgcggcgagcggggccagcacgggcccaagggcgagaagggguacccgggcaucccccccgagcugcagaucgccuucauggccucccucgccacgcacuucagcaaccagaacuccgggaucaucuucagcuccguggagaccaacaucggcaacuucuucgacgucaugaccggccgcuucggggcccccgugagcggcguguacuucuucaccuucuccaugaugaagcacgaggacgucgaggagguguacguguaccugaugcacaacgggaacacggucuucagcauguacuccuacgagaugaagggcaagagcgacaccuccagcaaccacgcggugcugaagcucgccaagggggacgagguguggcugcggaugggcaacggcgcccugcacggggaccaccagcgcuucuccaccuucgccggcuuccuccuguucgagaccaaguga

SEQ ID NO: 27491 - RNA, 732 nt, Artificial Sequence
  derived and/or modified sequence opt1 from C1QTNF5__Homo_sapiens__NP_001265360
augcgcccccugcucgugcugcugcuccugggccuggccgccgggagcccgccccucgacgacaacaagauccccucccugugccccggccacccggggcugcccggcacccccgggcaccacggcagccagggccuccccgggcgggacggccgcgacgggcgggacggcgcgccgggggcccccggcgagaagggcgagggcgggcgccccgggcugcccggcccgcggggcgaccccgggccccgcggcgaggccgggcccgccggcccgaccgggcccgccggcgagugcuccgucccgccccggagcgcguucuccgccaagcgcagcgagucccgggugcccccgcccagcgacgcgccccugcccuucgaccgcgugcucgucaacgagcagggccacuacgacgccgugacggggaaguucacgugccaggugcccggcgucuacuacuucgccgugcacgccaccguguaccgggccucccugcaguucgaccuggucaagaacggggagagcaucgccuccuucuuccaguucuucggcggguggcccaagcccgccagccucuccggcggcgcgauggugcgccuggagccggaggaccagguguggguccaggugggggugggcgacuacaucgggaucuacgccagcaucaagaccgacuccaccuucagcggcuuccuggucuacuccgacuggcacagcucccccguguucgccuga

SEQ ID NO: 27492 - RNA, 837 nt, Artificial Sequence
  derived and/or modified sequence opt1 from C1QTNF6__Homo_sapiens__NP_872292
augcaguggcugcgcgugcgggagagccccggcgaggccaccgggcaccgcgucaccaugggcacggccgcgcucgggccggugugggccgcccugcuccuguuccugcugaugugcgagauccccaugguggagcucaccuucgaccgggccgucgccuccggcugccagcgcugcugcgacagcgaggacccccuggaccccgcgcacguguccagcgccuccagcuccgggcggccgcacgcccugcccgagauccgccccuacaucaacaucaccauccucaagggcgacaagggcgaccccgggccgaugggccugcccggguacaugggccgggaggggccccagggcgagcccggcccgcaggggagcaagggcgacaagggggagaugggcucccccggcgcccccugccagaagcgcuucuucgcguucagcguggggcggaagaccgcccugcacuccggcgaggacuuccagacgcuccuguucgagcgcgucuucgugaaccuggacgggugcuucgacauggccaccggccaguucgccgcgccccuccgggggaucuacuucuucagccugaacgugcacuccuggaacuacaaggagaccuacguccacaucaugcacaaccagaaggaggccgugauccuguacgcccagccgagcgagcgcuccaucaugcagagccaguccgugaugcucgaccuggccuacggcgaccgggucugggugcgccuguucaagcggcagcgcgagaacgccaucuacagcaacgacuucgacaccuacaucacguucuccggccaccucaucaaggccgaggacgacuga

SEQ ID NO: 27493 - RNA, 891 nt, Artificial Sequence
  derived and/or modified sequence opt1 from C1QTNF7__Homo_sapiens__NP_001128642
augagccgccaggagcccaagauguucgugcugcucuacgucaccuccuucgccaucugcgccagcggccagccgcgggggaaccagcugaagggcgagaacuacagcccccgcuacaucugcuccauccccgggcugcccggcccgcccgggccgcccggcgcgaacggcucccccgggccccacggccggaucgggcuccccggccgcgacgggcgggacggccgcaagggcgagaagggggagaagggcaccgccgggcugcggggcaagacgggcccccuggggcucgccggcgagaagggggaccagggcgagaccgggaagaagggcccgaucggccccgagggggagaagggcgagguggggcccaucgggcccccgggccccaagggcgaccgcggcgagcagggggaccccggccugcccggggugugccggugcggcagcaucguccugaaguccgccuucagcguggggaucaccaccuccuacccggaggagcgccuccccaucaucuucaacaaggugcuguucaacgagggcgagcacuacaaccccgccacgggcaaguucaucugcgcguuccccgggaucuacuacuucagcuacgacaucacccuggccaacaagcaccucgccaucggccugguccacaacgggcaguaccggaucaagaccuucgacgccaacaccggcaaccacgacguggcguccggcagcacggugaucuaccugcagccggaggacgaggucuggcucgagaucuucuucaccgaccagaacgggcuguucuccgaccccggcugggccgacagccuguucuccggguuccuccuguacguggacaccgacuaccuggacagcaucuccgaggacgacgagcucuga

SEQ ID NO: 27494 - RNA, 324 nt, Artificial Sequence
  derived and/or modified sequence opt1 from C1QTNF9B-AS1__Homo_sapiens__NP_001014442
auguggauccugagcaaccucaugggcaccuccgaggaggggaaccugcugagcaccgugucccccacggucaaggcccucuucggcaagacccgcgugagcccgaucuuccccuucagcccccggucccccuuccagccgcugaucccccgcacccccgggucccccuggggcccgguggggcccgccagcccccugggccccggcuucccgaucgggcccaugggccccgggaagcccgucggcccgaaggggcccaugcucccccugggccccuccggcccgguggggcccaccagcccccuguuccccuucugcccguga

SEQ ID NO: 27495 - RNA, 2118 nt, Artificial Sequence
  derived and/or modified sequence opt1 from C1R__Homo_sapiens__NP_001724
auguggcugcucuaccugcuggugcccgcccucuucugccgcgccggcgggagcaucccgaucccccagaagcuguucggcgaggucaccagcccccuguuccccaagccguaccccaacaacuucgagaccacgaccgugaucaccgugcccaccggguaccgggucaagcucguguuccagcaguucgaccuggagcccagcgagggcugcuucuacgacuacgugaagaucuccgcggacaagaagucccuggggcgcuucugcggccagcucggcuccccgcuggggaacccgcccggcaagaaggaguucaugagccaggggaacaagaugcugcucacguuccacaccgacuucuccaacgaggagaacggcaccaucauguucuacaagggguuccuggccuacuaccaggccgucgaccuggacgagugcgccagccgguccaagcucggcgaggaggacccccagccccagugccagcaccugugccacaacuacgugggcggguacuucugcagcugccgccccggcuacgagcugcaggaggaccggcacuccugccaggccgagugcagcuccgagcucuacaccgaggcgagcggguacaucuccagccuggaguacccccgcuccuacccgcccgaccugcggugcaacuacagcauccgcguggagcggggccucacgcugcaccugaaguuccucgagcccuucgacaucgacgaccaccagcagguccacugccccuacgaccagcugcagaucuacgccaacggcaagaacaucggggaguucugcggcaagcagcggcccccggaccuggacaccuccagcaacgccguggaccuccuguucuucaccgacgagagcggggacucccgcggcuggaagcugcgcuacaccacggagaucaucaagugcccccagcccaagacccucgacgaguucaccaucauccagaaccugcagccccaguaccaguuccgggacuacuucaucgcgaccugcaagcagggguaccagcugaucgagggcaaccaggugcuccacagcuucacggccgucugccaggacgacggcaccuggcaccgcgccaugccgcggugcaagaucaaggacugcgggcagccccgcaaccugcccaacggcgacuuccgguacaccaccacgaugggggugaacaccuacaaggcccgcauccaguacuacugccacgagcccuacuacaagaugcagacccgggccggcucccgcgagagcgagcaggggguguacacgugcaccgcccagggcaucuggaagaacgagcagaagggcgagaagaucccgcggugccugcccgucugcgggaagcccgugaacccgguggagcagcgccagcgcaucaucggcgggcagaaggcgaagaugggcaacuuccccuggcaggucuucaccaacauccacgggcggggcggcggggcccuccugggcgaccgcuggauccugaccgccgcccacacccucuaccccaaggagcacgaggcccaguccaacgcgagccuggacguguuccuggggcacacgaacguggaggagcucaugaagcugggcaaccaccccauccggcgcgucuccgugcacccggacuaccggcaggacgagagcuacaacuucgagggcgacaucgcccugcucgagcuggagaacuccgugacccuggggcccaaccuccugcccaucugccugcccgacaacgacaccuucuacgaccugggccucaugggguacgucagcggcuucggggugauggaggagaagaucgcccacgaccugcgcuucguccggcugccgguggccaacccccaggccugcgagaacuggcuccgcggcaagaaccggauggacguguucucccagaacauguucugcgcgggccaccccagccugaagcaggacgccugccagggggacuccggcggggucuucgccgugcgcgaccccaacaccgaccgguggguggccacgggcaucgucagcugggggaucggcugcucccgcggcuacggguucuacaccaaggugcugaacuacguggacuggaucaagaaggagauggaggaggaggacuga

SEQ ID NO: 27496 - RNA, 564 nt, Artificial Sequence
  derived and/or modified sequence opt1 from C1RL__Homo_sapiens__NP_001284572
augcccggcccgcgcgugugggggaaguaccuguggcggagcccccacuccaagggcugccccggggccaugugguggcuccugcuguggggcguccuccaggccugccccacccgcgggagcgugcugcuggcgcaggagcucccgcagcagcugaccucccccggcuaccccgagcccuacggcaaggggcaggagagcuccacggacaucaaggccccggagggcuucgccgugcggcuggucuuccaggacuucgaccucgagcccagccaggacugcgccggggacuccgugaccaucagcuucgugggcuccgaccccagccaguucugcgggcagcagggcagcccccugggccgcccgcccgggcagcgggaguucgucuccuccggccgcagccugcggcucaccuuccgcacccagcccuccagcgagaacaagacggcccaccuccacaagggguuccuggcgcuguaccagaccgugggcgagugccccuccuggggcugccgggagggggccagcgugccgucccacgaccccggcaucuucaagcccuga

SEQ ID NO: 27497 - RNA, 2067 nt, Artificial Sequence
  derived and/or modified sequence opt1 from C1S__Homo_sapiens__XP_005253817
auguggugcaucgugcuguucagccuccuggccugggucuacgccgagcccaccauguacggcgagauccuguccccgaacuacccccaggcguaccccagcgagguggagaaguccugggacaucgaggugcccgagggguacggcauccaccucuacuucacccaccuggacaucgagcugagcgagaacugcgccuacgacuccguccagaucaucagcggggacacggaggagggccgccucugcgggcagcgguccagcaacaacccgcacucccccaucguggaggaguuccaggugcccuacaacaagcugcaggucaucuucaagagcgacuucuccaacgaggagcgcuucaccggcuucgccgccuacuacguggccaccgacaucaacgagugcaccgacuucguggacguccccugcagccacuucugcaacaacuucaucggcggguacuucugcuccugcccgcccgaguacuuccugcacgacgacaugaagaacugcggcgugaacugcagcggggacguguucacggcgcucaucggcgagaucgccucccccaacuaccccaagccguaccccgagaacagccggugcgaguaccagauccgccuggagaagggguuccaggucguggugacccugcggcgcgaggacuucgacgucgaggccgccgacuccgcgggcaacugccucgacagccugguguucguggccggcgaccggcaguucgggcccuacugcggccacggguuccccggcccgcugaacaucgagaccaaguccaacgcccucgacaucaucuuccagaccgaccugacgggccagaagaagggguggaagcugcgcuaccacggcgaccccaugcccugccccaaggaggacaccccgaacagcgucugggagcccgccaaggccaaguacguguuccgggacgugguccagaucaccugccucgacggguucgaggugguggagggccgcgucggggcgaccagcuucuacuccacgugccagagcaacggcaagugguccaacagcaagcugaagugccagcccguggacugcggcauccccgaguccaucgagaacgggaaggucgaggacccggagagcacccuguucggcuccgugauccgguacaccugcgaggagcccuacuacuacauggagaacgggggcgggggcgaguaccacugcgccggcaacgggagcugggugaacgagguccucggccccgagcugcccaagugcgugccggugugcggggucccccgcgagcccuucgaggagaagcagcggaucaucggcggguccgacgccgacaucaagaacuucccguggcagguguucuucgacaaccccugggccggcggcgcccugaucaacgaguacugggugcucaccgcggcccacgucguggaggggaaccgcgagcccacgauguacgugggcagcaccuccguccagaccagccggcuggccaaguccaagaugcugacccccgagcacguguucauccacccgggguggaagcuccuggaggugcccgagggccgcacgaacuucgacaacgacaucgcccugguccggcucaaggaccccgugaagaugggccccaccgugagcccgaucugccugcccgggaccuccagcgacuacaaccugauggacggcgaccucgggcugaucuccggcugggggcgcaccgagaagcgggaccgcgccguccggcugaaggcggcccgccuccccguggccccccugcgcaagugcaaggaggugaaggucgagaagccgacggccgacgccgaggcguacguguucacccccaacaugaucugcgccggcggcgagaaggggauggacagcugcaagggcgacuccgggggcgccuucgccgugcaggaccccaacgacaagaccaaguucuacgcggccgggcuggucagcuggggcccccagugcggcaccuacgggcucuacacgcgggugaagaacuacguggacuggaucaugaagaccaugcaggagaacagcaccccgcgcgaggacuga

SEQ ID NO: 27498 - RNA, 3534 nt, Artificial Sequence
  derived and/or modified sequence opt1 from C20orf194__Homo_sapiens__NP_001009984
auggacguguacccgccccgccggcagggccugccccgcgcccggagccccgggggcuccagccgcgggucccccagcgucuccugcagccggcuccgccaggugcaguccauccugacccagagcuccaagagccggccggacggcauccugugcauccucgggaucgacucccgcuacaacgagggcugccgggagcuggccaacuaccugcuguucggccuguacaaccagaacaccagcgacuucgagaagacgggguucuccgaggaggugcuggacgacgucaucauccucaucaagagcgacuccgugcaccuguacugcaaccccgugaacuuccgcuaccugcuccccuacgucgcgcacuggcggaaccugcacuuccacugcaugaccgagaacgaguacgaggacgaggaggccgccgaggaguucaagaucaccagcuucguggacauggugcgcgacugcucccggaucggcauccccuacagcucccaggggcaccuccagaucuucgacauguucgucguggagaaguggccgaucgugcaggccuucgcccucgagggcaucgggggcgacggcuucuucaccaugaaguacgagcugcaggacgucagccugaaccucuggaacguguacagcaagauggaccccaugucccuggagagccugcucuccgacgaccugguggcguucgagcaccaguggacgagcuucuucgccaacuucgacaccgagauccccuuccugcucgagcuguccgagagccaggccggggagcccuuccgcuccuacuucagccacggcaugaucuccagccacaucaccgagaacuccccgaaccggcagcccuucguccuguucgggaaccacagcacccgcgagaaccucaacgccggcaacuucaacuuccccuccgagggccaccuggugcggagcacggggcccggcggguccuucgcgaagcacaugguggcccagugcgucagcccgaagggcccccuggccugcucccgcaccuacuucuucggggccacccacgugcccuaccucggcggcgacagcaagcugcccaagaagaccgagcagauccggcugcucucccagaucuacgccgcggugaucgaggccguccuggccgggaucgccugcuacgccaagacgagcagccugaccaaggcgaaggagguggccgagcagacccucggcuccgggcuggacagcuucgagcugaucccguucaaggccgcccuccgcuccaagaugaccuuccacauccacgccgugaacaaccagggccggaucgucccccuggacagcgaggacucccugagcuucgugaagacggcgugcauggccgucuacgacauccccgaccuccucgggggcaacggcugccugggguccgugguguucagcgaguccuuccucaccagccagauccuggucaaggagaaggacggcaccgugaccacggagaccuccagcgugguccugaccgccgccgugccccgcuucugcuccuggcucguggaggacaacgaggucaagcugagcgagaagacccagcaggccgugcgcggggacgaguccuuccugggcacguaccugaccgggggcgagggcgcguaccucuacagcuccaaccugcagagcuggccggaggaggggaacgugcacuucuucagcuccggccugcuguucagccacugccggcaccgcuccaucaucaucagcaaggaccacaugaacuccaucagcuucuacgacggggacuccaccagcaccgucgccgcccugcugaucgacuucaaguccagccuccugccccaccuccccgugcacuuccacggcuccagcaacuuccucaugaucgcccuguuccccaaguccaagaucuaccaggcguucuacagcgagguguucucccuguggaagcagcaggacaacagcggcaucucccucaaggucauccaggaggacgggcugagcguggagcagaagcggcugcacuccagcgcccagaagcuguucagcgcccugucccagccggccggcgagaagcgcagcucccugaagcuccugagcgccaagcugcccgagcucgacugguuccugcagcacuucgcgaucuccagcaucucccaggagcccgugaugcggacgcaccucccgguccugcugcagcaggccgagaucaacaccacccaccgcaucgagagcgacaaggugaucaucuccaucgugaccgggcugcccggcugccacgccagcgagcucugcgccuuccuggucacgcugcacaaggagugcgggcgguggaugguguaccgccagaucauggacuccagcgagugcuuccacgccgcgcacuuccagcgguaccucuccagcgcccuggaggcccagcagaaccgcuccgcccggcagagcgccuacauccgcaagaagacccggcugcucgugguccugcagggcuacaccgacgugaucgacgugguccaggcgcugcagacccaccccgacuccaacgugaaggccagcuucacgaucggcgccaucaccgccugcguggagcccauguccugcuacauggagcaccgcuuccucuucccgaagugccuggaccagugcagccaggggcuggucagcaacgugguguucaccucccacaccaccgagcagcggcacccccuccugguccagcugcagagccucauccgcgcggccaaccccgccgccgccuucauccuggcggagaacggcaucgugacgcggaacgaggacaucgagcugauccucuccgagaacagcuucuccagccccgagaugcugcgcucccgguaccugauguacccggggugguacgagggcaagcucaacgccgggagcguguacccccugaugguccagaucugcgugugguucggccgcccccuggagaagacccgcuucguggccaagugcaaggccauccaguccagcaucaagcccuccccguucagcggcaacaucuaccacauccucgggaaggucaaguucuccgacagcgagcggaccauggaggugugcuacaacacccuggccaacucccugagcaucaugcccgugcucgagggccccacgcccccgcccgacuccaagagcgucucccaggacagcagcgggcagcaggagugcuaccugguguucaucggcugcucccugaaggaggacagcaucaaggacuggcuccgccaguccgcgaagcagaagccccagcggaaggcccugaagacccgcgggaugcugacccagcaggagauccggagcauccacgugaagcgccaccucgagccccugccggccggcuacuucuacaacggcacccaguucgucaacuucuucggggacaagacggacuuccacccccugauggaccaguucaugaacgacuacguggaggaggccaaccgggagaucgagaaguacaaccaggagcucgagcagcaggaguaccacgaccuguucgagcugaagcccuga

SEQ ID NO: 27499 - RNA, 618 nt, Artificial Sequence
  derived and/or modified sequence opt1 from C20orf196__Homo_sapiens__NP_001290406
auggccgcccgcgacgcgaccagcggcucccugagcgaggaguccagcgcccucgaccugcccuccgccugcgacauccgggacuacgugcugcaggggccgagccaggaggccaacuccgaggccuucagcucccucgaguuccacagcuuccccuacuccagcgacgucgaccccgacaccuccaaccugaacaucgagcagaacaacagcuggacggcggagaacuucuggcuggaccccgccgugaagggccaguccgagaaggaggaggacgacgggcuccgcaagagccuggaccgguucuacgagauguucggccacccgcagcccggguccgccaacagccuguccgccagcgugugcaagugccucagccagaagaucacccagcugcgcggccaggagucccagaaguacgcgcugcggagcuuccagauggcccgcgucaucuucaaccgggacggcugcuccgugcuccagcgccacagccgggacacccacuucuacccccuggaggagggguccaccagccuggacgacgagaagcccaacccgggccucuccaaggacaucacgcacuuccugcugcagcagaacgugaugaaggaccucuga

SEQ ID NO: 27500 - RNA, 600 nt, Artificial Sequence
  derived and/or modified sequence opt1 from C20orf27__Homo_sapiens__NP_001034229
auggccgccgcgaacaagggcaagugccugcccgggguggucggccucgcccaggcccugccgguggggcccggccgccgggccaucgccgcggggaacaagccccgcgugcggagcauccgcuucgccgccggccacgacgccgagggcucccacagccacguccacuucgacgagaagcugcacgacuccguggugauggucacccaggagagcgacuccagcuuccucgugaaggugggguuccugaagauccugcaccgguacgagaucaccuucacgcugcccccgguccaccgccucuccaaggacgugcgggaggcgcccgugcccagccugcaccucaagcugcuguccgucgugcccgugccggagggcuacagcgucaagugcgaguacuccgcccacaaggagggggugcucaaggaggagauccugcuggccugcgagggcgggaccgggaccugcgugcgcgucaccgugcaggcccgggugauggaccgccaccacggcacgcccaugcuccuggacggcgucaagugcgugggcgccgagcuggaguacgacagcgagcacuccgacuggcacggguucgacuga

SEQ ID NO: 27501 - RNA, 414 nt, Artificial Sequence
  derived and/or modified sequence opt1 from C20orf85__Homo_sapiens__NP_848551
auggcccagaagccccugagcaccgccgcggccgagcgcaugaaccucgugggccaggacgagaucuggaaguaccggcugaaggccgaguccgaggcccgccagaacuggccgcagaacuggggguuccugaccacgcccuucgaggagcucaucaagugcgaggaggaccugcccacccccaagccgaagaucgagcugcccgagcgguuccgcauccggcccgucacccccguggagaaguacaucaagguguucccgagcccgcccgucccccagaccacgcagggcuucaucggguggcgcuccgccgugcccggccucaacaagugccuggagcuggacgacgcgauccggagcugcaagggggccuucgcccgcgagcucugcuggcccaagcagggcgugcacuga

SEQ ID NO: 27502 - RNA, 768 nt, Artificial Sequence
  derived and/or modified sequence opt1 from C21orf2__Homo_sapiens__NP_001258369
augaagcugacccgcaagauggugcucacccgggccaaggccagcgagcugcacuccguccgcaagcugaacugcuggggcagccggcucacggacaucuccaucugccaggagaugcccagccuggaggugaucacccuguccgugaacagcaucuccacccucgagcccgucagccgcugccagcggcuguccgagcuguaccuccgccggaaccgcauccccagccuggcggagcuguucuaccucaaggggcugccccggcugcgcgugcucuggcuggccgagaaccccugcugcggcaccuccccgcaccgguaccgcaugacggugcugcggacccucccccgccugcagaagcuggacaaccaggccgucaccgaggaggagcucagccgggcccuguccgagggggaggagaucaccgccgcgcccgagcgcgagggcacggggcacggcggccccaagcugugcugcacccucagcucccugagcuccgccgccgagaccgggcgggacccgcuggacagcgaggaggaggccaccggcgcgcaggacgagcgcgggcucaagccgcccucccggggccaguuccccagccugagcgcccgcgacgccuccagcucccaccgggggcgcaacgugcugacggccauccuccugcugcuccgcgagcuggacgccgagggccuggaggcggugcagcagaccgucggcagccggcuccaggcccugcgcggggaggaggugcaggagcacgccgaguga

SEQ ID NO: 27503 - RNA, 807 nt, Artificial Sequence
  derived and/or modified sequence opt1 from C21orf33__Homo_sapiens__NP_004640
auggccgccgugcgcguccugguggcgagccggcucgccgccgccuccgccuucaccagccugucccccggcgggcgcaccccgagccagcgggcggcccugcaccucuccgugccccgccccgccgcccgggucgcgcuggugcugagcggcugcgggguguacgacggcacggagauccacgaggccuccgccauccucguccaccugagccgcgggggcgccgaggugcagaucuucgcccccgacgugccgcagaugcacgucaucgaccacaccaagggccagcccuccgagggggagagccggaacgugcugaccgaguccgcgcgcaucgcccggggcaagaucaccgaccucgccaaccugagcgccgccaaccacgacgcggccaucuuccccgggggcuucggggccgccaagaaccuguccacguucgccguggacggcaaggacugcaaggucaacaaggagguggagcgcgugcucaaggaguuccaccaggcgggcaagcccaucgggcugugcugcaucgccccgguccuggccgccaaggugcuccggggcguggaggucaccguggggcacgagcaggaggagggcggcaaguggcccuacgccgggaccgcggaggccaucaaggcccugggcgccaagcacugcgugaaggaggucguggaggcgcacguggaccagaagaacaaggucgugaccacgcccgccuucaugugcgagaccgcccugcacuacauccacgacgggaucggcgccaugguccgcaaggugcucgagcugaccgggaaguga

SEQ ID NO: 27504 - RNA, 873 nt, Artificial Sequence
  derived and/or modified sequence opt1 from C21orf59__Homo_sapiens__NP_067077
auggugcugcuccacgucaagcgcggcgacgagagccaguuccugcugcaggcccccggguccaccgagcucgaggagcugaccguccagguggcccggguguacaacggccgccugaaggugcagcggcucugcagcgagauggaggagcuggcggagcacgggaucuuccugccgcccaacaugcagggccucacggacgaccagaucgaggagcugaagcugaaggacgaguggggcgagaagugcgugcccuccgggggcgccgucuucaagaaggacgacaucgggcgccggaacggccaggcccccaacgagaagaugaagcagguccucaagaagaccaucgaggaggccaaggccaucaucagcaagaagcaggucgaggcgggggugugcgugaccauggagauggugaaggacgcccuggaccagcugcgcggcgccgugaugaucguguacccgauggggcucccgcccuacgaccccauccggauggaguucgagaacaaggaggaccuguccggcacccaggccggccugaacgugaucaaggaggcggaggcccagcucuggugggccgccaaggagcugcgccggacgaagaagcugagcgacuacgucgggaagaacgagaagaccaagaucaucgccaagauccagcagcgcggccagggggcgcccgcccgggagcccaucaucuccagcgaggagcagaagcagcucaugcuguacuaccaccgccggcaggaggagcugaagcgccucgaggagaacgacgacgacgccuaccugaacucccccugggccgacaacaccgcccugaagcggcacuuccacggcgugaaggacaucaaguggcgcccccgguga

SEQ ID NO: 27505 - RNA, 660 nt, Artificial Sequence
  derived and/or modified sequence opt1 from C21orf62__Homo_sapiens__XP_011545334
auggcgcccccgagccgccacugccugcugcugaucuccacccugggcguguucgcccucaacugcuucaccaaggggcagaagaacagcacgcugaucuucacccgggagaacaccauccgcaacugcuccugcagcgccgacauccgggacugcgacuacucccuggccaaccucaugugcaacugcaagaccguccugccccuggccguggagcgcacgagcuacaacggccaccucaccaucugguucaccgacaccuccgcccuggggcaccuccugaacuucacgcuggugcaggaccugaagcucagccugugcuccaccaacacccugcccaccgaguaccucgccaucugcggccugaagcggcugcgcaucaacauggaggcgaagcaccccuucccggagcagagccuccugauccacuccgggggcgacagcgacucccgggagaagcccauguggcugcacaagggcuggcagcccugcauguacaucagcuuccucgacauggcccuguucaaccgcgacuccgcccucaagagcuacuccaucgagaacgucacgagcaucgccaacaacuuccccgacuucuccuacuuccggaccuucccgaugcccagcaacaagagcuacguggugaccuucaucuacuga

SEQ ID NO: 27506 - RNA, 894 nt, Artificial Sequence
  derived and/or modified sequence opt1 from C21orf91__Homo_sapiens__NP_001093890
augaacgaggaggagcaguucgugaacaucgaccugaacgacgacaacaucugcagcgucugcaagcucggcaccgacaaggagacccuguccuucugccacaucugcuucgagcugaacaucgagggggugcccaagagcgaccuccugcacacgaagucccugcgcggccacaaggacugcuucgagaaguaccaccucaucgccaaccaggggugcccgcggagcaagcuguccaagagcaccuacgaggaggugaagaccauccuguccaagaagaucaacuggaucguccaguacgcccagaacaaggaccucgacagcgacuccgagugcagcaagaacccccagcaccaccuguucaacuuccgccacaagcccgaggagaagcugcucccccaguucgacucccaggugccgaaguacagcgcgaaguggaucgacggcuccgccgggggcaucagcaacugcacccagcggauccuggagcagcgcgagaacacggacuucggccuguccaugcuccaggacagcggggccacccugugccggaacuccgugcuguggccccacagccacaaccaggcccagaagaaggaggagaccaucuccagccccgaggccaacguccagacccagcacccccacuacagccgcgaggagcucaacuccaugacgcugggcgagguggagcagcugaacgcgaagcuccugcagcagauccaggagguguucgaggagcugacccaccagguccaggagaaggacagccucgccucccagcugcacgugcggcacguggccaucgagcagcugcucaagaacugcagcaagcugccgugccugcaggucgggcgcaccggcaugaagucccaccuccccaucaacaacuga

SEQ ID NO: 27507 - RNA, 1095 nt, Artificial Sequence
  derived and/or modified sequence opt1 from C22orf29__Homo_sapiens__NP_078903
augccccgcggccggugccgccagcaggggccccggauccccaucugggccgccgcgaacuacgccaacgcccaccccuggcagcagauggacaaggccagccccggcguggccuacaccccgcuggucgaccccuggaucgagcgccccugcugcggggacaccgugugcgugcggacgaccauggagcagaaguccaccgcgagcgggaccugcggcggcaagcccgccgagcgcggcccgcucgccgggcacaugcccuccagccggccccaccgcgucgacuucugcugggugcccggcuccgacccggggacguucgacggcagccccuggcugcuggaccgguuccucgcccagcugggggacuacauguccuuccacuucgagcacuaccaggacaacaucagccgcgugugcgagauccugcggcgccucaccggccgggcgcaggccugggccgcccccuaccuggacggcgaccugccccucccggacgacuacgagcuguucugccaggaccugaaggaggucgugcaggaccccaacuccuucgccgaguaccacgcgguggugaccugcccccucccccuggccagcucccagcugccggucgcgccccagcuccccgugguccgccaguaccuggcccgguuccuggaggggcucgcccuggacaugggcaccgcgccccgcagccugccggccgccauggccacgcccgccguguccgggagcaacuccgugagccgguccgcccucuucgagcagcagcugaccaaggagagcacccccggccccaaggagccgcccguccugcccuccagcacgugcagcuccaagccgggccccguggagcccgccagcucccagcccgaggaggccgccccgacccccgugccccgccucagcgaguccgccaacccgcccgcgcagcggcccgaccccgcccaccccgggggcccgaagccccagaagaccgaggaggagguccuggagaccgagggggaccaggaggugagccugggcacgccccaggagguggucgaggcccccgagaccccgggggagccgccccucucccccggcuucuga

SEQ ID NO: 27508 - RNA, 7062 nt, Artificial Sequence
  derived and/or modified sequence opt1 from C2CD3__Homo_sapiens__NP_001273506
augaagcagcgcaagggccagggguccggcgggucccggggccgcaagaagcgggggcuguccgacaucucccccuccaccucccucccgccccugguggagggccagcugcgcugcuuccucaagcugaccgucaaccgggugaucuggaagaucgccaagcccccgaccugcgugcugguccgcgugcggugguggggcgagaccuccgacgggacccucuucugcccccgcgacgcccugcagaccgagcccaaggccgugcggaccaccacccgcuacgccauccggugcggccccaagcaguucaccuccuaccugaccgacauggccguccucgugcuggaggugaucaccaagcuggacgggcuccccaucggccgcguccagaucaacgggcuggcccagcugucccccacccaccagaucaacggcuucuucaccaucguguccagcaccuccaagaagcucggcgagcuccaggugagccuggcccuggagccccuguccgagaccuacgacagcuaccacccccugcccaccaccgacaugaccgagaacguccuccuguccaagcagggguuccgggagaacaccgagcccagcuccacccaguuccaggugcccagccgcccccgggacauccacaccaucaagaucgacggcaaggagcuggcggccaacuccagccgcagcaccacgccccgggggaaggaccacgugugcuucgccgagaaccccgacaccaucaaggacuccagcuucggccuccagcacucccugaacagcggccagucccuggagagcgucacccucaaggggcgcgcgccccggaagcagaugucccugcugaacagcuccgaguuccagccccagauccgcacgguggccaagucccacuccgacagcugcauccucuccagcaacaaccugcccaccaaggaccugcucuccgcccugcuggagcagggcaacaagcuccggaacgccauggugaucagcgccaugaaguccagccccgagaccuccaugcugcuggaccagguccacccgcccaucaacgaggacagccuccgcgccagcacccagauccgcgcguucucccggaaccgcuucaaggaccacaucgaggaccaccuccugcccagcacggagaacaccuucuggcggcacgacaccaaggccgacacccgcgccauccagcuccugcugggguccgccgagcucagccagggcaacuucugggacgggcugggcuccccgcccgacagccccucccccggcagcgacguguacugcaucuccgagcugaacgacccccaguacgaccagagccuccuggagaaccuguucuacacggcccccaaguccgacaccagcaucuccgacuuccugagcgaggaggacgacaucgugcccuccaagaagaucagccaguccaccgcgcucgcccggagcagcaagguccuggaguccagcgaccacaagcugaagaagcgcuccgccgggaagcggaaccgcaaccucguggagcagcagaugcugagcgagacccccgaggacgcccagacgaugacccuguccguggaccggcucgcccugcugggccgcacccacagcguccggaucaucaucgagaccaugggggugccgcccgacagcccccagaugaccccgggcaagaaguccuacgcggggccgccgcccaaggucacgaccgccaagaagcgcaccuucuucguggaguaccacuucccggugggcuucuccgagagcggccucgggaagaccgcccugaucacggaggucgugcggcuggccuccagcaagaucaccgacggcaaggugaaguuccagcagcgcuucgucuuccccgugcaguucgggggccccaugaucgagcacugguggaacuccaaccucaccuuccagaucuacgugaagaagacgccccagaagaagccggaggucaucgggagcgugucccugagccugcgggccgugauccaguccgagcuccugagcuucuccgaccagcugcccguccagcaggagaacggccagagccccuucggcccccucaaggugacgauggagcugaucaccgacaacaaggacuucaccgggaucaacaccaagcugagcggcaacacgcacuacaccccgcucugcgcgcccaccucccccaacaaggcccugcccgagcugaaccaggacaugaccugcacgaagaacccgcagaaccucaaccagauccacgaggagaccgccaagaaggcccagaaccuggugcugcccaaccgcaagagccccucccccgucgcgccgcaccccagcaccuucguggccacccccgccucccacaaccucgugaaccagacgaacgggaccaccaaggagagcgcccugcugcuccacguccugcugauggugcccgacggcaaggacuucaucuccggcgagagcgagaagcagucccccugcaacguguaccucaacugcaagcuguucagcaccgaggaggucacgcgguccgugaucgccugggggaccacccagcccguguucaacuucagccaggucauccccgugucccugagcuccaaguaccucgagcgccugaagaacaacgugauggucaucgagaccuggaacaaggugcggagcccgggccaggacaagcugcucgggcuggugaagcugccccuccaccaguucuacauguccuucaaggacgcgaagaucagccgccugcugcucgacgcccaguaccccgucguggccguggacuccuacaugcccgucaucgacguguucagcggccaccagaacgggagccugcgcguguuccuggccaugggcuccagcaaccagaucauggcccuccagcggcugaagaacgaggagggcacgcugccgcccuucagcccccggcccgcgcacuuccucgaccagccgaccgccgccagcgucgccauggccgaggaccgggggaacggccugauggagcacugcuucgagauccacaucgagauggugaaggggcuggcgccccuccaggccaccguguggggcgaggccgacugcuacguccaguacuacuuccccgugcagcacucccagagcuccgugcugaaggggcccgaguuccuggagaacggcaucacccucaagccguuccgcacggccaccacccugugcguccccgaccccaucuucaacagcgagcaccaccacucccugcuccugcccgcggaggugccggugcagcggcugcuccugagcgccuucuccgcccagggccugguccccgggggcggggugcaguucgagaucuggugccgcuacuacuaccccaacgugcgggaccagaaggucgccaagggcacccucccccugagccgcaucugcgccauggugacgacccagcaccgggaggacguggggauccagaccuucaaccugccgcucacgccccgcaucgagaaccggaaggagcugcgcaaccaguccagcggccugcucgacgucggccugcgguaccgccggagcccccgcaccgcggagggggugcuggccgcccggacggucagcaucuccgugcagaucauccgcgccugcggccuccaggccgcggccaaggcccuggccgagcgggagcccgcccugcaguucagcgcgaccgugggggucaacgccuccgugaccacccaccucagcuuccugccgcagggcgagcagcgccggacgcaccccguggccugcagcuucugccccgaguucucccaccacgucgaguucacgugcaaccuggugacccagcacugcagcggggaggccugcuuccucgcggagcugcuggaguucgccgaggugaucuucgccgucuaccacgagaacaccaaguccgccagcgacaucaucuccaucgagagcugcaaggaguaccuccugggcguggugaaggucccgacgaaggagcugcucaucaagcgcuccggcaucaccgggugguaccccaucauccugcccgaggacggcgggcugccccacggccucgagcugaugcagaagaucgugggcgggcuggagcucagcaucuccuucacccaccgcggcgaccgggagcgcgugcuggaggccgcggagcaccugggguggagcuucgagaacucccugaaggacuucguccggauggacgagggcgagccggccaccgugacgaucagcacgccccgccucuggcugcccauccacugcgugcugcucgccgggcacaaccacauccacaagaacaccuacugcuaccugcgguacaaguucuacgaccacgaggccuucuggacgccccugaagaagccgaaggaguccgucaacaagaagcagaucauggugacguucaaggccagcaagcgcgcggaggugacccggggccccucccuccugugguacuuccgcgaggagcggcuggagauccaggucuggcgcgccuacggcaacgacagcguggagcggccccaccagaccgacuccuggaucgggagcgccuacguggaccucgcccgccugggcgagcgguccgcccgcacccugacggucagcgggguguacccccucuucggccggaacgcgagcaaccuguccggggccgcccugcgcgugcacgucgugcucagcucccugagcucccaccuggagccgacccacgagcucgacagcauggacugcuccagccacuccgagagcgagcagcugccccggcgcaacgacgaggugcagcugagcccgcccgaggucaucagcugccaccagaaguccccggccagcacccaggugcccugcuccagcaccacggccgaggugcggcucacccaggagggccccgcggaccuggacggcaccuucgccgucuccauccugguggagcgcgccaugcaccucagccugaaggggagcccccugaccgagcgcaaggugagcaucccgagcugcugcgucuccuucgccacggcggacgagagcucccccguguacacccagguggucgagaacaccgacagccccaucuggaacuuccagcagcagucccggcucagcaaggagcugcugcucgacccccagcagacccugguguucaagguguggcacaagggcgacgaggagcgcgucaucggguucgccuccguggaccugagcccgcuccuguccggcuuccaguucgugugcgggugguacaacaucacggacuucagcggcgagugccagggccagaucaaggucgccgugagcccccuggagagccucauccacuucaaggaggagcggcaggcccgccggggcguggagaccuccaagagccugauccccaucuacucccccuucagcuucccggccuccgacaccuacgcggccuucagcagccacauggcccgccagacccuggaccagcucgcccacgccuccagcaaggagcuggacuucuccagccccggccgguccgacacgacccgcagccaggcgucccggcacgaggagcacguccagaacauccgccgguuccacgagagccugcaccuccagggggaggcgccccugccgugcgacgacaagcugaccaccagcccccugagcucccagaccagcauccugacgucccugcgcaagaaccucagcgagcuggaccagauccagcgguacuuccgccagaagcugaccaagcccuuccucccccuguccccgcagacccagaccgccaucagccagcaccaggaguccugccgggaccaccugggccccggcgccagcucccucgaccccgggagccagugcauccuggagaaguccuccaaccuggugcuccaggugagcucccugaucacggaccugcagaccaucacccgcgacagccaggccgcgcucuccagccaccgggcccgcucccggagcaacaaggccaccacgcugcccgacgcccaggacaccgaggcgcugcaggagcgcugcaccaugccggacgagccccucguccgggcccccgacaagggcaccgacucccccagcccgccgccccuggaggagacguccaacgggggccgcaugcugcacgagagccuccgccacgccgugcccaucacccggaugcaguccagcgaggacaccgaggccgggccggccuacuccgacgaggacuacgaggaggacaucaucgagccccgcacccugaacgagaucacgaccgucaccgacaagaccagccccugguccagcgugaucuccgacacgagcgaggugaucagcccccagccggacgagguccagcgggagggccccuccugccccagccccggcccguucugccgcgaggagcugauggugaaguccagcuuccucuccagccccgagcgggcggugaacccccaccucccccgccaggggucccccagccagucccuggucgccugcgagugcgaggccagcaaggcccgggugggcggggaguccgccagcgcgaacccccagcccaucccgugccccacccuguccggcgcccagcagagcuccaccuucgugggguggagcagcccccagaccgaccagaacaaggagcccaagagcgaggccccggccgagaacgaggccgcgacguccgagcugggcgacagcgccgacagcuucaagaagcugccccucaaccuggccucccagagccgccgggagaaccacaaggggccgcccaucgacuccagcgacauccgccagcggcaggucaccaccggguccgagaccagcacgaagcagucccugcuccugccgggccccaucguggugcccaacuucuuccugcccccgcagcagcucgaggccagccugcgcaugcugucccucagcgcgacccugccgcccgccgccaccaccgaccaggacaaguccgaggccacgcgcggggcccugagccagcgccccugccggccgcgccccaacucccucccccugaaccugcccgaggaggagacccuccggaucgcgcgcaucuucagcucccaguacagccagaaggacuga

SEQ ID NO: 27509 - RNA, 1110 nt, Artificial Sequence
  derived and/or modified sequence opt1 from C2CD4A__Homo_sapiens__NP_997205
auguggugccuggagcgccuccggcugggccccgagugccugcgccggagcggggacuggcuccugccgggccgcgcccgcggggccaagucccggaccaccgcggccugcgccaacgugcugacgcccgaccggauccccgaguucugcaucccgccccgccucaugccccggcuggcccuggccgcgcuccgcaacagcugggucgaggaggccggcauggacgagggggccggccggaccgacugggacccccgcucccaggccgcgcugagccugccccaccucccgcgggugcgcaccgccuacggcuucugcgcccugcuggagagcccccacacccggcgcaaggagucccuccugcucgggggcccgcccgcgccccggccccgcgcccacacguacgggggcgggggcggccccgacgcccugcuggggacccugcgggugccccgcgccccgggccccgccacccccgccgcccccgggugcccgcggccgccccaggacgcgcucgcccgccgcccccggggcugccgccugcugcggguccccgacggccuccugucccgcgcccugcgggccgggcgcagccggcgccucacccgggugcgcuccgugagcuccggcaacgaggacaaggagcggcgcgccgggagccagucccccgcgcgggcccccagcacgagcccgcccuccucccgcguccccuuccccgagcggcuggaggccgagggcaccguggcccuggggcgcgccggcgacgcgcuccggcuggccgccgaguacugcccgggcaccgggcgccugcggcuccgccugcugcgcgccgagagccccgcgggcggggcccccggcccccgggccguguccugccgccucagccugguccugcggccgcccgggaccgcccuccgccagugcagcacgguggugggccggucccgcaaggccagcuucgaccaggacuucugcuucgacggccuguccgaggacgagguccggcgccuggcggugcgggugaaggcccgcgacgaggggcggggccgcgagcgggggcgccuccugggccagggggagcugagccucggcgcccugcugcuccuguga

SEQ ID NO: 27510 - RNA, 1095 nt, Artificial Sequence
  derived and/or modified sequence opt1 from C2CD4B__Homo_sapiens__NP_001007596
augcgccugcucgagaagcugugcagcuccgccgccggcagcuccgcgcccaagcccgccuucgccaaggugcugacccccaaccggauccccgaguucugcaucccgccccgccuccccgcccccugcacccuggagagccccauccgggccgcggccgucccgcgccggugcgccgccgaguccgaccuguggccccgcgcggccgacgaggacgccgggcggacggacugggacccccgcagccaggccgcccucucccugccccaccucccgcgggugcgcaccaccuacggcuucugcgcgcugcuggagagcccccacacccggcgcaaggagucccugcuccucgggggcccgcccgccccgcggccccgcgcccacagcugcgggggcggcgggggccccgacgcgccccuggggacgcugugcggcccccgggggcccggccccgccacccccgccgccccgggcgggccccgccugccccaggacgcccuggccgccggcccccggcgcugccggcuccugcgcgugccggacgggcugcucucccgggcgcugcgcgccggccgcagccggcgccuggcccggguccgcuccgugagcuccggcaacgaggacgaggagcggcgcgccgggagcgagucccccgcccgggcgcccagcuccagcccgcucagcucccgcgcgccccugcccgagcggcuggaggccaagggcaccguggcccucgggcgcgccggcgacgcccugcggcuggccgccgaguacugccccgggacccgccggcuccgccugcggcugcuccgcgccgagagccuguucggcggcgcgccggggccccgggccguccgcugccggcugucccucgugcugcgcccgcccggcacggcccgcuggcagugcagcgccguggucgggcggucccgcaaggccagcuucgaccaggacuucugcuucgacggccuguccgaggacgaggugcggcgccucgcggugcgggucaaggcccgcgacgaggggcggggccgcgaccggggccgccugcuggggcagggcgagcucagccugggggcccugcuccugcuguga

SEQ ID NO: 27511 - RNA, 3165 nt, Artificial Sequence
  derived and/or modified sequence opt1 from C2CD5__Homo_sapiens__NP_001273104
augcccggcaagcugaaggugaagaucgucgccgggcgccaccucccggugauggaccgggccagcgaccugaccgacgcguucguggaggucaaguucggcaacaccacguucaagaccgacguguaccugaagucccucaacccccaguggaacagcgagugguucaaguucgagguggacgacgaggaccugcaggacgagccccugcagaucaccguccucgaccacgacaccuacuccgccaacgacgccaucgggaagguguacaucgacaucgacccccugcuguacagcgaggccgccacggugaucuccggcugguucccgaucuacgacaccauccacgggauccgcggcgagaucaacgucguggugaaggucgaccucuucaacgaccugaaccgguuccgccagagcuccugcggcgugaaguucuucugcaccaccagcauccccaagugcuaccgggcggugaucauccacggguucgucgaggagcugguggugaacgaggaccccgaguaccaguggaucgaccgcauccggacgccccgcgccuccaacgaggcccggcagcgccucaucagccugauguccggcgagcugcagcggaagaucgggcucaagguccuggagaugcgcggcaacgccguggugggguaccugcagugcuucgaccucgagggcgagagcggccuggucgugcgggcgaucgggaccgccugcacccuggacaagcucuccagcccggccgccuuccugcccgccugcaacucccccagcaaggagaugaaggagagcccccuggugcacccgcccagccacggcugccgcuccacccacaacagccccauccacacggcgaccgggagccggcucacccagaacuucuccgucagcgugcccacccugaucuacacgggcaugggcuccgggagcgccggcaaggagggcgggccguucaaggcccugcuccgccagcagacccaguccgcccuggagcagcgggaguuccccuucuucacccugaccgccuucccgcccggguuccucguccacgugggcggcguggucagcgcgcgcuccgugaagcugcuggaccggauccacaaccccgccuucguggggaucaugggcaacacgcgcagcuacaagcuccuggacuggaacuccuucaacagcgacgagcccgagacccgggacgccuggugggccgagauccgccaggagaucaagucccacgccaaggcgcuggggugccacgccgucgugggcuacagcgaguccaccagcaucugcgaggaggugugcauccucuccgccagcgggaccgccgccguccugaacccccgcuuccugcaggacggcacgguggagggcugccucgagcagcggcuggaggagaaccugcccacccgcugcggguucugccacaucccguacgacgagcucaacaugcccuuccccgcgcaccugaccuacugcuacaacugccggaagcagaaggugcccgacguccuguucaccacgaucgaccucccgaccgacgccaccgugaucggcaaggggugccugauccaggcccgccugugccggcucaagaagaaggcccaggcggaggccaacgccaccgccaucuccaaccugcugcccuucauggaguacgaggugcacacgcagcugaugaacaagcucaagcugaagggcaugaacgcccuguucgggcuccgcauccagaucaccgucggcgagaacaugcugaugggccuggcgagcgccaccgggguguaccucgccgcccugcccaccccgggcgggauccagaucgccggcaagacgcccaacgacggcuccuacgagcagcacaucagccacaugcagaagaagaucaacgacaccaucgcgaagaacaaggagcuguacgagaucaacccgcccgagaucagcgaggagaucaucgggucccccauccccgagccccggcagcgcagccggcuccugcgcucccagagcgaguccagcgacgaggugaccgagcuggaccucucccacggcaagaaggacgccuucguccuggagaucgacgacaccgacgccauggaggacgugcacagccugcucaccgacgugcccccgcccuccggguucuacagcugcaacacggagaucaugcccggcaucaacaacuggaccuccgagauccagauguucaccagcguccgggugauccgccuguccagccugaaccucaccaaccaggcccugaacaagaacuucaacgaccugugcgagaaccuccugaagucccuguacuucaagcuccggagcaugauccccugcugccugugccacgugaacuucacggucucccugccggaggacgagcucauccaggugaccgugaccgccgucgcgaucaccuucgacaagaaccaggcccugcagacgaccaagacccccguggagaagucccugcagcgcgccagcaccgacaacgaggagcuccugcaguucccccuggagcucugcuccgacagccugcccucccacccguucccgcccgccaaggagcaccuggagagcgcguccagcaacuccgggauccccgccgcccagcgggaccgcugcagcuccuggaucgagcucaucaagcugaaggcccagacgauccggcgcggcagcaucaagaccaccaugaccguggagaaggccucccccgucggcgacgggaacuuccggaaccgcagcgcgccgcccugcgccaacuccacggugggcguggucaagaugacgccccugagcuucauccccggggccaagaucaccaaguaccucggcaucaucaacauguucuucauccgcgagaccaccucccugcgggaggagggcggggugagcggcuuccugcacgccuucaucgccgagguguucgcgaugguccgcgcccacguggccgcccucgggggcaacgccguggucuccuacaucaugaagcagugcguguucauggagaaccccaacaagaaccaggcgcagugccugaucaacgugagcggggacgccgucguguucgugcgggaguccgaccuggaggucgugagcagccagcagcccaccaccaacugccaguccagcugcaccgagggcgaggugacgaccuga

SEQ ID NO: 27512 - RNA, 2259 nt, Artificial Sequence
  derived and/or modified sequence opt1 from C2__Homo_sapiens__NP_000054
augggcccccugaugguccucuucugccugcuguuccucuacccggggcuggccgacagcgcccccuccugcccccagaacgugaacaucagcggcgggaccuucacccugucccacggcugggcgcccgggagccuccugacguacuccugcccgcagggccuguaccccagccccgccucccgccucugcaagagcuccggccaguggcagacccccggggccacccggagccuguccaaggccgugugcaagccggugcgcugccccgcccccgucagcuucgagaacggcaucuacacgccccggcugggguccuacccggugggcgggaacgugagcuucgagugcgaggacggcuucauccuccgcggcucccccguccggcagugccgccccaacgggaugugggacggcgagaccgcggugugcgacaacggggccggccacugccccaacccgggcaucagccugggggccgugcggaccggcuuccgcuucgggcacggcgacaagguccgguaccgcugcuccagcaaccuggugcucaccggguccagcgagcgggagugccagggcaacggcguguggagcgggaccgagcccaucugccgccagcccuacuccuacgacuuccccgaggacgucgccccggcgcugggcacgagcuucucccacaugcugggggccaccaaccccacccagaagaccaaggagagccucggccggaagauccagauccagcgcuccgggcaccugaaccuguaccuccugcuggacugcagccaguccgugagcgagaacgacuuccucaucuucaaggaguccgccagccugaugguggaccggaucuucuccuucgagaucaacgucagcguggccaucaucacguucgccuccgagcccaaggugcugaugagcguccucaacgacaacucccgcgacaugaccgaggugaucagcucccuggagaacgcgaacuacaaggaccacgagaacggcaccggcaccaacacguacgccgcccugaacagcguguaccucaugaugaacaaccagaugcggcugcuggggauggagaccauggccuggcaggagauccgccacgccaucauccuccugaccgacggcaaguccaacaugggcgggagccccaagaccgcggucgaccacauccgggagauccugaacaucaaccagaagcgcaacgacuaccucgacaucuacgccaucggggugggcaagcuggacguggacuggcgggagcugaacgagcucggcagcaagaaggacggggagcgccacgccuucauccugcaggacacgaaggcccugcaccaggucuucgagcacaugcucgacguguccaagcugaccgacaccaucugcggcgucgggaacaugagcgccaacgcguccgaccaggagcgcaccccguggcacgugacgaucaagcccaagagccaggagaccugccggggcgcccugaucuccgaccagugggugcucaccgccgcccacugcuuccgcgacggcaacgaccacagccuguggcgggucaacgugggggaccccaagucccaguggggcaaggaguuccugaucgagaaggccgugaucagccccggguucgacgucuucgcgaagaagaaccagggcauccucgaguucuacggggacgacaucgcccugcugaagcuggcccagaaggugaagauguccacccacgcccgcccgaucugccuccccugcacgauggaggcgaaccuggcccugcggcgcccccagggcagcacgugccgggaccacgagaacgagcuccugaacaagcaguccgugccggcccacuucgucgcccugaacggcagcaagcucaacaucaaccugaagauggggguggaguggaccuccugcgccgagguggucagccaggagaagaccauguuccccaaccugaccgacgugcgcgagguggucaccgaccaguuccucugcuccggcacccaggaggacgagagccccugcaagggggaguccggcggggcgguguuccuggagcggcgcuuccgguucuuccaggugggccuggucagcuggggccucuacaaccccugccuggggagcgccgacaagaacucccgcaagcgggccccgcgcagcaaggugcccccgccccgggacuuccacaucaaccuguuccgcaugcagcccuggcuccggcagcaccugggcgacgugcugaacuuccucccccuguga

SEQ ID NO: 27513 - RNA, 5955 nt, Artificial Sequence
  derived and/or modified sequence opt1 from C2orf16__Homo_sapiens__NP_115642
auggagcugacccccggggcccagcagcaggggaucaacuaccaggagcugaccagcggcuggcaggacgucaagagcaugaugcuggugcccgagcccacgcgcaaguuccccagcgggccccugcugaccuccgugcgguucagcaaccuguccccggagagccagcagcaggacgugaagucccuggaguucaccguggagcccaagcugcagagcgugaagcacgugaagcuguccagcgucucccugcagcagaccaucaagagcguggagcucgcccccggcucccugccccagcgcgugaaguacggggagcagacgccgcggaccaacuaccagaucauggagagcuccgagcugaucccccgccccggccaccaguucgcgaaguacgccgagaugaucccccagccgaaguaccagauccccaagagcgccaaccucaucuccauccccaucuaccacgccaccgagagcuccgagauggcccagggccuggcguacaaggggaucgacaccgucgagaaguccgugggccugacgcccaagcucaccgggcgggccaaggagagccugggcaugcugcuccagccggaccugcagguccccaaguucgucgaccugacccccauggugcgcgaccagggguccaaguuccucggccugacccccgagaaguccuaccagauccuggagacgauggagcuccugucccagagccggccgcgcgugaaggacgucggcgagcuguacaugaagccccuccagcagaccguggaguacgaggggaucacccccgagcugaagcacuacuucaccgaggccaugggccugacggccgaggcgcggauccaggccaacgaguucuucgggaugacccccaagccgaccucccaggccaccggcuucgccgagcgcagcccccggcucugcccccagaaccuggagugcguggaggucaucuccgagaagcgccugcagggcgaggagagcguggugcucauccccaagucccugcaccacgucccggacagcgccuccgggaugacgcccggccuggggcaccgggugcccgagagcguggagcucaccuccaagagcggcguccagguggagaagacccugcagcugaccccgaagccccagcaccacgucgggucccccggcaucaucagcggccucgggcaccaggugcccgaguccgugaaccugacgugcaagcaguggcugcagauggaggagagccucgaggucccgcugaagcagaccucccaggugaucggccacgaggagagcguggagcugaccagcgaggcgcgccagcaccgggaggucuccauggggcucaccaagagcaagaaccaguccaugaagucccccggcacgacccccgggccccugggccgcaucguggaguucaugcggaucuccccggagccccuggaccaggugaccgagagcgcccgcacccagcuccaggucgcccaguccgaggaggugauccugaucgacgugcccaaggucgugcagagcgugaaggucacgcccggcccgcccuuccagaucgugaaguccgugaccaucccccggcccaccccgcagauggucgaguacaucgagcugacccccaagcugcaguacgugcgccccagcgagcaccacacggggcccugccuccaggacgugaaguccaccaagcugaucaccaagccgaagcaccagauccuggagaccgucgagcucaccggcuuccagaucgugaagacgaugcugauccccgggcccagccugcagaucgugaaguccgaggagcucgcccccggcccgaucccccaggucguggagcccaucgggguggcccuggagagcggcaucgaggcgaucaacugcgucgaccugcucccgcggccccaccuccaggagcugaucgugcccgccgagcucacccccuccccgugcacccaggucaagagcgccgagcugaccagcccccagacgagccccuucgaggagcacaccauccugacccacaagcagggccuccaggccgucaagagcaccgugaucaagacggagcccccgaaggugauggagaccgaggaccugaaccuggggcacgucugccagaaccgcgacugccagaagcucaccuccgaggagcuccaggugggcaccgacuucagccgcuuccugcaguccagcuccacgacccucaucagcuccagcgugcggaccgccuccgagcucgggggccugugggacagcggcauccaggaggucucccgcgcgcucgacaucaagaaccccgggaccgacauccugcagcccgaggagacguacaucgaccccaccaugauccagagccugaccuucccgcucgcccugcacaaccaguccagcgacaagaccgccaacaucguggagaaccccugccccgagauccugggcguggacgucaucuccaaggagacgaccaagcggaagcagauggaggagcucgagaacagccugcagcgccaccucccccaguccuggcggagccgcucccggaccuuccaggccgagagcggggugcagaagggccucaucaagagcuucccggggcgccagcacaacgugugggagucccacgccuggcggcagcgccugccccggaaguaccugagcaccaugcucaugcugggcaacauccugggcacgaccauggagcgcaagcucugcucccagaccagccuggcggagcgggccaccgccgacacgugccaguccauccagaaccuguucgggauccccgccgagcucauggagcccagccagucccugccggagaagggccccgucaccaucagccagcccuccguggugaagaacuacauccagcgccacaccuucuaccacgggcacaagaagcggauggcgcugcgcaucuggacccggggcagcacguccagcaucauccagcaguacuccgggacccgcguccggaucaagaagaccaacagcaccuucaacggcaucucccaggaggugauccagcacaugcccgugagcugcgccggcgggcagcucccgguccuggugaaguccgagagcucccugagcaucuucuacgaccgcgaggaccucgugcccauggaggagagcgaggacucccagagcgacucccagacgcgcaucagcgagucccagcacagccugaagcccaacuaccugucccaggccaagaccgacuucagcgagcaguuccagcuccuggaggaccugcagcucaagaucgccgccaagcugcugcggucccagaucccgcccgacgugccgcccccgcucgcgagcggccuggugcugaaguaccccaucugccuccagugcgggcgcugcuccggccugaacugccaccacaagcugcagaccaccagcgggcccuaccuccugaucuacccccagcugcaccucguccggaccccggagggccacggcgaggugcgccugcaccugggguuccggcuccgcaucggcaagcggucccagaucagcaaguaccgcgagcgggaccgccccgugauccggcgcucccccaucagccccucccagcggaaggccaagaucuacacgcaggccagcaaguccccgaccagcaccaucgaccugcagagcgggcccucccagagccccgcccccguccagguguacauccgccggggccagcgcucccggccggaccugguggagaagaccaagacgcgcgcccccgggcacuacgaguucacccagguccacaaccuccccgagagcgacuccgagagcacccagaacgagaagcgggcgaaggugcgcaccaagaagacguccgacagcaaguaccccaugaagcggaucaccaagcgccugcgcaagcaccggaaguucuacaccaacucccgcaccacgaucgagagcccgucccgggagcuggccgcccaccuccgccggaagcgcaucggcgccacccagaccagcaccgccucccugaagcggcagcccaagaagcccagccagcccaaguucaugcagcugcuguuccagucccugaagcgcgcguuccagacggcccaccgggugaucgccagcgucggccgcaagccgguggacgggacccggcccgacaaccugugggccuccaagaacuacuaccccaagcagaacgcgcgcgacuacugccuccccagcuccaucaagcgggacaagcgcagcgccgacaagcugaccccggccggcagcaccaucaagcaggaggacauccuguggggcgggacggugcagugccgguccgcccagcagccccgccgggccuacagcuuccagccccgcccccuccggcugccgaagcccaccgacucccagagcggcaucgcguuccagaccgccuccgucgggcagccccugcgcaccgugcagaaggacagcuccagccgcuccaagaagaacuucuaccggaacgagacgagcucccaggagagcaagaaccucuccaccccgggcacccgcgugcaggcccgggggcgcauccugcccggcagccccgucaagcggaccuggcaccgccaccugaaggacaagcucacgcacaaggagcacaaccaccccuccuucuaccgggagcgcaccccgcgggggcccagcgagcgcacccggcacaaccccuccuggcgcaaccaccggagccccuccgagcgcagccagcggagcucccuggagcgccggcaccacagcccgucccagcgcagccacugcucccccagccggaagaaccacuccagccccuccgagcgcagcuggcggucccccagccagcgcaaccacugcuccccgcccgagcgcagcugccacucccugagcgagcggggccuccacucccccagccagcgcagccaccggggccccucccagcgccggcaccacagcccguccgagcgcagccaccggucccccagcgagcgcucccaccggagcuccagcgagcgccggcaccgcucccccagccagcggucccaccgcgggcccagcgagcggucccacugcagcccguccgagcgccggcaccgcagccccucccagcggagccaccgcggccccagcgagcgccggcaccacucccccagcaagcgcucccaccggagcccggcccgccggucccaccgcagccccuccgagcggagccaccacucccccagcgagcgcucccaccacagcccguccgagcggcgccaccacagccccuccgagcggagccacugcucccccagcgagcgcucccacugcagccccagcgagcggcgccaccgguccccgagcgagcgccggcaccacucccccagcgagaagucccaccacagccccuccgagcgcagccaccacucccccagcgagcggcgccggcacuccccgcuggagcgcagccgccacucccugcuggagcggagccaccgcucccccagcgagcggcgcucccaccggagcuucgagcgcucccaccggcgcaucagcgagcggagccacucccccagcgagaagucccaccucagcccccuggagcgcucccggugcagcccguccgagcgccgggggcacagcuccagcggcaagaccugccacucccccagcgagcgcucccaccggagccccuccgggaugcgccagggccggacgagcgagcgcucccaccggagcuccugcgagcgcacccgccacagccccagcgagaugcggccgggccgccccuccgggcggaaccacugcagccccuccgagcgcagccggcgcagcccccugaaggagggccucaaguacagcuucccgggggagcggcccucccacagccugucccgcgacuucaagaaccagaccacccugcucggcacgacccacaagaaccccaaggccggccagguguggcggcccgaggcgacccgcuga

SEQ ID NO: 27514 - RNA, 447 nt, Artificial Sequence
  derived and/or modified sequence opt1 from C2orf40__Homo_sapiens__NP_115787
auggccgccagccccgcgcgcccggccgugcuggcccucaccggccuggcccugcuccugcugcucugcugggggcccggcgggaucuccggcaacaagcugaagcugaugcuccagaagcgggaggcccccguccccaccaagacgaagguggcgguggacgagaacaaggccaaggaguuccuggggagccugaagcgccagaagcggcagcucugggaccgcacccggccggagguccagcagugguaccagcaguuccuguacaugggcuucgacgaggccaaguucgaggacgacaucaccuacuggcugaaccgcgaccggaacggccacgaguacuacggggacuacuaccagcgccacuacgacgaggacuccgccaucggcccccggagccccuacggguuccgccacggcgcguccgugaacuacgacgacuacuga

SEQ ID NO: 27515 - RNA, 834 nt, Artificial Sequence
  derived and/or modified sequence opt1 from C2orf43__Homo_sapiens__NP_001269649
auggacagcgagcugaaggaggagauccccgugcacgaggaguucauccucugcggcggggccgagacccagguccugaagugcggcccguggaccgaccuguuccacgaccaguccgugaagcgccccaagcuccugaucuucaucauccccgacagcaacgcccaggagaucaaggacaucuacgggcugaacggccagaucgagcacaagcucgcguuccugcggacgcacgugcccaaggacaugaagcugguccucaucgggcacuccaucggcagcuacuucacccugcagaugcugaagcgcgugccggagcuccccgugauccgggccuuccugcuguuccccaccaucgagcgcauguccgagagccccaacggccggaucgccaccccgcuccugugcugguuccgcuacguccuguacgugacgggguaccuccugcugaagcccugccccgagaccaucaagucccuccugauccggcgcggccuccaggugaugaaccuggagaacgaguucagcccccugaacauccuggagccguucugccucgccaacgccgcguaccucgggggccaggagaugauggaggucgugaagcgggacgacgagaccaucaaggagcaccugugcaagcugaccuucuacuacgggacgaucgaccccuggugccccaaggaguacuacgaggacaucaagaaggacuuccccgagggcgacauccgccugugcgagaagaacaucccgcacgccuucaucacccacuucaaccaggagauggccgacaugaucgccgacucccugaaggacgaccucagcaagauguga

SEQ ID NO: 27516 - RNA, 876 nt, Artificial Sequence
  derived and/or modified sequence opt1 from C2orf47__Homo_sapiens__NP_078796
auggcccuggccgcgcgccuccugccccaguuccugcacagccggucccucccgugcggcgccgugcgccugcggacccccgccgucgccgaggugcgccugcccagcgccacccucugcuacuucugccggugccgccuggggcugggcgcggcccucuucccccgguccgcccgcgcccuggcggccagcgcccugccggcccaggggucccgguggcccgugcucagcucccccggccugcccgccgcguucgccagcuucccggccugcccccagcgcuccuacagcacggaggagaagccccagcagcaccagaagaccaagaugaucguccugggguucuccaaccccaucaacugggugcggacccgcaucaaggccuuccucaucugggccuacuucgacaaggaguucagcaucaccgaguucuccgagggcgcgaagcaggccuucgcccacgugagcaagcugcugucccagugcaaguucgaccuccuggaggagcuggucgccaaggaggugcuccacgcccugaaggagaaggugacgagccugccggacaaccacaagaacgcgcucgccgccaacaucgacgagaucgucuucaccuccaccggcgacaucagcaucuacuacgacgagaaggggcggaaguucgugaacauccugaugugcuucugguaccugaccuccgccaacauccccagcgagacgcuccgcggcgccagcguguuccaggucaagcuggggaaccagaacguggagaccaagcagcugcucuccgcgagcuacgaguuccagcgggaguucacccagggcgugaagcccgacuggaccaucgcccgcaucgagcacuccaagcugcuggaguga

SEQ ID NO: 27517 - RNA, 1188 nt, Artificial Sequence
  derived and/or modified sequence opt1 from C2orf57__Homo_sapiens__NP_689827
auggcccugcccggcuacccgcucgggaacguggacgacagccgcuccaaggacagccccgccggcgagccccaggggcaggucccccugaccgcggacgugcuggccguguccagcuccgucgccagcaccgacuggcaggacaucgaccaggccuccuucaagaccgccaccccgcgggcgaucagcaccuccggcgacaaggacaagagcgccguggugcccgagcacgggcagaagaccccgcgcaagaucacgccccuccugcccucccagaaccccagcccccugcaggucuccaugagccuccagaaccccgccugggaccgccaggugcaggacgcccggaccucccagagccugguggucuucccgucccaccuccugggcaaggacaagaugagccagauggcguccgugcccgagcgggagcccgagagcgcccccagcgccccguccgccgagcugcagagcacccagcacauggaggcccagcccguggaguccgacgcggaccacgucaccgccggcgccaacgggcagcacggcccccaggccgccagcacgaccaaguccgcggaggagaaggccgagcaccccaaggccccgcaccccgaggccgaggcccugcccagcgacgagucccccguggcgaugggggccaacguggucgacagccucggcgaccugcagaccugguucuucccgcccccgcccgccggguccgugagccccucccccggcccccacgagguggcccugggccgccggccgcucgacagcucccuguacaccgccagcgaggagaacuccuacaugcgcagcaugacgucccugcucgaccgcggggagggcagcaucuccagccuggcggacauccuggucuggagcgagaccaccauggggauggccaucgccaccggcuuccucgacuccggccacagcacgguggccgaccugcugcacuccagcgggcccucccuccggagcgugcccucccuggucggcagcguguccagcgcguucuccagcgggcugguguccggcaccagcuccgcccuccggaccaucacccgcguccuggagacgguggagcagcggaccgucgaggggauccgcagcgccaugcgguaccugaccucccaccucacgccccgccaggcccaggccgacccgaacuacgacuga

SEQ ID NO: 27518 - RNA, 747 nt, Artificial Sequence
  derived and/or modified sequence opt1 from C2orf61__Homo_sapiens__NP_001157033
auggaccagcccgccguggccaccgcgagcaccuccauccgcgaggaccuggucggcggggagagcuucaucacggccuccaagccggcccagaagaccagcuccuucgagcgggagggcugguggcgcaucgcccucaccgacacccccauccccgggacguaccaccugaagaccuucaucgaggagagccugcucaaccccgugaucgccaccuacaacuucaagaacgagggccggaagaagccgccccuggugcagcgcaacaaccccguccugaacgaccucccccaguacaugccgcccgacuuccuggaccugcucaagaagcaggucgcgaccuacuccuucaaggacaagccccggcccagcccguccacgcugguggacaaggaccagagccugcagcucucccccgggcaguacaacgugcugcccgcccccgugccgaaguacgccagccgcuccugcguguuccggagcaccguccagcgcuuccccaccaccuacuucaucccccacgagggccccggcccggggcacuacaacgugaagaugccgcccacguccagcgugaccuccugcuuccagagccgggucccccgcuuccugcccuccugcagcaagacccccggccccggggccuacaccacgcuccggcaguuccccaagcagagcccgaccaucgcgaagaugggccaggagcacucccuguucuucaacaacaacaacuggcugcucaaguga

SEQ ID NO: 27519 - RNA, 1449 nt, Artificial Sequence
  derived and/or modified sequence opt1 from C3AR1__Homo_sapiens__NP_004045
auggccagcuucuccgccgagaccaacagcaccgaccugcucucccagcccuggaacgagccgcccgugauccugagcauggucauccugucccucacguuccugcugggccuccccgggaacggccuggugcuguggguggcggggcucaagaugcagcgcaccgucaacaccaucugguuccugcaccugacccucgccgaccugcugugcugccucagccugcccuucucccuggcccaccucgcccugcagggccaguggccguacgggcgguuccugugcaagcucauccccagcaucaucgugcugaacauguucgccuccguguuccugcucacggcgaucagccuggaccgcugccuggucguguucaagcccaucuggugccagaaccaccggaacgugggcauggccugcuccaucugcggcugcaucugggucguggccuucgugaugugcauccccgucuucguguaccgcgagaucuucaccaccgacaaccacaaccggugcggguacaaguucggccucagcuccagccuggacuacccggacuucuacggggacccccuggagaaccgcucccucgagaacaucgugcagccgcccggcgagaugaacgaccggcuggaccccagcuccuuccagaccaacgaccaccccuggacgguccccaccguguuccagccccagaccuuccagcgcccgagcgccgacucccugccccgggggagcgcgcgccucaccagccagaaccuguacuccaacguguucaagcccgccgacgucgugagccccaagaucccguccggcuuccccaucgaggaccacgagacgagcccccuggacaacuccgacgccuuccucagcacccaccugaagcuguuccccuccgccagcuccaacagcuucuacgaguccgagcucccgcagggcuuccaggacuacuacaaccuggggcaguucaccgacgacgaccaggugcccacgccccuggucgccaucaccaucacccggcucguggugggcuuccugcugcccagcgucaucaugaucgcgugcuacuccuucaucguguuccgcaugcagcgggggcgcuucgccaagagccaguccaagaccuuccgggucgccgugguggucguggccguguuccucgucugcuggaccccguaccacaucuucggcgugcugagccugcucacggaccccgagacgccccugggcaagacccugauguccugggaccacgugugcaucgcccuggcgagcgccaacuccugcuucaacccguuccucuacgcccugcuggggaaggacuuccgcaagaaggcccggcagagcauccagggcauccucgaggccgcguucagcgaggagcugacccgcuccacccacugccccagcaacaacgucaucuccgagcggaacagcaccaccguguga

SEQ ID NO: 27520 - RNA, 4992 nt, Artificial Sequence
  derived and/or modified sequence opt1 from C3__Homo_sapiens__NP_000055
augggccccaccagcgggccgucccugcuccugcugcuccugacccaccucccccucgcccugggcagccccauguacuccaucaucacgcccaacauccugcgccucgagagcgaggagaccauggugcuggaggcccacgacgcgcagggggacgucccggugaccgugaccguccacgacuuccccggcaagaagcuggugcucuccagcgagaagacggugcugacccccgccaccaaccacauggggaacgucaccuucacgauccccgccaaccgggaguucaaguccgagaagggccgcaacaaguucgugaccgugcaggccaccuucggcacccaggucguggagaaggugguccuggugagccuccaguccggguaccuguucauccagacggacaagaccaucuacaccccgggcagcaccgugcuguaccggaucuucacggucaaccacaagcuccugcccguggggcgcaccgugauggucaacaucgagaaccccgagggcauccccgugaagcaggacucccugagcucccagaaccagcucggggugcugccgcugagcugggacauccccgagcucgucaacaugggccaguggaagauccgggccuacuacgagaacagcccccagcaggucuucagcaccgaguucgaggugaaggaguacgugcugcccuccuucgaggugaucgucgagccgaccgagaaguucuacuacaucuacaacgagaagggccuggaggugacgaucaccgcgcgcuuccucuacgggaagaagguggagggcaccgccuucgucaucuucgggauccaggacggcgagcagcggaucagccugcccgagucccugaagcgcauccccaucgaggacggcagcggggagguggugcucagccggaagguccugcuggacggcgugcagaacccccgcgccgaggaccucguggggaagucccuguacgucagcgccaccgugauccugcacuccggcagcgacauggugcaggcggagcgguccgggaucccgaucgucacgagccccuaccagauccacuucaccaagacccccaaguacuucaagcccggcaugccguucgaccucaugguguucgugaccaaccccgacggcucccccgccuaccgcguccccguggccgugcagggggaggacacgguccagagccugacccagggcgacgggguggccaagcuguccaucaacacccacccgagccagaagccccucuccaucaccgugcggacgaagaagcaggagcugagcgaggccgagcaggcgacccgcaccaugcaggcccugcccuacuccaccgucggcaacagcaacaacuaccuccaccuguccgugcugcggacggagcuccgcccgggggagacccugaacgugaacuuccugcuccggauggaccgcgcccacgaggccaagauccgguacuacaccuaccugaucaugaacaagggccgccugcugaaggccggccggcagguccgcgagcccgggcaggaccucguggugcugccccugagcaucaccaccgacuucauccccuccuuccgccucgucgcguacuacacgcugaucggcgccagcgggcagcgggaggugguggccgacuccgucuggguggacgugaaggacagcugcgucggcagccugguggugaaguccgggcagagcgaggaccgccagccgguccccggccagcagaugacccucaagaucgagggcgaccacggggcccggguggugcuggucgccguggacaagggcguguucguccugaacaagaagaacaagcucacccaguccaagaucugggacgugguggagaaggcggacaucgggugcacccccggcagcggcaaggacuacgccggggucuucuccgacgccggccugacguucaccagcuccagcgggcagcagaccgcccagcgcgccgagcugcagugcccccagccggcggcccggcgccggcgcuccgugcagcucaccgagaagcggauggacaaggugggcaaguaccccaaggagcugcgcaagugcugcgaggacgggaugcgggagaaccccaugcgcuucagcugccagcggcgcacgcgguucaucucccugggcgaggccugcaagaaggucuuccucgacugcugcaacuacaucaccgagcugcgccggcagcacgcccgcgcgagccaccugggccucgcccgguccaaccuggacgaggacaucaucgccgaggagaacaucgugagccgcuccgaguuccccgagagcuggcuguggaacguggaggaccucaaggagccgcccaagaacgggaucuccaccaagcugaugaacaucuuccugaaggacagcaucaccacgugggagauccucgccgucagcauguccgacaagaagggcaucugcguggccgaccccuucgaggucaccgugaugcaggacuucuucaucgaccugcgccugcccuacagcgugguccggaacgagcaggucgagauccgcgcggugcucuacaacuaccggcagaaccaggagcugaaggugcgcguggagcugcuccacaacccggccuucugcucccuggccaccaccaagcggcgccaccagcagacggugaccaucccgcccaagagcucccugagcguccccuacgugaucgugccccucaagaccgggcugcaggaggucgaggugaaggccgccguguaccaccacuucaucuccgacggcguccggaagucccugaagguggugcccgaggggauccgcaugaacaagaccgucgcggugcggacgcucgaccccgagcgccugggccgggagggcgugcagaaggaggacaucccgcccgccgaccuguccgaccagguccccgacaccgagagcgagacccgcauccuccugcaggggacccccguggcccagaugacggaggacgccguggacgccgagcggcugaagcaccucaucgucaccccguccggcugcggggagcagaacaugaucggcaugacccccaccgugaucgcggugcacuaccuggacgagacggagcagugggagaaguucgggcuggagaagcgccagggcgcccucgagcugaucaagaagggcuacacccagcagcuggccuuccggcagcccagcuccgccuucgcggccuucgucaagcgcgcccccagcaccuggcucaccgccuacguggugaaggucuucucccuggccgugaaccugaucgcgaucgacagccaggugcucugcggggccgucaaguggcugauccuggagaagcagaagccggacggcguguuccaggaggacgcccccgugauccaccaggagaugaucgggggccuccggaacaacaacgagaaggacauggcccugacggccuucguccugaucucccuccaggaggcgaaggacaucugcgaggagcaggucaacagccugcccggguccaucaccaaggccggcgacuuccuggaggccaacuacaugaaccuccagcgcagcuacaccguggccaucgccggcuacgcgcuggcccagauggggcggcugaagggcccccuccugaacaaguuccugaccacggccaaggacaagaaccgcugggaggacccggggaagcagcucuacaacguggaggccaccagcuacgcgcugcuggcccuccugcagcugaaggacuucgacuucgugccgcccgugguccgguggcucaacgagcagcgcuacuacggcggcggguacggcuccacccaggccaccuucaugguguuccaggcccuggcccaguaccagaaggacgcgcccgaccaccaggagcugaaccucgacgugagccugcagcugcccucccgcagcuccaagaucacccaccggauccacugggagagcgccucccuccugcgcagcgaggagacgaaggagaacgagggguucaccgucaccgccgagggcaaggggcagggcacccuguccguggugacgauguaccacgccaaggccaaggaccagcugaccugcaacaaguucgaccugaaggucaccaucaagcccgcgcccgagaccgagaagcggccccaggacgccaagaacacgaugauccuggagaucugcacccgcuaccggggcgaccaggacgccaccaugagcauccucgacaucuccaugaugaccggguucgccccggacacggacgaccugaagcagcuggccaacggcguggaccgcuacaucagcaaguacgagcucgacaaggcguucuccgaccggaacacccugaucaucuaccuggacaaggugagccacuccgaggacgacugccucgccuucaagguccaccaguacuucaacguggagcugauccagcccggggccgucaagguguacgccuacuacaaccuggaggagagcugcacccgcuucuaccaccccgagaaggaggacggcaagcucaacaagcugugccgggacgagcugugccgcugcgccgaggagaacugcuucauccagaaguccgacgacaaggugacccuggaggagcggcucgacaaggcgugcgagcccggggucgacuacguguacaagacgcgccuggugaagguccagcugagcaacgacuucgacgaguacaucauggccaucgagcagaccaucaaguccggcagcgacgagguccaggugggccagcagcggaccuucaucagcccgaucaagugccgcgaggcccucaagcuggaggagaagaagcacuaccugaugugggggcucuccagcgacuucuggggcgagaagcccaaccuguccuacaucaucgggaaggacaccuggguggagcacuggcccgaggaggacgagugccaggacgaggagaaccagaagcagugccaggaccugggcgccuucacggagagcauggugguguucgggugccccaacuga

SEQ ID NO: 27521 - RNA, 1704 nt, Artificial Sequence
  derived and/or modified sequence opt1 from C3orf17__Homo_sapiens__NP_056227
augauggccgccgugcccccgggccuggagcccuggaaccgcguccggauccccaaggcggggaaccgcagcgccgugaccgugcagaaccccggcgccgcccucgaccugugcaucgccgcggucaucaaggagugccaccuggugauccucucccucaagagccagacccuggacgccgagacggacgugcugugcgccguccuguacuccaaccacaaccggauggggcgccacaagccgcaccuggcccucaagcaggucgagcagugccugaagcggcugaagaacaugaaccucgagggcagcauccaggaccuguucgagcuguucuccagcaacgagaaccagccccucaccaccaaggugugcguggugcccucccagcccguggucgagcuggugcugaugaaggugcucggggcgugcaagcugcugcuccgccugcuggacugcugcugcaagaccuuccuccugacggucaagcaccugggccuccaggaguucaucauccugaaccuggugauggugggccucgucagccggcugugggugcuguacaagggggugcucaagcgccugauccugcucuacgagccgcuguucggccugcuccaggaggucgcccggauccagcccaugcccuacuucaaggacuucaccuuccccuccgacaucaccgaguuccuggggcagccguacuucgaggccuucaagaagaagaugcccaucgccuucgccgcgaagggcaucaacaagcugcucaacaagcuguuccugaucaacgagcagagcccccgcgccuccgaggagacccuccuggggaucagcaagaaggccaagcagaugaagaucaacgugcagaacaacguggaccugggccagcccgucaagaacaagcggguguucaaggaggaguccagcgaguucgacguccgcgccuucugcaaccagcucaagcacaaggccacgcaggagaccuccuucgacuucaagugcagccagucccggcugaagaccaccaaguacagcucccagaaggugaucggcacgccgcacgccaagagcuucgugcagcgcuuccgggaggcggagagcuucacccagcuguccgaggagauccagauggccgucguguggugccgcagcaagaagcugaaggcccaggccaucuuccucgggaacaagcugcugaaguccaaccggcucaagcaccuggaggcgcagggcaccagccugcccaagaagcucgagugcaucaagaccuccaucugcaaccaccuccugcgcgggagcggcaucaagacguccaagcaccaccuccggcagcgccggagccagaacaaguuccugcgccgccagcggaagccccagcgcaagcugcaguccacccugcugcgggagauccagcaguucagccagggcacccgcaaguccgccaccgacacgagcgccaaguggcggcugucccacugcaccgugcaccgcaccgaccucuaccccaacagcaagcagcugcugaacuccggggucagcaugccggugauccagaccaaggagaagaugauccacgagaaccuccggggcauccacgagaacgagacggacuccuggaccgugaugcagaucaacaagaacagcaccuccgggaccaucaaggagacggacgacaucgacgacaucuucgcccugaugggcgucuga

SEQ ID NO: 27522 - RNA, 489 nt, Artificial Sequence
  derived and/or modified sequence opt1 from C3orf18__Homo_sapiens__NP_001165212
augaacagccgcaccgccuccgcccggggcugguucagcucccggcccccgaccagcgaguccgaccuggagcccgcgacggacgggcccgccagcgagaccaccacccucucccccgaggccacgaccuucaacgacacccgcaucccggacgccgccggcgggaccgcgggcguggggacgaugcugcugagcuucggcaucaucaccgucaucggccucgccguggcccuggugcuguacauccgcaagaagaagcggcucgagaagcugcgccaccagcugaugcccauguacaacuucgaccccaccgaggagcaggacgagcucgagcaggagcugcuggagcacgggcgggacgccgcguccguccaggccgccaccagcgugcaggccaugcagggcaagacgacccuccccucccaggggccgcugcagcgccccagccggcugguguucaccgacgucgccaacgcgauccacgccuga

SEQ ID NO: 27523 - RNA, 2349 nt, Artificial Sequence
  derived and/or modified sequence opt1 from C3orf20__Homo_sapiens__NP_001171887
auggcccgccaggugcggacccaccaggagacccugaaccgcuuccagcagcagagcauccaccuccugacggagcugcuccggcugaagaugaaggccauggucgaguccaugagcgugggcgcgaacccccuggacaucacccgccgguucguggaggccucccagcuccugcaccugaacgccaaggagauggccuucaacugccucaucagcaccgccgggcgcuccggcuacagcuccgggcagcuguggaaggagagccuggcgaacauguccgccaucggcgucaacagcccguaccagcucaucuaccacuccagcaccgccugccuguccuucagccuguccgccgggaaggaggcgaagaagaagaucggcaagagccggacgaccgaggacguguccaugccgccccuccaccgcggcguggggacccccgccaacagccuggaguucuccgaccccugccccgaggcccgggagaagcugcaggagcucugccgccacaucgaggccgagcgggccaccuggaagggccgcaacaucagcuaccccaugauccugcggaacuacaaggcgaagaugcccagccaccugaugcucgcccgcaagggggacucccagacgccgggccugcacuacccgcccaccgccggggcccagacccugagccccaccucccaccccagcuccgccaaccaccacuucagccagcacugccaggagggcaaggcgcccaagaaggccuucaaguuccacuacacguucuacgacggcuccagcuucgucuacuaccccuccgggaacguggccgugugccagaucccgaccugcugccggggccgcaccaucacgugccucuucaacgacauccccggguucagccugcuggcccucuucaacaccgagggccagggcugcguccacuacaaccugaagaccuccugccccuacgugcugauccucgacgaggagggcgggaccaccaacgaccagcagggguacgugguccacaaguggagcuggacgucccggaccgagacccugcugagccucgaguacaaggugaacgaggagaugaagcugaaggugcugggccaggacuccaucaccgucacguucaccagccucaacgagaccgugacccugacgguguccgccaacaacugcccccacgggauggcguacgacaagcgccugaaccggcgcaucagcaacauggacgacaaggucuacaagaugucccgggcccucgccgagaucaagaagcgcuuccagaagaccgugacccaguucaucaacagcauccugcuggccgccggccucuucaccaucgaguaccccacgaagaaggaggaggaggaguucgugcgcuucaagaugcggagccgcacccacccggagcggcugcccaagcugucccucuacagcggcgagucccugcugcgcagccaguccgggcaccucgagagcuccaucgcggagacccugaaggacgagcccgagagcgcccccgucuccccggugcggaagaccacgaagauccacaccaaggccaaggugaccagccgcggcaaggcccgggaggggcgcucccccacccggugggcggcccugcccagcgacugcccccugguccuccgcaagcugaugcugaaggaggacacccgggccggcugcaagugccucgugaaggccccgcuggucuccgacguggagcuggagcgcuuccuccuggcgccccgggaccccagccaggugcuggucuucgggaucaucuccagccagaacuacacguccaccggccagcuccaguggcugcugaacacccucuacaaccaccagcagcgcggccgggggagcccgugcauccagugccgcuacgacagcuaccggcugcugcaguacgaccucgacagcccccugcaggaggacccgccccugauggugaagaagaacuccgugguccagggcaugauccucauguucgccgggggcaagcugaucuucgggggccgcgugcugaacggcuacgggcucuccaagcagaaccugcugaagcagaucuuccggagccagcaggacuacaagaugggcuacuuccuccccgacgacuacaaguucuccgugcccaacagcguccugucccuggaggacagcgaguccgugaagaaggccgagagcgaggacauccagggguccagcuccagccucgcccuggaggacuacguggagaaggagcugucccucgaggccgagaagacccgcgagcccgaggucgagcugcacccccugagccgcgacuccaagaucacgagcuggaagaagcaggccuccaagaaguga

SEQ ID NO: 27524 - RNA, 513 nt, Artificial Sequence
  derived and/or modified sequence opt1 from C3orf35__Homo_sapiens__NP_848029
augaagaccauggccacccgcaagcggugcaagcugagccgcacgggccccgaguucgagaacgugaucaagcggcuccugugcgcccgcaccuuccacacccggaucgggggcgaccugacccacgggaucaucaaccgcggccggcgcgcgaacgccgagcagauggggcuccagggcuccgcccagcacuucaacaucuucccgcuggaccuguggacgcagggcaagaagaccgagguccagaagcgggaggggaccgacagcauccccgccgccggccgcuccgggaccgcgaaccagcccagcaucgcgccccaccggugccucuucucccgcggcaucacggcccuggacgggcugaagcggggccgcggcugcaacggggccgcccaccucgugcggggcgacgccuggaagaccaagcugggggagccgugggugagcaucgcccuggcccucgccggccccggcgcgauccugauccuggagcucuccugguuccugggguga

SEQ ID NO: 27525 - RNA, 729 nt, Artificial Sequence
  derived and/or modified sequence opt1 from C3orf56__Homo_sapiens__NP_001007535
augggcaccggggccagcgagaagcaggccgagcagaaggugcgccgggccuucgaggccuccgaggaggcccacggcacccuggccgccagcacgcccugggucgcgaugggguccgccuacggcagcugcacgugccucggggcccagccggugaccgaccuggcccuguggcccgugaucuacuccugcaugggcuucagcccccaggcguaccccgccuucugggccuacccguggguccucuacggcggguaccuguggaugggcuacccgccgcccgccgcccuggugcccuccguguggcucuacuggcgcggggcgagcuccuucgacccccugaucggcagccccuaccuggccgcccucgcccccaaccuguuccccuuccccaugaaguucccgcccaccuacucccuggccagccccacccucgggggcgcgaccuccagccacugcccccaggucggcugcuggacccccgccuccagcgcgccccgggccgccguggaggggccgucccgcggcgcccccuaccugaagaccugcaaggccccgcccagcgagugggccucccgguucgggaucugggcgccccugcccugcugcagcagcgagcuccgcccccugcccccgucccccaucgaggacagccagcuggaccccggcugcucccggagcuccagccgcuccccgugccgggcccgccggcgccucuucgagugcuga

SEQ ID NO: 27526 - RNA, 666 nt, Artificial Sequence
  derived and/or modified sequence opt1 from C3orf58__Homo_sapiens__NP_001127942
augaaguccgagaacggcaccguggucgggagcuuccccagcgacgagggcuggccguucgccaaguaccugggggccugcggccgcaugguggcggugaacuacgucggggaggagcucugguccuacuucaacgcccccugggagaagcggguggaccuggccuggcagcugauggagaucgccgagcagcucaccaacaacgacuucgaguucgcccuguaccugcucgacgugagcuucgacaacuucgcggucggcccccgcgacggcaaggugaucaucguggacgccgagaacguccugguggccgacaagcggcugauccgccagaacaagcccgagaacugggacgugugguacgaguccaaguucgacgacugcgacaaggaggccugccucagcuucuccaaggagauccugugcgcgcgggccacggucgaccacaacuacuacgccgugugccagaaccugcucagccgccacgccaccuggcgggggaccuccggcgggcugcugcacgacccgcccagcgagaucgccaaggacggccgccucgaggcgcugcuggacgagugcgccaaccccaagaagcgguacgggcgcuuccaggccgccaaggagcuccgggaguaccuggcccagcuguccaacaacgugcgcuga

SEQ ID NO: 27527 - RNA, 1692 nt, Artificial Sequence
  derived and/or modified sequence opt1 from C3orf67__Homo_sapiens__NP_940865
augaucaagcgcaagaucuggugcaaccugugcaucgaccucguggccuucaccagcgagaucuucaagggcgccgucuuccagucccuggacgggaucguggugagcgcgaacugcaagcugcggaagaucuucacccucaaguccaagccccaggacacggccgacaaggacgccgucuacggcgugccguucagcaccgacgagcccaccgacaucaucccccgcuccugccagcugaugaccgacgugccccacgucacgcagcugcucaacaugaccaagcugcggcagaccgagaucaaguucgggggccacccgcugcgcagcgccgaguccgaccaguucaucaaccgggggaccagcaucacgcgcaacuccaagaaccaggacgugugccacaucgccuucggcagcaaggugcucgggcccccgccccuguccggccggcgcaacaacaugaagaucagcuccgagaccguccggagcgugggcuccaagaacaaccgcagcugccagcccuccaccguggagaagugcgucaacgggaccgagaugagcgcgcugcucauccccgaguccgaggagcagggcaacaaggagaacauccaccagaucaagcagacggugcccauccacgccgccaaccugcacaucaugcacccccacccgccccaggagcccagcgccgacaagaacaacaaccggcgccggcugcgccucaagagcaccucccgggagcgcaccgagacccccagcggguccagcuccggcaacaaccggaucgaggacaaggcgagcacgauccugaccaccgugucccagcagggcgccgagcugcucaacagcgggacccugggcccgcagucccccgaccagagcgacgaguggaucuuccccgagaacgccgaccacaucuccuaccuggccagcucccgccagagccuccugcugggggacgacuccugcaaccccagccaccucuggcuggaggccuccaaggagagcgagcacgaccagcaggcggaggagucccagagcgucccgaaggacaucuucacguucagcucccggccccgcagcgcgccccacggcaagacccagaccaugucccccgaggagcugagcuucauccucgaccugaaggaggacaacuccgugaccagccgggacacgcaguccgaggacgacuucuacggcggggacagcuccgaggaggaguacgacuggcgcaacuaccagccgagccagauguccgagagcgagcugcagaugcucgccucccugcgcuggcagcagaacgaggagcuggaggacgccggcaccagccacgggcucuccgccagccagguggacaacugcaacgucuccaucagcaccagcuccgacgacaccacgaccuggaacagcugccugcccccgcccgugaaccagggccggcacuaccagaaggagaugaacccgcccucccccagcaacccccgcgacuggcugaacaugcucuccccgcccaucgugccgcccagccagcagcccgccgagcagcggcccgacuccugcgagagccuguccguccagggggaggaggaccugagcguggaggaggacgaggaggugcucacccugcuguacgaccccugccucaacugcuacuucgacccccagaccggcaaguacuacgagcuggucuga

SEQ ID NO: 27528 - RNA, 303 nt, Artificial Sequence
  derived and/or modified sequence opt1 from C3orf79__Homo_sapiens__NP_001094807
augcacgugugcgaccugcagaagcucguccgcauccagcuggccuucaccaccuuccccuggauguucagcugccaccuccugccgacgcccgagcuguccagcaagcggaaccagugccugcucuacaagaccuccggcugccugacccagaugcccauccuguacgggcaccccgccacccuccugaaggacuacauccugcaggcgauccuccagccgggcaagaagauccagggcgggacggagauccagcgcgggagcuucgccaaccaguaccagaccgacgccucccaccuguga

SEQ ID NO: 27529 - RNA, 5097 nt, Artificial Sequence
  derived and/or modified sequence opt1 from C4A__Homo_sapiens__NP_001239133
augcgccugcugugggggcugaucugggccagcagcuucuucacccugagccugcagaagccccggcugcuccuguucucccccagcguggugcaccugggggugccccuguccgugggcguccagcuccaggacgugccccgcggccagguggucaagggcagcguguuccugcggaaccccucccgcaacaacgugccgugcagccccaaggucgacuucacccuguccagcgagcgggacuucgcccuccugucccuccaggugccccucaaggacgccaagagcugcgggcugcaccagcugcuccgcggccccgaggugcagcuggucgcccacucccccuggcugaaggacagccucucccggacgaccaacauccagggcaucaaccugcuguucagcucccgccgggggcaccucuuccugcagaccgaccagcccaucuacaaccccggccagcgcgugcgguaccgcguguucgcccuggaccagaagaugcggcccagcaccgacacgaucaccgucaugguggagaacucccacgggcuccgcgugcggaagaaggaggucuacaugcccagcagcaucuuccaggacgacuucgugauccccgacaucuccgagcccggcaccuggaagaucagcgcccgcuucuccgacgggcuggagagcaacuccagcacccaguucgaggugaagaaguacguccugcccaacuucgaggugaagaucacgccgggcaagcccuacauccucaccgugcccggccaccuggacgagaugcagcuggacauccaggcccgguacaucuacgggaagcccguccagggcguggcguacguccgcuucgggcuccuggacgaggacggcaagaagaccuucuuccggggccuggagucccagaccaagcucgugaacgggcagagccacaucucccugagcaaggccgaguuccaggacgcccuggagaagcucaacaugggcaucacggaccugcaggggcugcgccucuacguggccgccgccaucaucgaguccccgggcggggagauggaggaggccgagcugaccagcugguacuucgucuccagccccuucucccuggaccucagcaagaccaagcggcaccuggugcccggcgcccccuuccugcuccaggcccuggugcgcgagauguccggcagcccggcguccgggauccccgucaaggugagcgccaccgugagcucccccggcagcguccccgaggugcaggacauccagcagaacacggacggguccggccaggugagcaucccgaucaucaucccccagaccaucuccgagcugcagcugagcgucuccgccgggagcccccacccggccaucgcccgccucaccguggcggcgccgcccuccggcggccccggguuccugagcaucgagcggccggacucccggccgccccgcgugggcgacacccugaaccucaaccugcgcgccgucgggagcggcgccacguucucccacuacuacuacaugauccugagccgggggcagaucguguucaugaaccgcgagcccaagcggacccucaccuccgugagcgucuucguggaccaccaccuggccccguccuucuacuucguggcguucuacuaccacggcgaccaccccgucgccaacagccugcgcguggacgugcaggccggcgccugcgaggggaagcucgagcugagcgucgacggcgccaagcaguaccggaacggggaguccgugaagcugcaccucgagaccgacagccuggcgcugguggcccucggcgcccuggacacggcccuguacgcggccggcuccaagagccacaagccccucaacauggggaaggucuucgaggccaugaacuccuacgaccugggcugcgggcccggcgggggcgacagcgcccuccagguguuccaggccgcgggccucgccuucuccgacggggaccaguggacccugagccgcaagcggcuguccugcccgaaggagaagaccacccgcaagaagcggaacgugaacuuccagaaggccaucaacgagaagcucggccaguacgccagccccacggccaagcgcugcugccaggacggggucacccggcugcccaugaugcgcuccugcgagcagcgggcggcccgcgugcagcagcccgacugccgggagccguuccugagcugcugccaguucgccgagucccuccgcaagaagucccgcgacaagggccaggccgggcugcagcgggcccuggagauccuccaggaggaggaccugaucgacgaggacgacauccccgugcgcuccuucuuccccgagaacuggcuguggcgggucgagaccguggaccgcuuccagauccucacccuguggcugcccgacagccucacgaccugggagauccacggccugucccugagcaagaccaagggccucugcguggcgaccccgguccagcugcggguguuccgcgaguuccaccuccaccuccggcugcccauguccgugcgccgguucgagcagcuggagcuccgccccguccuguacaacuaccuggacaagaaccucacggugagcgugcacgucagccccguggaggggcugugccuggccggcgggggcgggcucgcccagcagguccuggucccggccggcuccgcgcggcccguggccuucagcgugguccccaccgccgccgccgcggugucccugaagguggucgcccgcggcagcuucgaguucccggugggggacgccgucuccaaggugcuccagaucgagaaggagggcgccauccaccgggaggagcugguguacgagcugaacccccucgaccaccgcgggcggacccuggagauccccggcaacagcgaccccaacaugaucccggacggggacuucaacuccuacguccgcgugaccgccagcgacccccuggacacccucggcuccgagggcgcgcugagccccgggggcguggccucccugcuccggcugccccgcgggugcggcgagcagacgaugaucuaccuggccccgacccucgccgccagccgguaccuggacaagaccgagcagugguccacccugccgcccgagacgaaggaccacgcggucgaccucauccagaagggcuacaugcgcauccagcaguuccggaaggccgacgggagcuacgccgccuggcugucccgcgacagcuccaccuggcugaccgcguucgugcucaaggugcugagccuggcccaggagcaggucggcgggucccccgagaagcuccaggagaccagcaacuggcugcugagccagcagcaggccgacggcuccuuccaggacccgugccccgugcucgaccgcagcaugcagggcgggcuggugggcaacgacgagacggucgcccugaccgccuucgugaccaucgcgcuccaccacgggcuggccguguuccaggacgagggcgccgagccccugaagcagcgggucgaggccuccaucagcaaggccaacuccuuccucggggagaaggcgagcgccggccugcugggggcccacgccgccgcgaucaccgccuacgcccucacgcugaccaaggcccccguggaccugcucggcguggcccacaacaaccugauggcgauggcccaggagaccggcgacaaccuguacuggggguccgucaccggcagccaguccaacgccgugagcccgacgcccgcgccccgcaaccccuccgacccgaugccccaggcgcccgcccucuggaucgagaccaccgccuacgcccugcugcaccuccugcugcacgaggggaaggccgagauggcggaccaggccagcgccuggcugacccggcagggcuccuuccagggcggguuccgcagcacgcaggacaccgugaucgcccuggacgcccuguccgcguacuggaucgccagccacaccaccgaggagcggggccugaacgucacgcucuccagcaccgggcgcaacggcuucaagucccacgcccugcagcugaacaaccggcagauccgcgggcucgaggaggagcugcaguucagccugggcagcaagaucaacgugaaggugggcgggaacuccaagggcacccucaagguccugcggaccuacaacgugcuggacaugaagaacacgaccugccaggaccuccagaucgaggugaccgucaaggggcacguggaguacaccauggaggccaacgaggacuacgaggacuacgaguacgacgagcugcccgccaaggacgacccggacgcgccccugcagcccgugacgccccuccagcuguucgagggccgccggaaccgccggcgccgggaggccccgaagcugaccagccucuccgaccgcuacgucagccacuucgagaccgaggggccccacgugcugcuguacuucgacuccgugcccaccagccgggagugcgucggcuucgaggccgugcaggaggugccggucggccucgugcagcccgccuccgcgacgcuguacgacuacuacaaccccgagcgccggugcagcguguucuacggggcccccuccaagagccgccugcucgccacccugugcuccgccgaggucugccagugcgccgagggcaagugcccgcgccagcggcgcgcgcuggagcgggggcuccaggacgaggacggcuaccgcaugaaguucgccugcuacuacccccggguggaguacggguuccaggugaagguccugcgcgaggacagccgggccgccuuccgccuguucgagaccaagaucacccaggugcuccacuucaccaaggacgugaaggccgcggccaaccagaugcggaacuuccugguccgcgccuccugccggcugcgccucgagcccggcaaggaguaccugaucaugggccuggacggggccacguacgaccucgagggccacccccaguaccugcuggacagcaacuccuggaucgaggagaugccgagcgagcggcucugccgcuccacccggcagcgcgccgcgugcgcccagcugaacgacuuccugcaggaguacgggacccagggcugccagguguga

SEQ ID NO: 27530 - RNA, 5235 nt, Artificial Sequence
  derived and/or modified sequence opt1 from C4B_2__Homo_sapiens__NP_001229752
augcgccugcuguggggccugaucugggccagcuccuucuucacccugagccugcagaagccccggcugcuccuguucucccccagcguggugcaccugggggugccccuguccgugggcgugcagcugcaggacgugccccgcggccagguggucaagggcagcguguuccugcggaaccccucccgcaacaacgugccgugcagccccaaggucgacuucacccuguccagcgagcgggacuucgcccugcugucccuccaggugccccucaaggacgcgaaguccugcgggcugcaccagcugcuccgcggccccgaggugcagcuggucgcccacucccccuggcugaaggacagccucucccggacgaccaacauccagggcaucaaccugcuguucagcucccgccgggggcaccucuuccugcagaccgaccagcccaucuacaaccccggccagcgcgugcgguaccgcguguucgcccuggaccagaagaugcggcccagcaccgacacgaucaccgucaugguggagaacucccacgggcuccgcgugcggaagaaggaggucuacaugcccagcagcaucuuccaggacgacuucgugauccccgacaucuccgagcccggcaccuggaagaucagcgcccgcuucuccgacgggcuggagagcaacuccagcacccaguucgaggugaagaaguacguccugcccaacuucgaggugaagaucacgccgggcaagcccuacauccucaccgugcccggccaccuggacgagaugcagcuggacauccaggcccgguacaucuacgggaagcccguccagggcguggcguacguccgcuucgggcuccuggacgaggacggcaagaagaccuucuuccggggccuggagucccagaccaagcucgugaacgggcagagccacaucucccugagcaaggccgaguuccaggacgcccuggagaagcucaacaugggcaucacggaccugcaggggcugcgccucuacguggccgccgccaucaucgaguacccgggcggggagauggaggaggccgagcugaccuccugguacuucgucagcucccccuucagccuggaccucuccaagaccaagcggcaccuggugcccggcgcccccuuccugcuccaggcccuggugcgcgagaugagcggcuccccggcgagcgggauccccgucaagguguccgccaccgugagcagccccggcuccguccccgaggugcaggacauccagcagaacacggacgggagcggccagguguccaucccgaucaucaucccccagaccaucagcgagcugcagcuguccgucagcgccgggagcccccacccggccaucgcccgccucaccguggcggcgccgcccagcggcggccccggguuccuguccaucgagcggccggacagccggccgccccgcgugggcgacacccugaaccucaaccugcgcgccgucggguccggcgccacguucagccacuacuacuacaugauccugucccgggggcagaucguguucaugaaccgcgagcccaagcggacccucaccagcguguccgucuucguggaccaccaccuggccccgagcuucuacuucguggcguucuacuaccacggcgaccaccccgucgccaacucccugcgcguggacgugcaggccggcgccugcgaggggaagcucgagcugagcgucgacggcgccaagcaguaccggaacggggagagcgugaagcugcaccucgagaccgacucccuggcgcugguggcccucggcgcccuggacacggcccuguacgcggccggcagcaagucccacaagccccucaacauggggaaggucuucgaggccaugaacagcuacgaccugggcugcgggcccggcgggggcgacuccgcccuccagguguuccaggccgcgggccucgccuucagcgacggggaccaguggacccugucccgcaagcggcugagcugcccgaaggagaagaccacccgcaagaagcggaacgugaacuuccagaaggccaucaacgagaagcucggccaguacgccucccccacggccaagcgcugcugccaggacggggucacccggcugcccaugaugcgcagcugcgagcagcgggcggcccgcgugcagcagcccgacugccgggagccguuccuguccugcugccaguucgccgagagccuccgcaagaagucccgcgacaagggccaggccgggcugcagcgggcccuggagauccuccaggaggaggaccugaucgacgaggacgacauccccgugcgcagcuucuuccccgagaacuggcuguggcgggucgagaccguggaccgcuuccagauccucacccuguggcugcccgacucccucacgaccugggagauccacggccugagccuguccaagaccaagggccucugcguggcgaccccgguccagcugcggguguuccgcgaguuccaccuccaccuccggcugcccaugagcgugcgccgguucgagcagcuggagcuccgccccguccuguacaacuaccuggacaagaaccucacgguguccgugcacgucagccccguggaggggcugugccuggccggcgggggcgggcucgcccagcagguccuggucccggccggcagcgcgcggcccguggccuucuccgugguccccaccgccgccgccgcggugagccugaagguggucgcccgcggcuccuucgaguucccggugggggacgccgucagcaaggugcuccagaucgagaaggagggcgccauccaccgggaggagcugguguacgagcugaacccccucgaccaccgcgggcggacccuggagauccccggcaacuccgaccccaacaugaucccggacggggacuucaacagcuacguccgcgugaccgccuccgacccccuggacacccucggcagcgagggcgcgcugucccccgggggcguggccagccugcuccggcugccccgcgggugcggcgagcagacgaugaucuaccuggccccgacccucgccgccucccgguaccuggacaagaccgagcaguggagcacccugccgcccgagacgaaggaccacgcggucgaccucauccagaagggcuacaugcgcauccagcaguuccggaaggccgacggguccuacgccgccuggcugagccgcggcuccagcaccuggcugaccgcguucgugcucaaggugcugucccuggcccaggagcaggucgggggcagccccgagaagcuccaggagaccuccaacuggcugcugagccagcagcaggccgacgggagcuuccaggaccucuccccggugauccaccgcagcaugcagggcggccugguggggaacgacgagacggucgcccugaccgccuucgugaccaucgcgcuccaccacggccuggccguguuccaggacgagggggccgagccccugaagcagcgggucgaggccuccaucagcaaggccuccagcuuccucggcgagaaggcguccgccgggcugcugggcgcccacgccgccgcgaucaccgccuacgcccucacgcugaccaaggcccccgccgaccugcgcggcguggcgcacaacaaccucauggccauggcccaggagaccggggacaaccuguacuggggcagcgugaccgggucccagagcaacgccgucucccccacgccggcgccccggaaccccagcgaccccaugccgcaggcccccgcccuguggaucgagaccaccgccuacgcccuccugcaccuccugcuccacgagggcaaggcggagauggccgaccaggccgccgccuggcugacccgccagggguccuuccagggcggcuuccggagcacgcaggacaccgugaucgcgcuggacgcccucuccgccuacuggaucgccagccacaccaccgaggagcgcgggcugaacgugacgcuguccagcaccggccggaacggguucaagucccacgcccuccagcugaacaaccgccagauccggggccuggaggaggagcuccaguucagccugggcagcaagaucaacgucaaggucggcgggaacuccaaggggacccugaaggugcuccgcaccuacaacguccuggacaugaagaacacgaccugccaggaccugcagaucgaggugaccgugaaggggcacgucgaguacaccauggaggcgaacgaggacuacgaggacuacgaguacgacgagcuccccgccaaggacgaccccgacgccccgcugcagcccgugacgccccugcagcuguucgaggggcggcgcaaccggcgccggcgcgaggcccccaagguggucgaggagcaggagagccgggugcacuacaccgugugcaucuggcgcaacggcaaggucggccucuccgggauggcgaucgccgacgugacccugcucagcggcuuccacgcccugcgggccgaccuggagaagcucaccucccugagcgaccgcuacgugucccacuucgagacggaggggccgcacguccugcucuacuucgacagcgugcccaccucccgcgagugcgugggcuucgaggccguccaggaggugcccguggggcugguccagccggcgagcgccacccuguacgacuacuacaaccccgagcggcgcugcuccguguucuacggcgcccccagcaagucccggcuccuggccacccugugcagcgccgaggugugccagugcgcggagggcaagugcccccgccagcggcgcgcccucgagcgggggcugcaggacgaggacggcuaccgcaugaaguucgccugcuacuacccgcgggucgaguacggguuccaggugaaggugcugcgcgaggacucccgggccgccuuccgccucuucgagaccaagaucacgcagguccugcacuucaccaaggacgugaaggcggccgccaaccagaugcggaacuuccuggugcgcgccagcugccggcuccgccuggagcccggcaaggaguaccugaucauggggcucgacggcgcgaccuacgaccuggagggccacccccaguaccugcucgacuccaacagcuggaucgaggagaugcccuccgagcggcugugccgcagcacccggcagcgcgccgccugcgcccagcugaacgacuuccuccaggaguacgggacgcagggcugccaggucuga

SEQ ID NO: 27531 - RNA, 5235 nt, Artificial Sequence
  derived and/or modified sequence opt1 from C4B__Homo_sapiens__NP_001002029
augcgccugcuguggggccugaucugggccagcagcuucuucacccugagccugcagaagccccggcugcuccuguucucccccagcguggugcaccugggggugccccuguccgugggcgugcagcugcaggacgugccccgcggccagguggucaagggcagcguguuccugcggaaccccucccgcaacaacgugccgugcagccccaaggucgacuucacccuguccagcgagcgggacuucgcccugcugucccuccaggugccccucaaggacgccaagagcugcgggcugcaccagcugcuccgcggccccgaggugcagcuggucgcccacucccccuggcugaaggacagccucucccggacgaccaacauccagggcaucaaccugcuguucagcucccgccgggggcaccucuuccugcagaccgaccagcccaucuacaaccccggccagcgcgugcgguaccgcguguucgcccuggaccagaagaugcggcccagcaccgacacgaucaccgucaugguggagaacucccacgggcuccgcgugcggaagaaggaggucuacaugcccagcagcaucuuccaggacgacuucgugauccccgacaucuccgagcccggcaccuggaagaucagcgcccgcuucuccgacgggcuggagagcaacuccagcacccaguucgaggugaagaaguacguccugcccaacuucgaggugaagaucacgccgggcaagcccuacauccucaccgugcccggccaccuggacgagaugcagcuggacauccaggcccgguacaucuacgggaagcccguccagggcguggcguacguccgcuucgggcuccuggacgaggacggcaagaagaccuucuuccggggccuggagucccagaccaagcucgugaacgggcagagccacaucucccugagcaaggccgaguuccaggacgcccuggagaagcucaacaugggcaucacggaccugcaggggcugcgccucuacguggccgccgccaucaucgaguccccgggcggggagauggaggaggccgagcugaccagcugguacuucgucuccagccccuucucccuggaccucagcaagaccaagcggcaccuggugcccggcgcccccuuccugcuccaggcccuggugcgcgagauguccggcagcccggcguccgggauccccgucaaggugagcgccaccgugagcucccccggcagcguccccgaggugcaggacauccagcagaacacggacggguccggccaggugagcaucccgaucaucaucccccagaccaucuccgagcugcagcugagcgucuccgccgggagcccccacccggccaucgcccgccucaccguggcggcgccgcccuccggcggccccggguuccugagcaucgagcggccggacucccggccgccccgcgugggcgacacccugaaccucaaccugcgcgccgucgggagcggcgccacguucucccacuacuacuacaugauccugagccgggggcagaucguguucaugaaccgcgagcccaagcggacccucaccuccgugagcgucuucguggaccaccaccuggccccguccuucuacuucguggcguucuacuaccacggcgaccaccccgucgccaacagccugcgcguggacgugcaggccggcgccugcgaggggaagcucgagcugagcgucgacggcgccaagcaguaccggaacggggaguccgugaagcugcaccucgagaccgacagccuggcgcugguggcccucggcgcccuggacacggcccuguacgcggccggcuccaagagccacaagccccucaacauggggaaggucuucgaggccaugaacuccuacgaccugggcugcgggcccggcgggggcgacagcgcccuccagguguuccaggccgcgggccucgccuucuccgacggggaccaguggacccugagccgcaagcggcuguccugcccgaaggagaagaccacccgcaagaagcggaacgugaacuuccagaaggccaucaacgagaagcucggccaguacgccagccccacggccaagcgcugcugccaggacggggucacccggcugcccaugaugcgcuccugcgagcagcgggcggcccgcgugcagcagcccgacugccgggagccguuccugagcugcugccaguucgccgagucccuccgcaagaagucccgcgacaagggccaggccgggcugcagcgggcccuggagauccuccaggaggaggaccugaucgacgaggacgacauccccgugcgcuccuucuuccccgagaacuggcuguggcgggucgagaccguggaccgcuuccagauccucacccuguggcugcccgacagccucacgaccugggagauccacggccugucccugagcaagaccaagggccucugcguggcgaccccgguccagcugcggguguuccgcgaguuccaccuccaccuccggcugcccauguccgugcgccgguucgagcagcuggagcuccgccccguccuguacaacuaccuggacaagaaccucacggugagcgugcacgucagccccguggaggggcugugccuggccggcgggggcgggcucgcccagcagguccuggucccggccggcuccgcgcggcccguggccuucagcgugguccccaccgccgccaccgccgugucccugaagguggucgcgcgcggcagcuucgaguucccggugggggacgccgucuccaaggugcuccagaucgagaaggagggcgccauccaccgggaggagcugguguacgagcugaacccccucgaccaccgcgggcggacccuggagauccccggcaacagcgaccccaacaugaucccggacggggacuucaacuccuacguccgcgugaccgccagcgacccccuggacacgcucggcuccgagggcgcccugagccccgggggcguggcgucccugcuccggcugccccgcgggugcggcgagcagaccaugaucuaccuggccccgacccucgccgccagccgguaccuggacaagaccgagcagugguccacgcugccgcccgagaccaaggaccacgccgucgaccucauccagaagggcuacaugcgcauccagcaguuccggaaggcggacgggagcuacgccgccuggcugucccgcggcagcuccaccuggcugaccgccuucgugcucaaggugcugagccuggcgcaggagcaggucgggggcucccccgagaagcuccaggagacgagcaacuggcugcugagccagcagcaggccgacggguccuuccaggaccucagcccggugauccaccgcuccaugcagggcggccugguggggaacgacgagaccgucgcccugaccgccuucgugaccaucgcccuccaccacggccuggcgguguuccaggacgagggggccgagccccugaagcagcgggucgaggccagcaucuccaaggccagcuccuuccucggcgagaaggccagcgcggggcugcugggcgcccacgccgccgccaucacggcguacgcccucacccugaccaaggcccccgccgaccugcgcggcguggcccacaacaaccucauggcgauggcccaggagaccggggacaaccuguacuggggcuccgugacggggagccaguccaacgccgucagccccaccccggcgccccggaaccccuccgaccccaugccgcaggcgcccgcccuguggaucgagaccaccgccuacgcccuccugcaccuccugcuccacgagggcaaggccgagauggcggaccaggccgccgccuggcugacgcgccaggggagcuuccagggcggcuuccgguccacccaggacaccgugaucgcccuggacgcgcucagcgccuacuggaucgccucccacaccacggaggagcgcgggcugaacgugacccugagcuccaccggccggaacggguucaagagccacgcccuccagcugaacaaccgccagauccggggccuggaggaggagcuccaguucagccugggcuccaagaucaacgucaaggucggcgggaacagcaaggggacccugaaggugcuccgcacguacaacguccuggacaugaagaacacgaccugccaggaccugcagaucgaggugaccgugaaggggcacgucgaguacaccauggaggccaacgaggacuacgaggacuacgaguacgacgagcuccccgcgaaggacgaccccgacgccccgcugcagcccgugacgccccugcagcuguucgaggggcggcgcaaccggcgccggcgcgaggcccccaagguggucgaggagcaggagucccgggugcacuacaccgugugcaucuggcgcaacggcaaggucggccucagcgggauggccaucgcggacgugacccugcucuccggcuuccacgcccugcgggccgaccuggagaagcucaccagccuguccgaccgcuacgugagccacuucgagaccgaggggccgcacguccugcucuacuucgacuccgugcccaccagccgcgagugcgugggcuucgaggccguccaggaggugcccguggggcugguccagccggccuccgcgacccuguacgacuacuacaaccccgagcggcgcugcagcguguucuacggcgcccccuccaagagccggcuccuggccacccugugcuccgccgaggugugccagugcgccgagggcaagugcccccgccagcggcgcgcgcucgagcgggggcugcaggacgaggacggcuaccgcaugaaguucgccugcuacuacccgcgggucgaguacggguuccaggugaaggugcugcgcgaggacagccgggccgccuuccgccucuucgagacgaagaucacccagguccugcacuucaccaaggacgugaaggccgcggccaaccagaugcggaacuuccuggugcgcgccuccugccggcuccgccuggagcccggcaaggaguaccugaucauggggcucgacggcgccaccuacgaccuggagggccacccccaguaccugcucgacagcaacuccuggaucgaggagaugcccagcgagcggcugugccgcagcacgcggcagcgcgcggccugcgcccagcugaacgacuuccuccaggaguacgggacccagggcugccaggucuga

SEQ ID NO: 27532 - RNA, 1794 nt, Artificial Sequence
  derived and/or modified sequence opt1 from C4BPA__Homo_sapiens__XP_005273308
augcacccgcccaagacccccagcggcgcccugcaccgcaagcggaagauggccgcguggcccuucucccgccucuggaaggugagcgaccccauccuguuccagaugacccugaucgccgcccuccugccggccguccuggggaacugcggcccgccgcccacgcucuccuucgccgcgcccauggacaucacccugaccgagacccgguucaagacggggaccacccugaaguacacgugccuccccggcuacgugcgcagccacuccacgcagacccugaccugcaacagcgacggggaguggguguacaacaccuucugcaucuacaagcggugccgccaccccggcgagcugcggaacggccaggucgagaucaagacggaccucuccuucgggagccagaucgaguucuccugcagcgagggcuucuuccugaucggguccaccaccagccgcugcgaggugcaggaccggggcgugggguggucccacccccugccccagugcgagaucgucaagugcaagcccccgcccgacauccgcaacggccggcacagcggcgaggagaacuucuacgccuacggguucuccgugaccuacagcugcgacccccgcuucucccuccugggccacgccagcaucuccugcaccguggagaacgagaccaucggggucuggcggcccagcccgcccacgugcgagaagaucacgugccgcaagcccgacgugagccacggcgagaugguguccggcuucgggcccaucuacaacuacaaggacaccaucgucuucaagugccagaagggcuucgugcugcgggggagcuccgugauccacugcgacgccgacagcaaguggaaccccagcccgcccgcgugcgagcccaacuccugcaucaaccuccccgacaucccccacgccuccugggagaccuacccgcgccccaccaaggaggacgucuacguggugggcaccguccugcgguaccgcugccaccccggguacaagccgaccaccgacgagcccaccaccgugaucugccagaagaaccugcgguggacgcccuaccagggcugcgaggcccucugcugccccgagccgaagcugaacaacggcgagaucacccagcaccgcaagagccggcccgccaaccacugcguguacuucuacggggacgagaucuccuucagcugccacgagaccucccgcuucagcgccaucugccagggcgacgggaccuggagcccccgcacgcccuccugcggcgacaucugcaacuucccgcccaagaucgcgcacgggcacuacaagcaguccagcuccuacagcuucuucaaggaggagaucaucuacgagugcgacaagggcuacauccuggucggccaggccaagcucuccugcagcuacagccacugguccgcccccgcgccccagugcaaggcccugugccggaagccggagcuggugaacgggcgccucagcguggacaaggaccaguacgucgagcccgagaacgugaccauccagugcgacuccggcuacggggucgugggcccccagagcaucacgugcuccgggaaccggaccugguaccccgaggugccgaagugcgagugggagacccccgagggcugcgagcagguccugaccggcaagcgccugaugcagugccuccccaaccccgaggacgugaagauggcccuggagguguacaagcugagccucgagaucgagcagcuggagcugcagcgggacuccgcccgccagagcacccucgacaaggagcuguga

SEQ ID NO: 27533 - RNA, 759 nt, Artificial Sequence
  derived and/or modified sequence opt1 from C4BPB__Homo_sapiens__NP_001017365
auguucuucuggugcgccugcugccugaugguggccuggcgcgucagcgcguccgacgccgagcacugccccgagcucccgcccguggacaacagcaucuucguggccaaggaggucgagggccagauccuggggaccuacgugugcaucaagggcuaccaccugguggggaagaagacccucuucugcaacgccuccaaggagugggacaacacgaccaccgagugccggcugggccacugccccgaccccguccuggugaacggggaguucagcuccagcggcccggugaacgucuccgacaagaucaccuucaugugcaacgaccacuacauccucaagggcagcaaccgcucccagugccuggaggaccacacgugggccccgcccuuccccaucugcaagagccgggacugcgacccgcccgggaaccccgugcacggcuacuucgaggggaacaacuucacccugggcuccaccaucagcuacuacugcgaggaccgcuacuaccucguggggguccaggagcagcagugcguggacggcgagugguccagcgcgcugcccgugugcaagcugauccaggaggcccccaagcccgagugcgagaaggcccuccuggccuuccaggaguccaagaaccugugcgaggcgauggagaacuucaugcagcagcucaaggagagcggcaugaccauggaggagcugaaguacucccuggagcucaagaaggccgagcugaaggccaagcugcucuga

SEQ ID NO: 27534 - RNA, 753 nt, Artificial Sequence
  derived and/or modified sequence opt1 from C4orf22__Homo_sapiens__NP_001193926
auggaccaggaggagggccugaaggcccucgacaacaucgugacccaguucaacgccuacgaggacuuccuggacagccagaucaccacggucgaccuguacuaccucgaggacgagacccuggcgcgccagcugguggagcucggguaccggggcaccggggagcgcgugaagcgggaggacuucgaggcccgcaaggccgccaucgagaucgcccggcuggcggagcgcgcccagcagaagacccugacguccgccggcaaggaccuccaggacaacuuccugaccgcccuggcgaugcgggaggaggacaaccgcagcgggaagcucucccugaaccagcaggagaccgacgccgcccacauccugaagaagcagcucgccagcgucaucuucauccgggaccgcaacucccacggccaggagaucagcggcuacaucgacuacgcccaccggcugaagaccgaggacuucgagguguacuucacggggaagaagcgccugcucccccggccgaccgacaucuccuucuacaacugggacgcggacaucgccgugagcaacuccagccccaacuaccaggucaucgccgacaaccccgagggccugcuguuccgcuacaagcgggaccgcaagauccucaacguggaccccaaggcccagccgggggacaacuccacccggaucaccauccugacggagcuguacgugcaggccgucaucuucgaccacaucagccgccggaagaccuga

SEQ ID NO: 27535 - RNA, 531 nt, Artificial Sequence
  derived and/or modified sequence opt1 from C4orf26__Homo_sapiens__NP_001193910
auggcccgccggcacugcuucagcuacuggcugcucgugugcuggcuggucgugaccguggccgaggcgcuguccaccuucuaccuccagcagcacaucaaccugcacauggacaagaagcgcuaccugcggcuccuggagauccacaagaucaugcgcacgcugcccaccgcccggagccuccacuccccgcugcaccucccccgcggcguccggagccaggggcccucccccagccagcgccacccgggcgugcccuccaucuucuuccacgaggggcccgagagcauccugggcuuccagaccgaccuguccagccugcagggggugaccacggucuuccacuccagccacuucaucggccacaccgugacccuccugaucggcaucucccccgaggaggacagccgggaggaggcccaccuccgcaaggccgagcgggaggagaagccgaagcacaccgaggccaagaagucccugagcuuccgcaagaagcagcagaaggacuucugcuucaucuuccggaacuga

SEQ ID NO: 27536 - RNA, 1041 nt, Artificial Sequence
  derived and/or modified sequence opt1 from C4orf27__Homo_sapiens__NP_060337
auggugggcgggggcgggaagcgccggcccggcggggagggcccgcagugcgagaagaccaccgacgucaagaaguccaaguucugcgaggccgacgugagcagcgaccugcgcaaggagguggagaaccacuacaagcucucccugcccgaggacuucuaccacuucuggaaguucugcgaggagcuggaccccgagaagcccagcgacucccucagcgccucccugggccugcagcucgucgggccguacgacauccuggcgggcaagcacaagacgaagaagaaguccaccgggcugaacuucaaccuccacuggcgguucuacuacgacccgcccgaguuccagaccaucaucaucggcgacaacaagacccaguaccacaugggguacuuccgcgacagccccgacgaguuccccguguacgugggcaucaacgaggccaagaagaacugcaucaucguccccaacggcgacaacguguucgccgccgugaagcuguuccugacgaagaagcuccgggagaucaccgacaagaagaagaucaaccugcugaagaacaucgacgagaagcucaccgaggccgcgcgcgagcugggguacagccuggagcagcggaccgucaagaugaagcagcgcgacaagaagguggugacgaagaccuuccacggcgccgggcucgucgugcccguggacaagaacgacgucggcuaccgggagcugcccgagaccgacgccgaccugaagcgcaucugcaagaccaucguggaggccgcguccgacgaggagcggcucaaggccuucgccccgauccaggagaugaugacguucgugcaguucgccaacgacgagugcgacuacggcauggggcuggagcugggcauggaccucuucugcuacgggagccacuacuuccacaaggucgccggccagcugcugccccucgcguacaaccugcugaagcgcaaccucuucgccgagaucaucgaggagcaccuggccaaccggucccaggagaacaucgaccagcuggccgccuga

SEQ ID NO: 27537 - RNA, 399 nt, Artificial Sequence
  derived and/or modified sequence opt1 from C4orf32__Homo_sapiens__NP_689613
augugcagcgccggcgagcugcuccgcgggggcgacgggggcgagcgggacgaggacggggacgcccuggcggagcgcgaggccgccggcaccgagugggaccccggcgccuccccgcggcgccgggggcagcgccccaaggagagcgagcaggacguggaggacucccagaaccacaccggcgagcccgucggggacgacuacaagaagaugggcacgcuguucggggagcucaacaagaaccugaucaacaugggcuucacccggauguacuucggcgagcgcaucguggagcccgugaucgucaucuucuucugggugaugcugugguuccucgggcugcaggcccugggccucguggcgguccugugccuggugaucaucuacgugcagcaguga

SEQ ID NO: 27538 - RNA, 600 nt, Artificial Sequence
  derived and/or modified sequence opt1 from C4orf33__Homo_sapiens__NP_001093253
auggacuucaagaucgagcacaccugggacggcuuccccgugaagcacgagccggucuucauccgccugaaccccggggaccggggcgugaugauggacaucagcgcccccuucuuccgcgacccgcccgcgccccucggggagcccggcaagcccuucaacgagcugugggacuacgagguggucgaggccuucuuccugaacgacaucaccgagcaguaccucgagguggagcugugcccgcacgggcagcaccuggugcuccugcuguccggccggcgcaacgucuggaagcaggagcucccccugagcuuccggaugucccgcggcgagacgaagugggaggggaaggccuaccugcccuggagcuacuucccgcccaacgugaccaaguucaacuccuucgccauccacggcagcaaggacaagcgguccuacgaggcccucuaccccgugccccagcacgagcugcagcaggggcagaagcccgacuuccacugccuggaguacuucaagagcuucaacuucaacacccuccugggcgaggaguggaagcagccggaguccgaccuguggcucaucgagaagugcgacaucuga

SEQ ID NO: 27539 - RNA, 354 nt, Artificial Sequence
  derived and/or modified sequence opt1 from C4orf36__Homo_sapiens__XP_011529917
auggccuacggcgugccccgcaagaacaccgucaagaccauccugcgggggagcugcuacaacgugcaggagccgugggacaucgcccuccuggcgaagacgugguccaccaaccuggccaacaucaagcuccccuuccuggaggagaucagcuucggcggguccgugcagcugaccaagugcaccacgaucaaggacggccuccugcccagcgccgaguccaucaagcuggagcgcgaguacgaggucaagcggcucugcaagcugaagugccaggagaacaccagcaaggagauccagcugcuccugcgcgagcggcccgccgggcugcgccggccgcuccccuccaaguga

SEQ ID NO: 27540 - RNA, 288 nt, Artificial Sequence
  derived and/or modified sequence opt1 from C4orf48__Homo_sapiens__NP_001135408
auggcgcccccgcccgccugccgcagccccauguccccgcccccgccccugcuccugcugcuccugcugagccucgcccugcugggcgcccgggcccgcgccgagcccgccggguccgcggugcccgcccagagccggcccugcgucgacugccacgccuucgaguucaugcagcgcgcccuccaggaccugcggaagaccgcgugcucccuggacgcccgcaccgagacgcuccugcugcaggccgagcggcgcgcccucugcgccugcuggcccgcgggccacuga

SEQ ID NO: 27541 - RNA, 609 nt, Artificial Sequence
  derived and/or modified sequence opt1 from C4orf51__Homo_sapiens__XP_011530499
augagccacuacuucuaccugacgccccagauccugcugccguucagcccccugaccagccaggaguucgaccucauccgccggaaggccggcgccuccuggcaggacgagacccgcuggagcgacuccagcgugaccaccuacaccggguccuaccggaagaagcagcuggacaagagcaugugcucccaguucagcuuccgcgcgggccagcacgagcccgagugcaagcagaugucccugacgaacagcuccgccugccaccuccugugcugggccgggacccaggagaccaccgacaucaagggccuguuccccgacaucacgcggccguucaagaaguccuucgacgucaagcacgggguggcccaccagaucugggacuucggcgacugcuuccccaccccgcccaacuacggcaaguacugcgugcgccccaagaagcccgcccaggaggcgcucaucaacuacucccggcgcgggaagggcguccugaagcaccuccacgggcggugcgacagcgaguccaaggugugcagcuccgaggacagcgaggccgaccgcuacagcgacuacggcuggggcgggcccuccagccccuucaacuga

SEQ ID NO: 27542 - RNA, 1053 nt, Artificial Sequence
  derived and/or modified sequence opt1 from C5AR1__Homo_sapiens__NP_001727
augaacagcuucaacuacaccacccccgacuacggccacuacgacgacaaggacacgcuggaccucaacaccccgguggacaagaccuccaacacccugcgcguccccgacauccuggcccucgugaucuucgccguggucuuccuggugggggugcugggcaacgcgcucgucgugugggugacggccuucgaggccaagcggaccaucaacgccaucugguuccugaaccuggccgucgcggacuuccucagcugccuggcccugcccauccucuucaccuccaucgugcagcaccaccacuggcccuucgggggcgccgccugcagcauccugccgucccugauccuccugaacauguacgcgagcauccugcuccuggccaccaucuccgccgaccgcuuccugcucguguucaagcccaucuggugccagaacuuccgcggggccggccuggccuggaucgcgugcgccgucgccuggggccuggcccuccugcugacgauccccagcuuccucuaccggguggugcgggaggaguacuucccgcccaagguccugugcgggguggacuacucccacgacaagcgccgggagcgcgccguggcgaucguccggcuggugcucggcuuccuguggccccugcucacccugaccaucugcuacaccuucauccugcuccgcacguggagccggcgcgccacccgguccaccaagacccugaagguggucguggccguggucgccagcuucuucaucuucuggcugcccuaccaggugacggggaucaugauguccuuccucgagcccagcuccccgaccuuccugcugcucaacaagcuggacagccugugcgucuccuucgccuacaucaacugcugcaucaaccccaucaucuacgugguggcgggccagggguuccagggccgccuccgcaagagccugcccucccugcuccggaacguccugaccgaggagagcguggugcgggagagcaaguccuucacccgcagcacggucgacaccauggcccagaagacccaggccguguga

SEQ ID NO: 27543 - RNA, 1014 nt, Artificial Sequence
  derived and/or modified sequence opt1 from C5AR2__Homo_sapiens__NP_001258679
augggcaacgacagcguguccuacgaguacggggacuacagcgaccuguccgaccgccccgucgacugccucgacggcgccugccuggccaucgacccgcugcggguggcgccccucccccuguacgccgccaucuuccugguggggguccccggcaacgccaugguggccuggguggcggggaaggucgcccgccggcgcgugggcgccaccuggcuccugcaccuggccguggcggaccuccugugcugccugagccucccgauccuggccguccccaucgcccggggcgggcacuggcccuacggcgccguggggugccgcgcccugcccuccaucauccuccugaccauguacgcgagcgugcugcuccuggccgcccuguccgccgaccucugcuuccuggcccugggcccggcgugguggagcacgguccagcgggccugcgggguccagguggccugcggcgccgccuggacccucgcgcugcugcucaccgugcccuccgccaucuaccgccggcugcaccaggagcacuuccccgcccgccugcagugcgugguggacuacggcgggagcuccagcaccgagaacgccgucacggccauccgguuccucuucggcuuccuggggccccugguggcgguggccuccugccacagcgcccuccugugcugggccgcgcgccggugccgcccgcugggcaccgccaucgucgugggcuucuucgugugcugggcccccuaccaccuccuggggcugguccucaccguggccgcccccaacuccgcgcugcuggcccgggcccuccgcgccgagccccugaucgucggccuggcccucgcgcacagcugccugaacccgaugcuguuccucuacuucgggcgggcccagcugcgccggucccugcccgccgccugccacugggcccugcgcgagagccagggccaggacgaguccguggacagcaagaaguccaccagccacgaccucgugagcgagauggaggucuga

SEQ ID NO: 27544 - RNA, 5031 nt, Artificial Sequence
  derived and/or modified sequence opt1 from C5__Homo_sapiens__NP_001726
augggccugcucgggauccugugcuuccugaucuuccucggcaagaccugggggcaggagcagaccuacgugaucagcgcccccaagaucuuccgcgucggcgccuccgagaacaucgugauccagguguacggguacacggaggcguucgacgccaccaucagcaucaaguccuacccggacaagaaguucagcuacuccagcggccacguccaccuguccagcgagaacaaguuccagaacuccgccauccugaccauccagcccaagcagcuccccggcgggcagaaccccgugagcuacguguaccuggaggucguguccaagcacuucagcaaguccaagcggaugccgaucaccuacgacaacggcuuccuguucauccacacggacaagcccguguacacccccgaccagagcgucaaggugcgcguguacucccucaacgacgaccugaagcccgccaagcgggagaccguccugaccuucaucgacccggaggggagcgagguggacaugguggaggagaucgaccacaucggcaucaucuccuuccccgacuucaagauccccagcaacccccgcuacgggauguggacgaucaaggccaaguacaaggaggacuucuccaccaccggcaccgcguacuucgaggucaaggaguacgugcucccgcacuucagcgugagcaucgagcccgaguacaacuucaucggcuacaagaacuucaagaacuucgagaucacgaucaaggcccgguacuucuacaacaaggucgugaccgaggccgacguguacaucaccuucgggauccgcgaggaccugaaggacgaccagaaggagaugaugcagaccgccaugcagaacacgaugcugaucaacggcaucgcgcaggucaccuucgacuccgagaccgccgugaaggagcucagcuacuacucccuggaggaccugaacaacaaguaccucuacaucgccgugaccgucaucgagagcacggggggcuucuccgaggaggccgagauccccggcaucaaguacgugcugagccccuacaagcugaaccucgucgccaccccgcuguuccugaagcccgggauccccuaccccaucaaggugcaggugaaggacucccucgaccagcuggucggcggggugccggugacccugaacgcgcagaccaucgacgucaaccaggagacgagcgaccucgaccccuccaagagcgugacccggguggacgacggcgucgccuccuucgugcugaaccugcccagcggggugaccguccucgaguucaacgugaagaccgacgcccccgaccugccggaggagaaccaggcccgcgagggcuaccgggccaucgcguacuccagccugucccagagcuaccucuacaucgacuggacggacaaccacaaggcccugcuggugggcgagcaccucaacaucaucgucacccccaagucccccuacaucgacaagaucacccacuacaacuaccugauccugagcaaggggaagaucauccacuucggcacccgcgagaaguucuccgacgccagcuaccagagcaucaacauccccgugacgcagaacauggugccguccagccggcuccuggucuacuacaucgugaccggggagcagaccgccgagcugguguccgacagcgucuggcucaacaucgaggagaagugcggcaaccagcugcaggugcaccugucccccgacgccgacgcguacagccccgggcagaccgugucccucaacauggccacgggcauggacagcugggucgcccuggccgccguggacuccgcgguguacggcguccagcgcggggccaagaagccgcuggagcggguguuccaguuccucgagaagagcgaccugggcugcggggccggcgggggccugaacaacgccaacguguuccaccuggcgggccucaccuuccugaccaacgccaacgccgacgacucccaggagaacgacgagcccugcaaggagauccugcgcccccggcgcacccuccagaagaagaucgaggagaucgccgccaaguacaagcacagcgucgugaagaagugcugcuacgacggggcgugcgugaacaacgacgagaccugcgagcagcgggccgcccgcaucucccugggcccccggugcaucaaggccuucacggagugcugcgucguggccagccagcugcgcgcgaacaucucccacaaggacaugcagcucgggcggcugcacaugaagacccugcucccggugagcaagcccgagauccgcuccuacuuccccgagagcuggcugugggagguccaccuggugccccgccggaagcagcuccaguucgcccugccggacagccugaccaccugggagauccagggcgugggcaucuccaacacggggaucugcgucgccgacaccgugaaggccaagguguucaaggacgucuuccucgagaugaacauccccuacagcguggugcgcggcgagcagauccagcugaaggggaccgucuacaacuaccggaccuccggcaugcaguucugcgugaagaugagcgccguggaggggaucugcacguccgagagccccgucaucgaccaccagggcaccaaguccagcaagugcgugcgccagaagguggagggcuccagcucccaccuggucaccuucaccgugcucccccuggagaucgggcugcacaacaucaacuucagccucgagacgugguucggcaaggagauccuggucaagacccugcggguggugccggagggggucaagcgcgaguccuacagcggcgugacccucgacccccgggggaucuacggcaccaucucccgccggaaggaguuccccuaccgcaucccccuggaccuggugccgaagacggagaucaagcggauccucagcgucaagggccugcuggugggggagauccucuccgcggugcugagccaggagggcaucaacauccugacccaccuccccaagggguccgccgaggccgagcugaugagcgucgugcccguguucuacgucuuccacuaccuggagaccggcaaccacuggaacaucuuccacagcgacccccucaucgagaagcagaagcugaagaagaagcugaaggaggggaugcucuccaucaugagcuaccgcaacgccgacuacuccuacagcguguggaagggcggcuccgcgagcaccuggcugacggccuucgcccugcgggugcucgggcaggucaacaaguacguggagcagaaccagaacuccaucugcaacagccugcuguggcucguggagaacuaccagcuggacaacggcuccuucaaggagaacagccaguaccagccgaucaagcugcaggggacccuccccgucgaggcccgcgagaacucccuguaccugaccgccuucaccgugaucggcauccggaaggcguucgacaucugcccccucgugaagaucgacacggcccugaucaaggccgacaacuuccugcucgagaacacccugcccgcccagagcaccuucacccuggccaucuccgcguacgcccucagccugggggacaagacgcacccgcaguuccgcuccaucgucagcgcccugaagcgggaggcccucgugaagggcaacccccccaucuaccgcuucuggaaggacaaccugcagcacaaggacuccagcgugccgaacaccggcaccgcccggauggucgagaccacggcguacgcccugcucaccucccugaaccugaaggacaucaacuacgugaaccccgugaucaaguggcucagcgaggagcagcgcuacgggggcggguucuacagcacccaggacaccaucaacgccaucgagggccugacggaguacucccugcucgucaagcagcugcgccugagcauggacaucgacguguccuacaagcacaagggcgcccuccacaacuacaagaugaccgacaagaacuuccuggggcggcccguggagguccugcucaacgacgaccugaucgugagcaccggcuucggguccggccuggcgaccgugcacgucaccacgguggugcacaagaccagcaccuccgaggaggucugcagcuucuaccucaagaucgacacccaggacaucgaggccucccacuaccgcggguacggcaacagcgacuacaagcggaucguggccugcgccuccuacaagcccagccgcgaggaguccagcuccggcagcucccacgccgugauggacaucagccugccgacggggaucuccgcgaacgaggaggaccugaaggcccucgucgagggcguggaccagcuguucaccgacuaccagaucaaggacgggcacgugauccugcagcucaacagcauccccagcuccgacuuccugugcguccgguuccgcaucuucgagcuguucgaggugggcuuccucagccccgccaccuucaccguguacgaguaccaccggcccgacaagcagugcacgauguucuacuccaccagcaacaucaagauccagaaggucugcgagggggccgccugcaagugcguggaggcggacugcggccagaugcaggaggagcuggaccugaccaucuccgccgagacccgcaagcagacggccugcaagccggagaucgccuacgccuacaaggugagcaucaccuccaucaccgucgagaacguguucgugaaguacaaggcgacccuccuggacaucuacaagacgggcgaggccgucgccgagaaggacagcgagaucaccuucaucaagaaggugaccugcaccaacgccgagcuggucaaggggcggcaguaccucaucaugggcaaggaggcccugcagaucaaguacaacuucuccuuccgcuacaucuacccccuggacagccugacguggaucgaguacuggccccgggacaccaccugcuccagcugccaggcguuccucgccaaccuggacgaguucgccgaggacaucuuccugaacgggugcuga

SEQ ID NO: 27545 - RNA, 1329 nt, Artificial Sequence
  derived and/or modified sequence opt1 from C5orf22__Homo_sapiens__NP_060826
augagcgacuccgccggcgggcgcgccggccugcggcgcuaccccaagcuccccgugugggucguggaggaccaccaggaggugcugcccuucaucuaccgggcgaucgggagcaagcaccuccccgccuccaacgucagcuuccugcacuucgacucccaccccgaccugcugaucccggugaacaugcccgccgacaccguguucgacaaggagacccucuucggcgagcugagcaucgagaacuggaucaugcccgccgucuacgccgggcacuucucccacgugaucugguuccaccccacgugggcgcagcagauccgcgagggccggcaccacuuccuggugggcaaggacaccagcaccaccacgauccgcgucaccuccaccgaccacuacuuccucagcgacgggcuguacgugccggaggaccagcuggagaaccagaagccccuccagcuggacgugaucauggucaagcccuacaagcugugcaacaaccaggaggagaacgacgccguguccagcgccaagaagcccaagcucgcccuggaggacuccgagaacaccgcgagcacgaacugcgacuccagcuccgagggccuggagaaggacaccgccacccagcggagcgaccagaccugccucgagccguccugcagcugcagcuccgagaaccaggagugccagacggccgccagcaccggggagauccuggagauccugaagaagggcaaggccuucgugcucgacaucgaccuggacuucuucuccgucaagaaccccuucaaggagauguucacccaggaggaguacaagauccugcaggagcucuaccaguucaagaagcccgggaccaaccugacggaggaggaccugguggacaucguggacacccgcauccaccagcucgaggaccuggaggcgaccuucgccgaccugugcgacggcgacgacgaggagaccguccagcggugggccagcaaccccggcauggagucccucgugccgcuggugcagagccugaagaagcgcauggagguccccgacuacgagauggugcaccaggccgggcucacgugcgacuacuccgagcugccccaccacaucagcaccgagcaggagaucgagugccugauccaguccgugcacuaccuccugaagaaccugcccaacccgacccucgucaccaucgcccggagcucccuggacgacuacugccccagcgaccagguggacacgauccaggagaagguccugaacaugcuccgcgcgcuguacggcaaccuggaccuccagguguacgccgccgaguccccgcccagcuga

SEQ ID NO: 27546 - RNA, 621 nt, Artificial Sequence
  derived and/or modified sequence opt1 from C5orf30__Homo_sapiens__NP_149988
auggagguggacaucaacggcgagagccgcuccacccugaccacgcuccccuucccgggggccgaggccaacagccccggcaaggcggaggccgagaagccccggugcuccagcacccccugcuccccgaugcgccggaccgucagcggguaccagauccugcacauggacuccaacuaccuggugggcuucaccacgggggaggagcuccugaagcuggcccagaagugcaccggcggcgaggagagcaaggccgaggccaugcccucccuccgcagcaagcagcuggacgcggggcuggcccgguccagccgccucuacaagacccggucccgcuacuaccagcccuacgagauccccgccgugaacggccggcgccggcgccggaugccgagcuccggggacaagugcaccaagagccugcccuacgagcccuacaaggcccugcacggcccccucccgcugugccugcucaaggggaagcgcgcgcacuccaagagccuggacuaccugaaccucgacaagaugaucaaggagcccgccgacacggagguccugcaguaccagcugcagcaccucacccugcggggcgaccgcguguucgcccggaacaacaccuga

SEQ ID NO: 27547 - RNA, 1917 nt, Artificial Sequence
  derived and/or modified sequence opt1 from C5orf34__Homo_sapiens__NP_940968
auggccgccgagcugcgcaugauccucuacgaggacgacagcgugcagguccaguacguggacggcuccacccugcagcugagccccugcggguccgaguuccucuucgagaaguccccgcccgugagcgcgcacccccuggagcagcccgagcggauccgccagcggacccacuucgucaucagcacguaccgcgagcagcugcagcgggcccucgacuuccgcaacuccagcgcgaccugcccguuccuguccgagaccaucauccccagcgagcggaagaagcacaucuucaucgacaucaccgaggugcgcuggcccucccuggacacggacggcaccaugaucuacauggagagcgggaucgugaagaucaccucccucgacggccacgccuaccugugccugccccggagccagcacgaguucaccguccacuuccucugcaaggugucccagaaguccgacagcagcgccgugcuguccgagacgaacaacaaggccccgaaggacaagcuggucgagaagaccgggaagaucugcauccgcggcaaccuccccggccagcggcugaagaacaaggagaacgaguuccacugccagaucaugaaguccaaggagacccugaagaagaugagcugcgugaacgggaccgagggccgcgaggagcuccccagccccgggacgaagcacacgugcguguacaccugggucaagcagugcuggagcguggccgccugcccggaggaguggaaguacccccugucccuggcccuccacuuccacaacaagaucagcaacauguccaagaucgacgcgcacaucacccagagccgguuccugaccuccgacaucagcgaggagcgcggcaagguggucuccgugcugccccgggcccucagccuguccugccccgugccgcaccuccaccgcuggaacuucugcgacagccugcugcagcggcaguccgacgaguacagcuaccccgagcuggucaagauggugugguacaagggggugaccuaccgccucacccaccagaacaugaacuccaucgagaucuacagcggcgacggcuccgucuucaagagcgagggggccuacuucggcaacuacuucaccuacuacuccauccaggaggggagcggcaagcgggaggagaagacguacagcgugaacaaccugccgcccgaccgccccggcucccccuucaccguggggagccugaucaagcaggccacccggauccuccagcacugcgucaagaugcgccugucccugagccacaacuaccgcaucugcugcuggaagauggugcccggcaucaacgacuccaacauccucccccugguccugaaggagagccucaucccguccguggggcgguuccuggccuacagcgacgacaaggugcacgcgaucuuccuggacggcaucacccucacgcugaacuggaacuucuccagccccaucgagaagcgccaggucaaccaggggcugaaccucggcuggugcaagcugaccuuccccgacggccaggagcagcugauccagaucgagcaccccgagccguacgagcgguacgugaccaccgugacguccuggugccgccggcucacccagaccagcccccgcgagaugcccacccacuccagcuccagcguccugcaggagaacugguccguggccagcgagcuggagaagauccagaaguucaaccugcuccuggagaacagcgggauccugaaccagaucuccaacaagaagaacgagcagcagagcuucgaccacuacaagccgggcuccagcgagacgcuccugggggaggugaacgagaaccgggucuccaucgcccugaagaagaccagcgagauccuccacgacaucgacugccugcuguccaacagcaagaaguga

SEQ ID NO: 27548 - RNA, 213 nt, Artificial Sequence
  derived and/or modified sequence opt1 from C5orf38__Homo_sapiens__NP_001281266
augguggcccccgccgcgcgcgucuuccugcgggccgugcgcgccgcccucaccagcaccgugccggaccugcugugccuccuggcccggggcagcccccgcgggcuggcguccggccggcucccccuggccguccacuccgcccagcacgggcccggcagcggggccccguggcugcgcaucgcgcggcgcgcccucucccagcggaucuga

SEQ ID NO: 27549 - RNA, 9594 nt, Artificial Sequence
  derived and/or modified sequence opt1 from C5orf42__Homo_sapiens__NP_075561
auggagauccggcuggagauccucaccagcaccggcaucaagcagaagaagcccuggccccgggugagcuggcuggggaaggagaaggaggccguguuccugcucgacgacaaguucaucaacgagaucaaccugcugagcggcaagaucaagaagaagauccccagccuccagcccuuccugaaggacgugaucgugcugaccaccagcagcaacgacgccuggcucgccggggugcugaccaccggcgagcuguuccucuggaacaaggaccaggacugccugaagacgauccccaucaccgagaagccgaaggagaugaucaaggccaccguggccagcagccugcgccucuaccuguacgugagcgggaacggcaagcggaucgugcugaucacccccuccggcugcaucuuccucugggaguaccuggagcugaagaacauccucagcuccaagagccugucccuggccgggcgcuggagccaggugauccccgaggaggccgugcuccugcccuccacggaggacaaggaggccgucgugaacgccguguucaucaagaacgagcuguucggcgacugcugccucugcagcuucaccuucuacuccggggagugccugaagcugaccuuccucgccauccgguggcacgagaacgucuucaccagcgugcgcucccugccguaccacgugcacugggcccagcaggacugccaccugugcagccucauccccaagugcgagagcgucaagucccggggcgcccugaucagcgccuucucccgcgacgggcugacgcucgccgugacccugaaccagaaggaccccaaggccacccaggugcuguucaucaacacccucaacuucgucacgcugugcggcagccugaagggcugcuccaacaagagccccguggugccggccacccucauccgguccuacugggucggggacaucagcuggacccacgacucccuguuccuggcgugcaugcucaagcgcggcagccuggugcugcugaccugccagggggagcugcugacgcugaucaccuucggcugcuccaucgaguucggccccgccgaguucaucccccuccacccccugaucaccuaccggccgcagcaguucaccuuccaggacagcaacaacuccguggacagcuccgccagcgacuccgaccccaugcgccagcgguucagcaucaaggcccacucccgccugcccuaccucgucaucagcgacggguacauggugacgacccugcgguuccuggacagccucucccccagcguccacaugcgcucccugcugcucgacagcacccagcggcuggagaagaucuaccaguccgugauccugagcaagccgaagggcaaggggcucaaccugcgcucccugaacagccuccgguccagccugcuggagcaccagggcaacgaguccagcgccgacuucaccgugcccaaguuccuccaggcggaggagacgaucaacgagaacgccgccgacuuccaggacuucgaggccgaggagaccaacgaggggcgccacuuccccgacaaccugugccccuucuggaacaagcgggacgacguccugugcuccagcaugaaggagggccgccucgaguucgccuccauguucgacaccauccacgcgaaggacgacagcgaggagaccgaccgcacgaucaccgagcugcacuccauccagaagucccugcucgccgccuggaccaucggcaucagcaagaccgugacggagaagaaccugaugcugaacuacaucguggucugcaucacccacuucuucuacauccuccaguucaucaagugcccguuccccaagcuggaccuggugcucuccaagagcucccggcacaacgccuggauccugugcaucuuccagcuguuccaccagugccucagcauccacuacugggacauccgcuacaagcaggacguggggcaccugaucaagcugaccuccaacaccgucaagcuccugcugacccagcagcagaagggccagcuguucagcgagaagcugcuggccugcuucuaccuccugaagaugguggcggacaaccugaacgggguguacauccuccagcccgaggucaucuccgccagcgccgacggcuccaagaucacggcccaggacagccugguggugcccaucuuccagauguuccaggacuccggguuccagaagaacuggagcuggaacuccuucuucaagauccacccgcaggucgugaaccccgugcagcagcccggccaccggcugcucauccuguggcgcauccuguacaagaagacccucugguaccaggcgcagcugaaccggcgcgucccggaggccgacagccagcugaccgagaagaugacccacgaggccuccacggucaagagccuccugugccaccuccaggccaaccuccaguccaccggcgacugccugaaccagacccuggagcucaagagcaucaacggggaggagugcuuccugcugggcuccuacgagaaguccgugcagcucuggaagaaggcccugcaggagaucgaggagaagggcgggcggcgcaccuacuuccugcagauccgguacuaccucagccugcuguacugccaccucuacuccuacaaccugaacgacgcgcaggggcugugcgaccagcucgcccgcgagauccugcgguggagccagcugcccgucaaggagaacaaggacuucuccggcgccgccaagagccacuucgagugcggcauggucggcggggugcaccccgaggccgcgguccgcguggugcaguccauggcccgguucauggccgccuacuucacgaaccagcagcucugcauccugcccccgcaccacgucaacgugcugccgccccugcacaucaagaccgagcagagcuuccgccugaucccccugcagcacuccaagguggccagcgucgugcgggaccagaaccucuccaacguguggaccgucgaguacgcgcuggagcuccucuucaucgggggccuggugccggaggccguguggcuggccuacaagcucggcgacuggaagaccagcgucuccaucgggguggccuuccagcuguucugcaagcgcgacagcaacuucaugcgguccaagaagaagucccugaaccucccccugcgcaugacgcccgcgcagaucuuccaggagaagcugcagugcgugcucgggcagcccgccucccuggaggccaagaacgagauggggagcaaguacaagcaguucaccgacccgaucgaggaggaggacgccaaccugcuguucggcuccguccaggaggugcucaaggccagcgugauggcggacgccgacauccuguccgagaccuuccagcugcucaucgacagcgccaaggacuucagcaagcggcugugggggcugguccccuucggccucuaccugcccgcgccgccccuguacugcccccagcccgccauccucuccgaggaggacggcgacgaccugcugcucaaggcggagaagaacaaccgccagaaggugagcgggauccugcagcgcgugcugcuccuguuccgggccgcccagugcuccuuccccgucgcccagugguacauccugcagcuccgcugggcccggaaggugaugcagaagauccgcaugaagggcagccugcccucccugagccccuucccccagucccuccugaacuacugcaagggcggcaucgcguucuuccggcccggggccgccggcgaccacaagcuggacgaggugagcauccgcgccaucggcugcuuccgggagcucugcgcgcugugcuggaugcugcacguccgcgacaagcucuccuacagcugccggcaguaccagaaggcccgcgagaacgugaagggggagaaggaccuggagguggaguucgacuccugcaugaucgagcacugccugagcgccgucgagugggccuaccggaugcucccguucucccgcuucuucaacauggaggagcugauccaggacaucauccugagccucaucggcgagcugccgcccauccggaagguggccgagaucuucgucaaggcguucccguaccccgaggacgugcgcgugccccugcgggacaaguaccacucccuccaccagcgccugcggcacugcgucgugaaggggccccagaccgaggagaugaugagcguggucaugcacuccauccagaaggugcgcgugaaggcccugaagcggguccagcgcaacaucggcagcuucgaggugaacaucugggagccgaucgaggaggagaagcccgacgaggcccccgggguggaccgguacucccucggcacgagccugagccgcuccacccugaccgagcucggcgacagcgucgugcacuccgacgccgacaccuucagcgaggcccuguccguggaggagaagucccgcaucaacaucuaccagcggaacgcgcccaaccacauggagcugacguccauccacaagccgaccgacaagcgcaagaugugcaaccagaaggagaaccccaccaagaaggaggaccacgagaagcucagccagaacacccugcccgucaucggggugugggaguucgagcgggacgacgacgaguacaucaaguuccuggaccucuuccuguccuacauccuggagcgcgaccuccccuacagccgggacgccgacaucccguuccugacguccuucagcggcaagcugcgcgagcacgagcucaacucccugcuguucgacgugcacaccacccucaagcggcaccagagcaagaccaagucccagaacgucuuccgcgccgggagcugcuucgugguggcccccgaguccuacgagagcgagaaguccagcagccugaacgacgaguacggcaugcaccuggagaaccagaagcucuccagcuccguccuggugaaccaggggaucaagcccuuccugcaguaccccagcaacgaggugaacaagaacgagggcauguccggccucuucgggcugaagcagcggagcaucuacaagauccaggacgacacgcgcgagaagugccugauccagcgguccagcaaccacaucuucuggaccccgaaguccaucaagacccgccggugcaucuucaaggccauccagugcaacgacaucaacccccaggaggaccucccccuggcgcugaacaccuucggcagcaucgggcgccuccuggaguggaugauccggugguccaaccgccggcugcucugcgacagcggcaucacggaguccagcuccgaguacagccccgucauccgcgugaagaccuccaccgccgccauccugaccagccuguggcuccuggagcagccguacuucgccacguacaaggccaagaacgcgaucaucaagaugguggagaaccgggacaccggcugccagaucgggcccaacaucgagcgcgaguccaagagcgacgccggcgggagcgucgccguggccacccccggcgggaccgaggagcgcaacggccagaacaaguccugccagaacauccugaaccggaugcccaccgaggcgaagaacccggacaucaaggagaucaacgacgacaucaucagcaucacgcacaacaccaagaaggaguucaucgacaucgacgagaaccuccuggagguggaggccuucaccgaggaggagauggacaugcacaucuccgacuacgaggaggacaucgaggagagcgucggcggguuccgcucccccagccuggccaucugcaugaugacccucccccagcagcuggaggaggaguucacggaggaggugcagugccagcgggaggagccccuggagaccaucauggaggagaaguccaccgagcagaagggcaugaucgaggccuucagccacccggggcacaccacgccccaguccaugcaggucgacaccagcuccgagaucagcuccgcccagaucagcaccuacaaggagaaguccagcuccgucccccuccugaucagcaacggcgugaacguggcgagccagccgcccgcccccacgccccagaagacgcagcgcaacgaguucaccgcccagcugccggacugcuccgagagcguccggcagaugcuccaggacgagauguucaagcuggugcagcugcagcagaucaacuucaugucccucaugcagaucguggggagcuccuucgccaaccugcccgacacccagcagcugguccagcagagccaguccgugcaccucggcgagagccaggaguccaaccugcgcggcugcggggacguggaggacagcaacaagaaccugaaggagcgguucuucaucaagccccaguccaugggcgagaacgcccgcgagccccggaagaacagcccgcacugccacgaggggaccauccccuccggccagaacagcacggggaacguccagaacgugccccacggcuccaucccccucugccagcugaacggccagccgcgcaagaaggggcccauccccagcucccagaaccugcccagcaccuccuucuacccggcgcccgccggcaacacccaccucuaccugcugagcacccccagcgugguccagaaggcgccccggcugaucccgcacgccaagacguucucccccggggacggcuucccccuccugcaguucaagagcaagcaggaguuccagccccuguuccuccacaccggcuccaucccccaggugcccuuccgcccccugccccagccgcgggaggccugggggcugagcgacuccuuccagcccgcgcucccccagcgcgccgcccagaccaccccggccagccaccugaacgugucccaguacaacacggaggcgcggaagaaggaggucgagcagaagaccugggccgagaccgugaucaccgagauccccaaccacgugaaccuggaccaguacgucggccaggagaaccucacgccccagcaggacagcuccguguucaucaagcccgagaagcuguucgacgucaagccggggacccuggagaucagcccccaccacuccuucggccucccccugcuguaccucccccugaagccgcccaacauguuccccagcaccucccgcgccagcaucaccgugcccuccacgccgauccagcccaucgccgaggagcggaaguacccccgccugagccuccugcacucccaccugagccccgagaaccggugcaagaagacccagcucaucccgcuggagaaccugaucgccuucaagcagucccagcagaagcucacccacaaccuguucgagcagggggacgcgggccaccuccagcuccugaaggugaagaucgagccgcccgagguccgccagggcaaggacagcaagaagcggcagcgccgccgggccgagaaggagcugcaggagaagcgcugcgagaagcuccggcgcaagcccaacgugaccuuccggccggagaacagcaucaucaacaacgacgacuccgagaucaucaagaagcccaaggagcagcaggagcacugcgggagccacccccuggacgacuucgacgugcccuucgagaugcugcaggacgacaacacguccgccggccuccacuucauggccagcgucaagaagaaggccaucgggucccaggacgcgagcaccaacaccgacccggagcacgagccccugaccgcgccccagcugcucgugccggacguguaccugaaccugaagcucuccagcgagauguccgagaagcccuggagccccuccaucccccacaccgucacgaaccuggagcugccggugcgcgaggagcccagcaacgacaacgugaucaagcagcaguccgaccaccucgccguccccagcuccgccgagcugcacuacauggccgcgagcgugaccaacgccgugcccccgcacaacuucaagucccagggccugcccaagcccgaguuccgguucaaggggcagagcaccaaguccgacagcgccgaggacuaccuccuguggaagcgccugcagggcgucagcgccgcgugccccgccccguccagcgccgcccaccagcucgagcaccuguccgccaagcugcagaagaucgacgagcagcuccuggcgauccagaacaucgccgagaacaucgagcaggacuuccccaagcccgagaugcuggaccuccacugcgacaagaucggccccguggaccacaucgaguucagcuccgggccggaguucaagaagacccuggccagcaagacgaucuccaucagcgaggaggugcgguuccugacccacauggacgaggaggaccaguccgacaagaaggagaccagcgagcccgaguucuccaucaccgagaacuacagcggccagaagacgugcgucuuccccaccgccgacuccgccgugagccucuccagcuccagcgaccagaacaccaccucccccgggaugaacagcagcgacgagcugugcgaguccgugagcguccacccgcugcagaugacgggccucaccgacaucgcggacaucaucgacgaccugaucaucaaggacgggguguccagcgaggagcugggccucaccgagcaggccaugggcaccucccgcauccagcacuacagcgggcggcacucccagcgcacggacaaggagcggcgcgagauccaggccuggaugaagcggaagcgcaaggagcggauggccaaguaccugaacgagcuggccgagaagcgcggccaggagcacgaccccuucugcccccggagcaacccccucuacaugaccucccgcgagauccgccugcggcagaagaugaagcacgagaaggaccgccugcuccugagcgagcacuacucccggcgcaucagccaggcguacgggcugaugaacgagcuccuguccgagagcgugcagcugccgacccucccccagaagccccugcccaacaagccgucccccacccagagcuccagcugccagcacugccccuccccgcggggcgagaaccagcacgggcacagcuuccugaucaaccgccccggcaaggucaaguacaugagcaagcccuccuacauccacaagcgcaagagcuucggccagccccagggguccccguggccccacggcacggccaccuucaccauccagaagaaggccgggggcgccaaggccgcggugcgcaaggccacccagagccccgugacguuccagaagggcuccaacgcccccugccacagccuccagcacaccaagaagcacggguccgccggccuggcgccgcagaccaagcaggucugcguggaguacgagcgggaggagaccguggucagccccuggacgauccccuccgagauccacaagauccugcacgagagccacaacucccuccugcaggaccugagccccaccgaggaggaggagccggagcaccccuucggggugggcgggguggacuccgucagcgaguccaccggcagcauccucuccaagcuggacuggaacgccaucgaggacaugguggccagcguggaggaccagggccugagcguccacugggcccucgaccuguga

SEQ ID NO: 27550 - RNA, 348 nt, Artificial Sequence
  derived and/or modified sequence opt1 from C5orf63__Homo_sapiens__NP_001157950
augcugugguuccagggcaacagcaugcagcucgcccgcuccagcuucgggcuguuccugcggaacugcuccgccagcaagacgacccuccccgugcugacgcuguucaccaaggacccgugcccccucugcgacgaggcgaaggagguccugaagcccuacgagaaccgcuucauccugcaggaggugaacaucacccuccccgagaacuccgugugguacgagcgguacaaguucgacaucccggucuuccaccugaacggccaguuccugaugaugcaccgcgugaacaccagcaagcucgagaagcagcugcugaagcucgagcagcaguccaccgggggcuga

SEQ ID NO: 27551 - RNA, 2805 nt, Artificial Sequence
  derived and/or modified sequence opt1 from C6__Homo_sapiens__NP_000056
auggcccgccggagcgugcuguacuucauccuccugaacgcccugaucaacaagggccaggcgugcuucugcgaccacuacgccuggacccaguggaccuccugcagcaagacgugcaacuccgggacccagagccgccaccggcagaucgucguggacaaguacuaccaggagaacuucugcgagcagaucugcuccaagcaggagacccgcgagugcaacuggcagcggugccccaucaacugccuccugggcgacuucgggccguggagcgacugcgaccccugcaucgagaagcaguccaaggugcgcagcguccugcggcccucccaguucggcgggcagcccugcaccgccccgcucguggccuuccagcccugcauccccagcaagcugugcaagaucgaggaggccgacugcaagaacaaguuccgcugcgacuccggccggugcaucgcgcgcaagcuggagugcaacggcgagaacgacugcggggacaacagcgacgagcgggacugcggccgcacgaaggccgugugcacccggaaguacaaccccaucccguccguccagcucauggggaacggcuuccacuuccuggccggggagccccgcggcgaggugcuggacaacagcuucaccggcgggaucugcaagaccgugaaguccagccggacguccaaccccuaccgcguccccgccaaccucgagaacgugggcuucgaggugcagaccgcggaggacgaccugaagaccgacuucuacaaggaccugaccagccucgggcacaacgagaaccagcagggcuccuucagcagccagggcggguccagcuucuccgucccgaucuucuacagcuccaagcggagcgagaacaucaaccacaacuccgccuucaagcaggccauccaggccagccacaagaaggacuccagcuucauccgcauccacaaggugaugaaggugcugaacuucacgaccaaggccaaggaccugcaccucuccgacgucuuccugaaggcgcugaaccaccucccccuggaguacaacagcgcccuguacucccggaucuucgacgacuucggcacccacuacuucaccagcgggucccucggcgggguguacgaccugcuguaccaguucagcuccgaggagcucaagaacagcggccugacggaggaggaggccaagcacugcgugcgcaucgagaccaagaagcggguccuguucgccaagaagaccaagguggagcaccgcugcaccacgaacaagcucuccgagaagcacgagggcagcuucauccagggggccgagaaguccaucagccugauccgcggcgggcggagcgaguacggcgcggcccuggccugggagaagggguccagcggccucgaggagaagaccuucuccgaguggcuggagagcgugaaggagaaccccgccgucaucgacuucgagcuggcccccaucguggaccucgugcgcaacaucccgugcgcggucaccaagcggaacaaccugcgcaaggcccugcaggaguacgccgccaaguucgaccccugccagugcgcccccugccccaacaacggccggccgacccucuccgggacggagugccugugcgugugccagagcggcaccuacggggagaacugcgagaagcagucccccgacuacaagagcaacgcggucgacggccagugggggugcugguccagcugguccacgugcgacgccaccuacaagcgcagccggacccgcgagugcaacaaccccgcgccccagcggggcggcaagcgcugcgagggggagaagcggcaggaggaggacugcaccuucuccaucauggagaacaacggccagccgugcaucaacgacgacgaggagaugaaggagguggaccugcccgagaucgaggccgacagcgggugcccccagcccgugccgcccgagaacggcuucauccgcaacgagaagcagcucuaccuggucggcgaggacguggagaucuccugccugaccggguucgagaccgugggcuaccaguacuuccggugccuccccgacgggacguggcgccagggcgacgucgagugccagcggaccgagugcaucaagccgguggugcaggagguccugaccaucacccccuuccagcgccuguaccggaucggggagagcaucgagcucacgugccccaagggcuucgugguggccggccccagccgcuacacgugccaggggaacuccuggaccccgcccaucagcaacucccugaccugcgagaaggacacccugaccaagcugaagggccacugccagcucgggcagaagcagagcggcuccgagugcaucugcaugagccccgaggaggacugcucccaccacagcgaggaccugugcgucuucgacaccgacuccaacgacuacuucaccagccccgccugcaaguuccuggccgagaagugccucaacaaccagcagcugcacuuccugcacaucggguccugccaggacggccggcagcucgaguggggccuggagcgcacccgccugagcuccaacagcacgaagaaggaguccugcggguacgacacgugcuacgacugggagaagugcagcgccuccaccagcaagugcgugugccuccugccgccccagugcuucaagggcgggaaccagcuguacugcgugaagaugggcuccagcaccagcgagaagacccucaacaucugcgaggucgggaccauccggugcgccaaccgcaagauggagauccugcaccccggcaagugccuggcguga

SEQ ID NO: 27552 - RNA, 699 nt, Artificial Sequence
  derived and/or modified sequence opt1 from C6orf106__Homo_sapiens__NP_073595
auggagggcauggacguggaccuggaccccgagcucaugcagaaguucagcugccuggggaccaccgacaaggacguccugaucuccgaguuccagcgccuccugggcuuccagcugaacccggccgggugcgccuucuuccucgacaugacgaacuggaaccugcaggcggccaucggcgccuacuacgacuucgagagccccaacaucuccgugcccagcauguccuucguggaggacgucaccaucggggagggcgagagcaucccgcccgacacccaguucgugaagaccuggcggauccagaacuccgacgugaucugggucauccugagcguggaggugggcgggcuccugggcgucacgcagcagcuguccagcuucgagaccgaguucaacacccagccccaccgcaagguggaggggaacuucaaccccuucgccagcccccagaagaaccggcaguccgacgagaacaaccucaaggacccgggcggguccgaguucgacagcaucuccaagaacaccugggcccccgcgcccgacacgugggcccccgccccggaccagaccgagcaggaccagaaccgccugagccagaacuccgugaaccugagccccuccagccacgccaacaaccucagcgucgugaccuacuccaagggccugcacggccccuaccccuucgggcagagcuga

SEQ ID NO: 27553 - RNA, 1692 nt, Artificial Sequence
  derived and/or modified sequence opt1 from C6orf10__Homo_sapiens__XP_011512542
augaccgugcuggagaucacccucgccgucauccugacgcugcucggccuggccauccuggcgauccuccugacccgcugggcccggugcaagcagagcgagauguacaucucccgcuacagcuccgagcagagcgcccggcugcucgacuacgaggacgggcgcggcucccggcacgccuacagcacccaguccgacaccagcuacgacaaccgcgagcgguccaagcgcgacuacacgcccagcaccaacucccuggugagcauggccuccaaguucagccuggggcagaccgagcucauccugcugcucaugugcuucauccuggcgcugucccggagcuccaucggcagcaucaagugccuccagaccacggaggagccgcccucccgcaccgccggggccaugaugcaguucaccgcccccauccccggcgcgaccggcccgaucaagcugagccagaagacgaucgugcagacccccgggcccaucguccaguaccccggcagcaacgccgggccgcccuccgcgccccgggggcccccgauggcccccaucaucaucagccagcgcaccgcccggaucccccaggugcacaccauggacuccagcggcaagaucacgcugacccccguggucauccucaccggcuacauggacgaggagcuggccaagaaguccugcagcaagauccagauccugaagugcggcgggaccgcccgcucccagaacagccgggaggagaacaaggaggcccucaagaacgacaucaucuucacgaacuccguggagagccugaaguccgcccacaucaaggagccggagcgcgagggcaaggggaccgaccuggagaaggacaagaucggcauggaggugaaggucgacagcgacgccggcauccccaagcggcaggagacccagcucaagaucuccgagaugagcaucccccaggggcagggcgcgcagaucaagaaguccgugagcgacgugccccgcgggcaggagucccaggucaagaaguccgagagcggcgugccgaaggggcaggaggcccaggugaccaagagcggccuggucgugcugaagggccaggaggcccagguggagaaguccgagaugggggucccccggcgccaggagagccaggugaagaagucccagagcggcgugagcaaggggcaggaggcccaggucaagaagcgggaguccguggugcucaagggccaggaggcccaggucgagaaguccgagcugaaggugcccaaggggcaggagggccaggucgagaagacggaggcggacgugcccaaggagcaggaggugcaggagaagaaguccgaggccggcguccugaaggggccggagagccaggugaagaacaccgaggugagcguccccgagacccucgagagccaggugaagaaguccgagagcggcgugcugaaggggcaggaggcccaggagaagaaggaguccuucgaggacaagggcaacaacgacaaggagaaggagcgcgacgccgagaaggaccccaacaagaaggagaagggggacaagaacaccaagggcgacaagggcaaggacaaggucaaggggaagcgcgagagcgagaucaacggcgagaaguccaaggggagcaagcgggccaaggcgaacacgggccgcaaguacaacaagaagguggaggaguga

SEQ ID NO: 27554 - RNA, 978 nt, Artificial Sequence
  derived and/or modified sequence opt1 from C6orf15__Homo_sapiens__NP_054789
augcagggccgcguggccgggagcugcgcgccccugggccuccugcuggucugccuccaccuccccgggcuguucgcccgguccaucggcgugguggaggagaaggucagccagaaccuggggaccaaccugccccagcugggccagcccuccagcaccggccccuccaacagcgagcacccgcagcccgcccucgacccccgcuccaacgaccuggcccgggugccccugaagcucagcgugccggccuccgacggguucccgcccgccggcgggagcgcgguccagcgcuggccgcccuccuggggccugcccgccauggacagcuggccgcccgaggaccccuggcagaugauggccgccgcggccgaggaccggcugggggaggcccuccccgaggagcuguccuaccugagcuccgccgccgcgcucgcccccggcagcggcccccugcccggggaguccagccccgacgccacgggccugucccccaaggccagccuccugcaccaggacagcgagucccgccggcugccccgcagcaacucccucggggccggcggcaagauccugagccagcggccgcccuggucccugauccaccgcgugcuccccgaccaccccugggggacccugaacccgagcguguccuggggcgggggcgggcccggcaccggcugggggacccggcccaugccgcaccccgagggcaucugggggaucaacaaccagccgcccggcacgagcugggggaacaucaaccgcuaccccggcggcuccugggggaacaucaaccgguaccccggcgggagcuggggcaacaucaaccgcuaccccgggggcuccuggggcaacauccaccuguaccccgggaucaacaacccguucccgcccggcguccuccggccgcccgggagcuccuggaacauccccgcgggcuuccccaacccgcccagcccccgccugcaguggggcuga

SEQ ID NO: 27555 - RNA, 714 nt, Artificial Sequence
  derived and/or modified sequence opt1 from C6orf25__Homo_sapiens__NP_079536
auggccguguuccugcagcuccugccccugcuccugagccgcgcccagggcaacccgggggcgucccuggacggccggcccggggaccgcgucaaccucagcugcggcggggugucccaccccauccggugggugugggcccccagcuucccggccugcaagggccuguccaagggccgccggcccauccugugggccagcuccagcgggacccccaccgugcccccgcuccagcccuucgucggccgccugcggucccuggacagcgggauccgccggcucgagcugcugcucuccgccggcgacagcgggacguucuucugcaagggccgccacgaggacgagucccggaccgugcugcacguccugggcgaccgcaccuacugcaaggcgcccgggcccacccacggcagcguguacccgcagcuccugaucccccugcucggggccggccuggugcugggccucggggcccugggccuggucugguggcuccaccggcgccugccgccccagcccauccggccccugccccgcuucgcccucuccccgccccacagcuccacgugcgagaaccgggcgcccgaggccagcaagggcgggcgcgcccaggacucccgggggcccggccccggcaccgagccggcccugugcgggagcggccccagcagcccccagcaggcgcccccggccgugcacuccgggcccugcuga

SEQ ID NO: 27556 - RNA, 885 nt, Artificial Sequence
  derived and/or modified sequence opt1 from C6orf47__Homo_sapiens__NP_067007
auguuccugcgccggcucggcggguggcugccccgcccguggggccggcgcaagcccaugcggcccgacccgcccuaccccgagccccgccggguggacagcuccagcgagaacuccgggagcgacugggacuccgcccccgagaccauggaggacgucggccacccgaagaccaaggacagcggggcccugcgcguguccggcgcggccagcgagcccuccaaggaggagccccagguggagcagcucggcagcaagcggauggacucccugaagugggaccagcccaucagcuccacgcaggagagcgggcgccuggaggccggcggggccuccccgaagcuccggugggaccacgucgacagcggcgggacccgccggcccggcgugucccccgagggcgggcugagcgugcccggcccgggggcgccccuggagaagcccggccgccgggagaagcuccugggcuggcugcgcggggagcccggcgccccgucccgguaccucgggggccccgaggagugccugcagaucagcaccaaccugacccuccaccuccuggagcugcuggccagcgcccugcucgcccugugcucccgcccccugcgggcggcccucgacacgcuggggcugcgcggcccccucggccuguggcugcacgggcuccugagcuuccuggccgcccuccacggccugcacgccguccugucccuccugaccgcgcacccgcugcacuucgccugccucuucgggcugcugcaggcccucgugcuggccgugagccugcgggagcccaacggcgacgaggccgcgaccgacugggaguccgaggggcucgagcgcgagggcgaggagcagcgcggcgaccccgggaagggccuguga

SEQ ID NO: 27557 - RNA, 228 nt, Artificial Sequence
  derived and/or modified sequence opt1 from C6orf48__Homo_sapiens__NP_001274413
auggagcgcagcuucguguggcuguccugccucgacagcgacuccugcaaccugaccuuccggcugggcgaggucgagagccacgccugcucccccagccuccuguggaaccugcucacccaguaccugccgcccggggccggccacauccugcgcacguacaacuuccccgugcucuccugcgugagcuccugccaccugaucgggggcaagaugcccgagaacuga

SEQ ID NO: 27558 - RNA, 1044 nt, Artificial Sequence
  derived and/or modified sequence opt1 from C6orf89__Homo_sapiens__NP_001273564
auggaccuggccgccaacgagaucagcaucuacgacaagcucuccgagaccguggaccugguccgccagaccggccaccagugcgggaugagcgagaaggcgaucgagaaguucauccggcagcugcucgagaagaacgagccccagcgcccgccgccccaguacccccugcugaucgugguguacaagguccucgccacgcugggccugauccuccugaccgccuacuucgugauccagcccuucagcccccuggcccccgagcccgugcucuccggggcccacaccuggcggucccugauccaccacauccgccugaugagccucccgaucgcgaagaaguacauguccgagaacaagggcgucccccugcacgggggcgacgaggaccggcccuuccccgacuucgacccgugguggaccaacgacugcgagcagaacgagagcgagcccauccccgccaacugcacgggcugcgcccagaagcaccugaaggugaugcuccuggaggacgcgccccgcaaguucgagcggcugcacccgcucgugaucaagaccgggaagccccugcuggaggaggagauccagcacuuccucugccaguaccccgaggccaccgagggcuucuccgagggguucuucgccaagugguggcgcugcuuccccgagcggugguucccguuccccuaccccuggcgccggccccugaaccgcagccagaugcugcgggagcuguucccggucuucacccaccuccccuuccccaaggacgccucccugaacaagugcagcuuccuccaccccgagccgguggugggcuccaagaugcacaagaugcccgaccuguucaucaucgggagcggcgaggccaugcugcagcucaucccgcccuuccagugccgccggcacugccaguccgucgccaugcccaucgagcccggcgacaucggguacguggacacgacccacuggaagguguacgucaucgcgcgcggcgugcagccccuggugaucugcgacgggaccgccuucagcgagcuguga

SEQ ID NO: 27559 - RNA, 2532 nt, Artificial Sequence
  derived and/or modified sequence opt1 from C7__Homo_sapiens__NP_000578
augaaggugaucagccuguucauccucgucggcuucaucggggaguuccaguccuucagcuccgccagcucccccgugaacugccagugggacuucuacgccccguggagcgagugcaacggcugcaccaagacccagacgcgccggcgcuccguggcggucuacgggcaguacggcgggcagcccugcgugggcaacgccuucgagacccagagcugcgagcccacccggggcugccccaccgaggaggggugcggcgagcgcuuccggugcuucuccgggcagugcaucagcaagucccuggugugcaacggcgacagcgacugcgacgaggacuccgccgacgaggaccgcugcgaggacagcgagcggcgcccguccugcgacaucgacaagcccccgcccaacaucgagcugacggggaacggcuacaacgagcucaccggccaguuccggaaccgcgucaucaacaccaagagcuucgggggccagugccggaagguguucuccggggacggcaaggacuucuaccgccugagcggcaacgugcuguccuacaccuuccaggucaagaucaacaacgacuucaacuacgaguucuacaacagcacguggagcuacgugaagcacaccuccaccgagcacaccagcuccagccggaagcgcuccuucuuccggagcuccagcuccagcucccgcagcuacacgucccacaccaacgagauccacaagggcaagagcuaccagcuccugguggucgagaacaccguggagguggcccaguucaucaacaacaaccccgaguuccugcagcucgccgagcccuucuggaaggagcugucccaccuccccagccuguacgacuacuccgcguaccggcgccugaucgaccaguacgggacccacuaccugcagagcgggucccucggcggggaguaccggguccuguucuacguggacagcgagaagcugaagcagaacgacuucaacagcguggaggagaagaagugcaaguccagcggcuggcacuucgucgugaaguucuccagccacggcugcaaggagcucgagaacgcccugaaggccgccuccgggacgcagaacaacgugcugcgcggcgagcccuucauccgcgggggcggggcgggcuucaucagcggccucuccuaccuggagcuggacaacccggccgggaacaagcggcgcuacagcgccugggccgaguccgucaccaaccucccccaggugaucaagcagaagcugacgccccuguacgagcucgugaaggagguccccugcgccagcgugaagaagcuguaccugaagugggcgcucgaggaguaccuggacgaguucgacccgugccacugccggcccugccagaacggcgggcuggccaccgucgagggcacccacugccucugccacugcaagcccuacaccuucggggccgccugcgagcagggcgugcuggugggcaaccaggccgggggcgucgacgggggcugguccugcuggagcuccuggagccccugcgugcagggcaagaagacccgcucccgggagugcaacaacccgccgcccagcgggggcgggcgcuccugcgugggcgagaccacggagagcacccagugcgaggacgaggagcuggagcaccuccggcugcuggagccccacugcuucccccucagccugguccccaccgaguucugccccuccccgcccgcgcugaaggacggguucgugcaggacgagggcaccauguuccccgugggcaagaacgucguguacacgugcaacgagggguacagccucaucggcaaccccguggcccgcugcggggaggaccugcgguggcuggucggcgagaugcacugccagaagaucgccugcgugcucccggugcugauggacgggauccagucccacccccagaagcccuucuacaccgucggcgagaaggugaccgugagcugcuccggcgggaugagccuggagggccccuccgccuuccucugcgggagcucccugaaguggagcccggagaugaagaacgcccgcugcguccagaaggagaacccccugacccaggcggugcccaagugccagcggugggagaagcugcagaacucccgcugcgugugcaagaugcccuacgagugcggcccgagccucgacgucugcgcccaggacgagcgguccaagcgcauccugccccugacggugugcaagaugcacgugcuccacugccaggggcggaacuacacccugaccggccgcgacagcugcacccugcccgccuccgccgagaaggccugcggcgcgugcccccucugggggaagugcgacgccgagagcuccaagugcgucugccgggaggccagcgagugcgaggaggagggcuucuccaucugcguggaggugaacgggaaggagcagacgaugagcgagugcgaggccggcgcgcugcgcugccgggggcagagcaucuccgucaccagcauccgcccgugcgccgccgagacccaguga

SEQ ID NO: 27560 - RNA, 309 nt, Artificial Sequence
  derived and/or modified sequence opt1 from C7orf49__Homo_sapiens__NP_001230683
augaacgaggccgagaucguggacgucgcccugggcauccucaucgagagccgcaagcaggagaaggcgugcgagcagcccgcccuggccggggccgacaacccggagcacuccccgcccugcagcgugagcccccacaccuccuccggcagcuccagcgaggaggaggacuccgggaagcaggcccuggcgcccggccucagccccucccagcggcccgggggcagcuccagcgccugcucccgcagccccgaggaggaggaggaggaggacgugcugaaguacguccgggagaucuucuucuccuga

SEQ ID NO: 27561 - RNA, 462 nt, Artificial Sequence
  derived and/or modified sequence opt1 from C7orf57__Homo_sapiens__NP_001254795
augcccgacuacauggugcacgaggaguucaacccggaccaggccaacggcagcuacgccucccgccgggggcccuucgacuucgacaugaagaccgucuggcagcgcgaggcggaggagcuggagaaggagaagaagaagcuccggcugcccgccaucgacagcaaguaccuguccaaggccggcacgccccucgggccgaagaaccccgccggcagccgccuguccuucccgcccgugaacggguacaaggacgaguggcugcagcagcagcagcgggccgacagcgacaagcgcacccccaagaccucccgggcgagcgugcucucccagagcccccgcgaccuggagggcccccaggacgccgcccggcugcaggacgccgaggcguccgagggccccgaggacaccccggggcccgaggagagcgucuccgccagcacccccgccgagcucaaguga

SEQ ID NO: 27562 - RNA, 1218 nt, Artificial Sequence
  derived and/or modified sequence opt1 from C7orf60__Homo_sapiens__NP_689769
auggagcccggcgccgggggccgcaacaccgcccgggcgcagcgcgccgggagcccgaacaccccgccgccccgggagcaggagcgcaagcuggagcaggagaagcucuccggcguggucaagagcgugcaccggcgccugcggaagaaguaccgcgaggugggggacuucgacaagaucuggcgggagcacugcgaggacgaggagacgcugugcgaguacgccgucgccaugaagaaccucgccgacaaccacugggcgaagaccugcgagggcgagggccgcaucgaguggugcugcuccgugugccgggaguacuuccagaacgggggcaagcgcaaggcccuggagaaggacgagaagcgggccgugcuggccaccaagaccacgcccgcgcucaacaugcacgagagcucccagcuggaggggcaccugaccaaccucagcuucaccaaccccgaguucaucaccgagcugcugcaggccuccggcaagauccgccuccuggacgucgggagcugcuucaaccccuuccugaaguucgaggaguuccucacggugggcaucgacaucgugcccgccgucgaguccguguacaagugcgacuuccugaaccugcagcuccagcagccccugcagcuggcccaggacgccaucgacgcguuccucaagcagcugaagaaccccaucgacagccugcccggcgagcuguuccacguggucguguucucccuccugcucagcuacuuccccuccccguaccagcgguggaucugcugcaagaaggcccacgagcugcuggugcucaacgggcugcugcucaucaucacccccgacagcucccaccagaaccgccacgccaugaugaugaaguccuggaagaucgccaucgagagccugggcuucaagcgguucaaguacagcaaguucucccacaugcaccugauggccuuccgcaagaucagccucaagaccaccagcgaccuggucucccggaacuaccccgggaugcuguacaucccccaggacuucaacagcaucgaggacgaggaguacuccaacccgagcugcuacgugcgcuccgacaucgaggacgagcagcucgcguacggcuucacggagcugcccgacgcccccuacgacagcgacuccggcgagagccaggccuccagcauccccuucuacgagcuggaggacccgauccuccugcuguccuga

SEQ ID NO: 27563 - RNA, 762 nt, Artificial Sequence
  derived and/or modified sequence opt1 from C7orf62__Homo_sapiens__XP_011514206
augagcuucuccgugcacaaccagaagggcagcaagcgcccccugccgcucgagccccugcuguuccuccaggucccccgguccaacuaccugcacuuccaggaggagaagcagcgccugcaccucaagaaguuccugcuggaccggauguuccucguggccaagauccaggccaacguggagcgcaaggacgucgcggacuacuacgagcagauguuccagagcgugcugaagcaccaccugggggaggccgugaccggccuccugcugaucuaccccaccuccauccuccacauccuggagagcuccagcgacacgcuguacaagguccuccuggacuacaucgggcacgugaaggacgagaccguguucuucauccagcagaugaagaucaucgucaucucccacaacaucccgaugcggcuguucaugcaguggcacgugagcgugaucaagguccccgugauguaccucgacgacgugacccagucccagagccugaaggaggucaucaccgacuuccugacgcagacccacaagcucucccuguaccugugccagaccaugaaggugggcaccaaggggcccggcgacaaccuccaccagguggcccccgaccugcugcucccggagcagaucaucaaguaccugugcaagagcgaggaguucauggaccccgccacguucaucaacauguacaaccgccccauccacaucacccuggacuccgaggucguguggcccgccccgagccgguucuga

SEQ ID NO: 27564 - RNA, 456 nt, Artificial Sequence
  derived and/or modified sequence opt1 from C7orf65__Homo_sapiens__NP_001116537
augcgcauggcccccaccgagagcaccgagggccggcgccuguggccggggccccgggagggcggguccggcaaggagacgaccagcgagaagcucuccaaccugccccgcccccacagcuacuccccgaagcgggccgacgcggagagcuuccgcggggugcccgccgccuucaagaagugccgggaggucuuccgcgccugcuggggcucccgggagcuccuguuccuguucaaggccaucagcgaggcgggccccgcccagaacuccugcgggaucacccuggagaaggccggcgggcucgaggacaccggcagccacuggcuguccugggcccgcugcaaggugcuguacaucaacggguucacggaccccuggaaggacgcgcaggccuggauccucaucgugagcugcaagaagggcaagggcaccccggagcgggaggggcgcaacuga

SEQ ID NO: 27565 - RNA, 369 nt, Artificial Sequence
  derived and/or modified sequence opt1 from C7orf69__Homo_sapiens__NP_079307
augggcuuccacuucugcaucuggaucaucuuccugcuccccccgcccugcaagaagugccugagcccccccaccaugaaccugcgcccgcccaaguccugcgggaacguguucuacuggguccucgugcugaacagcggccugcucuacaaguucugccagaccaucaagugccgggccaacuggcgccccgcccgggcgccccgcggguggaacgaggccacggagcggcaccaggagcgccggacccagauggagaccgagaugggcgggaucuccaccacguacuggcaccgccugugcaccugcaccgaccggcgcgccgagaagcuggugauggacggcaacaacugcugguuccacaaguga

SEQ ID NO: 27566 - RNA, 1317 nt, Artificial Sequence
  derived and/or modified sequence opt1 from C7orf72__Homo_sapiens__NP_001155306
auggacguggagauccaggacacccccggcaagaucagcaucuccaagcgcagcauccuguccgggaccgucgagaacaucgacuacccgcacuacugcgaccuccugcggaagaugaacaugcccuucgugaagggccuggagaaccgccacaacuacgggcgguucgagaagaagugcaaccccgccuuccucaaguuccaccccuacccgcccagcgugcugcccgacuaccaccuccacgaccccuacccgccgcccuacggcccccacuacccccuguucccccugcgcgacgacgucacgcugggggacuccugcagcggcuucaugucccccggcggggacgccgaccucaaccccggcaucgggcggaccaucccgacccugguggacuucagcgacgugaagccccagcaccgcgucccccggcccgacaccggcuuccagacgaccaucaagcgccagaagauccuguccgaggagcuccagcagaaccggcgcuggaacagccgggaggugccggacaucuccauccgcgcccggcucgggggcuggaccagcccccugaaggugacgccccugcagccccaccacgagggccgcucccugagccacaucuucaccuucgacgaggaggcgaccugcaccgacgagggggagccgcugguccagaccaacaagaagugcaacgccaaggacuccuucuacaagagcuccacgcagaaggccuacgaggacgugcccugggacaagaugcucccgcccaagcuggugcccgaggagaccacccuggagaaggccgccgaccccaucagccagugcuucacccucaagcgguacaagggcguccccgccaucacgcagauggugggggagcugugggaccgcuuccagacccgguccuuccuggccccggugaagcccaucaacuucgucagcagcuccagccgcuccaaguacaucccccucuacaccggccacgugcagagcaccaacgccgacgacguggacaacccccugggcgacaucgcgucccuggccaagcagcgguacagcaagccgcucuacacgaacaccucccgcgccgccaacauccccggguacaccggcaagguccacuucaccgccacgcaccccgcgaacagcaacauccccuccaccaccccgagccccgacuccgagcugcaccggguguuccagaaggagauggccguggaccuguuccgccaccaggcgccccucagccgccuggucaccacggugcggcccuacaacccguucaacaagaaggacaaggagaccaucgacuacuga

SEQ ID NO: 27567 - RNA, 1122 nt, Artificial Sequence
  derived and/or modified sequence opt1 from C8orf34__Homo_sapiens__NP_001182568
augagcagcccccuggccagcgagcucuccgagcuggccgcgcugcgcccgggcuuccggcucagcgcgccccacgcccgcguggcgccccgggccgccacccacgcccgcgggcggggccgcgccucccacgccgggcagccccggcugcgcagcuccugcccgggccccagccccgggaagcggcgcgucgugcccuccggcggcgcccagccgcgggugcugcccgcccucagcucccgcagccaccuguuccccauggccucccacccccagacccggauccaggccuaccuggagaagaacaagaucgggccccucuucgaggagcugaugacgaagcugaucaccgagacccccgaccagcccauccccuuccucaucgaccaccuccagagcaagcagggcaaccgcgggcagcugcagcggacccuguccggcagcgccgcgcugugggccgaguccgagaaguccgaguccaaggggacgcgccgggacuuccgcagcuacgacaagccguggcagcugaacgccaagaagcccaagaaguccaagagcgaccucgccgucagcaacaucuccccgcccagcccggacuccaagagccugccccgguccguggagcaccccaaguggaacuggcgcaccaagccccagagccgggacuucgacgagcugaaccacauccuccaggaguccaagaagcugggcaaggcccuggagaaccucagccgcuccaucgcgaucagcgacgagcuggacaaggagaccgugaccuucaacuccagccugcuccgcccgcgggucaucggcgaguggaucgggcgcgaggagaacgacgccgacccccuggccgccgagaugcugcagccgcccaucccccgguccaagaacgaccagugggagagcgaggacuccggcagcucccccgccgggagccucaagauggagcccaagaacaagggccugaagcagcagcagcagcagcacaagaagcugcucgcggccaugcugagccaggacuccuucgagagcauccacuccccgacgcccagcgugaccgaggaggacaucgacaacgaggacgacgccauggagcugcucggcaacuucaagaacuga

SEQ ID NO: 27568 - RNA, 624 nt, Artificial Sequence
  derived and/or modified sequence opt1 from C8orf37__Homo_sapiens__NP_808880
auggccgaggaccuggacgagcuccuggacgagguggagagcaaguucugcacccccgaccugcuccgccggggcauggucgagcagccgaaggggugcggcgggggcacccacuccagcgaccgcaaccaggccaaggcgaaggagacgcugcgguccaccgagaccuucaagaaggaggacgaccuggacagccucaucaacgagauccuggaggagcccaaccuggacaagaagcccuccaagcucaagagcaaguccagcgggaacaccuccgugcgcgccagcaucgagggccugggcaaguccugcagccccguguaccugggcggguccagcaucccgugcgggaucggcacgaacaucuccuggcgggccugcgaccaccuccgcugcaucgccugcgacuuccuggucgugagcuacgacgacuacaugugggacaaguccugcgacuaccuguucuuccggaacaacaugcccgaguuccacaagcucaaggccaagcugaucaagaagaaggggacccgcgcguacgccugccagugcagcuggcggaccaucgaggaggugaccgaccugcagacggaccaccagcuccgcugggucugcggcaagcacuga

SEQ ID NO: 27569 - RNA, 624 nt, Artificial Sequence
  derived and/or modified sequence opt1 from C8orf46__Homo_sapiens__NP_689978
augaugcaccagaucuacagcugcagcgacgagaacaucgagguguucaccaccgucauccccagcaagguguccagcccggcccgccggcgcgccaaguccagccagcaccuccugacgaagaacguggucaucgaguccgaccuguacacccaccagccccuggagcuccugccccaccggggcgaccgccgggaccccggggaccgccggcgcuucggccggcugcagaccgcgcgcccgcccaccgcccaccccgccaaggccagcgcccggcccguggggaucuccgagccgaagacgagcaaccucugcggcaaccgcgcguacgggaagucccugaucccgcccgugccccggaucagcgucaagaccuccgccagcgccucccuggaggccaccgcgaugggcaccgagaagggcgccgugcucaugcgcgggagccggcaccugaagaagaugacggaggaguaccccgcccugccccagggcgccgaggccucccucccccugaccgggagcgcguccugcggcgugcccgggauccugcgcaagauguggacccggcacaagaagaaguccgaguacgucggcgccaccaacagcgccuucgaggccgacuga

SEQ ID NO: 27570 - RNA, 960 nt, Artificial Sequence
  derived and/or modified sequence opt1 from C8orf48__Homo_sapiens__NP_001007091
auggccaucugccccgagcuggcccagaccgacaagagcgcgcucgccaaccuguccgacgagaccgagacgcugaagaacuucaccgacgaggugcagaccagcuccagcuucuccagcuccggcgggcgccagagcuccccgcucaccagcggcuccaagcuggagcgggagaagcagacgcccagccuggagcagggggacacccaguccgagcuccuggacuacaagaacuacgagaagaagcugagcaagaaguggaucaacuaccucaagcugaaggacuccaacuucgagcgccaccagcccgacaccaagcugcccaccgagaucacgcgggucagcgacgaggagcucaacgcccugcaguccuacugcaccaugaagaucaaccugauccaccgccggggcgacagcaagaagaagaccuccagccgccacaagaagcuccaccuggggcuggacguggaggccagcgagcgggacgccuucuccugcaccgugccggacgagcuccugaaccgcaucuacuucaagaacaugcggacgacccccaagcaggaggcggccgccaagcagcacaucagcuaccagugccccuacugcaaccgcaagcgggccgagcuggcgcucuccgccuuccugaagcagaagaagacccugcucgagagcuuccugcugcaggagcgcaucgacgagcaccuccacaccaaggacuuccugacgcggaucggcgaggcccaccaggacuucccccgccuguccgacgacccgcggaucaucuggaagcgccucaccgagaagucccacauccgguacagcggcuucgagcgcagcgagaccgagcagaagaugcagcgggacgggaacuccgccugccaccuccccuucagccugcccuuccugaagcgccugacccugaucaagcccgagcucgucaucgugaacgacaacguguga

SEQ ID NO: 27571 - RNA, 321 nt, Artificial Sequence
  derived and/or modified sequence opt1 from C8orf4__Homo_sapiens__NP_064515
augaaggccaagcgcagccaccaggccaucaucauguccaccagccugcgggugucccccagcauccacggcuaccacuucgacaccgcgucccgcaagaaggccgucgggaacaucuucgagaacacggaccaggagagccucgagcggcuguuccgcaacuccggcgacaagaaggccgaggagcgggccaagaucaucuucgccaucgaccaggacguggaggagaagacccgcgcgcugauggcccucaagaagcggaccaaggacaagcuguuccaguuccugaagcuccgcaaguacagcaucaaggugcacuga

SEQ ID NO: 27572 - RNA, 672 nt, Artificial Sequence
  derived and/or modified sequence opt1 from C8orf86__Homo_sapiens__NP_997295
augcgcccccugggcaaggggcuccugccggccgaggagcugauccggagcaaccucggcguggggcgcucccugcgggacugccugagccaguccggcaagcucgccgaggagcuggggagcaagcgccugaagcccgcgaaguucggcaccgagggcaaggagcgggucgagcagcgcaccgagcggcagcgcacgggguccagcaaggagccccggaugcagaucaucugccgccggcgcuggcgggagcccccgccccgccuccuguggggcugccugaugccccgggcccagccccuccugcacgugaccgccuacgagaacaccgggcacugggagcgccuggccuccguggucagcuccaagacccagcagccgacggugaucagccacuccagcaucuccaucaccuucagccacuacccgcccgccacccucgacuccuuccuggugcuggagcccaucaagcuguuccccgucagcucccuccggagcccccugugccucaacugcggcuccugccgcgagagcauccggaucagcggggagcugaucggcaacgcgcacucccccgcgcccccgcgcacccccgagcuggagacgcucggcugggacaagcaggccgugcugagcggggcccaggugauccuggucugcgccgagguguga

SEQ ID NO: 27573 - RNA, 1680 nt, Artificial Sequence
  derived and/or modified sequence opt1 from C9__Homo_sapiens__NP_001728
augagcgccugccgcuccuucgccguggcgaucugcauccuggagaucagcauccucaccgcccaguacaccacguccuacgaccccgagcugaccgagagcuccggcagcgccucccacaucgacugccggaugagcccgugguccgaguggagccagugcgaccccugccugcgccagauguuccggucccgcagcaucgaggucuucgggcaguucaacggcaagcggugcaccgacgccgugggggaccgccggcagugcgugcccaccgagcccugcgaggacgccgaggacgacugcggcaacgacuuccagugcuccacggggcgcugcaucaagaugcggcuccgcugcaacggcgacaacgacugcggcgacuucagcgacgaggacgacugcgaguccgagccgcggccgcccugccgcgaccgggucguggaggagagcgagcuggcgcgcaccgccggguacggcaucaacauccuggggauggacccccucuccacccccuucgacaacgaguucuacaacggccugugcaaccgggaccgcgacgggaacacccugacguacuaccggcgccccuggaacguggccagccucaucuacgagaccaagggcgagaagaacuuccggaccgagcacuacgaggagcagaucgaggccuucaaguccaucauccaggagaagaccagcaacuucaacgcggccaucagccugaaguucacgcccaccgagaccaacaaggccgagcagugcugcgaggagaccgccuccagcaucucccugcacggcaaggggagcuuccgcuucuccuacagcaagaacgagacguaccagcuguuccucuccuacagcuccaagaaggagaagauguuccugcacgucaagggcgagauccaccucgggcgguucgugaugcgcaaccgcgacgugguccugaccaccaccuucguggacgacaucaaggcccugcccacgaccuacgagaagggcgaguacuucgcguuccucgagaccuacggcacccacuacagcuccagcgggucccugggcgggcuguacgagcucaucuacgugcuggacaaggccagcaugaagcggaagggcgucgagcugaaggacaucaagcgcugccucggguaccaccuggacgugucccuggccuucagcgagaucuccgugggcgccgaguucaacaaggacgacugcgucaagcggggcgaggggcgcgccgugaacaucacgagcgagaaccucaucgacgacguggucucccugauccggggcgggacccgcaaguacgcguucgagcugaaggagaagcuccugcggggcaccgugaucgacgugaccgacuucgucaacugggccagcagcaucaacgacgccccggugcugaucucccagaagcucagccccaucuacaaccuggugcccgucaagaugaagaacgcccaccugaagaagcagaaccucgagcgcgccaucgaggacuacaucaacgaguucuccgugcggaagugccacacgugccagaacgggggcaccgucauccugauggacggcaagugccugugcgcgugccccuucaaguucgaggggaucgccugcgagaucagcaagcagaagaucuccgagggccucccggcccuggaguuccccaacgagaaguga

SEQ ID NO: 27574 - RNA, 699 nt, Artificial Sequence
  derived and/or modified sequence opt1 from C9orf106__Homo_sapiens__NP_001012733
auggccuacguggcccugagcgacaagccccaccucuccggcgaggucggggaggaggcgugcagcuccuggaacccgccccuguucagcccccgcccccugccgcggcucuggccccugcccggcacccccuuccugccgauccgcgcccuccccuucuccgccagcuccagcgggaaguccagccuggugcccucccccagcuccagcgcccacuccggcuuccggaccccgugccuggggcccgacugccuccugugcacgcagggcugcgagcugcacgagggccgcaaccacauggccgugcacagcugcgucgcgcgggccuggcccggggacccccaggaggugcgccaccucaacccgcugcugugcgaccccggcucccagguggagcccagcuggcccuggcacccggggcucgagcaggccgccgcguccugggucggcaaccacgugagccccgcccaccggcaggcccugcgcgggcacagccugggcuccgcccuccgggcccugaugcccggcgggcacugcccccugugcgugccgugcaagcgcggcugcaaccuccgcgggggccggggcaagcacgggccccggcccugcugcccccugcugcgcaaguucccgguccuccccgugcaccccuggccguuccccugcgcggugugggacagcggcugguccugccgguga

SEQ ID NO: 27575 - RNA, 690 nt, Artificial Sequence
  derived and/or modified sequence opt1 from C9orf135__Homo_sapiens__NP_001010940
auggacagccuggaccgcuccugccaggacuggugcgaccggaagcagcacuggcucgagaucgggcccccggaccugguggagcgcaagggcagccugacccuccggucccaccacaagaaguacagcaagcccguccugguguacuccuggcaccgcgaccgggaggccuuccccaagggcuacgacaucgaggggcccgagaaggugaagaagcugugcaacagcaccuaccgccggcucggcacggacgaguccccgaucuggaccagcgagacccacgagaagcugucccagaugugccugaacaccgagugggucgagaugaaguccaaggcccuccugaacgaggagacggugagcagcgggaucaucgagcgcgugaccggccugcccgcgaccggcuucggggccgucuucccccggcacccgcccgacugguccaagaugugcgcccucaccacguacagcgaggacuacgugccgcccuacgacuaccagccccacgccuaccccugccaggacgacuacuccaucgugcaccgcaagugccggagccaguucaccgaccugaacggcuccaagcgcuucgggaucaacaccuggcacgacgagagcggcaucuacgccaacuccgacgucaagcagaagcuguacccccucaccagcgggcccaucgugcccaucuga

SEQ ID NO: 27576 - RNA, 720 nt, Artificial Sequence
  derived and/or modified sequence opt1 from C9orf152__Homo_sapiens__NP_001013011
auggagggccugcccugcccgugccccgcccucccccacuucuggcagcugcgcagccaccugauggccgaggggucccggacccaggcgcccggcaaggggccgccccucagcauccaguuccugcgcgcccaguacgagggccugaagcggcagcagcgcacccaggcccaccuccuggugcugcccaagggcgggaacacccccgccccggccgaguccauggucaacgcgguguggaucaacaaggagcggcgcagcucccucagccuggaggaggccgacuccgagguggagggccggcuggaggaggccgcccaggggugccuccaggcgcccaagagccccuggcacacccaccuggagaugcacugccugguccagaccagcccccaggacaccucccaccaggugcaccaccgcggcaagcucgugggguccgaccagcggcugccgcccgagggcgacacgcaccuguucgagaccaaccagaugacccagcaggggaccggcauccccgaggccgcccagcuccccugccaggucggcaacacgcagaccaaggccguggagagcgggcugaaguucuccacccagugcccgcugagcaucaagaacccccaccgcuccggcaagcccgccuacuaccccuucccgcagcggaagacgccccgcaucagccaggcggcccggaaccucgggcuguacggcuccgccuga

SEQ ID NO: 27577 - RNA, 1326 nt, Artificial Sequence
  derived and/or modified sequence opt1 from C9orf156__Homo_sapiens__NP_057565
augcgcggccuggaggagagcgggccccggccgaccgccacccccugcggcugcgugaagcccgcccucgagacggggaaccugcugaccgagcccgucggcuaccucgaguccugcuucagcgcgaagaacgggaccccgcgccagcccuccaucugcagcuacucccgggccugccugcgcauccggaagcgcaucuucaacaaccccgagcacagccugaugggccucgagcaguucucccacguguggauccuguucguguuccacaagaacggccaccugagcugcaaggccaagguccagcccccgcggcucaacggggccaagaccggcguguucuccacgcgcagcccccaccggcccaacgccaucgggcugacccuggcgaagcucgagaagguggagggcggggccaucuaccuguccggcaucgacaugauccacggcacccccguccuggacaucaagccguacaucgccgaguacgacagcccccagaacgugauggagccccucgccgacuucaaccugcagaacaaccagcacacccccaacacggugucccagagcgacuccaagaccgacagcugcgaccagcgccagcuguccgggugcgacgagccgcagccccaccacagcaccaagcggaagcccaagugccccgaggaccgcaccuccgaggagaacuaccucacgcacagcgacaccgcgcggauccagcaggccuucccgaugcaccgcgagaucgccgucgacuucggccuggagagccggcgcgaccaguccagcuccguggccgaggagcagaucgggcccuacugccccgagaaguccuucagcgagaagggcaccgacaagaagcuggagcggguggagggcgccgcgguccuccaggggagccgcgccgagacccagcccauggccccgcacugccccgccggccgggccgacggggcgccccgcuccguggugcccgccugggucacggaggccccgguggccacccuggaggugcgguucacgccccacgccgagauggaccugggccagcucagcucccaggacgucgggcaggcgagcuucaaguacuuccaguccgccgaggaggccaagcgcgccaucgaggccgugcugagcgcggacccccgcuccguguaccggcgcaagcugugccaggaccgccucuucuacuucaccgucgacaucgcccacgugaccugcugguucggcgacggcuucgccgaggugcugcggaucaagccggccagcgagcccguccacaugaccgggcccgugggcucccuggucagccucggguccuga

SEQ ID NO: 27578 - RNA, 366 nt, Artificial Sequence
  derived and/or modified sequence opt1 from C9orf170__Homo_sapiens__NP_001001709
auguggagccgccggggccugggggugucccgcgcgccccuccaccuccugcucggcgucugggggccgagcggccggaccgggggccagcgcaagggcgccucccuggcccggcccgggcgcggcgggcuggccagcugcuccgugggcgccaacgggaagcgggacgugcuguuccugcgcaagacccugacgaacaccgucgaggacauccagaucgacaacuuccggcgcaagagcgaccucggcgugggcucccccgacuggaagaaccugcugaucgacgugacccgggaggaccacgagaacagccagaacaacuccaagcgccggugcaaggucaacugcgagaccgaccagcgcuga

SEQ ID NO: 27579 - RNA, 855 nt, Artificial Sequence
  derived and/or modified sequence opt1 from C9orf171__Homo_sapiens__NP_001269886
augcccgaggcccgcagcuccggccccgaccugacccgguggcgcaagcagcagcagcccgugcggcgcaccgucagccaggugugcccgccgccccggcgcccccucacgguggccgacauccgguccgggauggagaacgagcgccugggcgucgugcgggacagcauguuccagaacccccugaucgugaaggcggagcucgggaagccccgcgagcgguccuacagccugcccggcaucaacuucaacuacgggcuguacauccgcggccucgacggcgggguccccgaggccaucggccgguggaacguguucaagcagcagccgaccugcccccacgagcugacccgcaacuacaucgccaugaaccgcggggccgugaaggccggccuggucaccgcgcgggagaaccuccuguaccggcagcugaacgacauccgcaucuccgaccaggacgaccggcgcaugaagaaggagcccccgccccugccgcccaacaugacguucgggauccgggcccgccccagcacccccuucuucgaccuccugcagcaccgcuaccuccagcugugggugcaggagcagaaggccacccagaaggccaucaagcuggagaagaagcagaaggugguccucggcaagcuguacgagacccgguccagccagcugcgcaaguacaagccgcccgugaagcucgacacgcuguggcacaugccccacuuccagaaggugggccggcaccuggacaccuuccccaccgaggcggaccgccagcgggcccucaaggcccaccgcgaggagugcgccguccggcaggggacccugcgcaugggcaacuacacgcaccccuga

SEQ ID NO: 27580 - RNA, 1701 nt, Artificial Sequence
  derived and/or modified sequence opt1 from C9orf3__Homo_sapiens__NP_001180260
auggacauccagcuggaccccgcccgcgacgaccucccgcugauggccaacaccagccacauccuggugaagcacuacgugcucgaccuggacguggacuucgagucccaggugaucgagggcaccaucguccuguuccucgaggacgggaaccgguucaagaagcagaacagcuccaucgaggaggcgugccagagcgaguccaacaaggccugcaaguucggcaugcccgagcccugccacauccccgugacgaacgcccgcaccuucagcuccgagauggaguacaacgacuucgccaucugcagcaagggggagaaggacaccuccgacaaggacggcaaccacgacaaccaggagcacgccagcgggaucuccagcuccaaguacugcugcgacaccggcaaccacggcagcgaggacuuccugcuggugcucgacugcugcgaccuguccguccugaagguggaggagguggacgucgcggccgugccggggcucgagaaguucacgcggagccccgagcugaccguggucuccgaggaguuccgcaaccagaucgugcgggagcuggugacccuccccgccaaccgcuggcgggagcagcuggacuacuacgcccgcugcagccaggcgcccggcugcggggagcuccuguucgacaccgacacguggucccugcagauccggaagaccggcgcccagaccgccaccgacuucccgcacgccauccgcaucugguacaagacgaagcccgaggggcggagcgucaccuggaccagcgaccaguccggccgccccugcguguacaccgugggcagccccaucaacaaccgggcccuguucccgugccaggagccgcccgucgcgauguccacguggcaggccaccgugcgcgccgccgccagcuucgugguccucauguccggggagaacagcgcgaagcccacccagcugugggaggagugcuccagcugguacuacuacgugaccaugcccaugcccgccuccacguucaccaucgccgugggcugcuggaccgagaugaagauggagaccuggagcuccaacgaccuggccacggagcggcccuucagccccuccgaggccaacuuccgccacgucggggugugcagccacauggaguacccgugccgguuccagaacgcguccgccaccacccaggagaucaucccccaccgcgucuucgcccccgugugccucaccggcgccugccaggagacgcugcugcggcucaucccgcccugccugagcgccgcgcacuccgugcugggcgcccaccccuucagccgccucgacguccugaucgugcccgccaacuuccccucccuggggauggccagcccgcacaucauguuccucagccaguccauccugaccggcgggaaccaccugugcggcacccggcucugccacgagaucgcgcacgccugguucgggcuggccaucggcgcccgcgacuggaccgaggaguggcugagcgagggcuucgccacgcaccucgaggacguguucugggcgaccgcccagcagcuggcccccuacgaggcccgcgagcagcaggagcugcgggccugccuccgcuggcggcgccugcaggacgagaugcagugcucccccgaggagaugcagguccugcgguucccgcacgucgggggcugcagcggguccuucagcuga

SEQ ID NO: 27581 - RNA, 1386 nt, Artificial Sequence
  derived and/or modified sequence opt1 from C9orf43__Homo_sapiens__NP_001265558
auggaccugcccgacgagagccagugggacgagacgaccugcggccucgccgugugccagcacccgcagugcugggccaccauccgccggaucgagcgcgggcacccccggauccugggcuccagcugcaagacgccccuggacgcggaggacaagcuccccguccugaccgugguggacauccuggacuccggguucgccgcccaccaccucccggagugcaccuucaccaaggcccacagccugcugucccagagcuccaaguucuacagcaaguuccacggccgcccgcccaaggggcuccccgacaagucccugaucaacugcaccaaccggcugccgaaguuccccguccucaaccugaacgagacccagcugcccugccccgaggacgugcgcaacauggugguccucuggaucccggaggagaccgagauccacgugagccagcacggcaagaagaagcggaagaacuccgccgucaagagcaaguccuuccugggccugagcgggaaccaguccgcgggcacgcgcguggggacccccggcaugaucgugcccccgcccacccccgugcagcucagcgagcaguucuccagcgacuuccugccccugugggcccaguccgaggcccucccccaggaccugcugaaggagcuccugcccgggggcaagcagaccaugcugugccccgagaugaagaucaagcucgccaugaugaagaagaaccugccccuggagaagaaccggcccgacagcgucaucagcuccaagauguuccucagcauccaccgccugacgcuggagcggccggcgcuccgcuaccccgagcggcugaagaagcugcacaaccucaagaccgagggcuaccgcaagcagcagcagcggcagcagcagcagcagcagcagcagaagaaggugaagacccccaucaagaagcaggaggccaagaagaaggccaaguccgaccccgggauccagagcaccucccacaagcacccggugacgaccguccacgaccgccuguacggcuaccggacccugcccgggcagaacagcgacaugaagcagcagcagcagauggagaagggcaccacguccaagcaggacagcaccgagcgccccaagaugaacuacuacgaccacgccgacuuccaccacuccgucaagagcccggagcucuacgagaccgagcccaccaacaaggacaucuccgcccccguggacgcggugcccgaggcccaggccgcccggcagaagaagaucagcuucaacuucuccgagaucauggccagcacgggcuggaacuccgagcugaagcugcuccgcauccugcaggacaccgacgacgaggacgaggaggaccagagcuccggggcggaguga

SEQ ID NO: 27582 - RNA, 888 nt, Artificial Sequence
  derived and/or modified sequence opt1 from C9orf66__Homo_sapiens__NP_689782
augcgccacagcguggcccggcccacccgccugccgcggcgccucucccccuucugggaccccgcgaccugcaagaaccuggagggcggggccggcgaggucgugcgggggcgcgacccccggcgccugcggacgagccgcuccaccgagauccucggcgaggaccuggccgggccgagcgccggcgccgccgcgcggcccgccgcgcccccgccccagccccgcgagcccggcgcccccgggcugcggcgcgccccgccccggacccgcauggacuccagcggccucgggcccugcuccgaggcgccccugcacaccagcgccggccuguccgggcggaaccuccgcgccgccggcggcgugcugccggucgaccuggagcgggagcgcgccgcccucugcgcccggcagagcgggcacggcccgcccgccgugcgcuggcugcuggggucccgcggcgccgagagcggcgggcucgcgcggcgccggguggccgccgagcacgcccagcccuccgccaaccuggucugccgcagcgcgcuggagacguccgccuucccgcccagcaagcccaagagcccccggggccgcgugcgggcccgcuccuccgacgggcggcuccgccaccccgccuggcgggccggcagcgggggccgcggcgggcggggccccagcgcggagcuggccucccgcuacugggggcggcgccgggcccugcccggcgccgcggaccuccgccccaagggggcccgggccgacgaccgccgcccgcugcgggccggccgcaagcugcaccuccccgaggccgcgcggcugcccggcaacgugggcaagagcggggagccgcacaaggccggggaggucggcaaccacccccgcgacuccuga

SEQ ID NO: 27583 - RNA, 1446 nt, Artificial Sequence
  derived and/or modified sequence opt1 from C9orf72__Homo_sapiens__NP_060795
augagcacccugugcccgccgcccucccccgccguggccaagaccgagaucgcgcucagcggcaagagcccccugcuggccgccacguucgccuacugggacaacauccucgggccccgcguccggcacaucugggcccccaagaccgagcagguccugcugagcgacggcgagaucaccuuccucgcgaaccacacccugaacggggagauccugcgcaacgccgaguccggcgccaucgacgugaaguucuucgugcucagcgagaagggggugaucaucgugucccugaucuucgacggcaacuggaacggcgaccggagcacguacgggcuguccaucauccucccccagaccgagcugagcuucuaccugccccuccaccgcgucugcguggaccggcugacccacaucauccgcaagggccggaucuggaugcacaaggagcgccaggagaacgugcagaagaucauccuggaggggaccgagcggauggaggaccagggccaguccaucaucccgaugcucacgggggaggucauccccgugauggagcugcugagcuccaugaagucccacuccgugcccgaggagaucgacaucgccgacaccguccucaacgacgacgacaucggcgacagcugccacgagggcuuccugcugaacgcgaucuccagccaccuccagaccugcgggugcuccgugguggucggcagcagcgccgagaaggugaacaagaucgugcgcacccugugccuguuccucacgcccgccgagcggaagugcucccgccugugcgaggccgagagcuccuucaaguacgagagcgggcuguucguccagggccuccugaaggacuccaccggcagcuucgugcugccguuccgccaggugauguacgcccccuaccccaccacccacaucgacgucgacgugaacacggugaagcagaugcccccgugccacgagcacaucuacaaccagcggcgguacaugcgcuccgagcucaccgcguucuggcgggccaccagcgaggaggacauggcccaggacaccaucaucuacacggacgaguccuucacccccgaccugaacaucuuccaggacguccugcaccgcgacacccucgugaaggccuuccuggaccaggucuuccagcugaagcccgggcucagccugcgguccaccuuccuggcccaguuccuccuggugcugcaccgcaaggcgcucacgcugaucaaguacaucgaggacgacacccagaagggcaagaagcccuucaagagccugcggaaccucaagaucgaccuggaccugaccgccgagggggaccugaacaucaucauggcccucgccgagaagaucaagccgggccugcacuccuucaucuucgggcgccccuucuacaccagcgugcaggagcgcgacguccugaugacguucuga

SEQ ID NO: 27584 - RNA, 474 nt, Artificial Sequence
  derived and/or modified sequence opt1 from C9orf85__Homo_sapiens__NP_872311
augagcucccagaagggcaacguggcccgcagccggccccagaagcaccagaacaccuucuccuucaagaacgacaaguucgacaagagcguccagaccaagaagaucaacgccaagcugcacgacggggugugccagcgcugcaaggaggugcucgaguggcgggucaaguacuccaaguacaagccgcugagcaagcccaagaagugcgugaagugccugcagaagacggugaaggacuccuaccacaucaugugccgccccugcgcgugcgagcucgaggucugcgccaagugcggcaagaaggaggacaucgugaucccccugaacaaggagaccgagaagaucgagcacaccgagaacaaccugagcuccaaccaccggcgcagcugccggcgcaacgaggaguccgacgacgaccucgacuucgacaucgaccuggaggacaccgggggcgaccaccagaugaacuga

SEQ ID NO: 27585 - RNA, 1029 nt, Artificial Sequence
  derived and/or modified sequence opt1 from C9orf91__Homo_sapiens__NP_694590
auggccugcgagccccagguggacccgggcgccaccgggccccugccgcccagcucccccggcuggagcgcgcuccccgggggcuccccgcccggguggggccaggagcugcacaacggccagguccugaccgugcuccgcaucgacaacacgugcgcccccaucagcuucgaccugggggccgccgaggagcagcugcagaccuggggcauccaggugcccgccgaccaguaccggucccucgcggagagcgcccugcuggagccccagguccgccgguacaucaucuacaacucccgccccaugcggcucgccuucgccgugguguucuacgucguggugugggcgaacaucuacagcaccucccagauguucgcccuggggaaccacugggccggcaugcugcucgucacccuggccgccgugagccugacgcucacccuggugcuggucuucgagcgccaccagaagaaggcgaacaccaacaccgaccuccggcuggccgccgccaacggggcccugcuccgccaccgggugcugcugggcgugacggacaccgucgagggcugccaguccgugauccagcucugguucguguacuucgaccuggagaacugcguccaguuccugagcgaccacgugcaggagaugaagaccucccaggagagccuccugcgcucccggcugagccagcucugcguggucauggagaccgggguguccccggcgacggccgagggccccgagaaccuggaggacgcgccccugcuccccgggaacagcugcccgaacgagcgcccccugaugcagaccgagcugcaccagcucgugcccgaggccgagcccgaggagauggcccggcagcugcuggccgucuucggcggcuacuacauccgccuccuggugaccucccagcugccgcaggccauggggacccggcacacgaacagcccccgcauccccugccccugccagcucaucgaggccuacauccugggcaccgggugcugcccguuccuggcccgguga

SEQ ID NO: 27586 - RNA, 507 nt, Artificial Sequence
  derived and/or modified sequence opt1 from C9orf9__Homo_sapiens__NP_061829
augaacgaggugaaggagagccugcgcuccaucgagcagaaguacaagcuguuccagcagcagcagcucaccuucaccgccgcccuggagcacugccgggagaacgcgcacgacaagauccgccccaucagcuccaucggccagguccagagcuacauggagcacuacugcaacuccagcacggaccggcgcgugcuccugauguuccuggacaucugcuccgagcucaacaagcugugccagcacuucgaggccgugcacagcgggaccccggucaccaacaaccugcucgagaagugcaagacccuggugucccagagcaacgaccuguccagccuccgggccaaguacccccacgacguggucaaccaccuguccugcgacgaggcccgcaaccacuacggcgggguggugagccugaucccccucauccuggaccugaugaaggaguggaucgcccacuccgagaagcucccccggaagguccugcagcacggcacgaccuga

SEQ ID NO: 27587 - RNA, 987 nt, Artificial Sequence
  derived and/or modified sequence opt1 from CA10__Homo_sapiens__NP_001076003
auggagaucgugugggagguccuguuccuccugcaggccaacuucaucgugugcaucagcgcccagcagaacucccccaagauccacgagggcuggugggcguacaaggaggugguccaggggagcuucgugccggugcccuccuucuggggccuggucaacagcgccuggaaccucugcuccguggggaagcgccagagccccgugaacaucgagaccucccacaugaucuucgaccccuuccugaccccgcugcggaucaacacgggcgggcgcaaggucagcggcaccauguacaacaccggccggcacgugucccuccgccuggacaaggagcaccuggugaacaucagcgggggccccaugaccuacucccaccggcucgaggagauccgccugcacuucgggagcgaggacucccagggcagcgagcaccuccugaacgggcaggccuucuccggcgagguccagcugauccacuacaaccacgagcuguacacgaacgugaccgaggccgccaagagccccaacggccucguggucguguccaucuucaucaaggugagcgacuccagcaaccccuuccugaaccggaugcugaaccgcgacaccaucacccggaucacguacaagaacgacgcguaccuccugcaggggcugaacaucgaggagcucuacccggagaccagcuccuucaucaccuacgacggcagcaugaccaucccgcccugcuacgagacggccuccuggaucaucaugaacaagcccgucuacaucacccgcaugcagaugcacagccugcggcugcucucccagaaccagcccagccagaucuuccuguccaugagcgacaacuuccgccccgugcagccccugaacaaccggugcauccgcaccaacaucaacuucucccuccaggggaaggacugccccaacaaccgggcccagaagcugcaguaccgcgugaacgaguggcugcucaaguga

SEQ ID NO: 27588 - RNA, 987 nt, Artificial Sequence
  derived and/or modified sequence opt1 from CA11__Homo_sapiens__NP_001208
augggcgccgccgcgcgccugagcgcgccccgggcccucgugcugugggccgcccugggggccgccgcccacaucggcccggcccccgaccccgaggacuggugguccuacaaggacaaccuccaggggaacuucguccccggcccgcccuucugggggcuggugaacgcggccuggagccugugcgccgugggcaagcgccagucccccgucgacguggagcucaagcgggugcuguacgaccccuuccugccgccccuccgccugagcaccggcggggagaagcugcggggcacccucuacaacacggggcgccacgucuccuuccugcccgcgccccggccgguggugaacgucagcggcgggccccugcucuacucccaccgccugagcgagcugcggcuccuguucggcgcccgcgacggcgccggguccgagcaccagaucaaccaccagggcuucagcgccgaggugcagcugauccacuucaaccaggagcucuacgggaacuucuccgccgccagccggggccccaacggccuggccauccugucccucuucgugaacgucgcgagcaccuccaaccccuuccugagccgccugcucaaccgggacaccaucacccgcaucuccuacaagaacgacgccuacuuccugcaggaccugagccucgagcugcuguucccggaguccuucggguucaucacguaccagggcagccucagcaccccgcccugcuccgagaccgugaccuggauccugaucgaccgggcccugaacaucacgagccuccagaugcacucccugcgccugcucagccagaacccgcccucccagaucuuccagagccuguccgggaacagccggccccugcagccccucgcccaccgcgcccugcggggcaaccgcgacccccggcaccccgagcgccgcugccgggggcccaacuaccgccugcacguggacggcgucccccacggccgguga

SEQ ID NO: 27589 - RNA, 1065 nt, Artificial Sequence
  derived and/or modified sequence opt1 from CA12__Homo_sapiens__NP_001209
augccccgccggagccugcacgccgccgcggugcuccugcuggucauccucaaggagcagccguccagccccgcccccgugaacggcuccaaguggaccuacuucgggcccgacggcgagaacagcugguccaagaaguacccgagcugcgggggccugcugcagucccccaucgaccuccacagcgacauccugcaguacgacgccucccugacgccccucgaguuccagggguacaaccugagcgccaacaagcaguuccugcucaccaacaacggccacuccgugaagcugaaccugcccagcgacaugcacauccagggccuccagucccgcuacagcgccacccagcugcaccuccacugggggaacccgaacgacccccacggcuccgagcacaccgucagcgggcagcacuucgcggccgagcuccacaucgugcacuacaacuccgaccuguaccccgacgccagcaccgccuccaacaagagcgagggccuggcggugcucgccguccugaucgagauggggagcuucaaccccuccuacgacaagaucuucagccaccuccagcacgugaaguacaagggccaggaggccuucgugccgggcuucaacaucgaggagcugcugcccgagcggacggccgaguacuaccgcuaccgggggucccugaccaccccgcccugcaaccccaccguccucuggacgguguuccgcaaccccgugcagaucagccaggagcagcugcuggcccucgagaccgcgcuguacugcacccacauggacgaccccagcccccgggagaugaucaacaacuuccgccagguccagaaguucgacgagcggcugguguacaccuccuucucccaggugcaggucugcacggccgccggccucagccuggggaucauccugucccucgcccuggccggcauccugggcaucugcaucgugguggucgugagcaucuggcuguuccgccggaaguccaucaagaagggggacaacaagggcgugaucuacaagccggcgaccaagauggagaccgaggcccacgccuga

SEQ ID NO: 27590 - RNA, 789 nt, Artificial Sequence
  derived and/or modified sequence opt1 from CA13__Homo_sapiens__NP_940986
augagccgccuguccuggggcuaccgggagcacaacgggcccauccacuggaaggaguucuucccgaucgccgacggcgaccagcagagccccaucgagaucaagaccaaggaggugaaguacgacuccagccuccgcccccuguccaucaaguacgaccccagcuccgccaagaucaucagcaacuccgggcacagcuucaacgucgacuucgacgacaccgagaacaaguccgugcugcggggcgggccgcucacgggcagcuaccgccugcgccaggugcaccuccacuggggcuccgcggacgaccacgggagcgagcacaucgucgacggcguguccuacgccgccgagcugcacgugguccacuggaacagcgacaaguaccccuccuucguggaggccgcccacgagcccgacgggcuggcggugcugggcgucuuccuccagaucggggagcccaacagccagcugcagaagaucaccgacacccuggacuccaucaaggagaagggcaagcagacccgguucacgaacuucgaccuccugagccugcucccgcccagcugggacuacuggaccuaccccggcucccugaccgugcccccgcugcucgagagcgugaccuggaucguccugaagcagcccaucaacaucuccagccagcagcuggccaaguuccggucccuccugugcacggccgagggggaggccgcggccuuccuggugagcaaccaccgcccgccccagccccucaagggccggaaggugcgcgccuccuuccacuga

SEQ ID NO: 27591 - RNA, 786 nt, Artificial Sequence
  derived and/or modified sequence opt1 from CA1__Homo_sapiens__XP_011515886
auggccagccccgacuggggcuacgacgacaagaacgggccggagcagugguccaagcuguaccccaucgccaacggcaacaaccagagccccguggacaucaagaccuccgagaccaagcacgacacgagccucaagcccaucuccgucagcuacaacccggcgaccgccaaggagaucaucaacguggggcacuccuuccacgugaacuucgaggacaacgacaaccgcagcguccugaagggcgggcccuucuccgacagcuaccggcuguuccaguuccacuuccacuggggcuccaccaacgagcacggcagcgagcacaccguggacggggugaaguacuccgccgagcuccacgucgcccacuggaacagcgccaaguacuccagccuggcggaggccgccuccaaggccgacggccuggcggugaucggggugcucaugaaggucggcgaggccaaccccaagcugcagaaggugcuggacgcccuccaggccaucaagacgaaggggaagcgcgcccccuucaccaacuucgacccgagcacccugcugcccuccagccucgacuucuggaccuaccccggcagccugacgcacccgccccuguacgaguccgugaccuggaucaucugcaaggagagcaucuccgucagcuccgagcagcucgcgcaguuccggagccugcuguccaacguggagggcgacaacgccgugcccaugcagcacaacaaccgccccacccagccccucaaggggcggaccguccgcgccagcuucuga

SEQ ID NO: 27592 - RNA, 783 nt, Artificial Sequence
  derived and/or modified sequence opt1 from CA2__Homo_sapiens__NP_000058
augagccaccacuggggcuacgggaagcacaacggccccgagcacuggcacaaggacuucccgaucgccaagggggagcgccagucccccguggacaucgacacccacaccgccaaguacgaccccagccugaagccccucuccgucagcuacgaccaggcgacgucccugcggauccugaacaacggccacgccuucaacguggaguucgacgacagccaggacaaggccgugcucaagggcgggccgcuggacggcaccuaccgccugauccaguuccacuuccacugggggucccucgacggccaggggagcgagcacaccgucgacaagaagaaguacgccgccgagcugcaccuggugcacuggaacaccaaguacggcgacuucgggaaggcggugcagcagcccgacggccucgccguccugggcaucuuccugaaggugggguccgccaagcccggccuccagaagguggucgacgugcuggacagcaucaagacgaaggggaaguccgccgacuucaccaacuucgacccccggggccugcucccggagagccuggacuacuggaccuaccccggcucccugaccacgccgccccuccuggagugcgugaccuggaucguccugaaggagcccaucagcguguccagcgagcagguccucaaguuccgcaagcugaacuucaacggggagggcgagcccgaggagcugaugguggacaacuggcggcccgcgcagccccucaagaaccgccagaucaaggccuccuucaaguga

SEQ ID NO: 27593 - RNA, 783 nt, Artificial Sequence
  derived and/or modified sequence opt1 from CA3__Homo_sapiens__NP_005172
auggccaaggaguggggcuacgccagccacaacgggcccgaccacuggcacgagcuguuccccaacgcgaagggcgagaaccagucccccguggagcuccacaccaaggacauccgccacgaccccagccugcagcccugguccgucagcuacgacgggggcuccgccaagaccauccugaacaacgggaagacgugccgggugguguucgacgacaccuacgaccgcagcaugcuccggggcggcccgcugcccgggcccuaccgccugcggcaguuccaccuccacuggggcuccagcgacgaccacggguccgagcacaccgucgacggcgugaaguacgccgccgagcugcaccuggugcacuggaaccccaaguacaacaccuucaaggaggcccucaagcagcgcgacgggaucgcggucaucggcaucuuccugaagaucggccacgagaacggggaguuccagaucuuccuggacgcccucgacaagaucaagacgaagggcaaggaggccccguucaccaaguucgaccccagcugccuguuccccgccugccgggacuacuggaccuaccagggguccuucaccacgcccccgugcgaggagugcaucguguggcugcuccugaaggagcccaugaccgugagcuccgaccagauggcgaagcugcgcagccuccuguccagcgccgagaacgagccgcccgucccccugguguccaacuggcggccgccccagcccaucaacaaccgcgugguccgggccagcuucaaguga

SEQ ID NO: 27594 - RNA, 939 nt, Artificial Sequence
  derived and/or modified sequence opt1 from CA4__Homo_sapiens__NP_000708
augcgcaugcugcucgcccugcuggcccucagcgcggcccggcccuccgccagcgccgagucccacuggugcuacgaggugcaggccgagagcuccaacuacccgugccugguccccgugaaguggggcgggaacugccagaaggaccgccagagccccaucaacaucgugaccaccaaggcgaaggucgacaagaagcugggccgguucuucuucuccggguacgacaagaagcagacguggaccgugcagaacaacggccacagcgugaugaugcuccuggagaacaaggccuccaucagcgggggcggccugcccgccccguaccaggccaagcagcuccaccuccacugguccgaccugcccuacaaggggagcgagcacucccuggacggcgagcacuucgcgauggagaugcacaucguccacgagaaggagaaggggaccagccgcaacgugaaggaggcccaggaccccgaggacgagaucgccgugcuggccuuccuggucgaggccggcacccaggugaacgagggguuccagccccucguggaggcgcuguccaacaucccgaagcccgagaugagcacgaccauggccgaguccagccugcucgaccugcugcccaaggaggagaagcuccggcacuacuuccgcuaccugggcucccugaccacccccacgugcgacgagaaggucguguggaccguguuccgggagccgauccagcuccaccgcgagcagauccuggccuucagccagaagcuguacuacgacaaggagcagaccgucagcaugaaggacaacgugcggccccuccagcagcugggccagcgcaccgugaucaaguccggggcccccggccggccccugccgugggcccuccccgcgcugcuggggcccaugcucgccugccugcuggccggcuuccuccgcuga

SEQ ID NO: 27595 - RNA, 918 nt, Artificial Sequence
  derived and/or modified sequence opt1 from CA5A__Homo_sapiens__NP_001730
augcugggccgcaacaccuggaagaccagcgccuucuccuuccucguggagcagaugugggccccccuguggagccgguccaugcgcccggggcgguggugcagccagcgcuccugcgcguggcagacgagcaacaacacccugcacccccucuggaccguccccguguccgugcccggcgggacccggcagagcccgaucaacauccaguggcgcgacuccgucuacgacccccagcugaagccccugcgggugagcuacgaggccgccuccugccucuacaucuggaacacgggcuaccuguuccagguggaguucgacgacgccaccgaggccagcgggaucuccggcggcccccuggagaaccacuaccgccucaagcaguuccacuuccacuggggggcggucaacgagggcgggagcgagcacaccguggacggccacgccuacccggccgagcugcaccuggugcacuggaacuccgucaaguaccagaacuacaaggaggccguggugggggagaacggccucgcggucaucggcguguuccugaagcugggggcccaccaccagacccuccagcggcugguggacauccugcccgagaucaagcacaaggacgcccgcgccgccaugcggcccuucgaccccagcacgcuccugccgaccugcugggacuacuggaccuacgcgggcucccugaccacgcccccccucaccgagagcgucaccuggaucauccagaaggagcccguggagguggccccgucccagcugagcgccuuccgcacccugcucuucagcgcccugggggaggaggagaagaugauggucaacaacuaccggccccugcagccccucaugaaccgcaaggugugggccuccuuccaggcgacgaacgagggcacccggagcuga

SEQ ID NO: 27596 - RNA, 885 nt, Artificial Sequence
  derived and/or modified sequence opt1 from CA6__Homo_sapiens__XP_011540385
augugcagcaccaugcgcgcccuggugcuccugcugucccucuuccugcugggcgggcaggcccagcacgucagcgacuggaccuacuccgagggcgcgcucgacgaggcccacuggccccagcacuacccggccugcgggggccagcggcagagccccaucaaccugcagcgcacgaaggugcgguacaaccccucccugaaggggcucaacaugaccggcuacgagacccaggccggcgaguuccccauggugaacaacgggcacaccguccagaucagccugccguccacgaugcgcaugaccguggccgacggcaccguguacaucgcgcagcagaugcacuuccacuggggcggggccagcuccgagaucagcggguccgagcacaccgucgacggcauccggcacgugaucgagauccacaucgugcacuacaacagcaaguacaaguccuacgacaucgcccaggacgcccccgacggccuggcgguccucgccgccuucguggaggugaagaacuaccccgagaacacguacuacagcaacuucaucucccaccuggccaacaucaaguaccccgggcagcgcaccacccugaccggccucgacguccaggacaugcugccgcggaaccugcagcacuacuacacguaccacgggagccucaccaccccgcccugcaccgagaacgugcacugguucgugcuggccgacuucgucaagcugucccgcacccagguguggaagcucgagaacagccugcuggaccaccggaacaagacgauccacaacgacuaccgccggacccagccccucaaccaccgcguggucgaguccaacuuccccaaccaggagaacugcauccccgcgggccugaucuga

SEQ ID NO: 27597 - RNA, 873 nt, Artificial Sequence
  derived and/or modified sequence opt1 from CA8__Homo_sapiens__NP_004047
auggccgaccugagcuucaucgaggacaccguggccuuccccgagaaggaggaggacgaggaggaggaggaggagggcgucgaguggggguacgaggagggcguggagugggggcucguguucccggacgcgaacggcgaguaccagucccccaucaaccugaacagccgcgaggcccgguacgaccccucccugcucgacguccgccugagccccaacuacguggugugccgggacugcgaggucaccaacgacgggcacacgauccaggugauccugaaguccaagagcgugcucuccggcggcccgcugccccaggggcacgaguucgagcuguacgagguccgcuuccacuggggccgggagaaccagcgcgggagcgagcacaccgugaacuucaaggccuuccccauggagcuccaccugauccacuggaacuccacccuguucggcagcaucgacgaggccguggggaagccccacggcaucgccaucaucgcccucuucguccagaucggcaaggagcacguggggcugaaggcggugaccgagauccugcaggacauccaguacaagggcaaguccaagacgaucccgugcuucaaccccaacacccuccugcccgacccccugcuccgggacuacugggucuacgaggggagccugaccaucccgcccugcuccgagggcgugaccuggauccuguuccgcuacccccucacgaucagccagcugcagaucgaggaguuccggcgccugcggacccacgugaagggcgccgagcucgucgaggggugcgacggcauccugggggacaacuuccgccccacccagccgcuguccgaccgggugauccgcgccgcguuccaguga

SEQ ID NO: 27598 - RNA, 1026 nt, Artificial Sequence
  derived and/or modified sequence opt1 from CAB39__Homo_sapiens__NP_001124322
augcccuucccguucggcaagagccacaagucccccgccgacaucgugaagaaccugaaggagagcauggccguccucgagaagcaggacaucuccgacaagaaggcggagaaggccaccgaggaggugagcaagaaccugguggccaugaaggagauccuguacgggaccaacgagaaggagccccagacggaggccgucgcccagcucgcgcaggagcuguacaacuccggccugcucagcacccugguggccgaccugcagcucaucgacuucgaggggaagaaggacguggcccagaucuucaacaacauccugcgccggcagaucggcacccgcacccccacggucgaguacaucugcacccagcagaacauccuguucaugcuccugaagggguacgaguccccggagaucgcccugaacugcggcaucaugcuccgggagugcauccgccacgagccccuggcgaagaucauccuguggagcgagcaguucuacgacuucuuccgguacguggagauguccaccuucgacaucgccagcgacgccuucgccaccuucaaggaccuccugacgcgccacaagcugcucuccgccgaguuccuggagcagcacuacgaccgguucuucagcgaguacgagaagcugcuccacuccgagaacuacgugaccaagcgccagagccugaagcugcucggcgagcugcugcucgaccggcacaacuucaccaucaugaccaaguacaucuccaagcccgagaaccugaagcugaugaugaaccuccugcgcgacaagagccggaacauccaguucgaggcguuccacgucuucaagguguucguggccaaccccaacaagacgcagccgauccuggacauccuccugaagaaccaggccaagcugaucgaguuccucuccaaguuccagaacgaccgcaccgaggacgagcaguucaacgacgagaagaccuaccuggucaagcagauccgggaccugaagcgccccgcccagcaggaggccuga

SEQ ID NO: 27599 - RNA, 1014 nt, Artificial Sequence
  derived and/or modified sequence opt1 from CAB39L__Homo_sapiens__NP_001274268
augaagaagaugccccuguucagcaagucccacaagaacccggccgagaucgugaagauccucaaggacaaccuggccauccuggagaagcaggacaagaagaccgacaaggcgagcgaggaggucuccaagagccuccaggccaugaaggagauccugugcggcaccaacgagaaggagccgcccacggaggccguggcccagcuggcccaggagcucuacuccagcgggcugcuggugacccucaucgcggaccugcagcugaucgacuucgagggcaagaaggacgucacccagaucuucaacaacauccuccgccggcagaucgggacccgcucccccacgguggaguacaucagcgcccacccccacauccuguucaugcugcucaagggcuacgaggcgccccagaucgcccugcggugcgggaucaugcugcgcgagugcauccggcacgagccccucgccaagaucauccuguucuccaaccaguuccgcgacuucuucaaguacguggagcugagcaccuucgacaucgccuccgacgccuucgccaccuucaaggaccuccugacccggcacaagguccugguggccgacuuccucgagcagaacuacgacacgaucuucgaggacuacgagaagcugcugcagagcgagaacuacgugaccaagcgccagucccucaagcugcugggcgagcucauccuggaccggcacaacuucgcgaucaugaccaaguacaucagcaagcccgagaaccugaagcucaugaugaaccugcugcgcgacaaguccccgaacauccaguucgaggccuuccacgucuucaagguguucguggccagcccccacaagacccagcccaucgucgagauccuccugaagaaccagcccaagcugaucgaguuccucuccagcuuccagaaggagcggacggacgacgagcaguucgccgacgagaagaacuaccugaucaagcagauccgcgaccugaagaagaccgccccguga

SEQ ID NO: 27600 - RNA, 6663 nt, Artificial Sequence
  derived and/or modified sequence opt1 from CABIN1__Homo_sapiens__NP_036427
augauccgcaucgccgcccugaacgcgagcagcaccaucgaggacgaccacgagggcagcuucaagucccacaagacccagaccaaggaggcccaggaggccgaggccuucgcccuguaccacaaggcgcuggaccugcagaagcacgaccgguucgaggagagcgccaaggccuaccacgagcuccuggaggccucccugcuccgcgaggcggugagcuccggggacgagaaggagggccugaagcaccccgggcugauccucaaguacagcaccuacaagaaccuggcccagcuggccgcccagcgggaggaccucgagaccgccauggaguucuaccuggaggcggugaugcuggacuccaccgacgugaaccucugguacaagaucggccacguggcccugcgccugauccggaucccccucgcccgccacgccuucgaggaggggcugcggugcaaccccgaccacuggcccugccuggacaaccucaucaccgugcuguacacccugagcgacuacacgaccugccucuacuucaucugcaaggcccuggagaaggacugccgcuacuccaagggccuggugcucaaggagaagaucuucgaggagcagcccugccugcggaaggacagccugcgcauguuccucaagugcgacauguccauccacgacgugagcgucuccgcggccgagacccaggccaucguggacgaggcccugggccugcggaagaagcgccaggcccucaucgugcgggagaaggagcccgaccugaagcugguccagcccauccccuucuucaccuggaagugccucggggagagccugcuggcgauguacaaccaccucacgaccugcgagccgccccgccccucccugggcaagcggaucgaccugagcgacuaccaggaccccucccagccccucgagagcagcaugguggugacccccgucaacgugauccagcccuccaccgugagcaccaaccccgccgucgccguggccgagcccguggucuccuacaccagcguggccacgaccuccuucccccugcacagccccgggcugcucgagaccggcgcgcccgugggggacaucuccggcggcgacaagagcaagaagggggucaagcgcaagaagaucuccgaggagagcggcgagaccgccaagcggcgcuccgcccgggugcgcaacacgaagugcaagaaggaggagaagguggacuuccaggagcugcugaugaaguuccuccccagccggcugcgcaagcuggaccccgaggaggaggacgacuccuucaacaacuacgagguccagagcgaggccaagcuggaguccuuccccagcaucgggccccagcgccucuccuucgacagcgcgaccuucauggaguccgagaagcaggacgugcacgaguuccugcuggagaaccucaccaacggcggcauccuggagcugaugaugcgguaccucaaggccauggggcacaaguuccugguccgcuggccgcccggccuggccgagguggugcucagcgucuaccacagcuggcggcgccacuccaccagccugcccaacccccugcuccgggacugcuccaacaagcacaucaaggacaugaugcugaugagccuguccugcauggagcuccagcuggaccaguggcugcucacgaaggggcgcagcuccgccgugagcccccggaacugccccgccggcauggugaacgggcgcuucggccccgacuuccccggcacccacugccugggggaccugcuccagcuguccuucgcgagcucccagcgggaccuguucgaggacggcuggcucgaguucgucgugcgcguguacuggcugaaggcccgguuccuggcccuccagggggacauggagcaggcccuggagaacuacgacaucugcaccgagaugcugcagagcuccaccgccauccaggucgaggcgggcgccgagcgccgggacaucgugauccgccuccccaaccugcacaacgacagcguggucucccuggaggagaucgacaagaaccucaagagccuggagcggugccagucccuggaggagauccagcgccucuacgaggccggggacuacaaggccguggugcaccuccugcggcccacgcucugcaccagcggcuucgaccgcgccaagcaccuggaguucaugaccagcauccccgagcggcccgcgcagcugcuccugcugcaggacucccuccugcgccugaaggacuaccgccagugcuucgagugcagcgacgucgcccucaacgaggccgugcagcagauggugaacuccggcgaggccgcggccaaggaggagugggucgccaccgugacgcagcugcugauggggaucgagcaggcccucagcgccgacuccagcggcuccauccugaaggugagcuccagcaccaccgggcugguccggcucaccaacaaccugauccaggugaucgacugcuccauggcggugcaggaggaggccaaggagccgcacgucagcuccgugcugcccuggaucauccuccaccgcaucaucuggcaggaggaggacacguuccacagccugugccaccagcagcagcugcagaaccccgccgaggagggcauguccgagacccccaugcucccgagcucccugaugcugcucaacaccgcccacgaguaccuggggcggcgcagcuggugcugcaacuccgacggcgcccugcuccgguucuacgugcgcguccugcagaaggagcuggcggccagcaccagcgaggacacccaccccuacaaggaggagcucgagacggcccuggagcagugcuucuacugccuguacuccuuccccagcaagaaguccaaggcccgguaccucgaggagcacagcgcccagcaggucgaccugaucugggaggacgcgcuguucauguucgaguacuucaagcccaagacccucccggaguucgacuccuacaagaccagcaccguguccgccgaccuggccaaccugcucaagcgcaucgccacgaucgucccccggaccgagcgccccgcgcugagccuggacaagguguccgccuacaucgagggcaccagcaccgaggugcccugccucccggagggggccgaccccagcccgcccgucgugaacgagcuguacuaccugcucgccgacuaccacuucaagaacaaggagcagagcaaggccaucaaguucuacaugcacgacaucugcaucugcccgaaccgguucgacuccugggcgggcauggcccuggcccgcgccagccggauccaggacaagcugaacuccaacgagcucaagagcgacgggcccaucuggaagcacgccacgcccgugcugaacugcuuccgccgggcgcuggagaucgacuccagcaaccucucccuguggaucgaguacggcaccaugagcuacgcccugcacagcuucgccucccgccagcucaagcaguggcggggcgagcugcccccggagcugguccagcagauggaggggcgccgggacagcaugcuggagaccgccaagcacugcuucaccuccgccgcgcgcugcgagggcgacggggacgaggaggaguggcucauccacuacaugcugggcaagguggccgagaagcagcagcagccgcccacgguguaccugcuccacuaccggcaggccgggcacuaccugcacgaggaggccgcccgcuacccgaagaagauccacuaccacaacccgcccgagcuggcgauggaggcccucgaggucuacuuccgccugcacgccagcauccugaagcuccugggcaagcccgacuccggcgugggggccgaggugcuggucaacuucaugaaggaggcggccgagggcccguucgcccgcggggaggagaagaacacccccaaggccagcgagaaggagaaggccugccucguggacgaggacucccacagcuccgcgggcacccugcccgggcccggcgccagccugccguccagcuccggccccgggcucaccuccccgcccuacacggccaccccgaucgaccacgacuacgugaagugcaagaagccccaccagcaggccacccccgacgaccgcucccaggacagcaccgccgucgcgcuguccgacagcuccagcacgcaggacuucuucaacgagcccaccagccugcucgagggcucccggaaguccuacaccgagaagcgccugccgauccuguccagccaggccggggccaccggcaaggaccuccagggggccacggaggagcggggcaagaacgaggagucccuggagagcaccgagggcuuccgcgccgcggagcagggggugcagaagcccgccgccgagacccccgccuccgcgugcauccccggcaagccgagcgccuccacccccacgcugugggacgggaagaagcggggcgaccuccccggggagcccguggccuucccgcagggccugcccgccggcgccgaggagcagcgccaguuccugaccgagcagugcaucgcgagcuuccggcucugccugucccgcuucccccagcacuacaagagccuguaccggcucgccuuccuguacaccuacuccaagacccaccgcaaccugcagugggcccgggacguccuccuggggagcuccauccccuggcagcagcugcagcacaugccggcccagggccucuucugcgagcgcaacaagacgaacuucuucaacgggaucuggcggauccccguggacgagaucgaccgccccggcagcuucgccuggcacaugaaccgguccaucgugcugcugcucaagguccuggcgcagcugcgcgaccacagcacccuccugaagguguccagcaugcugcagcggaccccggaccagggcaagaaguaccuccgcgacgccgaccgccagguccuggcccagcgggccuucauccugaccgugaaggugcucgaggacacgcugagcgagcuggccgagggguccgagcgccccggccccaaggucugcgggcuccccggcgcgcggaugaccaccgacgugagccacaaggccuccccggaggacgggcaggagggccugccccagcccaagaagcccccgcuggccgacggcagcgggcccggccccgagcccgggggcaagguggggcuccugaaccaccgcccggucgccauggacgcgggcgacuccgccgaccagagcggcgagcggaaggacaaggagagcccccgggccgggcccaccgagcccauggacaccagcgaggccacggugugccacuccgaccuggagcggaccccgccccuccugcccggccgccccgcccgggaccgcgggccggagagccggcccaccgagcugucccucgaggagcugagcaucuccgcgcgccagcagcccacgccccugacgccggcccagcccgcccccgcccccgccccggcgaccaccaccggcacgcgggccgggggccaccccgaggagccccucagccgccugucccggaagcgcaagcugcucgaggacaccgagagcggcaagacccugcugcucgacgccuaccggguguggcagcaggggcagaagggcgucgccuacgaccuggggcgcguggagcggaucauguccgagaccuacaugcugaucaagcaggucgacgaggaggccgcgcucgagcaggccgucaaguucugccaggugcaccugggcgccgccgcccagcgccaggcgagcggcgacacgccgaccacccccaagcaccccaaggacucccgggagaacuucuuccccgugaccgucgugccgacggcccccgaccccgugcccgccgacagcguccagcgcccgagcgacgcccacaccaagccccgccccgcgcuggccgccgccaccaccaucaucacgugcccgcccuccgccagcgcguccacccucgaccagagcaaggaccccgggccgccccggccccaccgccccgaggccacccccuccauggccagccugggccccgagggggaggagcuggcccggguggccgagggcaccuccuucccgccccaggagccccgccacagcccccaggugaagauggcgccgacguccagccccgccgagccccacugcuggccggccgaggccgcccucgggaccggcgcggagccgaccugcucccaggagggcaagcugcggcccgagccccgccgggacggggaggcccaggaggccgccagcgagacccagccgcuguccuccccgcccacggcggccuccagcaaggcccccuccagcggcagcgcccagccgcccgaggggcaccccggcaagcccgagccgucccgcgccaagagccggccccuccccaacaugcccaagcuggucaucccguccgcggccaccaaguucccgcccgagaucaccgugacgccgcccacgcccacccugcucagccccaagggguccaucagcgaggagaccaagcagaagcugaaguccgccauccugagcgcccaguccgccgcgaacgugcgcaaggagagccucugccagcccgcccuggagguccuggagaccuccagccaggaguccagccucgaguccgagacggacgaggacgacgacuacauggacaucuga

SEQ ID NO: 27601 - RNA, 1902 nt, Artificial Sequence
  derived and/or modified sequence opt1 from CABLES1__Homo_sapiens__NP_001094089
auggccgccgcggccgccgccgccaccaccgcggccugcagcuccggcagcgccgggacggacgccgcgggcgccuccgggcugcagcagcccccgccccagccccagccccagccggccgccgccgcgcccgcccagccccccccggagcccccccgcaagccccggauggacccgcgccggcgccaggccgcccucagcuuccugaccaacaucucccuggacggccggcuccccccccaggacgccgagugggggggcggcgaggaggggggcgcggccaagcccggggccggcggggccugcggcgcccgcacccgguucagccugcuggcggccgccgagcgcggcgggugcaucgcccucgccgcgccgggcacccccgccgccgggcuggccgcgggcuccggccccugccugccccagccgagcucccuccccccccugauccccgggggccacgccacggugagcgggccgggcgucgcccggggguucgccuccccccugggcgccggccgcgcgagcggggagcaguggcagcccccccggccggccccccucgccgccugcgcccagcugcagcugcucgacggcuccggggcggccggccaggaggagcuggaggaggacgacgccuucaucagcgugcaggugcccgccgccgcguuccugggguccggcaccccgggcagcggguccggcagccgcgggcggcucaacuccuucacccagggcauccugcccaucgccuucagccgccccaccagccagaacuacugcucccuggagcagcccgggcagggcggcagcacguccgccuucgagcagcuccagcggagccgccggcgccugaucucccagcggagcucccuggagacccucgaggacaucgaggagaacgccccgcugcgccggugccgcacccugagcggguccccccgccccaagaacuucaagaagauccacuucaucaagaacaugcggcagcacgacacccgcaacggccggaucguccucaucagcgggcgccgguccuucugcagcaucuucuccgugcugcccuaccgcgacagcacgcaggugggcgaccugaagcucgacggcgggcggcaguccaccggcgcggucagccugaaggagaucaucgggcuggagggcguggagcucggggccgacggcaagaccguguccuacacccaguuccugcugccgacgaacgccuucggcgcccgccggaacaccaucgacagcaccuccagcuucagccaguuccgcaaccucucccaccggagccuguccaucgggcgcgccagcggcacccaggggucccuggacacgggcagcgaccucggggacuucauggacuacgaccccaaccugcuggacgacccccaguggcccugcggcaagcacaagcggguccucaucuucccguccuacaugaccaccgugaucgacuacgugaagcccagcgaccugaagaaggacaugaacgagaccuucaaggagaaguucccccacaucaagcugacgcucuccaagauccgcagccugaagcgggagaugcgcaagcuggcgcaggaggacugcggccucgaggagcccaccgucgccauggccuucguguacuucgagaagcuggcccugaaggggaagcugaacaagcagaaccggaagcucugcgccggcgcgugcgugcugcuggccgccaagaucggguccgaccucaagaagcacgaggucaagcaccugaucgacaagcuggaggagaaguuccgccucaaccggcgcgagcugaucgccuucgaguucccggugcugguggcccucgaguucgcgcugcaccugcccgagcacgaggucaugccccacuaccgccggcucgugcagagcuccuga

SEQ ID NO: 27602 - RNA, 663 nt, Artificial Sequence
  derived and/or modified sequence opt1 from CABP2__Homo_sapiens__NP_057450
augggcaacugcgccaagcgccccuggcggcgcgggccgaaggacccccugcaguggcucggcagcccgccccggggguccugccccagccccuccagcucccccaaggagcagggcgaccccgccccgggggugcagggcuacagcguccugaacucccuggugggccccgcgugcaucuuccuccgccccagcaucgccgccacccagcuggaccgggagcugcgccccgaggagaucgaggagcuccagguggccuuccaggaguucgaccgggaccgcgacggguacaucggcugccgggagcugggggccugcaugcgcacccugggcuacaugccgacggagauggagcucaucgagaucucccagcagaucagcgggggcaaggucgacuucgaggacuucguggagcugaugggccccaagcugcucgcggagaccgccgacaugaucggggugcgggagcugcgcgacgccuuccgggaguucgacaccaacggcgacgggcgcaucuccgucggcgagcugcgggccgcgcucaaggcccugcugggcgagcgccucagccagcgggagguggacgagauccugcaggacguggaccugaacggggacggccucgucgacuucgaggaguucgugcgcaugaugucccgguga

SEQ ID NO: 27603 - RNA, 513 nt, Artificial Sequence
  derived and/or modified sequence opt1 from CABP4__Homo_sapiens__NP_001287824
augaccgagcccuggcuggcccucggcaccagcuggacgcugccgcugcaggaccgcgagcucgggcccgaggagcuggacgagcugcaggccgcguucgaggaguucgacaccgaccgggacggcuacaucucccaccgcgagcucggggacugcaugcggacccugggcuacaugcccaccgagauggagcugcucgaggugagccagcacaucaagaugcgcaugggcgggcgggucgacuucgaggaguucguggagcugaucggccccaagcugcgcgaggagacggcccacaugcucggggugcgggagcugcgcaucgccuuccgggaguucgaccgcgaccgggacggccgcaucaccgucgccgagcugcgggaggccgugccggcgcuccugggggagccccuggccggccccgagcucgacgagaugcugcgcgagguggaccugaacggggacggcaccgucgacuucgacgaguucgugaugaugcucucccggcacuga

SEQ ID NO: 27604 - RNA, 1188 nt, Artificial Sequence
  derived and/or modified sequence opt1 from CABS1__Homo_sapiens__NP_149113
auggccgaggacggccugcccaagaucuacagccacccgcccaccgaguccagcaagacccccacggccgcgaccaucuucuucggggccgacaacgccauccccaaguccgagaccaccaucacgagcgagggcgaccacgugaccuccgucaacgaguacaugcucgagagcgacuucuccaccaccacggacaacaagcugaccgccaagaaggagaagcugaaguccgaggacgacauggggaccgacuucaucaagagcaccacgcaccuccagaaggagaucaccagccugaccggcaccacgaacuccaucacccgcgacagcaucaccgagcacuucaugccggugaagaucgggaacaucuccagccccgugaccacggucucccugaucgacuucagcaccgacaucgccaaggaggacauccuccuggcgaccaucgacaccggcgacgccgagaucuccaucacgagcgagguguccggcacccugaaggacagcagcgccgggguggccgacgcgcccgccuucccccggaagaaggacgaggccgacauguccaacuacaacagcuccaucaagagcaacgucccggccgacgaggccguccaggugaccgacuccaccauccccgaggcggagaucccgcccgcccccgaggagagcuucacgaccauccccgacaucaccgcccucgaggaggagaagaucaccgagaucgaccuguccgugcuggaggacgacacgagcgccguggccacccucaccgacuccgacgagaaguucaucaccguguucgagcugacgaccagcgcggagaaggacaaggacaagcgcgaggacacccugcucaccgacgaggagaccacggagggcgccuccaucuggauggagcgggacaccgccaacgaggccgagacccacagcguccugcugaccgccguggagucccgcuacgacuucgugguccccgcgagcaucgccacgaaccucguggaggaguccagcaccgaggaggaccuguccgagaccgacaacaccgagacggugcccaagaucaccgagccguucagcgggaccaccuccguccuggacacgcccgacuacaaggaggacaccagcaccaccgagacggacaucuucgagcuccugaaggaggagcccgacgaguucaugaucuga

SEQ ID NO: 27605 - RNA, 1482 nt, Artificial Sequence
  derived and/or modified sequence opt1 from CABYR__Homo_sapiens__NP_036321
augaucagcuccaagccccgccugguggugccguacggccucaagacccugcuggaggggaucagccgggccgugcucaagaccaaccccuccaacaucaaccaguucgccgcggccuacuuccaggagcugacgauguaccgcggcaacaccaccauggacaucaaggaccuggugaagcaguuccaccagaucaaggucgagaaguggagcgaggggaccacgccccagaagaagcucgagugccugaaggagcccggcaagaccuccguggagagcaaggugccgacccagauggagaaguccaccgacacggacgaggacaacgucacccggaccgaguacagcgacaagaccacgcaguuccccuccguguacgccgugcccgggaccgagcagaccgaggccgucggcggccugagcuccaagcccgccaccccgaagacgaccaccccgcccagcagcccgccgcccaccgcggugagccccgaguucgccuacgugcccgccgaccccgcccagcucgcggcccagaugcuggggaaggucuccagcauccacuccgaccagagcgacgugcugaugguggacgucgccacguccaugcccguggugaucaaggagguccccagcagcgaggccgccgaggacgugaugguggcggcgccccucgucugcuccggcaaggugcuggaggugcaggucgugaaccagaccagcguccacguggaccuggggucccagcccaaggagaacgaggccgagcccagcaccgccuccagcgugccccuccaggacgagcaggagcccccggccuacgaccaggcccccgaggucacccugcaggccgacaucgaggugauguccacggugcacaucagcuccgucuacaacgacgugcccgugaccgagggcgucguguacaucgagcagcugcccgagcagaucgugaucccguucaccgaccaggucgccugccucaaggagaacgagcagagcaaggagaacgagcagagcccccgcgugagccccaaguccguggucgagaagaccacgagcgggauguccaagaaguccguggaguccgugaagcuggcccagcuggaggagaacgccaaguacagcuccgucuacauggaggcggaggccaccgcccuccugagcgacaccagccugaagggccagccggaggugcccgcccagcuccuggacgccgagggcgcgaucaagaucggguccgagaagucccugcaccucgagguggagaucaccuccaucgucagcgacaacacgggccaggaggaguccggggagaacagcgugccccaggagauggagggcaagcccgugcuguccggcgaggccgccgaggccguccacagcgggaccuccgucaagagcuccagcggcccguucccgcccgcgcccgaggggcugaccgcccccgagaucgagcccgagggcgaguccaccgccgaguga

SEQ ID NO: 27606 - RNA, 6786 nt, Artificial Sequence
  derived and/or modified sequence opt1 from CACNA1A__Homo_sapiens__NP_001120693
auggcccgcuucggcgacgagaugcccgcccgguacgggggcgggggcuccggggcggccgccggcgugguggugggcuccgggggcgggcgcggcgccgggggcagccggcagggcgggcagcccggcgcccagcgcauguacaagcaguccauggcgcagcgggcccgcaccauggcccuguacaaccccauccccgugcggcagaacugccucaccgucaaccgcagccuguuccuguucuccgaggacaacguggugcggaaguacgccaagaagaucaccgaguggccgcccuucgaguacaugauccucgcgaccaucaucgccaacugcaucguccuggcccuggagcagcaccuccccgacgacgacaagacccccaugagcgagcgccuggacgacaccgagcccuacuucaucgggaucuucugcuucgaggccggcaucaagaucaucgcccugggcuucgcguuccacaagggguccuaccuccggaacggcuggaacgugauggacuucguggucgugcugacggggauccuggccaccgugggcaccgaguucgaccuccgcacccugcgggccguccgcgugcugcggccccucaagcuggugagcgggauccccucccugcaggucgugcucaagagcaucaugaaggccaugaucccccugcugcagaucggccuccugcuguucuucgccauccucaucuucgcgaucaucggccuggaguucuacauggggaaguuccacacgaccugcuucgaggagggcaccgacgacauccagggggagucccccgcccccugcggcaccgaggagcccgcccgcacgugccccaacgggaccaagugccagcccuacugggagggccccaacaacggcaucacccaguucgacaacauccuguucgccgugcucaccgucuuccagugcaucacgauggagggguggaccgaccugcuguacaacagcaacgacgccuccggcaacaccuggaacuggcucuacuucaucccccugaucaucaucgggagcuucuucaugcugaaccucgugcugggcgugcuguccggggaguucgcgaaggagcgggagcgcgucgagaaccggcgcgccuuccucaagcugcggcgccagcagcagaucgagcgcgagcugaacggcuacauggaguggaucagcaaggccgaggaggugauccucgccgaggacgagaccgacggcgagcagcggcaccccuucgacggggcccugcgccggacgaccaucaagaaguccaagaccgaccugcucaaccccgaggaggcggaggaccagcuggccgacaucgccagcgugggcucccccuucgcccgcgcgagcaucaagagcgccaagcuggagaacuccaccuucuuccacaagaaggagcggcgcaugcgguucuacauccgccggauggucaagacgcaggccuucuacuggaccgugcucagccuggucgcccugaacacccucugcguggccaucgugcacuacaaccagcccgaguggcuguccgacuuccuguacuacgcggaguucaucuuccugggccuguucaugagcgagauguucaucaagauguacggccugggcacccgccccuacuuccacuccagcuucaacugcuucgacugcggggucaucaucggcuccaucuucgaggugaucugggccgugaucaagcccgggacgagcuucggcaucuccguccugcgggcccuccgccugcugcggaucuucaaggugaccaaguacugggccagccuccgcaaccugguggucucccugcucaacagcaugaaguccaucaucagccugcuguuccuccuguuccuguucaucgugguguucgcccuccuggggaugcagcuguucggcggccaguucaacuucgacgaggggaccccgcccaccaacuucgacacguuccccgcggccaucaugaccgucuuccagauccucaccggcgaggacuggaacgaggugauguacgacgggaucaagucccagggcggggugcagggcggcauggucuucagcaucuacuucaucgugcugacccuguucgggaacuacacgcuccugaacguguuccuggccaucgccgucgacaaccucgccaacgcgcaggagcugaccaaggacgagcaggaggaggaggaggccgccaaccagaagcuggcccuccagaaggcgaaggagguggccgaggugagcccccucagcgccgccaacauguccaucgccgucaaggagcagcagaagaaccagaagcccgccaaguccgugugggagcagcggaccagcgagaugcgcaagcagaaccugcucgccucccgggaggcccuguacaacgagauggaccccgacgagcgcuggaaggccgccuacacccggcaccuccgccccgacaugaagacccaccucgaccgcccgcugguggucgacccccaggagaaccggaacaacaacacgaacaagagccgcgcggccgagcccaccguggaccagcggcugggccagcagcgcgccgaggacuuccuccggaagcaggcccgcuaccacgaccgggcccgcgaccccuccgggagcgcgggccuggacgcccggcgcccgugggccgggucccaggaggccgagcugagccgggagggccccuacggccgcgaguccgaccaccacgcgcgggaggggagccucgagcagcccggcuucugggagggggaggccgagcgcggcaaggccggggacccccaccggcgccacgugcaccggcagggcggcucccgcgagagccgguccgggagcccgcgcaccggcgccgacggggagcaccggcgccaccgcgcccaccggcgccccggcgaggagggccccgaggacaaggcggagcggcgcgcccggcaccgcgaggggucccggcccgcccgcggcggggagggcgagggggagggcccggacggcggggagcggcgccggcgccaccggcacggcgcccccgccaccuacgagggggacgcgcgccgggaggacaaggagcgccggcaccgccggcgcaaggagaaccagggcagcgggguccccguguccggccccaaccugagcacgacccgcccgauccagcaggaccugggccggcaggacccgccccucgccgaggacaucgacaacaugaagaacaacaagcuggccaccgccgaguccgccgcgccccacgggagccugggccacgccgggcucccgcagagccccgccaagaugggcaacuccaccgaccccgggcccaugcuggccaucccggccauggcgacgaacccccagaacgccgccagccgccggacccccaacaacccgggcaaccccuccaaccccgggccgcccaagacccccgagaacagccugaucgugaccaaccccuccgggacgcagaccaacagcgccaagaccgcgcgcaagcccgaccacaccacggucgacaucccgcccgccugcccgccgccccucaaccacaccguggugcaggucaacaagaacgccaaccccgacccccugcccaagaaggaggaggagaagaaggaggaggaggaggacgaccggggcgaggacgggcccaagcccaugccgcccuacuccagcauguucauccuguccaccaccaacccccuccgccggcugugccacuacauccugaaccuccgcuacuucgagaugugcauccugauggugaucgccaugagcuccaucgcccuggcggccgaggaccccgugcagcccaacgcgccccggaacaacguccuccgcuacuucgacuacguguucacgggcguguucaccuucgagauggucaucaagaugaucgaccugggccuggugcuccaccagggggccuacuuccgggaccuguggaacauccuggacuucaucguggucagcggcgcccucguggcguucgccuucaccgggaacuccaagggcaaggacaucaacaccaucaagagccugcgcgugcugcggguccuccgcccgcugaagacgaucaagcggcugcccaagcucaaggccguguucgacugcguggucaacucccugaagaacguguucaacauccugaucguguacaugcuguucauguucaucuucgccgucguggccguccagcuguucaaggggaaguucuuccacugcaccgacgagagcaaggaguucgagaaggacugccgcggcaaguaccugcucuacgagaagaacgaggugaaggcgcgggaccgcgaguggaagaaguacgaguuccacuacgacaacgugcugugggcccugcucacccuguucaccgucuccacgggcgagggguggccccaggugcugaagcacagcguggacgccaccuucgagaaccagggccccuccccgggguaccggauggagaugagcaucuucuacgucguguacuucguggucuuccccuucuucuucgugaacaucuucguggcccucaucaucaucaccuuccaggagcagggcgacaagaugauggaggaguacagccuggagaagaacgagcgcgcgugcaucgacuucgccaucuccgccaagccccugacccggcacaugccgcagaacaagcagagcuuccaguaccgcauguggcaguucgucgugagcccgcccuucgaguacacgaucauggccaugaucgcccucaacaccaucgugcugaugaugaaguucuacggggcgagcgucgccuacgagaacgcccugcgcguguucaacaucguguucaccucccucuucagccuggagugcguccugaaggugauggccuucggcauccucaacuacuuccgggacgccuggaacaucuucgacuucgugaccguccugggcuccaucacggacauccuggugaccgaguucgggaacaacuucaucaaccucagcuuccugcgccuguuccgggcggcccgccugaucaagcuccugcggcagggcuacaccauccgcauccugcucuggaccuucgugcaguccuucaaggcccugcccuacgucugccugcucaucgccaugcuguucuucaucuacgccaucaucgggaugcaggucuucggcaacaucgggaucgacguggaggacgaggacagcgacgaggacgaguuccagaucaccgagcacaacaacuuccggacguucuuccaggcgcugaugcuccuguuccgcuccgccaccggcgaggccuggcacaacaucaugcugagcugccucuccggcaagccgugcgacaagaacagcgggauccugacccgggagugcggcaacgaguucgccuacuucuacuucgucuccuucaucuuccugugcagcuuccucaugcugaaccuguucguggcggugaucauggacaacuucgaguaccucacccgcgacuccagcauccuggggccccaccaccuggacgaguacguccgggugugggccgaguacgaccccgccgccugcggccgcauccacuacaaggacauguacucccuccugcgggugaucagcccgccccuggggcucggcaagaagugcccccaccgcgucgccugcaagcggcugcugcgcauggaccuccccguggcggacgacaacacggugcacuucaacagcacccugauggcccugauccggaccgcccucgacaucaagaucgccaagggcggggccgacaagcagcagauggacgcggagcugcgcaaggagaugauggccaucuggcccaaccugucccagaagacccucgaccugcuggucacgccccacaagagcaccgaccucaccgugggcaagaucuacgccgccaugaugaucauggaguacuaccggcaguccaaggccaagaagcugcaggcgaugcgcgaggagcaggaccgcacgccccugauguuccagcggauggagccgcccagcccgacgcaggagggcgggcccggccagaacgcccuccccuccacccagcuggaccccgggggcgcccugauggcccacgagagcgggcucaaggaguccccgagcugggugacccagcgcgcccaggagauguuccagaagaccggcacguggucccccgagcaggggccgcccaccgacaugccgaacagccagcccaacucccagagcgucgagaugcgggagaugggccgcgacggcuacuccgacagcgagcacuaccugcccauggaggggcagggccgggcggccuccaugccccgccugccggccgagaaccagcggcgccgggggcgcccccggggcaacaaccucagcaccaucuccgacaccagccccaugaagcgcuccgccagcgugcuggggccgaaggcgcggcgccuggacgacuacagccucgagcgggugccgcccgaggagaaccagcgccaccaccagcggcgccgggaccgcucccaccgggccagcgagcgcucccugggccgcuacacggacgucgacaccggccuggggaccgaccucagcaugaccacgcaguccggcgaccugcccagcaaggagcgggaccaggagcgcgggcggccgaaggaccgcaagcaccggcagcaccaccaccaccaccaccaccaccaccacccgccgccgcccgacaaggaccgcuacgcccaggagcggcccgaccacggccgcgcccgggcccgcgaccagcgguggucccgcagccccuccgaggggcgggagcacauggcgcaccgccaguga

SEQ ID NO: 27607 - RNA, 7020 nt, Artificial Sequence
  derived and/or modified sequence opt1 from CACNA1B__Homo_sapiens__NP_000709
auggugcgguucggcgacgagcucggcgggcgguacgggggccccgggggcggcgagcgcgcccgcgggggcggggccggcggggcgggcggccccgggcccggcgggcugcagcccggccagcggguccuguacaagcagagcaucgcccagcgggcccgcaccauggcccuguacaaccccaucccggugaagcagaacugcuucaccgugaaccggucccucuucgucuucagcgaggacaacguggugcgcaaguacgccaagcggaucacggaguggccgcccuucgaguacaugauccuggccaccaucaucgccaacugcaucguccuggcccucgagcagcaccuccccgacggcgacaagacccccauguccgagcgccuggacgacaccgagcccuacuucaucgggaucuucugcuucgaggccggcaucaagaucaucgcgcucggguucguguuccacaagggcagcuaccugcggaacggguggaacgugauggacuucgucguggugcugacgggcauccucgccaccgccggcaccgacuucgaccugcgcacccugcgggccguccgcgugcuccggccccugaagcugguguccgggauccccagccuccaggucgugcugaaguccaucaugaaggccauggugccccugcuccagaucggccugcuccuguucuucgcgauccugauguucgccaucaucgggcuggaguucuacaugggcaaguuccacaaggccugcuuccccaacagcacggacgccgagcccgucggggacuuccccugcggcaaggaggcccccgcgcgccucugcgagggcgacaccgagugccgggaguacuggcccgggcccaacuucggcaucaccaacuucgacaacauccuguucgccauccugaccguguuccagugcaucacgauggagggguggaccgacauccucuacaacaccaacgacgccgccggcaacaccuggaacuggcuguacuucaucccccugaucaucaucggguccuucuucaugcucaaccuggugcugggcguccucagcggcgaguucgccaaggagcgcgagcggguggagaaccgccgggcguuccugaagcugcgccgccagcagcagaucgagcgggagcucaacggguaccuggaguggaucuucaaggccgaggaggugaugcuggccgaggaggaccgcaacgccgaggagaaguccccgcucgacguccugaagcgggccgcgacgaagaagucccgcaacgaccugauccacgccgaggagggcgaggaccgguucgccgaccucugcgccguggggucccccuucgcgcgcgccagccugaaguccggcaagaccgagagcuccagcuacuuccggcgcaaggagaagauguuccgguucuucauccgccggauggucaaggcccaguccuucuacuggguggugcugugcgucguggcccucaacacccugugcguggccaugguccacuacaaccagccccgccggcugaccacgacccuguacuucgcggaguucguguuccucggccuguuccugaccgagaugagccucaagauguacgggcugggcccccgcagcuacuuccgguccagcuucaacugcuucgacuucggggugaucgucggcuccguguucgagguggucugggccgccaucaagcccgggagcuccuucggcaucagcgugcugcgcgcccuccggcugcugcgcaucuucaaggugaccaaguacugguccagccuccggaaccuggucgugucccugcucaacagcaugaaguccaucaucagccugcuguuccuccuguuccuguucaucguggucuucgcccuccugggcaugcagcuguucgggggccaguucaacuuccaggacgagacgcccaccaccaacuucgacaccuuccccgcggccauccucacgguguuccagauccugaccggggaggacuggaacgccgugauguaccacggcaucgagucccagggcggggucagcaagggcauguucuccagcuucuacuucaucgugcugacccucuucgggaacuacacccugcugaacguguuccucgccaucgccgucgacaaccuggcgaacgcccaggagcugacgaaggacgaggaggagauggaggaggccgccaaccagaagcucgcgcugcagaaggccaaggagguggccgaggugucccccaugagcgccgccaacaucuccaucgcggcccgccagcagaacagcgccaaggcccgcagcgucugggagcagcgggccucccagcugcgccuccagaaccugcgggcgagcugcgaggcccuguacuccgagauggacccggaggagcgccuccgguucgccaccacccgccaccuccgccccgacaugaagacccaccuggaccgcccccuggugguggagcugggccgggacggggcccgcggcccggucgggggcaaggcccggcccgaggcggccgaggcccccgagggcguggacccgccccgccggcaccaccgccaccgggacaaggacaagacgcccgccgcgggggaccaggaccgcgccgaggcccccaaggccgagagcggcgagcccggggcccgggaggagcgcccccggccccaccgcucccacagcaaggaggcggccgggccgcccgaggcccgguccgagcgcgggcgcggcccgggccccgagggcggccggcgccaccaccggcgcgggagccccgaggaggccgccgagcgggagccccgccggcaccgcgcgcaccggcaccaggacccguccaaggagugcgccggcgccaagggcgagcgccgggcccgccaccgcgggggcccccgcgccgggccccgggaggcggagagcggcgaggagcccgcccgccggcaccgcgcccggcacaaggcccagccggcccacgaggcgguggagaaggagaccaccgagaaggaggccaccgagaaggaggccgagaucgucgaggccgacaaggagaaggagcugcgcaaccaccagccccgcgagccccacugcgaccucgagaccuccgggacggugaccgugggccccaugcacacccugccguccacgugccugcagaaggucgaggagcagcccgaggacgcggacaaccagcggaacgugacccgcaugggcucccagcccccggaccccaacaccaucgugcacauccccgucaugcucaccgggccccugggcgaggccaccguggugccgagcgggaacgucgaccuggagucccaggccgagggcaagaaggagguggaggccgacgacgugaugcggagcgggccccgccccaucguccccuacuccagcauguucugccucagcccgacgaaccugcugcggcgcuucugccacuacaucgugaccaugcgguacuucgagguggucauccucguggugaucgcccuguccagcaucgcgcuggccgccgaggaccccguccgcaccgacagcccccggaacaacgcccucaaguaccuggacuacaucuucaccggcguguucacguucgagauggucaucaagaugaucgaccugggccuccugcugcaccccggggccuacuuccgcgaccucuggaacauccuggacuucaucguggugagcggcgcgcuggucgccuucgccuucuccgggagcaagggcaaggacaucaacaccaucaagucccuccgggugcugcgcgugcugcggccgcucaagaccaucaagcgccugcccaagcugaaggccgucuucgacugcguggugaacagccucaagaacguccugaacauccugaucguguacaugcuguucauguucaucuucgccgugaucgcgguccagcuguucaaggggaaguucuucuacugcaccgacgaguccaaggagcuggagcgggacugccgcggccaguaccucgacuacgagaaggaggagguggaggcccagccccggcaguggaagaaguacgacuuccacuacgacaacgugcugugggcccugcucacgcuguucaccgucagcaccggcgagggguggcccauggugcugaagcacuccguggacgccaccuacgaggagcagggcccgagccccggguaccgcauggagcucuccaucuucuacgucguguacuucguggucuuccccuucuucuucgugaacaucuucguggcgcugaucaucaucacguuccaggagcagggcgacaaggucaugagcgagugcucccuggagaagaacgagcgggccugcaucgacuucgccaucagcgccaagccccucacccgcuacaugccgcagaaccggcaguccuuccaguacaagaccuggaccuucgugguguccccgcccuucgaguacuucaucauggccaugaucgcgcugaacacggucgugcugaugaugaaguucuacgacgcccccuacgaguacgagcucaugcugaagugccugaacaucguguucaccuccauguucagcauggagugcguccucaagaucaucgccuucggcgugcugaacuacuuccgcgacgccuggaacguguucgacuucgucaccgugcuggggagcaucaccgacauccucgugacggagaucgccgagaccaacaacuucaucaaccuguccuuccugcgccuguuccgggcggcccgccucaucaagcugcugcggcagggcuacaccauccgcauccuccuguggaccuucguccagagcuucaaggcccugccguacgugugccuccugaucgccaugcuguucuucaucuacgccaucaucgggaugcaggucuucggcaacaucgcgcucgacgacgacacguccaucaaccggcacaacaacuuccgcaccuuccugcaggcccugaugcuccuguuccggagcgccaccggggaggccuggcacgagaucaugcuguccugccucagcaaccaggcgugcgacgagcaggccaacgccaccgagugcggcuccgacuucgccuacuucuacuucgucagcuucaucuuccugugcuccuuccugaugcucaaccuguucguggccgugaucauggacaacuucgaguaccugacgcgcgacagcuccauccucggcccccaccaccuggacgaguucauccgggucugggcggaguacgaccccgccgccugcgggcgcaucagcuacaacgacauguucgagaugcugaagcacaugagcccgccccucggccuggggaagaagugccccgcccggguggccuacaagcgccuggugcggaugaacaugcccaucagcaacgaggacaugaccguccacuucaccuccacccucauggcgcugauccgcaccgcccuggagaucaagcucgcccccgccggcacgaagcagcaccagugcgacgccgagcugcggaaggagaucagcguggugugggcgaaccugccccagaagacccucgaccugcuggugccgccccacaagccggacgagaugaccguggggaagguguacgccgcccucaugaucuucgacuucuacaagcagaacaagaccacgcgcgaccagaugcagcaggcccccggcggccugucccagauggggcccgucagccuguuccacccccucaaggccacccuggagcagacccagccggcggugcugcggggcgcccgcgucuuccuccggcagaaguccagcaccagccuguccaacgggggcgccauccagaaccaggagagcgggaucaaggaguccgugagcuggggcacgcagcgcacccaggacgcgccccacgaggcgcggccgccccuggagcggggccacuccaccgagaucccgguggggcgcagcggcgcccucgccgucgacgugcagaugcaguccaucacccggcgcgggcccgacggcgagccccagcccgggcuggagagccagggccgggccgccuccaugccgcgccuggcggccgagacgcagcccgugaccgacgccagccccaugaagcgguccaucagcacccucgcccagcgcccccggggcacccaccugugcuccacgaccccggaccggccgccgcccagccaggccuccagccaccaccaccaccaccggugccaccgccggcgcgaccggaagcagcgcucccuggagaaggggccgagccucuccgcggacauggacggcgcccccagcagcgccgucgggcccggccugcccccgggcgaggggcccaccggcugccggcgcgagcgggagcgccggcaggagcgcgggcgcucccaggagcggcgccagcccagcuccagcuccagcgagaagcagcgguucuacuccugcgaccgcuucggcgggcgggagccgcccaagcccaagcccagccuguccagccacccgaccucccccacggccggccaggagcccggcccccacccgcaggggagcggcuccgugaacgggagcccccuccuguccaccagcggcgccuccacccccgggcgcggcggccggcgccagcugccccagaccccgcucacgccccggcccagcaucaccuacaagaccgcgaacuccagccccauccacuucgccggggcccagaccagccugccggccuucucccccggccgccugagccgggggcucuccgagcacaacgcgcugcugcagcgcgacccccucagccagccccuggccccgggcucccggaucgggagcgaccccuaccugggccagcgccucgacuccgaggccagcgugcacgcccugcccgaggacacgcugaccuucgaggaggccgucgcgaccaacuccggccggagcucccgcaccagcuacguguccagccucacgucccagagccacccccugcggcgcgugccgaacggguaccacugcacccugggccucuccagcgggggccgggcccgccacuccuaccaccaccccgaccaggaccacuggugcuga

SEQ ID NO: 27608 - RNA, 6417 nt, Artificial Sequence
  derived and/or modified sequence opt1 from CACNA1C__Homo_sapiens__NP_000710
auggugaacgagaacacccgcauguacauccccgaggagaaccaccagggcuccaacuacgggagcccccggcccgcccacgccaacaugaacgcgaacgccgccgccggccuggcccccgagcacauccccacccccggggcggcccucagcuggcaggccgccaucgacgcggcccgccaggccaagcugaugggcuccgccgggaacgccaccaucagcaccgucuccagcacccagcggaagcgccagcaguacggcaagcccaagaagcagggcuccaccaccgcgacccggccgccccgcgcccugcucugccugacccugaagaaccccauccggcgcgccugcaucagcaucguggaguggaagcccuucgagaucaucauccuccugaccaucuucgccaacugcguggcccuggcgaucuacauccccuuccccgaggacgacuccaacgccacgaacagcaaccucgagcgggucgaguaccuguuccugaucaucuucaccguggaggccuuccucaaggugaucgccuacgggcugcuguuccaccccaacgccuaccuccgcaacggcuggaaccugcuggacuucaucaucgucgugguggggcuguucuccgcgauccuggagcaggccaccaaggccgacggcgccaacgcccucggcgggaagggggcgggguucgacgucaaggcccuccgggccuuccgcgugcugcggccccugcgccucgugagcggcguccccucccuccaggucgugcugaacagcaucaucaaggccauggucccccuccugcacaucgcgcugcucgugcuguucgugaucaucaucuacgccaucaucgggcuggagcuguucaugggcaagaugcacaagaccugcuacaaccaggagggcaucgccgacguccccgccgaggacgaccccucccccugcgcccuggagacggggcacggccggcagugccagaacgggaccgugugcaagcccggcugggacgggcccaagcacggcaucaccaacuucgacaacuucgcguucgccaugcugaccguguuccagugcaucacgauggagggcuggaccgacguccucuacugggugaacgacgccguggggcgcgacuggcccuggaucuacuucgucacccugaucaucaucggcagcuucuucgugcugaaccucguccugggggugcuguccggcgaguucagcaaggagcgggagaaggccaaggcccgcggggacuuccagaagcuccgggagaagcagcagcuggaggaggaccugaagggcuaccucgacuggaucacccaggcggaggacaucgaccccgagaacgaggacgagggcauggacgaggagaagccccgcaacauguccaugccgacgagcgagaccgagagcgugaacaccgagaacgucgccgggggcgacaucgagggggagaacugcggcgcccggcuggcccaccgcaucuccaagagcaaguucucccgcuacuggcggcgcuggaaccgguucugccgccggaagugccgcgccgcggugaaguccaacguguucuacuggcuggucaucuuccucguguuccugaacacccugacgaucgccuccgagcacuacaaccagcccaacuggcugaccgaggugcaggacaccgccaacaaggcccuccuggcgcuguucaccgccgagaugcuccugaagauguacagccuggggcuccaggccuacuucgucucccuguucaaccgguucgacugcuucguggugugcggcggcauccuggagacgauccucgucgagaccaagaucaugagcccccuggggaucuccgugcugcgcugcgugcggcuccugcgcaucuucaagaucacccgguacuggaacagccuguccaaccucgucgccagccugcugaacuccgugcgcagcaucgccucccuccugcugcuccuguuccuguucaucaucaucuucagccuccugggcaugcagcuguucgggggcaaguucaacuucgacgagaugcagacccggcgcuccacguucgacaacuucccccagagccuccugaccguguuccagauccugaccggcgaggacuggaacuccgucauguacgacgggaucauggcguacggcgggccgagcuuccccggcaugcucgugugcaucuacuucaucauccuguucaucugcgggaacuacauccugcucaacguguuccuggccaucgccgucgacaaccuggccgacgccgagagccucaccuccgcgcagaaggaggaggaggaggagaaggagcggaagaagcuggcccgcacggccagccccgagaagaagcaggagcugguggagaagccggccgugggcgaguccaaggaggagaagaucgagcucaagagcaucaccgccgacggcgagagcccgcccgcgaccaagaucaacauggacgaccugcagcccaacgagaacgaggacaagagcccguaccccaaccccgagaccaccggggaggaggacgaggaggagcccgagaugccggucggcccccggccccgcccccuguccgagcuccaccugaaggagaaggccgugccgaugcccgaggccagcgccuucuucaucuucuccagcaacaaccgguuccgccugcagugccaccgcaucgugaacgacacgaucuucaccaaccucauccuguucuucauccugcucuccagcaucucccuggcggccgaggaccccguccagcacaccagcuuccggaaccacauccuguucuacuucgacaucguguucaccacgaucuucaccaucgagaucgcccucaagaugaccgccuacggggccuuccugcacaagggcuccuucugccgcaacuacuucaacauccuggaccuccugguggucagcgugucccugaucagcuucgggauccagagcuccgcgaucaacguggucaagauccuccgggugcugcgcgugcugcggccccuccgcgccaucaaccgggccaagggccugaagcacgucgugcagugcguguucgucgccauccgcaccaucggcaacaucgugaucgugacgacccugcuccaguucauguucgccugcaucgggguccagcuguucaagggcaagcuguacacgugcagcgacuccagcaagcagaccgaggcggagugcaaggggaacuacaucacguacaaggacggcgagguggaccacccgaucauccagccccgguccugggagaacagcaaguucgacuucgacaacgugcucgccgccaugauggcccuguucaccgucuccaccuucgagggguggcccgagcugcucuaccgcagcaucgacucccacaccgaggacaagggccccaucuacaacuaccggguggagaucagcaucuucuucaucaucuacaucaucaucaucgccuucuucaugaugaacaucuucgugggcuucgucaucgugacguuccaggagcagggggagcaggaguacaagaacugcgagcuggacaagaaccagcgccagugcguggaguacgcgcugaaggcccggccgcuccgccgguacauccccaagaaccagcaccaguacaaggucugguacguggucaacuccaccuacuucgaguaccugauguucgugcugauccuccugaacaccaucugccuggccaugcagcacuacggccagagcugccucuucaagaucgccaugaacauccugaacaugcuguucaccggccucuucacgguggagaugauccugaagcugaucgccuucaagcccaagcacuacuucugcgacgcguggaacaccuucgacgcccucaucgucgugggcuccaucguggacaucgccaucaccgaggucaaccccgccgagcacacccagugcagcccguccaugaacgcggaggagaacagccgcaucuccaucacguucuuccggcuguuccgcgugaugcggcuggugaagcuccugagccgcggggagggcauccggacccugcucuggaccuucaucaaguccuuccaggcccugcccuacgucgcccugcucaucgugaugcuguucuucaucuacgccgugaucggcaugcaggucuucgggaagaucgcccugaacgacaccacggagaucaaccgcaacaacaacuuccagaccuucccccaggcggugcugcuccuguuccgcugcgccaccggcgaggccuggcaggacaucaugcuggccugcaugccggggaagaagugcgcccccgagagcgagcccagcaacuccaccgagggcgagacgcccugcggcagcuccuucgcgguguucuacuucaucagcuucuacaugcucugcgccuuccugaucaucaaccuguucgucgccgugaucauggacaacuucgacuaccucacccgggacugguccauccuggggccgcaccaccuggacgaguucaagcgcaucugggccgaguacgaccccgaggccaagggccggaucaagcaccucgacguggucacccugcugcgccggauccagccgccccucggguucggcaagcugugcccgcaccgcguggcgugcaagcggcuggugagcaugaacaugccccucaacuccgacgggaccgucauguucaacgccacgcuguucgcccuggugcgcaccgcccuccggaucaagaccgagggcaaccuggagcaggcgaacgaggagcugcgcgccaucaucaagaagaucuggaagcggaccagcaugaagcuccuggaccagguggugccgcccgccggcgacgacgaggugaccguggggaaguucuacgccacguuccugauccaggaguacuuccgcaaguucaagaagcggaaggagcagggccucgucgggaagccgucccagcgcaacgcccugagccugcaggcgggccuccggacccugcacgacaucgggcccgagauccgccgggccaucuccggcgaccugaccgccgaggaggagcucgacaaggccaugaaggaggccgugagcgcggccuccgaggacgacaucuuccgccgggccggcgggcuguucggcaaccacgugagcuacuaccaguccgacgggcgcagcgccuucccccagaccuucacgacccagcgcccccugcacaucaacaaggccggcuccagccagggggacaccgaguccccgagccacgagaagcucgucgacagcaccuucacgcccuccagcuacuccagcaccggcuccaacgcgaacaucaacaacgccaacaacaccgcccugggccggcugccccgccccgccggguacccgagcaccguguccacgguggagggccacgggccgccccucagccccgcgauccggguccaggagguggccuggaagcuguccagcaaccgcugccacucccgggagagccaggccgccauggccggccaggaggagaccucccaggacgagaccuacgaggugaagaugaaccacgacaccgaggcgugcagcgagccgucccugcucagcacggagaugcuguccuaccaggacgacgagaaccgccagcugacccuccccgaggaggacaagcgggacauccgccagagccccaagcggggcuuccugcgcuccgccagccuggggcggcgcgccagcuuccaccucgagugccugaagcggcagaaggaccgcggcggggacaucucccagaagaccguccugccccuccaccuggugcaccaccaggcccuggccguggcgggccucagcccgcugcugcagcggucccacagccccgccuccuucccccgcccguucgccacgccgcccgccacgcccgggagccggggcuggccgccccagcccguccccacccuccgccuggagggcguggaguccagcgagaagcugaacuccagcuucccguccauccacugcgggagcugggccgagaccacccccggcgggggcggguccagcgcggcccggcgcgugcggcccgucucccucauggugcccagccaggccggcgccccgggccgccaguuccacggguccgccagcucccugguggaggcgguccugaucagcgagggccucgggcaguucgcccaggaccccaaguucaucgaggugacgacccaggagcuggccgacgccugcgacaugaccaucgaggagauggagagcgcggccgacaacauccuguccggcggggcgccccagagccccaacggcgcccuccugccguucgugaacugccgcgacgccggccaggaccgggccgggggcgaggaggacgccgggugcguccgcgcccggggccgccccuccgaggaggagcugcaggacagccggguguacguguccagccucuga

SEQ ID NO: 27609 - RNA, 6546 nt, Artificial Sequence
  derived and/or modified sequence opt1 from CACNA1D__Homo_sapiens__NP_000711
augaugaugaugaugaugaugaagaagaugcagcaccagcggcagcagcaggccgaccacgccaacgaggcgaacuacgcccggggcacccgccugccccucagcggggagggccccaccucccagcccaacagcuccaagcagaccgugcugagcuggcaggccgccaucgacgccgcgcggcaggccaaggccgcccagaccauguccaccagcgcgccgccgcccguggggucccugagccagcgcaagcggcagcaguacgccaaguccaagaagcagggcaacagcuccaacagccgccccgcccgggcccucuucugccugucccugaacaaccccauccgccgggccugcaucagcaucguggaguggaagcccuucgacaucuucauccuccuggcgaucuucgccaacugcguggcccuggccaucuacauccccuuccccgaggacgacuccaacagcaccaaccacaaccucgagaagguggaguacgccuuccugaucaucuucaccguggagaccuuccugaagaucaucgcguacgggcuccugcugcaccccaacgccuacgugcgcaacggcuggaaccuccuggacuucgucaucgugaucgugggccuguucuccgucauccucgagcagcugaccaaggagaccgagggcgggaaccacagcuccgggaaguccggcggguucgacgugaaggcccugcgggccuuccgcgugcuccggccccugcgccuggucagcggcgugcccucccuccaggugguccugaacagcaucaucaaggccauggugccccugcuccacaucgcgcugcugguccucuucgucaucaucaucuacgccaucaucggccuggagcuguucaucgggaagaugcacaagaccugcuucuucgccgacuccgacaucguggccgaggaggaccccgcccccugcgcguucagcggcaacgggcggcagugcaccgccaacggcaccgagugccgcuccggcuggguggggcccaacggcgggaucaccaacuucgacaacuucgccuucgccaugcucacggucuuccagugcaucaccauggagggcuggaccgacgugcuguacugggugaacgacgcgaucgggugggaguggcccugggucuacuucgugagccugaucauccucggcuccuucuucguccugaaccuggugcucggcgugcugagcggggaguucuccaaggagcgggagaaggccaaggcccgcggcgacuuccagaagcugcgggagaagcagcagcucgaggaggaccugaagggguaccuggacuggaucacccaggccgaggacaucgaccccgagaacgaggaggagggcggggaggagggcaagcgcaacacgagcaugcccaccuccgagaccgagagcgucaacaccgagaacguguccggcgagggggagaaccggggcugcugcgggagccucuggugcugguggcgccgccggggcgccgcgaaggccgggccguccggcugccgccgguggggccaggccaucagcaaguccaagcugagccgccgguggcgccgguggaaccgcuucaaccggcgccggugccgcgccgccgugaaguccgucacguucuacuggcuggugaucgugcucgucuuccugaacacccugaccaucagcagcgagcacuacaaccagcccgacuggcugacccagauccaggacaucgcgaacaaggugcuccuggcccuguucacgugcgagaugcucgugaagauguacucccuggggcugcaggccuacuucgucagccucuucaaccgguucgacugcuucguggugugcggcgggaucaccgagaccauccuggucgagcuggagaucaugagcccccucggcaucagcguguuccgcugcgugcggcugcugcgcaucuucaaggucacccggcacuggacgucccucagcaaccugguggccucccugcucaacagcaugaaguccaucgccagccugcugcuccugcuguuccucuucaucaucaucuucucccugcugggcaugcagcuguucgggggcaaguucaacuucgacgagacccagaccaagcgcagcaccuucgacaacuucccccaggcgcuccugacgguguuccagauccucaccggggaggacuggaacgccgucauguacgacggcaucauggccuacgggggcccguccagcuccggcaugaucgugugcaucuacuucaucauccuguucaucugcgggaacuacauccugcucaacguguuccuggccaucgcggucgacaaccuggccgacgccgagagccucaacaccgcccagaaggaggaggccgaggagaaggagcggaagaagaucgcgcgcaaggagucccuggagaacaagaagaacaacaagcccgaggugaaccagaucgccaacagcgacaacaaggugaccaucgacgacuaccgcgaggaggacgaggacaaggaccccuacccgcccugcgacguccccgugggcgaggaggaggaggaggaggaggaggacgagcccgaggugccggccgggccccggccccgccggaucagcgagcugaacaugaaggagaagaucgcccccaucccggagggcuccgccuucuucauccucagcaagacgaaccccauccgcgucgggugccacaagcugaucaaccaccacaucuucaccaaccugauccucguguucaucaugcuguccagcgcggcccuggccgccgaggaccccauccggucccacagcuuccgcaacaccauccucggcuacuucgacuacgccuucaccgcgaucuucaccguggagauccugcugaagaugacgaccuucggcgccuuccuccacaagggggccuucugccggaacuacuucaaccugcuggacaugcucgucgugggcgugucccuggucagcuucgggauccaguccagcgccaucuccguggugaagauccugcgcguccuccgggugcugcgcccccugcgggcgaucaaccgcgccaagggccucaagcacgugguccagugcguguucguggccauccggaccaucgggaacaucaugaucgucaccacgcugcugcaguucauguucgccugcaucggcgugcagcuguucaagggcaaguucuaccgcugcaccgacgaggccaagagcaacccggaggagugccgggggcuguucauccuguacaaggacggcgacguggacucccccgucgugcgcgagcggaucuggcagaacagcgacuucaacuucgacaacgugcucuccgcgaugauggcccuguucaccgucagcaccuucgagggguggcccgcccugcucuacaaggccaucgacuccaacggcgagaacaucgggcccaucuacaaccaccgcguggagaucagcaucuucuucaucaucuacaucaucaucgucgccuucuucaugaugaacaucuucgugggcuucgugaucgucacguuccaggagcagggcgagaaggaguacaagaacugcgagcuggacaagaaccagcggcagugcguggaguacgcgcugaaggcccgcccgcuccggcgcuacauccccaagaaccccuaccaguacaaguucugguacguggucaacuccagccccuucgaguacaugauguucgugcugaucaugcugaacacccucugccuggccaugcagcacuacgagcagagcaagauguucaacgacgccauggacauccugaacaugguguucaccggggucuucaccguggagauggugcucaaggucaucgccuucaagccgaagggcuacuucuccgacgcguggaacacguucgacagccugaucgugaucggguccaucaucgacguggcccugagcgaggccgaccccaccgaguccgagaacguccccgugcccaccgccaccccgggcaacagcgaggaguccaaccgcaucagcaucacguucuuccgccucuuccgcgugaugcggcuggucaagcugcucucccgcggcgaggggauccggacccugcuguggaccuucaucaagagcuuccaggcccuccccuacguggcgcugcugaucgccaugcuguucuucaucuacgccgugaucggcaugcagauguucgggaaggucgccaugcgcgacaacaaccagaucaaccggaacaacaacuuccagaccuucccccaggcggugcugcuccucuuccgcugcgccacgggcgaggccuggcaggagaucaugcuggccugccugcccgggaagcucugcgacccggaguccgacuacaaccccggcgaggaguacacgugcggcagcaacuucgccaucguguacuucaucuccuucuacaugcugugcgcguuccugaucaucaaccucuucgucgccgugaucauggacaacuucgacuaccugacccgggacuggagcauccuggggccccaccaccuggacgaguucaagcgcaucugguccgaguacgacccggaggccaagggccggaucaagcaccucgacguggucacccugcugcgccggauccagccgccccucggguucggcaagcugugcccccaccgcguggccugcaagcggcugguggccaugaacaugccgcucaacagcgacgggacggucauguucaacgcgacccuguucgcccuggugcgcaccgcccucaagaucaagaccgagggcaaccuggagcaggccaacgaggagcugcgggccgugaucaagaagaucuggaagaagacguccaugaagcuccuggaccaggucgugccgcccgcgggcgacgacgaggugaccgucgggaaguucuacgccaccuuccugauccaggacuacuuccgcaaguucaagaagcggaaggagcagggccucguggggaaguaccccgccaagaacaccacgaucgcccugcaggcgggccugcgcacccuccacgacaucgggccggagauccgccgggccaucagcugcgaccugcaggacgacgagcccgaggagaccaagcgcgaggaggaggacgacguguucaagcggaacggcgcccugcucggcaaccacgucaaccacgugaacuccgaccgccgggacagccugcagcagaccaacacgacccaccgcccccugcacgugcagcggcccagcaucccgcccgccuccgacaccgagaagccccucuucccgcccgccgggaacagcgucugccacaaccaccacaaccacaacuccaucggcaagcagguccccaccagcaccaacgcgaaccugaacaacgccaacauguccaaggccgcccacgggaagcgccccagcaucggcaaccuggagcacguguccgagaacggccaccacagcucccacaagcacgaccgggagccccagcgccggagcuccgucaagcgcacgcgguacuacgagaccuacauccgcagcgacuccggggacgagcagcuccccaccaucugccgggaggaccccgagauccacggcuacuuccgcgacccccacugccugggggagcaggaguacuucagcuccgaggagugcuacgaggacgacagcucccccaccuggagccggcagaacuacggcuacuacucccgcuacccggggcggaacaucgacagcgagcgcccccggggcuaccaccacccccagggcuuccuggaggacgacgacagccccgugugcuacgacucccgccgcagcccgcggcgccggcuccugccgcccacgccggccucccaccgccggagcuccuucaacuucgagugccugcgccggcagagcucccaggaggaggugcccagcucccccaucuucccccaccgcaccgcgcucccgcugcaccugaugcagcagcagaucauggccgucgccgggcucgacagcuccaaggcccagaaguacagccccucccacagcacccgguccugggccacgccgcccgcgacgccgcccuaccgcgacuggacccccugcuacacgccccucauccagguggagcagagcgaggcccuggaccaggugaacggcucccucccgagccugcaccgguccagcugguacaccgacgagcccgacaucagcuaccgcacguucacccccgccucccugaccguccccagcuccuuccggaacaagaacagcgacaagcagcgcuccgccgacagccucguggaggcgguccugaucuccgaggggcugggccgguacgcccgcgacccgaaguucgugagcgccaccaagcacgagaucgccgacgccugcgaccucacgaucgacgagauggaguccgcggccagcacccugcugaacgggaacgugcggccccgcgccaacggcgacgucggcccccucucccaccggcaggacuacgagcugcaggacuucgggcccggcuacagcgacgaggagccggaccccgggcgcgacgaggaggaccuggccgacgagaugaucugcaucaccacccucuga

SEQ ID NO: 27610 - RNA, 6813 nt, Artificial Sequence
  derived and/or modified sequence opt1 from CACNA1E__Homo_sapiens__NP_000712
auggcccgcuucggcgaggccgugguggcgcggcccgggagcggcgacggggacagcgaccagagccggaaccggcagggcacccccgugcccgccagcgggcaggccgccgccuacaagcagaccaaggcgcagcgggcccggaccauggcccuguacaaccccauccccgugcgccagaacugcuucaccgucaaccggagccuguucaucuucggcgaggacaacaucgugcgcaaguacgccaagaagcugaucgacuggccgcccuucgaguacaugauccuggcgaccaucaucgccaacugcaucgugcucgcccuggagcagcaccuccccgaggacgacaagacccccaugucccggcgccucgagaagaccgagcccuacuucaucggcaucuucugcuucgaggccgggaucaagaucgucgcccugggcuucaucuuccacaaggggagcuaccugcggaacggcuggaacgugauggacuucaucgugguccucuccgggauccuggcgaccgccggcacccacuucaacacccacguggaccugcgcacgcuccgggccgugcgcguccugcggccccugaagcucgugagcggcauccccucccugcagaucgugcugaaguccaucaugaaggccauggucccccuccugcagaucgggcugcuccuguucuucgccauccugauguucgcgaucaucggccucgaguucuacuccgggaagcugcaccgcgccugcuucaugaacaacagcggcauccuggagggcuucgacccgccccaccccugcggggugcagggcugccccgccggguacgagugcaaggacuggaucggccccaacgacgggaucacccaguucgacaacauccucuucgccgugcugaccgucuuccagugcaucaccauggagggcuggacgaccgugcuguacaacaccaacgacgcccucggcgcgaccuggaacuggcuguacuucaucccccugaucaucaucggguccuucuucgugcucaaccugguccugggcgugcucagcggggaguucgccaaggagcgggagcgcguggagaaccggcgcgccuucaugaagcugcggcgccagcagcagaucgagcgcgagcugaacggcuaccgggccuggaucgacaaggccgaggaggucaugcucgcggaggagaacaagaacgccgggacguccgcccuggaggugcugcgccgggccaccaucaagcgcagccggaccgaggcgaugacccgcgacuccagcgacgagcacugcgucgacaucuccagcgugggcacgccccucgcccgggccagcaucaaguccgccaagguggacggcgucagcuacuuccgccacaaggagcggcugcugcgcaucuccauccggcacauggucaagagccagguguucuacuggaucguccucucccugguggcccugaacaccgcgugcguggccaucguccaccacaaccagccccaguggcucacccaccuccuguacuacgccgaguuccuguuccucgggcuguuccugcucgagaugagccugaagauguacggcauggggccgcgccuguacuuccacuccagcuucaacugcuucgacuucggcgugaccgugggguccaucuucgaggucgugugggccaucuuccggcccggcacgagcuucggcaucuccgugcuccgcgcccugcggcugcuccgcaucuucaagaucaccaaguacugggcgagccugcggaaccuggucgugucccucaugagcuccaugaaguccaucaucucccugcuguuccuccuguuccuguucaucguggucuucgcccuccuggggaugcagcuguucggcgggcgcuucaacuucaacgacggcacccccagcgccaacuucgacaccuuccccgccgccaucaugacgguguuccagauccucaccggcgaggacuggaacgaggugauguacaacgggauccggucccagggcggggucagcagcggcaugugguccgcgaucuacuucaucgugcugacccuguucgggaacuacacccuccugaacguguuccuggccaucgccgucgacaaccucgccaacgcgcaggagcugacgaaggacgagcaggaggaggaggaggccuucaaccagaagcacgcccugcagaaggccaaggaggugagcccgauguccgcccccaacaugcccagcaucgagcgcgaccgccggcgccggcaccacauguccaugugggagccccgcagcucccaccuccgggagcgccggcgccggcaccacaugagcgugugggagcagcgcaccucccagcugcggaagcacaugcagaugagcucccaggaggcgcugaaccgcgaggaggccccgaccaugaacccccucaacccccugaacccgcugagcucccucaacccccugaacgcccaccccagccuguaccggcgcccccgggccaucgagggccucgcccugggccuggcgcucgagaaguucgaggaggagcgcaucucccgcgggggcagccugaagggggacggcggggaccgcuccagcgcccuggacaaccagcggaccccgcucagccugggccagcgcgagccgcccuggcuggcccggcccugccacggcaacugcgacccgacgcagcaggaggccgggggcggggaggccgucgugaccuucgaggaccgcgcgcgccaccggcagucccagcgccggagccgccaccggcgcgugcggaccgagggcaaggaguccagcuccgccagccgcucccggagcgccucccaggagcgcagccucgacgaggccaugcccaccgagggggagaaggaccacgagcugcggggcaaccacggcgcgaaggagcccaccauccaggaggagcgcgcccaggaccugcggcgcacgaacucccucauggucagccggggguccggccuggccgggggccuggacgaggccgacacgccccuggugcugccgcaccccgagcuggagguggggaagcacgucgugcucaccgagcaggagcccgagggcagcuccgagcaggcccugcugggcaacgugcagcucgacauggggcgcgucaucagccaguccgagcccgaccugagcugcaucaccgcgaacacggacaaggccaccaccgaguccaccagcgugacgguggccaucccggacgucgacccccugguggacagcaccgugguccacaucuccaacaagaccgacggcgaggccagcccccucaaggaggccgagauccgggaggacgaggaggagguggagaagaagaagcagaagaaggagaagcgcgagaccgggaaggcgauggugccccacuccagcauguucaucuucuccacgaccaacccgauccggcgcgccugccacuacaucgucaaccugcgcuacuucgagaugugcauccugcucgugaucgccgccagcuccaucgcccuggcggccgaggaccccgugcugaccaacagcgagcggaacaagguccuccgcuacuucgacuacguguucaccggcguguucacguucgagauggucaucaagaugaucgaccagggccugauccugcaggacggguccuacuuccgggaccucuggaacauccuggacuucguggucguggugggcgcccuggucgccuucgcccucgcgaacgcccuggggaccaacaagggccgcgacaucaagaccaucaagagccugcgggugcuccgcgugcugcggccccugaagaccaucaagcgccuccccaagcugaaggccgucuucgacugcguggugacgucccugaagaacgucuucaacauccucaucguguacaagcuguucauguucaucuucgccgugaucgcgguccagcuguucaaggggaaguucuucuacugcaccgacagcuccaaggacaccgagaaggagugcaucggcaacuacguggaccacgagaagaacaagauggaggugaagggccgggaguggaagcgccacgaguuccacuacgacaacaucaucugggcccuccugacccuguucacggucagcaccggggagggcuggccccaggugcuccagcacuccguggacgucaccgaggaggaccgggggcccagccgcuccaaccggauggagaugagcaucuucuacgugguguacuucgucguguuccccuucuucuucgugaacaucuucgucgcccugaucaucaucaccuuccaggagcagggcgacaagaugauggaggagugcucccuggagaagaacgagcgcgccugcaucgacuucgccaucagcgcgaagccgcucacgcgguacaugccccagaaccgccacaccuuccaguaccggguguggcacuucguggucagccccuccuucgaguacaccaucauggccaugaucgcccugaacaccguggugcugaugaugaaguacuacagcgcccccugcacguacgagcuggcccucaaguaccugaacaucgcguucaccauggucuucucccuggagugcgugcucaaggugaucgccuucggguuccugaacuacuuccgcgacaccuggaacaucuucgacuucaucaccgucaucggcagcaucacggagaucauccugaccgacuccaagcucgugaacaccagcggcuucaacauguccuuccugaagcuguuccgggccgcccgccucaucaagcugcugcggcagggguacaccauccgcauccuccuguggaccuucgugcagagcuucaaggcccugccguacgucugccuccugaucgcgaugcuguucuucaucuacgccaucaucggcaugcaggucuucgggaacaucaagcucgacgaggagucccacaucaaccgccacaacaacuuccggagcuucuucggcucccugaugcuccuguuccgcagcgccacgggggaggccuggcaggagaucaugcuguccugccugggcgagaagggcugcgagcccgacaccaccgcgcccagcgggcagaacgagaacgagcggugcggcaccgaccucgccuacguguacuucgucuccuucaucuucuucugcagcuuccugaugcugaaccucuucguggccgugaucauggacaacuucgaguaccugacgcgcgacuccagcauccuggggccccaccaccucgacgaguucguccgggugugggccgaguacgaccgcgccgcgugcggccggauccacuacaccgagauguacgagaugcugacccugauguccccgccccucggccuggggaagcgcugccccagcaagguggccuacaagcggcugguccucaugaacaugcccguggccgaggacaugaccgugcacuucacgagcacccugauggcccugauccgcaccgcccucgacaucaagaucgcgaagggcggggccgaccggcagcagcuggacuccgagcugcagaaggagacccucgccaucuggccgcaccugagccagaagaugcuggaccuccugguccccaugcccaaggccuccgaccugacggugggcaagaucuacgccgcgaugaugaucauggacuacuacaagcagagcaaggugaagaagcagcgccagcagcucgaggagcagaagaacgcccccauguuccagcggauggagccguccagccugccccaggagaucaucgccaacgccaaggcgcugcccuaccuccagcaggaccccgucuccgggcugagcggccgcuccggcuacccgagcaugagcccccugagcccccaggacaucuuccagcucgccugcauggaccccgccgacgacgggcaguuccaggagcggcagucccugguggucaccgacccgagcuccaugcgccggagcuucuccaccauccgcgacaagcggagcaacuccagcuggcuggaggaguucagcauggagcgcuccagcgagaacaccuacaagucccgccggcgcagcuaccacuccagccuccggcuguccgcccaccgccugaacagcgacuccggccacaagagcgacacgcaccgguccgggggccgcgagcgggggcgcagcaaggagcggaagcaccuccugucccccgacgugagccgcugcaacuccgaggagcggggcacccaggccgacugggagagccccgagcgccggcagucccgcagccccuccgagggccggagccagaccccgaaccgccaggggaccggcagccuguccgagagcuccauccccagcguguccgacacgagcacgccccggcgcucccggcgccagcucccgcccgugccgcccaagccgcggccccugcugagcuacuccagccucauccgccacgcgggguccaucuccccgcccgccgacggcuccgaggaggggagcccgcugaccucccaggcccuggagagcaacaacgccugccucaccgaguccagcaacagcccccacccccagcagucccagcacgccagcccccagcgcuacaucuccgagccguaccuggcgcugcacgaggacagccacgccuccgacugcggcgaggaggagacgcucaccuucgaggccgccguggccaccagccugggccgguccaacaccaucgggagcgcgccgccccugcgccacuccuggcagaugcccaacggccacuaccggcgccggcgccgcgggggcccggggcccggcaugaugugcggcgccgugaacaaccuccugagcgacacggaggaggacgacaagugcuga

SEQ ID NO: 27611 - RNA, 5901 nt, Artificial Sequence
  derived and/or modified sequence opt1 from CACNA1F__Homo_sapiens__NP_001243718
augagcgagagcgagggcgggaaggacaccacccccgagcccagccccgccaacggcgccgggcccggccccgagugggggcugugccccgggccgcccgcgguggagggcgaguccagcggggccuccggccucgggacccccaagcgccggaaccagcacagcaagcacaagaccguggccguggccuccgcccagcgcagcccccgggcgcuguucugccugacccucgccaacccccugcgccgguccugcaucagcaucguggaguggaagcccuucgacauccugauccuccugaccaucuucgccaacugcguggcccugggcguguacauccccuuccccgaggacgacuccaacaccgcgaaccacaaccucgagcaggucgaguacgucuuccuggugaucuucaccguggagaccguccugaagaucguggccuacgggcucgugcugcaccccagcgccuacauccgcaacggcuggaaccugcucgacuucaucaucgucguggugggccuguucuccguccugcucgagcaggggcccggccggcccggggacgccccgcacaccggcggcaagcccgggggcuucgacgugaaggcccugcgcgcguuccgggugcugcgcccccuccggcuggucagcggggugcccucccugcacaucgugcucaacagcaucaugaaggcccuggucccccugcuccacaucgcccugcugguccucuucgugaucaucaucuacgccaucaucggccuggagcuguuccucgggcgcaugcacaagaccugcuacuuccugggcuccgacauggaggccgaggaggaccccagccccugcgcguccagcggcagcgggcgggccugcacccugaaccagaccgagugccgcggccgguggcccgggccgaacggcgggaucaccaacuucgacaacuucuucuucgccaugcucaccgucuuccagugcgugaccauggagggcuggaccgacguccuguacuggaugcaggacgccaugggcuacgagcugcccuggguguacuucgugucccucgucaucuucgggagcuucuucgugcugaaccuggugcucggcguccuguccggggaguucagcaaggagcgcgagaaggccaaggcgcggggcgacuuccagaagcagcgcgagaagcagcagauggaggaggaccugcggggguaccucgacuggaucacccaggccgaggagcuggacauggaggaccccuccgccgacgacaaccugggcccccagcucgccgagcugaccaaccgccggcgcggccgccugcggugguucagccacuccacccgcagcacccacuccaccagcucccacgccagccugccggcguccgacacggggagcaugaccgagacccagggcgacgaggacgaggaggagggggcccucgccuccugcacccggugccugaacaagaucaugaagacgcgcgugugccggcgccugcggcgcgccaaccgggugcuccgcgcgcggugccgccgggccgucaagagcaacgccugcuacugggccgugcugcugcucguguuccugaacacccugaccaucgccuccgagcaccacggccagcccgucuggcucacccagauccaggaguacgcgaacaaggugcugcugugccucuucacgguggagaugcugcugaagcucuacggccuggggcccagcgccuacgucuccagcuucuucaaccgcuucgacugcuucguggugugcggcgggauccuggagaccacccucgucgaggugggcgccaugcagccgcuggggaucagcgugcugcggugcguccgccuccugcggaucuucaaggugacccgccacugggccucccugagcaaccucguggccucccugcugaacagcaugaaguccaucgcgagccuccugcugcuccuguuccuguucaucaucaucuucucccuccugggcaugcagcuguucggcgggaaguucaacuucgaccagacgcacaccaagcggagcaccuucgacaccuucccccaggcccuccugacggucuuccagauccugaccggcgaggacuggaacguggugauguacgacgggaucauggccuacggcgggcccuucuuccccggcaugcucgucugcaucuacuucaucauccuguucaucugcggcaacuacauccugcucaacguguuccuggccaucgccguggacaaccuggcguccggggacgccggcaccgccaaggacaagggcggcgagaaguccaacgagaaggaccucccgcaggagaacgaggggcugguccccggcguggagaaggaggaggaggagggcgcccgccgcgagggggcggacauggaggaggaggaggaggaggaggaggaggaggaggaggaggaggaggaggagggcgccgggggcguggagcugcuccaggaggucgugcccaaggagaaggugguccccaucccggagggguccgccuucuucugccugagccagaccaacccccugcggaagggcugccacacccucauccaccaccacguguucacgaaccugauccugguguucaucauccucuccagcgucucccuggccgccgaggaccccauccgcgcgcacagcuuccggaaccacauccugggcuacuucgacuacgccuucaccuccaucuucaccguggagauccuccugaagaugaccguguucggggccuuccugcaccgcggcagcuucugccggagcugguucaacaugcucgaccugcuggucguguccgugagccucaucuccuucgggauccacagcuccgccaucagcgucgugaagauccugcgcgugcugcggguccuccgcccccugcgggccaucaaccgcgcgaagggccugaagcacguggugcagugcgucuucguggccauccggacgaucggcaacaucaugaucgucaccacccuccugcaguucauguucgccugcaucggggugcagcuguucaagggcaaguucuacacgugcacggacgaggccaagcacaccccgcaggagugcaagggguccuuccucguguaccccgacggcgacgucagccgcccccuggugcgggagcgccugugggugaacuccgacuucaacuucgacaacguccucagcgccaugauggcgcuguucaccguguccaccuucgagggguggcccgcccugcucuacaaggccaucgacgccuacgcggaggaccacggcccgaucuacaacuaccggguggagaucagcgucuucuucaucguguacaucaucaucaucgccuucuucaugaugaacaucuucgugggcuucgucaucaucacguuccgcgcccagggggagcaggaguaccagaacugcgagcuggacaagaaccagcggcagugcguggaguacgcccugaaggcccagccccuccgccgguacauccccaagaacccccaccaguaccgcgugugggcgaccgucaacuccgccgccuucgaguaccugauguuccugcucauccugcugaacaccguggcccucgccaugcagcacuacgagcagaccgcgccguucaacuacgccauggacauccugaacaugguguucacgggccuguucaccaucgagaugguccucaagaucaucgccuucaagcccaagcacuacuucaccgacgccuggaacaccuucgacgcccugaucgugguggggagcaucgucgacaucgcggugacggaggugaacaacggcgggcaccugggcgaguccagcgaggacuccagccggaucuccaucaccuucuuccgccucuuccgcgucaugcggcuggugaagcugcugagcaagggcgaggggauccgcacccuccuguggaccuucaucaagagcuuccaggcccugcccuacguggcccuccugaucgccaugaucuucuucaucuacgccgucaucggcaugcagauguucgggaagguggcgcugcaggacggcacgcagaucaaccggaacaacaacuuccagaccuucccccaggccgugcuccugcuguuccgcugcgccaccggggaggccuggcaggagaucaugcucgcgucccugccgggcaaccggugcgaccccgagagcgacuucggccccggggaggaguucacgugcggcuccaacuucgccaucgccuacuucaucagcuucuucaugcugugcgccuuccucaucaucaaccuguucgucgccgugaucauggacaacuucgacuaccugacgcgcgacugguccauccucgggccgcaccaccuggacgaguucaagcggaucuggagcgaguacgaccccggcgcgaagggccgcaucaagcaccuggacguggucgcccuccugcggcgcauccagccgccccugggguucggcaagcucugcccgcaccggguggccugcaagcgccugguggccaugaacaugccccugaacuccgacgggaccgucaccuucaacgccacccucuucgcgcuggugcggacgagccugaagaucaagaccgagggcaaccucgagcaggccaaccaggagcugcgcaucgugaucaagaagaucuggaagcggaugaagcagaagcugcucgacgaggucaucccgccgcccgacgaggaggaggugaccguggggaaguucuacgccaccuuccugauccaggacuacuuccgcaaguuccggcgccggaaggagaagggccugcucggcaacgacgccgcccccuccacgagcuccgcgcugcaggccgggcugcgcagccuccaggaccugggccccgagaugcgccaggcccugaccugcgacaccgaggaggaggaggaggaggggcaggagggcgucgaggaggaggacgagaaggaccucgagaccaacaaggccaccauggugucccagcccagcgcgcggcgcggguccggcaucagcgugucccugcccgucggcgaccggcugcccgacagccucuccuucgggcccagcgacgacgaccgcggcacgcccaccagcucccagccgagcgugccccaggccggguccaacacccaccggcgcggcagcggggcccugaucuucaccauccccgaggagggcaacucccagcccaagggcacgaaggggcagaacaagcaggacgaggacgaggaggugccggaccggcugagcuaccucgacgagcaggccggcacgccgcccugcuccguccugcugcccccgcaccgcgcccagcgguacauggacgggcaccucgugccccgccggcgccugcugccgcccaccccggcgggccggaagcccagcuucaccauccagugccuccagcgccagggguccugcgaggaccugcccaucccgggcacguaccaccggggccgcaacagcgggcccaaccgggcccagggcuccugggccacgccgccccagcgcgggcggcugcucuacgccccgcugcugcucguggaggagggcgccgcgggcgagggguaccugggccgcagcuccgggccccugcggaccuucacgugccuccacguccccggcacgcacagcgaccccucccacgggaagcgcggcagcgccgacucccugguggaggccguccugaucagcgagggccucgggcuguucgcccgcgacccgcgguucguggcccuggcgaagcaggagaucgccgacgccugccgccucacccuggacgagauggacaacgccgcguccgaccugcucgcccagggcaccagcagccuguacuccgacgaggagagcauccugucccgguucgacgaggaggaccucggggacgagauggccugcgugcacgcccuguga

SEQ ID NO: 27612 - RNA, 6945 nt, Artificial Sequence
  derived and/or modified sequence opt1 from CACNA1G__Homo_sapiens__NP_001243253
auggacgaggaggaggacggcgccggggccgaggaguccggccagccccgcuccuucaugcggcugaacgaccugagcggggccggcgggcgccccggccccggcuccgccgagaaggaccccgggagcgccgacuccgaggccgagggccugcccuaccccgcccuggcgcccguggucuucuucuaccucagccaggacucccggccccgcagcuggugccugcggaccgugugcaaccccugguucgagcgcaucuccaugcuggugauccuccugaacugcgucacccuggggauguuccggcccugcgaggacaucgccugcgacagccagcgcugccggauccuccaggccuucgacgacuucaucuucgccuucuucgccguggagaugguggucaagaugguggcccugggcaucuucgggaagaagugcuaccugggcgacaccuggaaccgccucgacuucuucaucgugaucgccggcaugcuggaguacucccuggaccuccagaacgucagcuucuccgccgugcggaccgugcgcguccugcggccccugcgcgccaucaaccgggugcccagcaugcgcauccucgugacccugcugcucgacacccugcccaugcuggggaacguccuccugcugugcuucuucguguucuucaucuucggcaucguggggguccagcucugggcgggccugcugcggaaccgcugcuuccucccggagaacuucucccugccccugagcguggaccucgagcgguacuaccagaccgagaacgaggacgagucccccuucaucugcagccagccccgcgagaacggcaugcgguccugccgcagcgugccgacccugcgcggggacggcgggggcgggccgcccugcggccuggacuacgaggccuacaacagcuccagcaacacgaccugcgucaacuggaaccaguacuacacgaacugcuccgccggcgagcacaaccccuucaagggggccaucaacuucgacaacaucggcuacgccuggaucgcgaucuuccaggugaucacccucgagggguggguggacaucauguacuucgucauggacgcccacagcuucuacaacuucaucuacuucauccugcugaucaucgugggcuccuucuucaugaucaaccucugccuggucgugaucgccacccaguucagcgagaccaagcagcgggagucccagcugaugcgcgagcagcgggugcgcuuccucagcaacgccuccacgcuggccagcuucuccgagccggggagcugcuacgaggagcugcucaaguaccuggucuacauccugcggaaggcggcccgccggcucgcccaggugucccgcgccgccggcgugcgggucggccugcugagcucccccgcgccccucggcgggcaggagacccagcccagcuccagcugcucccgcagccaccggcgccucagcgugcaccaccuggugcaccaccaccaccaccaccaccaccacuaccaccuggggaacggcacccuccgggccccgcgcgccucccccgagauccaggaccgggacgccaacgggagccgccggcugaugcugccgccgcccuccacccccgcgcucagcggcgcgccgcccggcggggccgaguccguccacagcuucuaccacgccgacugccaccuggagcccgugcgcugccaggcgcccccgccccggucccccagcgaggcguccggccgcacgguggggagcggcaaggucuaccccaccgugcacaccagcccgccgcccgagacccugaaggagaaggcccucguggaggucgccgccagcuccgggccgcccacgcugaccagccugaacaucccgcccgggcccuacuccagcaugcacaagcuccuggagacccaguccaccggcgccugccagagcagcugcaagaucuccagccccugccugaaggcggacuccggggccugcggccccgacagcugccccuacugcgcccgcgccggggccggcgagguggagcucgcggaccgggagaugcccgacuccgacagcgaggccguguacgaguucacgcaggacgcccagcacuccgaccugcgcgacccccacagccggcgccagcggucccugggccccgacgccgagcccagcuccguccucgcguucuggcgccugaucugcgacaccuuccggaagaucguggacagcaaguacuucgggcgcggcaucaugaucgccauccuggugaacacccucuccauggggaucgaguaccacgagcagcccgaggagcugaccaacgcccuggagaucagcaacaucgucuucacgucccucuucgcccuggagaugcugcucaagcugcugguguacggccccuucggguacaucaagaaccccuacaacaucuucgacggcgugaucgucgugaucagcgugugggagaucgucggccagcagggcggcgggcucuccgugcugcggaccuuccgccugaugcgggugcucaagcugguccgcuuccugcccgcccuccagcggcagcugguggugcugaugaagaccauggacaacgucgcgaccuucugcaugcuccugaugcuguucaucuucaucuucagcauccucggcaugcaccuguucgggugcaaguucgccuccgagcgcgacggcgacacgcugcccgaccggaagaacuucgacagccuccugugggccaucgugaccguguuccagauccugacccaggaggacuggaacaagguccucuacaacggcauggccagcaccuccagcugggccgcgcuguacuucaucgcccugaugacguucgggaacuacgugcuguucaaccugcugguggccauccucgucgagggcuuccaggccgaggagaucuccaagcgcgaggacgccagcgggcagcuguccugcauccagcugcccguggacagccagggcggggacgcgaacaaguccgagagcgagcccgacuucuucucccccagccucgacggcgacggcgaccggaagaagugccuggcccuggugucccucggggagcaccccgagcugcgcaagagccugcucccgccccugaucauccacaccgccgccacccccaugucccugcccaagagcaccuccaccggccucggggaggcgcugggcccggccagccggcgcacguccagcuccggcagcgccgagcccggggccgcccacgagaugaaguccccgcccuccgcgcggagcuccccgcacagccccugguccgccgccagcuccuggaccagccgccgcuccagccggaacucccugggccgcgcccccagccucaagcggcgcucccccagcggggagcggcgcucccugcugagcggcgaggggcaggagucccaggacgaggaggagagcuccgaggaggagcgggccagcccggcgggcagcgaccaccgccaccggggcucccucgagcgcgaggccaagagcuccuucgaccugcccgacacccugcagguccccgggcuccaccggaccgccagcggccgcggguccgccagcgagcaccaggacugcaacggcaaguccgccagcgggcggcuggcgcgcgcccugcggcccgacgacccgccccucgacggcgacgacgccgacgacgagggcaaccuguccaagggggagcgcgugcgggccuggauccgcgcccggcugcccgcgugcugccucgagcgcgacagcugguccgccuacaucuucccgccccagagccgcuuccggcugcugugccaccgcaucaucacgcacaagauguucgaccacgugguccucgugaucaucuuccugaacugcaucaccaucgccauggagcggcccaagaucgacccccacuccgccgagcgcaucuuccugacccucagcaacuacaucuucaccgcgguguuccuggccgagaugacggucaaggugguggcccugggcuggugcuucggggagcaggccuaccuccgguccagcuggaacguccuggacggccugcucgugcugaucuccgucaucgacauccuggugagcaugguguccgacagcgggaccaagauccugggcaugcuccgcguccugcggcugcuccgcacccugcggccccugcgcgugaucagccgggcccagggccucaagcugguggucgagacccugauguccagccucaagcccaucgggaacaucguggugaucugcugcgcguucuucaucaucuucggcauccuggggguccagcuguucaagggcaaguucuucgugugccagggcgaggacacgcgcaacaucaccaacaaguccgacugcgccgaggccagcuaccggugggugcgccacaaguacaacuucgacaaccucgggcaggcccugaugucccuguucguccucgccagcaaggacggcuggguggacaucauguacgacgggcuggacgcggugggcgucgaccagcagcccaucaugaaccacaaccccuggaugcugcucuacuucaucuccuuccugcugaucguggccuucuucgugcucaacauguucgucggggugguggucgagaacuuccacaagugccggcagcaccaggaggaggaggaggcccgccggcgcgaggagaagcggcugcgccggcuggagaagaagcgccgcaaggcccagugcaagccguacuacagcgacuacucccgguuccgccuccuggugcaccaccugugcaccagccacuaccucgaccuguucaucaccggcgugaucggccugaacgucgugacgauggccauggagcacuaccagcagccccagauccucgacgaggcgcugaagaucugcaacuacaucuucaccgugaucuucguccuggaguccguguucaagcucguggccuucggguuccggcgcuucuuccaggaccgguggaaccagcuggaccuggccaucguccuccugagcaucaugggcaucacccuggaggagaucgaggugaacgccucccuccccaucaaccccaccaucauccgcaucaugcgggugcugcgcaucgcgcggguccugaagcuccugaagauggccguggggaugcgcgcccugcucgacacggugaugcaggcccugccgcaggucggcaaccuggggcuccuguucaugcuccuguucuucaucuucgccgcgcugggcguggagcuguucggcgaccucgagugcgacgagacccaccccugcgaggggcugggccggcacgccaccuuccgcaacuucgggauggccuuccugacccucuuccgggugagcacgggcgacaacuggaacgggaucaugaaggacacccugcgcgacugcgaccaggaguccacgugcuacaacaccgucaucagccccaucuacuucgugagcuucgugcugaccgcccaguucguccucgugaacguggucaucgccgugcugaugaagcaccuggaggagagcaacaaggaggcgaaggaggaggccgagcucgaggccgagcuggagcuggagaugaagacccucagcccccagccgcacagcccccugggcagccccuuccuguggcccggcguggaggggccggacucccccgacagccccaagcccggcgcccuccacccggccgcgcacgcccgguccgccagccacuucucccuggagcaccccaccgaccgccagcuguucgacaccaucagccuccugauccaggggucccuggagugggagcucaagcugauggacgagcuggccggccccgggggccagcccagcgcguucccguccgcccccagccucggcggguccgacccccagaugcagccccacccgacggagcugcccggccccgaccugcucaccguccggaaguccggggugucccgcacccacagccugcccaacgacuccuacaugugccggcacggcagcaccgccgagggcccgcuggggcaccgcggcugggggcuccccaaggcccaguccggcagcgugcugagcguccacucccagcccgccgacacgagcuacauccugcagcucccgaaggacgcgccccaccuccugcagccccacuccgcccccaccugggggaccaucccgaagcugccgccgcccggccgcagcccgcuggcccagcggccccugcgccggcaggccgccauccgcaccgacucccucgacgugcagggccuggggagccgggaggaccugcucgcggaggucuccggccccuccccgccccuggcccgcgccuacuccuucugggggcagagcuccacccaggcccagcagcacagccggucccacagcaagaucuccaagcacaugacgccgcccgcccccugccccggccccgagcccaacugggggaagggcccgcccgagacccgcagcucccuggagcucgacaccgagcugagcuggaucuccggcgaccugcugccgcccgggggccaggaggagccgcccagcccccgggaccucaagaagugcuacagcguggaggcgcaguccugccagcgccggcccaccagcuggcuggacgagcagcgccggcacuccaucgccgugagcugccuggacuccgggagccagccccaccucggcacggaccccuccaaccucgggggccagccccugggcgggcccggcagccgcccgaagaagaagcucagcccgcccagcaucaccaucgacccgcccgagucccaggggccccggacgccgcccagccccggcaucugccugcgccggcgcgcccccuccagcgacuccaaggacccccuggccagcgggcccccggacuccauggccgcgagccccucccccaagaaggacguccucagccugagcggccuguccagcgaccccgccgaccucgacccguga

SEQ ID NO: 27613 - RNA, 7044 nt, Artificial Sequence
  derived and/or modified sequence opt1 from CACNA1H__Homo_sapiens__NP_001005407
augaccgagggcgcccgcgccgccgacgaggugcgggucccccugggggcgcccccgcccggccccgccgcccucgugggggccucccccgagucccccggcgcccccgggcgcgaggccgagcggggcuccgagcugggcgugucccccagcgaguccccggccgccgagcgcggggccgagcugggcgccgacgaggagcagcggguccccuaccccgcccucgccgccaccguguucuucugccuggggcagaccacccgcccccgguccuggugccugcgccucgugugcaaccccugguucgagcacgucuccaugcuggugaucaugcugaacugcgugacccucggcauguuccggcccugcgaggacgucgagugcggguccgagcgcugcaacauccuggaggcguucgacgccuucaucuucgccuucuucgccguggagauggugaucaagauggucgcccugggccucuucggccagaagugcuaccugggggacaccuggaaccggcuggacuucuucaucgugguggcgggcaugauggaguacucccucgacgggcacaacgucucccuguccgccauccgcacggugcgggugcugcgcccccuccgggccaucaaccgcguccccagcaugcggauccuggugacccugcuccuggacacccugcccaugcucggcaacgugcugcugcucugcuucuucgucuucuucaucuucggcaucgugggggugcagcugugggccggccugcuccgcaaccggugcuuccuggacuccgccuucguccgcaacaacaaccugaccuuccuccggcccuacuaccagacggaggagggggaggagaaccccuucaucugcagcucccgccgcgacaacggcaugcagaagugcagccacauccccgggcggcgcgagcugcggaugcccugcacccugggcugggaggcguacacccagccccaggccgagggcgugggggccgcccgcaacgccugcaucaacuggaaccaguacuacaacgucugccgguccggcgacagcaacccccacaacggggcgaucaacuucgacaacaucggcuacgccuggaucgccaucuuccaggugaucacccucgagggguggguggacaucauguacuacgucauggacgcccacuccuucuacaacuucaucuacuucauccugcugaucaucgugggcagcuucuucaugaucaaccucugccugguggucaucgcgacgcaguucagcgagaccaagcagcgcgagucccagcugaugcgggagcagcgcgcccggcaccucagcaacgacuccacccuggccagcuucuccgagcccggcagcugcuacgaggagcugcucaaguacguggggcacaucuuccgcaaggugaagcggcgcucccugcggcuguacgcccgcuggcagagccgguggcgcaagaaggucgacccguccgccgugcagggccaggggcccggccaccggcagcgccgggcggggcgccacaccgccagcgugcaccaccucgucuaccaccaccaccaccaccaccaccaccacuaccacuucucccacggcagcccccgccggcccggcccggagcccggggccugcgacacgcgccuggugcgggccggcgcgccgcccagcccgcccagccccgggcgcggcccgcccgacgcggaguccgugcacagcaucuaccacgccgacugccacaucgagggcccccaggagcgggcccgcgucgcccacgccgcggccaccgccgccgcgucccugcggcuggccaccgggcucggcaccaugaacuaccccacgauccugccgagcggggugggcuccgggaagggcagcaccagccccggccccaaggggaagugggccggcgggcccccgggcaccgggggccacggcccccugucccucaacagccccgaccccuacgagaagaucccgcacguggucggggagcacggccuggggcaggcccccggccaccuguccgggcucagcgugcccugcccccugccgagcccgcccgccggcacccugacgugcgagcucaagagcugccccuacugcacccgcgcgcuggaggacccggagggcgagcuguccgggagcgaguccggcgacagcgacgggcggggcguguacgaguucacccaggacguccgccacggggaccggugggaccccacccgcccgccccgggccacggacacccccggccccggccccgggagcccccagcgccgggcccagcagcgcgccgcccccggcgagcccggguggaugggccggcucugggugaccuucagcggcaagcugcgccggaucguggacuccaaguacuucucccgcgggaucaugauggcgauccuggucaacacccucuccaugggcguggaguaccacgagcagcccgaggagcugacgaacgcccuggagaucagcaacaucguguucaccuccauguucgcccucgagaugcugcugaagcuccuggccugcgggccccugggcuacauccggaaccccuacaacaucuucgacgggaucaucgucgugaucagcgugugggagaucgucggccaggccgacggcgggcucagcgugcugcgcaccuuccgccugcuccgggugcugaagcugguccgcuuccuccccgcgcugcggcgccagcugguggugcucgucaagaccauggacaacguggccacguucugcacccugcugaugcuguucaucuucaucuucuccauccugggcaugcaccuguucgggugcaaguucagccucaagaccgacaccggcgacaccgugcccgaccggaagaacuucgacucccugcugugggccaucgucacgguguuccagauccucacccaggaggacuggaacgugguccuguacaacgggauggccagcaccuccagcugggcggcccuguacuucguggcccucaugaccuucggcaacuacgugcuguucaaccugcucgucgccauccugguggagggcuuccaggccgagggggacgcgaaccgcuccgacacggacgaggacaagaccagcgugcacuucgaggaggacuuccacaagcugcgggagcuccagaccaccgagcugaagaugugcucccuggccgucacgccgaacggccaccucgaggggcgcggcagccugagcccgccccucaucaugugcaccgccgccacccccaugccgacccccaagagcucccccuuccucgacgccgcgcccagccugccggacucccggcgcgggagcuccagcuccggcgacccgccccugggcgaccagaagcccccggccagccuccggagcucccccugcgcccccugggggcccagcggcgccugguccagccgccgguccagcugguccagccuggggcgcgccccgucccugaagcggcgcggccagugcggcgagcgggagagccuccuguccggggagggcaaggggagcacggacgacgaggcggaggacggccgcgccgcccccgggccccgggccaccccgcugcgccgcgccgagucccucgacccccggccccugcgccccgcggcccugccgcccaccaagugccgggaccgcgacggccaggugguggcccuccccagcgacuucuuccugcggaucgacucccaccgcgaggacgccgcggagcuggacgacgacagcgaggacuccugcugccuccggcugcacaagguccuggagcccuacaagccgcaguggugccgcagccgggaggccugggcccucuaccuguucagcccccagaaccgcuuccgggugagcugccagaaggucaucacccacaagauguucgaccacguggugcuggucuucaucuuccucaacugcgugacgaucgcccuggagcgccccgacaucgaccccggcagcaccgagcggguguuccuguccgucagcaacuacaucuucaccgccaucuucguggcggagaugauggugaaggucguggcccucgggcugcuguccggcgagcacgccuaccuccagagcuccuggaaccugcuggacgggcuccuggugcuggucagccucguggacaucguggucgccauggccuccgcgggcggggccaagauccugggcgugcugcgcgugcuccggcugcugcgcacccugcggccgcuccgcgucaucagccgggcccccggccugaagcuggugguggagacgcucaucuccagccugcgccccaucgggaacaucguccugaucugcugcgccuucuucaucaucuucggcauccucggggugcagcuguucaagggcaaguucuacuacugcgaggggcccgacacccggaacaucuccaccaaggcccagugccgcgcggcccacuaccgcugggugcggcgcaaguacaacuucgacaaccugggccaggcccucaugagccuguucguccuguccagcaaggacggcugggugaacaucauguacgacgggcucgacgccgugggcgucgaccagcagccggugcagaaccacaaccccuggaugcugcuguacuucaucuccuuccuccugaucgugagcuucuucguccugaacauguucguggggguggucguggagaacuuccacaagugccggcagcaccaggaggcggaggaggcccgccggcgcgaggagaagcggcuccgccggcuggagcgccggcgccggaaggcccagcgccggcccuacuacgccgacuacucccccacccgccggagcauccacucccugugcacgagccacuaccucgaccuguucaucaccuucaucaucugcgugaacgucaucaccaugagcauggagcacuacaaccagccgaagucccuggacgaggcccucaaguacugcaacuacguguucaccaucguguucgucuucgaggcggcccugaagcugguggccuucggcuuccgccgguucuucaaggaccgcuggaaccagcucgaccuggccaucgugcugcucagccugauggggaucacgcuggaggagaucgagauguccgccgcgcuccccaucaaccccaccaucauccgcaucaugcggguccugcgcaucgcccgggugcugaagcuccugaagauggccaccggcaugcgcgcccugcucgacaccgugguccaggcccugccccaggugggcaaccuggggcuccuguucaugcuccuguucuucaucuacgcggcccugggcguggagcuguucgggcggcucgagugcagcgaggacaacccgugcgagggccugucccgccacgccacguucagcaacuucggcauggccuuccugacccucuuccgggucuccaccggggacaacuggaacggcaucaugaaggacacccugcgcgagugcagccgggaggacaagcacugccuguccuaccuccccgcgcugagccccguguacuucgugacguucguccugguggcccaguucguccucgugaacguggucguggccgugcugaugaagcaccuggaggaguccaacaaggaggcccgcgaggacgccgagcucgacgcggagaucgagcuggagauggcccaggggcccggcagcgcccggcgcgucgacgccgaccggccgccccugccccaggaguccccgggggcccgcgacgcgcccaaccucguggcccggaaggugagcgucucccgcaugcugagccugcccaacgacuccuacauguuccggcccguggugccggccagcgcgccccacccccgcccccuccaggaggucgagauggagaccuacggcgccggcaccccgcugggguccguggcgagcgugcacuccccgcccgccgaguccugcgccagccugcagaucccccucgccgucuccagcccggcccgguccggcgagccccugcacgcgcugagcccccgcgggaccgcccggucccccagccucucccgccugcugugccgccaggaggccgugcacaccgacagccucgagggcaagaucgacuccccgcgggacacgcuggaccccgccgagcccggggagaagacccccgugcgcccggucacccagggcggcagccugcagagcccgccccggagcccccgccccgcguccgugcggacccgcaagcacacguucgggcagcggugcgugagcucccgccccgccgcccccggcggggaggaggccgaggccagcgacccggcggacgaggaggucucccacaucaccagcagcgccugccccuggcagcccaccgccgagccccacggcccggaggccucccccguggccgggggcgagcgggaccuccgccggcuguacagcguggacgcgcagggcuuccuggacaagcccgggcgcgccgacgagcaguggcggcccuccgccgagcucggcagcggggagccgggcgaggccaaggccugggggcccgaggcggagcccgcccugggcgcccgccggaagaagaagaugagcccgcccugcaucagcgucgagccgcccgccgaggacgagggcuccgcgcgccccagcgccgccgagggcggguccaccacgcugcggcgccggacccccagcugcgaggccacgccccaccgcgacucccucgagcccaccgaggggagcggcgccggcggggaccccgcggccaagggcgagcgcugggggcaggccuccugccgggccgagcaccugacggugccgagcuucgccuucgagccccuggaccucggcgugcccuccggggaccccuuccuggacggcagccacuccgucaccccggagagccgcgcgagcuccagcggcgccaucgugccccuggagccgcccgaguccgagccgcccaugcccgugggggacccgcccgagaagcggcgcggccucuaccugaccgucccccagugcccccuggagaagccggggagccccuccgccacccccgcccccggcgggggcgccgacgacccgguguga

SEQ ID NO: 27614 - RNA, 6672 nt, Artificial Sequence
  derived and/or modified sequence opt1 from CACNA1I__Homo_sapiens__NP_066919
auggccgaguccgccagcccgcccagcuccagcgcggccgcccccgccgccgagcccggcgugaccaccgagcagcccgggccccgcagcccgcccuccagcccgcccggccuggaggagccccucgacggggccgacccccacgugccccaccccgaccuggcccccaucgccuucuucugccugcggcagaccaccagcccccgcaacuggugcaucaagauggugugcaaccccugguucgagugcguguccaugcucgucauccugcugaacugcgugacccucggcauguaccagccgugcgacgacauggacugccuguccgaccggugcaagauccuccagguguucgacgacuucaucuucaucuucuucgccauggagaugguccucaagaugguggcccuggggaucuucggcaagaagugcuaccugggcgacaccuggaaccgccucgacuucuucaucgugauggccgggauggucgaguacucccuggaccugcagaacaucaaccucuccgccauccggacggugcgcgugcugcggccccugaaggccaucaaccgcguccccuccaugcggauccucgugaaccugcugcucgacacccugcccaugcugggcaacgugcuccugcugugcuucuucgucuucuucaucuucgggaucaucggcgugcagcucugggccgggcugcugcgcaaccggugcuuccucgaggagaacuucaccauccagggcgacguggcccugccgcccuacuaccagcccgaggaggacgacgagaugcccuucaucugcucccuguccggcgacaacgggaucaugggcugccacgagaucccgccccucaaggagcaggggcgcgagugcugccuguccaaggacgacgucuacgacuucggcgccggccggcaggaccugaacgccuccgggcucugcgugaacuggaaccgcuacuacaacgugugccggaccggcagcgccaacccccacaagggggccaucaacuucgacaacaucggcuacgcguggaucgucaucuuccaggugaucacgcuggagggguggguggagaucauguacuacgucauggacgcccacuccuucuacaacuucaucuacuucauccugcucaucaucgugggcagcuucuucaugaucaaccugugccuggucgugaucgccacccaguucagcgagaccaagcagcgcgagcaccggcucaugcuggagcagcgccagcgguaccuguccagcuccaccguggccagcuacgccgagcccggcgacugcuacgaggagaucuuccaguacgucugccacauccuccgcaaggcgaagcggcgcgcccuggggcuguaccaggcccuccagucccgccggcaggcccugggccccgaggcccccgcgcccgccaagcccgggccccacgccaaggagccccgccacuaccacggcaagacgaaggggcagggcgacgagggccggcaccuggggagccgccacugccagacccugcacggccccgccuccccggggaacgaccacagcggccgggagcucugcccccagcacagcccccucgacgcgacgccccacacccuggugcagccgauccccgccacgcucgccagcgaccccgccuccugccccugcugccagcacgaggacgggcgccggccgagcggccugggcuccaccgacagcgggcaggagggcuccgggagcggcuccagcgccggcggggaggacgaggcggacggcgacggggcccgcuccagcgaggacggcgccagcuccgagcuggggaaggaggaggaggaggaggagcaggccgacggcgccguguggcucugcggcgacgucuggcgggagacccgcgcgaagcugcgggggaucguggacagcaaguacuucaaccgcggcaucaugauggccauccuggugaacaccgucuccauggggaucgagcaccacgagcagcccgaggagcucacgaacauccuggagaucugcaacgugguguucaccagcauguucgcccuggagaugauccucaagcuggccgccuucggccuguucgacuaccuccggaaccccuacaacaucuucgacuccaucaucgucaucaucagcaucugggagaucguggggcaggcggacggcggccuguccgugcugcgcaccuuccggcuccugcgcguccugaagcucgugcgguucaugcccgcccugcgccggcagcuggugguccucaugaagaccauggacaacguggccacguucugcaugcugcugaugcuguucaucuucaucuucagcauccuggggaugcacaucuucggcugcaaguucucccugcgcaccgacaccggggacaccgugcccgaccgcaagaacuucgacagccuccugugggccaucgucacgguguuccagauccugacccaggaggacuggaacgugguccucuacaacggcauggccuccaccagccccugggccucccuguacuucguggcccugaugaccuucgggaacuacguccuguucaaccugcuggucgccauccucguggagggcuuccaggccgagggcgacgcgaaccggagcuacuccgacgaggaccagagcuccagcaacaucgaggaguucgacaagcugcaggaggggcuggacagcuccggcgaccccaagcucugccccaucccgaugacgcccaacgggcaccuggaccccagccugccccucggcgggcaccugggcccggccggcgccgccgggcccgcgccccgccugucccuccagccggaccccaugcugguggcgcugggcagccggaaguccagcgucaugucccucgggcgcaugagcuacgaccagcggucccugagcuccagccgcuccagcuacuacggccccuggggccgguccgccgccugggccagccgccgguccagcuggaacucccugaagcacaagcccccgagcgccgagcacgagagccuccuguccgcggagcgcgggggcggggcccgggugugcgagguggccgccgacgaggggccgccccgcgcggcgccccugcacaccccgcacgcccaccacauccaccacgggccccaccucgcccaccggcaccgccaccaccggcgcacccugagccuggacaaccgggacuccgucgaccucgccgagcuggugcccgcggugggcgcccacccccgcgccgccuggcgggccgcgggcccggcccccgggcacgaggacugcaacggccgcaugcccagcaucgccaaggacgucuucaccaagaugggggaccggggcgaccgcggggaggacgaggaggagaucgacuacacgcugugcuuccgcgugcggaagaugaucgacguguacaagcccgacuggugcgagguccgcgaggacugguccguguaccucuucagcccggagaaccgguuccgcgugcugugccagaccaucaucgcccacaagcuguucgacuacgucgugcucgccuucaucuuccugaacugcaucaccaucgcgcuggagcggccccagaucgaggccggcuccaccgagcgcaucuuccucaccgugagcaacuacaucuucacggccaucuucgucggcgagaugacccugaagguggugucccuggggcucuacuucggcgagcaggccuaccugcggagcuccuggaacguccuggacggguuccucguguucgugagcaucaucgacaucgucgugucccuggccagcgcgggcggggccaagauccugggcguccuccgcgugcugcggcugcuccgcacccugcggccccugcgcgugaucucccgggcccccggccucaagcuggucguggagacccugaucagcucccucaagccgaucgggaacaucgugcugaucugcugcgccuucuucaucaucuucggcauccuggggguccagcuguucaagggcaaguucuaccacugccugggcguggacacgcgcaacaucaccaaccggagcgacugcauggcggccaacuaccgcugggugcaccacaaguacaacuucgacaaccuggggcaggcccucaugucccuguucguccuggccagcaaggacggcugggugaacaucauguacaacgggcuggacgccguggcggucgaccagcagcccgugaccaaccacaaccccuggaugcuccuguacuucaucagcuuccugcucaucguguccuucuucguccugaacauguucgugggcguggucguggagaacuuccacaagugccggcagcaccaggaggccgaggaggcccgccggcgcgaggagaagcgccugcggcgccucgagaagaagcggcgcaaggcccagcggcugcccuacuacgccaccuacugccacacgcgccugcucauccacagcaugugcaccucccacuaccuggacaucuucaucaccuucaucaucugccugaacguggucaccaugagccucgagcacuacaaccagccgacgucccuggagaccgcgcugaaguacugcaacuacauguucaccaccguguucgugcucgaggccguccugaagcugguggccuucgggcuccggcgcuucuucaaggaccgguggaaccagcuggaccuggccaucgugcuccugagcgucaugggcaucacgcuggaggagaucgagaucaacgccgcgcuccccaucaaccccaccaucauccgcaucaugcgggugcugcgcaucgcccgggugcugaagcuccugaagauggccaccggcaugcgcgcccugcucgacaccgucgugcaggcgcugccccagguggggaaccugggccuccuguucaugcuccucuucuucaucuacgccgcccugggggucgagcuguucggcaagcucgugugcaacgacgagaacccgugcgaggggaugucccggcacgccacguucgagaacuucggcauggccuuccugacccuguuccaggugagcaccggcgacaacuggaacgggaucaugaaggacacccuccgcgacugcacgcacgacgagcgguccugccugagcucccugcaguucgucagcccccucuacuucguguccuucgugcugaccgcgcaguucguccugaucaacgugguggucgccgugcucaugaagcaccuggacgacagcaacaaggaggcccaggaggacgccgagauggacgccgagcuggagcucgagauggcgcacggccuggggcccggcccgcgccugcccaccgggucccccggcgcccccggccgggggccgggcggggccggcgggggcggcgacaccgagggcggccucugccgccggugcuacagccccgcccaggagaaccuguggcuggacuccgugagccucaucaucaaggacucccuggagggggagcugacgaucaucgacaaccucagcggcagcaucuuccaccacuacuccagccccgccggcugcaagaagugccaccacgacaagcaggagguccagcuggcggagaccgaggccuucucccugaacagcgaccgcuccagcuccauccuccugggggacgaccugagccucgaggaccccaccgccugcccgcccggccgcaaggacuccaagggggagcuggacccgcccgagccgaugcgggugggcgaccugggggagugcuucuucccccucagcuccaccgccgugagccccgaccccgagaacuuccugugcgagauggaggagaucccguucaaccccguccgcuccuggcugaagcacgacagcucccaggcgccgcccagcccguucucccccgacgccagcagcccccuccugcccaugccggccgaguucuuccaccccgccgugagcgccagccagaagggccccgagaagggcacggggaccggcacccugcccaagaucgcgcuccagggguccugggccagccugcgguccccgcgcgugaacugcacccugcuccggcaggccacgggcagcgacaccucccuggacgccagccccuccagcuccgccgggagccugcagaccacccucgaggacucccugacccugagcgacagcccccgccgggcgcucggcccgcccgcccccgcccccggcccgcgcgccgggcugagccccgccgcgcggcgccggcugucccuccgcggccgggggcuguucagccugcgcggccuccgggcccaccagcgcucccacagcuccgggggcagcacgagccccggcugcacccaccacgacuccauggaccccagcgacgaggaggggcggggcggggccggcgggggcggcgccggguccgagcacagcgagacccuguccagccugucccucaccagccuguucugcccgccgccgcccccgcccgcccccggccugacgcccgcgcgcaaguucuccagcaccuccagccucgccgcccccgggcggccccacgccgcggcccuggcccacggccuggcccgcucccccagcugggccgcggaccgcuccaaggacccgcccggccgggcgccccuccccauggggcugggcccccuggcgcccccgccccagccgcugcccggggagcucgagcccggcgacgccgccagcaagcgcaagcgguga

SEQ ID NO: 27615 - RNA, 5622 nt, Artificial Sequence
  derived and/or modified sequence opt1 from CACNA1S__Homo_sapiens__NP_000060
auggagcccagcagcccccaggacgagggccugcgcaagaagcagcccaagaagcccgugcccgagauccucccccggccgccccgcgcccuguucugccugacccucgagaacccccugcggaaggccugcaucuccaucguggaguggaagcccuucgagaccaucauccugcucaccaucuucgcgaacugcguggcccuggccguguaccugcccaugcccgaggacgacaacaacucccucaaccuggggcuggagaagcucgaguacuucuuccugaucguguucagcaucgaggccgccaugaagaucaucgccuacggcuuccuguuccaccaggacgccuaccuccgcuccggguggaacgugcuggacuucaccaucguguuccugggcgucuucaccgugauccucgagcaggucaacgucauccagagccacaccgcccccauguccagcaagggggccggccuggacgugaaggcgcugcgggccuuccgcgugcuccggccccugcgccuggucuccggcgugcccagccuccaggugguccugaacuccaucuucaaggccaugcugccccucuuccacaucgcccugcuggugcuguucauggugaucaucuacgccaucaucgggcuggagcuguucaagggcaagaugcacaagaccugcuacuucaucgggaccgacaucgucgcgaccguggagaacgaggagcccagcccgugcgcccggaccggcuccgggcgccggugcacgaucaacggcagcgagugccgcggcggguggcccggccccaaccacgggaucacccacuucgacaacuucggcuucuccaugcucaccguguaccagugcaucaccauggagggcuggacggacguccuguacugggugaacgacgccaucgggaacgaguggcccuggaucuacuucgugacccugauccuccugggcagcuucuucauccugaaccucguccugggggugcuguccggcgaguucaccaaggagcgggagaaggccaagagccgcgggaccuuccagaagcuccgggagaagcagcagcuggacgaggaccugcgcggcuacauguccuggaucacgcagggcgaggucauggacguggaggacuuccgggaggggaagcucagccuggacgagggcgggagcgacaccgagucccuguacgagaucgccggccucaacaagaucauccaguucauccgccacuggcggcaguggaaccgcaucuuccgguggaagugccacgacaucgucaagagcaaggucuucuacuggcuggugauccugaucguggcgcugaacacccucuccaucgccagcgagcaccacaaccagccgcuguggcugacccgccuccaggacaucgccaaccgcguccugcugucccucuucacgaccgagaugcugaugaagauguacgggcugggccuccggcaguacuucaugagcaucuucaaccgcuucgacugcuucguggugugcuccggcauccuggagauccugcucgucgagagcggggccaugacgccccucggcaucuccgugcugcggugcauccgccuccugcggaucuucaagaucaccaaguacuggacgagccuguccaaccucguggccagccugcugaacuccauccgcagcaucgcgucccuccugcugcuccuguuccuguucaucgucaucuucgcccuccuggggaugcagcuguucggcgggcgguacgacuucgaggacaccgaggugcgccggagcaacuucgacaacuucccccaggcccucaucuccguguuccagguccugaccggcgaggacuggaccagcaugauguacaacggcaucauggccuacgggggccccuccuacccggggaugcuggugugcaucuacuucaucauccucuucgugugcggcaacuacauccugcugaacgucuuccucgccaucgcgguggacaaccuggccgaggccgagagccugacgagcgcccagaaggcgaaggccgaggagaagaagcgccggaagauguccaagggccuccccgacaagagcgaggaggagaaguccaccauggccaagaagcuggagcagaagcccaagggggagggcauccccaccaccgccaagcugaagaucgacgaguucgagagcaacgugaacgaggucaaggacccguaccccuccgccgacuuccccggggacgacgaggaggacgagccggagaucccccucagcccccgcccccggccgcuggcggagcugcagcucaaggagaaggccgugcccauccccgaggccuccagcuucuucaucuucucccccacgaacaagauccgcgugcugugccaccggaucgucaacgccaccugguucaccaacuucauccuccuguucauccugcugagcuccgccgcgcucgccgccgaggacccgauccgcgccgacagcaugcggaaccagauccugaagcacuucgacaucggcuucaccuccguguucacgguggagaucguccugaagaugaccaccuacggggccuuccuccacaagggcagcuucugccgcaacuacuucaacaugcuggaccugcucgugguggcggucucccugaucagcaugggccuggaguccagcgccaucagcguggugaagauccuccggguccugcgcgugcugcgcccccuccgggccaucaaccgcgccaaggggcugaagcacgugguccagugcauguucguggcgaucuccaccaucggcaacaucgugcuggucaccacgcuccugcaguucauguucgccugcaucggggugcagcuguucaagggcaaguucuuccggugcaccgaccucagcaagaugaccgaggaggagugccgcggguacuacuacguguacaaggacggcgaccccaugcagaucgagcugcggcaccgcgaguggguccacuccgacuuccacuucgacaacgugcugagcgccaugaugucccucuucaccgugagcacguucgagggcuggccccagcugcuguacaaggccaucgacuccaacgccgaggacgucgggccgaucuacaacaaccggguggagauggcgaucuucuucaucaucuacaucauccucaucgccuucuucaugaugaacaucuucgugggcuucgucaucgugaccuuccaggagcagggggagaccgaguacaagaacugcgagcuggacaagaaccagcgccagugcgugcaguacgcccugaaggcccggccccuccgcugcuacauccccaagaaccccuaccaguaccaggucugguacaucgugaccagcuccuacuucgaguaccugauguucgcccugaucaugcucaacacgaucugccugggcaugcagcacuacaaccagagcgagcagaugaaccacaucuccgacauccugaacgucgcguucaccaucaucuucacccucgagaugauccugaagcugauggccuucaaggcccggggguacuucggcgacccguggaacguguucgacuuccucaucgugaucggcagcaucaucgacgucauccuguccgagaucgacaccuuccuggccagcuccgggggccucuacugccucgggggcgggugcggcaacguggaccccgacgagagcgcccgcaucuccagcgcguucuuccggcuguuccgcgugaugcggcucaucaagcugcugucccgcgccgagggcguccggacgcugcucuggaccuucaucaagagcuuccaggcccugcccuacguggcccugcucaucgugaugcuguucuucaucuacgcggucaucgggaugcagauguucggcaagaucgcccugguggacgggacccagaucaaccgcaacaacaacuuccagaccuucccccaggccgugcuccugcuguuccggugcgccacgggcgaggccuggcaggagauccuccuggcgugcagcuacggcaagcugugcgacccggaguccgacuacgcccccggggaggaguacacgugcggcaccaacuucgccuacuacuacuucaucagcuucuacaugcucugcgccuuccuggucaucaaccuguucguggccgugaucauggacaacuucgacuaccucacccgcgacugguccauccuggggccccaccaccuggacgaguucaaggcgaucugggccgaguacgaccccgaggccaagggccggaucaagcaccucgacgucgugacgcugcugcgccgcauccagccgccccucggguucggcaaguucugcccccaccggguggccugcaagcgccuggucggcaugaacaugccgcugaacagcgacgggaccgugaccuucaacgccacccucuucgcgcuggugcggacggcccugaagaucaagaccgagggcaacuucgagcaggccaacgaggagcuccgcgccaucaucaagaagaucuggaagcggaccuccaugaagcugcuggaccaggucaucccgcccaucggggacgacgaggugaccgugggcaaguucuacgccacguuccucauccaggagcacuuccgcaaguucaugaagcggcaggaggaguacuacggguaccgccccaagaaggacaucguccagauccaggcgggccugcggaccaucgaggaggaggccgccccggagaucugccgcaccgugagcggcgaccuggccgcggaggaggagcucgagcgggccaugguggaggccgccauggaggaggggaucuuccgccggaccggcgggcuguucggccaggucgacaacuuccuggagcgcacgaacucccugccgcccgugauggccaaccagcggccccugcaguucgcggagaucgagauggaggagauggagagcccgguguuccuggaggacuucccccaggacccccgcaccaacccccucgcccgggccaacaccaacaacgccaacgccaacgucgcguacgggaacuccaaccacagcaacucccacguguucagcuccgugcacuacgagcgcgaguucccggaggagaccgagacgcccgccacccggggccgcgcccugggccagcccugccgcguccuggggccccacagcaagccgugcguggagaugcucaagggccugcugacccagcgggccaugccccgcgggcaggcgccgcccgcgccgugccagugcccccggguggaguccagcaugcccgaggaccgcaaguccagcacccccggcucccuccacgaggagaccccgcacagccggagcacgcgcgagaacaccucccggugcagcgcccccgccaccgcccugcugauccagaaggcgcucguccgcggcgggcugggcacccuggccgccgacgccaacuucaucauggccacggggcaggcgcucgccgacgccugccagauggagcccgaggagguggagaucauggccaccgagcugcugaagggccgggaggcccccgaggggauggcguccagccucggcugccugaaccugggcuccagccucgggucccuggaccagcaccagggcagccaggagacccugaucccgccccgccucuga

SEQ ID NO: 27616 - RNA, 3276 nt, Artificial Sequence
  derived and/or modified sequence opt1 from CACNA2D1__Homo_sapiens__NP_000713
auggccgccggcugccugcucgcgcugacccugacccucuuccagagccugcugaucgggcccuccagcgaggagccguuccccuccgccgugacgaucaagagcugggucgacaagaugcaggaggaccucgugacccuggccaagaccgccuccggcgugaaccagcuggucgacaucuacgagaaguaccaggaccucuacaccguggagcccaacaacgcccgccagcugguggagaucgcggcccgggacaucgagaagcugcucagcaaccgcuccaaggcccugguccggcuggcccucgaggcggagaaggugcaggccgcccaccaguggcgcgaggacuucgccagcaacgagguggucuacuacaacgccaaggacgaccuggaccccgagaagaacgacuccgagccggggagccagcggaucaagcccguguucaucgaggacgcgaacuucggccgccagaucuccuaccagcacgccgccgugcacauccccacggacaucuacgaggggagcaccaucguccugaacgagcucaacuggaccuccgcccuggacgagguguucaagaagaaccgggaggaggaccccagccugcucuggcaggucuucggcuccgccaccggccuggcgcgcuacuacccggccagccccuggguggacaacucccggacgcccaacaagaucgaccuguacgacgugcgccggcgccccugguacauccagggggccgccagcccgaaggacaugcucauccugguggacgucuccggcagcgugagcgggcugacccucaagcugauccggaccuccgugagcgagaugcuggagacccucuccgacgacgacuucgucaacguggccagcuucaacuccaacgcgcaggacgugagcugcuuccagcaccugguccaggccaacgugcgcaacaagaagguccugaaggacgccgugaacaacaucacggccaagggcaucaccgacuacaagaagggguucuccuucgccuucgagcagcuccugaacuacaacgugagccgggcgaacugcaacaagaucaucaugcuguucaccgacggcggcgaggagcgcgcccaggagaucuucaacaaguacaacaaggacaagaagguccggguguucaccuucuccguggggcagcacaacuacgaccgcggccccauccaguggauggccugcgagaacaagggguacuacuacgagauccccagcaucggcgccauccggaucaacacgcaggaguaccucgacguccugggccgccccauggugcuggcgggggacaaggccaagcagguccaguggaccaacguguaccucgacgcccuggagcugggccucgugaucaccgggacccugccgguguucaacaucacgggccaguucgagaacaagaccaaccugaagaaccagcucauccugggggucaugggcguggacgugucccuggaggacaucaagcggcucacgccccgcuucacccugugccccaacggcuacuacuucgccaucgaccccaacggguacguccugcugcacccgaaccuccagcccaagaaccccaagagccaggagcccgugacccuggacuuccuggacgccgagcucgagaacgacaucaagguggagauccgcaacaagaugaucgacggcgaguccggggagaagaccuuccggacccuggucaagagccaggacgagcgcuacaucgacaagggcaaccggaccuacacguggaccccggugaacgggaccgacuacucccuggcgcucgugcugcccaccuacagcuucuacuacaucaaggccaagcuggaggagacgaucacccaggcccgcuccaagaagggcaagaugaaggacagcgagacccucaagcccgacaacuucgaggaguccggcuacaccuucaucgcgccccgggacuacugcaacgaccugaagaucagcgacaacaacacggaguuccugcucaacuucaacgaguucaucgaccgcaagaccccgaacaaccccagcugcaacgccgaccugaucaaccggguccugcucgacgccggguucaccaacgagcuggugcagaacuacugguccaagcagaagaacaucaagggcgugaaggcccgcuucgucgugaccgacgggggcaucacccggguguaccccaaggaggccggggagaacuggcaggagaacccggagacguacgaggacagcuucuacaagcgcucccuggacaacgacaacuacgucuucaccgcccccuacuucaacaagagcggccccggcgccuacgaguccgggaucauggugagcaaggcgguggagaucuacauccagggcaagcuccugaagcccgccgucguggggaucaagaucgacgugaacuccuggaucgagaacuucaccaagaccagcauccgggacccgugcgccggccccgucugcgacugcaagcgcaacuccgacgugauggacugcgugauccuggacgacggcggguuccuccugauggccaaccacgacgacuacacgaaccagaucggccgguucuucggggagaucgaccccagccugaugcgccaccucgucaacaucuccguguacgcguucaacaagagcuacgacuaccaguccgugugcgagcccggcgccgccccgaagcagggggccggccaccggagcgccuacguccccuccguggcggacauccugcagaucggcuggugggccaccgccgccgccuggagcauccugcagcaguuccuccugucccugaccuucccccgccuccuggaggcgguggagauggaggacgacgacuucaccgccagccugagcaagcaguccugcaucacggagcagacccaguacuucuucgacaacgacagcaaguccuucagcgggguccucgacugcggcaacugcucccggaucuuccacggggagaagcugaugaacaccaaccugaucuucaucaugguggagagcaaggggaccugccccugcgacacgcgccuccugauccaggccgagcagaccuccgacggcccgaaccccugcgacauggugaagcagccccgguaccgcaagggccccgacgucugcuucgacaacaacgugcuggaggacuacaccgacugcggcggggugagcggccucaacccgucccugugguacaucaucgggauccaguuccugcuccuguggcuggucagcggcuccacccaccgccuccuguga

SEQ ID NO: 27617 - RNA, 3438 nt, Artificial Sequence
  derived and/or modified sequence opt1 from CACNA2D2__Homo_sapiens__NP_001005505
auggccgugcccgcccggaccugcggcgcgagccgccccgggcccgcccgcaccgcccggcccuggcccggcugcgggccgcaccccggccccgggacgcgccggcccaccuccggcccgccccgcccccuguggcuccugcugccccuccugccgcugcucgccgcccccggcgcgagcgccuacuccuucccccagcagcacaccaugcagcacugggcccggcgccuggagcaggaggucgacggggugaugcggaucuucggcggggugcagcagcugcgcgagaucuacaaggacaaccggaaccucuucgagguccaggagaacgagccccagaagcugguggagaagguggccggcgacaucgagagccugcucgaccgcaagguccaggcgcugaagcggcuggccgacgccgccgagaacuuccagaaggcccaccgcuggcaggacaacaucaaggaggaggacaucguguacuacgacgcgaaggccgacgccgagcucgacgacccggaguccgaggacguggagcgggggagcaaggccuccacccugcgccuggacuucaucgaggaccccaacuucaagaacaaggucaacuacagcuacgccgcggugcagauccccacggacaucuacaagggcuccaccgugauccucaacgagcugaacuggaccgaggcccuggagaacgucuucauggagaaccggcgccaggaccccacccuccuguggcaggucuucggcagcgccacgggggugacccgguacuacccggccacccccuggcgcgcccccaagaagaucgaccuguacgacgugcggcgccgccccugguacauccagggcgcguccagcccgaaggacauggugaucaucguggacgucuccgggagcguguccggccucacccugaagcugaugaagacgagcgugugcgagaugcucgacacccuguccgacgacgacuacgucaacguggccagcuucaacgagaaggcccagcccguguccugcuucacccaccugguccaggccaacgugcggaacaagaaggucuucaaggaggccgugcagggcaugguggcgaaggggaccacgggcuacaaggccggguucgaguacgccuucgaccagcuccagaacagcaacaucacccgcgccaacugcaacaagaugaucaugauguucaccgacggcggggaggaccggguccaggacguguucgagaaguacaacuggcccaaccgcaccgugcgggucuucacguucagcgugggccagcacaacuacgacgugacgccccugcaguggauggcgugcgccaacaagggcuacuacuucgagaucccguccaucggggccauccgcaucaacacccaggaguaccuggacguccucggccggcccauggugcuggccgggaaggaggccaagcagguccaguggaccaacguguacgaggacgcgcugggccucgggcugguggugaccggcacccugcccgucuucaaccucacccaggacggcccgggggagaagaagaaccagcugauccugggcgugauggggaucgacguggcccucaacgacaucaagcgccugacccccaacuacacgcugggcgccaacggguacgucuucgccaucgaccucaacggcuacgugcugcugcaccccaaccucaagccccagaccaccaacuuccgggagccggugacccuggacuuccuggacgccgagcuggaggacgagaacaaggaggagauccgccggagcaugaucgacggcaacaaggggcacaagcagauccgcacgcucgucaagucccuggacgagcgguacaucgacgaggugacccgcaacuacaccugggugcccauccggagcaccaacuacucccugggccucguccugccgcccuacagcacguucuaccugcaggcgaaccucuccgaccagauccuccaggugaaguacuucgaguuccugcugcccagcuccuucgagagcgaggggcacguguucaucgcgccccgcgaguacugcaaggaccugaacgccuccgacaacaacaccgaguuccugaagaacuucaucgagcucauggagaaggucacccccgacagcaagcagugcaacaacuuccugcugcacaaccucauccuggacaccggcaucacccagcagcugguggagcggguguggcgcgaccaggaccucaacacguacucccugcuggccgucuucgccgccaccgacggcgggaucacccggguguuccccaacaaggccgccgaggacuggaccgagaacccggagcccuucaacgccagcuucuaccgccgcucccucgacaaccacggcuacguguucaagccgccccaccaggacgcgcugcugcggccccucgagcuggagaacgacacggucgggauccuggugagcaccgccguggagcucucccugggccgccggacccugcgccccgccgucgugggggugaagcucgaccuggaggccugggccgagaaguucaagguccuggcgagcaaccggacccaccaggaccagccccagaagugcggccccaacucccacugcgagauggacugcgaggugaacaacgaggaccuccugugcgugcugaucgacgacggcggguuccucguccugagcaaccagaaccaccagugggaccaggugggccgcuucuucagcgagguggacgccaaccugaugcucgcccuguacaacaacuccuucuacacgcggaaggagagcuacgacuaccaggccgccugcgcgccgcagccgcccgggaaccugggcgccgcgccccgcggggucuucgugcccaccguggccgacuuccucaaccuggccugguggaccuccgccgccgccuggagccuguuccagcagcuccuguacggccugaucuaccacuccugguuccaggccgaccccgcggaggccgagggcagccccgagacccgggaguccagcugcgucaugaagcagacgcaguacuacuucggguccgugaacgccagcuacaacgccaucaucgacugcggcaacugcucccgccucuuccacgcccagcggcugaccaacaccaaccuccuguucguggucgcggagaagccgcugugcagccagugcgaggccgggcgccugcuccagaaggagacccacugccccgccgacggccccgagcagugcgagcuggugcagcggccccgcuaccggcgcgggccgcacaucugcuucgacuacaacgccacggaggacaccuccgacugcggccggggcgccagcuucccgcccucccuggggguccucgugagccugcagcugcuccugcugcucggccugccgccccgcccccagccccaggugcugguccacgcgucccggcgccucuga

SEQ ID NO: 27618 - RNA, 3276 nt, Artificial Sequence
  derived and/or modified sequence opt1 from CACNA2D3__Homo_sapiens__NP_060868
auggccggccccgggagcccgcgccgggccucccgcggcgcgagcgcccugcucgccgccgcccugcuguacgcggcccucggggacgugguccgguccgagcagcagaucccccugagcguggugaagcugugggccuccgccuucggcggggagaucaagagcaucgcggccaaguacuccggcagccagcuccugcagaagaaguacaaggaguacgagaaggacgucgccaucgaggagaucgacggccugcagcucgugaagaagcuggccaagaacauggaggagauguuccacaagaaguccgaggccgugcgccggcuggucgaggcggccgaggaggcccaccucaagcacgaguucgacgccgaccugcaguacgaguacuucaacgccgugcugaucaacgagcgcgacaaggacgggaacuuccucgagcugggcaaggaguucauccuggcgcccaacgaccacuucaacaaccuccccgugaacaucagccuguccgacguccaggugccgaccaacauguacaacaaggaccccgccaucgugaacggggucuacuggagcgagucccugaacaagguguucguggacaacuucgaccgggaccccagccucaucuggcaguacuucggcuccgccaagggguucuuccgccaguaccccggcaucaagugggagccggacgagaacggcgucaucgccuucgacugccggaaccgcaagugguacauccaggccgcgaccagccccaaggacguggugauccuggucgacguguccgggagcaugaagggccugcggcucacgaucgccaagcagaccguguccagcauccuggacacccugggggacgacgacuucuucaacaucaucgccuacaacgaggagcuccacuacgucgagcccugccugaacggcacccuggugcaggccgaccgcacgaacaaggagcacuuccgggagcaccucgacaagcuguucgccaagggcaucgggaugcuggacaucgcgcucaacgaggccuucaacauccugagcgacuucaaccacaccggccagggguccaucugcagccaggccaucaugcugaucaccgacggcgccguggacaccuacgacacgaucuucgcgaaguacaacuggcccgaccgcaagguccggaucuucaccuaccucaucgggcgcgaggccgccuucgccgacaaccugaaguggauggccugcgcgaacaagggcuucuucacccagaucuccacccuggccgacgugcaggagaacgucauggaguaccuccacgugcugagccggccgaaggugaucgaccaggagcacgacgucguguggacggaggccuacaucgacuccacccugccccaggcccagaagcucaccgacgaccagggccccgugcugaugaccacggucgccaugcccguguucagcaagcagaacgagacccgcuccaaggggauccugcucggcguggucgggaccgacgugccggugaaggagcugcugaagaccauccccaaguacaagcucggcauccacggguacgcguucgccaucacgaacaacggcuacauccugacccaccccgagcugcggcugcucuacgaggagggcaagaagcgccggaagcccaacuacagcuccgucgaccugagcgagguggagugggaggaccgcgacgacgugcugcgcaacgccauggucaaccggaagaccgggaaguucuccauggaggugaagaagaccguggacaagggcaagcgcguccucgugaugacgaacgacuacuacuacaccgacaucaaggggaccccguucagccugggcguggcccugucccgggggcacggcaaguacuucuuccgcggcaacgucaccaucgaggaggggcuccacgaccuggagcaccccgacgugagccuggccgacgagugguccuacugcaacacggaccuccaccccgagcaccggcaccugagccagcuggaggcgaucaagcucuaccugaagggcaaggagccccugcuccagugcgacaaggagcugauccaggaggugcuguucgacgccgucguguccgccccgaucgaggccuacuggaccagccucgcgcugaacaaguccgagaacagcgacaaggggguggaggucgccuuccugggcacccgcaccggccucagccggaucaaccuguucgugggggccgagcagcugacgaaccaggacuuccucaaggccggcgacaaggagaacaucuucaacgccgaccacuucccccugugguaccgccgggcggccgagcagauccccggguccuucguguacagcauccccuucuccaccggcccggucaacaagagcaacguggugaccgccuccaccagcauccagcugcucgacgagcgcaagucccccgucguggccgccguggggauccagaugaagcuggaguucuuccagcggaaguucuggacggcgagccgccagugcgccucccuggacggcaagugcagcaucuccugcgacgacgagaccgucaacugcuaccucaucgacaacaacggcuucauccuggugagcgaggacuacacccagaccggggacuucuucggcgagaucgagggggccgugaugaacaagcugcucaccaugggcuccuucaagcggaucacgcuguacgacuaccaggccaugugccgcgccaacaaggagagcuccgacggggcgcacggccugcucgaccccuacaacgccuuccugagcgccgucaaguggaucaugaccgagcugguccucuuccugguggaguucaaccugugcuccugguggcacagcgacaugaccgccaaggcgcagaagcucaagcagacccuggagccgugcgacacggaguaccccgccuucgugagcgagcggaccaucaaggagaccaccggcaacaucgccugcgaggacugcuccaagagcuucgugauccagcagauccccuccagcaaccuguucaugguggucguggacuccagcugccucugcgaguccguggcccccaucacgauggccccgaucgagauccgcuacaacgagagccugaagugcgagcggcugaaggcgcagaagauccgccggcgccccgaguccugccacggguuccaccccgaggagaacgcccgcgagugcggcggggcccccagccuccaggcccagaccguccugcugcuccugccgcugcuccugaugcuguucucccgguga

SEQ ID NO: 27619 - RNA, 3414 nt, Artificial Sequence
  derived and/or modified sequence opt1 from CACNA2D4__Homo_sapiens__NP_758952
auggugugcggcugcagcgcccugcucccccugccgaacccccgccccaccaugcccgccaccccgaacuuccuggcgaaccccuccagcuccagccgguggaucccccuccagcccaugccggucgccugggccuucgugcagaagacguccgcccugcuguggcuccugcugcucgggaccagccugucccccgccuggggccaggcgaagaucccccuggagaccgugaagcucugggccgacaccuucgggggcgaccuguacaacacggucaccaaguacagcgggucccugcuccugcagaagaaguacaaggacguggagagcucccugaagaucgaggagguggacggccucgagcugguccgcaaguucagcgaggacauggagaacaugcugcggcgcaagguggaggccgugcagaaccucgucgaggccgcggaggaggccgaccugaaccacgaguucaacgagucccugguguucgacuacuacaacagcgugcucaucaacgagcgggacgagaagggcaacuucgucgagcugggggccgaguuccugcucgaguccaacgcccacuucagcaaccugcccgugaacaccuccaucagcuccgugcagcugccgaccaacgucuacaacaaggaccccgacauccucaacggcguguacaugagcgaggcccugaacgcgguguucgucgagaacuuccagcgcgaccccacgcugaccuggcaguacuucgggagcgccaccggcuucuuccggaucuaccccgggaucaaguggaccccggacgagaacggcgugaucacguucgacugccgcaaccggggcugguacauccaggccgccaccucccccaaggacaucgugauccucgucgacgugagcggguccaugaagggccugcgcaugaccaucgccaagcacaccaucacgaccauccuggacacccucggggagaacgacuucaucaacaucaucgcguacaacgacuacgugcacuacaucgagcccugcuucaagggcauccugguccaggccgaccgggacaaccgcgagcacuucaagcugcucguggaggagcugauggucaagggcguggggguggucgaccaggcccugcgggaggccuuccagauccucaagcaguuccaggaggccaagcagggcagccugugcaaccaggcgaucaugcugaucuccgacggggccguggaggacuacgagcccguguucgagaaguacaacuggccggacugcaagguccgcguguucaccuaccucaucggccgggaggugagcuucgccgaccgcaugaaguggaucgccugcaacaacaagggguacuacacgcagaucuccacccuggccgacacccaggagaacgucauggaguaccugcacgugcucagccggcccauggugaucaaccacgaccacgacaucaucuggaccgaggcguacauggacuccaagcugcugagcucccaggcccagagccugacgcuccugaccaccgucgccaugcccguguucuccaagaagaacgagacccgcagccacggcauccugcucggcguggucggguccgacguggcccugcgggagcugaugaagcucgcgccccgcuacaagcugggcgugcacggguacgccuuccugaacacgaacaacggcuacauccucagccacccggaccugcggccccuguaccgcgaggggaagaagcucaagcccaagcccaacuacaacuccgucgaccugagcgagguggagugggaggaccaggccgagucccugcgcaccgccaugaucaaccgggagaccggcacccucagcauggacgugaaggucccgauggacaagggcaagcgcgugcuguuccugacgaacgacuacuucuucaccgacaucagcgacacccccuucucccucggggugguccugagccggggccacggggaguacauccugcucggcaacaccuccguggaggaggggcugcacgaccugcuccaccccgaccuggcccuggcgggcgacuggaucuacugcaucacggacaucgacccggaccaccgcaagcucagccagcuggaggccaugauccgguuccugacccgcaaggaccccgaccucgagugcgacgaggagcuggugcgggagguccuguucgacgccguggugaccgcccccauggaggccuacuggaccgcgcucgcccugaacauguccgaggagagcgagcacgucguggacauggccuuccugggcacccgcgccgggcuccugcgguccagccuguucgugggcuccgagaaggucagcgaccgcaaguuccucacgcccgaggacgaggccuccguguucacccuggaccgguucccgcugugguaccgccaggcgagcgagcaccccgccggguccuucguguucaaccuccggugggccgagggccccgagagcgccggcgagcccauggucgugaccgcguccaccgccguggccgucacgguggacaagcgcaccgccaucgccgcggccgccggggugcagaugaagcuggaguuccugcagcggaaguucugggccgccacccgccagugcagcaccgucgacggcccgugcacgcaguccugcgaggacagcgaccucgacugcuucgugaucgacaacaacggguucauccugaucagcaagcggucccgcgagaccggccgguuccugggggagguggacggcgcgguccucacccagcugcugagcaugggcguguucucccaggugaccauguacgacuaccaggccaugugcaagcccagcucccaccaccacagcgccgcccagccccucgucucccccaucagcgccuuccugacggcgacccgcuggcugcuccaggagcuggugcuguuccuccuggagugguccgugugggggagcugguacgaccgcggcgccgaggccaaguccgucuuccaccacagccacaagcacaagaagcaggacccgcugcagcccugcgacaccgaguaccccguguucgucuaccagcccgccauccgggaggcgaacgggaucguggagugcggcccgugccagaagguguucgucgugcagcagauccccaacuccaaccuccugcugcucgugaccgaccccacgugcgacugcagcaucuucccgcccguccugcaggaggccaccgaggugaaguacaacgccuccgugaagugcgaccgcaugcggagccagaagcugcgccggcgccccgacuccugccacgccuuccaccccgaggagaacgcccaggacugcgggggcgcgagcgacaccuccgccagcccgccccuccugcugcuccccgucugcgccuggggccugcugccccagcuccugcgguga

SEQ ID NO: 27620 - RNA, 1797 nt, Artificial Sequence
  derived and/or modified sequence opt1 from CACNB1__Homo_sapiens__NP_000714
auggugcagaagaccagcaugucccgcggccccuacccgcccagccaggagauccccauggaggucuucgaccccuccccgcaggggaaguacagcaagcggaagggccgcuucaagcgguccgacgggagcaccuccagcgacacgaccuccaacagcuucgugcgccagggcuccgccgagagcuacaccucccggcccagcgacuccgacgugagccuggaggaggaccgcgaggcccuccggaaggaggcggagcgccaggcccuggcccagcuggagaaggccaagaccaagcccgucgccuucgcggugcggacgaacgugggguacaaccccuccccgggcgacgagguccccgugcagggcguggccaucaccuucgagcccaaggacuuccuccacaucaaggagaaguacaacaacgacugguggaucgggcgccuggucaaggagggcugcgaggugggguucauccccagcccggugaagcuggacucccuccggcugcugcaggagcagaagcuccgccagaaccggcugggcagcagcaaguccggggacaacagcuccagcucccugggcgacgucgugaccggcacccgccggcccacgccgcccgccagcgccaagcagaagcagaaguccaccgagcacgugccgcccuacgacgucgugcccagcaugcgccccaucauccucguggggcccucccugaagggcuacgaggucaccgacaugaugcagaaggcgcuguucgacuuccucaagcaccgguucgacgggcgcaucagcaucacccgggugacggccgacaucucccuggccaagcgcagcgugcugaacaaccccuccaagcacaucaucaucgagcggagcaacacccgcuccagccucgccgagguccaguccgagaucgagcgcaucuucgagcuggcccggacccugcagcucguggcgcuggacgccgacaccaucaaccaccccgcccagcugagcaagacgucccucgcccccaucaucguguacaucaagaucaccagcccgaagguccugcagcgccugaucaagagccggggcaagucccagagcaagcaccucaacgugcagaucgccgcguccgagaagcuggcccagugcccgcccgagauguucgacaucauccuggacgagaaccagcucgaggacgccugcgagcaccuggccgaguaccuggaggccuacuggaaggcgacccacccgcccagcuccaccccgcccaacccccuccugaaccgcacgauggccaccgccgcccuggccgcgagccccgcccccgucuccaaccuccagggccccuaccuggccagcggggaccagccccuggagcgggccaccggcgagcacgcguccaugcacgaguaccccggggagcucggccagccgcccgggcuguaccccagcucccacccgcccggccgcgccggcacccugcgggcccucagccgccaggacacguucgacgccgacacccccgggucccggaacagcgccuacaccgagcugggcgacuccugcguggacauggagaccgaccccagcgaggggcccggccugggggaccccgcgggcggcgggacgcccccggcccgccagggcuccugggaggacgaggaggaggacuacgaggaggagcucaccgacaaccggaaccgcgggcggaacaaggcccgcuacugcgccgagggcgggggccccgugcugggccggaacaagaacgagcuggagggguggggccgcggggucuacauccgguga

SEQ ID NO: 27621 - RNA, 1818 nt, Artificial Sequence
  derived and/or modified sequence opt1 from CACNB2__Homo_sapiens__NP_000715
augcagugcugcggccuggugcaccgccggcgcguccgggugagcuacggguccgccgacagcuacaccucccgccccagcgacuccgacgugagccucgaggaggaccgggaggccguccgccgggaggcggagcgccaggcccaggcccagcuggagaaggccaagaccaagccgguggccuucgcggugcggacgaacgucuccuacagcgccgcccacgaggacgacgugcccgugcccggcauggccaucuccuucgaggcgaaggacuuccugcacgucaaggagaaguucaacaacgacugguggaucgggcgccucgugaaggagggcugcgagaucggguucauccccagcccggugaagcuggagaacaugcggcugcagcacgagcagcgcgccaagcagggcaaguucuacuccagcaaguccggcgggaacagcuccagcucccucggcgacaucguccccagcucccgcaagagcaccccgcccagcuccgccaucgacaucgacgccaccgggcuggacgccgaggagaacgacauccccgcgaaccaccggagccccaagcccuccgccaacagcgugaccagcccccacagcaaggagaagcggaugccguucuucaagaagacggagcacaccccgcccuacgacgugguccccuccaugcgccccguggugcuggucggccccagccucaagggguacgaggugaccgacaugaugcagaaggcccuguucgacuuccugaagcaccgguucgagggccgcaucuccaucacccgggugacggccgacaucagccucgccaagcgcuccguccugaacaaccccagcaagcacgcgaucaucgagcgguccaacacccgcagcucccuggccgaggugcagagcgagaucgagcgcaucuucgagcucgcccggacccugcagcuggugguccucgacgccgacaccaucaaccaccccgcccagcuguccaagacgagccuggcgccgaucaucguguacgucaagaucuccagccccaaggugcuccagcgccugaucaagagccggggcaagucccaggccaagcaccugaacgugcagauggucgccgccgacaagcucgcccagugcccgcccgagcuguucgacgugauccuggacgagaaccagcucgaggacgcgugcgagcaccuggccgacuaccuggaggccuacuggaaggccacccacccgcccagcuccagccuccccaacccccugcugucccgcacccucgcgaccagcucccugccccugagccccacgcucgccuccaacagccaggggucccagggcgaccagcggaccgaccgcagcgcccccauccgguccgccagccaggccgaggaggagccguccguggagcccgucaagaagucccagcaccgcuccagcagcuccgcgccccaccacaaccaccggagcgggaccucccgcggccugagccggcaggagaccuucgacuccgagacgcaggagagccgcgacuccgccuacguggagcccaaggaggacuacagccacgaccacguggaccacuacgccucccaccgggaccacaaccaccgcgacgagacccacggcagcuccgaccaccggcaccgcgagagccggcaccgcucccgggacgucgaccgcgagcaggaccacaacgagugcaacaagcagcgcagccggcacaaguccaaggaccgcuacugcgagaaggacggggaggugaucagcaagaagcggaacgaggccggcgaguggaaccgcgacguguacauccggcaguga

SEQ ID NO: 27622 - RNA, 1455 nt, Artificial Sequence
  derived and/or modified sequence opt1 from CACNB3__Homo_sapiens__NP_000716
auguacgacgacagcuacgugcccggcuucgaggacuccgaggccgggagcgccgacuccuacaccagccgcccgucccuggacagcgacgucucccucgaggaggaccgggagagcgcgcgccgggagguggagucccaggcccagcagcagcuggagcgcgccaagcacaagcccguggccuucgccguccggaccaacgugagcuacugcggcgugcuggacgaggagugccccguccagggguccggcgugaacuucgaggcgaaggacuuccuccacaucaaggagaaguacagcaacgacugguggaucgggcgccuggugaaggagggcggcgacaucgccuucauccccuccccgcagcggcuggagagcauccgccucaagcaggagcagaaggcccggcgcuccgggaaccccagcucccugagcgacaucggcaaccggcgcuccccgccgcccagccuggccaagcagaagcagaagcaggcggagcacgucccgcccuacgacguggugcccagcaugcggcccgucgugcucguggggcccucccugaagggcuacgaggucacggacaugaugcagaaggcccuguucgacuuccucaagcaccgcuucgacgggcggaucagcaucacccgcgugaccgccgaccugucccuggccaagcggagcgugcucaacaaccccggcaagcgcaccaucaucgagcgguccagcgcccgcuccagcaucgcggagguccaguccgagaucgagcggaucuucgagcuggccaagagccugcagcucguggugcuggacgccgacacgaucaaccaccccgcccagcuggccaagaccucccucgcgcccaucaucgucuucgugaaggugagcucccccaagguccugcagcgccugauccgcagccggggcaagucccagaugaagcaccucaccgugcagaugauggccuacgacaagcugguccagugcccgcccgagagcuucgacgugauccuggacgagaaccagcucgaggacgccugcgagcaccuggccgaguaccuggagguguacuggcgcgccacccaccaccccgcgcccgggcccggccuccuggggcccccguccgccauccccggccugcagaaccagcagcuccugggcgagcgcggggaggagcacagcccccuggagcgggacucccucaugcccagcgacgaggccagcgaguccagccggcaggccuggacgggcuccagccagcgcuccagccggcaccuggaggaggacuacgccgacgcguaccaggaccuguaccagccgcaccgccagcacaccuccgggcuccccagcgccaacggccacgacccccaggaccggcugcuggcccaggacuccgagcacaaccacagcgaccgcaacuggcagcggaaccgcccguggcccaaggacuccuacuga

SEQ ID NO: 27623 - RNA, 1563 nt, Artificial Sequence
  derived and/or modified sequence opt1 from CACNB4__Homo_sapiens__NP_000717
augagcuccagcuccuacgccaagaacggcaccgccgacgggccccacagcccgaccucccagguggcgcgcggcacgaccacccggcgcagccggcugaagcgcuccgacgggagcaccacguccaccagcuucauccuccggcagggcuccgccgacagcuacaccucccgccccagcgacuccgacgucagccuggaggaggaccgggaggccauccgccaggagcgggagcagcaggccgccauccagcuggagcgcgcgaaguccaagcccguggccuucgccgugaagaccaacgucagcuacugcggggcccucgacgaggacgugcccgugccguccacggcgaucagcuucgacgccaaggacuuccugcacaucaaggagaaguacaacaacgacugguggaucggccggcuggucaaggagggcugcgagaucggguucauccccagcccccuccgccuggagaacauccggauccagcaggagcagaagcgcggccgguuccacgggggcaaguccagcgggaacuccagcuccagccugggcgagaugguguccggcaccuuccgcgccacccccaccagcacggccaagcagaagcagaaggugaccgagcacaucccgcccuacgacgucgugcccuccaugcggcccgugguccucguggggccgagccugaagggcuacgaggugaccgacaugaugcagaaggcccuguucgacuuccucaagcaccgcuucgacgggcggaucuccaucacccgcgucacggcggacaucagccuggccaagcgguccgugcugaacaaccccagcaagcgcgccaucaucgagcgcuccaacacccggagcucccucgccgaggugcagagcgagaucgagcgcaucuucgagcuggcccggucccugcagcucgucgugcuggacgcggacaccaucaaccaccccgcccagcugaucaagaccagccucgcccccaucaucgugcacgucaaggugagcuccccgaaggugcugcagcgccugaucaagagccggggcaagucccagagcaagcaccucaacguccagcugguggccgccgacaagcuggcgcagugcccgcccgagauguucgacgucauccucgacgagaaccagcuggaggacgccugcgagcaccugggcgaguaccucgaggccuacuggcgcgccacgcacaccaccuccagcacccccaugacgccccugcuggggcggaaccucggcuccaccgcccugagccccuaccccaccgcgaucuccgggcugcagagccagcgcaugcggcacuccaaccacagcaccgagaacucccccaucgagcgccggagccucaugacguccgacgagaacuaccacaacgagcgcgcccgcaagagccggaaccggcuguccagcagcucccagcacagccgcgaccacuacccgcugguggaggaggacuaccccgacuccuaccaggacaccuacaagccccaccggaaccgcggcagccccgggggcuacucccacgacagccggcaccgccucuga

SEQ ID NO: 27624 - RNA, 972 nt, Artificial Sequence
  derived and/or modified sequence opt1 from CACNG2__Homo_sapiens__NP_006069
augggccuguucgaccgcggggugcagaugcuccugaccaccgucggcgccuucgccgcguucagccugaugacgaucgccguggggaccgacuacuggcucuacucccggggcgugugcaagaccaagagcgucuccgagaacgagaccagcaagaagaacgaggaggugaugacgcacuccgggcuguggcggaccugcugccuggagggcaacuucaagggccucugcaagcagaucgaccacuuccccgaggacgccgacuacgaggccgacaccgccgaguacuuccugcgcgcggugcgcgccagcuccaucuucccgauccugagcgucauccuccuguucaugggcgggcugugcaucgccgccuccgaguucuacaagacccggcacaacaucauccucagcgcggggaucuucuucguguccgccggccugagcaacaucaucgggaucaucguguacaucuccgccaacgccggcgaccccagcaaguccgacagcaagaagaacuccuacagcuacggcugguccuucuacuucggggcccugagcuucaucaucgcggagauggucggcgugcucgccgugcacauguucaucgaccgccacaagcagcugcgggccacggcccgcgccaccgacuaccugcaggcgagcgccaucacccggauccccuccuaccgcuaccgguaccagcgccggagccgcuccagcucccggagcaccgagcccucccacagccgcgacgccuccccggucgggaucaagggcuucaacacgcuccccagcaccgagaucuccauguacacccugagccgggacccccugaaggccgccaccacgcccaccgcgaccuacaacuccgaccgcgacaacagcuuccuccaggugcacaacugcauccagaaggagaacaaggacucccugcacagcaacaccgccaaccggcgcacgaccccgguguga

SEQ ID NO: 27625 - RNA, 948 nt, Artificial Sequence
  derived and/or modified sequence opt1 from CACNG3__Homo_sapiens__NP_006530
augcgcaugugcgaccggggcauccagaugcugaucaccaccgugggggccuucgccgcguucagccucaugacgaucgccgucggcaccgacuacuggcuguacucccgcggggugugccggaccaagagcaccuccgacaacgagacgagccgcaagaacgaggaggugaugacccacuccggccuguggcggaccugcugccucgagggggccuuccgcggcgucugcaagaagaucgaccacuuccccgaggacgccgacuacgagcaggacaccgccgaguaccugcugcgggcggugcgcgccagcuccguguucccgauccucagcgucacgcugcuguucuucggcgggcucugcguggccgccuccgaguuccaccggagccgccacaacgugauccuguccgcgggcaucuucuucgucagcgccgggcuguccaacaucaucggcaucaucguguacaucagcgccaacgccggggaccccggccagcgggacuccaagaaguccuacagcuacggcuggagcuucuacuucggggccuucuccuucaucaucgcggagaucgugggcgucguggccgugcacaucuacaucgagaagcaccagcagcuccgcgccaagagccacagcgaguuccugaagaaguccaccuucgcccggcugccgcccuaccgcuaccgguuccgccggcgcagcuccagccgguccaccgagccccgcagccgggaccucucccccaucagcaagggguuccacaccauccccuccacggacaucagcauguucacccugucccgcgaccccagcaagaucaccaugggcacccugcucaacuccgaccgcgaccacgccuuccugcaguuccacaacagcacgccgaaggaguucaaggagucccugcacaacaaccccgcgaaccggcgcaccacccccgucuga

SEQ ID NO: 27626 - RNA, 984 nt, Artificial Sequence
  derived and/or modified sequence opt1 from CACNG4__Homo_sapiens__NP_055220
auggugcgcugcgaccggggccugcagaugcuccugaccaccgccggggccuucgcggccuucagccugauggccaucgccaucggcacggacuacuggcucuacuccagcgcccacaucugcaacgggaccaaccugaccauggacgacgggcccccgccccgccgggcgcgcggcgaccugacccacuccggccucuggcgggucugcugcaucgagggcaucuacaaggggcacugcuuccgcaucaaccacuuccccgaggacaacgacuacgaccacgacagcuccgaguaccugcugcggaucgugcgcgccagcuccguguuccccauccucagcacgauccugcugcuccugggcgggcugugcaucggcgccgggcggaucuacucccgcaagaacaacaucguccucagcgccggcauccuguucguggcggccggccuguccaacaucaucgggaucaucguguacaucagcuccaacaccggcgacccgagcgacaagcgggacgaggacaagaagaaccacuacaacuacgggugguccuucuacuucggcgcccucagcuucaucgucgccgagaccgugggcgugcuggccgucaacaucuacaucgagaagaacaaggagcugcgcuucaagaccaagcgggaguuccucaaggcguccagcuccagccccuacgcccgcaugcccagcuaccgguaccgccggcgccggucccgcagcuccagccgguccacggaggccagccccucccgcgacgugagcccgauggggcugaagaucaccggcgccauccccaugggggagcuguccauguacacccucagccgcgagccccugaaggugaccacggccgcguccuacagccccgaccaggaggccuccuuccugcagguccacgacuucuuccagcaggaccucaaggagggcuuccacgugagcaugcugaaccggcgcaccaccccgguguga

SEQ ID NO: 27627 - RNA, 828 nt, Artificial Sequence
  derived and/or modified sequence opt1 from CACNG5__Homo_sapiens__XP_011522915
augagcgccugcggccgcaaggcccugacccuccuguccagcguguucgcggucugcgggcugggccuccuggggaucgccguguccaccgacuacuggcuguaccucgaggagggcgugaucgucccccagaaccagagcacggagaucaagaugucccugcacagcgggcuguggcgggugugcuuccucgccggcgaggagcgcggccggugcuucaccaucgaguacgugaugccgaugaacacccagcugaccuccgagagcacggucaacgugcugaagaugauccgcuccgccacccccuucccccucgugagccuguucuucauguucaucggguucauccugaacaacaucggccacauccggccccaccgcaccauccucgccuucgucuccgggaucuucuucauccugagcggccugucccucgugguggggcugguccuguacaucagcuccaucaacgacgagaugcucaaccggaccaaggacgcggagacguacuucaacuacaaguacggcuggagcuucgccuucgccgccaucuccuuccugcugaccgagagcgcgggcgugauguccguguaccucuucaugaagcgcuacaccgccgaggacauguaccggccgcaccccggguucuaccgcccccggcugagcaacugcagcgacuacuccggccaguuccugcaccccgacgccuggguccgcgggcggagcccguccgacaucagcuccgaggccagccuccagaugaacuccaacuaccccgcccugcugaagugccccgacuacgaccagaugagcuccagccccugcuga

SEQ ID NO: 27628 - RNA, 570 nt, Artificial Sequence
  derived and/or modified sequence opt1 from CACNG6__Homo_sapiens__NP_114103
augauguggagcaacuucuuccugcaggaggagaaccgccggcgcggcgccgccgggcggcgccgggcgcacggccaggggcgcuccggccucacccccgagcgggaggggaaggugaagcuggcccugcuccuggccgccgucggcgccacccuggcggugcucagcgugggcacggaguucugggucgagcugaacaccuacaaggccaacggguccgccgugugcgaggccgcgcaccugggccucuggaaggccugcaccaagcgccuguggcaggccgacgugccggucgaccgggacacgugcgggcccgccgagcugcccggcgggcuccugcugcucgugagccuggagguguuccgccacuccguccgggcccugcuccagcgcgugagccccgagccgccgcccgcgccccggcugaccuacgaguacuccuggagccugggcugcggcgugggggccggccucauccugcugcucggggccggcugcuuccugcugcucacccugcccuccuggcccuggggcagccugugccccaagcgcgggcaccgggccaccuga

SEQ ID NO: 27629 - RNA, 1110 nt, Artificial Sequence
  derived and/or modified sequence opt1 from CACUL1__Homo_sapiens__NP_722517
auggaggagagcauggaggaggaggagggcggguccuacgaggccaugauggacgaccagaaccacaacaacugggaggccgcgguggacggcuuccgccagccccugccgcccccgcccccgcccagcuccauccccgcccccgcccgggagccgcccgggggccagcuccuggccguccccgccgugagcguggaccgcaaggggcccaaggagggccugccgaugggcccccagcccccgcccgaggcgaacggggucaucaugaugcucaaguccugcgacgccgccgccgcgguggccaaggccgcccccgcccccaccgcgagcuccaccaucaacaucaacacgagcaccuccaaguuccugaugaacgugaucaccaucgaggacuacaagagcaccuacuggcccaagcuggacggcgccaucgaccagcuccugacgcagucccccggggacuacauccccaucagcuacgagcagaucuacuccugcgucuacaagugcgugugccagcagcacagcgagcagauguacuccgaccugaucaagaagaucaccaaccaccucgagcgggugagcaaggagcugcaggccuccccgcccgaccuguacaucgagcgcuucaacaucgcccucggccaguacaugggggcccugcagagcaucgucccccuguucaucuacaugaacaaguucuacaucgagaccaagcucaaccgggaccugaaggacgaccugaucaagcuguucaccgagcacguggcggagaagcacaucuacucccucaugccccugcuccuggaggcccagagcacgcccuuccaggugacccccagcaccauggccaacaucgucaagggccuguacacccuccgcccggagugggugcagauggcccccacgcuguucuccaaguucauccccaacauccugccgcccgccguggagagcgagcucuccgaguacgcggcccaggaccagaaguuccagcgggagcugauccagaacggcuucacccgcggggaccagagccggaagcgcgccggcgacgagcuggccuacaacuccagcuccgccugcgcgagcucccggggguaccgcuga

SEQ ID NO: 27630 - RNA, 558 nt, Artificial Sequence
  derived and/or modified sequence opt1 from CACYBP__Homo_sapiens__NP_001007215
augcagcagaagucccagaagaaggccgagcugcucgacaacgagaagcccgccgcgguggucgccccgaucaccaccggcuacacggugaagaucagcaacuacgggugggaccagagcgacaaguucgugaagaucuacaucacccugaccggcguccaccaggugcccaccgagaacgugcagguccacuucacggagcgcuccuucgaccugcucgugaagaaccugaacggcaagagcuacuccaugaucgugaacaaccugcucaagcccaucagcgucgagggguccagcaagaaggugaagaccgacaccgugcugauccugugccggaagaaggucgagaacacccgcugggacuaccucacccagguggagaaggagugcaaggagaaggagaagcccuccuacgacacggagaccgacccgagcgaggggcugaugaacgugcugaagaagaucuacgaggacggcgacgacgacaugaagcggaccaucaacaaggccugggucgagucccgcgagaagcaggccaagggcgacacggaguucuga

SEQ ID NO: 27631 - RNA, 6678 nt, Artificial Sequence
  derived and/or modified sequence opt1 from CAD__Homo_sapiens__NP_004332
auggccgcccuggugcuggaggacggcagcguccugcgcgggcagcccuucggcgccgccguguccaccgccggggagguggucuuccagaccggcauggugggguaccccgaggcccugaccgaccccagcuacaaggcccagauccucgugcugaccuacccccugaucggcaacuacggcaucccgcccgacgagauggacgaguucgggcucugcaagugguucgaguccagcggcauccacgucgccgcccugguggugggggagugcugccccacccccucccacuggagcgccacccggacgcugcacgaguggcuccagcagcacggcauccccgggcugcagggcgucgacacccgcgagcugaccaagaagcuccgggagcagggcucccugcuggggaagcucgugcagaacggcaccgagcccagcucccugcccuuccuggaccccaacgcccgcccccucgugccggaggucagcaucaagacgccccggguguucaacaccgggggcgcgccccgcauccuggcccuggacugcggccucaaguacaaccagauccggugccugugccagcgcggggccgaggugaccgucgugcccugggaccacgcccuggacucccaggaguacgagggccucuuccugagcaacgggccgggcgaccccgccuccuaccccagcguggucuccacccugagccgggugcucuccgagcccaacccgcgccccguguucgggaucugccugggccaccagcugcucgcccuggccaucggcgccaagacguacaagaugcgguacgggaaccgcggccacaaccagcccugccugcucgucgggagcggccggugcuuccugaccucccagaaccacggguucgccguggagaccgacagccugcccgccgacugggcgccccuguucaccaacgccaacgacggcagcaacgagggcaucgugcacaacucccugcccuucuucagcguccaguuccaccccgagcaccaggccgggcccuccgacauggagcuccuguucgacaucuuccuggagacggugaaggaggccaccgccggcaaccccggcggccagaccguccgcgagcggcugaccgagcgccucugcccgcccgggaucccgacgcccggcagcggccugccgccgccccggaaggugcugauccucggguccggcgggcugagcaucggccaggcgggcgaguucgacuacuccgggagccaggccaucaaggcccugaaggaggagaacauccagacccuccugaucaaccccaacaucgccaccgugcagaccucccagggccuggccgacaaggucuacuuccugcccaucacgccccacuacgugacccaggugauccgcaacgagcggcccgacgggguccuccugaccuucggcgggcagaccgcgcugaacugcggcguggagcucacgaaggccggcgugcuggcccgcuacgggguccgggugcugggcacccccguggagaccaucgagcucaccgaggaccgccgcgccuucgcggcccggauggccgagaucggggagcacgucgcccccagcgaggccgcgaacucccuggagcaggcccaggccgccgccgagcgccugggcuaccccgugcucgugcgggcggccuucgcccucgggggccugggcagcggguucgccuccaaccgcgaggagcucagcgcccuggucgcgccggccuucgcccacacgucccaggugcugguggacaagagccucaagggcuggaaggagaucgaguacgaggucgugcgggacgccuacgggaacugcgugaccgucugcaacauggagaaccuggacccccugggcauccacaccggggaguccaucgugguggcgcccagccagacccucaacgaccgcgaguaccagcugcugcggcagacggccaucaaggucacccagcaccucggcaucgugggcgagugcaacgugcaguacgcccugaaccccgaguccgagcaguacuacaucaucgaggucaacgcccgccugagccggagcuccgcccucgcgagcaaggccaccggguacccgcuggccuacguggccgccaagcuggcgcucggcaucccccugcccgagcugcgcaacuccgugaccgggggcaccgccgccuucgagcccagcgucgacuacugcguggugaagaucccgcggugggaccucuccaaguuccugcgcgucagcacgaagaucggguccugcaugaaguccgugggcgaggugaugggcaucgggcgguccuucgaggaggccuuccagaaggcccugcgcauggucgacgagaacugcgugggcuucgaccacaccgugaagcccgucagcgacauggagcucgagacccccaccgacaagcggaucuucgugguggcggccgcccugugggccggguacuccgucgaccgccuguacgagcucacgcggaucgaccgcugguuccugcaccggaugaagcgcaucaucgcgcacgcccagcugcucgagcagcaccgcggccagccccugccgcccgaccugcuccagcaggccaagugccugggcuucagcgacaagcagaucgcccuggccgugcucuccaccgagcuggcggugcggaagcugcgccaggagcucgggaucugccccgccgucaagcagaucgacaccguggccgccgaguggccggcccagaccaacuaccuguaccugacguacuggggcaccacccacgaccucaccuuccggacgccccacgugcugguccuggggagcggcguguaccgcaucggguccagcguggaguucgacuggugcgcggucggcugcauccagcagcuccggaagaugggcuacaagaccaucauggugaacuacaaccccgagaccgucuccaccgacuacgacaugugcgaccgccuguacuucgacgagaucagcuucgagguggugauggacaucuacgagcuggagaaccccgagggggucauccucagcaugggcgggcagcugccgaacaacauggccauggcccugcaccggcagcagugccgcgugcucggcacgucccccgaggccaucgacagcgccgagaaccgguucaaguucucccgccugcuggacaccaucgggaucagccagccccaguggcgggagcucuccgaccuggagagcgcgcgccaguucugccagaccgugggcuaccccugcgucgugcggccguccuacgugcugagcggcgccgccaugaacgucgccuacaccgacggggaccucgagcgcuuccuguccagcgccgcggccguguccaaggagcaccccguggucaucagcaaguucauccaggaggccaaggagaucgacguggacgccguggcguccgacggcgucguggccgccaucgccaucagcgagcacguggagaacgccgggguccacuccggcgacgcgacgcuggugaccccgccccaggacaucaccgccaagacccucgagcggaucaaggccaucgugcacgccgucgggcaggagcuccaggugacgggccccuucaaccugcagcucaucgccaaggacgaccagcugaaggugaucgagugcaacguccgcgugagccgguccuuccccuucgugagcaagacccugggcgucgaccucguggcgcuggccacccgcgugaucaugggggaggaggucgagcccgugggccugaugaccggguccggcguggucggcgugaaggugccccaguucagcuucagccggcucgccggggccgacgucgugcugggcguggagaugacguccaccggggaggucgccggcuucggggagagccgcugcgaggcguaccugaaggccaugcucuccaccggcuucaagaucccgaagaagaacauccugcugaccaucggcagcuacaagaacaaguccgagcuccugcccacggugcggcugcucgagagccugggguacucccuguacgccagccucggcaccgccgacuucuacaccgagcacggggugaaggucaccgcgguggacuggcacuucgaggaggccguggacggcgagugcccgccccagcgcuccauccuggagcagcuggccgagaagaacuucgagcucgucaucaaccugagcaugcgcggggccggcggccggcgccuguccagcuucgugacgaagggguaccggacccgccggcuggccgcggacuucuccgugccgcucaucaucgacaucaagugcaccaagcuguucgucgaggcccugggccagaucgggcccgcgccgccccugaaggugcacguggacugcaugaccagccagaagcugguccgccugccgggccucaucgacgugcacguccaccuccgggagcccgggggcacccacaaggaggacuucgccuccggcacggccgcggcccuggccgggggcaucaccauggugugcgccaugcccaacacccggccgcccaucaucgacgcccccgcgcucgcccuggcccagaagcuggccgaggcgggggcccggugcgacuucgcccucuuccugggcgccagcuccgagaacgccgggacccugggcacgguggcgggcagcgccgccgggcucaagcuguaccugaacgagaccuucuccgagcuccgccuggacagcgucgugcaguggauggagcacuucgagaccuggcccagccaccuccccaucguggcccacgccgagcagcagaccgucgcggccgugcugaugguggcccagcugacgcagcgguccguccacaucugccacguggcccgcaaggaggagauccugcucaucaaggccgcgaaggcccggggccugcccgugaccugcgaggucgcgccccaccaccuguuccucagccacgacgaccuggagcgccuggggcccggcaagggcgaggugcggcccgagcucgggucccgccaggacguggaggcccugugggagaacauggccgucaucgacugcuucgcgagcgaccacgcgccccacacccuggaggagaagugcggcucccggccgccgcccggguuccccggccucgagaccaugcugccccugcuccugacggccgugagcgaggggcgccugucccucgacgaccugcugcagcggcuccaccacaacccccgccgcaucuuccaccucccgccccaggaggacaccuacguggaggucgaccuggagcacgaguggaccauccccagccacaugcccuucuccaaggcccacuggacccccuucgagggccagaaggugaagggcacggugcggcgcgucgugcugcgcggggagguggcguacaucgacggccagguccuggugccgcccggguacggccaggacgugcgcaaguggccccagggggccgucccccagcugccgcccagcgcccccgccaccuccgagaugaccaccacgccggagcggccccgccggggcauccccggccuccccgacgggcgcuuccaccucccgccccggauccaccgcgccagcgaccccggccugcccgcggaggagcccaaggagaaguccagccggaagguggccgagcccgagcugauggggacccccgacgggaccugcuacccgccgccgcccgugccgcgccaggccagcccccagaaccuggggacccccggccugcuccacccccagacgagcccgcugcugcacucccucgucggccagcacauccugagcgugcagcaguucaccaaggaccagaugucccaccuguucaacguggcccacacccuccggaugaugguccagaaggagcgcagccuggacauccugaaggggaaggugauggccagcauguucuacgagguguccacccggacgagcuccagcuucgcggccgccauggcccgccucggcggggccguccuguccuucagcgaggcgaccuccagcgugcagaagggcgagucccuggccgacagcgugcagaccauguccugcuacgccgacgucguggugcuccggcacccccagcccggggccgucgagcuggcggccaagcacugccgccggcccgugaucaacgccggcgacggcgugggggagcacccgacccaggcccugcucgacaucuucacgauccgcgaggagcugggcaccgucaacgggaugaccaucaccauggugggcgaccugaagcacggccggacggugcacagccucgccugccugcugacccaguaccgcgucucccuccgcuacguggcgccgcccagccugcggaugcccccgaccgugcgcgccuucgucgccucccgggggaccaagcaggaggaguucgagagcaucgaggaggcccugcccgacaccgacgugcucuacaugacgcgcauccagaaggagcgguucggcuccacccaggaguacgaggccugcuucgggcaguucauccugacgccccacaucaugacccgcgcgaagaagaagauggucgugaugcaccccaugccgcgggugaacgagaucagcgucgagguggacuccgacccccgcgccgccuacuuccggcaggccgagaacggcauguacauccgcauggcccugcucgcgacggugcuggggcgguucuga

SEQ ID NO: 27632 - RNA, 1245 nt, Artificial Sequence
  derived and/or modified sequence opt1 from CADM1__Homo_sapiens__NP_001091987
auggccagcgugguccugcccuccggcagccagugcgccgcggccgccgccgccgcggccccgcccgggcuccgccugcggcugcuccugcuccucuucuccgccgccgcgcugauccccaccggcgacgggcagaaccuguucaccaaggacgugacggugaucgagggcgaggucgccaccaucagcugccaggugaacaaguccgacgacagcgugauccagcuccugaaccccaaccgccagaccaucuacuuccgggacuuccgcccgcugaaggacucccgguuccagcuccugaacuucagcuccagcgagcugaaggucucccucaccaacgugagcaucuccgacgaggggcgcuacuucugccagcuguacacggacccgccccaggagagcuacaccaccaucaccgugcuggugcccccgcggaaccucaugaucgacauccagaaggacacggccgucgagggcgaggagaucgaggugaacugcaccgccauggccuccaagcccgcgaccaccauccgcugguucaagggcaacacggagcugaagggcaagagcgaggucgaggagugguccgacauguacaccgugaccagccagcugaugcucaaggugcacaaggaggacgacgggguccccgugaucugccagguggagcaccccgccgucaccgggaaccugcagacgcagcgguaccuggaggugcaguacaagccccaggugcacauccagaugaccuacccccuccagggccugacccgcgagggggacgcccuggagcugaccugcgaggccaucggcaagccccagcccgucauggugacgugggugcgggucgacgacgagaugccgcagcacgccgugcuguccggccccaaccuguucaucaacaaccucaacaagaccgacaacgggaccuaccgcugcgaggcgagcaacaucgucggcaaggcccacagcgacuacaugcuguacguguacgacucccgggccggggaggagggcagcauccgcgccguggaccacgccgucaucggcggggugguggcggucgugguguucgccaugcugugccuccugaucauccugggccgguacuucgcccgccacaaggggaccuacuucacgcacgaggccaagggcgccgacgacgcggccgacgccgacaccgccaucaucaacgcggagggcgggcagaacaacuccgaggagaagaaggaguacuucaucuga

SEQ ID NO: 27633 - RNA, 1308 nt, Artificial Sequence
  derived and/or modified sequence opt1 from CADM2__Homo_sapiens__NP_001161146
augaucuggaagcgcagcgccgugcugcgguucuacuccgucugcggccuccugcugcaggggagccagggccaguucccccucacccagaacgugaccguggucgagggcgggacggccauccugaccugccgcguggaccagaacgacaacaccucccugcaguggagcaacccggcgcagcagacccucuacuucgacgacaagaaggcccugcgggacaaccgcaucgagcuggugcgggccuccuggcacgagcucagcaucuccgucagcgacgugucccugagcgacgaggggcaguacacgugcucccuguucaccaugcccgugaagaccagcaaggccuaccucaccguccugggcgugcccgagaagccccagaucuccggcuucagcuccccggugauggagggggaccugaugcagcucacgugcaagaccagcggcuccaagcccgccgcggacauccgcugguucaagaacgacaaggagaucaaggacgucaaguaccugaaggaggaggacgccaaccggaagaccuucaccgugagcuccacgcuggacuuccgcguggaccggagcgacgacggggucgccgugaucugccgcguggaccacgagagccucaacgccaccccgcaggucgcgaugcagguccuggagauccacuacacccccuccgugaagaucauccccagcacccccuucccccaggagggccagccccugauccucacgugcgaguccaaggggaagccgcugcccgagcccgugcuguggaccaaggacggcggcgagcuccccgacccggaccggaugguggugagcgggcgcgagcugaacauccuguuccucaacaagaccgacaacggcaccuaccggugcgaggccacgaacaccaucgggcaguccagcgccgaguacguccugaucgugcacgacguccccaacacccugcuccccaccacgaucauccccucccugaccaccgccaccgugacgaccaccguggccaucaccacgagcccgaccaccuccgcgaccacgagcuccauccgcgaccccaacgcccuggccggccagaacggccccgaccacgcccucaucgggggcaucgucgccgugguggucuucgugacccugugcagcaucuuccugcucgggcgguaccuggcgcgccacaagggcaccuaccugaccaacgaggccaagggggccgaggacgcccccgacgccgacaccgcgaucaucaacgccgagggcucccaggugaacgccgaggagaagaaggaguacuucaucuga

SEQ ID NO: 27634 - RNA, 1197 nt, Artificial Sequence
  derived and/or modified sequence opt1 from CADM3__Homo_sapiens__NP_001120645
augggcgcccccgccgcgagccugcuccugcugcuccugcuguucgccugcugcugggcccccgggggcgccaaccucucccaggacgacagccagcccuggaccuccgacgagaccguggucgccgggggcacgguggugcugaagugccaggucaaggaccacgaggacagcucccugcaguggagcaaccccgcgcagcagacccucuacuucggggagaagcgcgcccugcgggacaaccgcauccagcuggugaccuccaccccgcacgagcucagcaucuccaucagcaacguggcccuggccgacgagggcgaguacacgugcuccaucuucaccaugccgguccggaccgccaagagccuggugaccgugcucggcaucccccagaagcccaucaucacgggguacaaguccagccugcgcgagaaggacaccgcgacccugaacugccaguccagcggcuccaagcccgccgcccggcucaccuggcgcaagggggaccaggagcugcacggcgagccgacgcggauccaggaggaccccaacgggaagaccuucaccgucagcuccagcgugaccuuccaggugacgcgcgaggacgacggcgccagcaucgucugcuccgugaaccacgagagccugaagggcgcggaccgguccaccagccagcgcaucgaggugcucuacacccccaccgccaugauccggcccgacccgccccacccccgcgaggggcagaagcugcugcuccacugcgagggccgggggaaccccgucccgcagcaguaccugugggagaaggagggcuccgugccgccccugaagaugacgcaggagagcgcccucaucuuccccuuccugaacaaguccgacagcggcaccuacgggugcaccgccaccuccaacaugggcagcuacaaggccuacuacacgcugaacgugaacgaccccucccccguccccagcuccagcuccaccuaccacgcgaucaucgggggcaucguggccuucaucguguuccuccugcugaucaugcucaucuuccuggggcacuaccugauccgccacaagggcaccuaccucacccacgaggccaagggcagcgacgacgcccccgacgccgacacggcgaucaucaacgccgagggcgggcaguccgggggcgacgacaagaaggaguacuucaucuga

SEQ ID NO: 27635 - RNA, 1167 nt, Artificial Sequence
  derived and/or modified sequence opt1 from CADM4__Homo_sapiens__NP_660339
augggccgcgcccggcgcuuccaguggccccugcuccugcugugggccgcggccgccgggccgggcgccgggcaggaggugcagaccgagaacgucaccguggccgagggcgggguggcggagaucacgugccggcuccaccaguacgacggcagcaucgucgugauccagaaccccgcccgccagacccuguucuucaacggcacccgggcccugaaggacgagcgcuuccagcucgaggaguucagcccccggcgcgugcggauccgccuguccgacgcccggcuggaggacgagggcggguacuucugccagcucuacaccgaggacacccaccaccagaucgcgacccugaccguccugguggcccccgagaacccgguggucgaggugcgcgagcaggccguggagggcggggaggucgagcucuccugccuggugccccggagccgccccgccgccacccugcggugguaccgcgaccggaaggagcucaaggggguguccagcucccaggagaacggcaaggucuggagcguggcguccacggugcgcuuccgggucgaccgcaaggacgacggcgggaucaucaucugcgaggcccagaaccaggcccugcccagcggccacuccaagcagacccaguacgugcuggacgugcaguacagcccgaccgcccggauccacgccucccaggcggucgugcgcgagggggacacccucgugcugacgugcgccgucaccggcaacccccgccccaaccagauccgguggaaccgcggcaacgagagccugcccgagcgggccgaggccgugggggagacccucacccugccgggccuggucuccgccgacaacgggacguacacgugcgaggcgagcaacaagcacggccacgcccgcgcccucuacgugcugguggucuacgaccccggggccgugguggaggcccagaccuccguccccuacgcgaucgugggcggcauccuggcccuccugguguuccugaucaucugcguccucguggggaugguguggugcagcguccggcagaagggcuccuaccugacccacgaggccagcgggcuggacgagcagggcgaggcccgcgaggcguuccucaacgggagcgacggccacaagcggaaggaggaguucuucaucuga

SEQ ID NO: 27636 - RNA, 3768 nt, Artificial Sequence
  derived and/or modified sequence opt1 from CADPS2__Homo_sapiens__NP_001009571
augcuggaccccagcuccagcgaggaggaguccgacgagggccucgaggaggagagccgcgacgugcuggucgccgccggguccagccagcgggcgccgcccgcccccacccgcgagggccggcgcgacgcccccgggcgggccggcgggggcggcgccgcgcgcuccgugagcccgucccccagcgugcuguccgaggggcgggacgagccccagcgccagcucgacgacgagcaggagcggcgcauccggcugcagcuguacgucuucguggugcgcugcaucgccuaccccuucaacgccaagcagccgaccgacauggcccggcgccagcagaagcucaacaagcagcagcugcagcugcucaaggagcgguuccaggcguuccugaacggcgagacgcagaucgucgccgacgaggccuucugcaacgccgugcgcagcuacuacgagguguuccugaaguccgaccgggucgcccgcauggugcagagcgggggcugcuccgcgaacgacuuccgggagguguucaagaagaacaucgagaagcgcguccggagccuccccgagaucgacgggcuguccaaggagaccgugcugagcuccuggaucgccaaguacgacgccaucuaccgcggcgaggaggaccucugcaagcagcccaaccgcauggcccugagcgccgugagcgagcugauccucuccaaggagcagcuguacgagauguuccagcagauccugggcaucaagaagcucgagcaccagcugcuguacaacgcgugccagcucgacaacgccgacgagcaggccgcccagauccggcgcgagcuggacgggcggcugcagcucgccgacaagauggcgaaggagcgcaaguuccccaaguucaucgccaaggacauggagaacauguacaucgaggagcugcggagcuccgucaaccugcucauggccaaccuggagagccugccgguguccaagggcgggcccgaguucaagcuccagaagcugaagcgcagccagaacuccgccuuccuggacaucggcgacgagaacgagauccagcucagcaaguccgacgugguccugagcuucacccuggagaucgugaucauggaggugcagggccucaaguccgucgcccccaaccggaucguguacugcaccauggagguggagggggagaagcugcagacggaccaggcggaggccagccgcccccaguggggcacccagggggacuucaccaccacgcacccgcggcccgucgugaaggucaagcuguucaccgaguccaccggcgugcucgcccuggaggacaaggagcuggggcgcgugauccucuaccccaccagcaacuccagcaaguccgccgagcugcaccggauggucgugcccaagaacagccaggacuccgaccugaagaucaagcucgcggugcgcauggacaagccggcccacaugaagcacagcggcuaccuguacgcccugggccagaaggucuggaagcgguggaagaagcgcuacuucgugcuggugcaggucagccaguacacguucgccaugugcuccuaccgggagaagaaguccgagccccaggagcucaugcagcuggagggguacaccguggacuacaccgacccccaccccggccugcagggcgggugcauguucuucaacgccgugaaggagggggacaccgucaucuucgcgagcgacgacgagcaggaccgcauccucugggugcaggccauguaccgggccacgggccagagcuacaagccggugcccgccauccagacccagaagcugaaccccaagggcgggacccugcacgccgacgcgcagcucuacgccgaccgcuuccagaagcacggcauggacgaguucaucuccgccaaccccugcaagcuggaccacgccuuccuguuccggauccuccagcgccagacccuggaccaccgccugaacgacagcuacuccugccucgggugguucagcccgggccaggucuucgugcuggacgaguacugcgcccgguacggggugcgcggcugccaccggcaccugugcuaccucgcggagcugauggagcacuccgagaacggcgccgucaucgaccccacgcugcuccacuacagcuucgccuucugcgccucccacgugcacgggaaccgccccgacggcaucgggaccgugagcgucgaggagaaggagcgguucgaggagaucaaggagcgccuguccagccugcucgagaaccagaucucccacuuccgguacugcuucccguucggccgccccgagggcgcgcugaaggccacccugagccuccuggagcgggugcugaugaaggacaucgccacccccauccccgccgaggaggugaagaaggucgugcgcaagugccucgagaaggccgcgcugaucaacuacacgcggcugaccgaguacgccaagaucgaggagaccaugaaccaggccuccccggcccgcaagcucgaggagauccugcaccuggccgagcucugcaucgaggugcugcagcagaacgaggagcaccacgcggaggccuucgccugguggcccgaccugcucgccgagcacgccgagaaguucugggcgcuguucaccgucgacauggacacggcccuggaggcccagccccaggacagcugggacagcuucccccucuuccagcugcugaacaacuuccuccggaacgacacccugcugugcaacgggaaguuccacaagcaccuccaggagaucuucgugccgcuggugguccgcuacguggaccugauggaguccagcaucgcccaguccauccaccggggcuucgagcaggagaccuggcagcccgugaacaacgggagcgcgaccuccgaggaccucuucuggaagcuggacgcccugcagauguucgucuucgaccuccacuggcccgagcaggaguucgcccaccaccuggagcagcgccugaagcucauggccagcgacaugcuggaggccugcgugaagcggacgcgcaccgcguucgagcugaagcuccagaaggccuccaagaccaccgaccugcggauccccgccagcgugugcacgauguucaacguccugguggacgccaagaagcaguccaccaagcucugcgcccuggacggcgggcaggaguucggcagccaguggcagcaguaccacuccaagaucgacgaccugaucgacaacagcgugaaggagaucaucucccuccuggucagcaaguucguguccgugcuggagggcguccucagcaagcugucccgcuacgacgaggggaccuucuucagcuccauccugagcuucaccgugaaggcggccgccaaguacguggacgucccgaagcccggcauggaccucgccgacaccuacaucauguucgugcggcagaaccaggacauccugcgcgagaaggugaacgaggagauguacaucgagaagcuguucgaccagugguacagcuccagcaugaaggucaucugcguguggcucacggaccgccuggaccugcagcuccacaucuaccagcugaagacccugaucaagaucgugaagaagaccuaccgggacuuccgccuccaggggguccuggagggcacccugaacuccaagacguacgacaccgugcaccggcgccucaccgucgaggaggccaccgcgagcguguccgagggcgggggccugcaggggaucacgaugaaggacagcgacgaggaggaggagggcuga

SEQ ID NO: 27637 - RNA, 4062 nt, Artificial Sequence
  derived and/or modified sequence opt1 from CADPS__Homo_sapiens__NP_003707
augcuggaccccagcuccagcgaggaggaguccgacgagaucguggaggaggagagcggcaaggagguccucggguccgccccgagcggcgcccgccugucccccagccggaccuccgaggggagcgcgggcuccgccgggcugggcggcgggggcgccggggccggcgccggggugggcgcgggcgggggcgggggcagcggcgccuccagcgggggcggggccggcgggcuccagcccuccagccgcgccggcggcgggcggcccuccagcccgucccccagcguggucagcgagaaggagaaggaggagcuggagcgccugcagaaggaggaggaggagcggaagaagcgccuccagcuguacguguucgugaugcggugcaucgcguaccccuucaacgccaagcagcccaccgacauggcccgccggcagcagaagaucuccaagcagcagcugcagacggucaaggaccgcuuccaggccuuccucaacggcgagacccagaucauggccgacgaggcguucaugaacgccgugcagagcuacuacgagguguuccugaaguccgaccgggucgcccgcauggugcagagcgggggcugcuccgccaacgacagccgggagguguucaagaagcacaucgagaagcgcguccggucccugccggagaucgacgggcucagcaaggagaccgugcuguccagcuggauggccaaguucgacgcgaucuaccgcggcgaggaggacccccggaagcagcaggcccgcaugaccgccuccgccgccagcgagcugauccucuccaaggagcagcuguacgagauguuccagaacauccugggcaucaagaaguucgagcaccagcuccuguacaacgcgugccagcuggacaaccccgacgagcaggccgcccagauccggcgcgagcucgacgggcggcugcagauggccgaccagaucgcccgcgagcgcaaguuccccaaguucgugagcaaggagauggagaacauguacaucgaggagcugaaguccagcgucaaccuccugauggcgaaccuggaguccaugccggugagcaagggcggggaguucaagcuccagaagcugaagcggucccacaacgccagcaucaucgacaugggcgaggagagcgagaaccagcuguccaagagcgacgugguccucuccuucagccuggagguggugaucauggagguccaggggcugaagucccucgcccccaaccgcaucguguacugcacgauggagguggagggcggcgagaagcugcagaccgaccaggccgaggcgagcaagcccaccugggggacccagggcgacuucuccacgacccacgcccugcccgccgucaaggugaagcuguucaccgagagcaccgggguccuggcccuggaggacaaggagcucggccgggugauccugcacccgacgcccaacucccccaagcagagcgaguggcacaagaugaccguguccaagaacugccccgaccaggaccugaagaucaagcucgccguccgcauggacaagccgcagaacaugaagcacagcggcuaccugugggcgaucgggaagaacguguggaagcgguggaagaagcgcuucuucgugcugguccaggugucccaguacaccuucgccaugugcagcuaccgggagaagaaggccgagccccaggagcuccugcagcuggacggcuacaccguggacuacacggacccccagcccgggcucgagggcgggcgcgccuucuucaacgccgucaaggagggcgacaccgugaucuucgcguccgacgacgagcaggaccggauccugugggugcaggccauguaccgcgccaccggccagagccacaagccggucccgcccacccaggugcagaagcugaacgccaagggcgggaacgugccccagcuggacgcccccaucucccaguucuacgcggaccgggcccagaagcacgggauggacgaguucaucagcagcaaccccugcaacuucgaccacgccucccucuucgagaugguccagcgccugacgcuggaccaccggcucaacgacagcuacuccugccugggcugguucagccccggccagguguucgugcuggacgaguacugcgcccgcaacgggguccggggcugccaccgccaccucugcuaccugcgggaccugcucgagcgcgcggagaacggggccaugaucgacccgacccugcugcacuacuccuucgccuucugcgccagccacgugcacggcaaccggcccgacgggaucggcaccgugaccgucgaggagaaggagcgcuucgaggagaucaaggagcgccuccgggugcugcuggagaaccagaucacgcacuuccgcuacugcuuccccuucgggcggcccgagggcgcccucaaggcgacccugucccugcucgagcgcgugcugaugaaggacaucgucaccccggugccccaggaggaggugaagaccgucauccggaagugccuggagcaggccgcccucgugaacuacagccgccuguccgaguacgccaagaucgaggagaaccagaaggacgccgagaacgugggccggcugaucacgcccgcgaagaagcucgaggacaccauccgccuggccgagcuggucaucgaggugcuccagcagaacgaggagcaccacgccgagccccacguggacaagggggaggccuucgccugguggagcgaccugauggucgagcacgcggagaccuuccugucccucuucgccguggacauggacgccgcccuggaggugcagccgcccgacaccugggacagcuucccccuguuccagcuccugaacgacuuccugcggacggacuacaaccucugcaacggcaaguuccacaagcaccuccaggaccuguucgcgccccucgucgugcgcuacguggaccugauggaguccagcaucgcccaguccauccaccggggguucgagcgcgagagcugggagccggucaagucccugaccagcaaccuccccaacgugaaccugcccaacgugaaccugcccaaggucccgaaccuccccgugaacaucccccugggcaucccccagaugccgaccuucuccgcccccagcuggauggccgccaucuacgacgcggacaacgggagcggcaccuccgaggaccuguucuggaagcucgacgcccugcagacguucauccgggaccugcacuggcccgaggaggaguucggcaagcaccucgagcagcgccugaagcugauggccagcgacaugaucgaguccugcgugaagcggacccgcaucgccuucgaggucaagcuccagaagaccagccgguccaccgacuuccgcgugccccagagcaucugcaccauguucaacgugauggucgacgccaaggcgcaguccacgaagcugugcagcauggagauggggcaggagcaccaguaccacuccaagaucgacgagcugaucgaggagaccgugaaggagaugaucacccuccugguggccaaguucgucaccauccuggagggcgugcucgccaagcugagccgguacgacgaggggacgcuguucuccagcuuccucuccuucaccgucaaggccgccagcaaguacguggacgugccgaagcccggcauggacgucgcggacgccuacgugaccuucgugcgccacucccaggacguccugcgggacaaggugaacgaggagauguacaucgagcgccuguucgaccagugguacaacagcuccaugaacgugaucugcaccuggcucacggaccgcauggaccugcagcugcacaucuaccagcucaagacccugauccggauggucaagaagaccuaccgcgacuuccggcugcagggcgugcucgacagcacccugaacuccaagacguacgagaccauccgcaaccggcugaccguggaggaggccaccgccagcgucagcgagggcggcgggcuccaggggaucuccaugaaggacagcgacgaggaggacgaggaggacgacuga

SEQ ID NO: 27638 - RNA, 2520 nt, Artificial Sequence
  derived and/or modified sequence opt1 from CAGE1__Homo_sapiens__NP_001164163
augaacaaggacuaccagaaguucuggagcucccccagcgacccggugcacuucgaggucgacaccucccacgagaagguggagagcauguccgagagcgacaccaugaacguguccaaccugagccagggcgucaugcucucccacagccccaucugcauggagacgaccgggacgaccugcgaccugccccagaacgagaucaagaacuucgagcgcgagaacgaguacgaguccacgcugugcgaggacgccuacggcacccucgacaaccugcugaacgacaacaacaucgagaacuacagcaccaacgcccucauccagcccguggacaccaucuccaucagcucccugcggcaguucgagacggugugcaaguuccacugggucgaggcguucgacgacgagaugaccgagaagccggaguuccagagccagguguacaacuacgccaaggacaacaacaucaagcaggacuccuucaaggaggagaaccccauggagaccagcguguccgccaacaccgaccagcuggggaacgaguacuuccgccagccgccgccccggagcccgccccucauccacugcagcggcgagaugcugaaguucacggagaagucccuggccaagagcaucgccaaggaguccgcgcucaaccccagccagccgcccuccuuccugugcaagaccgccguccccagcaaggagauccagaacuacggggagauccccgagauguccgugagcuacgagaaggaggugaccgccgagggcgucgagcgccccgagaucguguccaccuggagcuccgccggcaucagcuggcgguccgaggcgugccgcgagaacugcgagaugcccgacugggagcagagcgccgagucccugcagcccgugcaggaggacauggcccucaacgagguccugcagaagcugaagcacacgaaccggaagcaggaggugcgcauccaggagcuccagugcagcaaccuguaccuggagaagcgggugaaggagcuccagaugaagaucaccaagcagcaggucuucaucgacgugaucaacaagcugaaggagaacguggaggagcugaucgaggacaaguacaagaucauccucgagaagaacgacaccaagaagacccugcagaaccuggaggagguccucgccaacacgcagaagcaccuccaggagucccgcaacgacaaggagaugcugcagcugcaguucaagaagaucaaggccaacuacgugugccugcaggagcgguacaugaccgagaugcagcagaagaacaagagcgugucccaguaccuggagauggacaagacccucagcaagaaggaggaggaggucgagcgccugcagcagcugaagaaggagcucgagaaggcgaccgccagcgcccuggaccugcucaagcgggagaaggaggcccaggagcaggaguuccugucccugcaggaggaguuccagaagcucgagaaggagaaccuggaggagcgccagaagcucaagagccggcuggagaagcugcugacccaggugcgcaaccuccaguucauguccgagaacgagcggaccaagaacaucaagcugcagcagcagaucaacgaggucaagaacgagaacgccaagcugaagcagcaggucgcgcgcagcgaggagcagaacuacgugcccaaguucgagaccgcccagcugaaggaccagcucgaggaggugcugaaguccgacaucaccaaggacacgaagaccacccacagcaaccugcuccccgacugcucccccugcgaggagcggcugaaccccgccgacaucaagcgcgccagccagcuggccuccaagaugcacagccuccuggcgcugaugguggggcuccugaccugccaggacaucaucaacuccgacgccgagcacuucaaggagagcgagaagguguccgacaucaugcugcagaagcucaagagccugcaccugaagaagaagacgcucgacaaggagcugcugaagcacaaggaccggaucaccaccuuccgcgagcucaucgccaaggagaaggccuuccaggaccacgccaucaaggucaucgacugcgacuccgacgaggccaagagcauccgcgacgugcccacccugcugggcgcgaagcucgacaaguaccacucccugaacgaggagcuggacuuccucaucacgaagcuggggcaccuccuggagagcaaggagaaccacugcaaccggcugaucgaggagaacgacaaguaccagcgccaccugggcaaccucaucaagaaggugaccagcuacgaggagaucaucgagugcgccgaccagcggcuggccaucucccacagccagaucgcgcaccuggaggagcgcaacaagcaccucgaggaccugauccggaagccgcgcgagaaggcccggaagccccgcuccaagagccuggagaaccaccccaaguccaugaccaugaugcccgcccucuucaaggagaaccggaacgaccuggacuga

SEQ ID NO: 27639 - RNA, 786 nt, Artificial Sequence
  derived and/or modified sequence opt1 from CALB1__Homo_sapiens__NP_004920
auggccgagagccaccuccaguccagccucaucaccgccucccaguucuucgagaucuggcugcacuucgacgcggacggcagcggguaccuggagggcaaggagcuccagaaccugauccaggagcugcagcaggcccgcaagaaggccgggcucgagcugucccccgagaugaagaccuucguggaccaguacggccagcgggacgacgggaagaucggcaucgucgagcuggcccacgugcucccgacggaggagaacuuccugcugcuguuccgcugccagcagcucaagagcugcgaggaguucaugaagaccuggcggaaguacgacaccgaccacuccggcuucaucgagaccgaggagcugaagaacuuccucaaggaccugcuggagaaggccaacaagacgguggacgacaccaagcucgcggaguacaccgaccugaugcugaagcuguucgacagcaacaacgacgggaagcuggagcugaccgagauggcccgccuccugcccguccaggagaacuuccugcucaaguuccagggcaucaagaugugcgggaaggaguucaacaaggccuucgagcuguacgaccaggacggcaacggguacaucgacgagaacgagcuggacgcccuccugaaggaccugugcgagaagaacaagcaggaccucgacaucaacaacaucacgaccuacaagaagaacaucauggcgcuguccgacggcggcaagcuguaccggaccgaccucgcccugauccugugcgccggggacaacuga

SEQ ID NO: 27640 - RNA, 816 nt, Artificial Sequence
  derived and/or modified sequence opt1 from CALB2__Homo_sapiens__NP_001731
auggccggcccccagcagcagccgcccuaccugcaccucgccgagcugaccgcgagccaguuccuggagaucuggaagcacuucgacgccgacgggaacggcuacaucgaggggaaggagcucgagaacuucuuccaggagcuggagaaggcccgcaagggcuccgggaugaugagcaaguccgacaacuucggcgagaagaugaaggaguucaugcagaaguacgacaagaacagcgacggcaagaucgagauggccgagcuggcccagauccuccccaccgaggagaacuuccugcugugcuuccggcagcacgugggguccagcgcggaguucauggaggccuggcgcaaguacgacacggaccgguccggcuacaucgaggccaacgagcucaagggguuccugagcgaccugcucaagaaggccaaccgccccuacgacgagcccaagcugcaggaguacacccagaccauccugcggauguucgaccucaacggcgacgggaagcugggccuguccgagaugagccgccuccugcccguccaggagaacuuccugcucaaguuccagggcaugaagcugaccuccgaggaguucaacgcgaucuucacguucuacgacaaggaccggagcggguacaucgacgagcacgagcuggacgcccuccugaaggaccuguacgagaagaacaagaaggagaugaacauccagcagcucaccaacuaccgcaaguccgugaugagccuggccgaggccggcaagcuguaccggaaggaccucgagaucgugcugugcuccgagccgcccauguga

SEQ ID NO: 27641 - RNA, 387 nt, Artificial Sequence
  derived and/or modified sequence opt1 from CALCA__Homo_sapiens__NP_001029125
augggcuuccagaaguucagccccuuccuggcccucuccauccuggugcugcuccaggccgggagccugcacgcggccccguuccgcuccgcccuggagagcucccccgccgaccccgccacccucagcgaggacgaggcgcggcugcugcucgccgcccugguccaggacuacgugcagaugaaggccuccgagcuggagcaggagcaggagcgcgagggcagccggaucaucgcgcagaagcgcgccugcgacaccgccacgugcgugacccaccggcucgccgggcugcugucccgcagcggcggggucgugaagaacaacuucgugcccaccaacgucggcuccaaggccuucggccggcgccggcgcgaccuccaggcguga

SEQ ID NO: 27642 - RNA, 384 nt, Artificial Sequence
  derived and/or modified sequence opt1 from CALCB__Homo_sapiens__NP_000719
augggcuuccgcaaguucagccccuuccuggcccucuccauccuggugcuguaccaggccgggagccuccaggcggccccguuccgguccgcccuggagagcucccccgaccccgccacccugagcaaggaggacgcccgccuccugcuggcggcccucguccaggacuacgugcagaugaaggccuccgagcugaagcaggagcaggagacccagggcagcuccagcgccgcgcagaagcgggccugcaacacggcgaccugcgugacccaccgccuggccgggcuccugucccggagcggcgggauggucaaguccaacuucgugcccaccaacgugggcagcaaggccuucggccgccggcgccgggaccugcaggccuga

SEQ ID NO: 27643 - RNA, 1821 nt, Artificial Sequence
  derived and/or modified sequence opt1 from CALCOCO1__Homo_sapiens__NP_001137154
auggaggagagcccccugucccgcgccccgagccggggcggggugaacuuccucaacgucgcccgcaccuacauccccaacaccaagguggagugccacuacacgcugccgcccggcaccaugcccuccgcgagcgacuggaucgggaucuucaagguggaggccgccugcguccgggacuaccacaccuucgugugguccagcgugcccgaguccaccacggacggcagccccauccacaccuccguccaguuccaggagccccgcccgauggacgagcuggugacccucgaggaggccgacgggggcagcgacauccugcuggugguccccaaggccaccgugcuccagaaccagcuggacgagucccagcaggagcggaacgaccugaugcagcucaagcugcagcuggagggccaggugacggagcuccgcagccggguccaggagcuggagcgcgcgcuggccaccgcccggcaggagcacaccgagcucauggagcaguacaaggggaucucccgcagccacggcgagaucaccgaggagcgggacauccugucccgccagcagggggaccacguggcccggauccuggagcucgaggacgacauccagacgaucagcgagaaggugcugaccaaggaggucgagcuggaccgccuccgggacaccgugaaggcgcugacccgcgagcaggagaagcugcucggccagcugaaggaggugcaggccgacaaggagcaguccgaggccgagcuggagccccucaaggagcagcugcgcggggcccaggagcuggccgcgagcucccagcagaaggccacgcuccugggcgaggagcuggccagcgccgccgcggcccgggaccggaccaucgccgagcuccaccgcagccggcuggaggucgccgaggugaacggccgccuggccgagcucgggcugcaccugaaggaggagaagugccagugguccaaggagcgcgcgggccuccugcagagcguggaggccgagaaggacaagauccugaagcucuccgccgagauccugcggcuggagaaggccguccaggaggagcgcacccagaaccagguguucaagaccgagcucgcccgggagaaggacagcucccuggugcagcugagcgaguccaagcgcgagcucacggagcugcggagcgcgcugcgcguccugcagaaggagaaggagcagcuccaggaggagaagcaggagcugcuggaguacaugcggaagcucgaggcccgccuggagaagguggccgacgagaaguggaacgaggacgccaccaccgaggacgaggaggcggccgucgggcuguccugccccgccgcccucaccgacagcgaggacgaguccccggaggacaugcggcugccgcccuacggccugugcgagcgcggcgaccccgggagcucccccgccggcccccgggaggcgagcccccucguggugaucucccagcccgccccgaucagcccccaccuguccgggcccgccgaggacagcuccagcgacagcgaggccgaggacgagaaguccguccugauggccgcggugcagagcggcggggaggaggccaaccuccugcugcccgagcucggcuccgccuucuacgacauggccagcggcuucacgguggggacccuguccgagaccagcaccggcgggccggccacgcccaccuggaaggagugccccaucugcaaggagcgcuuccccgcggaguccgacaaggacgcccuggaggaccacauggacggccacuucuucuucagcacccaggacccguucaccuucgaguga

SEQ ID NO: 27644 - RNA, 1413 nt, Artificial Sequence
  derived and/or modified sequence opt1 from CALCOCO2__Homo_sapiens__NP_001248319
auggaggagaccaucaaggacccgcccaccagcgccgugcugcucgaccacugccacuucucccaggucaucuucaacagcguggagaaguucuacauccccggcggggacgugacgugccacuacaccuucacccagcacuucaucccccgccggaaggacuggaucggcaucuuccgcgccuucaagugcuuccaggacaagcuggagcaggagcugcucaaguggcggucccaggggcagaagcugcaggucggcuggaagaccacgcgcgaguacuacaccuucaugugggugacccugcccaucgaccucaacaacaagagcgcgaagcagcaggaggugcaguucaaggccuacuaccugccgaaggacgacgaguacuaccaguucugcuacgucgacgaggacgggguggugcggggcgccuccauccccuuccaguuccgccccgagaacgaggaggacauccuggucgugaccacgcagggcgagguggaggagaucgagcagcacaacaaggagcucugcaaggagaaccaggagcugaaggacagcugcaucucccugcagaagcagaacagcgacaugcaggccgagcuccagaagaagcaggaggagcuggagacccugcaguccaucaacaagaagcucgagcugaaggucaaggagcagaaggacuacugggagaccgagcugcuccagcugaaggagcagaaccagaagaugagcuccgagaacgagaagauggggauccggguggaccagcugcaggcccagcucagcacccaggagaaggagauggagaagcuggugcagggcgaccaggacaagacggagcagcuggagcagcucaagaaggagaacgaccaccuguuccugucccucaccgagcagcgcaaggaccagaagaagcuggagcagaccgucgagcagaugaagcagaacgagaccacggcgaugaagaagcagcaggagcugauggacgagaacuucgaccucagcaagcggcuguccgagaacgagaucaucugcaacgcccugcagcgccagaaggagcggcucgagggggagaacgaccugcugaagcgcgagaacagccggcuccuguccuacaugggccuggacuucaacagccuccccuaccaggugccgaccuccgacgagggcggggcccgccagaaccccggccuggccuacgggaaccccuacagcggcauccaggagagcuccagccccuccccgcugagcaucaagaagugccccaucugcaaggcggacgacaucugcgaccacacccucgagcagcagcagaugcagccccugugcuucaacugccccaucugcgacaagaucuucccggccaccgagaagcagaucuucgaggaccacguguucugccacucccuguga

SEQ ID NO: 27645 - RNA, 1527 nt, Artificial Sequence
  derived and/or modified sequence opt1 from CALCR__Homo_sapiens__NP_001158209
augcaguucagcggcgagaagaucuccgggcagcgcgaccugcagaaguccaagaugcgguucaccuucaccagccgcugccucgcccuguuccugcuccugaaccaccccacgccgauccugcccgccuucagcaaccagaccuaccccaccaucgagcccaagccguuccucuacguggucggccggaagaagaugauggacgcgcaguacaagugcuacgaccgcaugcagcagcugcccgccuaccagggggagggccccuacugcaaccggaccugggacggguggcugugcugggacgacacgcccgccggcgugcucuccuaccaguucugcccggacuacuuccccgacuucgaccccagcgagaaggugaccaaguacugcgacgagaagggcgucugguucaagcaccccgagaacaaccgcaccugguccaacuacaccaugugcaacgccuucacgccggagaagcugaagaacgccuacgugcuguacuaccucgcgaucguggggcacagccuguccaucuucacccuggucaucagccucggcaucuucguguucuuccggaagcugaccaccaucuucccccugaacuggaaguaccgcaaggcccucucccuggggugccagcgggugacgcugcacaagaacauguuccucaccuacauccugaacagcaugaucaucaucauccaccuggucgagguggugcccaacggcgagcucguccgccgggaccccguguccugcaagauccugcacuucuuccaccaguacaugauggccugcaacuacuucuggaugcugugcgaggggaucuaccuccacacccugaucguggucgccguguucaccgagaagcagcgccugcggugguacuaccuccugggcuggggcuucccgcuggugcccacgaccauccacgcgaucacccgcgccgucuacuucaacgacaacugcuggcucagcguggagacccaccuccuguacaucauccacgggcccgugauggccgcccuggucgugaacuucuucuuccugcugaacaucgugcggguccucgugacgaagaugcgcgagacccacgaggccgagucccacauguaccugaaggcggucaaggccaccaugauccuggugccccuccugggcauccaguucguggucuucccguggcggcccagcaacaagaugcuggggaagaucuacgacuacgugaugcacucccucauccacuuccagggcuucuucguggccaccaucuacugcuucugcaacaacgagguccagacgaccgugaagcgccagugggcccaguucaagauccaguggaaccagcgguggggccgccggcccagcaaccgcuccgcccgcgcggccgccgccgccgcggaggccggggacauccccaucuacaucugccaccaggagcugcggaacgagccggccaacaaccagggcgaggagagcgccgagaucaucccccugaacaucaucgagcaggagagcuccgccuga

SEQ ID NO: 27646 - RNA, 1386 nt, Artificial Sequence
  derived and/or modified sequence opt1 from CALCRL__Homo_sapiens__NP_005786
auggagaagaagugcacccuguacuuccucgugcugcugcccuucuucaugauccucgucaccgccgagcuggaggagagcccggaggacuccauccagcugggcgugacgcgcaacaagaucaugaccgcccaguacgagugcuaccagaagaucaugcaggaccccauccagcaggcggaggggguguacugcaaccggaccugggacggcuggcucugcuggaacgacgucgccgccgggaccgagagcaugcagcugugccccgacuacuuccaggacuucgaccccuccgagaaggugacgaagaucugcgaccaggacggcaacugguuccgccacccggccagcaaccggaccuggaccaacuacacccagugcaacgugaacacgcacgagaaggucaagaccgcccugaaccucuucuaccugaccaucaucgggcacggccuguccaucgcgagccuccugaucucccugggcaucuucuucuacuucaagagccucuccugccagcgcaucacccugcacaagaaccuguucuucagcuucgugugcaacuccguggucacgaucauccaccucaccgccguggccaacaaccaggcccugguggcgaccaaccccgucagcugcaaggugucccaguucauccaccuguaccucauggggugcaacuacuucuggaugcugugcgagggcaucuaccugcacacccucaucguggucgccguguucgccgagaagcagcaccugaugugguacuacuuccugggguggggcuucccccucauccccgccugcauccacgccaucgcgcggagccuguacuacaacgacaacugcuggaucuccagcgacacgcaccuccuguacaucauccacgggccgaucugcgccgcccugcuggugaaccucuucuuccugcugaacaucguccgcgugcucaucaccaagcugaaggugacccaccaggccgaguccaaccuguacaugaaggccguccgggcgacccucauccuggugccccugcucggcaucgaguucgugcugauccccuggcgccccgagggcaagaucgccgaggaggucuacgacuacaucaugcacauccugaugcacuuccaggggcuccuggugagcacgaucuucugcuucuucaacggcgagguccaggccauccugcggcgcaacuggaaccaguacaagauccaguucgggaacuccuucagcaacagcgaggcccuccgguccgccagcuacaccguguccaccaucagcgacggcccgggcuacucccacgacugccccagcgagcaccugaacgggaaguccauccacgacaucgagaacgugcugcugaagcccgagaaccucuacaacuga

SEQ ID NO: 27647 - RNA, 1617 nt, Artificial Sequence
  derived and/or modified sequence opt1 from CALD1__Homo_sapiens__NP_004333
auggacgacuucgagcgccggcgcgagcugcggcgccagaagcgggaggagaugcgccucgaggccgagcggaucgccuaccagcgcaacgacgacgacgaggaggaggcggcccgggagcgccggcgccgggcccgccaggagcggcugcgccagaagcaggaggaggagagccugggccaggugaccgaccaggucgaggugaacgcccagaacuccgugcccgacgaggaggccaagaccacgaccaccaacacccaggucgagggggacgacgaggcggccuuccucgagcggcuggcccgccgggaggagcgccggcagaagcgccugcaggaggcccucgagcgccagaaggaguucgacccgacgaucaccgacgcgagccugucccugcccagccggcgcaugcagaacgacaccgccgagaacgagaccacggagaaggaggagaaguccgagagccggcaggagcgcuacgagaucgaggagaccgagaccgugaccaaguccuaccagaagaacgacuggcgggacgccgaggagaacaagaaggaggacaaggagaaggaggaggaggaggaggagaagcccaagcgcggcagcaucggggagaaccagaucaaggacgagaagaucaagaaggacaaggagcccaaggaggaggugaaguccuucauggaccggaagaagggcuucacggaggucaagagccagaacggggaguucaugacccacaagcucaagcacaccgagaacaccuucucccgcccgggcggccgggccagcguggacacgaaggaggccgagggggcgccccagguggaggccggcaagcgccuggaggagcugcggcgccggcgcggggagaccgaguccgaggaguucgagaagcucaagcagaagcagcaggaggccgcccuggagcuggaggagcucaagaagaagcgggaggagcgccggaagguccuggaggaggaggagcagcgccggaagcaggaggaggccgaccgcaagcugcgcgaggaggaggagaagcggcgccucaaggaggagaucgagcggcgccgggcggaggccgccgagaagcgccagaagaugcccgaggacggccugagcgacgacaagaagcccuucaagugcuucaccccgaagggguccagccugaagaucgaggagcgggccgaguuccucaacaaguccgugcagaaguccagcggcgucaagagcacccaccaggccgcgaucgugagcaagaucgacucccgccuggagcaguacacgagcgccaucgagggcaccaaguccgccaagcccaccaagcccgccgccagcgaccugcccgugccggcggagggggugcggaacaucaaguccaugugggagaagggcaacgucuucagcucccccaccgccgccgggacgcccaacaaggagaccgccggccucaaggugggcgugagcucccgcaucaacgaguggcugaccaagacccccgacgggaacaagagcccggcgcccaagcccuccgaccugcggcccggcgacgucagcuccaagcgcaaccucugggagaagcagagcguggacaaggugacguccccgaccaaggucuga

SEQ ID NO: 27648 - RNA, 1041 nt, Artificial Sequence
  derived and/or modified sequence opt1 from CALHM1__Homo_sapiens__NP_001001412
augauggacaaguuccgcaugaucuuccaguuccugcagagcaaccaggaguccuucaugaacggcaucugcgggaucauggcccucgccagcgcgcagauguacuccgccuucgacuucaacugccccugccugcccggcuacaacgccgccuacagcgccgggauccugcucgcgccgccccuggugcuguuccuccugggccuggucaugaacaacaacguguccaugcucgccgaggaguggaagcggccccuggggcgccgggccaaggaccccgccgugcugcgcuacauguucugcagcauggcgcagcgggcccucaucgcccccgucguguggguggccgucacccugcuggacggcaagugcuuccucugcgccuucugcaccgcggugcccguguccgcccugggcaacgggagccuggcccccggccucccggcccccgagcuggcccgccugcucgcgcggguccccugccccgagaucuacgacggggacuggcugcuggcccgcgagguggccgugcgguaccuccgcugcaucucccaggcccugggcuggagcuucguccugcucacgacccugcuggccuucguggugcgguccguccgcccgugcuucacccaggcggccuuccucaagagcaaguacuggucccacuacaucgacaucgagcggaagcuguucgacgagaccugcacggagcacgccaaggccuucgccaaggugugcauccagcaguucuucgaggcgaugaaccacgaccuggagcucgggcacacccacggcacccuggccaccgcccccgccagcgcggccgcccccacgacccccgacggcgccgaggaggagcgcgagaagcugcgggggaucaccgaccagggcaccaugaaccgccuccugacguccuggcacaagugcaagccgccccugcggcucgggcaggaggagccgccccugaugggcaacggcugggccgggggcgggccccgcccgccccggaaggagguggcgaccuacuucagcaaggucuga

SEQ ID NO: 27649 - RNA, 972 nt, Artificial Sequence
  derived and/or modified sequence opt1 from CALHM2__Homo_sapiens__XP_006717946
auggccgcccugaucgcggagaacuuccgcuuccucagccuguucuucaaguccaaggacgugaugaucuucaacggccuggucgcccucgggaccgugggcagccaggagcuguucuccguggucgccuuccacugccccugcagcccggcccggaacuaccuguacgggcucgccgcgaucggcgugcccgcccuggugcuguucaucaucgggaucauccucaacaaccacaccuggaaccuggucgccgagugccagcaccgccggacgaagaacugcuccgccgcgcccaccuuccugcuccugagcuccauccugggccgcgccgccguggcccccgugaccuggagcgucaucucccuccugcggggcgaggccuacgugugcgcgcugagcgaguucguggacccguccagccucaccgcccgcgaggagcacuuccccuccgcccacgccacggagauccuggcccgguuccccugcaaggagaaccccgacaaccugagcgacuuccgcgaggaggucucccggcgccuccgguacgagagccagcuguucggguggcugcucaucggcgugguggcgauccuggucuuccugaccaagugccucaagcacuacugcuccccgcugagcuaccgccaggaggccuacugggcccaguaccgggccaacgaggaccagcuguuccagcgcaccgccgaggugcacucccgggugcucgcggccaacaacguccgccgguucuucggguucguggcccugaacaaggacgacgaggagcugaucgccaacuuccccguggagggcacccagccccgcccccaguggaacgccaucacgggggucuaccucuaccgggagaaccagggccugccgcuguacagccgccuccacaagugggcgcagggccuggccgggaacggcgccgcccccgacaacguggagauggcgcugcuccccagcuga

SEQ ID NO: 27650 - RNA, 1035 nt, Artificial Sequence
  derived and/or modified sequence opt1 from CALHM3__Homo_sapiens__NP_001123214
auggacaaguuccgcaugcuguuccagcacuuccagagcuccagcgaguccgugaugaacggcaucugccuccugcuggccgccgugaccgugaagcucuacagcuccuucgacuucaacugccccugccuggugcacuacaacgcgcuguacgggcucggccugcugcucaccccgccccuggcccuguuccucugcgggcugcuggccaaccggcagagcgucgugaugguggaggaguggcgccggcccgccggccaccgccggaaggaccccgggaucauccgcuacaugugcuccagcguccuccagcgggcccuggcggccccgcugguguggauccuccuggcccugcucgacggcaagugcuucgugugcgccuucuccagcuccgucgaccccgagaaguuccuggacuucgcgaacaugacgcccagccaggugcagcuguuccucgccaaggugcccugcaaggaggacgagcugguccgcgacuccccggcccggaaggccgugagccgcuaccugcggugccucucccaggccaucggcuggagcgugacccugcugcucaucaucgcggccuuccuggcccgcugccugcggcccugcuucgaccagaccgucuuccuccagcgccgguacugguccaacuacguggaccuggagcagaagcuguucgacgagaccugcugcgagcacgcccgcgacuucgcccaccggugcgugcuccacuucuucgcgagcaugcgcuccgagcugcaggcccgggggcugcgccggggcaacgccgggcgccgccucgagcugcccgccguccccgagccgcccgagggccuggacagcgggagcggcaaggcccaccuccgggcgaucuccagccgcgagcaggucgaccggcugcuguccacgugguacagcuccaagccgccccucgaccuggccgccagccccggccugugcgggggcgggcucucccaccgcgcccccacccuggcccugggcacccggcugagccagcacaccgacguguga

SEQ ID NO: 27651 - RNA, 450 nt, Artificial Sequence
  derived and/or modified sequence opt1 from CALM2__Homo_sapiens__NP_001734
auggccgaccagcugaccgaggagcagaucgccgaguucaaggaggcguucagccucuucgacaaggacggggacgggaccaucacgaccaaggagcugggcaccgugaugcgcucccuggggcagaaccccaccgaggccgagcuccaggacaugaucaacgaggucgacgccgacggcaacgggacgaucgacuucccggaguuccugaccaugauggcccggaagaugaaggacaccgacagcgaggaggagauccgcgaggccuuccggguguucgacaaggacggcaacggcuacaucuccgcggccgagcugcgccacgugaugaccaaccucggggagaagcugacggacgaggaggucgacgagaugauccgggaggccgacaucgacggcgacggccaggugaacuacgaggaguucgugcagaugaugaccgccaaguga

SEQ ID NO: 27652 - RNA, 450 nt, Artificial Sequence
  derived and/or modified sequence opt1 from CALML3__Homo_sapiens__NP_005176
auggccgaccagcugaccgaggagcaggucaccgaguucaaggaggccuucagccucuucgacaaggacggcgacgggugcaucacgacccgcgagcugggcaccgugaugcggucccuggggcagaaccccaccgaggcggagcuccgcgacaugaugagcgagaucgaccgggacggcaacgggacgguggacuucccggaguuccugggcaugauggcccgcaagaugaaggacaccgacaacgaggaggagauccgggaggccuuccgcguguucgacaaggacggcaacggguucgucuccgccgccgagcugcggcacgugaugacccgccucggcgagaagcugagcgacgaggagguggacgagaugauccgggcggccgacaccgacggggacggccaggucaacuacgaggaguucgugcgcgugcuggucuccaaguga

SEQ ID NO: 27653 - RNA, 441 nt, Artificial Sequence
  derived and/or modified sequence opt1 from CALML5__Homo_sapiens__NP_059118
auggccggcgagcugacccccgaggaggaggcccaguacaagaaggcguucagcgccguggacaccgacgggaacggcacgaucaacgcccaggagcucggggccgcccugaaggcgaccggcaagaaccuguccgaggcccagcuccgcaagcugaucagcgaggucgacuccgacggggacggcgagaucagcuuccaggaguuccugaccgccgccaagaaggcgcgggccggccucgaggaccuccagguggccuuccgcgccuucgaccaggacggggacggccacaucaccguggacgagcugcggcgcgccauggcggggcugggccagccgcugccccaggaggagcuggacgccaugauccgggaggccgacgucgaccaggacgggcgcgugaacuacgaggaguucgcccggaugcucgcccaggaguga

SEQ ID NO: 27654 - RNA, 660 nt, Artificial Sequence
  derived and/or modified sequence opt1 from CALN1__Homo_sapiens__NP_001017440
augcccuuccaccacgugaccgccggccugcucuacaaggggaacuaccugaaccgcagccuguccgccggcagcgacuccgagcagcucgcgaacaucagcgucgaggagcuggacgagauccgggaggccuuccgcgugcuggaccgggacgggaacggcuucaucuccaagcaggagcucgggauggccaugcgcagccugggcuacaugccguccgagguggagcuggccaucaucaugcagcggcucgacauggacggcgacgggcaggucgacuucgacgaguucaugaccauccugggccccaagcuggugagcuccgaggggcgcgacggcuuccucgggaacacgaucgacagcaucuucuggcaguucgacaugcagcggaucacccuggaggagcugaagcacauccucuaccacgccuuccgcgaccaccugaccaugaaggacaucgagaacaucaucaucaacgaggaggagucccugaacgagaccagcggcaacugccagacggaguucgagggcgugcacucccagaagcagaaccggcagaccugcguccgcaagagccucaucugcgcguucgccauggccuucaucaucuccgugaugcugaucgccgcgaaccagauccugcggagcgggauggaguga

SEQ ID NO: 27655 - RNA, 1155 nt, Artificial Sequence
  derived and/or modified sequence opt1 from CALR3__Homo_sapiens__NP_659483
auggcccgcgcccuggugcagcucugggcgaucugcaugcugcggguggcccuggccaccguguacuuccaggaggaguuccucgacggcgagcacuggcgcaaccgguggcugcagagcaccaacgacucccgcuucgggcacuuccggcugagcuccggcaaguucuacgggcacaaggagaaggacaagggccuccagacgacccagaacgggcgcuucuacgccaucagcgcccgguucaagcccuucuccaacaagggcaagacccuggugauccaguacaccgucaagcacgagcagaagauggacugcggcgggggcuacaucaagguguucccggcggacaucgaccagaagaaccugaacggcaagagccaguacuacaucauguucgggcccgacaucugcggguucgacaucaagaaggugcacgucauccuccacuucaagaacaaguaccacgagaacaagaagcugauccgcugcaagguggacggcuucacgcaccuguacacccucauccugcggcccgaccuguccuacgacgugaagaucgacggccagagcaucgaguccgggagcaucgaguacgacuggaaccucaccucccugaagaaggagaccagccccgccgaguccaaggacugggagcagacgaaggacaacaaggcccaggacugggagaagcacuuccuggacgccagcaccuccaagcagagcgacuggaacggcgaccucgacggggacuggccggcgcccaugcugcagaagccgcccuaccaggacggccugaagcccgagggcauccacaaggacgucuggcuccaccgcaagaugaagaacaccgacuaccugacccaguacgaccuguccgaguucgagaacaucggggccaucggccucgagcuguggcagguccggagcgggacgaucuucgacaacuuccugaucaccgacgacgaggaguacgccgacaacuucggcaaggccaccuggggcgagaccaaggggcccgagcgcgagauggacgccauccaggcgaaggaggagaugaagaaggcccgggaggaggaggaggaggagcuccuguccggcaagaucaaccgccacgagcacuacuucaaccaguuccaccggcgcaacgagcuguga

SEQ ID NO: 27656 - RNA, 1254 nt, Artificial Sequence
  derived and/or modified sequence opt1 from CALR__Homo_sapiens__NP_004334
augcugcucagcgugccccugcugcucggccugcuggggcucgccgucgccgagccggcgguguacuucaaggagcaguuccuggacggcgacggguggaccucccgcuggaucgagagcaagcacaaguccgacuucggcaaguucgugcugagcuccgggaaguucuacggcgacgaggagaaggacaagggccuccagaccagccaggacgcccgguucuacgcccuguccgccagcuucgagcccuucuccaacaaggggcagacgcuggucgugcaguucaccgugaagcacgagcagaacaucgacugcggcgggggcuacgucaagcuguuccccaacagccucgaccagaccgacaugcacggggacuccgaguacaacaucauguucggccccgacaucugcggcccggggaccaagaaggugcacgugaucuucaacuacaagggcaagaacguccugaucaacaaggacauccgcugcaaggacgacgaguucacgcaccucuacacccugaucgugcggcccgacaacaccuacgaggugaagaucgacaacagccaggucgaguccgggagccuggaggacgacugggacuuccucccgcccaagaagaucaaggaccccgacgccuccaagcccgaggacugggacgagcgcgcgaagaucgacgaccccaccgacagcaagcccgaggacugggacaagccggagcacauccccgaccccgacgccaagaagcccgaggacugggacgaggagauggacggcgagugggagccgcccgugauccagaaccccgaguacaagggcgaguggaagccccggcagaucgacaacccggacuacaaggggacguggauccaccccgagaucgacaaccccgaguacucccccgacccgagcaucuacgccuacgacaacuucggcgugcuggggcuggaccucuggcaggucaaguccggcaccaucuucgacaacuuccugaucaccaacgacgaggccuacgcggaggaguucgggaacgagaccuggggcgugacgaaggccgccgagaagcagaugaaggacaagcaggacgaggagcagcgccugaaggaggaggaggaggacaagaagcggaaggaggaggaggaggccgaggacaaggaggacgacgaggacaaggacgaggacgaggaggacgaggaggacaaggaggaggacgaggaggaggacgugcccggccaggccaaggacgagcucuga

SEQ ID NO: 27657 - RNA, 948 nt, Artificial Sequence
  derived and/or modified sequence opt1 from CALU__Homo_sapiens__NP_001124146
auggaccugcgccaguuccucaugugccugagccugugcaccgccuucgcccucuccaagcccaccgagaagaaggaccgggugcaccacgagccgcagcugagcgacaagguccacaacgacgcgcaguccuucgacuacgaccacgacgccuuccugggcgccgaggaggccaagacguucgaccagcucacccccgaggagagcaaggagcgccuggggaugaucguggacaagaucgacgccgacaaggacggcuucgugaccgagggggagcugaaguccuggaucaagcacgcgcagaagaaguacaucuacgacaacgucgagaaccaguggcaggaguucgacaugaaccaggacggccucaucagcugggacgaguaccggaacgugaccuacgggacguaccuggacgaccccgaccccgacgacggcuucaacuacaagcagaugauggugcgcgacgagcggcgcuucaagauggccgacaaggacggcgaccugaucgccaccaaggaggaguucaccgccuuccuccacccggaggaguacgacuacaugaaggacaucgucgugcaggagaccauggaggacaucgacaagaacgcggacggguucaucgaccuggaggaguacaucggcgacauguacucccacgacgggaacacggacgagcccgagugggugaagaccgagcgggagcaguucgucgaguuccgcgacaagaaccgggacggcaagauggacaaggaggagaccaaggacuggauccugcccagcgacuacgaccacgccgaggccgaggcccgccaccucguguacgaguccgaccagaacaaggacgggaagcugaccaaggaggagaucguggacaaguacgaccuguucgucggcagccaggccacggacuucggcgaggcgcucgugcggcacgacgaguucuga

SEQ ID NO: 27658 - RNA, 654 nt, Artificial Sequence
  derived and/or modified sequence opt1 from CALY__Homo_sapiens__NP_056537
auggugaagcugggcugcagcuucuccgggaagcccggcaaggacccgggggaccaggacggcgccgccauggacagcgucccccucaucagcccccuggacaucucccagcugcagcccccgcuccccgaccagguggugaucaagacccagaccgaguaccagcuguccagccccgaccagcagaacuuccccgaccuggaggggcagcgccucaacugcucccacccggaggagggccggcgccugcccacggcccggaugaucgccuucgccauggcccugcucggcugcguccugaucauguacaaggccaucugguacgaccaguucacgugccccgacggguuccugcuccgccacaagaucugcacgccccugacccuggagauguacuacaccgagauggacccggagcggcaccgcagcauccucgcggccaucggcgccuacccccugucccggaagcacgggaccgagacccccgccgcguggggcgacggguaccgcgccgccaaggaggagcggaagggccccacccaggccggcgccgcggccgccgccaccgagccgcccgggaagcccagcgccaaggcggagaaggaggccgcccgcaaggccgccggcuccgcggcgcccccgcccgcccaguga

SEQ ID NO: 27659 - RNA, 1074 nt, Artificial Sequence
  derived and/or modified sequence opt1 from CAMK1D__Homo_sapiens__NP_065130
auggcccgcgagaacggcgagagcuccagcuccuggaagaagcaggccgaggacaucaagaagaucuucgaguucaaggagacccuggggaccggcgcguucagcgaggugguccucgccgaggagaaggccaccgggaagcuguucgccgugaagugcauccccaagaaggcccugaagggcaaggaguccagcaucgagaacgagaucgcggugcuccggaagaucaagcacgagaacaucgucgcccuggaggacaucuacgaguccccgaaccaccuguaccucgugaugcagcuggugagcgggggcgagcuguucgaccgcaucgucgagaagggcuucuacaccgagaaggacgccuccacccucauccgccaggugcuggacgccguguacuaccugcaccggauggggaucguccaccgggaccucaagcccgagaaccugcuguacuacagccaggacgaggaguccaagaucaugaucagcgacuucggccucuccaagauggaggggaagggcgacgugaugagcaccgcgugcgggacgcccggcuacguggcccccgagguccuggcccagaagccguacuccaaggccguggacugcuggagcaucggcgugaucgccuacauccugcucugcggguacccgcccuucuacgacgagaacgacuccaagcuguucgagcagauccugaaggcggaguacgaguucgacagccccuacugggacgacaucuccgacagcgccaaggacuucauccgcaaccucauggagaaggaccccaacaagcgguacacgugcgagcaggccgcccgccaccccuggaucgccggcgacaccgcgcugaacaagaacauccacgagagcgucuccgcccagauccggaagaacuucgccaagagcaaguggcgccaggccuucaacgccaccgcgguggugcggcacaugcgcaagcugcaccucggguccagccuggacuccagcaacgccuccgucagcuccagccugucccucgccagccagaaggacugcgccuacguggccaagcccgagucccugagcuga

SEQ ID NO: 27660 - RNA, 1431 nt, Artificial Sequence
  derived and/or modified sequence opt1 from CAMK1G__Homo_sapiens__NP_065172
augggccgcaaggaggaggacgacugcagcuccuggaagaagcagaccaccaacauccggaagacguucaucuucauggaggugcuggggagcggcgccuucuccgaggucuuccucgugaagcagcgccugaccgggaagcuguucgcccucaagugcaucaagaagucccccgcguuccgggacagcagccuggagaacgagaucgccgugcugaagaagaucaagcacgagaacaucgucacccucgaggacaucuacgaguccaccacgcacuacuaccuggugaugcagcuggugagcggcggggagcuguucgaccgcauccuggagcggggcgucuacaccgagaaggacgccucccuggugauccagcagguccucagcgccgugaaguaccugcacgagaacggcaucgugcaccgcgaccugaagccggagaaccuccuguaccugacccccgaggagaacuccaagaucaugaucaccgacuucgggcucagcaagauggagcagaacggcaucauguccacggccugcgggacccccggcuacguggcgcccgagguccuggcccagaagccguacagcaaggccguggacugcugguccaucggggugaucaccuacauccugcucugcggcuacccgcccuucuacgaggagaccgagagcaagcuguucgagaagaucaaggagggcuacuacgaguucgagucccccuucugggacgacaucagcgaguccgccaaggacuucaucugccaccuccucgagaaggaccccaacgagcgguacacgugcgagaaggcgcugagccaccccuggaucgacgggaacaccgcccugcaccgcgacaucuaccccagcgucucccuccagauccagaagaacuucgccaagagcaaguggcggcaggccuucaacgccgcggccguggugcaccacaugcgcaagcugcacaugaaccugcacucccccggcguccggccggagguggagaaccgcccgcccgagacccaggccagcgagaccucccggcccagcucccccgagaucacgaucaccgaggcccccgugcucgaccacagcgucgcccugcccgcgcugacccagcuccccugccagcacgggcgccggccgaccgcccccggcggccgcucccugaacugccuggugaacgggagccuccacaucuccagcucccuggugcccaugcaccagggcagccuggccgccgggcccugcggcugcugcuccagcugccucaacaucggguccaagggcaagagcuccuacugcagcgagccgacgcugcugaagaaggccaacaagaagcagaacuucaagagcgaggucauggugcccgucaaggcguccggcagcucccacugccgggccgggcagaccggcgugugccucaucauguga

SEQ ID NO: 27661 - RNA, 1113 nt, Artificial Sequence
  derived and/or modified sequence opt1 from CAMK1__Homo_sapiens__NP_003647
augcugggcgccguggaggggccccgcuggaagcaggccgaggacauccgggacaucuacgacuuccgcgacguccucggcaccggggcguucagcgaggugauccuggccgaggacaagcggacccagaagcugguggccaucaagugcaucgccaaggaggcccucgagggcaaggagggguccauggagaacgagaucgcgguccugcacaagaucaagcacccgaacaucguggcccuggacgacaucuacgagagcggcggccaccucuaccugaucaugcagcugguguccgggggcgagcuguucgaccgcaucgucgagaagggguucuacacggagcgggacgccagccgccucaucuuccaggugcuggacgccgugaaguaccuccacgaccugggcaucguccaccgggaccugaagcccgagaaccuccuguacuacucccuggacgaggacagcaagaucaugaucuccgacuucgggcucagcaagauggaggaccccggcuccgugcugagcaccgcgugcggcacccccggguacguggccccggagguccuggcccagaagcccuacuccaaggccguggacugcuggagcaucggcgugaucgccuacauccuccugugcggguacccgcccuucuacgacgagaacgacgcgaagcuguucgagcagauccucaaggccgaguacgaguucgacucccccuacugggacgacaucagcgacuccgccaaggacuucauccgccaccugauggagaaggaccccgagaagcgguucacgugcgagcaggcccugcagcaccccuggaucgccggcgacaccgcgcucgacaagaacauccaccagagcgucuccgagcagaucaagaagaacuucgccaagagcaaguggaagcaggccuucaacgccaccgccguggugcgccacaugcggaagcugcagcugggcaccucccaggaggggcagggccagaccgcgagccacggggagcuccugacgcccgucgccggcgggccggccgccggcugcugcugccgcgacugcugcguggagcccggcaccgagcugagccccacccucccccaccagcuguga

SEQ ID NO: 27662 - RNA, 1470 nt, Artificial Sequence
  derived and/or modified sequence opt1 from CAMK2A__Homo_sapiens__NP_057065
auggccaccaucacgugcacccgcuucaccgaggaguaccagcuguucgaggagcucggcaagggggccuucagcgugguccggcgcugcgugaaggugcuggcgggccaggaguacgccgccaagaucaucaacaccaagaagcuguccgcccgggaccaccagaagcucgagcgcgaggcccggaucugccgccugcugaagcaccccaacaucguccggcuccacgacagcaucuccgaggaggggcaccacuaccugaucuucgaccuggugaccggcggggagcuguucgaggacaucguggcgcgcgaguacuacagcgaggccgacgccucccacugcauccagcagauccucgaggccguccugcacugccaccagaugggcguggugcaccgggaccucaagccggagaaccugcugcucgcgagcaagcugaagggcgccgccgucaagcuggccgacuucgggcucgccaucgagguggagggcgagcagcaggcgugguucggguucgccggcacgcccggguaccugucccccgaggugcugcgcaaggaccccuacggcaagccggucgaccucugggccugcggcgugauccuguacauccugcucgugggguacccgcccuucugggacgaggaccagcaccggcuguaccagcagaucaaggccggcgccuacgacuuccccagccccgagugggacaccgucacccccgaggcgaaggaccugaucaacaagaugcucaccaucaaccccuccaagcgcaucacggccgccgaggcccugaagcaccccuggaucagccaccgguccaccguggccagcugcaugcaccgccaggagaccguggacugccugaagaaguucaacgcgcggcgcaagcucaagggggccauccugaccacgaugcuggccacccggaacuucuccggcggcaagagcgggggcaacaagaaguccgacggggucaagaagcgcaagagcuccagcuccgugcagcucauggagagcagcgaguccaccaacaccacgaucgaggacgaggacaccaaggugcggaagcaggagaucaucaaggucaccgagcagcugaucgaggccaucagcaacggcgacuucgaguccuacaccaagaugugcgacccggggaugacggccuucgagcccgaggcgcugggcaaccucguggagggccuggacuuccaccgcuucuacuucgagaaccuguggagccggaacuccaagcccgugcacaccaccauccucaacccccacauccaccugaugggggacgagagcgccugcaucgccuacauccgcaucacccaguaccuggacgccggcgggaucccgcgcacggcgcaguccgaggagacccgggucuggcaccgccgggacggcaaguggcagaucgugcacuuccaccgcagcggggcccccuccguccucccccacuga

SEQ ID NO: 27663 - RNA, 2001 nt, Artificial Sequence
  derived and/or modified sequence opt1 from CAMK2B__Homo_sapiens__NP_001211
auggccaccaccgugacgugcacccgcuucaccgacgaguaccagcuguacgaggacaucggcaagggggccuucagcgucgugcggcgcugcgugaagcucugcaccggccacgaguacgccgccaagaucaucaacacgaagaagcuguccgcccgggaccaccagaagcuggagcgcgaggcccggaucugccgccuccugaagcacagcaacaucguccggcugcacgacuccaucagcgaggagggguuccacuaccucguguucgaccuggugaccggcggggagcuguucgaggacaucgucgcccgcgaguacuacuccgaggcggacgccagccacugcauccagcagauccucgaggccgugcugcacugccaccagaugggcgugguccaccgggaccugaagcccgagaaccuccugcuggccuccaagugcaagggcgcggccgugaagcucgccgacuucgggcuggccaucgaggugcagggcgaccagcaggccugguucggguucgcgggcaccccgggguaccugagccccgagguccuccgcaaggaggccuacggcaagcccguggacaucugggccugcggcgugauccuguacauccugcucgucggguacccgcccuucugggacgaggaccagcacaagcuguaccagcagaucaaggccggcgccuacgacuuccccucccccgagugggacaccgugacgcccgaggcgaagaaccugaucaaccagaugcucaccaucaacccggccaagcggaucaccgcccacgaggcccugaagcaccccugggugugccagcgcagcaccgucgccuccaugaugcaccggcaggagacgguggagugccugaagaaguucaacgcgcgccggaagcucaagggggccauccugaccaccaugcuggccacccgcaacuucagcgugggccggcagacgaccgcccccgccaccauguccaccgcggccagcggcacgaccauggggcucgucgagcaggccaagucccugcugaacaagaaggccgacggcgugaagccccagaccaacagcaccaagaacuccgcggccgccacgagcccgaaggggacccucccgcccgccgcccuggagccccagaccaccgugauccacaaccccgucgacggcaucaaggaguccagcgacagcgcgaacacgaccaucgaggacgaggacgccaaggcgccccgcgugcccgacauccuguccagcguccggcgcggguccggcgcccccgaggccgagggcccgcuccccugccccagccccgccccguucagcccccugcccgcccccuccccgcggaucuccgacauccugaacagcgugcgccgcggguccggcacccccgaggccgaggggccccucagcgccggcccgccgcccugccugucccccgcccugcucgggccccugagcucccccagcccccggaucuccgacauccugaacagcgugcgccggggcuccggcacccccgaggcggaggggccgagccccgucggcccgccgcccugccccucccccacgauccccgggccccuccccacccccagccgcaagcaggagaucaucaagaccaccgagcagcugaucgaggccgugaacaacggcgacuucgaggccuacgccaagaucugcgaccccgggcugacgagcuucgagccggaggcgcucggcaaccugguggagggcauggacuuccaccgguucuacuucgagaaccugcuggccaagaacuccaagcccauccacaccaccauccucaacccccacguccacgugaucggggaggacgccgccugcaucgccuacauccgccugacccaguacaucgacggccaggggcggccccgcaccagccaguccgaggagacgcggguguggcaccgccgggacggcaaguggcagaacguccacuuccacugcagcggcgcgccgguggcgccccugcaguga

SEQ ID NO: 27664 - RNA, 1500 nt, Artificial Sequence
  derived and/or modified sequence opt1 from CAMK2D__Homo_sapiens__NP_001212
auggccagcaccaccacgugcacccgcuucaccgacgaguaccagcuguucgaggagcucggcaagggggccuucuccgugguccggcgcugcaugaagauccccaccggccaggaguacgcggccaagaucaucaacacgaagaagcugagcgcccgggaccaccagaagcuggagcgcgaggcccggaucugccgccuccugaagcaccccaacaucgugcggcugcacgacuccaucagcgaggagggguuccacuaccucguguucgaccuggucaccggcggggagcuguucgaggacaucguggcccgcgaguacuacuccgaggcggacgccagccacugcauccagcagauccucgaguccgugaaccacugccaccugaacggcaucguccaccgggaccugaagcccgagaaccuccugcuggccagcaaguccaagggcgccgcggugaagcucgccgacuucgggcuggccaucgaggugcagggcgaccagcaggccugguucggguucgccggcacccccggguaccugagccccgagguccuccgcaaggacccguacggcaagcccguggacaugugggcgugcggcgugauccuguacauccugcucgucggguacccgcccuucugggacgaggaccagcaccggcuguaccagcagaucaaggccggcgccuacgacuuccccucccccgagugggacaccgugacgcccgaggccaaggaccugaucaacaagaugcucaccaucaaccccgccaagcgcaucaccgcgagcgaggcccugaagcacccguggaucugccagcgguccaccguggccagcaugaugcaccgccaggagacggucgacugccugaagaaguucaacgcccggcgcaagcucaagggggccauccugaccaccaugcuggcgacccggaacuucuccgccgccaagagccuccugaagaagcccgacggcgugaaggaguccacggagagcuccaacaccaccaucgaggacgaggacgugaaggcccgcaagcaggagaucaucaaggucaccgagcagcugaucgaggccaucaacaacggcgacuucgaggcguacacgaagaucugcgaccccgggcucaccgccuucgagcccgaggcccugggcaaccugguggaggggauggacuuccaccgguucuacuucgagaacgcccucagcaagagcaacaagccgauccacaccaucauccugaacccccacgugcaccuggucggcgacgacgcggccugcaucgccuacauccgccucacccaguacauggacggguccggcaugcccaagacgaugcagagcgaggagacccggguguggcaccgccgcgacggcaaguggcagaacgugcacuuccaccgguccgggagccccaccgucccgaucaagccgcccugcauccccaacggcaaggagaacuucuccgggggcaccagccuguggcagaacaucuga

SEQ ID NO: 27665 - RNA, 1488 nt, Artificial Sequence
  derived and/or modified sequence opt1 from CAMK2G__Homo_sapiens__NP_001213
auggccaccaccgccacgugcacccgcuucaccgacgacuaccagcuguucgaggagcucggcaagggggccuucagcgugguccggcgcugcgugaagaagaccuccacgcaggaguacgccgccaagaucaucaacaccaagaagcugagcgcccgggaccaccagaagcuggagcgcgaggcccggaucugccgccuccugaagcaccccaacaucgugcggcugcacgacuccaucagcgaggagggcuuccacuaccucgucuucgaccuggugaccgggggcgagcuguucgaggacaucguggcgcgcgaguacuacuccgaggccgacgccagccacugcauccaccagauccucgaguccgucaaccacauccaccagcacgacaucgugcaccgggaccugaagccggagaaccugcuccuggccagcaagugcaagggggcggccgugaagcuggccgacuucggccucgccaucgagguccagggcgagcagcaggccugguucggguucgcgggcacccccggguaccugucccccgaggugcugcgcaaggaccccuacggcaagccgguggacaucugggccugcggggucauccucuacauccugcuggugggcuacccgcccuucugggacgaggaccagcacaagcucuaccagcagaucaaggccggcgccuacgacuuccccagccccgagugggacacggugacccccgaggccaagaaccugaucaaccagaugcugaccaucaaccccgcgaagcggaucaccgccgaccaggcccucaagcaccccugggucugccagcgcuccacgguggccagcaugaugcaccggcaggagaccguggagugccugcgcaaguucaacgcccggcgcaagcugaagggggcgauccucaccaccaugcuggucucccggaacuucagcgccgccaagucccugcucaacaagaaguccgacggcggggugaaggagccgcagacgaccgugguccacaacgccaccgacggcaucaagggcagcaccgagagcugcaacacgaccaccgaggacgaggaccugaaggugcgcaagcaggagaucaucaagaucaccgagcagcugaucgaggccaucaacaacggggacuucgaggcguacacgaagaucugcgaccccggccucaccuccuucgagcccgaggcccuggggaaccugguggagggcauggacuuccacaaguucuacuucgagaaccuccugagcaagaacagcaagcccauccacaccaccauccugaacccgcacguccacgugaucggggaggacgccgccugcaucgcguacauccggcucacgcaguacaucgacggccagggccgcccccggaccucccagagcgaggagacccgcgucuggcaccgccgggacgggaaguggcugaacgugcacuaccacugcuccggcgcccccgccgcgccccugcaguga

SEQ ID NO: 27666 - RNA, 1422 nt, Artificial Sequence
  derived and/or modified sequence opt1 from CAMK4__Homo_sapiens__NP_001735
augcugaaggugaccguccccagcugcuccgccagcuccugcagcuccgugaccgccagcgccgccccgggcacggccucccucgugcccgacuacuggaucgacgggagcaaccgcgacgcccuguccgacuucuucgaggucgagagcgagcugggccgcggggccaccuccaucguguaccggugcaagcagaagggcacccagaagcccuacgcgcucaaggugcugaagaagaccgucgacaagaagaucgugcggacggagaucggggugcugcuccgccugagccaccccaacaucaucaagcugaaggagaucuucgagaccccgaccgagaucucccucguccuggagcuggugaccggcggcgagcuguucgaccggaucguggagaagggguacuacagcgagcgcgacgccgccgacgccgucaagcagauccucgaggcgguggccuaccugcacgagaacggcaucgugcaccgggaccucaagcccgagaaccugcuguacgccacgcccgcccccgacgccccgcucaagaucgcggacuucgggcuguccaagaucgucgagcaccaggugcugaugaagaccgugugcggcacccccggguacugcgcccccgagauccuccgcggcugcgccuacggccccgaggucgacauguggagcguggggaucaucaccuacauccugcugugcggcuucgagccguucuacgacgagcgcggggaccaguucauguuccggcggauccucaacugcgaguacuacuucaucucccccuggugggacgaggugagccugaacgccaaggaccugguccgcaagcucaucgugcuggaccccaagaagcggcugacgaccuuccaggcccuccagcaccccugggugaccggcaaggcggccaacuucguccacauggacaccgcccagaagaagcugcaggaguucaacgcccgccggaagcugaaggccgcggugaaggccgucguggccuccagccgccucggcagcgccuccagcucccacgggagcauccaggagucccacaaggccagccgggacccgucccccauccaggacggcaacgaggacaugaaggcgauccccgagggggagaagauccagggcgacggggcccaggccgccgugaagggcgcgcaggccgagcugaugaagguccaggcccuggagaaggugaagggcgccgacaucaacgccgaggaggcgcccaagauggugccgaaggccgucgaggacgggaucaagguggccgaccucgagcuggaggagggccuggccgaggagaagcucaagacgguggaggaggccgcggcgccccgcgaggggcagggcagcuccgccgucggguucgaggugccccagcaggacgugauccugcccgaguacuga

SEQ ID NO: 27667 - RNA, 1518 nt, Artificial Sequence
  derived and/or modified sequence opt1 from CAMKK1__Homo_sapiens__NP_757343
auggagggcgggcccgccgugugcugccaggacccgcgcgccgagcuggucgagcggguggcggccaucgacgugacccaccucgaggaggccgacggcgggcccgagcccacccgcaacggcgucgacccgccgccccgggcccgcgccgcgagcgugauccccggguccacgagccggcugcugcccgcccgccccucccucagcgcccggaagcugucccugcaggagcgccccgccggcagcuaccucgaggcgcaggccggccccuacgccaccgggcccgccucccacaucagcccgcgggccuggcgccggcccaccaucgagucccaccacguggcgaucagcgacgccgaggacugcguccagcugaaccaguacaagcugcaguccgagaucggcaagggggccuacggcguggugcgccucgccuacaacgagagcgaggaccggcacuacgccaugaagguccuguccaagaagaagcugcucaagcaguacggguucccccgccggcccccgccccgcggcagccaggcggcccagggcgggcccgccaagcagcugcugccccucgagcggguguaccaggagaucgccauccugaagaagcuggaccacgugaacgucgugaagcucaucgaggugcuggacgacccggccgaggacaaccuguaccucgucuucgaccugcugcgcaagggccccgugauggaggugcccugcgacaagcccuucuccgaggagcaggcgcggcucuaccugcgcgacgucauccuggggcucgaguaccugcacugccagaagaucgugcaccgggacaucaagccgagcaaccugcuccugggcgacgacggccacgugaagaucgccgacuucggggucuccaaccaguucgagggcaacgacgcccagcugagcuccaccgccgggacgcccgccuucauggcgcccgaggccaucagcgacagcggccaguccuucagcgggaaggcccucgacgugugggccaccggcgugacccuguacugcuucgucuacggcaagugccccuucaucgacgacuucauccuggcgcuccaccgcaagaucaagaacgagccgguggucuuccccgaggagcccgagaucuccgaggagcugaaggaccugauccucaagaugcuggacaagaacccggagacccgcaucggggugcccgacaucaagcugcaccccugggugacgaagaacggcgaggagccccucccgagcgaggaggagcacugcuccgucguggaggugaccgaggaggaggucaagaacagcgugcggcugauccccuccuggaccaccgugauccuggucaagagcaugcuccgcaagcgguccuucgggaaccccuucgagccccaggcccgccgggaggagcgcagcauguccgccccgggcaaccugcuggugaaggagggguucggcgagggcggcaagagccccgagcuccccggggugcaggaggacgaggccgccuccuga

SEQ ID NO: 27668 - RNA, 1767 nt, Artificial Sequence
  derived and/or modified sequence opt1 from CAMKK2__Homo_sapiens__NP_001257414
augagcuccugcgugagcucccagcccagcuccaaccgcgccgccccgcaggacgagcugggcgggcggggcagcuccagcuccgagagccagaagcccugcgaggcgcuccgcgggcuguccagccuguccauccaccucggcauggagagcuucaucgucgugaccgagugcgagcccgggugcgccguggaccugggccuggcccgggaccgcccccucgaggccgacggccaggaggucccgcuggacaccuccgggagccaggcccggccccaccuguccggccgcaagcucagccugcaggagcggucccagggcgggcuggcggccgggggcagccucgacaugaacggccgcugcaucugccccagccugcccuacuccccggugagcagcccccaguccagcccccggcugccccgccggccgacgguggagucccaccacgucuccaucaccgggaugcaggacugcgugcagcucaaccaguacacccugaaggacgagaucggcaaggggagcuacggcguggucaagcuggccuacaacgagaacgacaacaccuacuacgccaugaaggugcucuccaagaagaagcugauccgccaggcgggcuucccccggcgcccgccgccccgggggacgcgccccgcccccggcgggugcauccagccccggggccccaucgagcaggucuaccaggagaucgccauccugaagaagcucgaccaccccaacguggugaagcugguggagguccuggacgaccccaacgaggaccaccucuacaugguguucgagcuggugaaccaggggcccgucauggaggugccgacccugaagccccucagcgaggaccaggcccgcuucuacuuccaggaccugaucaagggcaucgaguaccugcacuaccagaagaucauccaccgggacaucaagcccuccaaccuccuggugggcgaggacgggcacaucaagaucgccgacuucggcgucagcaacgaguucaagggguccgacgcgcugcucagcaacaccgugggcacccccgccuucauggccccggagucccugagcgagacgcgcaagaucuucuccgggaaggcccuggacgugugggccaugggcgucacccucuacugcuucguguucggccagugccccuucauggacgagcggaucaugugccugcacagcaagaucaagucccaggcgcuggaguuccccgaccagccggacaucgccgaggaccucaaggaccugaucacccgcaugcuggacaagaaccccgagagccgcaucgucgugcccgagaucaagcuccaccccugggugacccggcacggggccgagccgcugcccagcgaggacgagaacugcacgcuggucgaggugaccgaggaggagguggagaacuccgucaagcacauccccagccucgccaccgugauccuggugaagaccaugauccgcaagcgguccuucggcaaccccuucgaggggagccgccgggaggagcgcucccugagcgccccgggcaaccuccugacgaagaagcccacccgggagugcgagucccugagcgagcugaaggaggcgcgccagcggcgccagccgcccgggcaccggcccgcgccccgcggcggcgggggcuccgcccucguccgggggagccccugcguggaguccugcugggcccccgccccgggcagccccgcccgcaugcacccccugcggcccgaggaggccauggagccggaguga

SEQ ID NO: 27669 - RNA, 972 nt, Artificial Sequence
  derived and/or modified sequence opt1 from CAMKMT__Homo_sapiens__NP_079042
auggagagccgcguggccgacgccggcaccggggagaccgcccgggccgccggcgggucccccgccgucggcugcacgacccgcgggccgguggugagcgcgccccugggcgccgcccgguggaagcuccugcgccagguccugaagcagaagcaccucgacgacugccugcggcacguguccgugcgccgguucgagagcuucaaccuguucuccgucaccgagggcaaggagcgcgagaccgaggaggaggugggggccugggugcaguacacgagcaucuucugccccgaguacuccaucagccuccggcacaacuccggcagccugaacgucgaggacgugcugaccuccuucgacaacaccgggaacgugugcaucuggcccagcgaggagguccucgccuacuacugccugaagcacaacaacaucuuccgcgcgcuggccgugugcgagcucggcgggggcaugaccugccuggccggccugaugguggccaucuccgccgacgucaaggaggugcuccugacggacgggaacgagaaggcgauccggaacgugcaggacaucaucacccgcaaccagaaggccggcgucuucaagacccagaagaucagcuccugcgugcugcggugggacaacgagaccgacgugagccagcucgaggggcacuucgacaucgucaugugcgccgacugccuguuccuggaccaguaccgcgccucccucguggacgccaucaagcggcugcugcagccgcgcggcaaggcgaugguguucgcgccccggcgcggcaacacgcucaaccaguucugcaaccuggccgagaaggccggguucugcauccagcggcacgagaacuacgacgagcacaucagcaacuuccacuccaagcugaagaaggagaaccccgacaucuacgaggagaaccuccacuacccccugcugcucauccugaccaagcacggcuga

SEQ ID NO: 27670 - RNA, 891 nt, Artificial Sequence
  derived and/or modified sequence opt1 from CAMLG__Homo_sapiens__NP_001736
auggagagcauggccguggccaccgacggcggggagcgccccggcgucccggcgggguccggccugagcgccucccagcggcgcgccgagcuccggcgccggaagcugcugaugaacagcgagcagcgcaucaaccggaucaugggguuccaccgccccggcuccggcgccgaggaggagagccagaccaaguccaagcagcaggacagcgacaagcucaacucccugagcgugcccuccgugagcaagcgggucgugcugggggacuccgugagcacgggcaccaccgaccagcagggcggggucgccgaggugaaggggacccagcucggcgacaagcuggacuccuucaucaagcccccggagugcagcuccgacgugaaccuggagcuccgccagcggaaccgcggcgaccugacggcggacagcguccagcgggggucccgccacggccuggagcaguaccucagccgguucgaggaggccaugaagcugcgcaagcagcugaucagcgagaagcccucccaggaggacgggaacaccaccgaggaguucgacagcuuccggaucuuccgccucgugggcugcgcccugcuggcccucggcgugcgggcguucgucugcaaguaccuguccaucuucgcccccuuccugacccuccagcuggccuacauggggcuguacaaguacuuccccaagagcgagaagaagaucaagacgaccgugcucaccgccgcccugcugcucuccggcaucccggcggaggugaucaaccgcagcauggacaccuacuccaagaugggggaggucuucacggaccugugcguguacuucuucaccuucaucuucugccacgagcugcucgacuacuggggcagcgaggugcccuga

SEQ ID NO: 27671 - RNA, 522 nt, Artificial Sequence
  derived and/or modified sequence opt1 from CAMP__Homo_sapiens__NP_004336
augggcaccaugaagacccagcgcgacgggcacagccugggccgguggucccucgugcugcugcuccuggggcuggucaugccccucgccaucaucgcccaggugcugagcuacaaggaggcggugcugcgcgccaucgacggcaucaaccagcgguccagcgacgccaaccucuaccgccugcuggaccucgacccgcggcccacgauggacggggaccccgacacccccaagccggucuccuucaccgugaaggagaccgugugcccccgcacgacccagcagagccccgaggacugcgacuucaagaaggacggccuggucaagcggugcaugggcaccgugacccugaaccaggcccgcggguccuucgacaucagcugcgacaaggacaacaagcgguucgcccuccugggcgacuucuuccgcaaguccaaggagaagaucgggaaggaguucaagcggaucgugcagcgcaucaaggacuuccugcggaaccucgucccccgcacggagagcuga

SEQ ID NO: 27672 - RNA, 4809 nt, Artificial Sequence
  derived and/or modified sequence opt1 from CAMSAP1__Homo_sapiens__NP_056262
augguggacgccagcggccgcgccgcggccgagggguggcggaagauggaggcgcccccggacggcgccgccgaccuggucccccucgaccgcuacgacgccgcccgggccaagaucgccgcgaaccugcaguggaucugcgccaaggccuacgggcgcgacaacauccccgaggaccugcgggaccccuucuacguggaccaguacgagcaggagcacaucaagccgcccgugaucaagcuccugcuguccagcgagcucuacugccgcgucugcucccugauccugaagggcgaccagguggccgcccuccaggggcaccagagcgugauccaggcgcugucccggaagggcaucuacgucauggagagcgacgacacccccgugaccgaguccgaccugagccgcgcccccaucaagauguccgcccacauggccaugguggacgcccucaugauggcguacacggucgagaugaucagcaucgagaaggugguggccuccgucaagcgguucagcaccuucuccgccagcaaggagcugccguacgaccuggaggacgccaugguguucuggaucaacaaggugaaccucaagaugcgcgagaucaccgagaaggaggucaagcugaagcagcagcugcucgagucccccgcccaccagaaggugcgguaccgccgggagcaccugagcgcgcgccagucccccuacuucccccugcucgaggaccugaugcgggacggcagcgacggggccgcccugcucgccgugauccacuacuacugcccggagcagaugaagcuggacgacaucugccugaaggaggucaccuccauggccgacagccucuacaacauccgccugcugcgggaguucagcaacgaguaccucaacaagugcuucuaccugacgcuggaggacaugcucuacgcgccccuggugcugaagcccaacgugauggucuucaucgccgagcuguucuggugguucgagaacgugaagcccgacuucgugcagccgcgcgacguccaggagcugaaggacgccaagaccgugcugcaccagaaguccagccggccgcccguccccaucuccaacgccaccaagcgcagcuuccucggcucccccgcggccgggacccuggccgagcugcagccgcccgugcagcuccccgccgagggcugccaccggcacuaccugcaccccgaggagcccgaguaccuggggaagggcacggccgcguucagccccucccacccccuccugccgcugcgccagaagcagcagaaguccauccagggcgaggacauccccgaccagcgccaccggagcaacagccucacccgcguggacgggcagccccggggcgccgccaucgccuggccggagaagaagacccgccccgccucccagcccacccccuucgcgcugcaccacgccgccagcugcgaggucgacccguccagcggggacuccaucagccuggcccgguccaucagcaaggacucccuggccagcaacaucgugaaccucacgccccagaaccagccccaccccaccgcgaccaagagccacggcaagucccugcugagcaacguguccaucgaggacgaggaggaggagcucgucgccaucgugcgcgccgacguggucccgcagcaggccgaccccgaguucccccgggcgagcccccgcgcccugggccugaccgccaacgcccgguccccgcaggggcagcucgacacgagcgaguccaagcccgacagcuucuuccuggagccccugaugcccgccgugcucaagccggcgaaggagaagcaggucaucaccaaggaggacgagcgcggcgaggggcggccccgcuccaucgugagccggcgccccuccgagggcccccagccgcuggugcggcgcaagaugaccgggagccgggaccugaaccgcaccuucacgcccauccccugcuccgaguuccccaugggcaucgacccgaccgagaccggcccccucagcguggagaccgccggggaggucugcggcgggccccuggcccugggcggguucgacccguucccccagggccccuccacggacggcuucuuccuccacguggggcgggccgacgaggacaccgagggccgccuguacgugagcugcuccaagagccccaacagccacgacuccgagccguggacccugcuccgccaggacagcgacuccgacgucguggacaucgaggaggccgagcacgacuucaugggggaggcgcaccccguggucuucagccgguacaucggcgaggaggaguccgccaagcugcaggaggacaugaaggugaaggagcacgaggacaaggacgacgccagcgggcgcuccagccccugccuguccaccgccagccagauguccagcguguccauggccagcggcuccgucaagaugacgagcuucgcggagcggaagcuccagcgccugaacuccugcgagaccaagagcuccaccagcagcucccagaagaccacgcccgacgccagcgaguccugcccggcgccccugaccaccuggcggcagaagcgcgagcagagccccucccagcacggcaaggaccccgccagccuccuggccuccgagcuggugcagcuccacaugcagcuggaggagaagcggcgcgccaucgaggcccagaagaagaagauggaggcccugagcgcccggcagcgccucaagcuggggaaggcggccuuccugcacguggucaagaagggcaaggccgaggccgccccgccccuccggcccgagcacuucgcgaaggaguacucccagcacaacggggaggacugcggcgacgccgugagcaagaccgaggacuuccuggugaaggaggagcagcgcgaggagcugcuccacgagccccaggacgucgacaaggagucccuggccuucgcccagcagcacaaggccaaggacccgguggcgcugcacgagcucgagcggaacaaggugaucagcgccgcccugcuggaggacacggucggcgaggugguggacgucaacgagugcgaccucuccaucgagaagcugaacgagaccaucagcacccugcagcaggccauccucaagaucucccagcagcaggagcagcugcugaugaagucccccaccgugcccgugcccgggagcaagaacaacagccaggaccacaaggucaaggccccggugcacuucguggagccccucucccccaccggcgucgcggggcaccgcaaggcgccccggcugggccaggggcgcaacagccggagcggccgcccggccgagcugaaggugcccaaggaccggccccagggcuccagccgcuccaagacgcccaccccgagcguggagacccucccccaccuccggcccuucccggccuccagccacccccgcacccccacggaccccgggcuggacuccgcccucgagccgagcggcgacccccacgggaagugccuguucgacuccuaccgccugcacgacgagagcaaccagcggacccucacccuguccagcuccaaggacgccaacauccugagcgagcagaugucccucaaggagguccuggacgccagcgugaaggaggugggcuccagcuccagcgacgucagcgggaaggaguccgugcccguggaggagccccugcgcagccgggccucccucaucgaggucgaccugagcgaccugaaggccccggacgaggacggcgagcucgugucccuggacggcagcgcggaccuggucuccgagggggaccagaagcccggcgugggguucuucuucaaggacgagcagaaggccgaggacgagcucgccaagaagcgcgccgccuuccugcugaagcagcagcggaaggcggaggaggcccgcgugcggaagcagcagcucgaggccgaggucgagcugaagcgcgacgaggcccggcgcaaggccgaggaggaccgggugcgcaaggaggaggagaaggcgcggcgcgagcugaucaagcaggaguaccuccggcgcaagcagcagcagauccuggaggagcagggccuggggaagcccaagagcaagcccaagaagccgcggcccaaguccgugcaccgcgaggagagcugcuccgacagcggcaccaagugcuccagcacgcccgacaaccucucccggacccagagcggcuccagccugucccuggccagcgccgccaccaccgagcccgagagcguccacuccgggggcacgccgagccagcgcguggaguccauggaggcgcuccccauccugagccgcaaccccucccggagcaccgaccgcgacugggagaccgccuccgccgccagcucccuggccagcguggcggaguacaccgggcccaagcuguucaaggagccguccagcaaguccaacaagcccaucauccacaacgccaucagccacugcugccucgccggcaaggucaacgagccccacaagaacuccauccuggaggagcucgagaagugcgacgccaaccacuacaucauccuguuccgggacgccgggugccaguuccgcgcgcuguacugcuacuaccccgacacggaggagaucuacaagcucaccggcaccggcccgaagaacaucaccaagaagaugaucgacaagcuguacaaguacagcuccgaccggaagcaguucaaccugauccccgccaagacgaugagcguguccguggacgcccucaccauccacaaccaccuguggcagcccaagcgccccgccgucccgaagaaggcccagacccggaaguga

SEQ ID NO: 27673 - RNA, 4470 nt, Artificial Sequence
  derived and/or modified sequence opt1 from CAMSAP2__Homo_sapiens__NP_001284636
augggcgacgccgccgacccccgcgagaugcggaagaccuucaucgugccggcgaucaagcccuucgaccacuacgacuucagccgcgccaagaucgccugcaaccuggccuggcucgucgccaaggcguucgggaccgagaacgugcccgaggagcugcaggagcccuucuacacggaccaguacgaccaggagcacaucaagccgcccguggucaaccugcuccuguccgccgagcuguacugccgggccggcagccucauccugaaguccgacgccgcgaagccccugcucgggcacgacgccgugauccaggcccuggcccagaagggccuguacgugaccgaccaggagaagcucgucaccgagcgcgaccugcacaagaagcccauccagaugagcgcccaccuggcgaugaucgacacccucaugauggccuacacgguggagaugguguccaucgagaaggucaucgccugcgcccagcaguacagcgccuucuuccaggcgaccgaccugccguacgacaucgaggacgccgugauguacuggaucaacaaggugaacgagcaccugaaggacaucauggagcaggagcagaagcucaaggagcaccacaccgucgaggcccccgggggccagaagucccccagcaagugguucuggaagcuggugcccgcccgguaccgcaaggagcagacccugcucaagcagcugccgugcaucccccugguggagaaccuccugaaggacggcacggacgggugcgcccuggcggcccucauccacuucuacugccccgacgucgugcggcuggaggacaucugccugaaggagaccaugucccucgccgacagccuguacaaccugcagcucauccaggaguucugccaggaguaccugaaccagugcugccacuucacccuggaggacaugcucuacgccgccuccagcaucaaguccaacuaccugguguucauggcggagcuguucuggugguucgaggucgugaagcccagcuucgugcagccgcgcgucgugcggccccagggcgccgagcccgugaaggacaugcccuccaucccgguccucaacgccgccaagcgcaacgugcuggacagcuccagcgacuuccccuccagcggggagggcgcgaccuucacgcagagccaccaccaccuccccucccgguacagccgcccccaggcccacuccagcgccuccgggggcauccggcgcagcuccagcauguccuacgucgacggcuucaucgggaccuggccgaaggagaagcggagcuccgugcacggcgugagcuucgacaucuccuucgacaaggaggacagcguccagcgcuccacccccaaccgggggaucacccgcagcaucuccaacgagggccucacgcugaacaacagccacguguccaagcacauccggaagaaccugagcuucaagcccaucaacggcgaggaggaggccgagagcaucgaggaggagcugaacaucgacucccacagcgaccugaaguccugcgugccccugaacaccaacgagcucaacagcaacgagaacauccacuacaagcugccgaacggggcccugcagaaccgcauccugcucgacgaguucggcaaccagaucgagacccccuccaucgaggaggcgcugcagaucauccacgacaccgagaaguccccgcacacgccccagcccgaccagaucgccaacggguucuuccugcacagccaggagaugagcauccucaacuccaacaucaagcugaaccagagcucccccgacaacgucaccgacaccaagggcgcccugagccccaucaccgacaacacggagguggacaccgggauccacgugccguccgaggacauccccgagaccauggacgaggacagcucccuccgggacuacaccgucagccuggacuccgacauggacgacgccagcaaguuccugcaggacuacgacauccgcacgggcaacacccgcgaggcccucagccccugccccuccaccgugagcaccaagucccagccgggcagcuccgcgagcuccagcuccggggugaagaugacgagcuucgccgagcagaaguuccggaagcugaaccacaccgacggcaaguccagcggguccagcucccagaagaccacccccgagggcagcgagcugaacaucccccacgucguggccugggcccagauccccgaggagacggggcucccgcagggccgcgacaccacccagcugcuggccuccgagauggugcaccuccggaugaagcuggaggagaagcgccgggcgaucgaggcccagaagaagaagauggaggccgccuucaccaagcagcgccagaagaugggccggaccgcguuccugacggucgugaagaagaagggggacggcaucagcccccuccgcgaggaggccgccggggccgaggacgagaagguguacaccgaccgggccaaggagaaggagucccagaagaccgacggccagcgcagcaagagccuggcggacaucaaggaguccauggagaacccccaggccaaguggcucaagagccccaccacgccgaucgaccccgagaagcaguggaaccuggccucccccagcgaggagacccugaacgagggggagauccuggaguacaccaaguccaucgagaagcucaacagcucccugcacuuccugcagcaggagaugcagcggcucagccugcagcaggagaugcugaugcagaugcgcgagcagcaguccugggucaucagcccgccccagcccagcccccagaagcagauccgggacuucaagcccuccaagcaggccggccucuccagcgccaucgcgccguucuccagcgacuccccgcgccccacccaccccagcccccaguccagcaaccgcaagagcgccuccuucagcgugaagucccagcggacgccccggcccaacgagcugaagaucaccccgcugaaccgcacccucaccccgccccggagcguggacucccugccccgccugcgccgguucagccccucccagguccccauccagacgcgcagcuucgugugcuucggcgacgacggggagccccagcucaaggaguccaagcccaaggaggaggugaagaaggaggagcuggagagcaagggcacccuggagcagcgggggcacaacccggaggagaaggagaucaagcccuucgaguccaccgucagcgaggugcucucccugcccgugaccgagacggucugccugacccccaacgaggaccagcucaaccagccgaccgagcccccgcccaagcccguguucccgcccaccgcccccaagaacgugaaccugaucgaggucagccuguccgaccucaagccgcccgagaaggccgacgugcccguggagaaguacgacggcgagagcgacaaggagcaguucgacgacgaccagaaggucugcugcggcuucuucuucaaggacgaccagaaggccgagaacgacauggcgaugaagcgcgccgcccugcuggagaagcggcuccgccgggagaaggagacgcagcugcgcaagcagcagcuggaggccgagauggagcacaagaaggaggagacccggcgcaagaccgaggaggagcggcagaagaaggaggacgagcgcgcgcggcgcgaguucauccggcaggaguacaugcgccggaagcagcucaagcugauggaggacauggacaccgugaucaagccccgcccccagguggucaagcagaagaagcagcggcccaaguccauccaccgcgaccacaucgagagccccaagacgccgaucaaggggccgcccguguccagccugagccucgccucccugaacaccggcgacaacgagagcgugcacuccgggaagcggacgccccgcagcgaguccgucgagggcuuccugagccccucccgcugcgggagccggaacggcgagaaggacugggagaacgccuccaccaccagcuccguggccagcggcaccgaguacaccgggcccaagcucuacaaggagcccuccgccaagagcaacaagcacaucauccagaacgcgcuggcccacugcugccuggccggcaaggugaacgaggggcagaagaagaagauccucgaggagauggagaaguccgacgccaacaacuuccugauccuguuccgcgacagcggcugccaguuccggucccucuacaccuacugccccgagacggaggagaucaacaagcugaccgggaucggccccaagagcaucaccaagaagaugaucgagggccuguacaaguacaacuccgaccgcaagcaguucagccacaucccggccaagacccucagcgcguccgucgacgccaucacgauccacagccaccuguggcagaccaagcggcccgugacccccaagaagcugcucccgaccaaggccuga

SEQ ID NO: 27674 - RNA, 5022 nt, Artificial Sequence
  derived and/or modified sequence opt1 from CAMTA1__Homo_sapiens__XP_011539388
auguggcgcgccgagggcaaguggcugcccaagaccagccggaaguccgugucccaguccguguucugcgggaccuccaccuacugcgugcucaacaccgugccgcccaucgaggacgaccacggcaacuccaacagcucccacgucaagaucuuccugcccaagaagcugcucgagugccugcccaagugcagcucccugccgaaggagcgccaccgguggaacaccaacgaggagaucgccgcguaccucaucaccuucgagaagcacgaggaguggcugacgaccagccccaagacccgcccccagaacggguccaugauccuguacaaccggaagaaggugaaguaccgcaaggacggcuacugcuggaagaagcggaaggacgggaagaccacgcgcgaggaccacaugaagcucaaggugcagggcgucgagugccuguacggcugcuacgugcacagcuccaucauccccaccuuccaccggcgcugcuacuggcugcuccagaacccggacaucgugcugguccacuaccugaacgugcccgccaucgaggacugcgggaagcccugcggccccauccucugcagcaucaacaccgacaagaaggagugggccaaguggaccaaggaggagcugaucgggcagcugaagccgauguuccacggcaucaaguggacgugcuccaacgggaacagcuccagcggcuucuccguggagcagcucguccagcagauccuggacagccaccagaccaagccccagccccggacccacaacugccugugcaccggcagccucggggccggcggguccgugcaccacaagugcaacagcgccaagcaccgcaucaucucccccaagguggagccgcggacgggcggcuacgggagccacuccgagguccagcacaacgacgugagcgagggcaagcacgagcacucccacagcaagggguccagccgcgagaagcggaacggcaagguggcgaagcccguccugcugcaccaguccagcaccgagguguccagcaccaaccagguggagguccccgacaccacgcaguccagccccguguccaucagcuccgggcucaacagcgacccggacaugguggacagccccgucgugaccggcgucuccggcauggccguggccagcgugauggggucccugagccaguccgccaccgucuucaugagcgaggugaccaacgaggcgguguacacgaugucccccaccgccggccccaaccaccaccuccugagcccggacgccucccaggggcugguccuggccgugagcuccgacggccacaaguucgccuuccccaccaccgggagcuccgagagccucuccaugcugcccacgaacgugagcgaggagcugguccucuccaccacccuggacggcggccgcaagauccccgagaccacgaugaacuucgacccggacugcuuccugaacaaccccaagcaggggcagaccuacggcgggggcgggcucaaggcggagauggugagcagcaacauccggcacagcccgcccggcgagcgcagcuucuccuucaccaccgugcugacgaaggagaucaagaccgaggacaccagcuucgagcagcagauggccaaggaggccuacuccagcuccgccgccgcggucgccgccagcucccugacccucaccgccggcagcucccugcugcccagcgggggcgggcucucccccagcacgacccuggagcagauggacuucuccgccaucgacagcaacaaggacuacaccuccagcuucucccagaccggccacagcccccacauccaccagacgcccagccccuccuucuuccugcaggacgcgagcaagccccuccccguggagcagaacacccacuccagccuguccgacagcggcgggaccuucgugaugccgaccgucaagacggaggccuccagccagaccuccagcugcuccggccacguggagacccggaucgagagcaccuccagccugcaccucaugcaguuccaggccaacuuccaggccaugacggccgagggggaggugaccauggagaccucccaggcggccgagggcagcgagguccugcugaaguccggggagcugcaggccugcagcuccgagcacuaccuccagcccgagaccaacggcgugauccgcagcgccggcggggugcccauccugcccggcaacgucgugcaggggcuguacccgguggcgcagcccagccucggcaacgccuccaacauggagcugagccuggaccacuucgacaucuccuucagcaaccaguucuccgaccucaucaacgacuucaucagcgucgagggcggguccagcacgaucuacggccaccagcugguguccggggacagcaccgcccugucccagagcgaggacggcgcccgggcccccuucacccaggcggagaugugccuccccugcugcuccccgcagcaggggagccugcagcuguccagcuccgagggcggggccagcaccauggccuacaugcacguggccgaggucguguccgccgcgagcgcccagggcacgcucggcaugcugcagcagagcgggcgcguguucauggucaccgacuacucccccgaguggagcuaccccgagggcggggugaaggugcugaucaccggccccuggcaggaggccuccaacaacuacagcugccucuucgaccagaucuccgucccggccagccugauccagcccggggugcugcgcugcuacugccccgcccacgacaccggccucgugacgcugcaggucgcguucaacaaccagaucaucuccaacagcgugguguucgaguacaaggcccgggcccugcccacccucccguccagccagcacgacuggcugucccuggacgacaaccaguuccgcaugagcauccucgagcggcuggagcagauggagcgccggauggccgagaugaccggcucccagcagcacaagcaggcgagcgggggcggguccagcggcggcggguccggcagcgggaacggcgggucccaggcccagugcgccagcggcaccggcgcccuggggagcugcuucgagucccgcgucgugguggucugcgagaagaugaugagccgggccugcugggcgaaguccaagcaccucauccacagcaagacguuccgcggcaugacccugcugcaccucgccgccgcccagggguacgccacccugauccagacccugaucaaguggcggacgaagcacgcggacuccaucgaccucgagcuggagguggacccccugaacguggaccacuucagcugcacgccccucaugugggccugcgcccugggccaccuggaggccgccgucgugcucuacaagugggaccgccgggcgaucuccaucccggacagccuggggcgccugccccucggcaucgcccggucccgcggccacgugaagcuggccgagugccuggagcaccuccagcgggacgagcaggcccagcuggggcagaacccccgcauccacugccccgcgagcgaggagccguccaccgagagcuggauggcccaguggcacuccgaggccaucagcucccccgagauccccaagggcgucaccgugaucgccagcacgaaccccgagcugcggcgcccgcgguccgagcccagcaacuacuacuccagcgagagccacaaggacuaccccgcccccaagaagcacaagcucaacccggaguacuuccagacccgccaggagaagcugcugcccaccgcgcucucccuggaggagcccaacauccgcaagcagagccccuccagcaagcaguccgugccggagacccugagccccuccgaggggguccgggacuucagccgcgagcucagcccgcccaccccggagacggccgccuuccaggccagcggcucccagcccguggggaaguggaacagcaaggaccuguacaucggcgucuccaccguccaggugaccggcaaccccaaggggaccagcgucggcaaggaggccgcgcccucccaggugcggccgcgcgagcccaugagcgugcugaugauggccaaccgggaggucgugaacacggagcucggguccuaccgcgacagcgccgagaacgaggagugcggccagcccauggacgacauccaggugaacaugaugacccuggccgagcacaucaucgaggccacccccgaccggaucaagcaggagaacuucgucccgauggagagcuccggccuggagcgcaccgaccccgcgacgaucagcuccaccaugagcuggcucgccuccuaccuggccgacgccgacugccugcccagcgccgcgcagauccgguccgccuacaacgagccgcucacccccagcuccaacaccagccugucccccguggggagccccguguccgagaucgccuucgagaagccgaaccugcccagcgccgcggacugguccgaguuccucagcgccuccacgagcgagaaggucgagaacgaguucgcccagcugacccuguccgaccacgagcagcgcgagcucuacgaggccgcccggcuggugcagaccgcguuccgcaaguacaagggccggccccugcgcgagcagcaggagguggccgccgccgucauccagcggugcuaccgcaaguacaagcaguacgcccucuacaagaagaugacccaggcggccauccugauccagagcaaguuccggagcuacuacgagcagaagaaguuccagcagucccgccgggccgccgugcugauccagaaguacuaccgcagcuacaagaagugcgggaagcggcgccaggcccgccggacggcggugaucguccagcagaagcuccgcuccagccugcugaccaagaagcaggaccaggccgcccggaagaucaugcgcuuccuccggcgcugccggcaccgcgugaaggagcugaagaaggccaaggagcuggaggacauccagcagcacccccucgcgauguga

SEQ ID NO: 27675 - RNA, 3693 nt, Artificial Sequence
  derived and/or modified sequence opt1 from CAND1__Homo_sapiens__NP_060918
auggccagcgccuccuaccacaucagcaaccugcucgagaagaugaccuccagcgacaaggacuuccgcuucauggcgaccaacgaccugaugacggagcugcagaaggacuccaucaagcucgacgacgacagcgagcggaagguggucaagaugauccugaagcugcucgaggacaagaacggcgaggugcagaaccuggccgugaagugccuggggccccucgucuccaaggugaaggaguaccagguggagaccaucgucgacacccugugcaccaacaugcugagcgacaaggagcagcuccgcgacaucuccagcaucggccugaagacggugaucggggagcugccgcccgccuccagcggcuccgcccucgccgcgaacgugugcaagaagaucaccgggcggcugaccagcgccaucgccaagcaggaggacgucuccgugcagcuggaggcccucgacaucauggcggacaugcugagccgccagggcggccugcucgugaacuuccaccccuccauccugaccugccugcucccccagcugacgagcccgcggcuggccguccgcaagcggaccaucaucgcccucgggcaccuggugauguccugcggcaacaucguguucgucgaccugaucgagcaccuccugagcgagcugagcaagaacgacuccaugagcaccacccgcacguacauccagugcaucgccgccaucucccggcaggcggggcaccgcaucggcgaguaccucgagaagaucaucccccugguggugaaguucugcaacgucgacgacgacgagcugcgggaguacugcauccaggccuucgagagcuucgugcgccggugccccaaggagguguacccccacgucuccaccaucaucaacaucugccucaaguaccugaccuacgacccgaacuacaacuacgacgacgaggacgaggacgagaacgccauggacgccgacgggggcgacgacgacgaccagggcagcgacgacgaguacuccgacgacgacgacaugagcuggaaggugcgccgggccgcggccaagugccuggacgccguggucuccacccgccacgagaugcuccccgaguucuacaagacggugagccccgcccugaucucccgguucaaggagcgcgaggagaacgucaaggccgacguguuccacgcguaccugagccuccugaagcagacccggcccgugcaguccuggcugugcgacccggacgccauggagcagggggagacgccccucaccaugcugcagagccagguccccaacaucgugaaggcccugcacaagcagaugaaggagaaguccgugaagacccgccagugcugcuucaacaugcucaccgagcuggucaacgugcugcccggcgcccugacccagcacaucccggugcucguccccgggaucaucuucagccugaacgacaaguccagcuccagcaaccugaagaucgacgcccucagcugccuguacgugauccugugcaaccacagcccccagguguuccacccccacguccaggcgcucgugccgcccguggucgccugcgugggcgaccccuucuacaagaucaccagcgaggcccugcuggugacgcagcagcucgucaaggugauccggccccuggaccagccguccagcuucgacgccacccccuacaucaaggaccuguucacgugcaccaucaagcgccucaaggcggccgacaucgaccaggaggugaaggagcgcgccaucuccugcaugggccagaucaucugcaaccugggggacaaccugggcagcgaccuccccaacacccugcagaucuuccuggagcggcucaagaacgagaucacccgccugaccaccgucaaggcccugacgcucaucgccgggagcccccugaagaucgaccugcggccggugcucggcgagggggugcccauccuggcguccuuccugcgcaagaaccagcgggcccucaagcugggcacccuguccgcccucgacauccugaucaagaacuacagcgacucccugaccgccgccaugaucgacgcgguccucgacgagcugcccccgcugaucagcgaguccgacaugcacgugagccagauggccaucuccuuccucaccacgcuggccaagguguaccccagcucccugagcaagaucagcggcuccauccucaacgagcugaucgggcugguccgcagcccccuccugcagggcggggcccuguccgccaugcucgacuucuuccaggcgcugguggugaccggcaccaacaaccugggguacauggaccuccugcggaugcugaccggccccgucuacagccaguccaccgcccucacgcacaagcagagcuacuacuccaucgccaagugcguggccgcgcugacccgcgccugcccgaaggagggccccgccguggucgggcaguucauccaggacgugaagaacagccgguccaccgacagcauccgccugcucgcccugcugucccucggcgagguggggcaccacaucgaccugagcggccagcuggagcucaaguccgucauccuggaggccuucagcucccccagcgaggaggugaaguccgcggccagcuacgcccugggguccaucagcgugggcaaccuccccgaguaccugccguucguccugcaggagaucaccagccagcccaagcggcaguaccuccugcugcacucccucaaggagaucaucagcuccgccagcguggugggccugaagcccuacgucgagaacaucugggcccugcuccugaagcacugcgagugcgcggaggaggggacgcgcaacgugguggccgagugccugggcaagcucacccugaucgaccccgagacccugcucccgcggcugaagggguaccugaucuccggcagcuccuacgcccgcagcuccgucgugaccgccgugaaguucacgaucagcgaccacccccagcccaucgacccccuccugaagaacugcaucggcgacuuccugaagacccucgaggacccggaccugaacguccggcgcguggcccuggugaccuucaacuccgcggcccacaacaagcccagccucauccgggaccugcuggacaccguccucccccaccuguacaacgagacgaaggugcgcaaggagcugauccgggaggucgagauggggcccuucaagcacaccguggacgacggccucgacauccgcaaggccgccuucgagugcauguacacccugcuggacuccugccuggaccgccucgacaucuucgaguuccugaaccacguggaggacgggcugaaggaccacuacgacaucaagaugcucaccuuccugaugcugguccggcucagcacgcugugcccguccgcggugcugcagcgccucgaccggcugguggagccccugcgcgcgaccugcaccaccaaggucaaggccaacagcgugaagcaggaguucgagaagcaggacgagcucaagcgguccgccaugcgcgccguggccgcccugcugacgauccccgaggccgagaaguccccgcucauguccgaguuccagagccagaucagcuccaaccccgagcuggccgccaucuucgagagcauccagaaggacuccagcuccaccaaccuggagagcauggacaccuccuga

SEQ ID NO: 27676 - RNA, 3711 nt, Artificial Sequence
  derived and/or modified sequence opt1 from CAND2__Homo_sapiens__NP_001155971
augagcaccgccgccuuccacaucuccagccugcucgagaagaugaccuccagcgacaaggacuuccgcuucauggcgacguccgaccugaugagcgagcugcagaaggacuccauccagcucgacgaggacagcgagcggaagguggucaagaugcugcugcgccuccuggaggacaagaacggcgaggugcagaaccuggccgugaagugccucgggccccuggucgugaaggugaaggaguaccaggucgagaccaucguggacacccugugcaccaacaugcgguccgacaaggagcagcuccgcgacaucgccggcaucgggcugaagacggugcugagcgagcucccgcccgccgccaccggcuccgggcuggcgaccaacgucugccggaagaucaccggccagcugacgagcgccaucgcccagcaggaggacguggccgugcagcucgaggcgcuggacauccuguccgacaugcucagccgccugggcgucccccugggggccuuccacgccucccuccugcacugccugcucccccagcugagcuccccgcggcuggccgugcgcaagcgggccgugggcgcgcucgggcaccuggccgccgccugcagcaccgaccuguucgucgagcucgccgaccaccuccuggaccgccugcccggcccccgggugcccaccuccccgaccgcgauccgcacgcugauccagugccuggggagcgugggccggcaggccggccaccgccucggggcccaccuggaccggcuggucccccucguggaggacuucugcaaccuggacgacgacgagcugcgcgagagcugccuccaggccuucgaggccuuccugcggaagugccccaaggagaugggcccccacgugccgaacgucaccucccugugccuccaguacaucaagcacgaccccaacuacaacuacgacagcgacgaggacgaggagcagauggagaccgaggacuccgaguucagcgagcaggaguccgaggacgaguacagcgacgacgacgacauguccuggaaggugcgccgggcggccgccaagugcaucgccgcccugaucagcucccgccccgaccugcugcccgacuuccacugcacccucgcgccggugcugauccggcgcuucaaggagcgcgaggagaacgucaaggccgacguguucacggccuacaucguccugcuccggcagacccagccgcccaagggguggcuggaggccauggaggagcccacccagaccggcagcaaccugcacaugcuccgcggccaggugccccugguggucaaggcgcugcagcggcagcucaaggaccgcuccgugcgggcccgccaggggugcuucagccugcugacggagcucgccggcgugcugcccgggucccuggccgagcacaugcccguccucgugagcggcaucaucuucucccuggccgaccggagcuccagcuccaccauccgcauggacgcgcuggccuuccuccaggggcugcugggcaccgagcccgccgaggccuuccacccgcaccuccccauccugcugccgcccgugauggccugcgucgcggacagcuucuacaagaucgccgccgaggcccucguggugcugcaggagcugguccgggcccucuggccccugcaccgcccccggaugcuggaccccgagccguacgugggcgagaugagcgcggugacccucgcccgccugcgggccacggaccuggaccaggaggucaaggagcgcgccaucuccugcauggggcaccucgugggccaccugggggaccggcugggcgacgaccucgagcccacccugcugcuccugcuggaccgccuccggaacgagaucacccgccugcccgcgaucaaggcccugacccucguggccgucagcccccugcagcuggaccuccagccgauccuggccgaggcccugcacauccucgcguccuuccugcggaagaaccagcgcgcccugcgccucgccacgcuggccgcccuggacgcgcucgcccagagccaggggcugucccugccgcccagcgccgugcaggccgugcucgccgagcugcccgcgcuggucaacgaguccgacaugcacguggcccagcucgccguggacuuccuggccaccgucacccaggcgcagcccgccagccugguggagguguccggccccguccucagcgagcugcugcggcuccugcgcagcccccugcuccccgccggcgugcuggccgccgcggagggguuccugcaggcccucgugggcacccggccgcccugcgucgacuacgccaagcugaucucccugcucacggcccccguguacgagcaggccguggacgggggccccgggcugcacaagcaggucuuccacucccuggcgcgcugcguggccgcccucagcgccgccugcccgcaggaggcggccuccaccgccagccggcuggugugcgacgcccgcagcccccacuccagcaccggcgucaaggugcuggccuuccucucccuggcggaggugggccaggucgccgggcccggccaccagcgggagcugaaggccgugcuccuggaggcccuggggagccccuccgaggacgugcgcgcggccgccagcuacgcccucggccgggucggcgccgggucccugccggacuuccugcccuuccuccuggagcagaucgaggcggagccccgccggcaguaccugcugcuccacagccugcgcgaggcccugggcgccgcccagcccgacucccucaagccguacgccgaggacaucugggcgcugcuguuccagcggugcgagggggccgaggagggcacccgcggggugguggccgagugcaucggcaagcucguccuggugaaccccagcuuccugcucccccggcugcgcaagcagcuggccgccggccggccgcacacgcgcuccaccgugaucaccgcggucaaguuccucaucagcgaccagccccaccccaucgacccccugcugaaguccuucaucggggaguucauggagagccuccaggacccggaccugaacgugcggcgcgccacccuggccuucuucaacuccgccgugcacaacaagcccagccucguccgggaccugcuggacgacauccucccccugcuguaccaggagaccaagauccgccgcgaccucauccgggagguggagaugggccccuucaagcacacggucgacgacgggcuggacgugcgcaaggcggccuucgagugcauguacucccugcucgagagcugccugggccagcuggacaucugcgaguuccucaaccacguggaggacgggcugaaggaccacuacgacauccggaugcugaccuucaucauggucgcccgccucgccacccugugcccggcccccgugcugcagcggguggaccgccucaucgagccccugcgggcgaccugcacggccaaggucaaggccggcuccgugaagcaggaguucgagaagcaggacgagcugaagcgcagcgccaugcgggccguggcggcccuccugaccauccccgaggucggcaaguccccgaucauggccgacuucagcagccagauccgcuccaaccccgagcuggccgcccucuucgagagcauccagaaggacuccgcgagcgcccccuccaccgacagcauggagcuguccuga

SEQ ID NO: 27677 - RNA, 1206 nt, Artificial Sequence
  derived and/or modified sequence opt1 from CANT1__Homo_sapiens__XP_005257079
augcccgugcagcugagcgagcacccggaguggaacgaguccaugcacagccuccgcaucuccgucggcgggcugcccgugcuggccagcaugaccaaggccgcggacccccgguuccgcccccgguggaaggugauccucaccuucuucgucggcgccgccauccuguggcugcucugcucccaccgcccggcccccgggcggccgcccacgcacaacgcccacaacuggcgccugggccaggcgcccgccaacugguacaacgacaccuacccccugagcccgccccagcggacccccgccgggauccgcuaccggaucgccgugaucgcggaccucgacaccgagucccgcgcccaggaggagaacacgugguucagcuaccugaagaagggcuaccugacccucuccgacagcggcgacaagguggccgucgagugggacaaggaccacggggugcuggagucccaccuggccgagaagggccgggggauggagcucagcgaccugaucguguucaacggcaagcuguacuccgucgacgaccgcaccggggugguguaccagaucgagggcagcaaggccguccccugggugauccucuccgacggcgacgggaccguggagaagggcuucaaggcggaguggcuggccgucaaggacgagcggcuguacgucgggggccucggcaaggaguggacgaccaccaccggggacguggugaacgagaaccccgagugggugaagguggucggcuacaaggggagcguggaccacgagaacuggguguccaacuacaacgcccugcgcgccgccgcgggcauccagcccccgggguaccugauccacgagagcgccugcugguccgacacgcuccagcggugguucuuccugccccgccgggccagccaggagcgcuacagcgagaaggacgacgagcggaagggcgccaaccugcuccuguccgccagccccgacuucggcgacaucgcggucucccacgugggggccgucgugcccacccacggcuucagcuccuucaaguucaucccgaacaccgacgaccagaucaucguggcccucaagagcgaggaggacuccgggcgcgucgccagcuacaucauggccuucacccuggacggccgguuccugcugcccgagacgaagaucggguccgugaaguacgagggcaucgaguucaucuga

SEQ ID NO: 27678 - RNA, 1941 nt, Artificial Sequence
  derived and/or modified sequence opt1 from CANX__Homo_sapiens__XP_011532966
auguaccagaaggagaacacccaguggcugcgcaaccucgccgugaccgcccccauccuggaggcgagcaacccggucggcgaggggcagggcgugaagucccggaaggcccccgagagcuccagcaagugcaucuccuuccacaccgggggccuggagaucauggaggggaaguggcuccugugcaugcugcucgugcugggcacggccaucgucgaggcccacgacggccacgacgacgacgugaucgacaucgaggacgaccuggacgacgugaucgaggaggucgaggacagcaagcccgacaccaccgcgcccccguccagccccaaggugacguacaaggcccccgugcccaccggggaggucuacuucgccgacuccuucgaccgcggcacccucagcggguggauccuguccaaggccaagaaggacgacaccgacgacgagaucgccaaguacgacggcaagugggagguggaggagaugaaggagagcaagcugccgggggacaagggccucgugcugaugucccgggcgaagcaccacgccaucagcgccaagcugaacaagcccuuccucuucgacacgaagccccugaucguccaguacgaggugaacuuccagaacggcaucgagugcgggggcgccuacgugaagcugcucuccaagacccccgagcugaaccuggaccaguuccacgacaagaccccguacaccaucauguucgggcccgacaagugcggcgaggacuacaagcuccacuucaucuuccgccacaagaaccccaagacgggcaucuacgaggagaagcacgccaagcggcccgacgcggaccugaagaccuacuucaccgacaagaagacccaccuguacacgcucauccugaacccggacaacagcuucgagauccuggucgaccaguccguggugaacagcgggaaccuccugaacgacaugaccccgcccgucaaccccucccgcgagaucgaggaccccgaggaccggaagcccgaggacugggacgagcgccccaagauccccgacccggaggccgugaagcccgacgacugggacgaggacgcccccgccaagauccccgacgaggaggccaccaagccggagggcuggcuggacgacgagcccgaguacgugcccgacccggacgcggagaagcccgaggacugggacgaggacauggacggggagugggaggcgccccagaucgccaacccccggugcgagagcgccccgggcugcggggucuggcagcgccccgugaucgacaaccccaacuacaagggcaaguggaagcccccgaugaucgacaaccccagcuaccagggcaucuggaagccccggaagauccccaacccggacuucuucgaggaccucgagcccuuccgcaugacccccuucuccgccaucgggcuggagcuguggagcaugacguccgacaucuucuucgacaacuucaucaucugcgccgaccggcgcaucguggacgacugggccaacgacggcugggggcucaagaaggccgccgacggcgccgcggagcccggggucgugggccagaugaucgaggccgccgaggagcggccguggcugugggucguguacauccugaccguggcccuccccgucuuccuggugauccuguucugcugcagcggcaagaagcagaccuccgggauggaguacaagaagaccgacgcgccccagcccgacgugaaggaggaggaggaggagaaggaggaggagaaggacaagggcgacgaggaggaggagggggaggagaagcucgaggagaagcagaaguccgacgccgaggaggacggcgggacggucagccaggaggaggaggaccgcaagccgaaggccgaggaggacgagauccugaaccggagcccccgcaaccggaagccccgccgggaguga

SEQ ID NO: 27679 - RNA, 1428 nt, Artificial Sequence
  derived and/or modified sequence opt1 from CAP1__Homo_sapiens__XP_011538812
auggccgacaugcagaaccugguggagcgccucgagcgggccgucggccgccuggaggcggugagccacaccuccgacaugcaccggggguacgccgacagccccuccaaggccggcgccgcccccuacgugcaggcguucgacagccugcucgccgggcccgucgccgaguaccugaagaucuccaaggagaucggcggggacgugcagaagcacgccgagauggugcacaccggccugaagcucgagcgcgcgcugcuggucacggccagccagugccagcagcccgccgagaacaagcucuccgaccugcuggcccccaucagcgagcagaucaaggaggugaucaccuuccgggagaagaaccgcggcuccaagcuguucaaccaccugagcgccguguccgagagcauccaggcgcuggggugggucgccauggccccgaagcccggccccuacgugaaggagaugaacgacgccgccauguucuacaccaaccgggugcucaaggaguacaaggacgucgacaagaagcacguggacugggugaaggcguaccucuccaucuggaccgagcugcaggccuacaucaaggaguuccacacgaccgggcucgccuggagcaagaccggccccgucgccaaggagcuguccgggcugccgagcggccccuccgccggcagcugcccgccgcccccgccgcccugcccgcccccgccgcccguguccaccaucagcugcagcuacgaguccgcgagccgcuccagccucuucgcccagaucaaccagggggaguccaucacgcacgcccugaagcacgugagcgacgacaugaagacccacaagaaccccgcccugaaggcccaguccggccccguccggagcgggcccaagcccuucuccgcgcccaagccccagaccagccccucccccaagcgcgccaccaagaaggagcccgccgugcucgagcuggagggcaagaaguggcggguggagaaccaggagaacgucagcaaccuggugaucgaggacacggagcucaagcaggucgccuacaucuacaagugcgugaacaccacccugcagaucaagggcaagaucaacuccaucaccguggacaacugcaagaagcuggggcucgucuucgacgacguggugggcaucgucgagaucaucaacagcaaggacgugaaggugcaggucauggggaaggugcccacgaucuccaucaacaagaccgacggcugccacgcguaccugagcaagaacucccuggacugcgagaucgugagcgccaaguccagcgagaugaacguccucauccccaccgagggcggggacuucaacgaguuccccgugcccgagcaguucaagacccuguggaacggccagaagcuggugacgaccgucaccgagaucgccggguga

SEQ ID NO: 27680 - RNA, 1434 nt, Artificial Sequence
  derived and/or modified sequence opt1 from CAP2__Homo_sapiens__NP_006357
auggccaacaugcagggccugguggagcgccucgagcgggccgucagccgccuggagucccugagcgcggagucccaccggcccccggggaacugcggcgaggugaacggggugaucgccggcgucgcccccagcguggaggccuucgacaagcucauggacuccaugguggccgaguuccugaagaacagccgcauccuggcgggggacgucgagacccacgccgagauggugcacuccgccuuccaggcccagcgggcguuccuccugauggccagccaguaccagcagccccacgagaacgacguggccgcccugcucaagcccaucuccgagaagauccaggagauccagaccuuccgcgagcggaaccgcggcagcaacauguucaaccaccuguccgccgucagcgaguccaucccggcgcugggcuggaucgccgugagccccaagcccgggcccuacgugaaggagaugaacgacgccgccacguucuacaccaaccggguccucaaggacuacaagcacuccgaccugcgccacguggacugggucaagagcuaccugaacaucugguccgagcuccaggccuacaucaaggagcaccacaccaccggccugacguggagcaagaccgggcccguggcguccaccgugagcgccuucagcgugcuguccagcggccccgggcucccgccgcccccgccgccccugcccccgcccggcccgccgccccuguucgagaacgagggcaagaaggaggaguccagccccucccggagcgcccucuucgcccagcugaaccagggggaggccaucaccaagggccugcgccacgucacggacgaccagaagaccuacaagaaccccucccuccgggcgcagggcgggcagacccagagccccaccaagucccacacgcccagccccaccucccccaagagcuaccccucccagaagcacgcccccgugcuggagcuggagggcaagaaguggcgcguggaguaccaggaggaccggaacgaccucgucaucagcgagaccgagcugaagcaggucgccuacaucuucaagugcgagaaguccaccauccagaucaaggggaaggugaacagcaucaucaucgacaacugcaagaagcugggccucguguucgacaacguggucgggaucguggaggugaucaacucccaggacauccagauccaggucaugggccgcgugcccacgaucagcaucaacaagaccgaggggugccacaucuaccuguccgaggacgcccuggacugcgagaucgugagcgccaagagcuccgagaugaacauccucaucccccaggacggcgacuaccgggaguuccccauccccgagcaguucaagaccgcgugggacggcagcaagcugaucaccgagcccgccgagaucauggccuga

SEQ ID NO: 27681 - RNA, 1002 nt, Artificial Sequence
  derived and/or modified sequence opt1 from CAPG__Homo_sapiens__NP_001243069
auguacaccgccaucccccagagcggcuccccguuccccgggagcgugcaggaccccggccugcacgucuggcgcguggagaagcugaagcccgugccggucgcccaggagaaccaggggguguucuucuccggcgacagcuaccuggugcugcacaacgggcccgaggaggucucccaccuccaccuguggaucggccagcagagcucccgggacgagcagggcgcgugcgccgugcuggccgugcaccucaacacccugcugggggagcgccccguccagcaccgggaggugcagggcaacgagagcgaccucuucauguccuacuucccccgcgggcugaaguaccaggagggcgggguggagagcgccuuccacaagacguccaccggcgccccggcggccaucaagaagcuguaccaggucaagggcaagaagaacauccgggccaccgagcgcgcccucaacugggacagcuucaacaccggggacugcuucauccuggaccugggccagaacaucuucgcguggugcgggggcaaguccaacauccucgagcggaacaaggcccgcgaccuggcccuggccauccgggacagcgagcgccagggcaaggcccaggugcucgggcccaagcccgcgcugaaggagggcaaccccgaggaggaccugacggccgacaaggccaacgcccaggccgcggcccucuacaagguguccgacgccaccgggcagaugaaccugaccaaggucgccgacagcuccccguucgcccuggagcuccugaucagcgacgacugcuucgugcuggacaacggccucugcgggaagaucuacaucuggaagggccggaaggcgaacgagaaggagcgccaggccgcccuccagguggccgagggcuucaucucccggaugcaguacgcccccaacacccaggucgagauccugccccaggggcacgagagccccaucuucaagcaguucuucaaggacuggaaguga

SEQ ID NO: 27682 - RNA, 2019 nt, Artificial Sequence
  derived and/or modified sequence opt1 from CAPN10__Homo_sapiens__NP_075571
augcgcgccggccgcggggccacccccgcgcgggagcuguuccgggacgccgccuucccggccgccgacagcucccucuucugcgaccugagcacgccccuggcgcaguuccgcgaggacaucaccuggcggcgcccccaggagaucugcgccaccccgcgccucuuccccgacgacccccgcgagggccaggugaagcaggggcugcugggcgacugcugguuccucugcgccugcgccgcgcugcagaagucccggcaccuccucgaccaggucaucccgcccgggcagcccagcugggccgaccaggaguaccgcggcuccuucacgugccggaucuggcaguucggccgcuggguggaggugaccacggacgaccggcugcccugccuggccgggcgccucugcuucagccggugccagcgcgaggacgucuucuggcugccccugcucgagaagguguacgccaaggugcacggcuccuacgagcaccugugggccgggcaggucgcggacgcccugguggaccucaccggcgggcuggccgagcgguggaaccugaagggcguggccggcagcgggggccagcaggaccgccccgggcggugggagcaccggaccugccggcagcuccugcaccugaaggaccagugccucaucuccugcugcguccugagcccgcgggccggcgcgcgcgagcugggcgaguuccacgccuucaucguguccgaccugcgcgagcugcaggggcaggccggccagugcauccugcuccugcgcauccagaaccccugggggcggcgcugcuggcagggccuguggcgggagggcggggagggcuggagccagguggacgccgccgucgcguccgagcuccugagccagcugcaggagggggaguucuggguggaggaggaggaguuccuccgcgaguucgacgagcugaccgugggcuaccccgucaccgaggccgggcaccuccagucccuguacaccgagcggcugcugugccacacccgcgcccuccccggcgccugggugaaggggcagagcgccggcggcugccggaacaacuccggguucccgagcaaccccaaguucuggcugcgcguguccgagcccagcgaggucuacaucgcggugcugcagcggagccgccuccacgccgccgacugggccggccgggcgcgcgcccuggugggggacucccacaccagcuggucccccgccagcaucccgggcaagcacuaccaggccgucgggcugcaccucuggaagguggagaagcggcgcgugaaccugccccggguccuguccaugccgcccguggccggcacggcgugccacgccuacgaccgcgagguccaccuccggugcgagcugagccccggcuacuaccuggccgugcccuccaccuuccugaaggacgcccccggggaguuccuccugcgcguguucagcaccggccgcgucucccugagcgccauccgggcgguggccaagaacaccacgcccggggccgcccucccggccggcgaguggggcaccgugcagcugcgcggguccuggcgggucggccagaccgccgggggcagccgcaacuucgccuccuaccccaccaaccccugcuucccguucagcgugcccgaggggcccggcccccggugcgugcgcaucacgcugcaccagcacugccggccguccgacaccgaguuccaccccaucggcuuccacaucuuccagguccccgagggcgggcgcagccaggacgcgcccccgcuccugcugcaggagccccuccuguccugcgugccccaccgguacgcccaggaggugagccgccugugccuccugcccgcggggaccuacaaggucgugccguccaccuaccugcccgacacggagggcgccuucaccgugaccaucgccacccggaucgaccgccccagcauccacagccaggagaugcucgggcaguuccugcaggaggucuccgugauggccgugaugaagacguga

SEQ ID NO: 27683 - RNA, 2010 nt, Artificial Sequence
  derived and/or modified sequence opt1 from CAPN13__Homo_sapiens__NP_653176
auggccuacuaccaggagcccagcguggagaccuccaucaucaaguucaaggaccaggacuucaccacgcugcgcgaccacugccucagcaugggccggaccuucaaggacgagaccuucccggccgcggacuccagcaucgggcagaagcugcugcaggagaagcgccucuccaacgucaucuggaagcggccccaggaccugcccggcgggcccccgcacuucauccuggacgacaucagccgcuucgacauccagcagggcggggccgccgacugcugguuccucgccgcccugggcucccugacccagaacccccaguaccggcagaagauccucauggugcagagcuucucccaccaguacgcgggcaucuuccgcuuccgguucuggcagugcgggcaguggguggaggucgugaucgacgaccgccugcccgugcagggcgacaagugccuguucguccggccccgccaccagaaccaggaguucuggccgugccuccuggagaaggccuacgccaagcugcucgggagcuacuccgaccugcacuacggcuuccuggaggacgcccucguggaccugaccgggggcgugaucacgaacauccaccuccacagcucccccgucgaccuggugaaggcggugaagaccgccaccaaggccggcagccugaucacgugcgccacccccuccgggcccaccgacaccgcccaggcgauggagaacggccuggucagccuccacgccuacacggugaccggggccgagcagauccaguaccggcgcggcugggaggagaucaucucccuguggaacccguggggcuggggcgaggccgaguggcgggggcgcuggagcgacgggucccaggagugggaggagaccugcgacccccgcaagagccagcugcacaagaagcgggaggacggcgaguucuggaugagcugccaggacuuccagcagaaguucaucgccauguucaucugcuccgagauccccaucacccucgaccacgggaacacgcugcacgagggcuggagccagaucauguuccggaagcaggucauccugggcaacaccgccgggggcccccgcaacgacgcgcaguucaacuucuccgugcaggagccgauggaggggaccaacgugguggucugcgugaccguggccgucacgcccagcaaccucaaggccgaggacgccaaguucccccuggacuuccaggugauccuggcgggcucccagcgguuccgcgagaaguucccgcccguguucuucagcuccuuccggaacaccguccagagcuccaacaacaaguuccgccgcaacuucaccaugaccuaccaccucagccccgggaacuacguggucguggcccagacgcggcgcaaguccgccgaguuccugcugcggaucuuccucaagaugcccgacagcgaccgccaccuguccagccacuucaaccugcggaugaagggcucccccagcgagcacggcucccagcagagcaucuucaaccgcuacgcccagcagcggcucgacaucgacgccacccagcugcaggggcugcucaaccaggagcugcugaccggcccgcccggggacauguucucccucgacgagugccgcagccugguggcgcugauggagcucaaggucaacggccggcuggaccaggaggaguucgcccgccuguggaagcggcuggugcacuaccagcacguguuccagaagguccagaccagccccggggugcuccuguccagcgaccuguggaaggccaucgagaacacggacuuccuccgcggcaucuucaucucccgggagcugcugcaccucgugacccugcgcuacagcgacuccgucggccgggugagcuuccccucccuggugugcuuccucaugcgccuggaggccauggcgaagaccuuccggaaccugagcaaggacgggaagggccucuaccugaccgagauggaguggaugucccuggucauguacaacuga

SEQ ID NO: 27684 - RNA, 2055 nt, Artificial Sequence
  derived and/or modified sequence opt1 from CAPN14__Homo_sapiens__NP_001138594
augagccuguggcccccguuccgcugccgguggaagcucgcgccccgcuacucccggcgcgccagcccccagcagccccagcaggacuucgaggcccugcuggccgagugccuccggaacggcugccuguucgaggacaccuccuucccggccacccugagcuccaucgggagcggcucccuccugcagaagcugccgccccgccuccaguggaagcggccgcccgagcugcacagcaacccccaguucuacuucgccaaggccaagcgccuggaccucugccaggggaucgugggcgacugcugguuccuggcggcccugcaggcccucgcccugcaccaggacauccugucccgggucgugccccucaaccagagcuucacggagaaguacgcggggaucuuccgcuucugguucuggcacuacggcaacugggugcccgucgugaucgacgaccggcugcccgugaacgaggccggccagcuggucuucguguccagcaccuacaagaaccucuucuggggcgcccugcuggagaaggccuacgccaagcucuccgggagcuacgaggaccugcaguccgggcaggucagcgaggcgcuggucgacuucaccggcggggugaccaugacgaucaaccucgccgaggcccacggcaaccugugggacauccugaucgaggccaccuacaaccgcacccucaucggcugccagacccacuccggggagaagauccuggagaacggccugguggaggggcacgccuacacgcucaccggcauccggaaggugaccugcaagcaccgccccgaguaccuggugaagcugcggaaccccuggggcaagguggaguggaagggggacuggagcgacuccagcagcaagugggagcuccugucccccaaggagaagauccugcuccugcgcaaggacaacgacggcgaguucuggaugacccugcaggacuucaagacgcacuucguccuccuggugaucugcaagcugaccccggggcuccugagccaggaggcggcccagaaguggaccuacaccaugcgggagggccgcugggagaagcgguccacggccgggggccagcgccagcugcuccaggacaccuucuggaagaacccccaguuccugcugagcguguggcggcccgaggagggccgccgcucccugcggcccugcagcguccucgugucccugcugcagaagccgcgccaccggugccgcaagcggaagccccuccuggccaucggguucuaccuguaccgcaugaacaaguaccacgacgaccagcggcgccucccgcccgaguucuuccagcggaacacgccccugagccagcccgaccgcuuccugaaggagaaggaggugucccaggagcucugccuggagcccggcaccuaccugaucguccccugcauccucgaggcccaccagaaguccgaguucgugcugcggguguucagccgcaagcacaucuucuacgagaucgggagcaacuccggcgucguguucagcaaggagaucgaggaccagaacgagcggcaggacgaguucuucaccaaguucuucgagaagcacccggagaucaacgcgguccagcugcagaaccuccugaaccagaugaccugguccagccuggggucccgccagcccuucuucagccucgaggccugccagggcauccuggcccugcucgaccugaacgccuccggcaccaugagcauccaggaguuccgggaccuguggaagcagcucaagcugagccagaagguguuccacaagcaggaccgcggguccggcuaccugaacugggagcagcuccacgccgcgaugcgggaggccgggaucaugcugagcgacgacgugugccagcugaugcucauccgcuacggcgggccccggcugcagauggacuucgucuccuucauccaccugaugcuccgcguggagaacauggaggacguguuccagaaccugacccaggacggcaagggcaucuaccugcagaagccggaguggaugaugauggcccucuacagcuga

SEQ ID NO: 27685 - RNA, 2145 nt, Artificial Sequence
  derived and/or modified sequence opt1 from CAPN1__Homo_sapiens__XP_011543594
augagcgaggagaucaucacccccguguacugcaccggcgucuccgcccaggugcagaagcagcgcgcccgggagcuggggcucggccgccacgagaacgcgaucaaguaccuggggcaggacuacgagcagcugcgggugcgcugccuccagagcggcacgcuguuccgggacgaggccuucccgcccgucccccagucccugggguacaaggaccucggccccaacagcuccaagaccuacggcaucaaguggaagcgcccgaccgagcugcugagcaacccccaguucaucguggacggggccacccggacggacaucugccagggcgcccucggggacugcuggcugcuggccgcgaucgccucccucacccugaacgacacccugcuccaccgcguggucccccacggccagagcuuccagaacggguacgccggcaucuuccacuuccagcuguggcaguucggcgaguggguggacguggucguggacgaccugcuccccaucaaggacgggaagcugguguucguccacuccgccgagggcaacgaguucuggagcgcgcugcucgagaaggccuacgccaaggugaacggguccuacgaggcccugagcggcggcuccaccagcgagggguucgaggacuucacgggcggggugaccgagugguacgagcugcggaaggccccguccgaccucuaccagaucauccugaaggcgcuggagcgcggcagccuccuggggugcuccaucgacaucagcuccguccuggacauggaggccaucaccuucaagaagcucgugaagggccacgccuacagcgugaccggcgccaagcaggucaacuaccgggggcaggucgugagccugauccgcaugcggaaccccuggggcgagguggaguggacgggggccugguccgacagcuccagcgaguggaacaacguggaccccuacgagcgcgaccagcugcgggugaagauggaggacggcgaguucuggauguccuuccgcgacuucaugcgggaguucacccgccucgagaucugcaaccugacccccgacgcgcucaagagccggaccauccgcaaguggaacacgacccuguacgaggggaccuggcggcgcggcuccaccgccggcgggugccgcaacuacccggccacguucugggucaacccccaguucaagauccggcuggacgagaccgacgaccccgacgacuacggcgaccgcgagagcgggugcuccuucgugcuggcccucaugcagaagcaccggcgccgggagcgccgguucggccgcgacauggagaccaucggguucgccgucuacgaggugcccccggagcuggugggccagcccgcgguccaccugaagcgggacuucuuccucgccaacgccagccgcgcccgguccgagcaguucaucaaccugcgcgaggugagcacccgguuccgccugccgcccggcgaguacguggucgugcccuccacguucgagcccaacaaggagggggacuucgugcuccgguucuucagcgagaaguccgccggcaccgucgagcuggacgaccagauccaggcgaaccugcccgacgagcagguccucagcgaggaggagaucgacgagaacuucaaggcccuguuccgccagcuggccggggaggacauggagaucuccgugaaggagcugcggaccauccucaaccgcaucaucagcaagcacaaggaccugcggaccaagggcuucucccuggagagcugccgcagcauggugaaccucauggaccgcgacggcaacgggaagcugggccugguggaguucaacauccucuggaaccggauccgcaacuaccuguccaucuuccggaaguucgaccuggacaagagcggguccaugagcgccuacgagaugcgcauggcgaucgaguccgccggcuucaagcucaacaagaagcuguacgagcugaucaucacgcgguacagcgagcccgaccucgccguggacuucgacaacuucgucugcugccuggugcgccuggagaccauguuccgguucuucaagacccucgacaccgaccuggacgggguggucacguucgaccuguucaaguggcuccagcugaccauguucgccuga

SEQ ID NO: 27686 - RNA, 1869 nt, Artificial Sequence
  derived and/or modified sequence opt1 from CAPN2__Homo_sapiens__NP_001139540
auggagaucugcgccgacccccaguucaucaucggcggggccacccgcaccgacaucugccagggcgcgcugggggacugcuggcuccuggccgccaucgccagccugacgcucaacgaggagauccuggcccggguggucccgcugaaccaguccuuccaggagaacuacgcgggcaucuuccacuuccaguucuggcaguacggggaguggguggagguggucguggacgaccgccuccccaccaaggacggcgagcugcuguucgugcacagcgccgagggcuccgaguucuggagcgcccuccuggagaaggccuacgcgaagaucaacgggugcuacgaggcccuguccggcggggccaccaccgagggcuucgaggacuucaccgggggcaucgccgagugguacgagcucaagaagcccccgcccaaccuguucaagaucauccagaaggcccugcagaagggcagccuccuggggugcuccaucgacaucacgagcgcggccgacuccgaggccaucaccuuccagaagcuggucaagggccacgccuacagcgugaccggggccgaggagguggaguccaacggcagccuccagaagcugauccggauccgcaaccccuggggcgaggucgaguggacggggcgguggaacgacaacugccccuccuggaacaccaucgaccccgaggagcgcgagcggcugacccgccggcacgaggacggcgaguucuggaugagcuucuccgacuuccuccgccacuacagccggcuggagaucugcaaccugaccccggacacgcucaccuccgacaccuacaagaaguggaagcugaccaagauggacgggaacuggcgccggggcagcacggccgggggcugccgcaacuaccccaacaccuucuggaugaacccccaguaccugaucaagcucgaggaggaggacgaggacgaggaggacggcgaguccgggugcaccuuccuggugggccugauccagaagcaccggcgccggcagcgcaagaugggggaggacaugcacaccaucggcuucgggaucuacgaggugcccgaggagcucagcggccagacgaacauccaccugagcaagaacuucuuccugaccaaccgggcgcgcgagcgguccgacaccuucaucaaccuccgcgagguccugaaccgcuucaagcugccgcccggcgaguacauccucgugcccagcaccuucgagcccaacaaggacggggacuucugcauccggguguucuccgagaagaaggccgacuaccaggccgucgacgacgagaucgaggccaaccuggaggaguucgacaucagcgaggacgacaucgacgacggcuuccgccggcuguucgcgcagcucgccggggaggacgccgagaucuccgccuucgagcugcagacgauccugcgccgggugcucgccaagcgccaggacaucaagagcgacggcuucuccaucgagaccugcaagaucaugguggacaugcuggacagcgacggguccggcaagcugggccucaaggaguucuacauccuguggaccaagauccagaaguaccagaagaucuaccgggagaucgacgucgaccgcagcgggaccaugaacuccuacgagaugcggaaggcgcuggaggaggccggcuucaagaugccgugccagcuccaccaggugaucguggcccgcuucgccgacgaccagcugaucaucgacuucgacaacuucguccggugccuggugcgccuggagacccucuucaagaucuucaagcagcuggaccccgagaacacggggaccaucgagcuggaccucaucagcuggcugugcuucuccgugcuguga

SEQ ID NO: 27687 - RNA, 2466 nt, Artificial Sequence
  derived and/or modified sequence opt1 from CAPN3__Homo_sapiens__NP_000061
augcccaccgugaucagcgccuccgucgccccgcgcaccgcggccgagccccggagccccggccccgugccgcaccccgcccaguccaaggccacggaggccgggggcgggaaccccagcggcaucuacuccgcgaucaucagccgcaacuuccccaucaucggggugaaggagaagaccuucgagcagcugcacaagaagugccucgagaagaagguccuguacguggacccggaguucccgcccgacgagaccucccuguucuacagccagaaguuccccauccaguucguguggaagcggccgcccgagaucugcgagaacccccgcuucaucaucgacggcgccaaccggaccgacaucugccagggcgagcucggggacugcugguuccuggccgccaucgcgugccugacgcucaaccagcaccuccuguuccgcgucaucccccacgaccaguccuucaucgagaacuacgccggcaucuuccacuuccaguucuggcgguacggggaguggguggacguggucaucgacgacugccugcccaccuacaacaaccagcugguguucaccaagagcaaccaccgcaacgaguucugguccgcccugcucgagaaggccuacgccaagcugcacggcagcuacgaggcgcugaagggcgggaacaccacggaggccauggaggacuucaccggcgggguggccgaguucuucgagauccgggacgcccccuccgacauguacaagaucaugaagaaggccaucgagcgcggcagccucauggggugcuccaucgacgacggcaccaacaugaccuacggcacgagccccuccgggcugaacaugggcgagcugaucgcgcggaugguccgcaacauggacaacagccuccugcaggacuccgaccuggacccccgggggagcgacgagcgcccgacccggaccaucauccccgugcaguacgagacccgcauggccugcggccucgugcgggggcacgccuacagcgucacgggccuggacgaggugcccuucaagggcgagaaggugaagcugguccgccuccggaaccccuggggccagguggaguggaacggguccuggagcgaccgcuggaaggacugguccuucguggacaaggacgagaaggcccggcugcagcaccaggucaccgaggacggggaguucuggaugagcuacgaggacuucaucuaccacuucaccaagcuggagaucugcaaccucaccgccgacgcgcugcaguccgacaagcugcagacguggaccgugagcgugaacgagggccgcuggguccgcgggugcuccgccggcggcugccggaacuucccggacaccuucuggaccaacccccaguaccgccucaagcugcuggaggaggacgacgaccccgacgacagcgaggugaucugcuccuuccucgucgcccugaugcagaagaaccggcgcaaggaccggaagcugggggccagccucuucacgaucggcuucgccaucuacgaggugcccaaggagaugcacgggaacaagcagcaccuccagaaggacuucuuccuguacaacgcguccaaggcccgcagcaagaccuacaucaacaugcgggaggugucccagcgcuuccggcugccgcccagcgaguacgucaucgugcccuccaccuacgagccgcaccaggagggcgaguucauccugcgcguguucagcgagaagcggaaccuguccgaggaggucgagaacaccaucagcguggaccgccccgugaagaagaagaagacgaagcccaucaucuucgucuccgaccgggccaacagcaacaaggagcucgggguggaccaggagagcgaggagggcaagggcaagaccucccccgacaagcagaagcagagcccgcagccccagcccggguccagcgaccaggaguccgaggagcagcagcaguuccgcaacaucuucaagcagaucgccggcgacgacauggagaucugcgcggacgagcugaagaaggugcugaacaccgucgugaacaagcacaaggaccucaagacccacggguucacgcuggagagcugccgguccaugaucgcccugauggacaccgacggcagcggcaagcucaaccugcaggaguuccaccaccuguggaacaagaucaaggccuggcagaagaucuucaagcacuacgacaccgaccaguccgggaccaucaacagcuacgagaugcgcaacgccgugaacgacgccggcuuccaccugaacaaccagcucuacgacaucaucacgaugcgguacgcggacaagcacaugaacaucgacuucgacuccuucaucugcugcuucguccgccuggaggggauguuccgggccuuccacgccuucgacaaggacggcgacgggaucaucaagcugaacgugcucgaguggcugcagcugaccauguacgccuga

SEQ ID NO: 27688 - RNA, 1923 nt, Artificial Sequence
  derived and/or modified sequence opt1 from CAPN5__Homo_sapiens__NP_004046
auguucagcugcgugaagcccuacgaggaccagaacuacuccgcccugcgccgggacugccgccggcgcaagguccucuucgaggacccgcuguuccccgccaccgacgacagccuguacuacaagggcacccccgggcccgcggugcgguggaagcgcccgaagggcaucugcgaggacccccggcuguucguggacgggaucuccagccacgaccugcaccagggccaggucgggaacugcugguucguggccgccugcuccagccuggccucccgcgagagccucuggcagaaggugauccccgacuggaaggagcaggagugggaccccgagaagccgaacgccuacgcgggcaucuuccacuuccacuucuggcgguucggcgagugggucgacguggugaucgacgaccgccugcccacggucaacaaccagcugaucuacugccacuccaacagccggaacgaguucuggugcgcccucguggagaaggccuacgccaagcuggcggggugcuaccaggcccuggacggcgggaacaccgccgacgcccucguggacuucaccggcggggucuccgagcccaucgaccugaccgagggcgacuucgccaacgacgagacgaagcgcaaccagcuguucgagcggaugcucaaggugcacagccgcggcgggcugaucuccgcgagcaucaaggccgugaccgccgccgacauggaggcccggcuggcgugcggccucgucaaggggcacgccuacgccgugaccgacgugcgcaagguccggcugggccacggccugcucgccuucuucaaguccgagaagcuggacaugauccgccugcggaaccccuggggcgagcgcgaguggaacgggccguggagcgacaccuccgaggaguggcagaaggugagcaaguccgagcgggagaagaugggggugacgguccaggacgacggcgaguucuggaugaccuucgaggacgugugccgcuacuucaccgacaucaucaagugccgcgugaucaacaccagccaccucagcauccacaagacgugggaggaggcccggcugcacggggcguggacccugcacgaggacccccgccagaaccggggcggcgggugcaucaaccacaaggacaccuucuuccagaacccccaguacaucuucgaggucaagaagcccgaggacgaggugcucaucugcauccagcagcgcccgaagcgguccacccgccgggagggcaagggggagaaccuggccaucggcuucgacaucuacaaggucgaggagaaccgccaguaccggaugcacagccugcagcacaaggccgccuccagcaucuacaucaacucccgcagcguguuccuccggacggaccagcccgaggggcgcuacgugaucauccccaccaccuucgagcccggccacaccggcgaguuccugcugcgggucuucacggacgugccguccaacugccgcgagcuccggcuggacgagccgccccacacgugcuggagcucccugugcggguacccccagcucgugacccagguccacgugcugggcgccgcggggcugaaggacagccccaccggcgccaacuccuacgugaucaucaagugcgagggggacaagguccgcagcgccgugcagaagggcaccuccacccccgaguacaacgugaagggcaucuucuaccggaagaagcucagccagcccaucaccguccagguguggaaccaccgcgugcugaaggacgaguuccuggggcagguccaccucaaggccgaccccgacaaccugcaggcgcugcacacccuccaccuccgggaccgcaacucccgccagccgagcaaccugcccggcacgguggccgugcacauccucuccagcaccucccugauggccgucuga

SEQ ID NO: 27689 - RNA, 1926 nt, Artificial Sequence
  derived and/or modified sequence opt1 from CAPN6__Homo_sapiens__NP_055104
auggggcccccgcugaagcuguucaagaaccagaaguaccaggagcucaagcaggagugcaucaaggacagccgccuguucugcgaccccaccuuccuccccgagaacgacucccuguucuacaaccggcugcuccccggcaaggugguguggaagcgcccgcaggacaucugcgacgacccccaccugaucgugggcaacaucagcaaccaccagcugacccaggggcggcucggccacaagcccaugguguccgccuucagcugccuggccguccaggagucccacuggacgaagaccauccccaaccacaaggagcaggagugggacccgcagaagaccgagaaguacgcggggaucuuccacuuccgcuucuggcacuucggcgaguggaccgagguggugaucgacgaccugcuccccacgaucaacggcgaccuggucuucagcuucuccaccagcaugaacgaguucuggaacgcccugcucgagaaggccuacgccaagcugcuggggugcuacgaggcccucgacggccugaccaucaccgacaucaucguggacuucacggggacccuggcggagaccguggacaugcagaagggccgguacaccgagcucgucgaggagaaguacaagcuguucggggagcuguacaagacguucaccaagggcggccucaucugcugcuccaucgagagccccaaccaggaggagcaggagguggagaccgacugggggcugcugaagggccacaccuacacgaugaccgacauccgcaagauccggcucggggagcgccugguggaggucuucuccgccgagaagguguacauggugcggcugcgcaacccccucggccggcaggaguggagcggcccgugguccgagaucagcgaggaguggcagcagcugaccgccuccgaccgcaagaaccuggggcucgucaugagcgacgacggcgaguucuggaugucccuggaggacuucugccggaacuuccacaagcugaacgugugccgcaacgugaacaaccccaucuucgggcggaaggagcucgagagcguccugggcugcuggaccguggacgacgacccccugaugaaccgcuccgggggcugcuacaacaaccgggacacguuccuccagaacccccaguacaucuucaccgugccggaggacggccacaaggucaucaugagccugcagcagaaggaccugcgcaccuaccggcgcauggggcggcccgacaacuacaucaucggcuucgagcuguucaagguggagaugaaccgcaaguuccgccuccaccaccuguacauccaggagcgggccgggaccagcacguacaucgacacccgcaccguguuccucuccaaguaccugaagaagggcaacuacguccuggugcccaccauguuccagcacgggcggacgagcgaguuccuccugcgcaucuucuccgagguccccgugcagcugcgggagcugacccucgacaugccgaagaugagcugcuggaaccuggcgcgcggcuaccccaagguggucacccagaucaccgugcacuccgccgaggaccuggagaagaaguacgccaacgagacggugaaccccuaccucgucaucaagugcggcaaggaggaggugcggagccccgugcagaagaacaccguccacgccaucuucgacacccaggccaucuucuaccgccggaccacggacaucccgaucaucguccagguguggaacucccgcaaguucugcgaccaguuccuggggcaggucacccuggacgcggaccccagcgacugccgggaccucaagucccuguaccugcgcaagaagggcgggcccaccgccaaggugaagcagggccacaucagcuucaaggugaucuccagcgacgaccucaccgagcuguga

SEQ ID NO: 27690 - RNA, 2442 nt, Artificial Sequence
  derived and/or modified sequence opt1 from CAPN7__Homo_sapiens__NP_055111
auggacgccaccgcccuggagcgcgacgcggugcaguucgcccggcucgccguccagcgcgaccacgagggccgguacagcgaggccguguucuacuacaaggaggccgcgcaggcccugaucuacgccgagauggccggguccagccuggagaacauccaggagaagaucaccgaguaccucgagcgcgugcaggcgcugcacuccgccguccagagcaaguccgccgacccccugaaguccaagcaccagcucgaccuggagcgggcccacuuccuggugacgcaggccuucgacgaggacgagaaggagaacguggaggacgcgaucgagcucuacaccgaggccgucgaccugugccugaagaccuccuacgagaccgccgacaaggugcuccagaacaagcugaagcagcuggcccgccaggcccucgaccgggcggaggcccugagcgagccgcugacgaagcccgugggcaagaucuccagcaccuccgucaagcccaagcccccgcccgugcgcgcccacuucccccucggggccaaccccuuccuggagcggccgcagagcuucaucagcccccagagcugcgacgcccagggccagcgcuacaccgcggaggagaucgaggugcugcggaccacguccaagaucaacgggaucgaguacguccccuucaugaacguggaccuccgcgagcgguucgccuaccccaugccguucugcgaccgcuggggcaagcugccccugagccccaagcagaagaccaccuucuccaagugggugcggcccgaggaccucaccaacaacccgacgaugaucuacaccgucagcuccuucagcaucaagcagaccaucgugagcgacugcuccuucguggccagccuggccaucuccgccgcguacgagcgccgguucaacaagaagcugaucaccggcaucaucuacccccagaacaaggacggggagcccgaguacaaccccugcggcaaguacauggucaagcuccaccugaacggggugccgcgcaaggugaucaucgacgaccagcugcccgucgaccacaagggcgagcuccugugcagcuacuccaacaacaagagcgagcugugggugucccucaucgagaaggccuacaugaaggugaugggcggguacgacuuccccggcagcaacuccaacaucgaccugcacgcccugacgggguggauccccgagcggaucgccaugcacagcgacucccagaccuucagcaaggacaacuccuuccgcaugcucuaccagcgguuccacaagggcgacguccugaucaccgcgagcaccgggaugaugacggaggccgagggcgagaaguggggccuggugccgacccacgccuacgccguccucgacauccgcgaguucaaggggcugcgcuucauccagcugaagaaccccuggucccaccuccgguggaagggccgcuacagcgagaacgacgugaagaacuggacccccgagcugcagaaguaccugaacuucgacccccggaccgcccagaagaucgacaacgggaucuucuggaucuccugggacgaccucugccaguacuacgacgugaucuaccugagcuggaacccgggccuguucaaggaguccacgugcauccacagcaccugggacgcgaagcaggggcccgucaaggacgccuacagccucgccaacaacccccaguacaagcuggaggugcagugcccgcagggcggcgccgccguguggguccugcugucccgccacaucaccgacaaggacgacuucgcgaacaaccgggaguucaucaccauggugguguacaagacggacgggaagaaggucuacuaccccgccgacccgccgcccuacaucgacggcauccgcaucaacagcccccacuaccucaccaagaucaagcugaccacccccgggacgcacaccuucacccugguggugucccaguacgagaagcagaacaccauccacuacacgguccggguguacagcgccugcuccuucaccuucagcaagauccccucccccuacacccucagcaagcgcaucaacggcaagugguccgggcagagcgccggcggcugcgggaacuuccaggagacccacaagaacaaccccaucuaccaguuccacaucgagaagaccggcccccugcugaucgagcuccgggggccccgccaguacuccgugggcuucgaggucgugacggugagcacccugggggacccgggcccccacggcuuccugcggaaguccagcggggacuaccgcugcggcuucugcuaccucgagcuggagaacauccccuccgggaucuucaacaucauccccagcaccuuccugccgaagcaggagggccccuucuuccucgacuucaacuccaucauccccaucaagaucacccagcugcaguga

SEQ ID NO: 27691 - RNA, 2073 nt, Artificial Sequence
  derived and/or modified sequence opt1 from CAPN9__Homo_sapiens__NP_006606
augcccuaccuguaccgcgcccccggcccccaggcccaccccgugcccaaggacgcgcggaucacccacagcuccgggcagagcuucgagcagaugcgccaggagugccuccagcggggcacccuguucgaggacgccgacuucccggccuccaacagcucccuguucuacagcgagcgcccccagauccccuucgucuggaagcggcccggggagaucgugaagaacccggaguucauccucggcggggccacgcgcaccgacaucugccagggcgagcugggcgacugcuggcugcucgccgcgaucgccucccugacccugaaccagaaggcccucgcccgggugaucccccaggaccagagcuucgggcccggcuacgcggggaucuuccacuuccaguucuggcagcacuccgaguggcuggacgucgugaucgacgaccgccugcccaccuuccgggaccgccucguguuccugcacagcgccgaccacaacgaguucugguccgcccugcucgagaaggccuacgccaagcugaacggcagcuacgaggcgcugaagggcggguccgccaucgaggccauggaggacuucacgggcggggucgccgagaccuuccagaccaaggaggccccggagaacuucuacgagauccucgagaaggcgcugaagcggggcagccugcucgggugcuucaucgacacccgcuccgccgccgagagcgaggcccggacgcccuucggccugaucaagggccacgccuacuccgugaccgggaucgaccaggugagcuuccgcggccagcggaucgagcugauccgcauccggaaccccugggggcaggucgaguggaacggcuccuggagcgacagcucccccgaguggcgcagcguggggccggcggagcagaagcggcucugccacaccgcccuggacgacggcgaguucuggauggccuucaaggacuucaaggcccacuucgacaagguggagaucugcaaccugacccccgacgcccucgaggaggacgcgauccacaagugggaggucacggugcaccagggcuccugggugcgcgggagcaccgccggcgggugccggaacuuccuggacaccuucuggaccaacccccagaucaagcugucccucacggagaaggacgagggccaggaggagugcagcuuccuggucgcccugaugcagaaggaccgccgcaagcucaagcgguucggggccaacgugcugaccaucggcuacgcgaucuacgagugccccgacaaggacgagcaccugaacaaggacuucuuccgcuaccacgccucccgggcccgcagcaagaccuucaucaaccuccgggagguguccgaccgcuucaagcugccgcccggcgaguacauccugauccccagcaccuucgagccccaccaggaggccgacuucugccuccggaucuucuccgagaagaaggccaucacgcgcgacauggacgggaacgucgacaucgaccugccggagccgcccaagcccaccccgcccgaccaggagaccgaggaggagcagcgguuccgcgcgcuguucgagcaggucgccggcgaggacauggaggugaccgccgaggagcucgaguacgugcugaacgccgugcugcagaagaagaaggacaucaaguucaagaagcucagccugaucuccugcaagaacaucaucagccugauggacacguccgggaacggcaagcucgaguucgacgaguucaagguguucugggacaagcugaagcaguggaucaaccuguuccugcgguucgacgccgacaagagcgggaccauguccaccuacgagcuccgcaccgcgcugaaggccgccggcuuccagcugagcucccaccuccugcagcugaucguccuccgguacgccgacgaggagcugcagcuggacuucgacgacuuccucaacugccuggugcgccuggagaacgccagccgggucuuccaggcgcucagcacgaagaacaaggaguucauccaccugaacaucaacgaguucauccaccugaccaugaacaucuga

SEQ ID NO: 27692 - RNA, 807 nt, Artificial Sequence
  derived and/or modified sequence opt1 from CAPNS1__Homo_sapiens__NP_001289561
auguuccuggugaacagcuuccucaagggcgggggcgggggcgggggcggcgggggcgggcugggcgggggccugggcaacguccucgggggccugaucuccggggccggcggcgggggcgggggcgggggcggcgggggcgggggcgggggcggcgggggcgggggcaccgccaugcgcauccucgggggcgugaucagcgcgaucuccgaggccgccgcccaguacaaccccgagccgcccccgccccggacccacuacagcaacaucgaggccaacgaguccgaggaggugcgccaguuccggcgccuguucgcgcagcuggccggcgacgacauggaggucagcgccacggagcugaugaacauccucaacaagguggugacccggcaccccgaccugaagaccgacggguucggcaucgacacgugccgcuccauggucgccgugauggacagcgacaccaccgggaagcugggcuucgaggaguucaaguaccucuggaacaacaucaagcgguggcaggcgaucuacaagcaguucgacaccgaccgcuccggcaccaucugcagcuccgagcugcccggggccuucgaggccgccggcuuccaccugaacgagcaccucuacaacaugaucauccggcgcuacagcgacgaguccgggaacauggacuucgacaacuucaucagcugccuggugcggcuggacgccauguuccgcgcguucaagucccucgacaaggacggcacggggcagauccaggucaacauccaggaguggcugcagcugaccauguacagcuga

SEQ ID NO: 27693 - RNA, 2130 nt, Artificial Sequence
  derived and/or modified sequence opt1 from CAPRIN1__Homo_sapiens__NP_005889
augcccagcgccaccucccacagcggcuccgggagcaaguccagcggcccgcccccgcccuccgggagcuccggcagcgaggccgccgccggggccggcgccgccgcgcccgccucccagcaccccgccaccggcacgggggccgugcagaccgaggcgaugaagcagauccugggcgugaucgacaagaagcuccgcaaccuggagaagaagaaggggaagcuggacgacuaccaggagcggaugaacaagggcgagcgccucaaccaggaccagcuggacgccgugagcaaguaccaggaggugaccaacaaccuggaguucgccaaggagcuccagcgguccuucauggcccugagccaggacauccagaagaccaucaagaagacggcccgccgggagcagcugaugcgcgaggaggcggagcagaagcggcucaagaccguccuggagcugcaguacgugcucgacaagcugggggacgacgaggugcgcaccgaccugaagcagggccucaacggcguccccauccuguccgaggaggagcugagccuccuggacgaguucuacaagcugguggaccccgagcgggacaugucccuccgccugaacgagcaguacgagcacgccagcauccaccugugggaccuccuggaggggaaggagaagccggugugcggcaccacguacaagguccugaaggagaucguggagcggguguuccaguccaacuacuucgacagcacccacaaccaccagaacgggcucugcgaggaggaggaggccgccagcgcccccgcggucgaggaccaggugcccgaggccgagcccgagccggccgaggaguacaccgagcaguccgagguggagagcaccgaguacgucaaccgccaguucauggccgagacgcaguucaccuccggcgagaaggagcaggucgacgaguggaccguggagaccguggagguggugaacagccugcagcagcagccccaggccgcgucccccagcguccccgagccgcacucccugacgcccguggcccaggccgacccccucgugcggcgccagcggguccaggaccugauggcccagaugcagggccccuacaacuucauccaggacagcaugcuggacuucgagaaccagacccucgacccggccaucguguccgcgcagcccaugaaccccacccagaacauggacaugccccagcuggucugcccgcccgugcacagcgagucccgccuggcccagcccaaccaggugcccguccagccggaggccacccaggugccccucgugagcuccacgagcgagggguacaccgccucccagccccuguaccagccgagccacgcgaccgagcagcggccccagaaggagcccaucgaccagauccaggccaccaucucccugaacacggaccagaccaccgccagcuccagccuccccgccgccagccagccgcaggucuuccaggcgggcaccuccaagccccugcacagcuccgggaucaacgugaacgccgcccccuuccagagcaugcagacgguguucaacaugaacgcccccgucccgcccgugaacgagcccgagacccugaagcagcagaaccaguaccaggccuccuacaaccagagcuucuccagccagccccaccagguggagcagaccgagcuccagcaggagcagcugcagaccgucgugggcacguaccacggguccccggaccagagccaccaggugaccggcaaccaccagcagccgccccagcagaacaccggcuucccccgcuccaaccagcccuacuacaacagccgcggggucucccggggcgggagccggggcgcgcgcgggcugaugaacggcuaccgcggccccgccaacggguuccggggcggguacgacggcuaccgccccuccuucagcaacacccccaacuccggguacacgcagagccaguucagcgccccgcgggacuacuccggcuaccagcgcgacggcuaccagcagaacuucaagcgggggagcggccaguccgggccccgcggcgcgccccggggccgcgggggcccgccccggcccaaccgcgggaugccccagaugaacacccagcaggucaacuga

SEQ ID NO: 27694 - RNA, 3384 nt, Artificial Sequence
  derived and/or modified sequence opt1 from CAPRIN2__Homo_sapiens__NP_001002259
auggaggugcaggucagccaggccucccugggcuucgagcucaccagcguggagaagucccugcgcgaguggagccggcugucccgcgaggugaucgccuggcucugccccagcuccccgaacuucauccugaacuuccccccccccccgagcgcguccagcgucuccauggugcagcuguucagcucccccuucggguaccagagccccuccggccacagcgaggaggagcgggaggggaacaugaaguccgccaagccccaggugaaccacagccagcacggcgagucccagcgcgcccucagcccgcugcagagcacccuguccagcgccgccucccccagccaggcguacgagacguacaucgagaacgggcucaucugccugaagcacaagauccggaacaucgagaagaagaagcugaagcucgaggacuacaaggaccgccugaaguccggcgagcaccugaaccccgaccagcucgaggccgucgagaaguacgaggaggugcugcacaaccuggaguucgccaaggagcuccagaagaccuucagcggccugucccuggaccuccugaaggcccagaagaaggcgcagcggcgcgagcacaugcugaagcucgaggccgagaagaagaagcugcggaccauccugcaggugcaguacguccuccagaaccugacccaggagcacgugcagaaggacuucaaggggggccugaacggggccguguaccuccccagcaaggagcuggacuaccugaucaaguucuccaagcucacgugcccggagcgcaacgagagccuguccgucgaggaccagauggagcagagcucccuguacuucugggaccuccuggagggcagcgagaaggccgugguggggaccaccuacaagcaccugaaggaccuccuguccaagcugcucaacagcggcuacuucgaguccauccccguccccaagaacgccaaggagaaggaggugccccuggaggaggagaugcugauccagagcgagaagaagacccagcucuccaagacggagagcgugaaggagagcgagucccugauggaguucgcgcagccggagauccagccccaggaguuccugaaccggcgcuacaugaccgaggucgacuacagcaacaagcagggcgaggagcagcccugggaggccgacuacgcccggaagcccaaccucccgaagcgcugggacaugcugaccgagcccgacgggcaggagaagaagcaggaguccuucaagagcugggaggccuccggcaagcaccaggaggugagcaagcccgccgugucccuggagcagcggaagcaggacaccagcaagcugcgcuccacgcuccccgaggagcagaagaagcaggagaucagcaaguccaagccgagccccucccaguggaagcaggacacccccaagagcaaggcgggguacguccaggaggagcagaagaagcaggagacccccaagcuguggccggugcagcugcagaaggagcaggaccccaagaagcagacccccaaguccuggacgccgagcaugcaguccgagcagaacaccaccaagagcuggaccacgcccaugugcgaggagcaggacagcaagcagcccgagacccccaaguccugggagaacaacguggagagccagaagcacucccucaccagccagucccagaucagcccgaaguccuggggcgucgccaccgccagccugauccccaacgaccagcugcucccccggaagcugaacacggagcccaaggacgugccgaagcccguccaccagcccgugggcuccagcuccacccugcccaaggacccggugcuccgcaaggagaagcugcaggaccugaugacccagauccaggggaccugcaacuucaugcaggagagcguccucgacuucgacaagcccuccagcgccauccccacgucccagcccccgagcgccacccccggcucccccguggcgagcaaggagcagaaccuguccagccagagcgacuuccugcaggagccccuccaggccaccuccagcccggugaccugcuccagcaacgccugccuggucacgaccgaccaggccuccagcggguccgagaccgaguucaugaccagcgagacgcccgaggccgcgaucccccccggcaagcagccguccagccuggccucccccaaccccccgauggccaaggggagcgagcagggcuuccaguccccccccgccagcuccagcuccgugaccaucaacaccgcgcccuuccaggccaugcagaccguguucaacgucaacgccccgcuccccccccggaaggagcaggagaucaaggagagccccuacuccccgggcuacaaccagagcuucaccacggccagcacccagacccccccccagugccagcugcccuccauccacguggagcagaccgugcacagccaggagacggccgcgaacuaccacccggacgggaccauccaggucuccaacggcagccuggccuucuaccccgcccagaccaacguguucccccgccccacccagccguucgugaacucccgggggagcguccgcggcugcacgcgcgggggccggcucaucaccaacuccuaccgcagccccggcggguacaagggcuucgacaccuaccgggggcugcccuccaucagcaacggcaacuacucccagcugcaguuccaggcccgcgaguacagcggggcccccuacucccagcgggacaacuuccagcagugcuacaagcgcggcggcaccagcgggggcccgcgggcgaacucccgcgccggguggagcgacuccagccagguguccagccccgagcgggacaacgagacguucaacagcggcgacuccggccagggggacagccgcuccaugacccccguggacguccccgugaccaacccggccgccaccauccuccccgugcacgucuacccccugccccagcagaugcggguggccuucagcgcggcccgcacguccaaccuggccccgggcacccucgaccagcccaucguguucgaccugcugcucaacaaccugggggagaccuucgaccugcagcucggccgguucaacugccccgucaacgggaccuacguguucaucuuccacaugcugaagcuggccgugaacgucccgcucuacgugaaccugaugaagaacgaggaggugcuggucagcgcguacgccaacgacggcgcccccgaccacgagacggccuccaaccacgccauccuccagcuguuccagggcgaccagaucuggcugcgccuccaccggggggcgaucuacggcagcuccuggaaguacagcaccuucuccggguaccugcuguaccaggacuga

SEQ ID NO: 27695 - RNA, 1428 nt, Artificial Sequence
  derived and/or modified sequence opt1 from CAPS2__Homo_sapiens__NP_001273476
augaucaacaccggcacccagauggaccuggaggugaagggggucgccgccacgagccgcucccagauccagcccuucuucggccggaagaagccgcuccagcagcgcuggaccagcgaguccuggaccaaccagaacagcugcccgcccguggugccccggcuggaccuggggucccucgucgacagcgacgacgaggaccagaacaucauccccgagaaccugcccgcgcccaccgacaagugcaagcugaaguaccagcagugcaagacggagaucaaggagggcuacaagcaguacucccagcgcaacgccgagaacaccaagagcaacgugacccacaagcagagcccccggaacaagaucgacgagaagugcgugcaggacgaggaggccaacaccgacgaccucacgacccuggaccgcaaggccauccugcagcagggguacgccgacaacagcugcgacaagcagcagcgggcgcgcaagcucgacgccgagaucgucgccgccgagaagaagaagcagaucguggcggagcaggucaugaucgaccaccugucccgggccgugaucagcgacccggagcagaaccuggccaucgagcagaaggaguccgaccacauccuccccgacagcaagaugacgccccugcgcuuccggaagcgcacccugcacgagaccaagauccggacccacuccacccucaccgagaacgugcugagccacaagcugcaguucgacggccgcaucgugucccggacgaacguccuccccuucauccagaaguccaucuacucccaccagugcggccgccggaaggggaagcaguaccgccugggcgacuucuacgugggggccacccugaccuuccucagcagcgaccaccugucccugccggagagcaucaaggagaacacccuccugaagcugcggaucacgaacaucgaccagaucgcccucgacucccugaagaccgcgagcauggagcaggaggacgacaucaucauccaggagaccaacgaccgccugguguucaaggccauccaggacguccucaaggagaagcugcacaagcggggcgugcgcauccugaccgggcucggcaaguacuuccagcagcuggacaaggagggcaacgggcugcucgacaaggccgacuucaagcaggcccugaagguguuccaccuggaggucuccgagaaggacuucgagagcgccuggcucauccugaacgacaacggcaacgggaagguggacuacggcgaguucaagcgcggcaucaucggggagaugaacgaguaccggaaguccuacgugcgcaaggcguucaugaagcuggacuucaacaagagcggcuccguccccaucaucaacauccggaagugcuacugcgccaagaagcacagccaggugaucuccggguga

SEQ ID NO: 27696 - RNA, 828 nt, Artificial Sequence
  derived and/or modified sequence opt1 from CAPS__Homo_sapiens__NP_004049
augcagugccaccgcgaccuggcccucagccaggcccuguggggcuggcagcuguccaagcagagcgggugggcgcaccccucccucccgcacagcccccugcccuccaccgugcacagcugcuccugggcgcccccgcaccuccagcggcaccucccccuggccaccgucagccccggcacgacccagcugacccaggggcccgccggccgcacccuggggcagacgcaggccuccugcccggagccccggcccagcauggacgccguggacgccaccauggagaagcugcgcgcccagugccugucccggggcgccagcggcauccaggggcucgcgcgcuucuuccggcagcuggaccgcgacggcucccggagccuggacgccgacgaguuccgccaggggcucgccaagcugggccuggugcucgaccaggccgaggccgagggggucugccggaagugggaccgcaacggcuccggcacccuggaccuggaggaguuccuccgggcgcugcggcccccgaugagccaggcccgggaggccgugaucgccgccgcguucgccaagcuggaccgcuccggggacggcguggucaccguggacgaccuccgcgggguguacagcggccgcgcccaccccaagguccgguccggcgaguggacggaggacgaggugcugcgccgguuccuggacaacuucgacagcagcgagaaggacggccaggugacccucgccgaguuccaggacuacuacuccggggucagcgccuccaugaacaccgacgaggaguucguggcgaugaugaccagcgccuggcagcuguga

SEQ ID NO: 27697 - RNA, 627 nt, Artificial Sequence
  derived and/or modified sequence opt1 from CAPSL__Homo_sapiens__NP_001036090
auggccggcaccgcccgccacgaccgggagauggcgauccaggccaagaagaagcugaccacggccaccgaccccaucgagcgccuccggcugcagugccuggcccgcgggagcgccggcaucaaggggcucggccggguguuccgcaucauggacgacgacaacaaccggacccuggacuucaaggaguucaugaaggggcugaacgacuacgcggucgugauggagaaggaggagguggaggagcuguuccgccgguucgacaaggacggcaacggcaccaucgacuucaacgaguuccuccugacgcuccgcccgcccaugucccgggcccgcaaggaggucaucaugcaggccuuccggaagcuggacaagaccggggacggcgugaucaccaucgaggaccugcgcgagguguacaacgccaagcaccaccccaaguaccagaacggggaguggagcgaggagcaggucuuccggaaguuccucgacaacuucgacucccccuacgacaaggacggccuggugaccccggaggaguucaugaacuacuacgcgggggugagcgccuccaucgacacggacgucuacuucaucaucaugaugcgcaccgccuggaagcuguga

SEQ ID NO: 27698 - RNA, 861 nt, Artificial Sequence
  derived and/or modified sequence opt1 from CAPZA2__Homo_sapiens__NP_006127
auggccgaccuggaggagcagcucagcgacgaggagaaggugcgcaucgccgcgaaguucaucauccacgcgcccccgggcgaguucaacgaggucuucaacgacgugcggcugcugcucaacaacgacaaccugcugcgcgagggggccgcccacgccuucgcccaguacaaccucgaccaguucacccccgugaagaucgagggcuacgaggaccagguccugaucaccgagcacggggaccugggcaacgggaaguuccucgaccccaagaaccggaucugcuucaaguucgaccaccuccgcaaggaggccacggacccccggccgugcgagguggagaacgccguggaguccuggcgcaccagcgucgagaccgcccugcgggcguacgugaaggagcacuaccccaacggcgugugcaccgucuacggcaagaagaucgacgggcagcagacgaucaucgccugcaucgagucccaccaguuccaggccaagaacuucuggaacggccgcuggcggagcgaguggaaguucaccaucacccccuccaccacccaggugguggggauccugaagauccagguccacuacuacgaggacggcaacgugcagcuggugagccacaaggacauccaggacucccugacggucagcaacgaggugcagaccgccaaggaguucaucaagaucguggaggccgcggagaacgaguaccagaccgccaucuccgagaacuaccagacgaugagcgacaccaccuucaaggcccuccgccggcagcugcccgucacccgcacgaagaucgacuggaacaagauccuguccuacaagaucgggaaggagaugcagaacgccuga

SEQ ID NO: 27699 - RNA, 900 nt, Artificial Sequence
  derived and/or modified sequence opt1 from CAPZA3__Homo_sapiens__NP_201585
augacccugagcgugcucucccgcaaggacaaggagcgggucauccgccggcugcugcuccaggcgcccccgggcgaguucgugaacgccuucgacgaccugugccugcucauccgcgacgagaagcugaugcaccaccagggggagugcgccggccaccagcacugccagaaguacagcgugccccugugcaucgacgggaaccccguccuccugucccaccacaacgugaugggcgacuaccgguucuucgaccaccagagcaagcuguccuucaaguacgaccuccugcagaaccagcugaaggacauccagagccacgggaucauccagaacgaggccgaguaccuccgcgugguccugcugugcgcccucaagcuguacgugaacgaccacuaccccaagggcaacugcaacaugcugcggaagaccgugaaguccaaggaguaccucaucgccugcaucgaggaccacaacuacgagacgggcgagugcuggaacgggcuguggaaguccaaguggaucuuccaggucaacccguuccugacccaggugaccggccgcaucuucgugcaggcccacuucuuccggugcgucaaccuccacaucgagaucagcaaggaccugaaggagagccuggagaucgugaaccaggcgcagcucgcccuguccuucgcccgccugguggaggagcaggagaacaaguuccaggccgcgguccucgaggagcugcaggagcugagcaacgaggcccuccggaagauccugcgccgggaccugcccgugacccgcacgcucaucgacuggcaccggauccuguccgaccugaaccucgugauguaccccaagcugggguacgucaucuacagccgcuccgugcugugcaacuggaucaucuga

SEQ ID NO: 27700 - RNA, 3099 nt, Artificial Sequence
  derived and/or modified sequence opt1 from CARD10__Homo_sapiens__NP_055365
augcccggccgcgccgaggccggggaggcggaggaggaggccggcgccgggagcggcuccgaggccgaggaggacgcccugugggagcggaucgagggggugcgccaccggcucgcgcgcgcccugaacccggccaagcugacccccuaccuccggcagugccgcgucaucgacgagcaggacgaggaggaggugcugagcaccuaccgguuccccugccgcgugaaccggacgggccgccugauggacauccuccggugccgcggcaagcggggguacgaggccuuccuggaggcgcuggaguucuacuaccccgagcacuucacccuccugaccggccaggagccggcccagcgcugcuccaugauccuggacgaggaggggcccgagggccucacccaguuccugaugacggagguccggcgccugcgggaggcccgcaagagccagcuccagcgggagcagcagcugcaggcccgcgggcgggugcuggaggaggagcgcgccggccucgagcagcgccugcgggaccagcagcaggcgcaggagcgcugccagcggcugcgcgaggacugggaggccggcucccucgagcugcugcggcucaaggacgagaacuacaugaucgccaugcgccuggcccagcugagcgaggagaagaacuccgccgugcuccggagccgcgaccugcagcuggcggucgaccagcucaagcugaaggugucccggcuggaggaggagugcgcccuccugcgccgggcccgcgggccgcccccgggcgccgaggagaaggagaaggagaaggagaaggagaaggagcccgacaacguggaccuggucagcgagcuccgggccgagaaccagcgccugaccgcgucccugcgggagcuccaggaggggcugcagcaggaggccagccgccccggcgcccccggcuccgagcggauccugcucgacauccuggagcacgacuggcgcgaggcccaggacagccggcaggagcugugccagaagcuccacgccgugcagggggagcugcagugggcggaggagcugcgcgaccaguaccuccaggagauggaggaccugcgccugaagcaccggacccugcagaaggacugcgaccucuacaagcaccgcauggccaccgugcuggcccagcuggaggagaucgagaaggagcgggaccaggccauccagucccgcgaccggauccagcuccaguacagccagucccugaucgagaaggaccaguaccgcaagcagguccggggccuggaggcggagcgcgacgagcuccugacgacccugaccagccucgaggggaccaaggcccugcuggaggugcagcuccagcgggcccagggcgggacgugccugaaggccugcgccuccagccacagccugugcuccaaccucagcuccaccuggagccuguccgaguucccgagcccccugggcggccccgaggcgaccggggaggccgccgugaugggcgggcccgagccgcacaacuccgaggaggccaccgacagcgagaaggagaucaaccgccucuccauccugcccuucccgcccagcgccggcuccauccugcggcgccagcgggaggaggaccccgcgccgcccaagcgcagcuucuccagcauguccgacaucacggggagcgucacccucaagcccuggucccccggccugagcuccagcagcuccagcgacuccguguggccccugggcaagcccgaggggcuccuggcccggggcugcgggcuggacuuccucaaccgcagccuggccauccggguguccggccgcagcccgcccgggggccccgagccccaggacaagggccccgacgggcuguccuucuacggcgaccgguggagcggggccgucgugcgccgggugcucuccggccccggcagcgcccgcauggagccccgcgagcagcgggucgaggcggccgggcuggagggcgccugccuggaggccgaggcgcagcagcgcacccuccuguggaaccagggguccacccugcccagccucauggacuccaaggccugccagagcuuccacgaggcccuggaggccugggccaagggcccgggggcggagcccuucuacauccgggccaaccugacgcuccccgagcgcgccgacccccacgcccugugcgugaaggcccaggagauccugcggcucguggacuccgcguacaagcgccggcaggagugguucugcacccgcgucgacccgcugacccugcgggaccucgaccgcggcaccgugcccaacuaccagcgggcccagcagcugcuggagguccaggagaagugccuccccagcucccgccaccggggcccccgcagcaaccugaagaagcgggcccuggaccagcuccgccuggugcggccgaagcccgugggggcccccgccggcgacagccccgaccagcugcuccuggagccgugcgcggagcccgagcgcucccugcggcccuacagccucguccgcccccugcugguguccgcccuccgcccggugguccugcugcccgagugccucgcgccccggcugauccgcaaccugcucgaccugcccagcucccggcuggacuuccaggugugcccggccgagagccucuccggggaggagcugugccccagcuccgcccccggcgccccgaaggcccagcccgccacgcccgggcugggcagccgcauccgggccauccaggaguccgugggcaagaagcacugccuccuggagcugggggcgcgcggcguccgggagcucgugcagaacgagaucuaccccaucgugauccacgucgaggugaccgagaagaacgugcgcgagguccgggggcugcugggccgcccgggguggcgggacagcgagcuccugcgccagugccggggcuccgagcagguccuguggggccuccccugcagcuggguccaggugcccgcccacgagugggggcacgccgaggagcuggccaagguggugcgcggccggauccugcaggagcaggcccgccucguguggguggagugcggguccagccggggcugccccuccagcuccgaggcguga

SEQ ID NO: 27701 - RNA, 3465 nt, Artificial Sequence
  derived and/or modified sequence opt1 from CARD11__Homo_sapiens__NP_115791
augcccggcgggggcccggagauggacgacuacauggagacccugaaggacgaggaggacgcccucugggagaacguggagugcaaccgccacaugcugagccgguacaucaaccccgccaagcugacccccuaccuccgccagugcaaggucaucgacgagcaggacgaggacgaggugcugaacgcgcccaugcugccguccaagaucaaccgggccgggcgccuccuggacauccugcacacgaagggccagcggggguacguggucuuccucgagagccuggaguucuacuaccccgagcuguacaagcucgugaccggcaaggagcccacccgccgguucuccaccaucguggucgaggagggccacgaggggcugacgcacuuccugaugaacgaggugaucaagcuccagcagcagaugaaggccaaggaccugcagcgcugcgagcugcucgcccggcugcgccagcuggaggacgagaagaagcagaugacccucacccggguggagcugcugaccuuccaggagcgcuacuacaagaugaaggaggagcgggacagcuacaacgacgagcucgucaaggugaaggacgacaacuacaaccuggccaugcgcuacgcgcagcuguccgaggagaagaacauggccgugaugcggagccgcgaccuccagcuggagaucgaccagcugaagcaccggcucaacaagauggaggaggagugcaagcuggagcgcaaccagucccugaagcucaagaacgacaucgagaaccggcccaagaaggagcagguccuggagcuggagcgcgagaacgagaugcucaagacgaagaaccaggagcugcagagcaucauccaggccggcaagcggucccugccggacagcgacaaggccauccucgacauccuggagcacgaccgcaaggaggcgcuggaggaccgccaggagcucgugaaccggaucuacaaccugcaggaggaggcccgccaggccgaggagcugcgggacaaguaccucgaggagaaggaggaccuggagcugaagugcuccacccucgggaaggacugcgagauguacaagcaccgcaugaacaccgugaugcugcagcuggaggaggucgagcgggagcgcgaccaggccuuccacagccgggacgaggcccagacccaguacucccagugccugaucgagaaggacaaguaccgcaagcagauccgggagcucgaggagaagaacgacgagaugcgcaucgagauggugcggcgcgaggcgugcaucgugaaccuggagagcaagcugcggcgccucuccaaggacagcaacaaccuggaccagucccugccccggaaccuccccgucacgaucaucagccaggacuucggcgacgccagcccccgcaccaacgggcaggaggccgacgacuccagcaccuccgaggagagcccggaggacuccaaguacuuccugcccuaccacccgccccagcggcgcaugaaccugaagggcauccagcuccagcgggccaagagccccaucucccugaagcgcaccagcgacuuccaggccaagggccacgaggaggaggggacggacgcgucccccagcuccugcggcagccugcccaucaccaacuccuucaccaagaugcagcccccgcgcagccgguccagcaucauguccaucaccgccgagccgcccgggaacgacagcaucgugcgccgguacaaggaggacgcgccccaccgcuccacgguggaggaggacaacgacagcggcggcuucgacgcccucgaccuggacgacgacucccacgagcgguacagcuucgggcccagcuccauccacagcuccagcuccagccaccaguccgagggccuggacgccuacgaccucgagcaggucaaccugauguuccgcaaguucagccuggagcggcccuuccgccccuccgugaccagcguggggcacguccggggccccgggccguccgugcagcacaccacccucaacggcgacagccugacgucccagcugacccuccugggcgggaacgcccgcggcagcuucguccacuccgugaagcccgggagccuggccgagaaggccggccuccgggaggggcaccagcugcugcuccuggagggcugcauccgcggcgagcggcaguccgugccccuggacacgugcaccaaggaggaggcccacuggaccauccagcgcugcagcgggccggucacccuccacuacaaggugaaccacgagggcuaccggaagcuggugaaggacauggaggacgggcugaucaccagcggcgacuccuucuacauccgccucaaccugaacaucagcucccagcuggacgccugcaccaugagccucaagugcgacgacgucgugcacgugcgggacacgauguaccaggaccgccacgaguggcugugcgcgcgggucgaccccuucaccgaccacgaccuggacauggggaccauccccuccuacagccgcgcccagcagcuccugcuggugaagcuccagcggcugaugcaccgcggcucccgcgaggagguggacggcacccaccacacgcugcgggcccuccgcaacacccugcagcccgaggaggcccugagcaccuccgacccgcgggucagcccccgccucucccgggcgagcuuccuguucgggcagcugcuccaguucgugucccgcagcgagaacaaguacaagcggaugaacuccaacgagcgcgugcggaucaucagcggcagcccccuggggucccuggcccgcuccagccucgacgccaccaagcugcugaccgagaagcaggaggagcucgaccccgagagcgagcugggcaagaaccugucccucaucccguacagccugguccgggccuucuacugcgagcgccggcgccccgugcuguucacgcccaccgugcucgccaagacccugguccagcggcugcucaacuccggcggggcgauggaguucaccaucugcaagagcgacaucgugacgcgcgacgaguuccugcggcgccagaagaccgagaccaucaucuacucccgggagaagaaccccaacgccuucgagugcaucgccccggccaacaucgaggccguggcggccaagaacaagcacugccugcucgaggccggcaucgggugcacccgcgaccugaucaagagcaacaucuaccccaucguccuguucauccgcgugugcgagaagaacaucaagcgguuccgcaagcuccugccccggcccgagacggaggaggaguuccugcgcgugugccggcucaaggagaaggagcuggaggcccugccgugccucuacgccaccgucgagcccgacauguggggcuccguggaggagcugcugcgcguggucaaggacaagaucggggaggagcagcggaagaccaucuggguggacgaggaccagcucuga

SEQ ID NO: 27702 - RNA, 2223 nt, Artificial Sequence
  derived and/or modified sequence opt1 from CARD14__Homo_sapiens__NP_001244899
augggcgagcugugccgccgggacagcgcccugaccgcccuggacgaggagacccugugggagaugauggagucccaccgccaccggaucgugcgcugcaucugccccagccggcucacgccguaccugcgccaggcgaagguccugugccagcucgacgaggaggaggugcugcacagcccccggcugaccaacagcgccaugcgcgccgggcaccuccuggaccugcucaagacccggggcaagaacggggccaucgccuuccuggagucccugaaguuccacaaccccgacguguacacccucgucacgggccugcagcccgacguggacuucagcaacuucuccgggcugauggagaccagcaagcucaccgagugccuggcgggcgccaucggcucccugcaggaggagcucaaccaggagaaggggcagaaggaggugcugcugcgccggugccagcagcuccaggagcaccugggccuggccgagacccgcgccgaggggcuccaccagcuggaggcggaccacagccggaugaagcgcgaggucuccgcccacuuccacgaggugcugcggcucaaggacgagaugcugagccugucccuccacuacagcaacgcccugcaggagaaggagcuggccgccucccgcugccggagccuccaggaggagcuguaccugcucaagcaggagcugcagcgcgcgaacaugguguccagcugcgagcuggagcuccaggagcagucccugcggacggccagcgaccaggagagcggcgacgaggagcugaaccgccucaaggaggagaacgagaagcugcggucccugaccuucagccucgccgagaaggacauccuggagcagucccuggacgaggcccgcgggagccgccaggagcuggucgagcggauccacucccuccgcgagcgggccguggcggccgagcgccagcgggagcaguacugggaggagaaggagcagacccugcugcaguuccagaaguccaagauggccugccagcucuaccgcgagaaggugaacgcccugcaggcccaggucugcgagcugcagaaggagcgggaccaggcguacuccgcccgcgacagcgcccagcgggagaucucccagagccucguggagaaggacucccugcgccgccagguguucgagcugaccgaccaggucugcgagcuccggacgcagcugcggcagcugcaggccgagccgcccggcgugcucaagcaggaggcccgcacccgggagcccugcccccgcgagaagcagcggcuggugcgcaugcacgcgaucugcccgcgggacgacagcgacugcucccuggucagcuccaccgagagccagcuccuguccgaccugagcgccaccuccagccgcgagcucguggacagcuuccgcuccagcucccccgccccgcccagccagcagucccuguacaagcggguggccgaggacuucggcgaggagcccuggagcuucuccagcugccuggagauccccgagggggaccccggcgcgcuccccggggccaaggccggcgacccgcaccuggacuacgagcugcucgacacggccgaccugccccagcuggaguccagccuccagcccgucucccccggccgccuggacgugagcgaguccggggugcugaugcggcgccggccggcccgccggauccucagccaggucaccaugcuggcguuccagggcgacgcccugcucgagcagaucuccgugaucgggggcaaccugaccgggaucuucauccaccgcgucacccccggcagcgccgccgaccagauggcccugcggcccggcacgcagaucgugaugguggacuacgaggcguccgagccccucuucaaggccguccuggaggacaccacccuggaggaggccguggggcuccugcgccggguggacggcuucugcugccugagcgucaaggugaacaccgacggguacaagcgccuccugcaggaccuggaggccaagguggccacgagcggcgacuccuucuacauccgggucaaccucgcgauggaggggcgcgccaagggcgagcuccaggugcacugcaacgaggugcugcacgucaccgacaccauguuccagggcugcgggugcuggcacgcccaccgggugaacagcuacaccaugaaggacacggccgcgcacggcaccaucccgaacuacucccgcuga

SEQ ID NO: 27703 - RNA, 594 nt, Artificial Sequence
  derived and/or modified sequence opt1 from CARD16__Homo_sapiens__NP_001017534
auggccgacaaggugcugaaggagaagcgcaagcuguucauccacagcaugggcgaggggaccaucaacggccuccuggacgagcuccugcagacccggguccugaaccaggaggagauggagaaggugaagcgcgagaacgccacggugauggacaagacccgggcgcucaucgacuccgucauccccaagggggcccaggccugccagaucugcaucaccuacaucugcgaggaggacagcuaccuggccgagacccugggccucuccgccgcgcugcaggccgugcaggacaacccggccaugcccacgugcagcucccccgaggggcgcaucaagcugugcuuccucgaggacgcccagcggaucuggaagcagaagcugcagcgcugccacgugcagaacaccaucaucaaguggagcgagcgguacaccuccggcagcuucgagaugcaguggcuguuccuccgcaccaacuucaucgagcgguucuggcgcaacauccugcugcucccccugcacaagggcucccuguacccgcggauccccgggcucggcaaggagcugcagacggggacccacaagcugagcuga

SEQ ID NO: 27704 - RNA, 3114 nt, Artificial Sequence
  derived and/or modified sequence opt1 from CARD6__Homo_sapiens__NP_115976
auggccaccgagagcacccccuccgagaucaucgagcgcgagcggaagaagcugcucgagauccugcagcacgacccggacagcauccuggacacgcucaccucccgccggcugaucagcgaggaggaguacgagacccuggagaacgugaccgaccuccugaagaagucccgcaagcugcucauccugguccagaagaagggcgaggccacgugccagcacuuccugaagugccucuucagcaccuucccccaguccgcggccaucugcgggcugcggcacgaggugcugaagcacgagaacaccgugccgccccagagcaugggcgccuccagcaacuccgaggacgccuucagccccgggaucaagcagcccgaggcccccgagaucaccgucuucuucuccgagaaggagcaccucgaccuggagacgagcgaguucuuccgcgacaagaagaccuccuaccgggagaccgcgcugagcgcccgcaagaacgagaaggaguacgacacccccgaggugacgcucuccuacagcguggagaaggucggcugcgaggugccggccaccaucaccuacaucaaggacgggcagcgguacgaggagcuggacgacucccuguaccucggcaaggaggaguaccugggcagcguggacacccccgaggacgccgaggcgacggucgaggaggagguguacgacgaccccgagcacgugggguacgacggcgaggaggacuucgagaacagcgagaccaccgaguucuccggggaggagcccagcuacgagggcuccgagaccagccugucccucgaggaggagcaggagaaguccaucgaggagcgcaagaaggucuucaaggacgugcugcugugccucaacauggaccggagccgcaaggugcugccggacuucgucaagcaguucagccuggaccgggggugcaaguggacgcccgagucccccggcgaccucgccuggaacuuccugaugaaggugcaggcccgcgacgugaccgcccgggacagcauccugucccacaagguccucgacgaggacagcaaggaggaccugcuggccggcguggagaaccucgagauccgcgacauccagaccaucaacccccuggacgugcugugcgcgaccaugcucugcuccgacagcucccugcagcggcaggucaugagcaacauguaccagugccaguucgcccugccgcuccugcugcccgacgccgagaacaacaaguccauccucaugcugggggccaugaaggacaucgugaagaagcagagcacgcaguucuccggcgggcccaccgaggacaccgagaaguuccugacccucaugaagaugcccgugaucagcuucguccgccugggcuacugcagcuucuccaagagccggauccugaacacgcugcucuccccggcccagcugaagcugcacaagaucuuccuccaccaggaccugccccugcucgugcugccccgccagaucagcgacggccuggucgagaucaccuggugcuuccccgacuccgacgaccggaaggagaacccguucuuccagaagcccguggcgcucgccaaccugcgcgggaaccuggagagcuucuggacccaguucggcuuccucauggagguguccagcgccgucuucuucuucaccgacugccugggggagaaggagugggaccugcucauguuccugggcgaggccgccaucgagcgcugcuacuucgugcuguccagccaggcgcgggaguccgaggaggcccagaucuuccagcgcauccucaaccugaagcccgcccagcuccucuucugggagcgcggggacgccggcgaccgccggaagaacauggagggccugcaggccgcgcugcaggaggugauguucagcuccugccuccgcugcgucagcguggaggacauggccgcccuggcccgggagcuggggauccagguggacgaggacuucgagaacacgcagcgcauccaggucuccagcggcgagaacauggcggggaccgccgagggcgaggggcagcagcggcacucccagcucaagagcagcuccaagagccaggcccugaugcccauccaggagccgggcacccagugcgagcugucccagaaccuccagaaccuguacggcacccccguguuccgccccgugcuggagaacagcuggcuguucccgacgcggaucgggggcaacuucaaccacgucucccugaaggccagcugggugauggggcgccccuucggcuccgagcagcggcccaagugguuccacccccugccguuccagaacgccggggcgcagggccgcggcaagagcuucgggauccaguccuuccacccccagaucuucuacagcggcgagcgguucaugaaguucucccgcguggcccgggggugccacagcaacggcaccuucggccgccucccccggcccaucugccagcacguccaggccugcccggagcgcccccagaugauggggacccuggagcgcucccgggccguggccagcaagaucggccacuccuacagccuggacucccagcccgcgcgcgccguggggaagcccuggccgcagcaggccugcacccgggucaccgagcucacggaggccaccggcaagcugauccgcaccagccacaucgggaagccccacccccaguccuuccagcccgccgcggccacccagaagcugcggccggccagccagcagggcgugcagaugaagacgcagggcggggccagcaaccccgcgcuccagaucggcucccaccccaugugcaagagcucccaguucaagagcgaccaguccaaccccagcaccgugaagcacucccagccgaagcccuuccacagcguccccucccagcccaagagcucccagaccaagagcugccagucccagccgagccagaccaagcccucccccugcaagagcacgcagccgaagcccucccagcccuggcccccgcagagcaagcccucccagccccggcccccgcagcccaagagcagcuccaccaaccccagccaggccaaggcccaccacuccaaggccgggcagaagcggggcgggaagcacuga

SEQ ID NO: 27705 - RNA, 1614 nt, Artificial Sequence
  derived and/or modified sequence opt1 from CARD8__Homo_sapiens__NP_001171829
auggagaagaaggagugccccgagaaguccagcagcuccgaggaggagcugccccgccgggacagcggcuccagccgcaacaucgacgccuccaagcucauccggcugcaggggagccgcaagcugcucguggacaacuccauccgggagcugcaguacaccaagaccggcaucuucuuccaggccgaggcgugcgucacgaacgacaccguguaccgcgagcugcccugcgugagcgagacccucugcgacaucucccacuucuuccaggaggacgacgagaccgaggccgagccccugcuguuccgggccguccccgagugccagcucagcgggggcgacaucccguccgugagcgaggagcaggaguccagcgaggggcaggacuccggcgacaucugcagcgaggagaaccagaucguguccagcuacgccagcaaggucugcuucgagaucgaggaggacuacaagaaccgccaguuccugggccccgaggggaacguggacguggagcugaucgacaaguccacgaaccgguacagcgucugguuccccaccgccggcugguaccucugguccgcgaccgggcugggcuuccuggugcgcgacgaggugaccgucacgaucgccuucgggagcuggucccagcaccucgcccuggaccugcagcaccacgagcaguggcucgugggcggcccccuguucgacgugaccgccgagccggaggaggcggucgccgagauccaccucccccacuucaucagccugcaggccggggagguggacguguccugguuccuggucgcccacuucaagaacgagggcauggugcuggagcaccccgcccggguggagcccuucuacgcgguccucgagagcccguccuucagccugauggggauccugcuccgcaucgccuccggcacccggcugagcauccccaucaccuccaacacgcugaucuacuaccacccccaccccgaggacaucaaguuccaccucuaccuggugccgagcgacgcccugcucaccaaggccaucgacgacgaggaggaccgcuuccacggcgugcggcugcagaccuccccgcccauggagccccugaacuucgggagcuccuacaucgucagcaacuccgccaaccucaaggugaugcccaaggagcugaagcugagcuaccgcagccccggcgagauccagcacuucuccaaguucuacgcggggcagaugaaggagcccauccagcucgagaucaccgagaagcggcacggcacgcuggucugggacaccgaggugaagcccguggaccugcagcucgucgccgccagcgccccgccgcccuucuccggggccgcguucgugaaggagaaccaccgccagcugcaggcccggaugggcgaccugaagggcgugcucgacgaccugcaggacaacgagguccugaccgagaacgagaaggagcucguggagcaggagaagacccgccagagcaagaacgaggcccugcuguccaugguggagaagaagggggaccuggcccucgacguccuguuccggagcaucuccgagcgcgaccccuaccuggugagcuaccuccgccagcagaaccuguga

SEQ ID NO: 27706 - RNA, 1611 nt, Artificial Sequence
  derived and/or modified sequence opt1 from CARD9__Homo_sapiens__NP_434700
augagcgacuacgagaacgacgacgagugcugguccgugcuggagggcuuccgcgugacccucaccagcgugaucgaccccucccggaucacgccguaccugcgccagugcaaggugcugaaccccgacgacgaggagcagguccucagcgaccccaaccuggugauccggaagcgcaagguggggguccugcucgacauccugcagcggaccggccacaagggguacguggccuuccuggagucccucgagcuguacuacccccagcuguacaagaaggugaccggcaaggagccggcccgcgucuucagcaugaucaucgacgcguccggggagagcggccucacccagcugcugaugacggaggugaugaagcuccagaagaaggugcaggaccugaccgcccugcucuccagcaaggacgacuucaucaaggagcugcgggucaaggacucccugcuccgcaagcaccaggagcgggugcagcgccugaaggaggagugcgaggccggcagccgggagcugaagcgcugcaaggaggagaacuacgaccucgccaugcggcuggcccaccaguccgaggagaagggggcggcccugaugcgcaaccgggaccuccagcuggagaucgaccagcugaagcacagccucaugaaggccgaggacgacugcaagguggagcgcaagcacacccugaagcugcggcacgccauggagcagcgccccucccaggagcuccugugggagcugcagcaggagaaggcgcuccugcaggcccggguccaggagcuggaggccagcgugcaggagggcaagcucgaccgcuccagccccuacauccaggugcuggaggaggacuggcggcaggcccugcgcgaccaccaggagcaggccaacaccaucuucucccuccgcaaggaccugcggcagggggaggcgcgccggcugcgcugcauggaggagaaggagauguucgagcuccagugccuggcccugcggaaggacagcaagauguacaaggaccgcaucgaggccauccuccugcagauggaggaggucgccaucgagcgggaccaggccaucgcgacgcgcgaggagcugcacgcccagcacgcccggggccugcaggagaaggacgcccuccgcaagcagguccgggagcugggggagaaggccgacgagcugcagcuccagguguuccagugcgaggcgcagcugcuggccguggagggccgccuccggcgccagcagcuggagacccuggugcucagcuccgaccuggaggacggcagcccccggcgcucccaggagcugagccucccgcaggaccuggaggacacccagcuguccgacaaggggugccucgccggcgggggcagccccaagcagcccuucgccgcccugcaccaggagcagguccugcggaacccccacgacgcgggccucuccagcggggagccgcccgagaaggagcgccggcgccugaaggaguccuucgagaacuaccgccggaagcgcgcccugcggaagaugcagaagggcuggcgccagggggaggaggaccgggagaacaccacgggcagcgacaacaccgacaccgagggguccuga

SEQ ID NO: 27707 - RNA, 2178 nt, Artificial Sequence
  derived and/or modified sequence opt1 from CARF__Homo_sapiens__NP_001098056
auggagcagagcaacgacucccugcgcgugaaccacaacgacggcgaggagagcaagaccuccgcccaggucuucgagcaccucaucugcauggacagccgggacuccagcuucgggcagaacgacucccccaccgugcugccgaucacgacccgcgaggccaacaacagccugaucucccagaacauccccggcccccucacccagacccagacgcugagcgcggagcaguuccaccugguggaccagaacgggcaggccauccaguacgagcuccagucccugggcgagagcaacgcccagaugaugaucgucgccucccccaccgagaacggccaggugcugcgggugaucccgcccacccagaccgggauggcccaggucaucaucccccagggccagcucguggacgugaacagcccccgcgacgucccggaggagaagcccuccaaccggaaccugcccacggugcgcguggacacccuggcggacaacaccagcaacuacauccuccacccccagaccuccuucccgcugcccaagaaguccgucacggggaugcuggaggagccccuccugggcccccugcagccgcucagcagcaacacccccaucugggccugccggcugcgcagcugcgagaagaucggggacuccuaccggggcuacugcgugagcgagaccgagcuggaguccgugcucaccuuccacaagcagcagacgcagagcgucugggggacccgccagucccccagccccgccaagccggccacccggcugauguggaagucccaguacgugcccuacgacggcauccccuucgugaacgcgggcagccgcgccgucgugauggagugccaguacgggccccggcgcaagggcuuccagcugaagaagguguccgagcaggagagccgguccugccagcucuacaaggcgaccugcccggcccgcaucuacaucaagaagguccagaaguuccccgaguaccgggugcccacggaccccaagaucgacaagaagaucauccgcauggagcaggagaaggccuucaacaugcugaagaagaaccugguggacgccgggggcguccuccggugguacgugcagcugccgacccagcaggcccaccaguaccacgagcuggagacccccugccucacccugagccccuccccguuccccgucagcucccuggaggaggaggagacggccgugcgcgacgagaacugcgcccuccccagccggcugcacccccagguggcccacaagauccaggagcuggucucccagggcaucgagcaggucuacgcggugcgcaagcagcuccgcaaguucguggagcgggagcuguucaagccggacgaggugcccgagcgccacaaccugagcuucuuccccaccgugaacgacaucaagaaccacauccacgagguccagaagucccuccggaacggggacaccguguacaacagcgagaucauccccgccacccugcaguggacgaccgacagcggcaacauccugaaggagaccaugaccgugacguucgccgaggggaacuccccgggcgagagcaucaccaccaaggucgagaccaaccagacgcgcgggucccucagccccgagcccacccaccuccuguccagccuguccagcuuccagcccaagaucuucacccagcugcagggccugcagcuccagccgcgguacaccucccccgacgagagccccgccgugguguccgucaacaaccagcccagcuccagcccguccggccugcuggacaccaucgggagcgccgugaugaacaacaacucccugcuccugggccagagccacagccugcagcgcgacacgugccucacccagaacaacuccaccgcgagcaccauggggaaccugcccgagcccgaccagaaccugguggccauggacgagcucgucgaggugggcgacguggaggacacggggaaccuggagggcaccguccaccggauccugcucggcgacgugcagaccauccccauccagaucaucgacaaccacuccgcccugaucgaggagaacccggagagcaccaucuccgugagccaggucaagcaggagcccaaggagcccgcccuguccauggaggccaagaagacgguggacuacaagaagcucagcgcgaccuga

SEQ ID NO: 27708 - RNA, 1044 nt, Artificial Sequence
  derived and/or modified sequence opt1 from CARKD__Homo_sapiens__NP_001229810
auggugacccgcgccggcgccgggaccgcggucgccggcgccgugguggucgcccugcucagcgccgcgcuggcccuguacgggcccccgcucgacgccgugcuggagcgggccuucucccugcgcaaggcgcacagcaucaaggacauggagaacacgcuccagcuggugcggaacaucaucccgccccuguccagcaccaagcacaagggccaggacgggcgcaucggcgucgugggcgggugccaggaguacaccggcgcccccuacuucgccgccaucuccgcccucaaggugggggcggaccugagccacgucuucugcgccuccgccgccgcccccgugaucaaggcguacagccccgagcugaucgugcaccccguccucgacucccccaacgccgugcacgagguggagaaguggcugccgcggcugcacgcccucgucgugggccccgggcugggccgcgacgacgcccugcuccggaacgugcagggcauccuggaggucagcaaggcccgcgacauccccguggugaucgacgcggacgggcuguggcucgucgcccagcagcccgcccugauccacggcuaccggaaggccgugcugaccccgaaccacguggaguucucccgccucuacgacgccguccugcgggggcccauggacagcgacgacucccacggcagcgugcugcgccucucccaggcgcugggcaacgucacgguggugcagaagggggagcgggacauccugagcaacggccagcagguccucgugugcucccaggaggggagcucccgccggugcggcgggcagggcgaccugcugagcggcagccucggggugcugguccacugggcccugcucgccggcccccagaagaccaacggguccagcccccugcugguggccgcguucggcgccugcucccucacccgccagugcaaccaccaggccuuccagaagcacgggcggagcaccacgaccuccgacaugaucgccgaggugggcgccgcguucagcaagcuguucgagaccuga

SEQ ID NO: 27709 - RNA, 1827 nt, Artificial Sequence
  derived and/or modified sequence opt1 from CARM1__Homo_sapiens__NP_954592
auggccgccgcggccgccgccgugggccccggggccggcggggcgggcagcgccguccccgggggcgccggccccugcgccaccguguccguguuccccggggcgcgccugcucaccaucggcgacgccaacggggagauccagcggcacgccgagcagcaggcccugcgccuggagguccgggccggccccgacagcgcggggaucgcccucuacucccacgaggacgugugcguguucaagugcagcgucucccgcgagacggagugcagccgggugggcaagcaguccuucaucaucacccugggcugcaacagcgugcugauccaguucgccaccccgaacgacuucugcuccuucuacaacauccucaagaccugccgcgggcacacgcuggagcggagcgucuucuccgagcgcaccgaggagagcuccgccgugcaguacuuccaguucuacggcuaccugagccagcagcagaacaugaugcaggacuacgugcggaccgggaccuaccagcgcgccauccuccagaaccacacggacuucaaggacaagaucguccuggacgugggcugcggcuccgggauccugagcuucuucgcggcccaggccggcgcccggaagaucuacgccguggaggcguccaccauggcccagcacgccgagguccucgucaagagcaacaaccugaccgaccgcaucguggugauccccgggaagguggaggaggugucccugcccgagcaggucgacaucaucaucagcgagcccaugggcuacaugcuguucaacgagcggaugcucgagagcuaccugcacgccaagaaguaccucaagccguccgggaacauguuccccaccaucggcgacgugcaccuggcccccuucacggacgagcagcuguacauggagcaguucaccaaggcgaacuucugguaccagcccagcuuccacggcguggaccucuccgcccugcgcggggccgccgucgacgaguacuuccggcagccgguggucgacaccuucgacauccgcauccugauggccaagagcgugaaguacaccgugaacuuccucgaggcgaaggagggcgaccugcaccggaucgagauccccuucaaguuccacaugcugcacuccgggcucguccacggccuggccuucugguucgacguggccuucaucgggagcaucaugacgguguggcuguccaccgcccccaccgagccccucacccacugguaccagguccgcugccuguuccagagcccgcuguucgcgaaggccggcgacacgcucuccgggaccugccugcugaucgccaacaagcggcagagcuacgacaucuccaucguggcccagguggaccagaccggcagcaaguccagcaaccuccuggaccugaagaaccccuucuuccgcuacaccggcacgacccccuccccgccgcccgggagccacuacaccucccccagcgagaacauguggaacaccggcuccacguacaaccucagcagcgggauggccgucgcgggcaugcccaccgccuacgaccuguccagcgugaucgccuccggcagcuccguggggcacaacaaccugaucccgcucgccaacaccggcaucgucaaccacacccacagccggaugggguccaucaugagcacgggcaucgugcagggcuccagcggggcccagggcuccgggggcgggagcaccuccgcgcacuacgccgugaacagccaguucaccaugggcggccccgccaucuccauggccagccccauguccauccccaccaacacgaugcacuacgggagcuga

SEQ ID NO: 27710 - RNA, 2496 nt, Artificial Sequence
  derived and/or modified sequence opt1 from CARS__Homo_sapiens__NP_001014437
auggccgacagcuccggccagcaggcccccgacuaccgcagcauccuguccaucagcgacgaggcggcccgggcccaggcccucaacgagcaccuguccacccgcagcuacgugcagggguacucccugagccaggccgacgucgacgcguuccggcagcucuccgccccgcccgccgacccccagcuguuccacguggcccgcugguuccggcacaucgaggcgcugcucggcagccccugcgggaagggccagccgugccgccugcaggccuccaaggggcggcgcgugcagccccaguggagcccgcccgccggcacccagcccugccggcugcaccucuacaacucccugacgcgcaacaaggaggucuucaucccccaggacggcaagaaggugaccugguacugcugcgggcccaccguguacgacgccagccacaugggccacgcccgguccuacaucagcuucgacauccugcgccggguccucaaggacuacuucaaguucgacguguucuacugcaugaacaucaccgacaucgacgacaagaucaucaagcgcgcgcggcagaaccaccuguucgagcaguaccgcgagaagcggcccgaggccgcccagcugcucgaggacgugcaggccgcccugaagccguucuccgucaagcugaacgagacgaccgaccccgacaagaagcagaugcucgagcgcauccagcacgcggugcagcuggccaccgagccccuggagaaggccgugcagagccggcucaccggggaggaggucaacuccugcguggaggugcugcuggaggaggccaaggaccuccugagcgacuggcuggacagcacgcucggcugcgacgucaccgacaacuccaucuucagcaagcugcccaaguucugggagggggacuuccaccgcgacauggaggcccugaacgugcucccgcccgacgugcugacccgggucuccgaguacgugcccgagaucgugaacuucguccagaagaucguggacaacggcuacggcuacgugagcaacggguccgucuacuucgacaccgcgaaguucgccagcuccgagaagcacagcuacggcaagcuggugcccgaggccgucggggaccagaaggcccuccaggagggcgagggcgaccuguccaucagcgccgaccgccuguccgagaagcgcagcccgaacgacuucgcgcucuggaaggccuccaagcccggggagcccagcuggcccugcccguggggcaaggggcggcccggcuggcacaucgagugcuccgccauggccgggacgcugcugggcgcgagcauggacauccacggcgggggcuucgaccuccgcuucccccaccacgacaacgagcuggcccaguccgaggccuacuucgagaacgacugcugggugcgguacuuccugcacaccgggcaccucaccaucgccggcugcaagaugagcaagucccugaagaacuucaucaccaucaaggacgcccugaagaagcacagcgcgcgccagcuccggcuggccuuccugaugcacagcuggaaggacacgcucgacuacuccagcaacaccauggaguccgcccugcaguacgagaaguuccugaacgaguucuuccugaacgugaaggacauccuccgcgcccccgucgacaucaccgggcaguucgagaaguggggcgaggaggaggccgagcugaacaagaacuucuacgacaagaagaccgcgauccacaaggcccugugcgacaacguggacacgcggaccgugauggaggagaugcgcgcccucgucagccagugcaaccuguacauggccgcccggaaggcggugcgcaagcggccgaaccaggcccugcucgagaacaucgcccuguaccugacccacaugcucaagaucuucggcgccguggaggaggacuccagccugggguuccccgucggcgggcccggcaccucccugagccucgaggcgacggugaugccguaccuccaggugcuguccgaguuccgcgaggggguccggaagaucgcccgcgagcagaaggugcccgagauccugcagcugagcgacgcccugcgggacaacauccuccccgagcugggcgugcgcuucgaggaccacgagggccugcccaccgucgugaagcucguggaccggaacacccugcugaaggagcgcgaggagaagcggcgcgucgaggaggagaagcgcaagaagaaggaggaggccgcccggcgcaagcaggagcaggaggcggccaagcucgccaagaugaagaucccgcccuccgagauguuccugagcgagaccgacaaguacuccaaguucgacgagaacgggcugcccacgcacgacauggagggcaaggagcucagcaaggggcaggccaagaagcugaagaagcuguucgaggcccaggagaagcucuacaaggaguaccugcagauggcgcagaacggcuccuuccaguga

SEQ ID NO: 27711 - RNA, 351 nt, Artificial Sequence
  derived and/or modified sequence opt1 from CARTPT__Homo_sapiens__NP_004282
auggagagcucccgcgugcggcugcucccccugcugggcgccgcccuccugcugaugcucccgcugcuggggacccgcgcgcaggaggacgccgagcuccagccccgggcccuggacaucuacagcgccgucgacgacgccucccacgagaaggagcugaucgaggcgcuccaggaggugcugaagaagcucaagagcaagcgcgugcccaucuacgagaagaaguacggccagguccccaugugcgacgccggggagcagugcgccgugcggaagggcgcccgcaucgggaagcugugcgacugcccgcggggcaccuccugcaacagcuuccugcugaagugccucuga

SEQ ID NO: 27712 - RNA, 2073 nt, Artificial Sequence
  derived and/or modified sequence opt1 from CASC1__Homo_sapiens__NP_001076441
augcgccagaccggcgggggcgccaccacggacagcgccucccccgugcugaacaacgucaucaagagccaguccuacuucaccgcgaagcggguggggcucggcaacaacagcuaccugggggugggccgcccguccagccagcaguggcugucccuccccggccccgggggccaggggcccaaggccaagaaguccggcagcaagaagaagaaggucaccaaggccgagcggcugaagcugcuccaggaggaggaggagcgccggcugaaggaggaggaggaggcccgccugaaguacgagaaggaggagauggagcggcucgagauccagcgcaucgagaaggagaaguggcaccggcuggaggccaaggaccuggagcgccggaacgaggagcucgaggagcuguaccugcucgagcgcugcuucccggaggcggagaagcugaagcaggagaccaagcugcucagccaguggaagcacuacauccagugcgacgggucccccgaccccagcguggcccaggagaugaacacguucaucucccuguggaaggagaagaccaacgagaccuucgaggaggugaucgagaaguccaaggucgugcugaaccucaucgagaagcugaaguucauccugcucgagacgcccccgugcgaccugcaggacaagaacaucauccaguaccaggagagcauccugcagcuccaggagcugcugcaccucaaguucggcguggccaccgagauccugcugaagcaggccagcacccucgcggaccuggacuccggcaacauggagaaggucaucaaggacgagaacgugacccuguacgugugggccaaccucaagaagaacccccggcaccgcagcguccgguucuccgagacccagaucggguucgagaucccccgcauccuggccacgagcgacaucgccgugcggcugcuccacacccacuacgaccacgugagcgcccugcaccccgucuccaccccgagcaaggaguacaccuccgcggugacggagcuggugaaggacgacgucaagaacguggagaaggccaucagcaaggagguggaggaggaguccaagcagcaggagcgcggcagccaccucauccaggaggaggagaucaaggucgaggaggagcagggggacaucgaggugaagauguccagcgccgaggaggaguccgaggccaucaagugcgagcgggagaugaaggugcugagcgagaccgucuccgccgcgcagcugcuccugguggagaacagcuccgagaagcccgacuucuucgaggacaacgucguggaccugugccaguucaccacccucggcggcguguaccaccuggacauccuggagcugccgccccagugcaagcccgucaagggguggaugaucguggagauccucaaggagggccugcagaaguacacguacccgcccgagaccaccgaggaguucgagaccgagaacgccuucccgcccaucgaggugacgcuggagguccacgagaacgugaucuucuucgaggaccccguggucgugcgcugggacgccgaggggaagcacuggcggaccgacggcaucagcaacguguccuacaagcccaaggagcgccucgucaccuucagccuggacaccuucgggcccgugacgcugauccaggacgcccacaucaacaugcccuaccaguccugggagcuccgcccccuggacgugaacaagguccugcucaccgugaccaccguguucacggagauccagauccagaucaaggagaaccugugcaugcugagcuccaucaagcucaaggacaagaagcacaucagcauccuggagggcaccuggaugacccccauccccuucaucaucgcccugaaggaggcgggccucaacaucuucccgacccggcacagccacuucuacgucaucaucaacaacaaggugccccugguggaggucaaggccuaccgccagauggcccugcucuccagcgccuucgccuucgggugguccaaguggaaccugcugugcaacagcacgaaggugguguucaagugguga

SEQ ID NO: 27713 - RNA, 2112 nt, Artificial Sequence
  derived and/or modified sequence opt1 from CASC3__Homo_sapiens__XP_005257220
auggccgaccgccggcgccagcgggccagccaggacaccgaggacgaggaguccggcgcgagcggguccgacagcggcggguccccccugcgcggcgggggcagcugcuccggcagcgccgggggcgggggcuccgggagccucccgucccagcggggcggccgcaccggggcccugcaccugcggcgcguggagagcggcggggccaaguccgccgaggagagcgagugcgaguccgaggacggcaucgagggcgacgcgguccucagcgacuacgaguccgccgaggacagcgagggggaggagggcgaguacuccgaggaggagaacagcaagguggagcugaagagcgaggccaacgacgccgugaacuccagcacgaaggaggagaagggggaggagaagcccgacaccaaguccaccgucaccggcgagcggcagagcggggacggccaggaguccacggagcccguggagaacaaggugggcaagaaggggcccaagcaccuggacgacgacgaggaccgcaagaacccggcguacaucccccggaagggccucuucuucgagcacgaccugcgcgggcagacccaggaggaggagguccggcccaagggccgccagcggaagcuguggaaggacgaggggcgcugggagcacgacaaguuccgggaggacgagcaggcccccaagagccgccaggagcucaucgcccuguacggcuacgacauccgguccgcccacaacccggacgacaucaagccccgccggauccgcaagccccgcuacggcagccccccgcagcgggaccccaacuggaacggggagcgccugaacaagucccaccggcaccagggccucgggggcacccugcccccccgcaccuucaucaaccggaacgccgcggggacgggccgcaugagcgccccgcggaacuacucccgcagcggcggguucaaggagggccgggccggguuccgccccguggaggccggcggccagcacgggggccgguccggggagaccgugaagcacgagaucagcuaccgcucccggcgccuggagcagaccagcguccgggaccccucccccgaggccgacgcgccggugcucggcagccccgagaaggaggaggccgccuccgagccccccgccgccgcgccggacgccgcccccccccccccggaccgccccaucgagaagaagagcuacagccgggcccgccggacccgcacgaaggugggggacgccgucaagcuggcggaggaggugcccccgccccccgagggccugauccccgccccgcccgugcccgagaccacccccaccccgcccacgaagaccggcaccugggaggcccccgucgacuccagcaccuccgggcucgagcaggacguggcccagcugaacaucgcggagcagaacuggagccccggccagccguccuuccugcagccccgcgagcuccgggggaugcccaaccacauccacaugggcgccgggcccccgccccaguucaaccgcauggaggagaugggcgugcagggcgggcgggccaagcgcuacagcucccagcggcagcgccccguccccgagccgcccgccccccccgugcacaucagcaucauggagggccacuacuacgacccgcugcaguuccaggggcccaucuacacgcacggcgacucccccgccccgcugcccccccaggggaugcucgugcagcccggcaugaaccugccgcaccccggccugcacccccaccagacccccgcgccgcuccccaaccccgggcuguaccccccgcccgucagcaugucccccggccagcccccgccccagcagcugcucgcccccaccuacuucagcgcccccggggugaugaacuucggcaacccguccuaccccuacgcccccggggcccugcccccgcccccccccccgcaccuguaccccaacacccaggcgcccagccagguguacggcggcgucacguacuacaacccggcccagcagcaggugcagcccaagcccucccccccgcggcgcaccccccagcccgucaccaucaagcccccgccccccgagguggugagccggggguccagcuga

SEQ ID NO: 27714 - RNA, 1311 nt, Artificial Sequence
  derived and/or modified sequence opt1 from CASC4__Homo_sapiens__NP_612432
auggugggcuucggggccaaccgccgggccggccgccugcccagccucguccugguggugcugcucgucgugaucgugguccuggcguucaacuacugguccaucagcucccggcacgugcugcuccaggaggagguggccgagcugcaggggcagguccagcgcaccgagguggcccggggccgccuggagaagcggaacagcgaccuccugcugcucguggacacccacaagaagcagaucgaccagaaggaggccgacuacgggcgccuguccagccggcugcaggcccgcgagggccucggcaagcggugcgaggacgacaaggucaagcugcagaacaacaucuccuaccagauggcggacauccaccaccugaaggagcagcucgccgagcugcgccaggaguuccugcggcaggaggaccagcuccaggacuaccgcaagaacaacacguaccuggugaagcggcuggaguacgagagcuuccagugcgggcagcagaugaaggagcuccgcgcccagcacgaggagaacaucaagaagcuggccgaccaguuccuggaggagcagaagcaggagacccagaagauccaguccaacgacggcaaggagcucgacaucaacaaccagguggucccgaagaacauccccaagguggcggagaacguggccgacaagaacgaggagcccagcuccaaccacaucccccacgggaaggagcagaucaagcggggcggggacgccggcaugccgggcaucgaggagaacgaccuggccaaggucgacgaccugccgcccgcccuccgcaagccgcccaucagcgugucccagcacgagagccaccaggcgaucucccaccuccccaccgggcagccccugagccccaacaugccgcccgacucccacaucaaccacaacggcaaccccgggaccagcaagcagaaccccuccagcccccugcagcggcugauccccggcagcaaccuggacuccgagccccgcauccagacggacauccucaagcaggccaccaaggaccgggugagcgacuuccacaagcugaagcagucccgcuucuucgacgagaacgagagccccgucgacccgcagcacggcuccaagcuggccgacuacaacggggacgacggcaacgugggggaguacgaggccgacaagcaggccgagcucgcguacaacgaggaggaggacggcgacgggggcgaggaggacgugcaggacgacgaggagcgcgagcugcagauggaccccgccgacuacggcaagcagcacuucaacgacguccuguga

SEQ ID NO: 27715 - RNA, 6951 nt, Artificial Sequence
  derived and/or modified sequence opt1 from CASC5__Homo_sapiens__NP_653091
auggacggcgugagcuccgaggccaacgaggagaacgacaacaucgagcgccccguccggcgccggcacagcuccauccugaagccgccccgcagcccccuccaggaccugcgggggggcaacgagcgcgugcaggaguccaacgcccugcggaacaagaagaacagccgccggguguccuucgcggacaccaucaaggucuuccagaccgagagccacaugaagaucgugcgcaaguccgagauggaggagacggagaccggggagaaccuccugcugauccagaacaagaagcucgaggacaacuacugcgagaucaccggcaugaacacccugcugagcgcccccauccacacgcagaugcagcagaaggaguucuccaucaucgagcacacccgggagcgcaagcacgccaacgaccagaccgugaucuucagcgacgagaaccagauggaccucaccuccagccacacggucaugaucaccaaggggcugcuggacaacccgaucuccgagaagagcaccaagaucgacaccacguccuuccucgccaaccugaagcugcacaccgaggacagccggaugaagaaggaggugaacuucuccguggaccagaacaccagcagcgagaacaagaucgacuucaacgacuucaucaagcgccucaagaccggcaagugcuccgccuuccccgacguccccgacaaggagaacuucgagauccccaucuacagcaaggagccgaacuccgcgagcuccacgcaccagaugcacgugagccugaaggaggacgagaacaacuccaacaucacccggcuguuccgcgagaaggacgacggcaugaacuucacccagugccacaccgccaacauccagacgcucauccccaccagcuccgagaccaacagccgggaguccaaggggaacgacaucaccaucuacggcaacgacuucauggaccugacguucaaccacacccugcagauccuccccgccaccgggaacuucagcgagaucgagaaccagacccagaacgccauggacgugacgaccggcuacgggaccaaggcguccggcaacaagaccgucuucaagagcaagcagaacacggccuuccaggaccuguccaucaacagcgccgacaagauccacaucacccgcucccacaucaugggcgccgagacccacaucgugagccagaccugcaaccaggacgcccggauccuggcgaugacgcccgaguccaucuacagcaacccgagcauccaggggugcaagaccguguucuacuccagcugcaacgacgccauggagaugaccaagugccucuccaacaugcgcgaggagaagaaccugcugaagcacgacagcaacuacgccaagauguacugcaaccccgacgccauguccagccucaccgagaagaccaucuacuccggcgaggagaacauggacaucacgaagagccacaccgucgccaucgacaaccagaucuucaagcaggaccaguccaacgugcagaucgcggccgcccccacccccgagaaggagaugaugcugcagaaccugaugaccacgagcgaggacgggaagaugaacgugaacugcaacuccgucccgcacgugagcaaggagcggauccagcagucccucagcaacccccuguccaucagccugaccgaccgcaagaccgagcuccuguccggcgagaacauggaccugaccgagagccacacgagcaaccucggcucccaggugccccuggccgccuacaaccuggcgcccgagagcaccuccgagagccacucccagagcaaguccagcuccgacgagugcgaggagaucaccaagagccgcaacgagccguuccagcgguccgacaucaucgccaagaacagccucaccgacacguggaacaaggacaaggacuggguccugaagauccugcccuaccucgacaaggacuccccccagagcgccgacugcaaccaggagaucgccaccucccacaacaucguguacugcgggggcgugcuggacaagcagaucaccaaccgcaacaccgucagcugggagcagucccuguucagcacgaccaagccccucuucuccagcgggcaguucagcaugaagaaccacgacaccgccaucuccagccacaccgugaaguccguccugggccagaacagcaagcuggcggagccgcuccggaagucccugagcaaccccacgcccgacuacugccacgacaagaugaucaucugcuccgaggaggagcagaacauggaccugaccaagagccacaccguggugaucggguucggccccuccgagcugcaggagcucggcaagaccaaccuggagcacacgaccgggcagcugaccaccaugaaccgccagaucgccgucaagguggagaagugcggcaagagcccgaucgagaaguccggggugcucaagagcaacugcaucauggacguccuggaggacgaguccgugcagaagcccaaguuccccaaggagaagcagaacgugaagaucuggggccggaagagcgucgggggcccgaagaucgacaagacgaucguguucuccgaggacgacaagaacgacauggacaucaccaagagcuacaccaucgagaucaaccaccgcccccugcucgagaagcgggacugccaccuggugccccuggccggcaccuccgagacgauccucuacaccugccgccaggacgacauggagaucacccggagccacaccacggcccuggagugcaagaccgucucccccgacgagaucaccacccgcccgauggacaagaccgugguguucgucgacaaccacguggagcuggagaugacggagagccacaccguguucaucgacuaccaggagaaggagcggaccgaccgccccaacuucgagcucagccagcggaagucccuggggacccccacggucaucugcacccccaccgaggagagcguguucuucccgggcaacggggaguccgaccgccugguggcgaacgacagccagcucaccccccuggaggagugguccaacaaccggggccccgucgagguggccgacaacauggagcugagcaaguccgccacgugcaagaacaucaaggacgugcagagccccggguuccucaacgagccgcuguccagcaagucccagcgccggaagagccugaagcucaagaacgacaagaccaucgucuucuccgagaaccacaagaacgacauggacaucacccagagcugcaugguggagaucgacaacgaguccgcccuggaggacaaggaggacuuccaccuggccggcgcgagcaagaccauccucuacuccugcggccaggacgacauggagaucacgcgcagccacaccaccgcccuggagugcaagacccugcuccccaacgagaucgccauccggcccauggacaagacggugcuguucaccgacaacuacuccgaccuggaggucaccgacagccacaccguguucaucgacugccaggccacggagaagauccucgaggagaaccccaaguucgggaucggcaaggggaagaaccugggcgugagcuucccgaaggacaacuccugcguccaggagaucgccgagaagcaggcgcuggccgugggcaacaagaucgugcuccacaccgagcagaagcagcagcuguucgccgccaccaaccgcaccacgaacgagaucaucaaguuccacagcgccgcgauggacgagaaggucaucgggaaggugguggaccaggccugcacccuggagaaggcccaggucgaguccugccagcucaacaaccgcgaccggcgcaacguggacuucaccagcucccacgccaccgcggugugcggcagcuccgacaacuacagcugccugcccaacgucaucuccugcacggacaaccuggaggggagcgccaugcuccugugcgacaaggacgaggagaaggccaacuacugccccgugcagaacgaccuggccuacgccaacgacuucgcguccgaguacuaccucgagagcgagggccagccccuguccgccccgugcccccugcucgagaaggaggaggugauccagaccagcaccaaggggcagcuggacugcgucaucacccugcacaaggaccaggaccucaucaaggacccccggaaccugcuggccaaccagacgcucguguacucccaggaccugggcgagaugaccaagcugaacagcaagcgcguguccuucaagcuccccaaggaccagaugaaggucuacguggacgacaucuacgugaucccgcagccccacuucagcaccgaccagcccccgcugcccaagaagggccaguccagcaucaacaaggaggaggucauccugagcaaggccgggaacaagucccucaacaucaucgagaacagcuccgcccccaucugcgagaacaagcccaagauccugaacagcgaggagugguucgcggccgccugcaagaaggagcugaaggagaacauccagaccacgaacuacaacaccgcccucgacuuccacuccaacagcgacgugaccaagcaggugauccagacccacgucaacgccggcgaggcgccggaccccgugaucaccuccaacguccccugcuuccacagcaucaagcccaaccugaacaaccugaacgggaagacgggcgaguuccucgccuuccagaccgugcaccugccgccccugcccgagcagcuccuggagcuggggaacaaggcccacaacgacaugcacaucgugcaggccaccgagauccacaacaucaacaucaucuccagcaacgcgaaggacucccgggacgaggagaacaagaagagccacaacggcgccgagaccacgucccuccccccgaagaccgucuucaaggacaaggugcgccggugcagccugggcaucuuccugccccgccuccccaacaagcggaacugcuccgugaccgggaucgacgaccuggagcagauccccgccgacaccacggacaucaaccaccuggagacccagccggucagcuccaaggacagcggcaucggguccguggccggcaagcucaaccugagccccagccaguacaucaacgaggagaaccugcccguguaccccgacgagaucaacuccagcgacuccaucaacaucgagaccgaggagaaggcccucaucgagaccuaccagaaggagaucagcccguacgagaacaagauggggaagacgugcaacucccagaagcgcaccuggguccaggaggaggaggacauccacaaggagaagaagauccggaagaacgagaucaaguucagcgacaccacccaggaccgcgagaucuucgaccaccacacggaggaggacaucgacaaguccgcgaacagcgugcugaucaagaaccugucccggacccccagcuccugcagcuccagccucgacuccaucaaggccgacggcaccagccuggacuucuccaccuaccgcagcagccagauggagucccaguuccugcgggacacgaucugcgaggagagccuccgcgagaagcugcaggacggccggaucaccauccgcgaguucuucauccugcuccaggugcacauccugauccagaagccccggcaguccaaccugcccgggaacuucaccgucaacaccccgcccacgcccgaggaccucaugcugagccaguacguguaccgccccaagauccagaucuaccgggaggacugcgaggcccgccgccagaagaucgaggagcugaagcucuccgccagcaaccaggacaagcugcugguggacaucaacaagaaccugugggagaagaugcggcacugcuccgacaaggagcucaaggccuucggcaucuaccugaacaagaucaagagcugcuucaccaagaugaccaaggucuucacccaccaggggaagguggcgcuguacggcaagcucgugcaguccgcccagaacgagcgcgagaagcugcagaucaagaucgacgagauggacaagauccugaagaagaucgacaacugccucacggagauggagaccgagaccaagaaccuggaggacgaggagaagaacaacccggucgaggagugggacagcgagaugcgggccgccgagaaggagcuggagcagcucaagaccgaggaggaggagcugcagcgcaaccugcucgagcuggaggugcagaaggagcagacgcuggcccagaucgacuucaugcagaagcagcggaaccgcaccgaggagcuccuggaccagcugucccucagcgagugggacguggucgagugguccgacgaccaggcgguguucaccuucguguacgacaccauccagcugacgaucaccuucgaggagagcgucgugggguuccccuuccuggacaagcgguaccgcaagaucguggacgucaacuuccagucccuccuggacgaggaccaggcccccccgagcucccugcucgugcacaagcugaucuuccaguacguggaggagaaggagagcuggaagaagaccugcaccacgcagcaccagcugcccaagaugcucgaggaguucucccuggucgugcaccacugccggcugcucggcgaggagaucgaguaccugaagcgcuggggccccaacuacaaccugaugaacaucgacaucaacaacaacgagcuccggcugcuguucagcagcuccgccgccuucgccaaguucgagaucacccucuuccugagcgcguacuaccccuccgugccgcugcccagcaccauccagaaccacgucgggaacaccucccaggacgacaucgccaccauccucagcaaggugccccuggagaacaacuaccugaagaacguggucaagcagaucuaccaggaccucuuccaggacugccacuucuaccacuga

SEQ ID NO: 27716 - RNA, 2394 nt, Artificial Sequence
  derived and/or modified sequence opt1 from CASD1__Homo_sapiens__NP_075051
auggccgcccuggcguacaaccucggcaagcgcgagaucaaccacuacuucagcgugcgguccgccaagguccuggcccugguggccgugcuccugcuggccgcgugccaccucgccagccgccgguaccgcgggaacgacuccugcgaguaccugcugagcuccggccgguuccucggggagaaggucuggcagccccacagcugcaugaugcacaaguacaagaucuccgaggccaagaacugccugguggacaagcacaucgccuucaucggcgacagccgcauccggcagcuguucuacuccuucgugaagaucaucaacccgcaguucaaggaggaggggaacaagcacgagaacauccccuucgaggacaagaccgcgagcgucaagguggacuuccucuggcaccccgaggugaacggcuccaugaagcagugcaucaaggucuggaccgaggacagcaucgccaagccccacgugaucguggccggcgccgccacgugguccaucaagauccacaacgggagcuccgaggcgcugagccaguacaagaugaacaucaccuccaucgccccgcugcucgagaagcuggccaagaccagcgacgucuacugggugcugcaggaccccguguacgaggaccuccuguccgagaaccgcaagaugaucaccaacgagaagaucgacgccuacaacgaggccgcggucagcauccugaacagcuccacgcggaacagcaaguccaacgugaagauguucagcguguccaagcucaucgcccaggagaccaucauggagagccuggacggccugcaccuccccgaguccagccgcgagaccaccgccaugauccugaugaacgucuacugcaacaagauccugaagcccguggacggguccugcugccagccgcggccgcccgugacgcucauccagaagcuggccgccugcuucuucacccugagcaucaucggcuaccucaucuucuacaucauccaccgcaacgcgcaccggaagaacaagcccugcaccgaccuggaguccggggaggagaagaagaacaucaucaacacccccgucagcucccuggagauccuccugcagagcuucugcaagcugggccucaucauggccuacuucuacaugugcgaccgcgccaaccuguucaugaaggagaacaaguucuacacgcacuccagcuucuucauccccaucaucuacauccuggugcucggcguguucuacaacgagaacaccaaggagaccaagguccugaaccgggagcagaccgacgaguggaagggguggaugcagcuggugauccucaucuaccacaucuccggcgccagcacguuccugcccgucuacaugcacauccgcgugcugguggccgcguaccucuuccagaccggguacggccacuucuccuacuucuggaucaagggcgacuucgggaucuaccgggucugccaggugcuguuccgccugaacuuccucguggucgugcugugcaucgugauggaccggcccuaccaguucuacuacuucgucccgcuggugaccgugugguucauggucaucuacgugacccuggcccucuggccccagaucauccagaagaaggccaacggcaacugcuucuggcacuucgggcugcugcucaagcugggcuuccugcuccuguucaucugcuuccuggccuacagccagggggcguucgagaagaucuucagccucuggccccuguccaagugcuucgagcugaagggcaacguguacgaguggugguuccgcuggcggcucgaccgcuacgucguguuccacggcaugcuguucgccuucaucuaccuggcccuccagaagcgccagauccugagcgaggggaagggcgagccccuguucuccaacaagaucagcaacuuccuccuguucaucuccguggucagcuuccugacguacuccaucugggccagcuccugcaagaacaaggccgagugcaacgagcuccacccgagcguguccgugguccagauccuggcguucauccugauccggaacauccccggguacgcccgcagcguguacuccagcuucuucgccugguucggcaagaucucccucgagcuguucaucugccaguaccacaucuggcuggccgccgacacccgggggauccucgugcugauccccggcaaccccaugcugaacaucaucgucagcaccuucaucuucgugugcguggcgcacgagaucucccagaucaccaacgaccucgcccagaucaucaucccgaaggacaacagcagccugcugaagcgccucgccugcaucgccgccuucuucugcggccugcugauccucuccagcauccaggacaaguccaagcacuga

SEQ ID NO: 27717 - RNA, 2697 nt, Artificial Sequence
  derived and/or modified sequence opt1 from CASK__Homo_sapiens__NP_001119526
auggccgacgacgacgugcuguucgaggacgucuacgagcucugcgaggugaucggcaaggggcccuucagcgugguccgccggugcaucaaccgcgagaccggccagcaguucgccgugaagaucguggacgucgccaaguucaccuccagcccggggcuguccacggaggaccugaagcgggaggccagcaucugccacaugcucaagcacccccacaucguggagcugcuggagaccuacuccagcgacggcaugcucuacaugguguucgaguucauggacggggccgaccugugcuucgagaucgucaagcgcgccgacgccggcuucguguacuccgaggcgguggccagccacuacaugcggcagauccuggaggcccuccgcuacugccacgacaacaacaucauccaccgggacgucaagccccacugcgugcugcuggccuccaaggagaacagcgcgcccgugaagcucggcggguucggcgucgccauccagcugggggaguccggccugguggccgggggccgcgugggcaccccgcacuucauggcccccgaggucgugaagcgggagcccuacgggaagcccguggacgucuggggcugcggggugauccucuucauccugcugagcggcugccucccguucuacggcaccaaggagcgccuguucgaggggaucaucaagggcaaguacaagaugaacccccggcaguggucccacaucagcgaguccgccaaggaccuggugcgccggaugcucaugcuggaccccgcggagcgcaucacggucuacgaggcccugaaccaccccuggcucaaggagcgggaccgcuacgccuacaagauccaccucccggagaccguggagcagcugcggaaguucaacgcccgccggaagcugaagggggccguccuggcggccgugagcucccacaaguucaacagcuucuacggcgacccgcccgaggagcugcccgacuucuccgaggaccccaccagcagcgggcuccuggccgccgagcgcgccgugucccagguccuggacagccucgaggagauccacgcgcugaccgacugcuccgagaaggaccuggacuuccuccacagcguguuccaggaccagcaccuccacacgcugcuggaccuguacgacaagaucaacaccaaguccagcccccagauccggaacccgcccuccgacgccgugcagcgcgccaaggagguccuggaggagaucagcugcuaccccgagaacaacgacgccaaggagcucaagcgcauccugacccagccccacuucauggcccugcuccagacccacgacgugguggcgcacgaggucuacuccgacgaggcccugcgggugacgcccccgcccaccagccccuaccugaacggcgacucccccgagagcgccaacggcgacauggacauggagaacgugacccgcguccggcucgugcaguuccagaagaacaccgacgagcccauggggaucacgcugaagaugaacgagcugaaccacugcaucguggcccgcaucaugcacggcgggaugauccaccggcagggcacccugcacgucggggacgagauccgcgagaucaacggcaucuccguggcgaaccagaccguggagcagcuccagaagaugcugcgggagaugcgcggcagcaucaccuucaagaucgucccguccuaccggacgcagagcuccagcugcgaggaccugcccuccaccacccagcccaaggggcgccagaucuacgugcgggcccaguucgaguacgacccggccaaggacgaccucauccccugcaaggaggccggcauccgcuuccgggugggggacaucauccagaucaucagcaaggacgaccacaacugguggcagggcaagcuggagaacagcaagaacgggaccgccggccugauccccucccccgagcuccaggaguggcgcgucgcgugcaucgccauggagaagacgaagcaggagcagcaggccagcugcaccugguucggcaagaagaagaagcaguacaaggacaaguaccuggccaagcacaacgccgaccuggugaccuacgaggagguggucaagcucccggcguucaagcggaagacccuggugcugcucggggcccacggcguggggcgccggcacaucaagaacacgcugaucaccaagcaccccgaccgcuucgccuaccccaucccccacaccacccggccgcccaagaaggacgaggagaacggcaagaacuacuacuucgucucccacgaccagaugaugcaggacaucagcaacaacgaguaccuggaguacggcucccacgaggacgccauguacgggacgaagcucgagaccauccgcaagauccacgagcagggccugaucgccauccuggacguggagccccaggcgcucaaggugcugcgcaccgccgaguucgcccccuucgucguguucaucgccgcgccgaccaucacgcccgggcugaacgaggacgagagccuccagcggcugcagaaggaguccgacauccugcagcgcaccuacgcccacuacuucgaccucaccaucaucaacaacgagaucgacgagaccauccggcaccuggaggaggccguggagcuggucugcaccgcgccccagugggugcccgugagcugggucuacuga

SEQ ID NO: 27718 - RNA, 1368 nt, Artificial Sequence
  derived and/or modified sequence opt1 from CASP10__Homo_sapiens__NP_001193453
augaagucccagggccagcacugguacagcagcuccgacaagaacugcaaggugagcuuccgcgagaagcugcucaucaucgacuccaaccuggggguccaggacguggagaaccugaaguuccucugcaucggccuggugcccaacaagaagcuggagaaguccagcagcgccuccgacgucuucgagcaccuccuggccgaggaccugcucagcgaggaggacccguucuuccuggcggagcugcucuacaucauccggcagaagaagcugcugcagcaccucaacugcaccaaggaggagguggagcgccugcugcccacccggcagcgcgugucccucuuccggaaccugcuguacgagcucagcgaggggaucgacuccgagaaccugaaggacaugaucuuccugcucaaggacagccugcccaagacggagaugaccucccugagcuuccucgccuuccuggagaagcagggcaagaucgacgaggacaaccugaccugccucgaggaccugugcaagaccgucgugcccaagcugcuccgcaacaucgagaaguacaagcgggagaaggccauccagaucgugacgccgcccgucgacaaggaggccgaguccuaccagggggaggaggagcuggugagccagaccgacgugaagaccuuccuggaggcccucccccaggaguccuggcagaacaagcacgcgggcagcaacgagauccugagccacgucuuccaguggcugggcuucaccgugcacauccacaacaacgugacgaaggucgagauggagauggugcuccagaagcagaagugcaaccccgcccacgccgacggggacugcuucguguucugcauccugacccacggccgcuucggggccgucuacuccagcgacgaggcgcugaucccgauccgggagaucaugucccacuucaccgcccuccagugcccccgccuggccgagaagcccaagcuguucuucauccaggccugccagggcgaggagauccagcccagcguguccaucgaggccgacgcgcucaacccggagcaggcccccaccagccugcaggacuccauccccgccgaggccgacuuccugcucgggcuggccacggugcccggcuacgucagcuuccggcacguggaggagggcuccugguacauccagagccugugcaaccaccugaagaagcucgugccgcgccacgaggacauccuguccauccugaccgcggucaacgacgacgugagccggcgcgucgacaagcaggggaccaagaagcagaugccccagcccgccuucacccuccggaagaagcugguguuccccgugccgcuggacgcccucucccuguga

SEQ ID NO: 27719 - RNA, 729 nt, Artificial Sequence
  derived and/or modified sequence opt1 from CASP14__Homo_sapiens__NP_036246
augagcaacccccgcucccuggaggaggagaaguacgacaugagcggcgcccggcucgcccugauccugugcgugaccaaggcgcgcgagggguccgaggaggaccucgacgcccuggagcacauguuccggcagcugcgcuucgagagcaccaugaagcgggacccgacggccgagcaguuccaggaggagcucgagaaguuccagcaggccaucgacucccgcgaggaccccgucagcugcgccuucguggugcugauggcgcacggccgggagggguuccugaagggcgaggacggggagauggucaagcucgagaaccuguucgaggcccugaacaacaagaacugccaggcccuccgcgccaagcccaagguguacaucauccaggcgugccggggcgagcagcgcgaccccggcgagaccgucgggggcgacgagaucgugauggugaucaaggacuccccgcagaccauccccaccuacacggacgcccugcacguguacagcaccgucgagggguacaucgccuaccggcacgaccagaagggcuccugcuucauccagacccugguggacguguucaccaagcgcaaggggcacauccucgagcugcugacggaggucacccggcgcauggccgaggccgagcucgugcaggagggcaaggcgcggaagaccaaccccgagauccagagcacccugcgcaagcggcuguaccuccaguga

SEQ ID NO: 27720 - RNA, 1152 nt, Artificial Sequence
  derived and/or modified sequence opt1 from CASP1__Homo_sapiens__NP_001244048
auggccgacaaggugcugaaggagaagcgcaagcuguucauccggagcaugggcgaggggaccaucaacggccuccuggacgagcuccugcagacccgcguccugaacaaggaggagauggagaaggugaagcgggagaacgccacggugauggacaagacccgcgcgcucaucgacuccgucauccccaagggggcccaggccugccagaucugcaucaccuacaucugcgaggaggacagcuaccuggccggcacccuggggcucuccgccgcgccgcaggccgugcaggacaaccccgccaugcccacgagcuccggcagcgagggcaacgugaagcugugcucccuggaggaggcccagcggaucuggaagcagaaguccgcggagaucuaccccaucauggacaagagcagccgcacccggcucgcccugaucaucugcaacgaggaguucgacuccaucccgcgccggaccggggccgaggucgacaucaccggcaugacgaugcugcuccagaaccugggguacagcguggacgugaagaagaaccugaccgccuccgacaugaccaccgagcucgaggccuucgcgcaccgccccgagcacaagacgagcgacuccaccuuccuggucuucaugagccacggcauccgggaggggaucugcggcaagaagcacuccgagcagguccccgacauccugcagcucaacgccaucuucaacaugcugaacaccaagaacugccccagccugaaggacaagccgaaggugaucaucauccaggccugccgcggcgacucccccgggguggugugguucaaggacagcgugggcgucagcgggaaccucucccugcccaccacggaggaguucgaggacgacgccaucaagaaggcccacaucgagaaggacuucaucgcguucugcagcuccacccccgacaacgugagcuggcggcacccgaccaugggcuccguguucaucggccgccugaucgagcacaugcaggaguacgccugcagcugcgacgucgaggagaucuuccggaaggugcgcuucuccuucgagcagcccgacgggcgggcccagaugcccaccacggagcgcgugacccucacccggugcuucuaccuguuccccggccacuga

SEQ ID NO: 27721 - RNA, 939 nt, Artificial Sequence
  derived and/or modified sequence opt1 from CASP2__Homo_sapiens__NP_001215
augcacccccaccaccaggagacccugaagaagaaccgcgugguccuggccaagcagcugcugcucagcgagcugcuggagcaccuccuggagaaggacaucaucacccuggagaugcgggagcucauccaggccaaggugggcuccuucagccagaacguggagcugcugaaccuccugccgaagcgcgggccccaggcguucgacgccuucugcgaggcccugcgggagacgaagcagggccaccucgaggacaugcugcugaccacccucuccgggcugcagcacguccugccgccccucagcugcgacuacgaccugucccugcccuuccccgugugcgagagcugcccccucuacaagaagcugcgccuguccaccgacacgguggagcacagccucgacaacaaggacggccccgucugccuccaggugaagccgugcacccccgaguucuaccagacccacuuccagcuggccuaccggcuccagucccgcccccgggggcuggcccuggugcucagcaacguccacuucaccggcgagaaggagcuggaguuccgcuccggcggggacguggaccacagcacgcuggugacccucuucaagcugcugggcuacgacguccacgugcucugcgaccagaccgcgcaggagaugcaggagaagcugcagaacuucgcccagcugcccgcccaccgggugaccgacuccugcaucgucgcccuccugagccacgggguggagggcgcgaucuacgggguggacggcaagcugcuccagcugcaggaggucuuccagcuguucgacaacgccaacugcccgucccuccagaacaagcccaagauguucuucauccaggccugccgcggcggggccaucggcagccuggggcaccuccugcuguucacggccgcgaccgccucccuggcccuguga

SEQ ID NO: 27722 - RNA, 834 nt, Artificial Sequence
  derived and/or modified sequence opt1 from CASP3__Homo_sapiens__XP_011530603
auggagaacaccgagaacagcguggacuccaagagcaucaagaaccuggagcccaagaucauccacggcuccgagagcauggacuccgggaucagccucgacaacuccuacaagauggacuacccggagaugggccugugcaucaucaucaacaacaagaacuuccacaagagcaccgggaugacgucccgcagcggcaccgacgucgacgccgccaaccugcgggagaccuuccgcaaccucaaguacgaggugcggaacaagaacgaccugacccgcgaggagaucguggagcugaugcgggacgucuccaaggaggaccacagcaagcgcuccagcuucgugugcgugcuccugucccacggggaggagggcaucaucuucggcacgaacgggcccgucgaccugaagaagaucaccaacuucuuccggggcgaccgcugccggagccucaccgggaagcccaagcuguucaucauccaggcgugccgcggcaccgagcuggacugcgggaucgagacggacuccggcguggacgacgacauggccugccacaagauccccguggaggccgacuuccucuacgccuacagcaccgccccgggcuacuacuccuggcggaacagcaaggacgggagcugguucauccagucccugugcgcgaugcugaagcaguacgccgacaagcucgaguucaugcacauccugacccgcgucaaccggaagguggccaccgaguucgagagcuucuccuucgacgccacguuccacgcgaagaagcagauccccugcaucgugagcaugcugaccaaggagcucuacuucuaccacuga

SEQ ID NO: 27723 - RNA, 1134 nt, Artificial Sequence
  derived and/or modified sequence opt1 from CASP4__Homo_sapiens__NP_001216
auggccgagggcaaccaccgcaagaagccccugaaggugcucgagagccuggggaaggacuuccugaccggcguccucgacaaccugguggagcagaacgugcugaacuggaaggaggaggagaagaagaaguacuacgacgccaagaccgaggacaagguccgggugauggcggacuccaugcaggagaagcagcgcauggccgggcagaugcuccugcagaccuucuucaacaucgaccagaucagcccgaacaagaaggcccaccccaacauggaggccggcccgcccgaguccggggagagcaccgacgcccugaagcucugcccccacgaggaguuccugcggcugugcaaggagcgcgcggaggagaucuaccccaucaaggagcggaacaaccgcacccggcucgcccugaucaucugcaacaccgaguucgaccaccucccgccccgcaacggcgccgacuucgacaucacgggcaugaaggagcugcuggaggggcuggacuacuccguggacgucgaggagaaccucaccgcccgggacauggagagcgcgcugcgcgccuucgccacccggcccgagcacaaguccagcgacuccaccuuccuggugcucaugagccacggcauccuggaggggaucugcggcacggugcacgacgagaagaagcccgacguccugcucuacgacaccaucuuccagaucuucaacaaccgcaacugccugucccugaaggacaagcccaaggugaucaucgugcaggccugccgcggggccaaccggggcgagcucuggguccgggacagccccgcgucccuggagguggccagcucccagagcuccgagaaccuggaggaggacgccguguacaagacccacgucgagaaggacuucaucgccuucugcagcuccaccccgcacaacgugagcuggcgcgacagcacgaugggcuccaucuucaucacccagcucaucacgugcuuccagaaguacagcuggugcugccaccuggaggagguguuccggaagguccagcaguccuucgagacgccccgcgccaaggcgcagaugcccaccaucgagcggcugagcaugacccgcuacuucuaccucuuccccgggaacuga

SEQ ID NO: 27724 - RNA, 1131 nt, Artificial Sequence
  derived and/or modified sequence opt1 from CASP5__Homo_sapiens__NP_001129581
auggccgaggacaaccacaagaagaagaccgugaagaugcuggaguaccucggcaaggacguccugcacgggguguucaacuaccuggccaagcacgacgugcucacccugaaggaggaggagaagaagaaguacuacgacacgaagaucgaggacaaggcgcugauccucgucgacagccugcgcaagaaccggguggcccaccagauguucacccagacccugcucaacauggaccagaagaucaccuccgugaagccccugcugcagaucgaggccggcccgcccgagagcgccgaguccacgaacauccucaagcugugcccccgcgaggaguuccugcggcucugcaagaagaaccacgacgagaucuaccccaucaagaagcgcgaggaccggcgccggcuggcccugaucaucugcaacaccaaguucgaccaccucccggcgcgcaacggggcccacuacgacaucgucggcaugaagcggcugcugcaggggcucggcuacaccgugguggacgagaagaaccugaccgcccgcgacauggagagcguccugcgggccuucgcggcccgccccgagcacaaguccagcgacuccacguuccucgugcugaugagccacggcauccuggaggggaucugcggcaccgcccacaagaagaagaagcccgacgugcuccuguacgacaccaucuuccagaucuucaacaaccggaacugccugucccucaaggacaagcccaaggucaucaucgugcaggccugccgcggggagaagcacggcgagcugugggugcgggacagcccggccucccuggcgcucaucagcucccagagcuccgagaaccuggaggccgacagcgucugcaagauccacgaggagaaggacuucaucgccuucugcuccagcacgccccacaacguguccuggcgcgaccggacccgcgggagcaucuucaucaccgagcugaucacgugcuuccagaaguacagcugcugcugccaccucauggagaucuuccggaaggugcagaaguccuucgaggucccccaggccaaggcccagaugcccaccaucgagcgcgcgacccugacccgggacuucuaccuguucccgggcaacuga

SEQ ID NO: 27725 - RNA, 882 nt, Artificial Sequence
  derived and/or modified sequence opt1 from CASP6__Homo_sapiens__NP_001217
augagcuccgccagcggccugcgccgggggcaccccgccggcggggaggagaacaugaccgagaccgacgcguucuacaagcgcgagauguucgacccggccgagaaguacaagauggaccaccggcgccggggcaucgcccucaucuucaaccacgagcgcuucuucuggcaccugacgcugcccgagcggcgcgggaccugcgccgaccgggacaaccucacccgccgguucuccgaccugggcuucgaggugaagugcuucaacgaccugaaggccgaggagcuccugcugaagauccacgaggugagcaccgugucccacgcggacgccgacugcuucgugugcgucuuccucagccacggcgaggggaaccacaucuacgccuacgacgccaagaucgagauccagacgcugaccggccuguucaagggggacaagugccacucccucgugggcaagcccaagaucuucaucauccaggcgugccgcgggaaccagcacgacgugcccgucaucccgcuggacgugguggacaaccagaccgagaagcuggacaccaacaucacggaggucgacgccgccagcguguacacccuccccgccggcgccgacuuccugaugugcuacuccguggcggagggcuacuacagccaccgggagaccgucaacggguccugguacauccaggaccugugcgagaugcucggcaaguacgggagcucccuggaguucaccgagcugcucacgcuggugaaccgcaaggugagccagcggcgcgucgacuucugcaaggaccccuccgccaucggcaagaagcagguccccugcuucgccagcaugcugaccaagaagcuccacuucuucccgaaguccaacuga

SEQ ID NO: 27726 - RNA, 912 nt, Artificial Sequence
  derived and/or modified sequence opt1 from CASP7__Homo_sapiens__NP_001218
auggccgacgaccagggcugcaucgaggagcaggggguggaggacagcgccaacgaggacuccgucgacgcgaagcccgaccgcagcuccuucgugccgagccuguucuccaagaagaagaagaacgugaccaugcggagcaucaagaccacgcgcgaccggguccccaccuaccaguacaacaugaacuucgagaagcucggcaagugcaucaucaucaacaacaagaacuucgacaaggugaccgggaugggcgugcgcaacgggaccgacaaggacgccgaggcccuguucaagugcuuccggucccugggcuucgacgucaucguguacaacgacugcagcugcgccaagaugcaggaccuccugaagaaggccuccgaggaggaccacacgaacgcggccugcuucgccugcauccugcucagccacggcgaggagaacgugaucuacgggaaggacggcgucacccccaucaaggaccugaccgcccacuuccgcggggaccggugcaagacccugcucgagaagcccaagcuguucuucauccaggcgugccgcggcacggagcuggacgacgggauccaggccgacuccggcccgaucaacgacaccgacgccaacccccgguacaagauccccguggaggccgacuuccucuucgccuacagcaccgugcccggcuacuacuccuggcgcagcccggggcggggcuccugguucguccaggcgcugugcagcauccuggaggagcacgggaaggaccucgagaucaugcagauccugacccgcgugaacgaccggguggcccgccacuucgagucccagagcgacgacccccacuuccacgagaagaagcagauccccugcgucguguccaugcugacgaaggagcucuacuucagccaguga

SEQ ID NO: 27727 - RNA, 5949 nt, Artificial Sequence
  derived and/or modified sequence opt1 from CASP8AP2__Homo_sapiens__NP_001131140
auggccgccgacgacgacaacggcgacgggaccagccuguucgacguguucuccgcgagcccccucaagaacaacgacgagggcucccuggacaucuacgccgggcuggacagcgccgucuccgacagcgccuccaagagcugcgugccgucccgcaacugccucgaccuguacgaggagauccugaccgaggagggcacggccaaggaggcgaccuacaacgaccuccagguggaguacgggaagugccagcugcagaugaaggagcugaugaagaaguucaaggagauccagacccagaacuucagccucaucaacgagaaccagucccugaagaagaacaucagcgcccugaucaagaccgcccgggucgagaucaaccgcaaggacgaggagaucuccaaccuccaccagcggcugagcgaguucccccacuuccgcaacaaccacaagacggcccggaccuucgacaccgugaagaccaaggaccugaagucccgcagcccccaccucgacgacugcuccaagacggaccaccgggcgaagagcgacguguccaaggacguccaccacagcaccagccugcccaaccuggagaaggagggcaagccgcacuccgacaagcgcagcaccucccaccuccccaccagcguggagaagcacugcacgaacggcguguggucccggagccacuaccaggucggggagggcuccagcaacgaggacucccgccgggggcgcaaggacauccggcacagccaguucaaccgcggcaccgagcgggugcgcaaggaccuguccaccgggugcggcgacggcgagccccggauccuggaggccagccagcgccuccaggggcaccccgagaaguacggcaagggggagccgaagaccgaguccaagagcuccaaguucaagagcaacuccgacagcgacuacaagggcgagcggaucaacuccagcugggagaaggagacgcccggcgagcgcagccacucccggguggacagccaguccgacaagaagcuggagcgccagagcgagcgcucccagaacaucaaccggaaggaggucaagagccaggacaaggaggagcgcaagguggaccagaagcccaaguccguggucaaggaccaggaccacuggcggcgcagcgagcgggccucccugccccacagcaagaacgagaucaccuucucccacaacagcuccaaguaccaccucgaggagcgccgggggugggaggacugcaagcgcgacaagagcgugaacucccacagcuuccaggacggccggugcccguccagccugagcaacucccgcacccacaagaacaucgacagcaaggagguggacgccaugcaccagugggagaacaccccccugaaggccgagcggcaccgcacggaggacaagcggaagcgcgagcaggaguccaaggaggagaaccggcacauccgcaacgagaagcggguccccaccgagcaccuccagaagaccaacaaggagaccaagaagacgaccaccgaccugaagaagcagaacgagcccaagaccgacaagggggaggugcuggacaacggcgugagcgagggggcggacaacaaggagcucgccaugaaggccgaguccggcccgaacgagacgaagaacaaggaccugaagcugagcuucaugaagaagcucaaccugacccugucccccgccaagaagcagcccgucagccaggacaaccagcacaagaucaccgacauccccaaguccagcggcgugugcgacuccgagagcuccaugcaggugaagaccgucgccuacgugccgagcaucuccgagcacauccucggggaggcggccgucagcgagcacacgaugggcgagaccaaguccacccugcuggagcccaagguggcccuccuggccgugaccgagccccgcaucgggaucagcgagacgaacaaggaggacgagaacucccugcucguccggagcguggacaacaccaugcacugcgaggagcccaucugcggcaccgagaccagcuucccgucccccauggagauccagcagaccgagagccuguuccccuccacggggaugaagcagaccaucaacaacggccgcgccgcggcccccguggucauggacgugcugcagaccgacgugagccagaacuucggccucgagcuggacaccaagcgcaacgacaacuccgacuacugcgggaucagcgagggcauggagaugaaggucgcccuguccacgaccgugagcgagaccaccgaguccauccuccagccgagcaucgaggaggccgacauccugcccaucaugcuguccgaggacaacaaccccaaguucgagccgagcgugaucgucacgccccugguggaguccaagagcugccaccucgagcccugccugcccaaggagacccuggacuccagccuccagcagaccgagcugauggaccaccggauggccaccggggagacgaacuccguguaccacgacgacgacaacagcguccuguccaucgaccucaaccaccugcgcccgauccccgaggcgaucagcccccugaacagccccgugcggccgguggccaagguccuccgcaacgagucccccccccaggugcccguguacaacaacagccacaaggacgucuuccugccgaacuccgcccacagcaccuccaagagccaguccgaccugaacaaggagaaccagaagcccaucuacaagagcgacaagugcaccgaggccgacaccugcaagaacuccccccucgacgagcuggaggagggcgagauccggagcgacuccgagacgagcaagccccaggaguccuucgagaagaacagcaagcgccggguguccgcggacgugcgcaagagcaagaccaucccgcggcgcgggaaguccaccgucugccuggacaaggacagccggaagacccacgugcgcauccaccagacgaacaacaaguggaacaagcggcccgacaaguccagccgcagcuccaagaccgagaagaaggacaaggugaugagcaccuccagccucgagaagaucguccccaucaucgccgugcccuccagcgagcaggagaucaugcacaugcugcggaugauccgcaagcacgugcggaagaacuacaugaaguucaaggccaaguucucccugauccaguuccaccgcaucaucgagagcgccauccucuccuucaccagccugaucaagcaccugaaccuccacaagaucuccaagagcgucacgacccugcagaagaaccugugcgacaucaucgaguccaagcucaagcaggugaagaagaacggcaucguggaccggcuguucgagcagcagcugccggacaugaagaagaagcucuggaaguucgucgacgaccagcuggacuaccuguucgccaagcucaagaagauccuggugugcgacagcaaguccuucggccgcgacagcgacgaggggaagcuggagaagaccuccaagcagaacgcgcaguacagcaacucccagaagcggagcguggacaacagcaaccgcgagcuccugaaggagaagcuguccaagagcgaggaccccguccacuacaagucccucgugggcugcaagaagagcgaggagaacuaccaggaccagaacaacuccagcaucaacaccgugaagcacgacaucaagaagaacuucaacaucugcuucgacaacaucaagaacucccagagcgaggagcgcucccuggagguccacugccccagcacgcccaaguccgagaagaacgaggggagcuccaucgaggacgcccagaccagccagcacgccacccugaagccggagcgguccuucgagauccucaccgagcagcaggccagcucccugacguucaaccuggugagcgacgcccagaugggcgagaucuucaagucccuccugcagggcagcgaccugcucgacagcuccgugaacugcaccgagaagagcgagugggagcugaagacccccgagaagcagcugcucgagacccugaagugcgaguccauccccgcgugcacgaccgaggagcuggucagcgggguggccuccccgugccccaagaugaucagcgacgacaacuggucccuccugagcuccgagaagggccccagccuguccagcgggcucucccugcccgugcacccggacguccuggacgagagcugcauguucgagguguccaccaaccucccccugagcaaggacaacgugugcuccgucgagaagagcaagcccugcgugagcuccauccugcucgaggaccuggccgugagccugaccguccccuccccgcucaagagcgacggccaccuguccuuccugaagcccgacaugagcuccagcuccacccccgaggaggugaucagcgcccacuucuccgaggacgcccuccuggaggaggaggacgcgagcgagcaggacauccaccuggcccucgaguccgacaacagcuccagcaaguccagcugcuccagcagcuggacgucccgcagcgucgcccccggguuccaguaccacccgaaccugcccaugcacgccgugaucauggagaaguccaacgaccacuucaucgugaagauccggcgcgcgacccccagcaccuccagcggccugaagcaguccaugaugcccgacgagcuccugaccagccugccgcggcacggcaaggaggccgacgaggggcccgagaaggaguacaucuccugccagaacacggucuucaagagcguggaggagcucgagaacuccaacaagaacguggacggcagcaaguccacccacgaggagcagagcuccaugauccagacccagguccccgacaucuacgaguuccugaaggacgccagcgacaagauggggcacuccgacgagguggccgacgagugcuucaagcugcaccaggugugggagaccaagguccccgagagcaucgaggagcucccguccauggaggagaucagccacagcgugggcgagcaccugcccaacacguacguggaccugaccaaggaccccgucaccgagaccaagaaccucggggaguucaucgaggugacggugcugcacaucgaccagcugggcugcuccggcgggaaccucaaccagagcgcccagauccuggacaacucccugcaggcggacaccgucggcgccuucaucgaccucacccaggacgccagcuccgaggccaagagcgaggggaaccaccccgcccuggcgguggaggaccugggcugcggggugauccaggucgacgaggacaacugcaaggaggagaaggcccagguggccaaccgcccgcucaagugcaucguggaggagaccuacaucgaccugacgaccgagucccccagcuccugcgaggucaagaaggacgagcugaagagcgagcccggcuccaacugcgacaacagcgagcuccccggcacccugcacaacucccacaagaagcggcgcaacaucagcgaccugaaccacccgcacaagaagcagcggaaggagaccgaccugacgaacaaggagaagaccaagaagcccacccaggacuccugcgagaacaccgaggcccaccagaagaaggccagcaagaagaaggcgcccccggugacgaaggaccccuccagccucaaggccacccccgggaucaaggacuccagcgccgcccuggcgaccagcaccucccugagcgccaagaacgugaucaagaagaagggcgagaucaucauccucuggacgcgcaacgacgaccgggagauccugcuggagugccagaagcgcgggcccuccuucaagaccuucgccuaccucgccgccaagcuggacaagaacccgaaccaggucagcgagcgguuccagcagcugaugaagcucuucgagaaguccaagugccgcuga

SEQ ID NO: 27728 - RNA, 1617 nt, Artificial Sequence
  derived and/or modified sequence opt1 from CASP8__Homo_sapiens__NP_001073594
auggagggcgggcgccgggcccgcguggucaucgagagcaagcggaacuucuuccugggcgccuuccccaccccguuccccgcggagcacguggagcucgggcgccugggcgacuccgagaccgccauggugcccgggaagggcggcgccgacuacauccugcuccccuucaagaagauggacuucagccggaaccuguacgacaucggggagcagcuggacuccgaggaccucgccagccugaaguuccugucccucgacuacaucccgcagcgcaagcaggagcccaucaaggacgcccugaugcuguuccagcggcuccaggagaagcgcaugcuggaggagagcaaccuguccuuccucaaggagcugcuguuccggaucaaccgccucgaccugcugaucacguaccucaacacccggaaggaggagauggagcgcgagcugcagacccccggccgggcgcagaucagcgccuaccgcgucaugcuguaccagaucuccgaggaggugagccgguccgagcuccgcagcuucaaguuccugcugcaggaggagaucuccaagugcaagcucgacgacgacaugaaccugcuggacaucuucaucgagauggagaagcgggugauccucggggagggcaagcuggacauccugaagcgcgucugcgcccagaucaacaagagccuccugaagaucaucaacgacuacgaggaguucuccaaggagcggagcuccagccuggaggggucccccgacgaguucagcaacggcgaggagcucugcggcgugaugaccaucagcgacuccccgcgcgagcaggacagcgagucccagacgcuggacaagguguaccagaugaaguccaagccccggggguacugccugaucaucaacaaccacaacuucgccaaggcgcgcgagaagguccccaagcuccacagcauccgcgaccggaacggcacccaccuggacgccggggcccugaccaccacguucgaggagcuccacuucgagaucaagccccacgacgacugcaccguggagcagaucuacgagauccugaagaucuaccagcugauggaccacagcaacauggacugcuucaucugcugcauccucucccacggcgacaagggcaucaucuacgggaccgacggccaggaggccccgaucuacgagcugaccagccaguucacggggcugaagugccccucccucgccggcaagcccaagguguucuucauccaggcgugccagggggacaacuaccagaagggcauccccgucgagaccgacagcgaggagcagccguaccuggagauggaccuguccagcccccagacccgcuacauccccgacgaggccgacuuccugcucggcauggccaccgugaacaacugcguguccuaccggaaccccgccgaggggacgugguacauccagagccugugccagucccugcgcgagcggugcccgcgcggcgacgacauccucaccauccugaccgaggucaacuacgaggugagcaacaaggacgacaagaagaacauggggaagcagaugccccagcccaccuucacgcugcggaagaagcucguguuccccuccgacuga

SEQ ID NO: 27729 - RNA, 1089 nt, Artificial Sequence
  derived and/or modified sequence opt1 from CASP9__Homo_sapiens__XP_011540572
auggacgaggccgaccgccggcugcuccgccggugccgccugcggcugguggaggagcuccaggucgaccagcugugggacgcccugcucagccgcgagcuguuccggccccacaugaucgaggacauccagcgcgcgggcuccgggagccggcgcgaccaggcccggcagcugaucaucgaccucgagacccgcggcucccaggcccugccgcuguucaucagcugccucgaggacaccgggcaggacaugcuggccuccuuccugcggacgaaccgccaggccgcgaagcucagcaagcccacccuggagaaccugacccccguggugcuccggcccgagauccgcaagccggagguccugcggcccgagacgccccgccccguggacaucggcuccgggggcuucggcgacgugggggcccuggagagccuccggggcaacgccgaccuggccuacauccuguccauggagccgugcgggcacugccucaucaucaacaacgucaacuucugccgcgagagcggccugcggacccgcaccggguccaacaucgacugcgagaagcugcgccggcgcuucagcucccuccacuucaugguggaggugaagggcgaccugaccgcgaagaagaugguccuggcccuccuggagcuggcccagcaggaccacggcgcccucgacugcugcgugguggucauccugagccacgggugccaggccucccaccuccaguuccccggcgcgguguacgggaccgacggcugccccgugagcgucgagaagaucgugaacaucuucaacggcacguccugccccagccucgggggcaagccgaagcuguucuucauccaggccugcgggggcgggugccaggccgaccccgcccccucccacagccggcugcggcccccgugcugcgccgugagccgccacucccagacccccggcgcggacagcggcgucuccaccaagaagaccacgcgcagcaacgagccccagaaccuggagaagaacauggccgugaccgaccagcgggggcccccgcuggaggccggcgggcugcgcgagaagcagugggacuccuga

SEQ ID NO: 27730 - RNA, 1191 nt, Artificial Sequence
  derived and/or modified sequence opt1 from CASQ1__Homo_sapiens__NP_001222
augagcgccaccgaccgcaugggcccccgggccgugccggggcugcgccucgcgcugcugcuccugcugguccucggcacccccaaguccggggugcagggccaggaggggcuggacuuccccgaguacgacggcguggaccgggucaucaacgugaacgccaagaacuacaagaacguguucaagaaguacgagguccuggcccuccuguaccacgagcccccggaggacgacaaggccagccagcgccaguucgagauggaggagcugauccucgagcuggccgcccaggugcuggaggacaagggcgugggguucggccucgucgacuccgagaaggacgccgccguggccaagaagcuggggcugacggagguggacagcauguacgucuucaagggcgacgaggugaucgaguacgacggggaguucuccgcggacaccaucguggaguuccuccuggacguccuggaggaccccguggagcucaucgagggcgagcgggagcugcaggccuucgagaacaucgaggacgagaucaagcugaucggcuacuucaagagcaaggacuccgagcacuacaaggccuucgaggacgccgccgaggaguuccaccccuacauccccuucuucgcgaccuucgacagcaagguggccaagaagcucacccugaagcugaacgagaucgacuucuacgaggccuucauggaggagccggucacgauccccgacaagcccaacuccgaggaggagaucgugaacuucguggaggagcaccgccggagcacccuccgcaagcugaagcccgaguccauguacgagaccugggaggacgacauggacgggauccacaucgucgccuucgccgaggaggcggacccggacggcuucgaguuccuggagacccucaaggccguggcccaggacaacacggagaaccccgaccugagcaucaucuggaucgaccccgacgacuucccccugcucgugccguacugggagaagaccuucgacaucgaccuguccgcgccccagaucggggucgugaacgucaccgacgccgacagcguguggauggagauggacgacgaggaggaccugcccuccgcggaggagcucgaggacuggcuggaggacgugcuggagggcgagaucaacaccgaggacgacgacgacgacgacgacgacuga

SEQ ID NO: 27731 - RNA, 3267 nt, Artificial Sequence
  derived and/or modified sequence opt1 from CASR__Homo_sapiens__NP_001171536
auggccuucuacagcugcugcugggugcugcucgcccugaccuggcacaccuccgcguacggccccgaccagcgcgcccagaagaagggggacaucauccugggcgggcucuucccgauccacuucggcgucgccgccaaggaccaggaccugaagagccggcccgaguccguggagugcauccgcuacaacuuccggggguuccgcuggcugcaggccaugaucuucgcgaucgaggagaucaacagcucccccgcccuccugcccaaccugacgcucggcuaccggaucuucgacaccugcaacaccgugagcaaggcccuggaggccacccuguccuucgucgcgcagaacaagaucgacagccucaaccuggacgaguucugcaacugcuccgagcacaucccgagcacgaucgccguggugggcgccaccggguccggcgucagcaccgccguggccaaccugcucgggcuguucuacaucccccagguguccuacgcgagcuccagccgccugcucuccaacaagaaccaguucaagagcuuccugcggaccauccccaacgacgagcaccaggccacggccauggccgacaucaucgaguacuuccgcuggaacugggucggcaccaucgccgcggacgacgacuacgggcggcccggcaucgagaaguuccgcgaggaggccgaggagcgggacaucugcaucgacuucuccgagcugaucagccaguacagcgacgaggaggagauccagcacgugguggaggucauccagaacuccaccgccaaggugaucguggucuucagcuccggcccggaccucgagccccugaucaaggagaucgugcgccggaacaucaccgggaagaucuggcuggccagcgaggccugggcguccagcucccucaucgccaugccccaguacuuccacguggucggcgggacgaucggcuucgcccugaaggccggccagauccccggguuccgcgaguuccugaagaaggugcacccgcggaagagcgugcacaacggcuucgccaaggaguucugggaggagaccuucaacugccaccuccaggagggggcgaagggcccccugcccgucgacaccuuccugcgcgggcacgaggaguccggcgaccgguucagcaacuccagcaccgccuuccgcccccucugcacgggcgacgagaacaucuccagcguggagaccccguacaucgacuacacccaccugcggaucuccuacaacguguaccuggccgucuacagcaucgcccacgcgcuccaggacaucuacaccugccugcccgggcgcggccuguucacgaacggguccugcgccgacaucaagaagguggaggccuggcagguccucaagcaccugcggcaccugaacuucaccaacaacaugggcgagcaggugaccuucgacgagugcggggaccucgugggcaacuacagcaucaucaacuggcaccugucccccgaggacggcagcaucgucuucaaggaggugggguacuacaacguguacgccaagaagggcgagcgccuguucaucaacgaggagaagauccucuggagcggguucucccgcgagccccugaccuucguccugagcgugcuccaggugccguucuccaacugcagccgggacugccuggccggcacgcgcaaggggaucaucgagggcgagcccaccugcugcuucgagugcgucgagugccccgacggcgaguacuccgacgagaccgacgcgagcgccugcaacaagugccccgacgacuucugguccaacgagaaccacaccagcugcaucgccaaggagaucgaguuccuguccuggacggagccguucgggaucgcccucacccuguucgccgugcugggcaucuuccugaccgcguucgugcucggggucuucaucaaguuccggaacacccccaucgugaaggccacgaaccgcgagcugagcuaccugcuccuguucucccugcucugcugcuucagcuccagccuguucuucaucggcgagccccaggacuggaccugccggcugcgccagcccgccuucggcaucuccuucgugcucugcaucagcugcauccuggucaagaccaaccgggugcugcucguguucgaggccaagaucccgaccuccuuccaccgcaaguggugggggcugaaccugcaguuccuccuggucuuccugugcacguucaugcagaucgugaucugcgugaucuggcucuacaccgccccccccagcagcuaccggaaccaggagcuggaggacgagaucaucuucaucaccugccacgagggcucccugauggcgcucggguuccugaucggcuacaccugccugcucgccgccaucugcuucuucuucgccuucaagagccgcaagcugccggagaacuucaacgaggcgaaguucaucaccuucuccaugcugaucuucuucaucgucuggaucagcuucauccccgccuacgccuccacguacgggaaguucgugagcgccguggaggucaucgccauccucgcggccuccuucggccugcuggccugcaucuucuucaacaagaucuacaucauccucuucaagcccagccggaacaccaucgaggaggugcgcugcuccaccgccgcccacgcguucaagguggccgcccgggccacccugcgccggagcaacgucucccgcaagcggagcuccagccugggcggguccacgggcagcacccccuccagcuccaucagcagcaaguccaacagcgaggacccguucccccagcccgagcgccagaagcagcagcagccccucgcccugacccagcaggagcagcagcagcagccgcugacccucccccagcagcagcggucccagcagcagccccgcugcaagcagaaggugaucuucgggagcggcacggugaccuucucccugagcuucgacgagccccagaagaacgcgauggcccaccgcaacuccacccaccagaacagccuggaggcccagaaguccagcgacacccucacgcggcaccagccgcugcugccccuccagugcggggagaccgaccuggaccugaccguccaggagaccggccuccagggccccguggggggcgaccagcgccccgagguggaggacccggaggagcugucccccgcccuggucgugagcuccagccaguccuucgugaucagcgggggcggguccacggucaccgagaacguggugaacagcuga

SEQ ID NO: 27732 - RNA, 1050 nt, Artificial Sequence
  derived and/or modified sequence opt1 from CASS4__Homo_sapiens__NP_001157587
augaagggcaccgggaucauggacugcgcccccaaggcccugcucgcgcgcgcccuguacgacaacugcccggacugcagcgacgagcuggccuucucccggggcgacauccucaccauccuggagcagcacgugcccgagagcgaggggugguggaagugccugcuccacggccgccaggggcuggcccccgccaaccggcugcagauccucacggaggucgcggccgaccgccccugcccgcccuuccugcggggccuggaggaggcccccgccuccagcgaggagaccuaccaggugcccacccucccgcgcccgcccacccccggccccguguacgagcagaugcgguccugggcggaggggccccagccgcccacggcccaggucuacgaguuccccgacccgcccaccagcgcccgcaucaucugcgagaagacccuguccuuccccaagcaggccauccugacccucccccggcccgugcgcgccagccugcccacgcugcccucccagguguacgacgucccgacccagcaccggggccccguggugcucaaggagcccgagaagcagcagcuguacgacauccccgcgagcccgaagaaggccgggcugcacccgcccgacucccaggccagcaaccccggcccccucaucccccagcccuccagccagcagaccccggagcgcaagccccggcuguccgagcacugccgccuguacuucggggcccucuucaaggccaucagcgcguuccacggcucccugagcuccagccagcccgccgagaucaucacccagagcaagcuggucaucauggugggccagaagcucguggacacgcugugcauggagacccaggagcgggacguccgcaacgagauccugcggggguccagccaccucugcucccugcugaaggacguggcccucgccaccaagaacgccgugcugaccuaccccagcccggcggcccugggccaccuccaggccgaggccgagaagcuggagcagcacacgcgccaguuccgggggacccugggcuga

SEQ ID NO: 27733 - RNA, 2253 nt, Artificial Sequence
  derived and/or modified sequence opt1 from CAST__Homo_sapiens__NP_001035905
augagccagcccggccagaagccggccgccagcccccgcccccggcgcgcggccgccgcccggcgcacccacgagcacgugagcgagaagaccuccgagagccccuccaagccgggggagaagaagggcagcgacgagaagaaggccgcgucccuggggagcucccagagcucccggacguacgccggcgggaccgccagcgccaccaaggucuccgcgagcuccggcgccaccagcaaguccagcuccaugaaccccacggagaccaaggccgugaagaccgagcccgagaagaagucccagagcaccaagcccaagucccucccgaagcaggccagcgacacgggcuccaacgacgcccacaacaagaaggcggugagccgcuccgccgagcagcagcccagcgagaaguccaccgagcccaagaccaagccccaggacaugaucagcgccgggggcgaguccgucgccgggaucaccgccaucagcggcaagccgggggacaagaagaaggagaagaagucccugacgcccgcggugcccguggagagcaagcccgacaagccguccggcaagagcggcauggacgccgcccuggacgaccucaucgacacccucgggggccccgaggagaccgaggaggagaacaccacguacaccgggcccgaggucuccgaccccaugagcuccaccuacaucgaggagcugggcaagcgggaggugaccaucccgcccaaguaccgcgagcugcuggccaagaaggagggcaucacggggccgcccgccgacagcuccaagcccaucggccccgacgacgcgaucgacgcccugagcagcgacuucacgugcgggucccccaccgccgccggcaagaagaccgagaaggaggagagcaccgaggugcucaaggcccaguccgcggggaccguccggagcgccgcgcccccgcaggagaagaagcgcaagguggagaaggacaccauguccgaccaggcccuggaggcccugagcgccucccucggcacccggcaggccgagcccgagcuggaccugcgcagcaucaaggagguggacgaggccaaggccaaggaggagaagcucgagaagugcggcgaggacgacgagacgauccccuccgaguaccggcugaagccggcgaccgacaaggacgggaagccccugcuccccgagcccgaggagaagccgaagccccgcagcgaguccgagcugaucgacgagcugagcgaggacuucgaccgguccgagugcaaggagaagcccagcaagcccaccgagaagaccgaggaguccaaggccgccgccccggcccccgucagcgaggcggugugccgcacguccaugugcagcauccagagcgccccgcccgagcccgccacccucaagggcaccgugcccgacgacgccgucgaggcccuggcggacucccuggggaagaaggaggccgaccccgaggacggcaagcccgugauggacaaggugaaggagaaggccaaggaggaggaccgggagaagcucggggagaaggaggagaccaucccgcccgacuaccgccuggaggaggucaaggacaaggacggcaagccccugcuccccaaggagagcaaggagcagcugccgcccauguccgaggacuuccugcucgacgcccugagcgaggacuucuccggcccccagaacgcgagcucccugaaguucgaggacgccaagcucgccgccgccaucagcgagguggugucccagacgcccgcgagcaccacccaggccggggccccgccccgggacaccucccagagcgacaaggaccuggacgacgcccuggacaagcucuccgacagccugggccagcgccagcccgacccggacgagaacaagcccauggaggacaaggucaaggagaaggccaaggcggagcaccgggacaagcugggggagcgcgacgacaccaucccgcccgaguaccgccaccuccuggacgacaacggccaggacaagcccgugaagccgcccacgaagaaguccgaggacagcaagaagcccgccgacgaccaggaccccaucgacgcccuguccggggaccucgacagcugccccuccaccaccgagaccagccagaacacggccaaggacaagugcaagaaggccgcgagcuccagcaaggcccccaagaacggcggcaaggccaaggacuccgccaagaccaccgaggagaccagcaagcccaaggacgacuga

SEQ ID NO: 27734 - RNA, 3573 nt, Artificial Sequence
  derived and/or modified sequence opt1 from CASZ1__Homo_sapiens__XP_011539937
augaagguggacuaccugagcgaguucggcuuccgccucuccgacuacgaguucgggaccaaggagaagcggauggaccugggcaccgccgaggggacgcgcugcaccgaccccccggccggcaagcccgcgauggcccccaagcggaaggggggccugaagcucaacgccaucugcgccaagcugagccgccaggucgugguggagaagcgggccgacgcgggcucccacaccgaggggagccccucccagccgcgcgaccaggagcggagcggccccgaguccggggccgcccgcgccccccggagcgaggaggacaagcgccgggcggucaucgagaagugggugaacggcgaguacuccgaggagcccgccccgacccccgugcuggggcgcaucgcccgggagggccucgagcugccccccgagggcgucuacauggugcagccgcaggggugcagcgacgaggaggaccacgccgaggagcccuccaaggacggcggggcccuggaggagaaggacagcgacggcgcggccuccaaggaggacagcggccccuccacgcgccaggccagcggggaggccuccagccuccgggacuacgccgcguccaccaugaccgaguuccugggcauguucggguacgacgaccagaacacccgcgacgagcuggcccggaagaucagcuucgagaagcuccacgccggcagcacgcccgaggccgccaccuccagcaugcugccgaccuccgaggacacccugagcaagcgcgcgcgguucuccaaguacgaggaguacauccgcaagcucaaggccggggagcagcugagcuggcccgcccccuccacgaagaccgaggagcgggugggcaaggaggucgugggcacccugcccgggcuccgccugccgagcuccaccgcccaccuggagacgaaggccaccauccucccccugcccagccacuccagcgugcagaugcagaaccuggucgcgcgcgccuccaaguacgacuucuucauccagaagcucaagaccggcgagaaccugcggccccagaacgggagcaccuacaagaagccguccaaguacgaccuggagaacgugaaguaccuccaccuguucaagcccggcgaggggagccccgacaugggcggcgccaucgccuucaagacggggaaggugggccgccccuccaaguacgacguccgggggauccagaagccgggccccgcgaaggugcccccgacccccagccuggcccccgccccccucgccuccgugccgagcgcccccagcgcgcccgggcccggcccggagccccccgccucccugagcuucaacacccccgaguaccugaaguccaccuucagcaagacggacuccaucaccaccggcaccgucagcacggugaagaacgggcucccgaccgacaagcccgccgugaccgaggacgucaacaucuaccagaaguacaucgcccgcuucuccggcagccagcacugcgggcacauccacugcgccuaccaguaccgggagcacuaccacugccuggaccccgagugcaacuaccagcgcuucaccuccaagcaggacgugauccggcacuacaacaugcacaagaagcgcgacaacagccugcagcacggcuucaugcgguucuccccccucgacgacugcagcguguacuaccacggcugccaccugaacgggaaguccacgcacuaccacugcaugcaggucggcugcaacaagguguacaccagcaccuccgacgucaugacccacgagaacuuccacaagaagaacacgcagcugaucaacgacggguuccagcgcuuccgggcgaccgaggacugcggcaccgccgacugccaguucuacgggcagaagaccacccacuuccacugccgccggccgggcugcacguucaccuucaagaacaagugcgacaucgagaagcacaagagcuaccacaucaaggacgacgccuacgccaaggacggcuucaagaaguucuacaaguacgaggagugcaaguacgaggggugcguguacuccaaggccaccaaccacuuccacugcauccgcgcgggcugcggguucaccuucacgagcaccagccagaugaccucccacaagcggaagcacgagcgccggcacauccgcagcuccggcgcccucgggcugccccccagccugcucggcgccaaggacaccgagcacgaggaguccagcaacgacgaccugguggacuucuccgcccugagcuccaagaacagcucccucagcgcgucccccacgagccagcaguccagcgccucccuggccgccgccaccgcggccaccgaggccggcccgagcgccaccaagccccccaacuccaagaucagcgggcugcucccccagggccugccggggagcaucccccuggcccuggcgcucuccaacagcggccugcccacgccgacccccuacuuccccauccuggccgggcggggcuccaccagccuccccgucggcaccccgucccugcugggggccgugagcuccggcagcgccgccuccgcgacgcccgacacccccacccucguggccagcggggccggcgacuccgcccccgucgcggccgccagcgugccggccccccccgccuccaucauggagcgcaucagcgcguccaaggggcugaucagccccaugauggcccgccuggccgccgccgcgcucaagccguccgccaccuucgaccccggcagcggccagcaggugacgcccgcccgguuccccccggcccaggucaagcccgagcccggggaguccaccggcgcccccgggccgcacgaggcgagccaggaccgcagccuggaccugaccgugaaggagcccuccaacgagagcaacggccacgccgugcccgccaacuccagccuccuguccagccugaugaacaagaugucccagggcaaccccgggcucggcagccugcugaacaucaaggccgaggccgagggguccccggcggccgagcccagccccuuccucggcaaggccgucaaggcccuggugcaggagaagcuggcggagcccuggaagguguaccuccggcgcuucgggaccaaggacuucugcgacggccagugcgacuuccugcacaaggcccacuuccacugcgucguggaggagugcggcgcccuguucuccacgcucgacggggccaucaagcacgccaacuuccacuuccggaccgagggcggggcggccaagggcaacaccgaggccgccuucccggccagcgcggccgagaccaagccccccauggccccguccagcccccccgugcccccggucacgaccgccaccguguccagccuggaggggcccgcccccucccccgcgagcgugccguccacccccacgcugcucgccuggaagcagcuggccagcaccaucccccagaugccccagaucccggccagcgucccccaccugcccgcguccccccucgccaccaccagccuggagaacgccaagccgcaggugaagcccggcuuccugcaguuccaggagaaguga

SEQ ID NO: 27735 - RNA, 1584 nt, Artificial Sequence
  derived and/or modified sequence opt1 from CAT__Homo_sapiens__NP_001743
auggccgacagccgcgaccccgccuccgaccagaugcagcacuggaaggagcagcgggcggcccagaaggccgacgugcugaccaccggcgccgggaacccggucggcgacaagcucaacgugaucacgguggggccccgcggcccccugcugguccaggacgugguguucaccgacgagauggcccacuucgaccgggagcgcauccccgagcgggucgugcacgcgaagggggccggcgccuucggcuacuucgaggugacccacgacaucaccaaguacagcaaggccaaggucuucgagcacaucgggaagaagacgccgaucgcggugcgcuucuccaccguggccggcgagagcggguccgccgacaccguccgggacccccgcggcuucgccgugaaguucuacaccgaggacgggaacugggaccucgugggcaacaacacgcccaucuucuucauccgggaccccauccuguucccgagcuucauccacucccagaagcgcaacccccagacccaccugaaggaccccgacauggucugggacuucuggagccuccggcccgagucccugcaccaggugagcuuccuguucuccgaccgcggcaucccggacgggcaccggcacaugaacggcuacgggagccacaccuucaagcucgugaacgccaacggcgaggcggucuacugcaaguuccacuacaagaccgaccagggcaucaagaaccuguccguggaggacgccgcccgccugagccaggaggaccccgacuacgggauccgggaccucuucaacgccaucgccacgggcaaguaccccuccuggaccuucuacauccaggugaugaccuucaaccaggcggagaccuuccccuucaacccguucgaccugacgaaggucuggccccacaaggacuacccccugauccccguggggaagcucgugcugaaccgcaacccggucaacuacuucgccgagguggagcagaucgccuucgaccccagcaacaugccgcccggcaucgaggccucccccgacaagaugcugcaggggcgccucuucgccuaccccgacacccaccggcaccggcugggccccaacuaccugcacauccccgucaacugcccguaccgcgcgcggguggccaacuaccagcgcgacggccccaugugcaugcaggacaaccagggcggggcccccaacuacuacccgaacagcuucggggcccccgagcagcagcccuccgcccucgagcacagcauccaguacagcggcgaggugcgccgguucaacaccgcgaacgacgacaacgucacccaggugcgcgccuucuacgugaacguccugaacgaggagcagcggaagcgccugugcgagaacaucgccgggcaccucaaggacgcccagaucuucauccagaagaaggcggugaagaacuucacggaggugcaccccgacuacggcucccacauccaggcccugcuggacaaguacaacgccgagaagccgaagaacgccauccacaccuucguccagagcggcucccaccucgccgcgcgggagaaggccaaccuguga

SEQ ID NO: 27736 - RNA, 2343 nt, Artificial Sequence
  derived and/or modified sequence opt1 from CATSPER1__Homo_sapiens__NP_444282
auggaccagaacagcgugcccgagaaggcccagaacgaggccgacaccaacaacgcggaccgcuucuuccggucccacagcuccccgccccaccaccgccccggccacagccgggcccugcaccacuacgagcuccaccaccacggggucccccaccagcgcggcgagucccaccacccgcccgaguuccaggacuuccacgaccaggcccugagcucccacgugcaccagagccaccaccacuccgaggcccggaaccacgggcgcgcccacggccccaccggguucggccuggcgcccagccagggcgccgugccgucccaccggagcuacggggaggacuaccacgacgagcuccagcgcgacggccggcgccaccacgacgggucccaguacggcggguuccaccagcagagcgacucccacuaccaccggggcagccaccacggccgcccccaguaccugggggagaaccugucccacuacagcuccggcgucccccaccacggggaggccagccaccacggcggcagcuaccucccccacgggccgaaccccuacuccgagagcuuccaccacuccgaggccagccaccuguccggccugcagcacgacgagagccagcaccaccaggugccccaccggggguggccccaccaccaccaggugcaccaccacggccgcucccggcaccacgaggcgcaccagcacgggaaguccccgcaccacggcgagacgaucagcccccacagcuccgucggcagcuaccagcgcgggaucuccgacuaccacagcgaguaccaccagggcgaccaccaccccuccgaguaccaccacggggaccacccccaccacacccagcaccacuaccaccagacccaccggcaccgcgacuaccaccagcaccaggaccaccacggcgccuaccacagcuccuaccuccacggggacuacgugcagagcaccucccagcugagcaucccgcacacgagccggucccugauccacgacgcccccggccccgccgccagccgcaccggcguguuccccuaccacgucgcgcacccgcggggguccgcccacagcaugacccgcuccagcuccaccauccgcagccgggugacgcagauguccaagaaggugcacacccaggacaucagcaccaagcacuccgaggacuggggcaaggaggaggggcaguuccagaagcgcaagaccggccggcuccagcgcacgcggaagaaggggcacagcaccaaccuguuccaguggcugugggagaagcucaccuuccugauccagggcuuccgcgagaugauccggaaccugacccagucccucgccuucgagacguucaucuucuucgucgugugccugaacaccgugaugcuggucgcccagaccuucgccgagguggagauccgcggcgagugguacuucauggcgcucgacagcaucuucuucugcaucuacguggucgaggcccugcugaagaucaucgcccucgggcuguccuacuucuucgacuucuggaacaaccuggacuucuucaucauggccauggccgugcucgacuuccugcugaugcagacccacagcuucgcgaucuaccaccagucccucuuccggauccugaagguguucaagagccugcgcgcccuccgggccauccgcguccugcggcgccugagcuuccucacguccgugcaggaggugaccggcacccuggggcagagccugcccuccaucgccgccauccucauccugauguucacgugccuguuccucuucagcgcgguccugcgggcccuguuccgcaaguccgaccccaagcgguuccagaacaucuucaccaccaucuucacccucuucacccugcugacgcucgacgacuggagccugaucuacauggacucccgcgcccagggcgccugguacaucauccccauccuggugaucuacaucaucauccaguacuucaucuuccugaaccucgucaucaccgugcugguggacagcuuccagaccgcgcuguucaagggccucgagaaggccaagcaggagcgggccgcccgcauccaggagaagcugcuggaggacucccucaccgagcugcgcgccgcggagccgaaggaggucgccagcgaggggacgaugcugaagcggcucaucgagaagaaguucggcaccaugaccgagaagcagcaggagcugcuguuccacuaccuccagcugguggccuccguggagcaggagcagcagaaguuccgcagccaggccgccgucaucgacgagaucguggacaccacguucgaggcgggggaggaggacuuccggaacuga

SEQ ID NO: 27737 - RNA, 1587 nt, Artificial Sequence
  derived and/or modified sequence opt1 from CATSPER2__Homo_sapiens__NP_001269238
auggccgccuaccagcaggaggagcagaugcagcugccccgcgcggacgccauccggagccgccucaucgacaccuucucccugaucgagcaccuccagggccugagccaggccgugccgcggcacaccauccgcgagcugcuggaccccucccggcagaagaagcucguccugggggaccagcaccagcuggugcgcuucagcaucaagccccagcggaucgagcagaucucccacgcccagcgccuccugagccggcugcacgugcgcugcucccagcggcccccgcucagccugugggccggcuggguccuggagugcccccucuucaagaacuucaucaucuuccugguguuccugaacacgaucauccucaugguggagaucgagcugcuggaguccaccaacaccaagcucuggccccugaagcugacccucgaggucgcggccugguucauccugcugaucuucauccucgagauccugcugaaguggcucagcaacuucuccguguucuggaaguccgccuggaacguguucgacuucgucgugacgaugcugagccugcuccccgagguggucgugcuggugggggucaccggccagagcguguggcugcagcuccugcgcaucugccgggugcugcgcucccucaagcugcuggcccaguuccggcagauccagaucaucauccucguccuggugcgcgcgcucaagagcaugaccuuccugcugaugcugcuccugaucuucuucuacaucuucgccgugaccggggucuacguguucuccgaguacacgcggagcccgcgccaggaccuggaguaccacguguucuucuccgaccugcccaacagccucgucaccguguucauccuguucacccuggaccacugguacgcccuccugcaggacgucuggaaggugcccgaggugagccggaucuucuccagcaucuacuucauccuguggcuccugcugggcuccaucaucuuccgcagcaucaucgucgccaugauggugaccaacuuccagaacauccggaaggagcucaacgaggagauggcccgccgcgaggugcagcugaaggcggacauguucaagcggcagaucauccagcgccggaagaacaugucccacgaggcccugacgagcucccacagcaagaucgaggaccgcggcgccucccagcagcgggagagccucgaccuguccgaggucagcgagguggaguccaacuacggggccaccgaggaggaccugaucaccagcgccuccaagaccgaggagacgcucagcaagaagcgcgaguaccaguccagcuccugcgugagcagcaccuccagcuccuacagcuccagcuccgagagccgguucuccgagagcaucggccgccuggacugggagacccugguccacgagaaccuccccgggcugauggagauggaccaggacgaccggguguggccgcgcgacucccuguuccgguacuucgagcuccuggagaagcugcaguacaaccucgaggagcgcaagaagcugcaggaguucgcggugcaggcccugaugaaccucgaggacaaguga

SEQ ID NO: 27738 - RNA, 444 nt, Artificial Sequence
  derived and/or modified sequence opt1 from CAV1__Homo_sapiens__NP_001166366
auggccgacgagcugagcgagaagcaggucuacgacgcccacaccaaggagaucgaccucgugaaccgcgaccccaagcaccugaacgacgacguggugaagaucgacuucgaggacgucaucgcggagccggagggcacccacuccuucgacgggaucuggaaggccagcuucacgaccuucaccgugaccaaguacugguucuaccggcugcucuccgcccuguucggcauccccauggcccugaucugggggaucuacuucgccauccucagcuuccugcacaucugggcggugguccccugcaucaaguccuuccugaucgagauccagugcaucagccgcguguacuccaucuacgugcacacggucugcgacccccucuucgaggccgugggcaagaucuucagcaacgugcggaucaaccugcagaaggagaucuga

SEQ ID NO: 27739 - RNA, 489 nt, Artificial Sequence
  derived and/or modified sequence opt1 from CAV2__Homo_sapiens__NP_001224
augggccuggagaccgagaaggccgacgugcagcuguucauggacgacgacagcuacucccaccacagcgggcucgaguacgccgaccccgagaaguucgccgacuccgaccaggaccgcgacccgcaccggcugaacagccaccucaagcugggcuucgaggacgucaucgccgagcccgugaccacgcacuccuucgacaagguguggaucugcagccacgcccuguucgagaucuccaaguacgucauguacaaguuccucaccguguuccuggccaucccccuggccuucaucgcggggauccucuucgccacccugagcugccugcacaucuggauccucaugcccuucgugaagaccugccugaugguccugccguccgugcagacgaucuggaaguccgugaccgacgucaucaucgcgccccucugcaccagcgugggccgcugcuucagcuccgugagccugcagcugucccaggacuga

SEQ ID NO: 27740 - RNA, 456 nt, Artificial Sequence
  derived and/or modified sequence opt1 from CAV3__Homo_sapiens__NP_001225
augauggccgaggagcacaccgaccuggaggcccagaucgugaaggacauccacugcaaggagaucgaccucgucaaccgcgaccccaagaacaucaacgaggacaucgugaagguggacuucgaggacgucaucgcggagccggugggcaccuacagcuucgacgggguguggaaggucuccuacacgaccuucaccgugagcaaguacuggugcuaccggcugcuguccacccuccugggcgugccccuggcccuccuguggggguuccuguucgccugcaucagcuucugccacaucugggccgucgugcccugcaucaaguccuaccucaucgagauccagugcaucagccacaucuacucccugugcauccgcacguucugcaacccccuguucgccgcgcucggccaggugugcagcuccaucaaggucgugcugcggaaggagguguga

SEQ ID NO: 27741 - RNA, 1788 nt, Artificial Sequence
  derived and/or modified sequence opt1 from CBFA2T2__Homo_sapiens__NP_001028171
auggugggcguccccggggccgccgcguuccagcugggcccggagaagcgcgugcccgccaugcccgggagccccguggaggucaagauccagucccggagcuccccgcccaccaugccgccccugccgcccaucaaccccggcgggccccgccccgugagcuucacccccacggcccucuccaacggcaucaaccacagcccgcccacccugaacggcgcccccuccccgccccagcgguucagcaacgggcccgccuccagcaccuccagcgcgcucaccaaccagcagcugcccgccacgugcggcgcccgccagcuguccaagcucaagcgguuccugaccacccugcagcaguucgggaacgacaucagccccgagaucggcgagaaggugcgcacccucguccuggcccuggugaacuccacggugaccaucgaggaguuccacugcaagcuccaggaggcgaccaacuucccccugcggcccuucgucaucccguuccugaaggccaaccucccccugcugcagcgcgagcuccugcacugcgcccgggccgccaagcagacccccagccaguaccuggcgcagcacgagcaccuccugcugaacacguccaucgccagccccgccgacuccagcgagcuccugauggaggugcacgggaacggcaagcgcccgagccccgagcggcgcgaggagaacuccuucgaccgggacaccaucgcccccgagccgcccgccaagcgcgugugcaccaucagccccgcgccccggcacuccccggcccugaccgucccccucaugaaccccggcgggcaguuccaccccacgccgccgccccugcagcacuacacccuggaggacaucgccaccagccaccucuaccgcgagcccaacaagaugcuggagcaccgggaggugcgcgaccggcaccacucccugggccucaacgggggcuaccaggacgagcugguggaccaccgccugaccgagcgggagugggccgacgaguggaagcaccucgaccacgcccugaacugcaucauggagauggucgagaagacgcgccgcagcauggcggugcugcggcgcugccaggaguccgaccgggaggagcucaacuacuggaagcgccgguacaacgagaacaccgagcugcgcaagaccggcaccgagcuggugagccggcagcacucccccgggagcgccgacucccucagcaacgacucccagcgcgaguucaacagccggcccggcacgggguacguccccguggaguucuggaagaagaccgaggaggccgugaacaaggucaagauccaggccauguccgaggugcagaaggccguggcggaggccgagcagaaggccuucgaggucaucgccaccgagcgcgcgcggauggagcagaccaucgccgacgugaagcgccaggccgccgaggacgccuuccuggucaucaacgagcaggaggagagcacggagaacugcuggaacugcggccggaaggcguccgagaccugcagcgggugcaacaucgcccgcuacugcggcuccuucugccagcacaaggacugggagcggcaccaccgccugugcggccagaaccuccacgggcagagcccccacggccaggggcggccgcugcugcccgugggccgcgggagcuccgcccggagcgccgacugcuccgugcccagccccgcccucgacaagaccuccgcgaccacgagccgcuccagcaccccggccuccgucaccgccaucgacaccaacggccuguga

SEQ ID NO: 27742 - RNA, 1962 nt, Artificial Sequence
  derived and/or modified sequence opt1 from CBFA2T3__Homo_sapiens__NP_005178
augcccgccagccgccugcgggaccgcgccgcguccagcgccuccggcuccacgugcggguccaugagccagacccacccggugcucgaguccggccugcuggccagcgccgggugcuccgcgccccggggcccccgcaagggcgggcccgccccggucgaccggaaggccaaggccagcgccaugcccgacucccccgcggaggugaagacccagccccgcagcaccccgcccuccaugccgccgcccccgcccgccgccagccagggcgccacccggccgcccuccuucacgccccacacccaccgcgaggacgggcccgccacccucccccacggccgguuccacgggugccugaaguggagcauggugugccugcucaugaacggcuccagccacucccccaccgcgaucaacggggcccccugcacccccaacggcuucagcaacggccccgccacgagcuccaccgccagccuguccacccagcaccucccgcccgccugcggggcgcgccagcucagcaagcugaagcgguuccugaccacgcuccagcaguucggcuccgacaucagccccgagaucggggagcgcguccggacccuggugcugggccucgugaacuccacccugaccaucgaggaguuccacagcaagcugcaggaggccacgaacuucccccugcgccccuucgucauccccuuccugaaggccaaccugccccuccugcagcgggagcugcuccacugcgcccgccuggccaagcagaccccggcgcaguaccuggcccagcacgagcagcuccugcuggacgccagcgccagcucccccaucgacagcuccgagcuccugcuggaggugaacgagaacggcaagcggcgcacccccgaccggaccaaggagaacgggagcgaccgcgacccccuccacccggagcaccuguccaagcggcccugcacgcugaaccccgcccagcgcuacagccccuccaacggcccgccccagcccacgcccccgccccacuaccgccucgaggacaucgcgauggcccaccacuuccgggacgccuaccgccaccccgacccccgggagcugcgcgagcggcaccgcccgcuggugguccccgggagccggcaggaggaggugaucgaccacaagcucaccgagcgcgagugggccgaggaguggaagcaccugaacaaccugcucaacugcaucauggacaugguggagaagacccggcgcucccugaccguccugcggcgcugccaggaggcggaccgggaggagcucaaccacugggcccgccgguacagcgacgccgaggacaccaagaagggccccgcccccgccgcggcccgcccgcggagcuccagcgccgggcccgagggcccccagcuggacgugccccgcgaguuccugccgcggacccucaccggcuacgugcccgaggacaucuggcgcaaggccgaggaggccgucaacgaggugaagcgccaggcgauguccgagcugcagaaggccgugagcgacgccgagcggaaggcccacgagcugaucacgaccgagcgcgccaagauggagcgggcgcuggccgaggccaagcgccaggccuccgaggacgcgcucaccgucaucaaccagcaggaggacagcuccgagagcugcuggaacugcgggcggaaggccuccgagaccugcagcggcugcaacgccgcccgcuacugcggguccuucugccagcaccgggacugggagaagcaccaccacgugugcggccagagccugcaggggcccacggccguggucgcggacccggugcccggcccgcccgaggccgcccacucccugggccccagccuccccgugggggccgccucccccagcgaggcgggcuccgccgggcccagccgcccgggcagccccuccccgcccgggccccuggacaccgucccccgguga

SEQ ID NO: 27743 - RNA, 549 nt, Artificial Sequence
  derived and/or modified sequence opt1 from CBFB__Homo_sapiens__NP_001746
augccccgcguggucccggaccagcggagcaaguucgagaacgaggaguucuuccgcaagcugucccgggagugcgagaucaaguacaccggcuuccgcgaccggccccacgaggagcgccaggcccgguuccagaacgccugccgcgacgggcggagcgagaucgcguucguggccaccggcacgaaccucucccugcaguucuuccccgccagcuggcagggggagcagcgccagacccccucccgggaguacguggaccuggagcgcgaggccggcaaggucuaccucaaggccccgaugauccugaacggggugugcgugaucuggaagggcuggaucgaccugcagcggcucgacggcauggggugccuggaguucgacgaggagcgcgcgcagcaggaggacgcccuggcccagcaggccuucgaggaggcgcggcgccggacccgcgaguucgaggaccgggaccgcagccaccgggaggagauggagguccgcgugucccagcuccuggccgugaccggcaagaagacgacccgccccuga

SEQ ID NO: 27744 - RNA, 2949 nt, Artificial Sequence
  derived and/or modified sequence opt1 from CBLB__Homo_sapiens__NP_733762
auggccaacagcaugaacggccgcaaccccgggggccgggggggcaacccgcgcaaggggcggauccugggcaucaucgacgccauccaggacgcggugggcccccccaagcaggccgccgccgaccgccggaccgucgagaagaccuggaagcucauggacaagguggugcgccugugccagaaccccaagcugcagcucaagaacuccccgcccuacauccuggacauccugcccgacacguaccagcaccuccggcugauccugagcaaguacgacgacaaccagaagcucgcccagcuguccgagaacgaguacuucaagaucuacaucgacagccugaugaagaaguccaagcgcgcgauccggcucuucaaggaggggaaggagcgcauguacgaggagcagagccaggaccggcgcaaccugaccaagcugucccucaucuucagccacaugcuggccgagaucaaggccaucuuccccaacggccaguuccagggggacaacuuccggaucaccaaggccgacgcggccgaguucuggcgcaaguucuucggcgacaagaccaucgucccguggaagguguuccggcagugccugcacgaggugcaccagaucuccagcgggcucgaggccauggcccugaaguccacgaucgaccugaccugcaacgacuacaucagcgucuucgaguucgacaucuucacccgccucuuccagcccuggggcuccauccugcggaacuggaacuuccuggccgugacccaccccggcuacauggcguuccucacguacgacgaggugaaggcccgccugcagaaguacagcaccaagcccggguccuacaucuuccggcugagcugcacccgccucggccagugggccaucggguacgucaccggcgacggcaacauccugcagacgaucccgcacaacaagccccuguuccaggcccucaucgacgggucccgggagggcuucuaccuguaccccgacgggcgcagcuacaaccccgaccugaccggccucugcgagccgaccccccacgaccacaucaaggugacccaggagcaguacgagcuguacugcgagaugggguccacguuccagcugugcaagaucugcgccgagaacgacaaggacgugaagaucgagcccugcggccaccucaugugcaccagcugccugaccgcguggcaggagagcgacggccaggggugccccuucugccgcugcgagaucaagggcaccgagccgaucaucgucgaccccuucgacccccgggacgaggggucccgcugcugcagcaucaucgaccccuucggcaugccgaugcuggaccucgacgacgacgacgaccgggaggagucccugaugaugaaccgccuggccaacgugcggaagugcacggaccgccagaacagccccgugaccucccccgggagcuccccccucgcccagcggcgcaagccgcagcccgacccccugcagaucccgcaccugagccucccccccguccccccgcggcuggaccugauccagaagggcaucgugcgcucccccugcggcagccccaccgggucccccaagagcuccccgugcauggugcggaagcaggacaagccccuccccgcccccccgcccccccugcgcgaccccccgcccccccccccggagcggcccccccccaucccgcccgacaaccgccugagccggcacauccaccacgucgaguccgugcccagccgcgacccgcccaugccccuggaggccuggugcccccgggacguguucggcaccaaccagcucgucgggugccgccugcugggcgagggguccccgaagcccggcaucacggcgagcuccaacgugaacggccggcacagccgcguggggagcgaccccguccucaugcgcaagcaccggcgccacgaccugccccuggagggcgccaagguguucuccaacgggcaccucggcagcgaggaguacgacgucccgccccggcuguccccccccccgcccgugaccacccugcuccccagcaucaagugcaccggcccccuggccaacucccugagcgagaagacgcgcgacccgguggaggaggacgacgacgaguacaagauccccuccagccaccccgucucccucaacagccagcccucccacugccacaacgugaagccgcccgugcggagcugcgacaacgggcacugcaugcugaacggcacccacgggcccuccagcgagaagaaguccaacauccccgaccugagcaucuaccucaagggcgacgucuucgacuccgccagcgacccggugccccugccccccgcccgcccgcccacccgggacaaccccaagcacgggagcucccugaaccgcaccccgagcgacuacgaccuccugauccccccccugggcgaggacgcguucgacgcccuccccccgucccugcccccccccccgccccccgcccggcacagccugaucgagcacuccaagcccccgggcagcuccagccgccccuccagcgggcaggaccucuuccugcugcccuccgaccccuucguggaccucgccagcggccaggucccgcugccccccgcgcggcgccugcccggggagaacgugaagacgaaccggaccucccaggacuacgaccagcucccgagcugcuccgacggcagccaggcccccgcccgcccccccaagccgcggccccgccggaccgcccccgagauccaccaccgcaagccccacgggccggaggccgcgcuggagaacguggacgccaagaucgccaagcugaugggcgagggcuacgccuucgaggaggucaagcgggcccucgagaucgcgcagaacaacguggagguggcccgcuccauccugcgggaguucgccuucccccccccggucagcccccgccugaaccucuga

SEQ ID NO: 27745 - RNA, 2721 nt, Artificial Sequence
  derived and/or modified sequence opt1 from CBL__Homo_sapiens__NP_005179
auggccggcaacgugaagaagagcuccggggccggcgggggcagcggguccggcggcagcggguccggcgggcugaucggccucaugaaggacgcguuccagccccaccaccaccaccaccaccaccugagcccgcacccccccgggaccgucgacaagaagaugguggagaagugcuggaagcugauggacaaggugguccgccucugccagaaccccaagcuggcccugaagaacuccccgcccuacauccucgaccugcugcccgacaccuaccagcaccuccggacgauccugagccgcuacgagggcaagauggagacccugggcgagaacgaguacuuccggguguucauggagaaccucaugaagaagaccaagcagaccaucucccuguucaaggaggggaaggagcgcauguacgaggagaacagccagccccggcgcaaccugacgaagcucucccugaucuucagccacaugcuggccgagcucaagggcaucuucccguccgggcuguuccagggcgacaccuuccggaucaccaaggccgacgccgcggaguucuggcgcaaggccuucggcgagaagaccaucgugcccuggaagagcuuccggcaggcccugcacgagguccaccccaucuccagcgggcucgaggccauggcgcugaaguccacgaucgaccugaccugcaacgacuacaucagcguguucgaguucgacaucuucacccgccucuuccagcccugguccagccugcugcggaacuggaacagccucgccgugacccacccgggcuacauggccuuccugacguacgacgaggucaaggcccgccugcagaaguucauccacaagcccggguccuacaucuuccggcucagcugcacccgccugggccagugggccaucggguacgugaccgcggacggcaacauccugcagaccaucccccacaacaagccccucuuccaggcccugaucgacggcuuccgggagggguucuaccuguucccggacggccgcaaccagaaccccgaccucacggggcugugcgagcccaccccccaggaccacaucaaggugacccaggagcaguacgagcuguacugcgagaugggcuccaccuuccagcucugcaagaucugcgccgagaacgacaaggacgucaagaucgagccgugcgggcaccugaugugcacgagcugccugaccuccuggcaggagagcgagggccagggcugccccuucugccggugcgagaucaaggggaccgagcccaucgugguggaccccuucgacccgcgcggcuccgggagccuccugcggcagggcgccgagggggcccccucccccaacuacgacgacgacgacgacgagcgcgcggacgacacccuguucaugaugaaggagcucgccggcgccaaggucgagcggcccccgagccccuucuccauggccccccaggccagccugccgcccgugcccccccgccuggaccuccugccgcagcgcgugugcguccccuccagcgcguccgcccugggcacggccagcaaggccgccuccgggagccugcacaaggacaagccccuccccgugccgcccacccugcgggaccugccccccccgcccccccccgaccgcccguacuccgugggcgcggagagccggccccagcgccggccccuccccugcaccccgggggacugccccagccgcgacaagcugccccccgucccguccagccggcugggcgacuccuggcucccccgccccaucccgaaggugcccgugagcgcccccuccagcuccgaccccuggaccggccgggagcugacgaaccgccacagccugccguucucccuccccagccagauggagccccggcccgacgucccgcgccugggguccaccuucagccuggacaccuccaugagcaugaacuccagcccccucgugggccccgagugcgaccaccccaagaucaagccguccagcagcgccaacgccaucuacucccuggcggcccggccccugcccguccccaagcucccgcccggggagcagugcgagggcgaggaggacaccgaguacaugacgcccagcucccgcccccugcggccgcuggacaccagccaguccagccgcgccugcgacugcgaccagcagaucgacuccugcaccuacgaggccauguacaacauccagagccaggcccccuccaucaccgagagcuccacguucggggagggcaaccucgcggccgcccacgccaacaccggccccgaggagagcgagaacgaggacgacggguacgacgugcccaagccgcccgugcccgccguccuggcgcggcgcacccuguccgacaucagcaacgccuccagcuccuucggcuggcucagccuggacggggaccccaccaccaacgugacggagggcucccaggugccggagcggccccccaagccguucccccgccgcaucaacagcgagcggaaggccgggagcugccagcagggcuccggccccgccgccagcgcggccaccgccuccccccagcugagcuccgagaucgagaaccucaugagccagggguacuccuaccaggacauccagaaggcccuggucaucgcgcagaacaacaucgagauggccaagaacauccugcgcgaguucgugagcaucuccagcccggcccacguggccaccuga

SEQ ID NO: 27746 - RNA, 1473 nt, Artificial Sequence
  derived and/or modified sequence opt1 from CBLL1__Homo_sapiens__NP_001271220
auggaccacaccgacaacgagcugcagggcaccaacagcuccgggagccucggcgggcuggacgugcgccggcgcauccccaucaagcugaucuccaagcaggccaacaaggccaagccggcgccccggacgcagcgcaccaucaaccggaugcccgccaaggcccccccgggcgacgagggguucgacuacaacgaggaggagcgcuacgacugcaagggcggcgagcucuucgccaaccagcggcgcuuccccgggcaccuguucugggacuuccagaucaacauccugggcgagaaggacgacacccccguccacuucugcgacaagugcgggcuccccaucaagaucuacggccggaugaucccgugcaagcacguguucugcuacgacugcgccauccugcacgagaagaagggggacaagaugugccccggcugcagcgaccccgugcagcgcaucgagcagugcacccggggcucccuguucaugugcagcaucguccaggggugcaagcgcacguaccucucccagcgggaccugcaggcgcacaucaaccaccgccacaugcgggccggcaagcccgugacccgcgccagccuggagaacgugcacccgcccaucgccccccccccgaccgagauccccgagcgguucaucaugccccccgacaagcaccacaugucccacaucccgcccaagcagcacaucaugaugccccccccgccccuccagcacgucccccacgagcacuacaaccagccccacgaggacauccgcgcgccgcccgccgagcugagcauggcccccccgcccccccgguccgugagccaggagaccuuccgcaucuccacgcggaagcacagcaaccugaucaccgugcccauccaggacgacuccaacagcggggcccgcgagccgcccccccccgccccggcgcccgcccaccaccaccccgaguaccagggccagcccgucgugucccacccgcaccacaucaugcccccccagcagcacuacgcccccccgcccccccccccgccccccaucagccaccccaugccgcaccccccccaggccgccggcaccccgcaccucguguacucccaggcgcccccccccccgaugaccagcgcccccccccccaucacgccgccccccgggcacaucaucgcccagaugcccccguacaugaaccaccccccccccggcccgccccccccccagcacgggggcccgcccgucaccgccccccccccgcaccacuacaaccccaacagccugccccaguucaccgaggaccaggggacccugucccccccguucacgcagcccggcggcaugagccccgggaucuggccggccccccgcggcccccccccgcccccccggcuccaggggcccccgucccagaccccccugcccggcccccaccacccggaccagacccgcuaccggcccuacuaccaguga

SEQ ID NO: 27747 - RNA, 582 nt, Artificial Sequence
  derived and/or modified sequence opt1 from CBLN1__Homo_sapiens__NP_004343
augcugggcgugcucgagcugcugcuccugggggccgccuggcuggcgggccccgcccgcgggcagaacgagaccgagccgaucguccucgagggcaagugccugguggugugcgacagcaaccccaccuccgaccccacggggaccgcccugggcaucagcguccgguccggcagcgccaagguggccuucuccgcgauccgcagcaccaaccacgagcccuccgagaugagcaaccggaccaugaucaucuacuucgaccaggugcucgucaacaucgggaacaacuucgacuccgagcgcagcacguucaucgccccgcggaagggcaucuacuccuucaacuuccacguggugaaggucuacaaccgccagaccauccaggugagccugaugcugaacggguggcccgugaucuccgccuucgccggcgaccaggacgucacccgggaggcggccagcaacggggugcucauccagauggagaagggcgaccgcgccuaccugaagcuggagcggggcaaccucaugggcggguggaaguacuccaccuucagcggguuccugguguucccccuguga

SEQ ID NO: 27748 - RNA, 675 nt, Artificial Sequence
  derived and/or modified sequence opt1 from CBLN2__Homo_sapiens__XP_011524128
augcaggcccccggccgcgggccgcugggccuccggcugaugaugcccgggcgccggggcgcccugcgcgagcccgggggcugcggcagcugccucgggguggcgcuggcccugcuccugcugcuccugcccgccugcugcccgguccgggcccagaacgacaccgagcccaucgugcuggagggcaagugccucguggucugcgacuccagccccuccgccgacggggcggugaccagcucccugggcaucagcgugcgcuccgggagcgccaaggucgccuucuccgccacgcggagcaccaaccacgagcccuccgagaugagcaaccgcaccaugaccaucuacuucgaccaggugcuggugaacaucggcaaccacuucgaccucgcguccagcaucuucgucgccccgcggaagggcaucuacuccuucagcuuccacguggugaaggucuacaaccgccagacgauccaggugucccugaugcagaacggguaccccgugaucagcgccuucgccggcgaccaggacgucacccgggaggccgcguccaacggggugcugcuccugauggagcgcgaggacaaggugcaccugaagcucgagcggggcaaccugaugggcggguggaaguacagcaccuucagcggcuuccuggucuucccccucuga

SEQ ID NO: 27749 - RNA, 606 nt, Artificial Sequence
  derived and/or modified sequence opt1 from CBLN4__Homo_sapiens__NP_542184
augggcagcgggcgccgggcccuguccgccgugcccgcgguccuccuggugcugacccucccgggccugcccgugugggcccagaacgacaccgagcccaucguccuggaggggaagugccucguggugugcgacagcaaccccgccacggacuccaagggcagcuccagcuccccgcuggggaucagcguccgcgccgccaacuccaagguggcguucagcgccgugcgguccaccaaccacgagcccagcgagauguccaacaagacccgcaucaucuacuucgaccagauccuggucaacgugggcaacuucuucacccucgagagcguguucgucgcgccccggaagggcaucuacuccuucagcuuccacgugaucaagguguaccagucccagacgauccaggucaaccugaugcugaacgggaagcccgugaucagcgccuucgccggcgacaaggacgugacccgcgaggccgccaccaacgggguccuccuguaccuggacaaggaggacaagguguaccucaagcuggagaagggcaaccuggucgggggcuggcaguacuccaccuucagcggcuuccucguguucccgcuguga

SEQ ID NO: 27750 - RNA, 834 nt, Artificial Sequence
  derived and/or modified sequence opt1 from CBR1__Homo_sapiens__NP_001748
augagcuccggcauccacguggcccuggucaccgggggcaacaaggggaucggccucgccaucgugcgcgaccugugccggcuguucagcggggacgugguccucaccgcgcgcgacgugacgcggggccaggccgccgugcagcagcugcaggccgagggccugagcccccgcuuccaccagcucgacaucgacgaccugcaguccauccgggcccugcgcgacuuccuccggaaggaguacgggggccuggacguccuggugaacaacgcggggaucgccuucaagguggccgacccgacccccuuccacauccaggccgaggucaccaugaagaccaacuucuucggcacgcgcgacgugugcaccgagcuccugccccugaucaagccccaggggcggguggucaacguguccagcaucauguccgugcgcgcgcucaagagcugcuccccggagcugcagcagaaguuccggagcgagaccaucaccgaggaggagcuggucggccucaugaacaaguucguggaggacacgaagaagggcgugcaccagaaggagggguggcccuccagcgccuacggcgucaccaagaucggggugaccgugcugucccgcauccacgcccggaagcugagcgagcagcgcaagggcgacaagauccuccugaacgccugcugccccggcuggguccggaccgacauggccgggcccaaggcgacgaaguccccggaggagggcgccgagacccccguguaccuggcccuccugccgcccgacgccgaggggccccacggccaguucgugagcgagaagcgcgucgagcagugguga

SEQ ID NO: 27751 - RNA, 834 nt, Artificial Sequence
  derived and/or modified sequence opt1 from CBR3__Homo_sapiens__NP_001227
augagcuccugcagccgcguggcccuggucaccggcgccaaccgggggaucggccucgcgaucgcccgcgagcugugccggcaguucuccggggacguggugcugaccgcccgcgacgucgcccggggccaggccgcggugcagcagcuccaggccgaggggcugagcccccgcuuccaccagcuggacaucgacgaccuccaguccauccgggcccugcgcgacuuccugcggaaggaguacggcggccucaacgugcuggucaacaacgccgcgguggccuucaagagcgacgaccccaugcccuucgacaucaaggccgagaugacgcugaagaccaacuucuucgccacccgcaacaugugcaacgagcuccugcccaucaugaagccccacgggcggguggucaacaucuccagccugcagugccuccgcgccuucgagaacugcuccgaggaccugcaggagcgguuccacagcgagacccugacggagggcgaccucguggaccugaugaagaaguucguggaggacaccaagaacgagguccacgagcgcgagggguggccgaacucccccuacggcgugagcaagcugggggugaccguccucucccggauccuggcgcgccggcuggacgagaagcgcaaggccgaccggauccucgugaacgccugcugccccggccccgugaagaccgacauggacggcaaggacagcauccgcacggucgaggagggggccgagaccccgguguaccuggcccugcucccgcccgacgcgaccgagccccagggccagcuggugcacgacaaggucgugcagaacugguga

SEQ ID NO: 27752 - RNA, 714 nt, Artificial Sequence
  derived and/or modified sequence opt1 from CBR4__Homo_sapiens__NP_116172
auggacaaggugugcgccgucuucggcgggagccgcggcaucgggcgggccguggcgcagcugauggcccgcaagggcuaccggcucgccgugaucgcccgcaaccuggagggggccaaggcggccgccggcgaccugggcggggaccaccucgccuucuccugcgacgucgcgaaggagcacgacgugcagaacaccuucgaggagcuggagaagcaccugggccgggugaacuuccucgucaacgccgccgggaucaaccgcgacggccugcuggugcggaccaagacggaggacauggugagccagcuccacaccaaccugcugggguccaugcugaccugcaaggccgccaugcgcaccaugauccagcagcagggcggcagcaucgucaacgugggguccaucgugggccucaaggggaacagcggccaguccgucuacagcgcguccaagggcgggcuggugggcuucagccgggcccucgccaaggagguggcccgcaagaagauccgggucaacgugguggcccccggguucguccacacggacaugaccaaggaccugaaggaggagcaccugaagaagaacaucccgcucggccgcuucggggagaccaucgagguggcgcacgccguggucuuccugcuggagucccccuacaucaccggccacgugcucguggucgacggcgggcugcagcugauccucuga

SEQ ID NO: 27753 - RNA, 1698 nt, Artificial Sequence
  derived and/or modified sequence opt1 from CBS__Homo_sapiens__XP_011528084
augcccagcgagaccccgcaggccgaggugggccccaccgggugcccccaccgcuccggcccccacagcgccaaggggucccuggagaagggcagcccggaggacaaggaggcgaaggagccccucuggauccggcccgacgcccccucccgcugcacguggcagcuggggcggccggccagcgagagcccccaccaccacaccgcccccgccaagucccccaagauccugccggacauccucaagaagaucggcgacacccccaugguccgcaucaacaagaucggcaagaaguucgggcugaagugcgagcugcucgcgaagugcgaguucuucaacgccggcggguccgugaaggaccggaucagccugcgcaugaucgaggacgccgagcgggacggcacccugaagcccggggacacgaucaucgagcccaccuccggcaacaccggcaucgggcucgcccuggcggccgccgugcgcggcuaccggugcaucaucgucaugccggagaagaugagcuccgagaagguggacgugcugcgcgcccucggggccgagaucguccggacccccacgaacgcgcgcuucgacagccccgagucccacgugggcguggccuggcggcugaagaacgagauccccaacagccacauccuggaccaguaccgcaacgccuccaacccgcucgcccacuacgacaccaccgccgacgagauccugcagcagugcgacggcaagcuggacaugcucgucgcgagcguggggaccggcgggacgaucaccggcaucgcccggaagcugaaggagaagugccccgggugccgcaucaucggcguggaccccgagggcuccauccuggccgagcccgaggagcucaaccagaccgagcagaccacguacgaggucgaggggaucggcuacgacuucaucccgaccgugcuggaccggaccguggucgacaagugguucaagagcaacgacgaggaggccuucaccuucgcccgcaugcugaucgcgcaggaggggcuccugugcggcgggagcgccggcuccacgguggccguggccgucaaggccgcgcaggagcugcaggagggccagcggugcguggugauccuccccgacagcguccgcaacuacaugaccaaguuccuguccgaccgguggaugcugcagaagggguuccucaaggaggaggaccugaccgagaagaagcccuggugguggcaccuccgcgugcaggagcugggccugagcgcgccccugaccgugcucccgacgaucacgugcgggcacaccaucgagauccugcgcgagaagggcuucgaccaggcccccgucguggacgaggccggggucauccugggcauggugacccucggcaacaugcuguccagccugcucgccgggaaggugcagcccuccgaccaggucggcaaggugaucuacaagcaguucaagcagauccggcugaccgacacccuggggcgccucagccacauccuggagauggaccacuucgcccuggugguccacgagcagauccagucccaggaccaggccugggccggcguggugggcgggccggccgaccacagcaccggcaaguccagccagcggcagauggucuucgggguggugaccgcgaucgaccuccugaacuucgucgccgcccaggagcgcgaccagaaguga

SEQ ID NO: 27754 - RNA, 558 nt, Artificial Sequence
  derived and/or modified sequence opt1 from CBX1__Homo_sapiens__NP_006798
augggcaagaagcagaacaagaagaagguggaggagguccuggaggaggaggaggaggaguacgugguggagaagguccucgaccgccggguggugaaggggaaggucgaguaccugcugaaguggaagggcuucagcgacgaggacaacaccugggagcccgaggagaaccucgacugcccggaccugaucgccgaguuccugcagucccagaagaccgcccacgagacggacaagagcgagggcgggaagcgcaaggcggacuccgacagcgaggacaagggggaggaguccaagcccaagaagaagaaggaggagagcgagaagccccggggcuucgcccgcggccucgagcccgagcggaucaucggggccaccgacuccagcggcgagcugauguuccugaugaaguggaagaacuccgacgaggccgaccucgugccggccaaggaggcgaacgugaagugcccccaggucgugaucagcuucuacgaggagcgccugaccuggcacuccuaccccagcgaggacgacgacaagaaggacgacaagaacuga

SEQ ID NO: 27755 - RNA, 1599 nt, Artificial Sequence
  derived and/or modified sequence opt1 from CBX2__Homo_sapiens__NP_005180
auggaggagcugagcuccgugggcgagcaggucuucgccgccgagugcauccucagcaagcgccugcggaaggggaagcuggaguaccucgugaaguggcgcggcugguccagcaagcacaacuccugggagcccgaggagaacauccuggacccgcggcugcuccuggcguuccagaagaaggagcacgagaaggaggugcagaaccgcaagcgggggaagcgcccccggggccgcccccggaagcugaccgccaugagcuccugcagccgccgguccaagcucaaggagcccgacgccccgagcaaguccaagagcuccagcuccagcuccagcuccaccagcagcuccagcuccagcgacgaggaggacgacuccgaccuggacgccaagcgcgggccccggggccgcgagacgcaccccgucccccagaagaaggcccagauccugguggcgaagccggagcucaaggaccccauccggaagaagcgcggccggaagccccugcccccggagcagaaggccacccgccggcccgugagccuggccaagguccucaagaccgcccgcaaggaccugggggcgcccgccuccaagcugcccccgccccucagcgcccccguggccggccuggccgcgcugaaggcccacgccaaggaggccugcgggggccccuccgccauggcgaccccggagaaccucgccagccugaugaaggggauggccuccagccccggccggggcgggaucuccuggcagagcuccaucgugcacuacaugaaccgcaugacgcagagccaggcccaggccgcgucccgccuggcccucaaggcccaggccaccaacaagugcggccuggggcuggaccucaagguccggacccagaagggcgagcugggcaugagcccgcccggguccaagauccccaaggcccccagcggcggggcgguggagcagaaggugggcaacaccgggggcccgccccacacgcacggcgccagccgcguccccgccgggugccccggcccccagccggcccccacccaggagcugucccuccaggugcuggaccugcagagcgugaagaacgggaugcccggcgucgggcuccuggcgcggcacgccaccgccaccaagggcgugcccgccacgaacccggcccccggcaaggggaccggcuccgggcugaucggcgcgagcggggccaccaugcccaccgacacguccaagagcgagaagcucgccucccgcgccguggcgcccccgacccccgccagcaagcgggacugcgucaagggcuccgccacccccagcggccaggagucccgcaccgcccccggggaggcccggaaggccgcgacgcugccggagaugagcgccggcgaggaguccagcuccagcgacuccgaccccgacagcgccagcccgcccuccaccgggcagaaccccagcguguccgugcagaccagccaggacuggaagcccacccgcucccugaucgagcacgucuucgugacggacgugaccgccaaccucaucaccgucaccgugaaggagagccccacguccgucggcuucuucaaccugcggcacuacuga

SEQ ID NO: 27756 - RNA, 552 nt, Artificial Sequence
  derived and/or modified sequence opt1 from CBX3__Homo_sapiens__NP_009207
auggccagcaacaagaccacccugcagaagaugggcaagaagcagaacgggaaguccaagaagguggaggaggccgagcccgaggaguucgucguggagaaggugcucgaccgccgggucgugaacggcaagguggaguacuuccugaaguggaagggguucacggacgcggacaacaccugggagccggaggagaaccuggacugccccgagcucaucgaggccuuccugaacagccagaaggccggcaaggagaaggacgggaccaagcgcaagucccugagcgacuccgagagcgacgacuccaagagcaagaagaagcgggacgccgccgacaagccccgcggcuucgcgcggggccucgaccccgagcgcaucaucggggccaccgacuccagcggcgagcugauguuccugaugaaguggaaggacuccgacgaggccgaccucguccuggccaaggaggcgaacaugaagugcccgcagaucgugaucgccuucuacgaggagcggcugacguggcacagcugccccgaggacgaggcccaguga

SEQ ID NO: 27757 - RNA, 1683 nt, Artificial Sequence
  derived and/or modified sequence opt1 from CBX4__Homo_sapiens__NP_003646
auggagcugcccgccgugggcgagcacgucuucgccguggagagcaucgagaagaagcgcauccggaaggggcgcguggaguaccucgucaaguggcggggcugguccccgaaguacaacaccugggagcccgaggagaacauccuggacccccgccugcucaucgcguuccagaaccgggagcgccaggagcagcugaugggguaccggaagcgcggccccaagccgaagccccugguggugcagguccccaccuucgcccggcgcagcaacgugcucacggggcugcaggacuccagcaccgacaaccgggccaagcuggaccucggcgcccagggcaaggggcagggccaccaguacgagcugaacuccaagaagcaccaccaguaccagccccacagcaaggagcgcgccgggaagccgcccccgcccggcaaguccgggaaguacuacuaccagcugaacagcaagaagcaccaccccuaccagcccgaccccaagauguacgaccuccaguaccagggcggccacaaggaggcgcccuccccgaccugccccgaccugggggccaagagccacccgcccgacaagugggcccagggcgccggggcgaagggcuaccugggcgccgugaagccccucgccggggccgccggcgcgcccgggaagggcuccgagaaggggccgcccaacggcaugaugcccgcccccaaggaggccgucaccggcaacgggaucggcgggaagaugaagaucgugaagaacaagaacaagaacggccggaucgugaucgucaugagcaaguacauggagaacgggaugcaggccgugaagaucaaguccggcgagguggccgagggcgaggcgcgcagccccucccacaagaagcgggccgccgacgagcgccacccgcccgccgaccggacguucaagaaggccgcgggggccgaggagaagaaggucgaggccccgcccaagcgccgggaggaggaggugagcggcguguccgacccccagccccaggacgccgggagccgcaagcugucccccaccaaggaggccuucggcgagcagccccugcagcucaccaccaagccggaccugcuggcgugggaccccgcccggaacacgcacccgcccagccaccacccccacccccacccccaccaccaccaccaccaccaccaccaccaccaccacgccgucgggcucaaccugagccacgugcgcaagcgcugccuguccgagacccacggcgagcgggagcccugcaagaagcgccucaccgcccggagcaucuccaccccgacgugccugggcgggagccccgcggccgagcgccccgccgaccugcccccggccgccgcgcucccccagcccgaggugauccugcuggacuccgaccucgacgagcccaucgaccugcggugcgucaagacccgcagcgaggccggcgagccgcccuccagccuccaggugaagcccgagacccccgccuccgccgccguggcggucgccgccgccgccgcgccgaccacgaccgccgagaagccgcccgccgaggcccaggacgagcccgcggagagccuguccgaguucaagcccuucuucgggaacaucaucaucaccgacgugaccgccaacugccugacggucaccuucaaggaguacgugaccguguga

SEQ ID NO: 27758 - RNA, 576 nt, Artificial Sequence
  derived and/or modified sequence opt1 from CBX5__Homo_sapiens__NP_001120793
augggcaagaagaccaagcgcaccgccgacagcuccagcuccgaggacgaggaggaguacguggucgagaaggugcuggaccggcgcguggucaagggccagguggaguaccuccugaaguggaagggguucagcgaggagcacaacacgugggagcccgagaagaaccuggacugcccggagcucaucuccgaguucaugaagaaguacaagaagaugaaggagggggagaacaacaagccccgggagaaguccgagagcaacaagcgcaagagcaacuucuccaacagcgccgacgacaucaaguccaagaagaagcgggagcagagcaacgacaucgcgcgcggcuucgagcgggggcuggagcccgagaagaucaucggcgccaccgacuccugcggcgaccugauguuccucaugaaguggaaggacaccgacgaggccgaccuggugcuggccaaggaggccaacgucaagugcccccagaucgugaucgcguucuacgaggagcgccucaccuggcacgccuacccggaggacgccgagaacaaggagaaggagacggccaagagcuga
